United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 111

SEQ ID NO: 215879 - DNA, 5165 bp, Artificial Sequence
  Description of Artificial Sequence: Synthetic coding sequence
atgctctcagctaccccattatatggtaacgttcactcctggatgaactctgagcgcgtgagaatgtgcggggcaagtgaggaccgaaagatccttgttaatgacggagacgccagtaaggcacggcttgagctgcgagaggagaatcctctgaaccacaacgttgtggatgccagcactgcacatagaatcgatggactggctgccttgtccatggatcggaccggcttgatccgcgaaggacttagagtacctgggaacatcgtgtattccagcctgtgtggtcttggtagcgagaagggacgggaggcagcgacatctacactggggggtcttgggttttcctcggagcgcaaccctgaaatgcagtttaagcccaacactcccgagacagtggaagcttccgcagtgtctggtaagccgccaaacggattcagcgcaatttacaaaacacctccaggtatccagaaaagtgccgttgccactgctgaagcccttggtctagacagaccagcctcggataaacagtctccacttaatattaacggggcaagttacctgaggctgccctgggtaaatccatatatggaaggagcaacacccgctatatatcctttcttggattctcccaacaagtattctctaaatatgtataaagccctgctgccacaacagtcctatagcctggcccagcccctctactctcctgtctgcacaaatggcgaacgctttctgtatttgcctcccccacactacgtcggaccacacattcctagttctctcgctagtcccatgcggctgagtactccatcagcgtcacctgcgatcccgcctctcgtgcactgcgctgacaagtcactgccctggaaaatgggggtgagcccagggaatcccgttgacagtcatgcatacccacatatccaaaattccaaacagccaagagtgccctcagccaaggctgttacatctggccttcctggagatactgcattgttgcttccaccgtccccgagacctagcccacgcgtgcatttacctacacaacccgcagcagatacatactctgagttccacaagcactatgcaaggatcagtacgagccccagcgtggccctgagtaaaccttacatgaccgtatcaagcgaattcccagcagctcgcttgagcaatggcaaatatccaaaggcacccgagggtggggagggagcccaacctgtgcctggccacgctaggaagacagcagtacaagacagaaaggacggttcgtctccccctcttctcgaaaagcaaacggtgacaaaggacgtgaccgataaaccattagatctgtcgtctaaagttgtggacgtggacgcctcaaaggccgaccatatgaaaaaaatggcccctactgtcttggtgcacagcagggctgggagcgggctcgttctttccgggtccgaaattccgaaggagaccctttccccaccagggaatggatgcgcaatctacaggtcagagatcataagcactgctccttcaagttgggtcgtccccggtccttcccctaacgaggaaaacaatgggaaaagtatgtctctcaaaaacaaagcactggactgggcaattccgcaacagagaagctcctcttgtccgaggatgggcggaactgatgcggtgatcactaacgtctcaggctctgtaagttctgccggacgcccagctagcgccagccccgcaccaaacgccaacgcagatggtaccaagaccagcagatccagcgtcgaaactacgcctagcgtaattcaacacgtgggtcagcccccagctactcccgctaagcacagctcatcaaccagcagcaagggggcaaaggcatccaacccagaacctagctttaaagcgaatgagaatggtctgcctcctagttcaatatttttgtctccgaatgaggccttccggtctccccctattccatacccccgtagctacctcccttatcctgctccagaggggatcgctgtgtctccgctgtctctgcatggaaaaggcccagtgtacccccacccggtgctgctccctaacggttctttgtttccgggacacctggcccctaagcccggactgccgtatggcttgcctacaggcaggccggagttcgtgacttatcaggacgcactcggtttgggaatggtacatccgatgttgatccctcacaccccgatagaaattaccaaggaagagaaaccagaaagacgcagtaggtcccatgaacgcgctaggtacgaagaccccactctccgcaaccgcttttccgaaatcttagagacgagtagcaccaaattgcacccagacgttcctacggacaagaatctcaaacctaatcccaactggaaccaggggaagaccgttgtaaagtctgataaactggtgtatgtggacttactgagggaggagccagatgcaaaaacagacacaaacgtctctaagcctagctttgccgcagagtccgtgggtcagtccgccgagccgccaaaaccctccgtcgaacccgcactgcagcagcacagagactttatagcactgagggaggagctcggcagaatcagtgactttcacgaaacatatacattcaagcaacccgtgttcactgtcagcaaagatagcgtgctagctggaacaaataaagaaaaccttggcctccccgtttctaccccctttctggaaccccctctcggtagcgatgggccagcagtgacctttgggaaaacccaagaagacccaaagccattctgcgtgggcagcgcacctcccagtgtggatgtcactcctacatacaccaaagacggagccgatgaggccgagtccaacgatggaaaggtattaaagcccaaaccttccaagctagccaaaaggatcgccaactctgcaggctacgttggcgacaggttcaaatgcgtgactacagaactctacgccgatagctcacaactgagccgagaacagagagccctgcagatggaagggttgcaggaggattccatactgtgcttaccagcagcctactgcgaacgcgctatgatgaggttctcagagctggaaatgaaagaaagggagggcggacatccagcaacgaaggattctgaaatgtgcaagttctccccagccgactgggagagacttaaaggcaaccaagataaaaaacccaagtctgtgactctggaagaggcaatagccgagcagaatgaatctgaacgctgtgaatacagtgtcggaaacaagcatagagatccatttgaagccccagaggacaaggatctgcccgtggaaaagtattttgtagaaagacaacccgtttctgagccccctgccgaccaggtggcctcagatatgccgcattctcctacacttagagtcgatagaaagagaaaagtctctggcgattcgtctcacactgagaccactgcagaggaagtgccggaggacccgctgctgaaagctaagagacgcagggtgtcaaagggcctgcaccctaagaaacagcgccacctgctgcacctgagggagcgctgggagcagcaagttagtgccgcagatggcaaacctggcagacagtcaagaaaagaggtgacacaggccacacaacccgaagcgatacctcagggcaccaacatcacggaagaaaaacctgggcgaaagcgggcagaggccaaggggaaccggtcttggtcagaagaatcccttaagccttcggacaatgagcagggactccccgtcttctccgggtcacctccaatgaagtctctgagctcgacttcggctggaggcaaaaagcaggcacagccttcatgcgcgcctgcctcacgacctccggctaagcagcaaaaaatcaaagaaaaccagaaaaccgacgtgctgtgtgcggatgaagaagaggattgccaggccgctagcctgctgcagaaatacaccgataactcagagaagcctagcggaaagcggctgtgcaagacaaagcacctcattcctcaagaatcacggcgtggactgcctctcactggcgagtattacgtggagaatgcagacggtaaggtaaccgtgagacgttttaggaaaagacccgagcccagttctgattatgatctctcgccagcaaagcaggagccgaagccctttgatcggctgcagcagttactccccgctagccagtccacccagctgccatgttcatcgagcccacaagagaccacacagtcacggcctatgcctcctgaggctagacgcctcatcgtgaataagaatgctggcgaaactttactccagcgggcagccagattaggttacgaggaggtcgtgctctattgcctggagaataagatatgtgatgtcaaccaccgtgataacgccggttattgtgccctccacgaggcctgtgctaggggttggctcaacatcgtgaggcacctactcgaatacggagccgatgttaactgtagcgcccaggatggtacaagacctcttcacgatgctgtagagaatgatcacttggagatcgtgagactgctactctcctatggagcagatcccaccctggccacatacagcgggaggacaatcatgaagatgactcatagcgaactcatggagaagttcttgaccgattacctcaacgatttgcaggggaggaacgatgatgacgcatctgggacgtgggatttctacggcagctctgtgtgcgaacccgatgacgaaagcggctatgatgttctggccaatccgcctggccctgaggatcaagacgatgatgacgatgcttatagcgatgttttcgagttcgagttcagcgaaacccccttactgccttgttacaatatccaggtttcagtcgcccaggggcctagaaactggctcctgctgtctgatgtcctgaaaaagctcaagatgtctagcagaatatttagatgcaacttcccaaacgtagagatagtcactattgctgaagctgagttctataggcaggtttctgcaagcctgctgttcagttgttccaaggatctggaagcttttaacccagagtccaaggaacttttggatcttgtcgaatttactaacgagatccagacgctgctggggagttctgtcgaatggctgcatcctagtgatttggcttctgacaactattggta

SEQ ID NO: 215880 - DNA, 5267 bp, Artificial Sequence
  Description of Artificial Sequence: Synthetic coding sequence
atgctttctgccactcctttatatggaaatgtgcactcttggatgaattcagaaagggttcgcatgtgcggagcatccgaagaccggaaaatactcgtgaacgacggcgacgccagcaaggccagactagagctccgtgaggaaaaccctttaaatcataatgtggtggatgcttccaccgctcatcggattgacggtttggcagccttaagcatggaccgaactggactgatcagggaagggctccgagtgcccggtaacattgtgtattcttctctgtgcggtctcggttccgagaaagggagagaggctgctacctctaccctaggaggtctgggattctcgtccgagcggaatccagagatgcagttcaagcccaatactccagaaaccgtcgaggcctcagccgttagcggaaagccccctaacggcttttctgctatctataagactcctcctgggattcagaaatctgctgttgctaccgccgaggccttgggcctcgaccgaccagcatcagataagcagagtccacttaacattaacggagcctcttatctccggctgccctgggtgaacccctatatggaaggtgcaacacccgctatttatccatttctggattcacctaataagtacagcctgaatatgtataaggcactgttgcctcagcagtcatactcccttgcacagcctctttacagtcctgtctgcacgaacggtgaacggtttctgtacctgcctccaccacattacgtgggccctcacattccctcatctcttgctagtcccatgaggctcagcaccccgtccgcctcacccgctattccccctctggtgcactgcgccgataagtccctcccctggaaaatgggcgttagtcccggtaatccagttgatagccacgcttacccccacatccaaaattctaagcagccgagggtgccaagcgcgaaggctgtgacctccgggctgccaggagatacagccttgctgcttccaccctccccacgccctagccccagagtgcatttacccacacagcctgcagctgatacctacagcgaattccacaaacattacgctcggatctccacttctcctagtgtagccctttctaagccctatatgaccgtttcatccgagttcccggcagccaggttatccaatggcaagtacccaaaggctcctgaggggggagaaggtgcccaaccagtcccaggccatgctcgcaagactgcagtccaggacagaaaagacggctcctcacccccactactggaaaaacaaacagtcacaaaagacgtgaccgacaaaccactcgaccttagtagcaaagtcgtggacgtggacgcaagtaaggccgaccacatgaagaaaatggcacccacagtgctcgtccacagccgggctggctcggggctggtcctgagcggaagcgaaatccccaaagagacgctgagtccgcctggaaatggctgtgctatctacaggtccgagatcatctcaactgccccttcctcctgggtggttcccggaccgtcgccgaacgaagaaaacaatgggaagtctatgagcctgaaaaataaagccctcgactgggctatcccgcaacaacgatcctccagttgccccagaatgggtggtacagatgctgtgatcaccaatgtgagtgggtctgtcagctcagccggaagacctgcctccgcttctccagcacctaatgctaacgccgacggcacgaagacctctcggtcctccgttgagaccacaccttcagttatccagcacgtgggccagcctccggctacgcccgcaaagcacagttcttctactagttctaagggagcaaaggcgtccaacccggagcctagcttcaaagctaacgagaacggtctgcctccaagctcgattttcttgtctccaaatgaggcttttcgctccccccctataccatatccaaggtcatatctgccttatccagcccctgaaggaatcgctgtgtctccgctgagcctgcacgggaaaggcccagtctatccacacccagtgctgctccccaacggttctctgttcccaggacacctcgccccaaagccagggctgccgtatggcttgccaacaggcaggcccgaatttgttacatatcaggacgctcttggactcggaatggtgcacccgatgcttatccctcacacccctattgaaattaccaaagaggaaaagcccgagcggaggagtagatcccacgaacgcgctcgctacgaggacccaacactgcgaaaccggttttccgagatcctcgagacctcctcgactaaactgcatccagacgtgcccactgacaagaacctcaaacccaatcctaactggaaccagggtaaaactgtcgtcaagtccgacaagctggtgtatgtggatctgctcagggaggaacccgacgcgaagacggacaccaatgtcagcaagccgagttttgccgcagagagcgtaggacagtccgccgagccacccaagccttccgtggaaccagcattgcagcagcatagagacttcattgccctcagggaagaactaggcaggatttcagacttccatgaaacatatactttcaagcagcctgtctttacagtgagtaaagatagcgttctcgccggaacaaataaagagaatcttggcctgccagtgtccactcctttcctggagccccctctcggctccgatggacctgcggtgacatttgggaagactcaagaggatcccaagcctttttgtgtagggagtgctcccccatccgtggatgtgacgcctacgtataccaaggatggtgctgatgaagcagaaagcaatgacggaaaggtgctgaaaccaaaacctagcaaactggctaagaggatcgccaactctgcgggatacgtgggcgaccgcttcaagtgtgtcacaactgaactgtacgctgactcctctcaattgtccagagagcagagggctctccagatggagggcctccaagaagattctatcctgtgtttgcccgcagcctactgcgaacgtgcaatgatgaggttttcagagcttgagatgaaggagcgcgagggtggccacccagctaccaaggattcagagatgtgtaagtttagccccgcagactgggagagacttaagggaaaccaggataagaaaccgaagtccgtcactcttgaagaagcaatcgcagaacagaacgagagcgagagatgtgaatattcagtaggcaataaacacagggatccttttgaagccccagaagacaaggacttgcctgttgagaaatacttcgtggagcgccaaccagtgtccgaaccaccggcagatcaggtggcctccgatatgccacacagccctactctgcgggtggacagaaagagaaaagtctcaggggattcaagccacactgaaacgacggcggaagaagtgcccgaagatcctttgctcaaggctaaaagaaggagggtgagcaaggacgactggcctgagcgcgagatgaccaattcctctagcaaccatctggaggatccgcactatagtgagctgaccaatttaaaagtctgcatagagctgactggactgcacccaaagaagcagcgtcacctgctccatctcagagagcgttgggagcagcaggtctccgccgcagacggaaagccaggaagacagtcacggaaagaggttacgcaagctacccaacctgaggccatcccccagggtactaatattaccgaggagaaaccaggaagaaaaagggcagaggctaagggaaacagatcttggagtgaggaaagcctaaaaccgagcgataacgagcagggactgcctgtcttctccggtagccccccaatgaaatcactgtcttcaacatcagcgggtggaaaaaagcaagcgcagccatcttgcgccccagctagtcgcccaccggctaagcagcagaaaatcaaggaaaatcagaagactgacgtgctgtgcgccgatgaagaggaggactgccaagccgctagtctgcttcagaagtatacggataacagcgagaaaccaagtggcaagcggctttgcaagactaaacatctgattcctcaggagtcacgcagaggactcccgctgaccggcgagtattatgtagaaaatgctgacgggaaggttactgtccgcaggttcaggaagcgcccagaacccagcagcgattatgacttgtccccagccaagcaggaacccaagcccttcgacagactccagcagctgcttcccgcttctcagtccacacagctcccctgttcatcctctccacaagaaacaacacaaagccgacctatgccacctgaagcacggagactgatcgtgaataaaaacgcaggcgaaaccttgctgcaacgagcagcacgcctgggatacgaggaggttgtgttatactgtctcgagaacaagatctgtgacgtcaatcatagggacaatgccggatattgtgcgcttcatgaagcatgtgctagaggatggttaaacattgtgcgtcacctcctagagtatggtgcggatgtgaactgcagcgcccaagatggtacacggccacttcatgatgccgtggaaaacgatcatctcgagattgtccggctgctactgagttatggcgctgatccaaccctcgctacatatagcggtcgaaccataatgaagatgacacactctgaactgatggaaaagtttttgaccgattacctgaatgatctccaaggtcggaatgatgacgacgcaagtgggacatgggatttttacggcagttcagtttgcgagccagatgacgaaagcggttatgatgtgctggccaaccccccagggcctgaagatcaggacgacgatgacgatgcgtattccgacgtgtttgaattcgagttcagcgagacacctctgctcccatgctacaacattcaagtgagtgtggcccagggccctaggaattggctcctcctgtccgatgtgctgaagaagctgaaaatgtcaagtcggatcttcagatgcaattttccaaacgtagaaatagtgacgatcgctgaggctgaattttaccgacaagtttctgctagcttgttgttttcctgttccaaggacttggaagcctttaaccccgagtctaaggagctgcttgatctggttgagtttaccaatgagatccagactctgctgggcagctcagtggagtggctgcatccatctgacttggcttccgataattattggta

SEQ ID NO: 215881 - DNA, 5111 bp, Artificial Sequence
  Description of Artificial Sequence: Synthetic coding sequence
atgctgtcagcaacaccactctatgggaacgttcacagctggatgaacagcgagagagtgcgcatgtgcggcgcttctgaagatcggaagatcttggtcaatgacggagatgctagcaaggccaggttggagttgagagaagaaaatcccttgaatcacaacgtggtggatgcgtcaaccgcccatagaattgatggactagccgctctatcaatggatagaactgggctaatcagagaagggctgagagttccaggaaacattgtgtactcctccttatgtggcctgggcagcgaaaagggaagagaggctgctacaagcaccttgggcggtctgggttttagctctgaaaggaatcctgagatgcagttcaaaccaaacacaccggagacagtcgaggctagcgcagtgtctgggaagccgccaaacggctttagtgcaatatacaagacccccccagggatccaaaaatctgccgtcgccactgcggaggctctgggcctagataggcccgcaagtgacaagcagagccctctcaacatcaatggggcttcgtaccttaggctaccttgggttaatccatatatggagggggctacacctgcaatttatccctttttggatagccccaacaagtatagccttaatatgtataaagcgctgctgccccagcagtcatactctttggcacagcctctgtattcaccggtatgcacgaatggggagaggtttctctaccttcccccaccacattatgtgggacctcacattccgtcctctctggcctctccgatgaggttgtccacaccctctgcgagcccagcaattcccccactggttcattgcgctgacaaatcgctgccctggaagatgggagttagtcctggaaatcctgtggatagccacgcttacccgcacatccagaactctaagcaacccagagtaccttcagccaaggcagtaacatctgggctgcctggcgatactgccttgctgcttcccccatctcctcgcccttccccacgtgtgcatctgcctacacagccagccgcagatacttattctgaatttcacaaacactacgcgagaatttctacctcccctagtgtcgccctgagcaagccctacatgaccgtgagtagtgagtttcctgctgcaaggctgtccaatggaaaatatccaaaagctcccgaaggaggtgaaggcgcacagccagtacccggtcatgcacgaaagaccgccgtgcaagacagaaaagacggctccagccctccactgttagagaagcagaccgtaaccaaagatgtgaccgataaaccactggacctgtcatcaaaggtggtcgatgttgacgccagtaaagcagaccatatgaagaaaatggcaccaaccgtgttggtgcattcccgggctgggtccgggctcgttttgagcgggagcgaaattcccaaagagacgctgagccccccaggcaatggatgcgctatttaccgatctgagataatctccacagcacccagttcctgggtcgtgccgggtcctagtcctaatgaagagaataatggcaagagcatgagcttgaaaaataaggctctggattgggccattcctcagcagcgatcttcttcttgccccagaatgggaggtacagatgctgtgattactaatgtgagcgggagcgtgtctagcgcagggcgacccgcatctgcctcccctgcacctaacgctaacgccgacggtacgaagacctctcgcagcagcgttgagactaccccctccgtgatccaacacgtaggtcagcccccagccacacccgcaaaacacagttcctccactagctcgaaaggggcaaaggcaagtaaccccgagcccagcttcaaggccaacgaaaacggactcccgccttcttcaatctttctgtcccctaatgaggctttcaggtccccacccattccctaccctcggagttacctcccctaccctgccccagagggaattgccgtgagccccttatctctgcacgggaagggaccagtgtacccacatccagtgttgctgccgaatggcagcctctttcctggtcatctcgcacctaaacctggattaccctacggattaccgacaggtcggccagaattcgttacctaccaggatgccctcgggctgggcatggtgcaccccatgcttatcccccacacgcccatcgaaatcacgaaagaagaaaagccggagcggcgatcccggagccacgagcgagccagatatgaagatcctaccctacgaaatcggttctcagaaatcctagagacttcatccacgaagctacacccagacgtacccactgataagaacctgaagcctaacccgaattggaaccagggaaagactgttgtgaagagtgacaaactggtatatgtggatcttttgcgtgaagagcctgacgcaaagacagacactaacgtcagtaaaccatcttttgctgcggagagtgtgggccagagcgccgaacctccaaaaccctccgtcgagccagcgctgcagcaacaccgagatttcatcgccctgagggaagagttgggccgaatcagtgattttcacgagacctatactttcaagcaacccgtttttacggtgagcaaggattcagtactggctggcaccaataaagaaaacctggggctgccggtctccaccccctttttagaaccaccactgggctccgacggccctgcagtgacgtttgggaagacacaggaggatcctaagcctttttgtgtcggatcagccccaccaagtgtggatgtgactccaacttataccaaagacggggcagacgaggccgagagcaatgacggtaaggttctgaaacctaagccgagcaaattggccaaacgcattgccaatagtgcgggttacgtgggagaccgctttaagtgtgtgaccaccgagctttatgcggattcaagccagctctctcgcgaacagagagctctgcagagggccatgatgcgcttcagtgaacttgagatgaaggagagagagggaggacatcctgccacaaaggacagtgagatgtgtaagttctctccagcagactgggaacggctgaaagggaaccaagataaaaaacctaaaagcgttacattggaggaggcaattgcggagcagaacgaatctgagcggtgtgaatatagcgtgggaaataaacacagggatccattcgaggcacctgaagataaggacctgcccgtggagaagtactttgtggaaagacagcccgtgtccgagcctccagctgatcaagttgcctctgatatgccacacagtcccactctgagggtcgaccggaagcgcaaggtgagcggcgactcaagtcacacggaaacaactgctgaagaagtaccagaggaccctctcctcaaggccaaaaggcgccgagtatcaaagggtctccacccaaaaaagcagaggcacttactgcacttgagggagcggtgggagcagcaggtcagtgccgcagacggaaagccgggtaggcaatcgcgaaaggaagttactcaggcgactcagcccgaagcaattccgcaaggaaccaacattaccgaagagaagccaggaagaaaaagagcagaggctaaaggcaatagatcctggtctgaagaatcccttaaaccttccgataacgaacagggcctcccagtgtttagtggctcaccaccaatgaagtccctgtccagcactagcgccggtgggaagaagcaggcgcagccttcctgtgctcccgcatcccggcctcccgctaagcagcaaaagatcaaagaaaatcagaagacagatgtcttgtgcgcagacgaagaagaagactgccaggctgcatctttgctccagaagtatactgacaactccgagaaaccgagtggtaaaaggctatgtaaaactaagcacctgattccccaggagtctcgcaggggactgcctctcacaggggagtattacgtggagaatgccgacggtaaggttacagtcagacggttcaggaagaggcccgagcccagctcagactacgacctgagtccagcaaaacaggagcctaagcctttcgacagattacagcagctccttccagcttcccagtctactcagcttccatgtagcagctctccacaggagacaactcagagccggccaatgcctcctgaagcacgtcggctaattgtgaataaaaatgccggagaaaccttgttacagcgcgcagccagactgggctacgaggaggtggttttatactgccttgagaataagatctgcgacgtgaatcaccgtgataacgctggctactgtgcactccatgaagcatgcgccagaggatggttaaatatcgttcgccacctgctagagtacggggctgacgtcaattgttctgcccaagatggaacaaggcctctccacgacgctgtggaaaacgaccacctcgagatagttagattgctcctgagctatggagctgaccctactcttgcaacctacagcgggaggaccatcatgaaaatgacacattccgagctaatggagaagtttcttaccgactacctcaacgatctccagggaaggaatgatgacgacgcgagcggaacctgggacttctatggatcctcggtctgtgagcctgacgacgaatccgggtacgatgttttagccaatccacctggccctgaggatcaagatgatgatgatgatgcatacagcgatgtgtttgagtttgaattcagtgaaaccccattactgccgtgctacaatatccaggtatctgtagcccagggaccacgaaattggctgctcctgtccgacgttctcaagaagctgaagatgtctagccggatcttcagatgcaacttcccaaacgtagagatcgtcacaatcgcagaggcagagttctatcgccaggtctcagcttctcttctgtttagctgttccaaggacctcgaggcatttaatccagaatctaaagagctgctcgacttggttgagttcaccaatgaaattcagactttgttaggaagctctgtggagtggttgcaccccagtgacctagcatccgacaactactggta

SEQ ID NO: 215882 - DNA, 1869 bp, Artificial Sequence
  Description of Artificial Sequence: Synthetic coding sequence
atgccccattcaccaacattacgggtagaccgaaagcgcaaggtctccggtgattcatcccacacagagacaacagctgaagaggtgcccgaggaccccctgcttaaagcaaagcgcagacgagtgtcgaagggcctccatcccaagaagcagcgtcacctcctccacttgcgcgagcgttgggagcaacaggtgtccgcagccgacggaaagcccggacgccaatcccggaaggaggtgacacaagctacgcagcctgaggccattccccaggggactaacatcactgaggaaaagccgggtcggaaacgcgctgaagcaaagggcaatcggtcttggtccgaagagagtcttaagcctagcgacaacgagcagggcctacctgtttttagtggctccccgcctatgaaatctctttcctcaacatccgctggagggaagaagcaagcccagccctcctgcgcaccggctagcaggcctcccgctaagcagcagaagatcaaagagaaccagaagacggatgtgctctgcgctgatgaagaggaggattgtcaagccgcttctctcttgcagaagtacaccgataactctgagaagccatccggaaagcggttgtgtaagactaagcatctgatcccccaggagtcgaggcgcggactgcccttgactggggagtactacgttgaaaacgccgatggcaaagtcacagtgcggaggtttagaaaacgtcctgagcccagctccgattatgacctgtctccagcaaaacaggagcctaagccctttgacagactccagcagctgttaccggctagtcagtctacgcagctaccttgtagctcttctccacaggaaacaactcagtctaggccaatgcctcctgaagccagacggctcattgtgaacaagaacgcaggcgaaaccttgctgcagagggcagccagactcggctatgaggaagtagtattgtattgtttggagaacaagatatgcgacgtgaatcatcgtgacaacgccggatactgcgctttacacgaagcctgcgctcgcggttggttaaacatagttcgtcatttgctggagtacggcgctgacgtgaactgtagcgctcaggacggcacacgccctttgcatgatgccgtggagaatgatcatctggagatagtaagactgttgctgtcttatggagctgacccaacccttgcgacctactcaggcaggaccattatgaagatgacacatagtgagcttatggagaaatttctcacagattatctcaacgacctgcagggccgtaacgacgacgacgcctccggtacctgggatttttacggctcatccgtgtgcgaacccgacgacgagtccgggtacgatgtactggcgaatcctcctggccctgaagaccaggacgacgacgatgacgcatacagtgacgtcttcgagtttgaattctcagagacaccactgctgccatgctacaacatccaggtctctgtggcccagggccctcgtaattggctgttgttgtccgatgtactcaagaaactaaagatgagcagcagaattttcaggtgcaactttccaaatgtagagatagtgactatcgccgaggccgaattttatcgacaggtgtcagcctctctactattttcctgttcaaaagatctggaggcctttaacccagagtctaaggagctgctggatttagtggagtttaccaacgaaattcagacgctactgggctcgtctgtcgagtggcttcatccatccgacttggcttccgataattattggaagagccctcagattgcccgtggctccgtggagggtaaaaaaactgacgacaagacgtcgaaaaccgatttgtag

SEQ ID NO: 215883 - DNA, 5165 bp, Artificial Sequence
  Description of Artificial Sequence: Synthetic coding sequence
atgttgtcagcaacccctctgtatggcaatgtccatagctggatgaactcagagagagttaggatgtgtggagcgtcagaagaccgcaagatccttgtaaatgatggcgatgcaagtaaggcaagattggagctacgggaagagaatcctctaaaccacaacgtggtcgatgcatcgaccgctcataggatcgacggtctggccgcactctccatggacaggacaggtttaattcgcgaaggccttcgcgtgccgggaaacatcgtttactctagcctctgtggactgggctctgaaaagggcagagaggcagcaaccagtacgcttgggggattggggttctcatccgagcgcaacccagagatgcagttcaaacctaatacgcctgagaccgtcgaggcaagcgccgtgtcaggaaagccacctaatggcttcagcgctatatacaaaacaccacccggaatccagaagagcgcagtggccactgcagaggcgctggggctggaccgtcctgccagcgataagcaatcacctctgaacattaacggggcatcttaccttcggctgccgtgggtcaatccttacatggagggcgctacccctgcaatttacccattcctcgattcaccgaataaatactctctgaatatgtataaggctcttcttccacagcagagctacagtcttgcccagcctctctacagtcctgtctgtactaatggggaaaggtttctgtacttgcccccaccccactatgttggcccacatattccaagctctctggcaagccctatgcgccttagtacaccctctgcaagccccgcaatacctccacttgttcactgtgctgataaatccttgccctggaaaatgggagtttcgccaggcaaccctgtggactctcacgcctatccgcacatccagaacagtaagcagcccagggtcccatctgccaaagccgtcacttctggcctccctggtgatacagcactgttactgccaccgtctccaaggccctcacccagagtgcatctgcctactcagcccgctgctgacacgtattccgaatttcataagcattacgcacggatatctactagcccaagcgtcgctctctccaaaccttacatgactgtttcatcggaattcccggctgctaggctgagcaatgggaagtatccgaaagctccagaaggtggcgagggcgctcagccagtccccggtcacgcccgaaaaacagccgttcaggaccggaaagacgggagtagcccgccactgctagaaaagcagacagtcacgaaagatgtgaccgacaaacccttggacctgagcagcaaagtagtggacgtggatgcctccaaagccgatcacatgaagaagatggccccaacggtactggtccacagtcgtgccggatccggactggtcctgagcggcagcgagatacccaaggaaactctgtcccccccaggaaacggctgtgccatttaccgcagcgagattatctcgacggcccctagttcctgggtcgtgccaggcccttccccaaatgaggagaacaatggaaagagtatgagcttgaagaataaggccttagattgggccataccccagcagagatcatcaagctgtcctaggatgggtggaactgatgccgtgatcacaaacgtgagtggatcagtctcctccgcaggcaggcccgcttccgcctcccctgcacccaacgccaacgcggacggcacaaaaacgtctaggagctcagtggaaacgaccccttcggttatccagcacgtgggtcaaccaccagctactcctgcaaagcattccagcagcacttcaagtaaaggggctaaagcatcaaatcctgaaccatctttcaaggccaacgagaacgggctgcccccaagctccatattcctgtcccctaatgaagcgttccggagcccacctatcccctaccctagaagctacctgccttaccccgctcccgaagggatcgctgtttccccactctccttacacgggaagggccctgtctacccacatccagtgctgctccccaatggatccttatttccaggacacttggccccaaagccaggattaccatacgggctccctactggcaggccagaatttgttacatatcaggacgctctggggctggggatggtgcaccctatgctgattcctcacacacctattgagatcaccaaggaagaaaagccagagaggcgcagtcggagtcatgagagggcaaggtatgaagacccgactttacgaaaccgcttctccgaaatcttggagacaagctccaccaaattacacccggacgtgccgactgacaaaaacctcaagcccaacccgaattggaaccagggcaagacagtggttaagtcagacaagctcgtgtacgtcgacttgctgagggaggaacccgacgctaagacagacactaacgtaagtaaacccagttttgccgcagagagcgtcggccaatccgctgagcctcccaagcctagtgtggaacccgctctgcagcaacatagggatttcattgcccttcgggaagaactcgggcgtatttctgattttcacgaaacctatacttttaagcagcccgtttttacagtttcaaaagacagcgtgttggcaggtactaacaaagagaatctcggcctacctgtttccaccccttttctcgagcctccgctgggcagcgacggaccggcagttactttcggaaagactcaggaggaccccaagccattctgtgtgggttcggcgcctcctagtgttgacgtgacccctacctacaccaaagatggagcggacgaagcggaaagcaatgatgggaaggttcttaaacccaaaccctccaagctcgctaagcggatagccaattctgctgggtatgttggggatcgctttaaatgtgtgaccactgaactatacgctgatagctcacagctgagccgggagcaacgagccctccaaatggaggggttacaagaggattccatcctatgcttgccggctgcgtattgcgaacgtgccatgatgcggttctcagaactggagatgaaggagcgtgaagggggacaccccgcaactaaagattcggagatgtgtaaattctccccagcagattgggagagactcaaaggcaatcaagacaaaaagccaaaatccgtcactttggaagaggctatcgccgagcagaacgaatcagagaggtgcgagtatagtgtggggaataagcacagagacccctttgaggcgccagaagataaagatctccccgtcgaaaagtatttcgtggaaaggcagccagtgtccgagccccctgctgatcaggtcgcttctgatatgccccactccccaaccctccgcgtggatcgaaaaagaaaggtgagtggcgattcatctcacacggagaccaccgccgaggaggtcccagaagacccactcctgaaagcaaaacgccgacgtgtttctaaaggccttcatcctaagaaacagcgccatttactccatctgagagaacgctgggagcagcaagtgagtgcagccgatgggaaacccggtaggcaatccagaaaggaagtcacccaagcaacacagcccgaggctataccacagggaactaatatcacggaagagaaaccgggaagaaagcgtgcggaagcaaaagggaataggtcttggtctgaagagagcctgaaaccttctgacaatgaacagggacttcccgtgttctcggggtctccccctatgaagagtctttcctcgacgagtgccggaggcaagaaacaggcccagccaagttgtgctcctgcctcacgtcccccagccaagcagcagaaaattaaggagaatcaaaagactgacgttctgtgtgccgacgaggaagaggactgtcaagccgcaagcctgctgcaaaaatatacagataattcagaaaagcccagcggcaagagactgtgtaagacgaagcatttgatcccacaggaaagccggagaggcctgccactaacaggcgagtactacgtagagaatgctgatggtaaggtgacagtgagaaggttccggaaacgtccagagcctagttcggactacgacctgagcccagccaaacaagaacccaaaccctttgatcggttacagcagctgctgccagctagccagtccacccagttaccatgctcctcgtccccccaggagactacacaatcccgcccaatgccacccgaggctcggagactcatcgtcaataagaacgcaggcgagaccctgctgcaacgggcagcgaggctgggatacgaagaggtggttctctactgcctcgaaaacaagatttgtgatgtcaatcaccgtgataatgccggatactgtgcgcttcatgaagcgtgcgcccgtggctggctgaacattgttagacacctgctggagtacggggctgacgtcaactgcagtgcccaggatggcacccgaccactacacgatgccgtggaaaatgaccacctggaaattgtgagattgctcctgagttatggagcagacccgaccctggccacttacagtggccgaactattatgaagatgacacacagcgagctgatggaaaagttcttgacagattacctgaatgatctccagggtaggaatgacgacgacgccagtggaacgtgggacttttacggaagttccgtttgtgagcccgatgacgaaagtggctacgatgtgctcgccaatccccctggaccggaagatcaggatgatgatgatgacgcatattcagatgtgttcgagttcgaattcagtgagactcctctcctgccttgttataatatccaagtaagtgtggctcagggaccacggaattggctcctcttgagcgacgttcttaagaagcttaagatgagctctcggatctttaggtgtaacttccccaacgtggagatagtcacgattgccgaagctgaattctaccggcaggtcagcgcctcactgctttttagttgctctaaggatctggaggcattcaatccggaatccaaagagctgctggacctggtggagttcactaacgaaatccaaacacttcttggctctagtgtggagtggctgcatccctcagatttggccagcgacaactattggta

SEQ ID NO: 215884 - DNA, 87 bp, Artificial Sequence
  Description of Artificial Sequence: Synthetic coding sequence
atgctgagcgccacaccgctctatgggaatgtgcactcgtggatgaatagcgaacgcgtgcgcatgtgcggcgctagtgaagattag

SEQ ID NO: 215885 - DNA, 1236 bp, Artificial Sequence
  Description of Artificial Sequence: Synthetic coding sequence
atgacgcgccctgctttccaaccgccagccacccctgccaaacacagcagctctacctctagcaaaggcgcaaaagctagcaatccggagccatccttcaaggcaaatgagaatggactgccaccgagttcaattttcttatccccaaacgaagcatttagatccccacccataccctatcctaggagctacctgccctacccggctccggaaggaattgcggtgagcccacttagcctgcatggtaagggccctgtgtatccccaccccgtcctcctccccaacgggtcactttttcctgggcatctggcccctaagcccggtcttccgtatggcctccccaccggccgacccgaatttgtgacataccaggacgccctggggcttggcatggtgcaccccatgctgattccacatacccctattgaaatcaccaaggaggagaagccagaaaggcggtcacggagtcacgagcgggcaagatacgaagaccctacgctgcggaaccgcttctccgagatcctcgaaacctctagcacaaaactgcaccccgacgtgccaaccgacaaaaatttgaagccaaacccaaactggaaccaaggaaagacagtggttaagtccgataaactagtttacgtagatttactgagagaggaacccgacgccaaaacggataccaacgtatcaaagccgtcctttgcagcggaaagtgtcggacaatccgccgagccgcctaagccttccgtcgagcccgcactccagcagcacagagacttcattgccctcagagaggaactgggaaggatttccgacttccacgaaacatatactttcaaacagccagtgtttacggttagtaaagattccgtgttggcgggtactaataaggagaatctggggcttcctgtcagtacacctttcttggaaccacccctggggtctgacggccctgctgtgacatttggtaaaacacaggaggaccctaaacctttctgcgtgggatctgctcccccttccgtggacgttaccccaacctatacaaaagacggcgctgacgaagccgagagcaacgacggcaaggtgcttaagcccaagccatccaagctagctaaaagaatcgcgaattccgcgggttatgttggggatagatttaagtgcgttacgactgaattatatgctgatagttctcaactgagtagagagcaacgggcactccaggtgtctccacccacatag

SEQ ID NO: 215886 - DNA, 2238 bp, Artificial Sequence
  Description of Artificial Sequence: Synthetic coding sequence
atgcctgttctttctcgaccacgtccctggagaggcaatacactcaaacggacagctgtactcctggcactggcagcctacggagcccacaaggtgtacccactggtgcggcagtgtctcgccccagcccgtggactccaggcccctgctggcgagccaactcaggaagccagcggcgtcgcggctgccaaagccggtatgaacagagtgtttctgcaacgactgctgtggcttctgcgccttttattcccaagagttctgtgccgggagaccggcctcctggccctccacagcgctgccttggtaagccggacttttctcagcgtatacgtggccagacttgacggacggcttgcacggtgtatcgtcagaaaggatccacgagcttttggttggcaattgttacagtggctgctcatcgcgctgcctgccaccttcgtgaactccgcaataaggtacctagagggtcagctggccctcagtttcaggagccggttagtcgcccatgcttataggctttacttttcgcaacaaacatactatcgtgtgtcaaatatggatggaaggttgagaaaccccgatcagtcactgaccgaggacgtggtcgcctttgcagctagtgttgctcacttgtacagtaacctcactaagccattacttgacgtggcagtgacatcatacactcttctgagagccgcacggtcccgcggagccggtacggcttggcccagcgctatcgccggactggttgtattcttgaccgccaatgtacttcgggcattttccccgaaatttggggagctcgttgcagaggaggctcggagaaaaggtgaactgcgctacatgcacagtcgggtggtcgccaactctgaagaaattgcattctacggtgggcatgaggttgagctggccctccttcagcgttcttaccaagatctggctagccagatcaatctgatccttctcgagcgcctatggtatgtgatgctagaacagtttctgatgaagtacgtttggagtgcaagcggcctgttgatggtggccgtgccaatcattactgccacggggtactcagagagtgacgctgaggcagtgaaaaaggcagccctggagaagaaagaagaggagctagtgagtgaacggactgaagcttttaccatagcccgaaacctgcttaccgctgccgctgacgccatagaacgaatcatgagctcttataaggaggtcacagaactagctgggtataccgctagagttcatgagatgttccaagtcttcgaggatgtgcagcgctgccatttcaaacgtccgagagaattagaggacgcccaggcagggagtgggactattgggaggagtggagttagggtcgaaggacctctgaaaatcagagggcaggtcgtggatgtggagcaaggtatcatttgtgagaatattccaatcgtgacaccttccggagaagtcgtcgttgccagccttaatatccgggtggaagagggaatgcatctcctgattactgggcctaatggctgcggaaagtcctccctttttcggattcttggaggcctttggccaacatacggtggtgtgttgtacaagcctcctccccagaggatgttttacattcctcagagaccctacatgtccgtgggcagtctacgcgaccaagtcatctatcctgatagcgtggaagatatgcagcggaagggctactccgaacaggacttggaggcaatccttgacgtcgttcacctgcaccacatactccagcgggagggtgggtgggaggccatgtgcgactggaaagacgtgctgtctggaggtgagaaacagaggatcggcatggccagaatgttctatcatcgcccaaagtatgcactgttagacgagtgcacgagcgccgtgagcatcgatgtggaaggtaagatttttcaagctgctaaggatgccggaatcgccctgctgagtattacacacagaccatctctgtggaaataccatacccacttattgcagttcgacggggaaggcggatggaagttcgagaaactagacagtgccgctcgtctttccctgactgaagaaaaacagcgattggaacagcaactggcgggaattcctaaaatgcagcggagactccaagagttatgtcaaatcttgggagaggccgttgctccagcccacgtgcccgctccatctccccaaggacctggcggattgcaaggtgcctctacatag

SEQ ID NO: 215887 - DNA, 5358 bp, Artificial Sequence
  Description of Artificial Sequence: Synthetic coding sequence
atgatctccactgcacccctctattcaggggttcacaactggacatcatcagatagaattcgcatgtgtgggataaacgaagaaaggcgcgcacctctgtctgacgaggagagcaccactggggactgtcagcattttggttcccaggagttctgcgtaagctcatcattttccaaggttgaactgaccgccgtgggcagtggatctaatgcaaggggggcagacccagacggctccgctacagagaagctgggacacaagagcgaagacaagccggacgacccacagcccaagatggattatgccggaaacgtggcagaagccgagggtttccttgtgcctttgtcttcaccgggagacggactcaagttaccagcttccgactccgccgaggcaagcaatagcagagcagattgctcgtggacccctctcaatactcagatgtctaaacaggttgactgtagcccggcaggagtgaaagcattggactcccgtcagggtgttggagaaaagaacacgttcatcctggctaccctagggacaggcgtgcccgtggagggaacattacccctagtgactacaaacttctctcctttgccagcccctatctgtccccctgctccgggatcggccagtgtgccccattctgtacccgatgcatttcaggtaccactgtctgttccggctcctgttcctcattcaggtcttgtgcccgtgcaggtggcaacgagtgtccccgcaccatctccccctttggccccagtgccagcactcgctcccgcaccccctagcgttcctacactcatctccgacagtaatccgctttcagtgtccgccagcgtgctcgttccagttcccgctagcgccccaccatctggacctgtacccctcagtgcgcctgccccagccccactctccgttcccgttagcgcaccacccctcgccctgattcaggctcctgtgccaccatccgcaccaactcttgttctggcccctgtgcccacccctgtgctggctcctatgccagcctcaacacccccagcggcaccggctcccccttccgtccccatgccgacaccaactccctcttccggccctcctagtaccccaacgctcattcctgccttcgccccaacaccggtgcctgctcctactccagcccctatctttacccctgcccctacacccatgcctgctgctacccctgccgctataccaacttcagcccctatccccgcaagcttttcgctaagtagggtttgtttcccggcagcccaggcccctgccatgcagaaagtacctttgtcgttccagccaggcacagtgctgactcctagtcagcccctggtctatattccgccaccgtcttgcggtcagcccctgagcgttgctactctccccactactttaggagtgagttcgacacttacattgcctgtcctgccttcttatttgcaagacaggtgcctcccgggagtcttagcctccccagagcttaggtcatacccttatgcttttagcgtggcaaggcccttgacatcggattctaaactagtgtcgttagaagtcaatcggctgccctgcaccagtccaagcggatctaccacgacgcagcccgcacctgacggcgtccccggtccgcttgccgatacatccctagtcactgcatccgccaaagtgcttccaaccccacagcctctcttaccagcgcctagcggatcatctgccccaccccacccagcaaaaatgccaagtggcactgagcagcagacagaaggaacaagtgtaacctttagtcctctgaagagccccccacagctggagcgtgaaatggctagcccccctgaatgttccgaaatgccattagacctatcttctaaatccaaccgccagaaactcccactgccaaaccagcgcaagacgcccccaatgcctgtcctgacccctgtgcatacgagcagcaaggccctgctgtcaaccgtattatcccgctcccagcgtaccacacaagctgcgggtggtaacgtgacatcgtgtttaggctctacttcctctcctttcgtgatcttccccgaaatagtaagaaacggcgatcctagcacatgggttaagaattctaccgctctcatctctacaatccccggaacctacgtcggggtcgccaacccggtccctgcgtccctgctgctgaacaaagatcctaatctgggtctaaaccgcgaccctcgtcacctgcctaagcaggagcccatctccattatcgaccagggcgaacccaagggaactggagccacgtgcggaaagaaggggagtcaggctggcgcagaaggccagcccagtactgtgaagcgctatactccagccaggattgcgccaggcctccctggctgccagaccaaggagctgtccttgtggaagcccactggtcccgctaatatctacccaagatgctcagtcaatggtaagccgacctccacccaggttctgcccgtgggatggtctccttatcatcaagcaagcctgttaagtatcggaatcagttctgctgggcagctgactccatcgcaaggggcaccgattcgacctacatcagtggtgtccgagtttagcggagtgccctccctaagctctagcgaagccgtccatgggctgcccgagggacagccacgaccaggaggatcctttgtgcctgagcaggatcccgtcaccaagaacaagacatgccgtattgctgccaagccctatgaggaacaggttaatcccgtattactgactctttcaccccagacagggactcttgccttgagtgtccaaccttccgggggtgacattaggatgaaccaagggcctgaggaatcagagtcccacctgtgtagcgactctacccctaaaatggagggaccccaaggcgcatgtggcctgaagctagccggagacaccaaacctaaaaatcaggtcctggccacctatatgtcccacgaactggttctcgccaccccacaaaacctcccaaagatgccagaattgccactgttacctcatgactcccatcccaaagaattgattctggacgtggtcccatcttcccgcagagggtcatctaccgagcgccctcagctgggctcccaggtggatctcgggcgagtaaagatggaaaaggtagacggagacgttgttttcaacctggcaacatgtttccgtgccgatggcctgccggtcgcccctcagagggggcaggccgaagttcgcgcaaaggccggtcaagctcgcgttaagcaggaatcagtcggtgtcttcgcttgtaagaataaatggcagcccgatgatgtaactgagtccctaccgccaaagaagatgaaatgcggaaaagaaaaagactctgaggaacagcagctgcagccacaggccaaggcagtcgtgagatccagccataggccaaagtgccggaaactgcccagtgaccctcaggaatctactaagaagtcccctagaggagcctctgattctggcaaagagcacaacggcgttagggggaagcacaaacacagaaagcccacaaagcctgagtcccagtcaccagggaaaagagcggatagccatgaagaagggtctctggagaagaaggctaagtccagcttcagagacttcatccccgtggtgctcagtacacggacccgctctcaatcgggatcaatttgttctagcttcgctggaatggccgattctgacatgggttcccaagaagttttccccacagaagaggaagaagaggtaacgcctaccccagcgaaacgacgcaaagtccgtaagacccagcgagatacacagtatcgtagtcatcatgctcaagacaaaagcctgctctctcagggccgtaggcacctgtggcgggcacgggagatgccctggcggacagaagcggcaagacagatgtgggacacaaacgaggaagaggaggaggaggaagaagaagggctgctcaaacgcaagaaacggaggaggcagaaaagtagaaagtatcagactggcgagtatcttactgagcaggaggatgaacaaagacgcaagggtagagccgacctaaaggctcggaagcagaagacatccagcagccagtccctggagcatcgcttgcgcaaccgtaatttgttgttgcccaacaaggtccaggggatcagcgacagtcctaatggtttcctgcctaacaacctggaggaacctgcttgcctagaaaattccgaaaagcctagcgggaaaagaaagtgcaagaccaaacacatggcaacggtgagcgaagaggccaaggggaaaggacggtggtcccagcagaagactcggtcccctaaaagtcctacgcctgtgaagccaactgaaccatgcacgcctagcaaaagcagatctgccagcagcgaagaagcaagcgagtcaccaacggctagacagatccctccggaggctcgacgactgatcgtaaacaagaacgctggagagactctgctccagcgtgcagcgaggttaggatataaggatgtggttctctactgtttacagaaggactcagaggacgttaatcatcgggataacgctggctacacagcgttgcacgaagcatgctcccgaggatggactgacatccttaatatcctgctcgagcatggcgctaatgtgaattgcagtgcacaggacggcacccggccagtccacgatgccgtcgtgaacgacaacttggagaccatatggctcttgctttcttacggcgcagaccccactttggccacatacagtggacagactgccatgaagctggcttctagcgataccatgaaaagattcctatccgatcacctttcagatttacaggggagggccgagggcgacccgggagtatcctgggacttttactcgtcgtcagtgctcgaggaaaaagacgggttcgcttgtgacctcctgcacaatccacccggttcctctgatcaggagggtgatgaccccatggaagaagatgacttcatgttcgagctctccgacaaaccccttttaccgtgctacaacctgcaggtttcggtgtctcgcggtccctgcaattggtttttattctcagatgtgcttaagcgcttgaaactcagttcgcggattttccaggcccgatttccacacttcgagatcacgacaatgccgaaggccgagttttatcgtcaggtggcttcttctcagcttctcactccagccgagcgtcctggtggcttggacgaccgaagtcccccaggcagttctgagaccgtggaactcgtgagatacgagcctgacctgctccgactcctgggatccgaggtggagtttcaatcctgtaattcatac

SEQ ID NO: 215888 - DNA, 4746 bp, Artificial Sequence
  Description of Artificial Sequence: Synthetic coding sequence
atgatttctacagcccctctctattccggagtacacaattggactagttcagacagaatcaggatgtgcggcatcaacgaggaaagaagggcacctttgtctgatgaggagagtaccacgggagattgccaacactttggcagccaggagttctgtgtctcaagctctttctccaaggtagaactgacagctgtgggatcagggtcgaatgccaggggcgcagatccggacgggagcgccaccgaaaagctgggtcacaaatctgaagataaacccgacgatcctcagcctaagatggattatgccggaaatgttgccgaggcagagggcttcctcgtgcctctgagttctcccggtgatggactcaagctcccggctagtgacagtgctgaagcctctaacagcagagccgactgctcatggaccccgctaaacacacagatgtctaaacaggtcgactgctccccagccggagttaaggccttagattctcgccagggcgtaggagaaaaaaacactttcatcttagcgactctgggcacaggagtgccagtggaagggaccctgccattggttaccacgaattttagccctcttccggcacccatttgtccccctgcgcctggatcagcaagcgtgccacactctgtgccagacgcttttcaggtcccactgagcgtccccgctccagtgccacactctggcctagtccctgtccaggtagcgactagcgtgccggcaccatccccgccactagctcctgttcccgctctcgctcccgctccaccctctgttccgaccctcatttcggattccaatcctttgtccgtgtcagcctcagttttggtgcctgttccagcctccgcaccgccttcgggccctgtacctctgtcggcccctgcaccagcgcctctcagtgttccagtgtcagcccctccgctcgctctaatccaagctccagtcccaccctccgcccctaccctggtcttagctcccgtgcccacccccgtactcgcccctatgcctgcatccaccccaccagccgcacccgcacccccatccgttccaatgcccaccccaactccttcgagcgggcctcctagcacccccactctgataccagcttttgccccaacgccggtgccagcaccgacaccagcgcctattttcacccctgccccaacgcctatgcccgcagcaactccagcggctatccctacttctgccccaattcctgcctctttctcactcagccgcgtatgttttccagcagcacaggcccctgcgatgcagaaggtgcctttgagcttccaacccggtactgtgctcacaccgagccaaccactggtatatattccacctccatcatgcggacaacctctcagcgttgctacactgcccactaccctcggggtcagcagtactctgaccctgcctgtgcttccgtcttatttgcaagaccgctgtctgccaggcgtcctcgcctcgcccgagctgcgctcgtatccttacgcttttagcgtagcgaggccactcaccagtgattccaagctcgtttctctggaggtgaataggctgccgtgtacctctccctccggctccaccaccactcagcccgcacccgacggggtgccgggaccactggcagacacgagccttgtgactgcaagcgctaaggtcctgccgacaccacagccacttctgcctgcccctagcggcagctccgcccctcctcatccagccaagatgccgtcagggacagagcaacagaccgaagggacttccgtcactttcagccccttgaaaagtccaccgcagcttgaacgcgaaatggcctcacccccagagtgctcagaaatgccacttgatttgtcgtcaaaatccaaccggcagaaactgcctcttccaaaccagaggaagactccacctatgcctgttctgacgccagtgcacactagcagcaaggctcttctctcaaccgtgctatcgaggagtcagcgaaccacccaagctgccggaggtaatgtaacatcatgtctggggtctacaagttcaccctttgttatatttcccgagatagtgagaaatggggaccccagtacctgggttaagaattctaccgctctcatttccactatcccaggaacgtacgtcggcgtggctaacccagtgccagctagcttgctgttgaataaggaccccaacttggggcttaatcgcgacccacggcacttgccaaagcaagaaccgatctccataattgaccagggagaacctaaggggacaggcgctacttgtgggaagaagggatctcaggcaggagccgaagggcagcctagtactgtgaagaggtatacacccgctcgcatagctcctggactgccaggatgtcagaccaaagaattgagcctgtggaagccaactggacctgccaacatataccccagatgttccgtcaacgggaaacccacctcaactcaagtacttccggtgggctggagtccatatcaccaggccagcctgctgagtatcggtataagcagtgcagggcaattaactccgagtcagggtgcgccaattcgtcccacatcggtggtctctgagtttagtggcgtgccttccctctcttcttcggaggccgttcacggactgccagagggccagccaagaccaggcggttcatttgtgccagagcaggacccagtgaccaaaaataagacatgcaggattgccgcaaagccttacgaagagcaggtgaatcccgtgctacttactctgtccccgcagacggggacactggccctgtccgtgcagccatccggcggagatatccgaatgaatcaaggacccgaagaatcggagtcacacctctgcagcgacagcacccctaaaatggaaggccctcaaggcgcttgtggactcaagctcgccggagacaccaagccaaagaatcaggtccttgcgacgtacatgtctcatgagctggtgctggccaccccacagaacctccccaagatgccggaacttcctctcctcccccacgattctcatcctaaggagttaatcctcgacgttgtgccaagctcacggagaggcagctcaacagagagaccccagctagggagtcaagttgatttgggcagggtgaagatggagaaggttgacggggacgtggtgtttaatctggcaacatgtttccgggcagacggcctcccagtcgctccccagcggggtcaggccgaagtgcgggctaaagcagggcaagctagagtcaaacaggaatctgtgggcgtgtttgcctgtaaaaataaatggcagccagacgatgtgactgaatcactgcctccaaaaaaaatgaagtgtggtaaggagaaggattcagaagaacagcaactccagccccaggccaaggccgtggttcggagtagtcataggccaaaatgtcgaaaacttccttccgacccacaggaaagcacaaaaaaatctcccagaggtgccagtgactccgggaaggagcacaatggcgtccgcggaaaacataagcacagaaagcctacgaagcccgaatcccagtccccagggaaacgggcagactcacacgaagaagggtctctcgaaaaaaaggctaagtcttcatttcgagacttcatcccggttgtgctgtctacgagaacaagaagccaaagcgacctaaaggcacggaagcaaaaaacgtcttcgtcccaaagcctcgaacacaggctgagaaatcgcaacctgttactccccaacaaggtccagggaatctccgactccccgaacggcttcttacccaacaatcttgaggagccagcttgcttagaaaactcggagaagcctagtggcaaaaggaaatgtaaaacaaagcatatggctacagtttcagaagaagctaaagacgtggtactgtattgcttacagaaagattccgaggatgtgaatcacagagacaatgccggatacacagccctgcatgaggcgtgtagtcgcggatggaccgacatcttgaacatcctgctggagcacggcgcaaacgtcaattgttccgctcaggatggtactcgcccagtgcatgacgcggtggttaacgacaatctcgaaacgatatggctactgctgtcttacggagccgaccccacactggcaacgtactccggtcaaacagcaatgaaactcgcctcctcagatacgatgaagaggttcctctccgaccacctttccgacttgcagggcagagctgaaggcgaccccggtgtctcctgggacttttattctagcagcgtgcttgaggagaaagatggattcgcctgtgatctacttcataacccgcctgggagttctgaccaggaaggggatgaccctatggaagaggatgactttatgttcgagctttcagacaaacctctcttgccatgttacaacctgcaagtgtccgttagcagaggtccctgtaattggtttttgtttagtgatgtgctcaagcgacttaagctcagctcgcgtatattccaagccaggtttcctcatttcgaaatcaccaccatgccaaaagctgaattctacaggcaggtcgccagctctcagctgctgacccccgctgaacgtcctggcggactggatgaccggtctccccctggaagcagtgagacagtcgagctggtgcgttacgagccggatctcctccgccttttaggttcagaggtagaattccagagttgcaatagctag

SEQ ID NO: 215889 - DNA, 2226 bp, Artificial Sequence
  Description of Artificial Sequence: Synthetic coding sequence
tagccactgctgcccgctcccagtggaagctccgcaccgcctcaccccgcaaagatgccctctggaactgaacagcagacagagggaaccagcgtgaccttctcacccctcaagtctccaccacagctagaacgcgagatggcatcccccccagaatgtagcgagatgcctttggacttatctagcaaaagcaaccggcaaaaattgcctctccctaaccaacggaaaacccccccaatgccagtcttgacgccagttcatacgagcagtaaagcactgctgtcgacggtcctgagccgctctcagaggaccacacaggctgctggaggcaacgtgacgtcgtgcttaggtagcaccagcagcccgttcgtgatcttccctgaaatagtgcgaaacggggaccctagcacatgggtgaaaaattccactgcattgatttccactatccccggaacatacgtcggagtggctaacccagtcccagcatccctgcttttaaacaaggatccaaaccttggtctgaatcgtgaccccaggcatctacccaagcaagaaccgatttctattattgatcagggagagccaaaaggaacaggcgctacatgcgggaagaaggggtctcaggcgggagccgaaggacagccctcaacagtaaagcgatacactcccgcacgcatcgccccaggcctcccagggtgtcaaactaaggagttgagtctgtggaaacctacaggaccggctaacatttatccgagatgctctgtgaatggtaaacctacatctactcaagtgctgcccgtgggatggagcccatatcaccaagccagtctgctaagcataggtatcagcagcgctgggcagcttaccccgtcacagggagccccaatcagaccgactagcgtggtttctgaattcagtggtgtgcctagtctgtcctccagcgaggcagtgcatgggcttcctgaaggacagccacgccctggagggagctttgtgccagaacaggatccagtcacaaaaaataaaacttgccgcatcgcagccaagccttacgaagagcaagtaaatcctgtgctgttgactcttagtcctcagacaggtactctggcgctgagcgttcagccgagcgggggtgatattcgtatgaaccaggggccagaggagtccgaaagccacctgtgcagcgattctactcccaagatggaagggccacagggggcatgtggccttaagctggcaggcgatacaaagccaaagaaccaggttctggcaacttacatgtcgcatgaactcgtacttgcaactccacagaatctgcccaagatgccggagctccctctgttgccacacgattcgcacccaaaggaacttattctggacgttgtgccgagttcccggcgaggaagctctaccgagcggccacagctgggctcccaggtggacctgggccgagtaaaaatggagaaggtggatggagatgtcgtgtttaacctggctacttgctttagagctgacggactccccgtggcgcctcaacgcggtcaggcagaagtgagggccaaggctgggcaggctagggtcaagcaagagagcgtaggggtgttcgcctgtaagaacaaatggcagcctgacgacgtgaccgagagcctgcccccaaagaaaatgaagtgtggtaaggagaaagatagcgaggagcaacagctgcagccccaggccaaggctgtcgtgaggtcaagccatcgtcccaaatgtcggaaactgccatcggacccacaggaaagtaccaaaaaatcgcctaggggcgcttcagattcaggtaaggaacacaacggagttagaggtaagcataaacacagaaagcccactaaacccgagtcccaatcaccgggtaagagagctgacagccatgaagaaggttccctagaaaaaaaagccaagagtagcttccgggactttatcccagtggtgctttccacaagaacacggagccagtccgacctaaaggccagaaaacagaaaaccagctcaagccagagcctggaacatcgattgagaaataggaacctcttattgcccaacaaggtccaaggaattagcgattccccaaacggcttcttgccaaataacctggaggagcccgcttgtctagagaactccgagaagcctagcggtaagcgcaagtgtaaaaccaagcatatggccaccgtttcagaagaggccaagtag

SEQ ID NO: 215890 - DNA, 4158 bp, Artificial Sequence
  Description of Artificial Sequence: Synthetic coding sequence
acccccgcagctatccccacctcagcacctatacccgctagcttctcgctgagcagggtctgcttccccgctgctcaggctccagccatgcagaaggtgcctttatccttccagcccggaaccgtcctcactcccagtcagcctttggtgtatattccaccaccttcctgtgggcagcccttgtccgtggcaacattgccaacaacactgggagtaagcagcaccctcacccttcctgtcctgccgagctatctgcaggacagatgtctgcccggagtgttggcttctcccgaactgcgctcttacccgtacgcctttagcgtggctcggcctttaactagcgattctaagttagtgtccctggaggtcaaccggctgccctgtacaagcccgtccggttctacgacgacacagccagcccctgacggtgtgcctggtcccctggccgatacttccctcgtgaccgccagcgccaaggttttacctacgccccaacctctgcttcctgcaccatctggatctagcgctccgcctcaccccgctaagatgccctcgggaactgaacagcagactgagggaacttccgtcaccttctcaccacttaaaagccccccacagctggagcgggaaatggccagtccaccggaatgctccgaaatgcccctggatttatccagcaaatctaatagacagaaactgcccctgcccaatcaaagaaagacccccccaatgcccgtgctgactccagtacatacatcctcgaaagcgctgctaagtacagttctgagcagaagccagcgcactacccaggcagccggaggtaacgtcacctcgtgtctgggtagcaccagtagtccgttcgtgatattccctgagatagtgcggaatggcgaccccagtacctgggtgaagaacagtacagctctgataagtaccatcccaggaacgtatgtgggagtcgcgaaccccgtacccgcatctctcctgcttaacaaggatcctaacctgggattgaaccgcgatcccaggcatttacccaagcaggagccgatttccatcatcgatcagggagaacctaagggaaccggagccacctgcggaaagaaggggagtcaggccggtgctgagggacagccttcgaccgtgaaacgctatactccagcaaggatcgcccctggattgccagggtgtcagacgaaggagctgtctctctggaaaccgactggccctgctaacatctatcctcggtgctcagtcaatggaaagcctactagtacccaggtgctcccagtggggtggagcccctaccaccaagctagcctgttgtcaatcggtatcagctctgcgggacagctgaccccatcacagggtgcacccattcgccctacctcagttgtgtcagaattctcaggtgtgccctcgttatctagttctgaagcagtgcatggactccccgaagggcagcccagacccggtggctctttcgtccctgagcaagatcccgtgacaaaaaataagacttgtaggatcgctgctaaaccctacgaggagcaagttaaccccgtgctgctgacactgagcccacagaccggcacactagccttatccgttcagccctctggaggagatataagaatgaaccagggacccgaagagagtgagtctcacctgtgttcagatagtacaccaaagatggaaggccctcagggggcttgtggacttaagcttgccggtgatacgaaacctaagaatcaggttcttgcaacctacatgagccacgagttggtgctggctacccctcagaaccttcccaagatgcctgagctcccattgctgcctcacgactcgcatcctaaagagctaatcctcgatgttgtcccctcctcccgaaggggctcatctacagaaagaccgcagctgggctcccaggtagatcttgggagagttaaaatggaaaaggtggacggcgatgtcgttttcaacttggccacatgcttccgagctgacgggctccccgtggcccctcagagagggcaggctgaggtcagagctaaagctggacaggcccgtgtgaagcaggaatcagtgggtgtctttgcctgtaaaaacaaatggcagcctgatgatgtgactgagtccttgcccccaaagaaaatgaagtgcgggaaagaaaaagattccgaagagcaacaattgcagcctcaggccaaggctgtcgttaggagtagtcacagacctaaatgcaggaagctgccctccgatcctcaggaaagcactaaaaagagtcccagaggggcaagcgattcaggcaaagaacataacggggtgcgcggaaagcacaaacacaggaaaccaactaaaccggaatcccaatctccgggtaagcgcgctgattctcatgaagagggatccctcgagaagaaagcgaagtcttcgttcagggattttattcccgtggtgctcagtactcgcacacgaagccagtctggcagcatttgctcctcttttgcaggaatggccgactccgacatgggctcacaagaagtttttccaactgaagaagaagaggaagtcacaccgacacctgcgaagcgcaggaaggtgcggaagacccagagggacacccaataccggtcacaccatgcccaggataaaagtctcctctctcaaggcaggcgtcatctgtggcgcgctagagagatgccatggcggacggaagccgctcggcaaatgtgggacactaatgaggaggaggaagaagaggaggaagagggtctgcttaaaagaaagaagcgaaggcgccagaaatcccgaaaataccaaaccggagaatatcttactgagcaggaagatgagcagaggagaaagggaagggcggatcttaaggcgagaaagcagaagaccagcagttcacagtcactggagcatcggctgcgcaaccgtaatctgttactgcctaataaagtgcaggggatcagcgattcccccaatggctttctgcccaataacttggaggagccggcttgcctggagaactctgaaaaaccgagcgggaaaagaaagtgtaaaaccaagcatatggccactgtatccgaagaagcaaaagggaaaggccgttggagccagcaaaaaacccgaagccctaaatcccctacccccgtgaagcccaccgaaccttgtacaccttccaaaagtcggagcgcctcctcagaggaggccagtgagagtccaacagctagacagatccctccagaggctcggcgtctcattgtgaacaagaatgccggtgaaactcttctgcagcgcgctgccaggcttggctacaaagatgtagtgctctattgcctgcagaaggattctgaagacgtgaatcaccgtgataacgctgggtacaccgctcttcatgaggcctgctctagaggctggaccgatatattaaatatcctgctggaacacggtgcaaatgtcaactgtagtgcgcaggatgggacgaggcccgtacacgatgccgtcgtcaatgacaacctcgaaacaatctggctacttctcagctacggtgccgatcccactttagccacgtactctgggcagacagccatgaagttggcgtctagcgatacaatgaaacggtttctcagtgatcatctcagcgatctgcagggtagggcagagggggatcctggtgtcagctgggatttctactcttcctcagtcctagaagagaaggacggctttgcctgtgatctgcttcataacccccctggctcttccgaccaggagggggacgatccgatggaggaagacgacttcatgttcgaactaagcgacaagccacttctgccgtgctacaatctgcaggtcagcgtgagtcgcggaccatgcaactggtttttattcagcgacgtccttaagagattgaaactgagctcaaggatttttcaggccaggtttcctcatttcgaaatcactactatgccaaaggcagagttctacaggcaggtggcttcctcacagctcctgacccctgctgaaagaccaggaggcttagatgatcggagccctcccggaagttcagagactgttgaactggtacggtacgagccagacctgctcagattgctgggtagtgaagtcgagttccaatcttgtaattcgtag

SEQ ID NO: 215891 - DNA, 5135 bp, Artificial Sequence
  Description of Artificial Sequence: Synthetic coding sequence
atgatttccaccgctccgctgtactccggcgtgcataactggacctcctccgatcgaatccggatgtgcggtattaacgaggaacggagagcccctctttcagatgaggaatcaaccacaggtgactgccagcacttcgggagccaggaattttgcgttagttcgtctttctccaaggtggaattgactgctgttgggagcggctctaatgccaggggcgcagaccctgatgggagtgctactgaaaaacttgggcacaagtctgaggataaaccagatgatcctcagccgaaaatggactacgccggaaacgtggcggaggctgagggctttctagtgcctctgagcagccccggagacggcctgaagctgcccgcttcagattccgcagaagcctccaatagccgggcagattgttcttggactcctttaaatacacagatgtccaagcaagtggattgctctcccgctggagtcaaggccctggactcccgccagggagtaggggagaaaaatacatttatcctggcgacactggggacaggggtcccagtggagggaacgctgcccttagtgactactaacttctcaccccttccagccccaatctgcccccctgcacctggatctgcgtctgttccccattccgtaccagacgctttccaggtgcccctttctgtgcctgcacccgtccctcactcaggcctcgttccggtacaggttgctacaagcgtaccggctccttctcctcctttggcaccagtgccagctctggctcctgcgcctccgagtgtacctacattgatcagcgatagcaatccactctctgtgtccgcaagcgtgctggttcccgttcctgcttccgctccgccatcagggcctgtcccactgtcagcgcctgcaccagcacctctttccgtcccagtgtcagcccctcctctggcgttaatccaagctcccgtacctcccagcgcaccgactctcgtcctcgcgccagtcccaacgccagtcttggcccctatgcctgcatcaactcctccggctgccccagccccacctagcgtgccaatgcctaccccaaccccaagttctggccctccatcgacacctaccttgattccagctttcgcaccaactcctgtgccagcccctacgcccgcacccatctttactcccgctcctacaccaatgcctgccgcaacgccagcagccattccgacctccgcaccaatacccgctagtttcagcctttcacgggtgtgcttccccgcagcacaggctccagccatgcagaaagtccctttatcgtttcagcccggaacagttttgacgccaagtcagccactggtgtatataccccctccttcatgcggacagccattatctgtagcaacattgcccaccaccctgggtgtatcctctaccctcaccttacctgttcttcctagttacctacaggacaggtgtctaccaggcgtcctggcatcccctgagctgaggagctacccatatgccttctcagtagcacgccctctgacatccgacagcaagctggtatccctggaagttaacagactgccgtgcacaagtccttctggaagcacaactacccagccagcgcctgacggagttccgggaccgctggcggacactagcctggtgacagccagcgccaaagtgttgcccacaccacagcctctgctgcctgcgccttctggcagcagtgcgccaccacaccccgcaaaaatgccctccgggaccgaacaacagacagaaggcacttctgtcaccttttcacccctgaagtccccgcctcagctcgagagagaaatggcttctccgccagagtgcagtgaaatgccactggacctgtcctcgaagtcaaaccgccagaagcttcctttacctaatcagcggaaaacacctccaatgccagtattaaccccagtgcacacgtctagcaaggcactgcttagtactgtacttagcaggagtcagcgtacgacgcaggcggcaggtggtaacgtcacatcatgcctgggatctacttcatcccccttcgtgatttttccggagattgtgcgcaacggggaccctagcacctgggtgaagaattccaccgctctgatctctacgatccctggcacttatgtgggcgtcgcgaaccctgtcccagcctcactgcttctgaataaggaccccaatctgggactgaacagggacccacgccacttacccaagcaggaaccaatttctatcatcgatcaaggagagccgaagggcaccggggctacctgtggaaagaaagggtcacaggccggtgccgaaggccagccctcgacagttaaacgatacactccggctcggatcgcccctggcctgcctggctgtcagacaaaagagctgtccctgtggaaaccaaccggccctgcgaatatttaccccaggtgctccgtgaatggaaaacccacatccacccaggtgctacccgtcggctggtccccatatcatcaggctagcttactatccatcggcatcagctcagctgggcagttaactccttctcagggcgctcccatcaggcccactagtgtggtgagcgagttttcaggagttcccagcctttcctcttctgaggctgtgcacgggctgccggaggggcagcctcgcccaggcggatcgttcgttccagaacaagacccggtcaccaagaacaaaacatgtcgcatcgctgccaagccttacgaggagcaagtgaatccagtgttgcttaccctcagcccccagactggaacactggctctgtccgtgcagccctctggtggggatatccggatgaaccagggaccagaggaaagtgagtcacacctgtgcagcgattctacccctaaaatggaaggccctcagggcgcttgtgggctgaaactcgcaggggacaccaagccaaaaaaccaggttctggcaacgtacatgtcacacgaactggtgctggcaacaccacagaacttgccgaaaatgcccgagctgcccttacttccccacgactcacaccctaaagaattgatcctggacgtcgtgccgtcatcgagaaggggttcctctaccgaacggccacagcttggatcacaggtcgaccttggcagggtcaaaatggaaaaagtcgatggagatgtcgttttcaacctagcaacgtgtttccgcgcagacggtctccctgtggcaccacagcgaggtcaggccgaggtgagggctaaggccggtcaggcacgtgttaagcaggagtccgtgggggtctttgcctgtaagaacaaatggcagcctgacgacgtgacagagagtctccctccaaaaaagatgaagtgcggcaaggaaaaggattccgaagagcagcagctccagccccaagccaaggctgttgtgcggtcaagtcaccgcccaaagtgcaggaaactgcccagtgacccacaggagagcaccaaaaagagcccacgaggagcatcggattcaggcaaggagcataacggcgtgagaggcaagcacaaacaccggaagccgaccaaaccagagtctcaatcccccggtaagagggcagatagccacgaggaggggagtctggagaagaaagctaagagctctttcagggactttattccagtggtgctgtccacacgaacccggtcacaaagtgggtccatctgttcctccttcgctgggatggctgattcagatatggggtctcaggaggtgttccccaccgaggaagaagaggaggtcactcctacccccgcaaagcggaggaaggtgcgaaagacccagcgagacactcagtatcgctcacaccatgctcaggataaaagcctgctcagccaggggagacgacacctgtggcgcgcacgtgagatgccatggcgtacggaagcggctcggcagatgtgggatacaaatgaggaggaagaggaggaggaggaggaaggcctgctcaaacgaaaaaagcgtcggaggcaaaagagtaggaaatatcagacaggtgaatatctcaccgagcaggaggacgaacagcgaagaaagggcagagccgacctgaaggctcgaaaacagaagacctcatcatcccagagtctggagcaccggctgcgcaacagaaacctcctgctgcctaataaggtgcaaggaatctcagattcaccgaatgggttcctccccaataacctggaggagcctgcgtgcttggaaaattctgagaaaccctccgggaaaagaaagtgtaaaaccaaacacatggcaactgttagtgaggaagccaaggatgttgttctgtactgtctccaaaaggacagtgaagatgtcaaccaccgagacaatgcaggctacacagctcttcatgaggcctgcagcagagggtggaccgatatcctgaacattctgcttgaacatggggctaacgtaaactgtagcgctcaggatggcacacgtccagtccatgatgcagtcgtgaatgataatcttgaaacaatctggcttctgttatcttatggggctgacccaactctggccacctacagcgggcagacggccatgaagctggcgagcagcgacactatgaagaggtttctctccgatcatctaagcgaccttcagggtcgtgctgagggggaccccggtgtgtcttgggatttttactcgagctcagtgttagaggaaaaagacggctttgcatgtgaccttctccataatccacctggctctagcgatcaggagggggacgatccgatggaggaggacgattttatgtttgaactttctgacaagcctttgctcccttgttataatttgcaggtgtctgtctcacgcggaccgtgtaattggttcttgttttcggacgtcctcaagcgcctgaaactcagcagtaggattttccaggctcgattcccacatttcgaaataactaccatgccgaaggccgaattttatcgccaggttgcgtcatctcagctcttgacccccgctgaacgtcccggtggtttggatgatcggagcccacctggatcgtcagagaccgtggaactggtgaggtacgaacccgatctcctccggctgctgggaagcgaggtggagttccagtcctgcaatagcta

SEQ ID NO: 215892 - DNA, 1260 bp, Artificial Sequence
  Description of Artificial Sequence: Synthetic coding sequence
atgccgctgagtgactttatcctggctctgaaggacaacccctattttggcgcagggttcggcctcgtcggggtgggtactgctctggcactggcacgtaagggagtccagctgggcctggtggcatttcgacgccactacatgattacgctggaagtgccggctagagaccgatcatatgcttggctactgtcctggctgacgcgacattccacccgaacccaacatctgtccgtggaaacttcctatttacagcacgagtctggcaggatcagcactaagtttgaattcgtgccgtcgcccggaaaccattttatatggtaccgcggaaagtggatccgggttgagcggtcccgcgagatgcagatgatcgacctccagactggaaccccttgggagagcgtcaccttcaccgccctggggaccgatcgcaaagtgtttttcaatatcctggaagaggccagagagctcgcattacaacaagaagaggggaagaccgtgatgtacaccgctgttggcagtgagtggcggccttttgggtatccgaggaggcgtcgccctctcaattctgttgtgctacagcaggggttggcagaccggatcgtgcgggacgtccaggagttcatcgacaatcccaagtggtatacggacaggggaatcccatatagaagaggatacctcctgtatggaccacctgggtgcgggaaatcgtcctttattactgcactggccggagagctggagcacagcatttgtctcctgagcctgacagactcatctctgtcagacgatagattaaatcaccttctctccgttgcacctcagcagtccctcgtgcttctcgaagatgtcgacgctgcgttcctaagtcgggatctggctgtcgagaatcctgttaaataccaaggactcgggagattgacattttctggcctcctgaatgctctcgatggagttgcatcaactgaggccaggatcgtgtttatgaccaccaaccacgtcgatcggctggacccagccttgatccggccagggagagtggatctcaaagagtacgtcgggtactgcagccattggcaactgacccaaatgttccagaggttttaccccggacaggctccaagcctggcagagaactttgcagagcacgtactgcgggcaaccaatcagatcagccctgctcaggtgcagggctattttatgttatacaaaaacgatcccgtgggcgctattcacaatgctgaaagcttgcgacggtag

SEQ ID NO: 215893 - DNA, 1260 bp, Artificial Sequence
  Description of Artificial Sequence: Synthetic coding sequence
atgccactcagtgatttcatcctggcactgaaggataacccatatttcggagcaggctttgggctcgtcggtgtcggcaccgctctcgccctagccaggaagggggtccagctgggactggtggccttccgcagacactatatgattactcttgaagtgcctgctcgcgatagatcctacgcttggctcctctcctggctcaccagacacagcactcgcactcagcatcttagcgttgagaccagctatttgcagcacgagtccggacgtatatcaacgaaattcgagttcgtcccttcaccagggaatcatttcatttggtatagaggtaaatggattcgggtcgaacgtagcagggagatgcagatgatagatttacagaccgggactccctgggaaagtgtgactttcaccgccctgggcacagatcggaaggttttttttaatatcctggaggaggcccgagaactggccctacagcaggaagagggaaaaacagtgatgtacactgcagtggggtccgagtggagaccctttggataccctcggaggagaaggcccctgaattctgtcgtattacaacaagggctggctgaccgcattgtgcgggatgtgcaggaatttatagacaaccccaagtggtacactgatcgcggaatcccctatcggaggggctacctgctctacggccctcctggctgcggcaaatcaagttttatcacagccctggctggtgaattagaacacagtatctgccttctcagcctcaccgattcctctttgtctgacgatcggctgaatcatctcctgagtgtcgcaccacagcagtccttggttctgctggaggacgttgacgcagccttcctctccagggacttagcagttgagaacccggttaagtatcagggccttggtcggctgaccttctctgggctccttaatgccctcgacggtgtagccagtacagaagctcgtatcgtcttcatgacaactaatcacgtggacaggctggaccctgctcttattagaccgggtcgtgtggatctaaaagaatacgtgggctattgctctcactggcagttgacccagatgttccagaggttttaccctggacaagcgccaagcctggcagagaatttcgccgagcatgttctccgtgcaactaatcagattagccccgcacaggttcagggttatttcatgctgtataaaaacgatcccgtgggagcgattcacaacgctgagtctctgagaaggtag

SEQ ID NO: 215894 - DNA, 1260 bp, Artificial Sequence
  Description of Artificial Sequence: Synthetic coding sequence
atgcctttatccgatttcattctggcgctgaaagataatccgtatttcggggctggattcgggttggtgggagtgggcacggcacttgccttggcccgaaagggtgtgcaactggggctggttgcattcagacgacattacatgataacactcgaagtgcctgcccgagatcgatcttatgcctggttgctgtcctggcttacccggcactccaccaggacacagcatctgtctgtggaaacctcctaccttcagcacgagagtggacgtatatctactaaattcgagttcgtccctagccctggtaaccactttatatggtaccgcggaaagtggattcgtgtcgagcgtagtagagaaatgcagatgatcgatctccagactggcacaccttgggaatccgtgacattcacggctctgggaacggaccggaaagtgttcttcaacattcttgaggaggccagggaactcgccctacagcaggaggaaggtaaaactgtgatgtataccgccgtgggaagcgagtggcggcctttcggctacccaagacggagacgaccactgaatagtgtggtattacaacagggcctagcagataggatcgtacgcgacgtgcaggagtttatcgacaatcctaaatggtataccgaccgtggaatcccgtacaggcgtggctatctgttatacggcccacccggatgtggtaaatccagcttcattaccgctctagccggagagctggaacacagtatctgcttactgtctcttaccgatagctcactgagcgacgacagactaaatcatctactatcagtcgcccctcagcagtcactggtactactggaggacgtcgatgctgcctttctgtcaagagatctggctgtcgagaatccagtgaagtatcaaggtcttggacggttgacattctcaggactcctgaacgccctggatggagtggcgtcaactgaggcccgtattgtgtttatgacaacaaatcatgtggaccgacttgacccagccttgattaggccaggcagagtggatctgaaggagtacgtaggctactgctcccattggcaactcactcaaatgtttcagcgcttttaccccggacaggctccatcacttgccgagaatttcgccgagcacgtgctccgcgcaaccaaccagatttcaccagcccaggtacagggttacttcatgctgtacaaaaacgaccccgtaggcgctatccacaacgccgaaagcctcagacgatag

SEQ ID NO: 215895 - DNA, 1260 bp, Artificial Sequence
  Description of Artificial Sequence: Synthetic coding sequence
atgccattgtctgattttattctggcactgaaagacaacccttatttcggcgctgggttcggccttgtgggagtgggaacagccctcgccctggcacgaaaaggggtccaattaggcctggttgcattccgcagacactatatgataactctggaagttccagcgagagaccgcagttatgcatggttacttagctggctcacaagacacagtactaggacacagcacctgtccgtcgagacatcttatctgcagcacgagtccggcagaatcagcaccaagttcgagtttgtcccaagccctgggaatcatttcatttggtacagaggcaagtggattcgggtggagcgcagtagagaaatgcagatgatcgatctgcagacgggtactccttgggagtctgtaacatttacagcgcttgggactgacaggaaggttttcttcaacattcttgaagaagcgagagaactggctctgcaacaggaggaagggaaaacggttatgtatacagcagtgggctctgaatggcgacccttcggatacccgaggcgcagacgccctctgaactccgtggtcctccagcagggactggctgatcgaatagtccgggatgtccaggagtttatcgacaatcccaaatggtacaccgataggggaatcccataccgacgcggatacttactctatggccctccaggctgcggaaagtcaagctttatcaccgctcttgctggcgaactggaacactctatttgcctgctgtccctgaccgattctagtctgagcgacgatcgtctcaaccacctcttgagcgtggcaccacaacagagcctcgtccttttggaggacgtcgacgccgcattcttaagcagagatctggctgttgaaaatcctgtcaagtatcaaggacttggcaggctaacattcagcgggttgctcaacgccctcgacggggtagcaagtactgaagccaggatcgtgtttatgacgactaaccacgtggaccggctggatcccgctctcattcgcccaggcagggtggatctcaaagagtacgtggggtactgcagccattggcagctgacccaaatgttccaacgcttctatcccggacaggcaccctccctcgcagaaaattttgccgaacatgtacttcgggcaaccaatcagatctcccctgcccaagtgcagggatatttcatgttgtataaaaatgaccccgtcggagcgattcacaatgcagaaagcctccgacggtag

SEQ ID NO: 215896 - DNA, 1260 bp, Artificial Sequence
  Description of Artificial Sequence: Synthetic coding sequence
atgcccctgagcgatttcatccttgccctgaaagacaatccctatttcggagccggtttcggactggtgggagtgggcaccgcccttgctctggcgaggaagggagtgcaactaggtctggtggcttttcggcgtcactacatgatcacccttgaagtgcccgctcgggatcggtcttacgcttggcttctctcctggctaacaagacattctacaaggacgcagcatttatctgtggagacctcctatctgcagcatgagagcggacggatctcaaccaaatttgagtttgtgcccagcccagggaatcatttcatctggtaccgcggaaagtggatcagggtcgagaggtctagagaaatgcagatgatagaccttcagacgggcaccccatgggagtcggtgactttcaccgcactgggcaccgaccggaaagtgttttttaacatcttggaagaagcacgcgagctcgcgcttcagcaagaggagggcaaaacagtgatgtacacggctgtaggatccgagtggaggccatttgggtatccaagacgccgaaggccactgaactccgtggttctgcagcagggcctggccgatcgaatagtacgcgatgtgcaggagttcatagataacccaaagtggtatactgatcgcggaattccttatcgacgcggttatctgttgtatggcccaccaggctgcgggaagtcttctttcattaccgccctggccggagaactggagcattccatttgtctgctgagtcttactgacagcagcttgtcagatgatcggctgaatcatctgctgtccgtggctccccaacagtcccttgtgctgcttgaagatgtggacgccgcttttctcagtagagatctcgcagtggaaaacccggtcaagtatcagggattgggaagactaacgtttagtgggttgcttaacgctctagacggggtggcctctacggaggccagaatcgtgtttatgaccacaaatcacgtggacagactcgaccccgcactgatcaggcccggacgggttgatcttaaggagtatgtcggatattgttctcattggcagcttacgcagatgttccagcggttttaccctggccaggctccttccctagccgaaaatttcgcagaacacgtattgcgtgctaccaaccagataagtcccgcacaagtgcagggatatttcatgctatataaaaacgacccggtaggagcaattcataacgctgaatctttgagaagatag

SEQ ID NO: 215897 - DNA, 333 bp, Artificial Sequence
  Description of Artificial Sequence: Synthetic coding sequence
atgccccttagcgactttattctggcactgaaggataatccttactttggagccggatttggactcgtgggcgtgggtactgccttagccctagccagaaagggtgtgcagctgggattggttgcattccggagacactatatgattacactcgaggtaccagccagagaccgcagctatgcttggctgctctcctggcttactcgccacagcaccagaacccagcatctctccgttgaaacgagctacctgcaacatgagagcggccgaataagcactaagttcgaattcgtaccctcccccggaaaccactttatttggtacaggggatag

SEQ ID NO: 215898 - DNA, 234 bp, Artificial Sequence
  Description of Artificial Sequence: Synthetic coding sequence
atgcccttgtctgacttcattctggcactgaaggataatccctattttggcgctggattcggcttagttggcgtgggaaccgccctagcactcgctcgaaagggtgttcagctggggttggtggcgttccggcgtcactatatgattacgctggaagtgccagctagagataggtcttacgcctggctactttcctggctgacacggcactcgacccggactcagcacctgtag

SEQ ID NO: 215899 - DNA, 621 bp, Artificial Sequence
  Description of Artificial Sequence: Synthetic coding sequence
atgcccctgagtgacttcattcttgcactcaaggacaacccttacttcggggcaggcttcggtctggtgggcgtcggaactgcattagccttagctcggaagggagttcagctgggactcgtggccttccggagacattatatgataaccctagaggttccagcacgggaccgcagttacgcttggctgctttcctggctgacacgccattcaactcgtactcagcatctctctgtggagacctcgtatctccaacacgagagcggcaggatttccacaaaatttgagttcgttcctagccccggaaaccattttatttggtaccgaggcaagtggattcgcgttgaaagatccagagagatgcagatgatcgatctgcaaacaggcactccgtgggaaagcgtgacattcactgcgctaggcacagaccgaaaggtattctttaacattctcgaagaggctagagaattggcgttgcagcaggaagaggggaaaactgtcatgtacacagctgtagggtcagaatggcggccattcggataccctagaaggcgcaggcctctcaacagcgtggtgctacagcagggcctggcagacagaattgtgagagatgtacagtag

SEQ ID NO: 215900 - DNA, 1260 bp, Artificial Sequence
  Description of Artificial Sequence: Synthetic coding sequence
atgcccctgtccgacttcatactagcactcaaggacaacccttatttcggagcaggattcgggttagtcggagtgggcactgcacttgcgttggcgagaaaaggagtccagttagggctggtcgcttttcgccgacattatatgattacattagaggtcccggcacgggatcggagctacgcttggctacttagttggctcacccgacactctactagaacccagcatctgtcagtcgagacctcttacctccaacacgagagcggacgcataagcacgaaatttgaatttgtcccctccccgggtaaccacttcatctggtatcggggtaaatggataagggtcgagaggtcgagggagatgcagatgatcgacctccagactggaactccttgggaaagtgtcactttcactgccttgggcaccgatagaaaagtgttctttaacattttagaagaagcaagagagctcgcccttcagcaagaagaggggaagacggtgatgtacacagcagtgggcagcgagtggaggccctttggctatcccagaagaagacgccctttaaattcagtggtcctgcagcaaggtctggccgaccgtatagtcagagatgtgcaagagttcatcgacaaccccaagtggtacaccgatagaggaataccgtatcgccgaggatatctgctttacggtcccccagggtgcggaaagagctcatttatcaccgctctggcgggtgagttagagcattccatttgtctgttgtcactaacagattcatccctgtccgatgacaggttgaaccatcttctgtccgtggcaccgcagcagagcttggtgctcctcgaagatgtggatgcagccttcttgtcacgtgacctggctgtcgaaaaccctgtgaagtaccagggtttggggagactcacatttagcggcctcctgaatgccctggatggtgtcgcctcaacggaagctagaattgtgtttatgactacgaaccatgtggacaggctggatcctgccctcataagacctggccgtgtggatctgaaagagtacgtgggctactgcagccactggcagctgacccaaatgttccaacggttctatcctggccaggcccctagccttgccgagaacttcgctgagcatgttcttagagcaactaaccaaatctcgcccgctcaggtccagggatatttcatgctctacaaaaacgacccggtgggagccatacacaacgcagaaagcttgaggcggtag

SEQ ID NO: 215901 - DNA, 1260 bp, Artificial Sequence
  Description of Artificial Sequence: Synthetic coding sequence
atgcctctgtctgactttatacttgcactgaaggacaatccttacttcggggcaggctttggcctcgtcggagtgggcaccgctttggccctggcgcgaaaaggtgtgcagctgggattggttgcattccggagacactacatgatcacactggaggtgccagccagggataggtcttatgcctggctgcttagttggttgacccgccactccactaggactcagcatcttagtgtggaaacgagctacctgcagcacgagtctggaaggatctctaccaagtttgaatttgtaccttcaccaggcaaccattttatatggtacagggggaagtggattcgggtagaaaggtcaagagagatgcagatgatcgatctgcaaacgggaacgccgtgggaatcagttaccttcaccgctctcggcacagataggaaagttttcttcaatatccttgaggaagcacgcgagctagcattacaacaggaagagggcaaaaccgtgatgtatacagccgtcggatccgagtggcggcctttcggatatcccagacggcgacggcctctgaattctgttgtactccagcaaggccttgccgaccggatcgtacgggacgtgcaggagttcatagataacccaaagtggtacacggatagaggaattccctacagacgcggatatttgctatacggccctccgggttgcgggaaaagtagtttcatcactgccctcgctggagagctggagcactctatttgcctgttgagcctcaccgatagctccctcagcgacgacagacttaatcatctgctgtcagtcgctccccagcagtctcttgttctgctggaggatgtagatgctgcgtttctgtcacgtgacctggcagtcgagaatccggttaagtatcagggacttggcaggctgacattctcgggacttcttaacgctctggacggggtagcatcaactgaggctaggatcgtatttatgaccaccaaccacgtcgacagactggatcctgcgctgatcaggccaggtcgagtggatctgaaggaatacgtgggctattgttcacactggcagcttactcaaatgttccagcggttttacccaggacaagctccgtccctcgccgagaactttgccgagcatgtgttgcgagccaccaaccagataagtcccgctcaagtccaaggatatttcatgctgtataaaaatgaccccgttggcgctatccacaatgctgagtcattacggcgttag

SEQ ID NO: 215902 - DNA, 621 bp, Artificial Sequence
  Description of Artificial Sequence: Synthetic coding sequence
atgccgctatctgactttatactcgccttgaaggataatccatattttggggctggattcgggctggtcggggtaggaactgctctcgctctcgcgagaaaaggggtccaactgggactggttgctttccggagacactacatgatcacgttggaagtacccgctcgcgaccgttcgtacgcatggcttttaagctggttgacgagacatagtaccaggacccagcatttgagcgtcgagacatcctatctgcagcacgagagcggacggattagtactaagttcgagttcgtcccatcgcccggaaaccatttcatctggtacagaggtaaatggattagggtcgaaaggagcagagaaatgcagatgatcgacttacaaacaggtaccccatgggaaagcgtgacctttacagctctgggaactgatcgcaaagtgtttttcaacatcctggaagaagcccgtgaattggccctgcagcaggaagaagggaagaccgttatgtacacagccgtcggatccgagtggagaccctttgggtacccacgtcggcgaagacctcttaattctgttgtactacaacagggtctggccgatcggatcgtccgggacgtgcagtag

SEQ ID NO: 215903 - DNA, 1623 bp, Artificial Sequence
  Description of Artificial Sequence: Synthetic coding sequence
atgtatgaaaacgagtgtgaatgtcagttgttactgaaagaaatgctcgagcgccttaataaggaggccgacgaggcgctcctgcacaaccttcgacttcagttggaagcgcagttcttacaggatgacataagcgcagcaaaagatcggcacaaaaagaatctcttagaggtccaaacgtatattagcatcctccagcagattatacataccacaccccctgcatctatcgttacttccgggatgcgcgaagagaaattactaaccgaacgcgaagtggcggctctacgtagccagctggaagagggcagggaggttttatcccacctgcaagcgcagagggtggaactgcaggcgcagacaacgactctggagcaggctattaagagtgctcatgagtgttatgacgatgagattcagctctataatgagcagattgaaacgcttcgaaaggaaattgaggagacagagcgcgtcctggaaaaatcttcatacgactgccgccagttagctgtggcgcaacaaaccctgaagaacgaacttgatcgttaccacagaatcattgagatcgaggggaatcggctgacaagcgcttttatcgaaacacctattccactgtttactcaaagccacggcgtgtccttgtcaacgggctctggaggtaaggatctcacgcgcgctcttcaggacatcacggccgctaagcccaggcagaaagcactccctaaaaatgtgcccaggaggaaagagatcataaccaaagataaaaccaatggcgctctcgaggatgctcctctaaagggactagaggacaccaagttggtgcaggttgtgctgaaggaggagagtgagtccaagttcgagtcagagtccaaagaggtctcaccactcacgcaggaaggcgctcccgaggatgtgcccgatggcggtcagatcagcaagggtttcgggaagctgtatcggaaggtgaaagagaaagttcggtccccaaaggagccggaaacccctaccgaactttacaccaaagagcgccatgttttggtgacaggggatgcaaactatgtggaccctaggttctacgtttcttccattacggccaaggggggagtggctgtgagcgtggccgaagatagtgtgctctacgatgggcaggtggagcctagcccagagtccccaaaaccccctctcgagaacggccaggtgggccttcaagaaaaggaggatggccagcctattgaccagcagccaattgacaaggaaatagagccagacggtgccgaacttgagggtcccgaggaaaaacgagagggtgaggaacgagacgaagagtcccgtcgcccatgcgctatggtcacccctggcgcagaggaacccagcattccggagcctcccaaaccagccgcagaccaggacggcgcagaagtcctcggcactcgctcccggagcttgcccgagaaagggccaccgaaggcactcgcatacaaaacggttgaggtggttgagtctatagaaaaaatcagtactgagtctattcaaacatatgaagagaccgccgtgattgtcgaaacaatgattggaaagaccaaatctgacaagaagaaatccggagagaaatcatcctag

SEQ ID NO: 215904 - DNA, 1998 bp, Artificial Sequence
  Description of Artificial Sequence: Synthetic coding sequence
atgtaccgcaggagctatgtgttccagactaggaaagagcagtatgaacacgccgacgaggcctcaagggccgcagagcctgagaggccggctgacgagggttgggccggagcaacctctcttgccgctttgcagggattaggagagagggttgcggctcatgtgcagcgggctcgcgctttggaacaaaggcatgccggactgcgaaggcagctcgatgcatttcagcgactaggcgagctggccggacctgaggatgccctggccagacaggtcgagtccaatagacagcgagtgcgagatctggaagccgagcgtgccaggttggagcgtcagggcaccgaagctcaaagagccctggacgaatttaggtccaagtatgaaaatgagtgcgagtgtcagctgctcctgaaggagatgctagaaaggcttaacaaagaagccgacgaggccctgcttcacaaccttagactgcagctcgaagctcaatttttgcaggatgatatatccgcggcaaaagatcggcacaagaaaaacctgctcgaggttcagacgtacatttcaatcctccagcagataatccatacaactccccctgccagtattgtcacttcagggatgcgagaagagaaacttctcaccgaacgcgaagtggccgcactgaggagccaactggaggagggcagggaggtgttatcccatctgcaagcacagcgcgttgagctgcaagcccagaccacgaccttggaacaggccataaaaagtgcccacgagtgctatgacgatgagatccagttgtacaatgagcagatagagacacttcggaaagagatagaagagaccgagcgagtgcttgagaagtcgtcatacgactgccgtcagctcgcggtcgcccaacagactctgaagaatgagctggacaggtaccacaggataatcgaaatagagggcaatcggctgaccagcgcttttatagagactcccatccctttgtttacccagtcacacggagtctcactgagcacagggtcgggcggaaaagacttgacccgggctttgcaagacatcactgccgcaaaaccccgacagaaggctctaccaaagaacgtcccaaggcggaaagagatcattaccaaggacaaaaccaacggagctctggaggacgctccactgaagggcctggaggataccaagcttgtgcaggtggtgctgaaagaagaatctgagagcaagttcgaatctgagtctaaggaagtttcccctctgacccaggaaggggcacctgaggacgtgcccgacggcggacagatttcgaagggttttggcaagttgtaccggaaagtcaaagagaaggtgagaagtcccaaggaaccggaaacccctacagaactctacacaaaggagagacacgtcctcgtgaccggcgacgccaattacgttgacccacggttctatgtctcctctattacagccaagggaggagtagcagtgagcgtggctgaggattctgttctgtatgacggtcaggtggagcccagtccagaatcccctaagcctcccctcgaaaacgggcaggtaggattacaagagaaagaagacgggcaacccattgatcagcagcccatcgataaagagatcgaacctgacggagctgaactggaaggccctgaagaaaaaagggagggagaagagagagacgaggagtcccgtagaccctgtgcaatggtaacacccggagccgaggagccctcaattccagagcctcccaagcctgcagcagaccaagacggtgctgaggtgctgggaactagaagtaggtcgctgcccgaaaaaggaccacctaaagctctggcgtacaagactgtggaagtggtggagtctatcgaaaagattagcactgagtccattcagacctatgaggaaaccgcggttattgttgaaacaatgattggtaaaacaaaatccgacaaaaagaagtcgggcgaaaaaagcagttag

SEQ ID NO: 215905 - DNA, 1581 bp, Artificial Sequence
  Description of Artificial Sequence: Synthetic coding sequence
atgctcgagcgcctaaataaggaggctgacgaagctctactgcacaacctgaggctgcagctagaggcccagttccttcaggatgatatctctgcagccaaagacaggcacaaaaagaacctgttagaggttcagacgtacatttcaatactacagcagatcatccatacaacccctccggcttctatcgtgactagtggcatgcgagaggagaagctgttgactgagcgggaagtcgctgccctgagatcacaattagaggagggcagggaggtcttgtcccatttgcaggctcagcgtgtggaactgcaggcacagacgactactctggagcaggcgattaaatccgcccacgagtgctatgatgatgagatccagctgtacaacgaacaaatcgagacgttgaggaaggagatcgaagagacagagcgggtgctggagaaaagctcttacgactgccgtcagctcgccgttgctcagcagaccctgaaaaacgagctagacagatatcatagaatcattgagattgaagggaaccggttgactagtgccttcattgaaactccaatccccctatttacacagtctcacggcgtatctctatctactggatcagggggaaaagacctgaccagagctctgcaggatatcactgctgcaaagcccaggcagaaggcccttcccaagaatgttcctaggagaaaggaaatcatcaccaaagacaaaactaatggcgctctggaagacgcccctctgaaggggcttgaggataccaaattagtgcaggtcgttctaaaggaagaaagcgagagcaaatttgaaagtgagtcaaaggaggtgtccccactcacccaggagggtgcccctgaggatgtgcctgacgggggtcagataagcaaggggttcggaaaactgtaccgcaaggtaaaagagaaggtgcgctcccccaaggagcctgagacccctacagaactatatacaaaggaaagacatgtattggtcacaggcgacgctaattatgtcgaccctcgtttctatgtttcttctatcactgccaagggcggtgtcgccgtctccgtcgccgaggacagtgttctttatgacggacaggtggagccttcccccgaaagtcccaagccaccactggagaatggacaagttggtctccaagagaaggaggacggccagcccattgaccaacagcctattgacaaggaaatcgagccagacggggcagagctggagggccctgaggaaaaaagggagggtgaagagcgtgatgaagaaagtcggaggccgtgtgctatggtgaccccaggagccgaggaacctagcatcccagagcctcccaaacccgcagccgaccaggacggggctgaagtgctggggacaagatcccgaagccttcccgaaaagggccctcctaaagcgctggcttacaagacagtagaagtcgtggaatccatagagaagatttccaccgagtcaattcagacttacgaggaaacagccgtaatagtcgagactatgattggcaagactaagtcagataaaaagaagagtggtgagaagtcctcctag

SEQ ID NO: 215906 - DNA, 1581 bp, Artificial Sequence
  Description of Artificial Sequence: Synthetic coding sequence
atgctagaaagactgaataaagaagccgatgaagccttgttgcacaatttgcggttacagctggaagcgcagttcctgcaagatgacatttctgcagccaaagaccgccacaagaagaatctgctggaggttcagacttatatctctatattacaacagatcatccacaccaccccccctgccagtatcgtgacctccggaatgcgagaggagaagctcttgacggagcgtgaagtggctgccctccggtcccagcttgaagagggacgagaagtgctgtcacacctgcaagcacagcgggttgagctgcaagcgcagacaacgacactcgagcaggccataaaatccgcacacgagtgttatgacgacgagatccagctgtacaatgaacaaattgagacactcagaaaagaaattgaggagaccgaaagagtccttgagaaaagctcgtacgactgcaggcaattggctgtggcacagcaaaccttaaaaaatgagcttgatcgataccacagaatcatagaaatcgagggaaatcgtctgaccagcgcattcatagaaaccccgatccccctgttcacccagtcccatggagtgagtctgtctacaggtagtggcggaaaggacctcacccgagcgctgcaggacatcacggctgctaagccacgccaaaaggcactgcccaagaatgtgcccagacgcaaagagatcatcaccaaggacaagacaaatggcgctctcgaagacgcccctctcaagggtctcgaagataccaaattagttcaagtcgtgcttaaagaagagagcgagagtaaatttgaatccgagtccaaagaagtgagccccttgacacaagagggagcgccagaggatgtccctgatggcggacaaataagtaagggattcggcaagctctaccggaaggtgaaggaaaaagtgcggagccccaaggaacctgagacacctactgaactatacacaaaagagcggcacgtgctggtgactggggatgctaactatgtcgaccccagattctatgtgtccagcatcactgccaagggaggggtagccgtatctgtggcagaagacagcgtcctctatgatggacaggtggagcccagccctgagagcccaaagccccctctggagaacgggcaagtcggactccaagagaaggaagatgggcagccaattgaccagcagcctatcgataaggagattgagcccgatggagcggagctcgaaggacctgaggaaaagagggaaggagaagagcgggatgaggagtcccgacgaccatgtgcaatggtgacgcccggagccgaagaaccctccatacccgaaccgccaaagcccgctgcagaccaagacggggcagaagtgctaggaacgcgtagccggtccttaccagaaaagggacccccaaaagctctggcctacaaaacagtggaggtcgtagagagcatcgaaaagatctccacagagtccattcagacctacgaagagaccgccgtaatcgtcgagacaatgataggaaagactaagtctgacaaaaagaagagtggtgagaagagtagctag

SEQ ID NO: 215907 - DNA, 1248 bp, Artificial Sequence
  Description of Artificial Sequence: Synthetic coding sequence
atgtctgagagacgcgttgttgtcgacctgcctactagtgcatctagttccatgccgttacagcgcagacgggcaagttttcgtggcccacgctcctccagttcactcgaatccccacccgcatctcgaacaaatgctatgtccggattggttcgcgctccaggtgtgtacgtgggaactgccccttctggctgcattggcggattgggagcacgggttactcggagggccctcggaattagctcagttttcctgcagggcctcagaagctctgggctggcaacggtgcctgcacccggtctggagcgagaccatggggcagtggaagatctcggtgggtgtctggtggaatacatggccaaggtccacgcgctagagcaggtctcacaggaactggagactcagttgcgcatgcatctggagagtaaagccacaagaagcggtaactggggagccctgcgagcgtcctgggccagctcttgccagcaagtgggggaagcagtgctggagaatgcccgtctgatgttacagactgagactatccaagcaggggctgatgactttaaagagcgctacgaaaatgagcagcctttcaggaaggcagcagaggaagaaatcaatagcctgtacaaggtcatcgacgaagcgaaccttacaaagatggatctggagtctcagattgagagtctgaaagaagagcttggcagcctaagccggaactacgaagaagacgttaagttgctccacaaacagctagcgggttgcgagcttgagcagatggatgcaccaattgggaccggactggatgatatcctagaaactatacgtatccagtgggaaagggacgtggagaagaaccgggttgaggcaggtgctctactgcaggctaagcagcaagccgaagtcgcccacatgtcccagacccaggaggagaagctcgcagccgcactccgtgtggagctccacaataccagctgtcaagtacagagtctgcaggcggagacggagtccctgcgagcactaaaacgaggtctggagaacactctgcacgatgcaaaacactggcacgatatggagttgcagaaccttggggcagtggtgggtaggctcgaagcggagctgcgagagatcagagctgaagccgagcagcagcaacaggagagagcacacctcctcgctagaaagtgccagctgcagaaggacgtcgccagctaccacgccctgctcgaccgggaggagtcaggatag

SEQ ID NO: 215908 - DNA, 1353 bp, Artificial Sequence
  Description of Artificial Sequence: Synthetic coding sequence
atggaaggttcaaaaacttctaacaactcaacaatgcaggtgtctttcgtatgtcaacggtgttcacagcctttgaaactcgacacgtcttttaagattttggatcgggtgaccattcaggaactaacagcaccactgctaaccaccgcgcaggcaaaaccaggcgagacacaggaggaggaaacaaattcaggcgaggagcctttcattgagactcccaggcaagacggcgtgagccggaggtttattccacctgccagaatgatgtctactgaatccgctaatagctttacactcattggcgaggcatctgacggaggcacgatggagaatctttccagaagactaaaagtgaccggggatctgttcgacatcatgtccggccagacggatgttgatcacccgctgtgcgaggagtgcactgatactctcttagatcaactggacacccaattaaatgtgaccgaaaacgagtgtcagaactacaagaggtgtctggagattttggaacaaatgaatgaagatgacagcgagcagctccaaatggaactgaaagaattggccctggaggaagagcggttaatccaggagcttgaagatgtggaaaagaatcgaaagatcgtcgccgagaatctggagaaggtccaggccgaagccgaacggcttgatcaggaggaggcccagtaccagcgggagtactctgaatttaaacgccagcagttggagttagacgatgagctgaagtccgtcgaaaaccagatgcgatatgcacagacccagctcgacaagctgaaaaagacaaacgtgttcaatgcaacttttcacatttggcactctggccagtttggcacaatcaacaacttccgcctgggtaggcttcccagtgtgcctgttgaatggaatgaaatcaatgcagcttgggggcaaacagtgctgctgcttcacgcccttgcaaataagatgggactcaagttccagaggtacaggctagtaccctatgggaaccattcatacctggagagcttaactgataagtccaaagaactcccgctgtactgcagcgggggactgaggttcttctgggacaataaattcgatcacgcgatggtggcgttcttagactgcgtacaacagttcaaggaagaggtggagaagggagagacccgcttttgtctaccataccgcatggatgtcgagaagggaaagatcgaggatacgggcggatccgggggatcatactccatcaaaacccagttcaattccgaagaacagtggaccaaagccctaaagtttatgcttaccaacctcaaatggggacttgcatgggtttccagccagttttacaataagtag

SEQ ID NO: 215909 - DNA, 840 bp, Artificial Sequence
  Description of Artificial Sequence: Synthetic coding sequence
atggaaggctctaaaacatctaacaattctactatgcaggtctctttcgtatgtcaacggtgtagccaacccctcaagctggacacatcttttaagatactggaccgggtgacgatccaagagctcacagccccattgctgacaaccgcacaggccaagcctggcgagacgcaggaagaggagaccaacagcggggaagagccattcattgaaacccctcgccaggacggcgtgtcacggcgattcattccgccagcacggagatgtctggagatactagaacagatgaatgaagacgattcagaacagcttcagatggagctcaaggaactagccctggaagaggagaggttaatccaggagctggaggacgtcgagaaaaaccggaagatcgttgcagagaatctggagaaggtacaggccgaagctgagagattagaccaggaggaggcccagtaccagcgcgagtatagtgaatttaaacgacaacagctggagttagatgatgagctgaaaagcgtggagaatcagatgaggtatgctcagactcagctggataaactgaagaaaacaaacgtgtttaacgccacttttcacatttggcacagcggccagttcgggactatcaacaactttcgattaggtaggctccctagcgtgcccgtcgaatggaacgagattaatgcagcttggggacaaacagtcctcttgctccatgctctggccaataagatgggactcaaatttcagagatataggctagtgccttacggtaatcattcttaccttgagtccctgactgataaaagtaaagacggctgcggtgaacggcaggactag

SEQ ID NO: 215910 - DNA, 1092 bp, Artificial Sequence
  Description of Artificial Sequence: Synthetic coding sequence
atgatgtccacagagagcgcaaattcattcacactgataggcgaggcaagcgacggcggaaccatggagaatttgtccagacgcctgaaagtgaccggcgacctctttgatatcatgagcggtcagaccgacgtggaccaccctctatgtgaggagtgtacggataccctcctggatcagttagacacccagctgaatgtgacggagaacgagtgccagaactataagcggtgcctggaaattctggagcaaatgaacgaggatgatagcgagcagctgcagatggaattaaaagagctcgctctggaggaggaacgcttaatccaagagcttgaagacgtcgaaaaaaacagaaagattgttgctgagaacttggagaaggtgcaggccgaggctgagagactcgaccaggaggaagctcagtaccagcgggagtacagtgagtttaaacggcaacaacttgagttggatgacgagttaaaatctgtcgagaatcagatgcggtacgcccagacacagttagataaactcaaaaaaacgaatgtgtttaatgccactttccacatctggcactctggacagtttggcactatcaataatttccgccttggcaggttacctagtgttccggttgagtggaacgaaattaatgcagcttggggccagacagtgctcctcctgcacgccctggcgaataagatgggcttaaaatttcagcggtataggctcgtaccctatgggaaccactcatatttggagtccctcacagataaaagcaaggagcttcctctttactgttccggcggtctgcggttcttttgggacaacaagtttgaccacgccatggtggcttttttagattgcgtgcagcagtttaaagaggaagtggaaaagggggaaacacggttttgtctgccgtataggatggacgttgaaaaaggcaagatagaggatacggggggtagtggagggtcctactccatcaagacgcagttcaattctgaggaacagtggactaaggccttgaagttcatgctgaccaacctgaagtggggtctggcatgggtgtcgtcgcagttctacaataagtag

SEQ ID NO: 215911 - DNA, 5393 bp, Artificial Sequence
  Description of Artificial Sequence: Synthetic coding sequence
atggaacagctaacaactctgccacggccaggggatccaggcgcaatggaaccgtgggcactgcctacatggcatagctggacccctgggcgaggcggagagcctagctcagcggctccctccatcgctgacacacctcccgcagcactgcaactgcaggaactgcgatctgaggagtcttctaaaccaaagggtgatggatccagcagacccgtgggcggtactgacccagagggcgcagaggcttgtctccccagcttaggacagcaagccagcagcagtggaccagcatgccagcggcctgaagatgaagaggtggaggctttcctaaaagctaagctaaacatgtcctttggagacaggcccaacctcgagctgttgcgtgctctgggtgagctgcggcaaagatgcgctattctgaaggaagaaaaccagatgctgagaaaaagctctttcccagagacagaggagaaggtgcggaggctgaaacgcaagaacgccgagctggccgtgatcgctaagaggctggaggaacgggctcggaaacttcaggagacaaacctacgcgtggaaggcccacaatggctgcacgtaagagactttgaccggctcctccgggagtctcagagggaggtgctccggcttcagcgtcaaatcgctttacgcaaccagcgcgaaactttacctctaccaccatcctggccaccgggacccgcactgcaggctcgggcaggtgctccagccccaggcgcacctggcgaggcgactccccaggaagatgctgataatcttccggtgattctaggcgaaccggaaaaagagcagcgggtccaacaactcgaatccgagctgagtaagaagcgcaaaaagtgtgaaagtcttgagcaggaagccagaaaaaaacaacggagatgcgaagaactagaactgcagttgcggcaggcacagaatgaaaacgcccgactcgttgaggagaattccagactgtccggacgtgccactgaaaaggaacaggttgagtgggagaatgccgagctccggggacaactgctaggggtaacgcaggagagagattccgctctacgcaaatcccagggcctgcaatcaaagctggagagcttagagcaggtcctgaagcacatgcgagaggtcgctcagcgcagacagcaactggaagtggagcacgagcaagcaagactgagcctgcgcgagaagcaagaagaagttagaagattgcaacaggctcaggcagaagcccagagagaacacgagggcgctgttcagttgttggagtccacattggacagcatgcaggcacgagtacgtgaacttgaagaacaatgtaggagtcagacagaacagttctccttactggcccaggaattacaggcttttcggctgcatccgggaccccttgacctgttgacctctgccctggactgcggtagtctcggggattgtcctccccctccctgctgttgttccattccacagccttgcagaggttctggccctaaggatctagatcttccgcctggatcccccggacgctgtaccccaaagtctagtgagccagcacctgccactttgacaggcgtgcctaggcggacagcaaaaaaagccgaaagtctatccaactctagccattctgaatctattcataactcacctaagtcatgtcctacccctgaggttgataccgctagcgaagtcgaagagctggaggccgactcggtgtccttgctccccgctgccccagaaggttcacgcggtggcgctagaatccaggtgtttttagcccgatatagctataatccgttcgagggcccaaatgagaaccccgaagcagaactaccgttgacagccggagagtacatttatatctatggcaacatggacgaggatggattctttgaaggtgagctcatggacggccgacgtgggctggtcccttcaaattttgttgagcgcgtgtccgacgacgacctgctcacctcacttccacctgagttggcggatctttcccatagttcaggacccgagctgagcttcctgagcgtcggaggcggagggtcctcgagcggcggtcagtcttcagtaggacgatcccagccacgtcccgaggaagaggacgcgggtgatgagctgagtttatcaccgagtccagagggcctcggcgaacccccagccgtgccgtatcctcgcaggctcgtggtgctaaagcagcttgctcactcagtggttctggcatgggagccacccccagagcaggtcgaacttcatggattccatatatgtgtcaatggcgagttaaggcaggcactggggcctggggctccacctaaggccgtgctggagaacctggatttgtgggccggtcctcttcacatctccgttcaggccttgacttcgcgaggatcttcagaccctctccggtgctgtctggccgttggtgcacgcgctggggtggtgccgtcacagttgcgtgttcatcgactgacggcaacaagtgctgagatcacttgggtgcctggaaacagcaacctggcgcatgccatttacctcaacggcgaggaatgcccacctgcgtccccttctacctactgggccactttttgtcaccttaggcccggtaccccatatcaggcccaggttgaggcccagttgcctcctcaggggccttgggaacctggttgggagcggttggagcagcgggctgctactttgcaattcactacactcccagcagggccacccgacgctccgctcgacgtgcagatagagcccggacccagccctggaatcctgatcatctcctggctccccgtaactatcgatgcagccggaacctcaaacggcgtacgggtgaccggatatgcaatttacgcagacggtcaaaagataatggaggttgctagccccaccgctggctccgtgctggtggagctctcacagctgcaactgctgcaggtgtgccgggaagttgtggtgaggactatgtctccacatggggagtcagccgattccatcccagcccctattacccctgccctggcacctgcttcgctgcctgcccgtgtatcttgcccgagtcctcacccaagtcccgaggcgagggccccactcgccagcgcttccccaggtcccggagatcctagcagccctctacaacatcccgctcccctggggacgcaggagccgcctggagctccacccgctagtccctctcgtgagatggccaaagggtcacatgaagatccacctgcaccctgttctcaggaggaggccggagccgcagtgttggggacctcagaagaaaggaccgcctctacctccacccttggcgagaaggatcccggaccggcagccccttcactagcaaagcaggaggcagagtggactgccggagaggcctgtcctgcctcatcttcgactcaaggggctagggctcagcaggcacctaacaccgagatgtgtcagggcggagatccaggctctggtctgagacctcgcgcagagaaagaagacaccgcagagctcggtgtccacctggtgaatagtctcgtcgatcatggtaggaactctgacctgtcagatattcaggaggaggaagaagaagaagaggaggaggaggaggaggagttaggatcgcgtacctgcagcttccagaagcaagtggcagggaactctatacgtgagaatggagccaaaagccagcctgatccattttgtgagacagatagcgacgaggagatcctggagcagatactcgagctccctctgcagcaattctgctctaaaaaactgttttccattccagaagaagaggaagaggaagaggaagacgaggaggaagagaaatctggcgcaggttgtagcagtagggatccaggtccacctgagcccgcactactgggactgggatgcgacagcggccagcctcggaggcctggccagtgtcctttatcacccgagagctcgcgggcaggcgattgtttggaagacatgcctggcttagtgggaggatcttctagaagacggggtggaggcagtccagagaaacctccatcacgcagaaggccccctgacccgagggaacactgtagtcggttgctatctaataatggcccacaagcttcaggtcgactgggccctacgagggagcggggaggcctccccgtgatcgaagggccacggactggtttggaggctagcggccgtgggcgtttgggtcctagccgacgatgttctcgcggacgggctcttgagccgggtctcgcctcgtgtctgagtcctaaatgtctggaaatcagtatcgagtatgacagtgaagacgagcaggaggctggatctggaggtattagtattacctcttcatgctaccctggtgacggcgaggcctggggaaccgcgacagtgggacgccctcggggaccgccaaaagcgaacagtggaccgaagccctacccccgactgccggcatgggagaagggagaaccagagaggagagggcgtagtgccacaggacgagctaaggaacctctgagccgtgcgaccgaaaccggcgaagctcggggacaggatgggtcaggaaggcggggaccacagaagaggggagtgagagtcctgcggccttcgactgctgagctggtgccagcgcgatccccctctgaaactctggcataccagcacctcccagtgcgtattttcgttgccctctttgactacgatccagtgagcatgtctcccaacccagacgcaggcgaggaggagcttccatttagggaagggcagatactgaaagtgttcggggacaaggacgctgatggattctatcaaggagaaggcggaggccgaaccggatatattccatgcaatatggttgctgaggtcgccgtggactctccggctggtcgtcagcagttgcttcagcggggttatctcagcccagacattctgctcgagggtagcggaaacggcccatttgtttacagtaccgcccacactaccgggcctccgcctaagccaaggaggtctaaaaaagccgagtccgaaggccctgctcagccttgtcccggtcctccaaagttggtgccctctgccgatctgaaggcaccacattcgatggtggccgcttttgactacaacccgcaagagtctagccctaacatggacgtggaagcggaattgccctttcgggctggcgatgtcataaccgtttttggcggaatggacgacgatggtttttactacggggagctgaatggtcagcgtggccttgtacccagcaatttcctggaaggcccagggcctgaggctggcggactggatcgggagcctagaactcctcaggctgaatcccagaggacacggaggcggagggtgcaatgtta

SEQ ID NO: 215912 - DNA, 5573 bp, Artificial Sequence
  Description of Artificial Sequence: Synthetic coding sequence
atggagcagctgacaaccctgcctcgaccaggcgaccctggagccatggaaccttgggctctgcccacttggcacagttggacacctggcaggggaggcgagcctagttccgctgcgccatcgatcgctgatacaccacccgctgccttgcaacttcaggagctgagatccgaagaaagcagtaagcccaagggggatggctctagccggcctgtcggtggcaccgatcccgaaggagccgaagcgtgcttgcctagtttgggacagcaagctagtagctccggccctgcctgccagcgcccagaagatgaagaggtggaagctttcctgaaagcaaagctgaacatgtcgttcggcgacaggcccaacctcgagctgcttcgtgcccttggggagctgcgtcaacgttgtgccatcctgaaagaagagaatcagatgctcagaaaatcatcctttcccgagaccgaagaaaaagtgaggcggctgaaaaggaagaacgcagagctggcggtcatagcaaaaagactggaggagagagctcgtaagttgcaggaaacaaacctgcgtgtggtctcagcccctctgcccaggcccggtacatctctggaactttgtcgtaaggcactcgctaggcagcgggcacgcgacttaagcgagactgcttccgctctgctagcgaaagacaaacagattgctgcactgcagcgcgaatgcagggagcttcaggctcgactcacactggttggaaaggaaggccctcagtggctgcatgtccgcgattttgatagactcctacgggaaagtcagcgggaggttttacgactgcagcgccagatcgcgctgcggaatcagagagaaaccctccccctgccaccatcttggccgcctgggcctgcactccaggcaagagctggagcccctgctccaggggcacctggtgaggctacaccccaggaagacgcagacaacttaccagtaattctgggcgagcccgaaaaggagcagcgcgtgcagcaactggagtcggaactgagcaaaaaacggaaaaaatgtgaatcattggagcaggaggctagaaagaagcaaaggcgttgcgaagagctggagctgcagcttagacaggctcaaaacgagaatgccaggctagtcgaggaaaattccaggctaagtgggcgagctaccgagaaggagcaggtcgaatgggaaaacgccgaactgcggggtcagcttctcggcgtgactcaggagagggactccgctctccgcaagagccaaggcctacaatcaaaactcgaaagcttggagcaggtgttaaaacacatgagagaggttgcacaaaggcggcagcaacttgaggtcgaacatgagcaggccagactgtctctgcgagaaaaacaggaagaagtacggcgtctgcagcaggcgcaagccgaggctcagagagagcacgaaggcgctgtgcagctgctggagagcactctcgatagcatgcaggctcgtgtaagggagctggaagaacaatgccgaagccaaactgagcagttttctctgctcgcccaagagttacaggcgtttaggctgcatccaggtcctcttgatctgctgacctccgccctggattgcggttcgttaggggactgcccacctccaccttgctgctgctcaatccctcagccctgtagaggatcaggtcccaaggatctggacctaccacctggaagtccaggtaggtgcacccccaagagcagcgagcccgctccagccacactgactggagttcctaggcgcacagccaaaaaggcagaatccctgagtaatagcagtcattctgagtccatccacaattcaccaaagagctgccctactcccgaggtcgacaccgcctcagaagtcgaggaactggaggccgactccgtaagtttgctaccagccgctcctgaaggcagtcgtggtggagcccgaattcaggtgtttctggccaggtactcctataaccctttcgagggaccgaatgagaaccccgaagctgagttgccgcttacagcaggagaatacatatacatttatgggaacatggacgaggacggcttctttgaaggcgagcttatggatggaagacgcggtctcgttccctctaatttcgtggaacgcgtgagcgatgacgacttgctcaccagtttgccaccagaactagcagacctctctcactctagcggtccagagctgtcctttctttccgtggggggaggcggtagctcgtctggcggacagtcatctgtgggtcgctcccagcccagaccggaggaggaggatgctggtgatgaactaagcctgtcgccatcccctgagggtctgggcgaaccacccgctgttccctatcccagaagactcgtcgtgctgaaacagctggctcactccgtggtcctcgcttgggagcctcctcccgaacaggtggaactgcatggtttccacatctgtgtgaacggcgagctcagacaggcattaggtcccggtgcccctcctaaagcagttctcgaaaatttggatctgtgggcaggacctctacacatctcggtgcaggccctaactagtagaggctccagcgaccctttaagatgttgcctagcggtgggggcacgcgcaggtgtggtgccgagccagctcagagttcacaggctgacagctacttctgctgaaataacctgggtgccaggcaattctaacctcgctcacgcgatttacctgaacggggaagagtgcccaccagcttctccatctacgtattgggccacattctgccacctgcgtcctgggacaccctaccaggcccaagtggaggctcaactgccccctcagggaccgtgggagcccggatgggaacgtctggagcagcgggctgctacccttcagttcactactctccctgcgggaccaccagacgcccctttggatgtgcagattgagcccggaccaagccccggaattctcataattagttggctgcctgtaaccattgatgcagctggcacctctaacggggtgcgagttaccggctatgcaatttatgctgacgggcagaagatcatggaagtcgcgagtcccacggccggatctgtcctggtagaactgagtcagctccagctgctgcaagtgtgcagagaggtcgtggttcggaccatgagcccccacggcgagtcggccgattccatccctgcccctatcacaccagcactggcaccagcttccctgcccgctagggtgagctgtccgagtcctcacccctccccagaggcaagggccccattagcctccgctagtccgggaccaggggacccctcatcacccctgcagcatcccgctcctcttggcacccaggagccccctggggctcccccagcgtctcccagcagagagatggctaagggaagccacgaggatccccctgcaccctgctctcaagaggaggcgggtgccgctgtcctaggaaccagtgaagaacggactgcatctacttcgacacttggggaaaaagacccagggccagcggctccgtctcttgccaagcaggaggcagagtggactgcaggtgaggcttgtcccgcttcctcttctactcagggagcacgggcacaacaggcccctaatacggagatgtgtcaaggtggcgatccagggagtgggcttcgtccaagggctgagaaggaagatactgctgagctcggggtgcatctggtcaacagcctggttgaccacggtcggaattctgatcttagcgatatccaggaggaagaagaagaggaggaagaggaagaggaagaagagctgggttctcgcacctgctctttccagaagcaggtggcaggtaattccatacgcgagaacggtgccaaatcccagccagatccattttgtgagactgacagtgacgaggaaatcctggaacagattctagaactacctcttcagcagttttgctcaaagaagctgttctccatccctgaagaagaggaggaggaagaggaggatgaggaggaagagaagagcggagccggttgcagctctagagacccagggccaccagagcccgcactcctgggcctcggctgcgatagtggccagccaagaaggcccggtcagtgtccactgtcgcctgagtcgtcgagagccggtgattgccttgaggacatgccagggctcgtgggtggctcttctcgcagacggggtggcggaagccctgagaaaccacctagccgcagaagaccaccagatccacgggaacactgctctcggctactgagtaacaatggccctcaagcttccggcaggctcggaccaacacgcgaaagaggcggtctccctgtgatagagggaccgagaactgggctggaagctagcggcaggggcaggcttggccctagccgccgatgcagccgagggagagcgctagagcctgggctcgcttcatgtcttagtccgaagtgccttgaaattagtatcgaatatgattcagaggatgagcaggaggccggtagtggagggatctcaatcacttcatcctgctaccctggcgatggagaagcctggggtactgccaccgtcggtcgacctaggggcccaccaaaagccaacagcggaccaaagccttacccaaggctcccagcctgggaaaagggcgaaccagagaggagaggcagaagcgcaaccgggagagccaaagaacccttatcacgggctacagaaacgggggaagcacgtggccaagacggtagtgggcgacgtggtccccagaagaggggtgtgagagtgcttcgaccgtctacggcagagctcgtaccagctcgcagcccaagcgaaacactggcttaccagcatctgcctgtgcggatcttcgtcgcacttttcgactacgatccagtgtcaatgtcacccaatcctgacgccggagaagaggaacttccattcagagaaggccaaatactgaaagtgttcggagacaaggatgcggacggcttctatcaaggcgaggggggaggtaggactggatacattccttgtaacatggtcgctgaagttgccgttgattctcctgctgggcgacagcagctactgcagcgaggatatttgtcacccgacatcttattagagggaagtggtaatggtccgtttgtttactctaccgcacataccaccggtcctccgccaaaacctaggcgaagcaagaaggcagaaagtgaaggcccagctcagccctgcccgggtcccccaaagctagtccctagcgctgacctgaaggcgcctcattctatggtggcggcattcgactataatccacaagaatccagcccaaacatggacgtggaggcagagctaccttttagagcaggcgacgtgatcacagtgttcgggggaatggacgatgatgggttctactatggggagctgaatggccagagggggctggtcccaagcaattttctggaaggacccggtccagaagccggaggactggaccgggaaccaaggaccccccaggctgagtcacagcggaccaggcgacgccgtgtacagtgcta

SEQ ID NO: 215913 - DNA, 5723 bp, Artificial Sequence
  Description of Artificial Sequence: Synthetic coding sequence
atggaacagctgacaacactcccccgacctggcgatcccggagcaatggaaccttgggccttgccgacgtggcattcatggacacctggcagaggcggtgaacccagctccgcagccccatcaatcgctgataccccgccagctgctctccaactacaggaactacggtcagaagagtcctcgaaacccaaaggagacggcagctcccggccagttggcggtacagatccggaaggcgctgaggcatgccttccatcactcgggcagcaagcatcgtcgagtggtcccgcatgtcagcggccagaggatgaagaagtggaggcattcttaaaagcaaaactgaatatgtcctttggggaccgcccaaatctggagttgttgagagccctcggggaactgaggcagaggtgtgccatcctaaaggaggaaaatcagatgctcagaaagagcagcttcccagaaactgaggagaaagtccgacgcctcaagaggaagaatgccgagctggccgtgatcgctaagaggctcgaagagcgggctaggaagctgcaagaaaccaacctgcgagtcgtgtctgctcccctcccaagacccggtacctccctggagctctgtagaaaggccctggcccgacaacgcgctagggatctgagtgagacagccagcgctctcctcgctaaggacaaacagatagcagcactccagcgggaatgcagagaattgcaggctcgactgacacttgtaggcaaagaaggaccccagtggctccacgtgcgcgattttgatagactattaagagagagccagcgggaggtactcaggcttcagcggcagatcgcactacgaaaccagagggagacactacccctgcccccatcctggccaccgggtccagcgttgcaggctagagccggagccccagctcccggagcgccaggggaggcaacaccacaagaagacgctgacaatctgcccgtcatacttggagagccagaaaaagaacagagagttcagcagctcgagtccgaactcagtaagaagaggaaaaagtgtgaatctctcgaacaagaagctcgcaagaagcagagaagatgtgaagaactggagctgcagctgcgtcaggcacagaacgaaaacgcccgactcgttgaagaaaatagccggctgtccggcagggccaccgagaaggagcaggtcgagtgggaaaacgctgagctgaggggacaactgctcggtgtaacccaggagcgagactcggccttgcgcaaaagccaaggcttgcaatctaaattagaaagcctggaacaagttctgaagcacatgcgggaggtcgcgcagagaaggcaacagctggaggtagaacacgagcaggcgcgattgtcactccgagagaaacaggaagaggtgcggaggttgcagcaggcgcaagccgaagctcagagggaacatgagggcgctgttcagctgctggagagtacattggattcaatgcaggccagggtgcgggaactcgaagagcagtgccggtcccaaaccgagcagttcagtctcttggcacaagaattacaggcgtttcgcttgcaccccggaccgctcgacctgttgacgagcgccctcgactgcgggtctctcggcgactgcccaccccctccgtgttgttgcagcattccccagccctgccgcggttcagggccaaaagatctggacttgccgcctggtagtccaggtagatgcacaccaaaaagcagcgaacccgctcctgcgactctgactggtgttcctcggagaaccgctaaaaaggctgagtccctttcaaactccagtcactctgagagcatacataattcccccaagtcctgtcccactccagaagtggatacagcctccgaagtggaagaactggaggctgactcggtttctctgctccccgctgctcccgagggaagccgcggtggagcacgcatccaagttttcctcgcaaggtattcctataatcccttcgagggccctaacgaaaatcccgaagccgaactacctctgactgcgggagagtatatctacatatacggcaacatggacgaggacggtttctttgaaggcgagctgatggacgggaggcggggactggtgcctagcaacttcgtggagcgcgtctcagatgatgatctactcacttccctcccgccagagctggcggacctctcacatagttccggccctgaactctcgtttctctctgtcggaggaggtgggtcatcctctggcggacaaagctctgtcgggaggtctcagccacgccctgaggaggaggacgcgggagacgagctgtctctctctccatccccagagggactcggtgaacctcctgccgtaccttacccgagaaggctggtcgtcctgaaacaactcgcccactctgttgttttagcctgggagcctccaccggaacaggtggagctgcacggctttcatatttgcgtcaacggagaactgcgccaggccctggggccaggcgcaccccctaaagccgtgcttgaaaatctcgacttgtgggccggtccccttcatatctctgtgcaggcccttacgtcgcggggtagcagcgaccccctaaggtgctgtctggccgtaggggctagggccggagtggtgccatcccagctgcgcgtacatcgattaacagccacaagcgctgagatcacatgggtgcccggaaacagcaatttagcccatgccatttacctcaatggggaagagtgtcccccagcgtcccccagcacttactgggctacattctgccatctgcgcccaggcaccccatatcaagctcaggtcgaggctcaactccctcctcagggtccatgggaacccggatgggagagactggagcagagggcggctacactccaattcaccacacttcctgcgggaccacccgatgcccctctggacgtacagatagagcccggtccttccccaggtattctgattatctcttggctgcccgtgaccattgatgctgcaggaacaagcaatggtgtccgggtgaccggatatgcaatatacgccgatggccaaaagataatggaggttgcaagcccaactgcaggaagtgtgctggtggagctgagtcagcttcagcttctacaagtgtgtcgagaggtggtagtccggaccatgtccccacacggtgagagcgctgactccattccagcaccaataaccccagctctcgcacccgcaagcttgccagcgagggtgtcctgcccctctccacatcccagcccggaggctcgggctccattggcaagtgcctctcctggcccaggagatccgtcctctcctctccaacatcctgcccctttgggcacacaggaacctccaggcgcaccaccggctagcccctcccgagaaatggctaaagggtcccacgaggatccacctgcaccatgctcacaggaggaagccggtgctgctgtgctgggtacttccgaagaacgaacggccagcacatcaactctgggggagaaggacccgggtcccgcagctcccagcctggctaagcaggaagcagagtggaccgcaggtgaggcctgtccggcttcatcttccacccagggagcgagagcacagcaagccccaaacacggaaatgtgccaggggggagatccaggcagcggcctgagaccaagggctgaaaaagaagacaccgccgagctcggcgttcacctggtcaattccctcgtggatcacggccgaaatagtgacctgtctgacattcaggaggaggaggaggaggaggaggaagaggaagaagaagagctcggatcacggacttgttcttttcagaagcaagtggcaggcaacagcattagggagaatggagctaagagccagcctgaccccttctgcgagactgattccgacgaggagatactcgagcagatcttagagctacctttgcaacagttttgttccaagaaactatttagcattccagaggaggaagaggaggaagaggaggacgaggaggaggagaagtccggggctggctgctcttctcgtgatcccggaccccctgaacccgcactattgggacttggctgcgacagtggacagccgaggagacccggacagtgtcccctgagccccgaaagctcaagagcaggggactgcctggaagacatgcccggtctcgtagggggatcaagccggaggaggggaggcggttcccccgagaagccgccaagccgcaggagaccgccagaccccagggaacactgtagcaggctccttagcaataacggacctcaggcatcaggccgtcttggacccacccgtgaacgcggaggtcttccagtcatagaaggaccacgtactggcctggaggcgtcgggtagaggaagactaggcccaagtcgcagatgctcacgcggtagagcgttagagcccggtctcgctagttgcctgagccctaaatgcctggaaatcagtatcgaatacgactcagaggacgaacaagaagccggtagtggagggatttctattactagttcatgttaccccggagatggagaagcatggggaacggcaactgtcggacggcctagaggacctcctaaagccaatagcggaccgaagccttatccgaggctccccgcatgggagaagggggagcccgagcgcagagggagaagcgccacggggagggctaaagagccgttgtcccgagccaccgaaaccggcgaagcccgtgggcaggacggcagcgggagaagaggccctcagaagagaggggtacgggtgctgcgcccttccactgctgaactcgtccctgctagatccccaagcgagacgcttgcatatcagcatctgccggtgcgaatttttgtggccctgttcgactatgaccccgtctcaatgagccccaatccagacgctggggaagaagagttaccttttagggaagggcagatcctgaaagttttcggagataaggacgcggacggtttttaccagggcgagggcggaggccgaactggctatataccatgtaacatggtcgcagaggtcgccgttgacagtccagctgggcgacagcagttgcttcagcgtggttacctgtccccggacattctgttggagggttccgggaatgggccatttgtctacagcaccgctcataccacaggcccaccaccaaaacctagaagaagcaaaaaggctgagagcgaggggccagcgcagccctgccccggaccccctaagctcgtcccctccgcagatctgaaggctccgcacagcatggtcgctgctttcgactataacccgcaagagtcctcccctaacatggacgtggaggcagagcttccctttcgagccggtgacgtcattacagtgtttgggggaatggacgacgacggcttctattatggtgagctgaatggtcagagagggctggtgccatccaacttcctggaaggtccaggacctgaggcgggtggccttgatagggagcccagaacaccccaggcagagtctcaggattggggctgtacaacgcagggcagcccgggaccacctggagggccttgtacaccctcctcagggtcagcgccacgtatcgagcgaggcgagccacaggggaggtccgaaaaagtttgggggttttttagcaagggtaaacagttgttacggcgtttaggaagcgggaaaaaggagta

SEQ ID NO: 215914 - DNA, 864 bp, Artificial Sequence
  Description of Artificial Sequence: Synthetic coding sequence
atggtcaacgacccacccgttccagctttgctttgggcccaggaggtgggtcaagtgcttgcaggcagggctagacgcctcctgctacaattcggcgtactgttctgcaccatcctgctgttactgtgggtctccgtctttctgtacgggtccttttattattcctacatgccaaccgtttcacatctttcgcccgttcatttctactatcggacagactgcgacagttccaccacaagcctctgcagctttcctgttgctaatgtgagccttacaaaaggaggacgggacagggtgcttatgtacggtcagccatatagagtgacgctggagctcgaactgcctgaaagcccggtgaaccaagacctgggcatgttcttggttacaatctcctgttacacccggggtggccgaattatctctaccagctcacggtctgtaatgctgcactatcggtctgacttgctgcagatgctggataccctcgtgttcagctcccttcttctgtttgggttcgcagaacagaagcaactgctcgaggtagaactctacgccgattatagagagaactcgtatgtgcccaccacaggggctatcatcgaaatccactccaaacgcatacagctctacggcgcttatctccgaatccacgcccattttaccgggctgaggcttactagtgagaaggagaccattcccggacgaaagtcgaatgaaggctctcttttgattagccaggggctcaaggcccgtcgctctcagctccggaatcagatgctccagagaatggtgagagcgctgaagatcccccaggggcagagagtcagttgccccagacgacgaaaccagattagctctccttag

SEQ ID NO: 215915 - DNA, 1389 bp, Artificial Sequence
  Description of Artificial Sequence: Synthetic coding sequence
atgtctacggaaaaagttgatcagaaagaggaggccggagaaaaagaggtgtgcggagatcagataaaggggcctgataaagaagaagaaccaccagccgctgcctcccacgggcaaggctggcgaccaggtggccgagcggcacggaatgccagacccgagccaggtgcccgtcaccctgcattgcctgccatggtgaacgatcctcccgtgcccgcactgctgtgggcccaggaggtaggtcaagtgctggcaggcagagctcgcaggctcctattgcagttcggcgtgttattttgtactattctcctcctgctgtgggtttctgtgttcctctatggctcgttttactattcatatatgcctactgtctctcacctgtctccggtgcacttctattatcgaactgactgcgattcttcaacaacttccctgtgcagtttccctgttgcaaatgtgtctctcactaagggcggtagggatcgtgtgctgatgtatggtcagccgtatagggtaacactggaattggagcttccggaatccccagtgaatcaggatctggggatgttcttggttaccatttcgtgctacactcgtggaggcaggattatttctacttcatctcgctcagttatgttgcattaccggtcagacttgctacagatgctggatacacttgtgttcagctcactgctgctcttcggatttgcagaacagaagcaacttctagaggtggaactatacgcagactatagagaaaactcctatgtgcccaccacaggggctattatcgaaatacattctaagcgaatccagctgtacggggcatacctcaggatccacgcccactttacaggactgaggtacctgctgtataacttcccaatgacctgtgccttcattggtgtcgcctccaatttcacctttctgtccgttattgtgctgttctcctatatgcagtgggtgtggggaggaatatggcctcggcacagattctctttgcaggttaacattcggaagcgggacaactcccgcaaggaagtccagaggagaattagcgcgcaccagccagggcctgaaggacaggaggagagcaccccgcagagcgacgtaacagaggacggcgagtctccggaggaccctagtggcaccgaaggccagttgtccgaggaggagaaacccgaccagcagcctttatcaggcgaagaggaactggagcctgaggcgtcagatggctcgggctcatgggaagatgccgcattgttgactgaggcaaacctgcccgctccggcacctgcaagcgctagcgcccctgttcttgaaactttagggtcaagcgaacctgcgggaggagcactccgccaaaggccaacatgtagttcatcttag

SEQ ID NO: 215916 - DNA, 1197 bp, Artificial Sequence
  Description of Artificial Sequence: Synthetic coding sequence
atggtgaatgaccctccagtccccgctctcttatgggcccaggaggtgggacaagttctggcaggtcgggctcgcaggctgctactgcagttcggtgtgctcttttgtacaatactgttgcttctctgggtatcagtgttcttgtacggctccttttattattcctacatgcctactgtcagtcacctgtccccagtgcacttctactacagaacagactgcgactcctccaccacgagcctttgctcttttcctgtggcaaacgtatcactcacaaagggtggacgtgatcgagtgctgatgtatggccaaccatatcgagtgacacttgagctggagctgccagaatccccagtaaatcaagatttagggatgtttctagttaccatctcatgttacacaaggggcggaaggatcattagtacctctagccggagcgtcatgctgcattaccgttcagacctgcttcaaatgctggacacgcttgtcttttctagtctgctcctgttcgggttcgctgagcagaaacaacttctagaggttgaactctacgcggactatcgtgaaaactcatatgtgcctacaactggcgcaattatcgagatccatagtaagcggatccagctgtatggtgcctatctgcgtatccatgcgcattttacagggctccgctacctgctgtacaattttcccatgacgtgcgccttcattggagtggcttccaatttcacattcctttccgtcatcgtgctatttagctatatgcagtgggtttggggagggatttggcctcggcataggttctccttgcaggtgaacatcagaaaacgcgataacagtaggaaggaagttcagaggcgcataagtgcacaccaacctggcccagagggtcaggaggagtctaccccccagtctgacgtcacagaggatggagagagccccgaagatccttccggtacggagggacaattatctgaggaagaaaagcctgaccagcagcccttgtccggggaggaagaactcgagcctgaggcaagtgatggatccggcagctgggaagacgcagcactcctgactgaggctaatctaccagccccagccccagcttctgcctcagccccagtgttggagactctgggctcctccgagccagccggtggcgcactgcgacagcggcctacatgtagcagcagctag

SEQ ID NO: 215917 - DNA, 1197 bp, Artificial Sequence
  Description of Artificial Sequence: Synthetic coding sequence
atggttaacgacccacctgtgcccgctctgctctgggcacaggaggtcgggcaggttcttgccggaagagctagacgccttctgctccagtttggagtgttgttctgtactatacttctgctcctgtgggtgtccgtgtttttgtacggatctttctattatagctacatgcccaccgtcagccatctgtcccccgtacatttttactatcgcacagattgtgactcctctacaacatctctctgctcatttccagtagctaatgtgtcacttacaaaaggcggacgagatcgagtgctgatgtatggtcagccctatagagtgaccctggaattagagctgccagagagtcctgttaaccaggacctcgggatgttcctggtaacaattagttgctacacacgcggaggacgaataattagcacatcctccaggtcagttatgcttcactaccggtcagatctccttcaaatgctggacaccctagtgtttagttccctactactgttcggttttgccgagcagaagcaactgctagaggtcgagctgtatgcagattaccgagagaattcatacgttcctaccaccggcgcaattattgagattcattcaaagcgtatacagctctacggagcctatctaagaattcatgcacattttacggggctcagatacttactgtacaacttccccatgacttgtgcctttatcggagtggcctccaatttcaccttcctatccgttatcgtgctgtttagctatatgcagtgggtgtggggagggatctggcctcggcatagattttcactgcaggtcaatattagaaagagggataattcccggaaagaggttcagaggagaatcagtgcacaccagccaggccctgaaggtcaggaggaatcaacccctcaatcagacgtgaccgaggacggggagtctcctgaagacccttcaggtacagaaggacagctctctgaagaggaaaagccagatcagcagccgctgtcgggcgaagaggaactcgagcctgaagcttctgacggctctgggtcctgggaggacgccgcactgctaactgaggccaaccttccagcacctgcacccgcttctgcaagcgctccagttcttgaaactctgggctcttctgagcccgctggcggagcccttcgacagcgtccaacttgctcatctagctag

SEQ ID NO: 215918 - DNA, 1197 bp, Artificial Sequence
  Description of Artificial Sequence: Synthetic coding sequence
atggtgaatgaccccccagtgccagcacttctgtgggcgcaggaggtggggcaggtgctggctggcagagccaggcggctgctgttacagttcggcgtccttttctgcacaatactgttactcttgtgggtgagcgtgtttctgtatgggagcttttactacagctacatgccgaccgtctcacatctttctccagtacacttttactaccgtacagactgcgactcctctaccacgagcctttgctcattccctgtggccaacgtgagtctgaccaaggggggaagagacagagtgctgatgtatggccagccttaccgcgtcacattggagctggagctgccggagagtcccgtgaaccaggatttagggatgttcttggtgaccatctcttgctatacaagaggtggcagaatcatctccaccagttcccggtcggtaatgctccattacagaagcgatttgctacaaatgcttgacacactcgtcttttctagcctgcttctatttggctttgccgagcagaagcagttgttagaagttgaactctacgcagattacagagaaaattcgtatgtccctacaactggggctattattgagatccactctaaacggattcagttgtacggagcatacctgcgcatccacgcccatttcaccggcctacggtatctcctctataacttccccatgacctgcgcattcattggcgtagcatccaatttcactttcctgtcagtcatcgtactgttctcatacatgcaatgggtttggggcggaatctggccacggcatcgcttcagccttcaggttaacattcgaaaacgcgacaattcaagaaaagaagtgcagcgacgcattagtgcccaccaacctgggcctgaaggccaggaagaatctaccccccagtcagatgtgactgaagacggggagtcacccgaggatcccagtggaaccgaaggccaactgtcagaagaagaaaagccggaccagcagcccctgtctggtgaggaagagcttgaacccgaggcctctgacggttcgggctcatgggaggacgcagccctgctgactgaggctaacctaccagctcctgccccagccagcgcctcagcgcctgtcttggagactctgggttcttctgaacccgctggaggggcactgcgccagagacccacttgttcaagctcctag

SEQ ID NO: 215919 - DNA, 1389 bp, Artificial Sequence
  Description of Artificial Sequence: Synthetic coding sequence
atgtctaccgaaaaggtcgatcagaaagaggaggcaggagaaaaagaggtgtgtggagaccagatcaagggcccagataaggaagaagagccccctgctgcagcatcccacggccagggatggcgacctggaggcagggccgctcggaatgccagacctgaacctggcgctcgccaccctgcattgcccgctatggtcaacgatccaccagtccccgcactcttgtgggcacaagaagttggacaggtgctggcaggcagagccaggcgactcctgctccagttcggcgttctgttttgtactatcctgttactactgtgggtttcagtgttcttgtatggatctttctattactcttacatgcccactgtgagccacctgtctcccgtgcacttctactacagaaccgattgcgactcttcgacgacaagcttgtgtagtttccccgtggcaaatgtgtctctcaccaagggaggaagagatcgggttctgatgtatggccagccctacagggtcactctggaattagagttgcccgaatccccagtaaatcaggacctgggaatgtttctagtgactatttcctgctatacacgtggcggtcgaattatttctacttcctcccgcagtgtgatgctgcattacagatccgatctgctccaaatgttggacaccctggtctttagtagtctactgctgttcgggttcgccgagcagaaacagctccttgaggtggaattatacgctgattacagagagaactcttatgttcccactactggagcaatcatcgaaatccacagcaaaagaattcagctttatggggcatatttgaggatccatgctcatttcaccggcctccgctacttgttatacaacttccccatgacatgcgcttttataggcgtcgcctcgaactttactttcctgtcagtgatcgtcctattctcatacatgcagtgggtctggggtggcatatggccgcgacatcggtttagtctgcaggttaatatcagaaaaagggacaattccagaaaagaggtgcaacgcagaatctccgcccatcaacctggcccagaggggcaagaggagtcaacaccccagtccgacgtgaccgaggatggcgaatcaccagaggatccctccgggacagaggggcagttgtcggaggaagagaagcccgaccaacagccactgagcggggaagaagagctcgaacccgaggcctccgatggttccgggagctgggaagatgcagcccttctaaccgaggcgaaccttcctgcccctgcaccagcctcagcgtccgcacctgtgttggagaccttgggaagctccgaacccgcaggtggagccctgcggcaaaggccaacatgtagtagcagctag

SEQ ID NO: 215920 - DNA, 672 bp, Artificial Sequence
  Description of Artificial Sequence: Synthetic coding sequence
atggttaacgatcctcctgttcccgcactcctatgggctcaagaagtagggcaggtactggcgggacgtgccagacgcctcttactgcaattcggggtgctgttttgcaccatattgctgctgctctgggtctctgtgttcctctacgggtccttctactattcctacatgcctacggtttcacacctgtcccctgtacatttctactaccgcaccgattgcgactcgagcaccacctccctgtgttccttcccggtcgcaaacgttagtctcaccaaggggggtagggaccgcgttctgatgtacggacagccatatagggttaccctggaactcgagctccccgaatcaccagtgaaccaggacctcgggatgtttctcgtaactatctcttgctacactcgcggagggaggatcattagcacgagcagccgatccgtgatgctccactatcggtctgacctcctccaaatgctcgacactctggtgttcagctctttgctcttgttcggcttcgcagagcaaaaacagctgctagaagtggagctctacgcggactaccgagaaaactcctatgtcccaaccaccggggcaatcatagagattcatagcaaaaggattcagctgtacggagcatacctgcgcattcatgcacactttactggtctgtag

SEQ ID NO: 215921 - DNA, 282 bp, Artificial Sequence
  Description of Artificial Sequence: Synthetic coding sequence
atgagcaccgagaaggtggaccagaaggaagaagccggtgaaaaggaagtttgtggcgatcaaataaagggccctgataaagaggaagaaccacctgccgcagcttcccatggacaaggatggagacccggtggcagagccgcacgcaacgctaggcctgagccaggcgcacgccaccctgcactccctgccatggttaatgaccccccagttcccgcactgctgtgggcgcaggaagtgggccaagtgctggctgggcgagcgagaaggctcctcctctag

SEQ ID NO: 215922 - DNA, 681 bp, Artificial Sequence
  Description of Artificial Sequence: Synthetic coding sequence
atgtcaaccgaaaaggtggaccaaaaagaagaagctggtgagaaggaggtctgcggggatcagattaaagggcctgacaaagaggaagaacctcccgctgctgctagccatggacaaggttggcggccaggcggtagggctgcccgtaacgctcggccagagccaggtgcccgacatcccgcattgcccgctatggtgaacgaccccccagtgcccgcacttctgtgggctcaagaagttggacaggtgctcgctggaagggccagacggctgttattacagtttggagtgctgttttgcactattctgcttctactctgggtctctgtgtttctctacggatctttttactatagctatatgcccactgtctctcatctatcacccgtgcatttctattacagaacggattgcgacagctccaccaccagcctctgctccttcccagtagccaatgtgagcctcaccaaaggcggaagagaccgggtacttatgtatggacaaccctaccgcgttaccttggagttagagttgccagaatcaccagttaatcaggacctggggatgtttctggttactatctcctgctatacacggggagggagaattatatccacatcgtccaggtctgtgatgttgcactatcggtctgacctgctacagatgctcgacactttgtag

SEQ ID NO: 215923 - DNA, 72 bp, Artificial Sequence
  Description of Artificial Sequence: Synthetic coding sequence
atgtctacggaaaaagtggaccagaaggaggaggccggagaaaaagaggtctgcggtgaccagattaagtag

SEQ ID NO: 215924 - DNA, 87 bp, Artificial Sequence
  Description of Artificial Sequence: Synthetic coding sequence
atgagtacagagaaagttgatcagaaggaggaggctggggagaaggaggtttgcggggatcagataaaaggccctgacaaggagtag

SEQ ID NO: 215925 - DNA, 372 bp, Artificial Sequence
  Description of Artificial Sequence: Synthetic coding sequence
atgtcaactgagaaagttgatcaaaaagaggaggcgggagaaaaagaggtgtgcggcgaccagattaaaggtccagacaaagaggaagaacctcctgcagcagcaagtcacggacagggatggcggcctggtggacgagctgctcgcaacgcacggcctgaacccggagcaaggcatccagcactaccagccatggttaacgatccaccggttccggcactgttatgggctcaggaggttgggcaggtcctggcaggccgagcgaggcgcctgctgcttcaattcggtgtgctgttttgcaccatacttctgcttctgtgggtatcagtctttctgtacggtagcttctattatagctatatgcctacgtag

SEQ ID NO: 215926 - DNA, 300 bp, Artificial Sequence
  Description of Artificial Sequence: Synthetic coding sequence
atggttaacgacccaccggtgccagcactcctgtgggcccaagaagttggtcaggttctagccggacgcgctaggaggctgctgctgcagttcggagtattgttctgcactattctgcttctgctgtgggtgtccgttttcctttacggctctttctactatagctatatgccaaccgtttcacatctgtccccagtgcatttctattaccggacagactgcgattctagtactacgtctctttgcagttttcccgtggcgaatgtgtcccttactaaagggggtcgtgaccgagtgtag

SEQ ID NO: 215927 - DNA, 879 bp, Artificial Sequence
  Description of Artificial Sequence: Synthetic coding sequence
atggaattccagccaaaccaggaggatgaggaagacgcgcatgcaggaatcataggcagatttctgggattacagagccatgatcatcaccccccaagggcgaactcgagaactaagctgctgtggccaaagcgcgaatctctgttacacgagggactgcccaagaatcacaaggccgcaaagcaaaatgtcaggggccaagaggataacaaggcttggaagttaaaggcagtagacgcctttaaatctgcgcctctgtaccaaaggcccggttactattcagctccccagacacccctgtcccctactcccatgtttttccccctcgaaccaagtgccccttccaagctgcattcagtgaccggaatagacacaaaagacaagagcctgaaaaccgtaagtagcggtgccaaaaaatcttttgagctgctgagtgagagcgatggggctctgatggaacaccctgaggtctcccaggtgcgacggaagacagtagaattcaacttaaccgatatgccggaaataccagaaaatcacctaaaggagcccctcgagcaatcaccaacgaacatccataccaccctgaaagatcatatggatccgtattgggccctggagaatcgaagcgtgctgcatctgaatcaaggtcactgcatcgcactctgcccgaccccggcaagcctggccttgagtctgccattccttcacaacttcctggggtttcaccattgccagagtacactcgatcttcgccctgcattagcatggggtatttaccttgctacatttaccgggatactcggaaaatgtagcggccctttcctaacctccccatggtatcacccagaggatttcctgggaccaggcgagggcagatag

SEQ ID NO: 215928 - DNA, 1497 bp, Artificial Sequence
  Description of Artificial Sequence: Synthetic coding sequence
atgttcgagaaactgaccctgtactgtgactcatacatacaactcatccctatcagtttcgtcctggggttttacgtcacgctagtggtcacccgctggtggaaccagtacgagaatcttccatggcccgacaggctaatgagcctggtgtcaggctttgtggaaggaaaagatgagcagggtagactgctcaggcggactctcatcagatacgctaacctcggcaacgttctgattttacgcagtgtgtctaccgcagtttataagcggttcccatccgcacagcatcttgttcaggccggatttatgactccagccgagcataagcagctcgaaaaactctccctccctcataatatgttttgggttccatgggtctggttcgctaacttaagcatgaaagcttggctgggcggtaggatcagggaccccatccttctccagtctctactcaatgaaatgaacactctgagaacccaatgcggtcacttatatgcatatgactggatatcaataccgctggtatatacgcaggttgtcacagtggctgtgtactcattcttcctgacttgcctcgttggtaggcagtttctcaaccccgcaaaggcgtatcctgggcatgaactggacctggttgtccccgtcttcaccttccttcaattttttttctacgtcggctggctgaaggtgagcctcctggccgtggatgagatgcatcaggacctgccgcgtatggagcctgacatgtactggaacaaaccagaaccccagccaccatataccgctgcaagcgcccagttccggagggcttcctttatgggttcaacatttaacatctcactgaataaggaggaaatggaatttcaacctaatcaggaggacgaggaggacgcacatgccggaatcatcgggaggttccttggcctccaatcccacgaccaccatccccctagggccaactctcgcaccaagttgctgtggcctaagcgggagtcactacttcacgagggcctacctaagaatcacaaggcggcaaagcagaatgtgaggggtcaggaggacaataaggcttggaaactaaaggctgtggacgcctttaagagtgcgcctctctaccaaagacccggatactacagtgcaccacagacgcccctgtcccccaccccgatgttcttccctctggagccatctgccccatccaaactgcactctgtgacgggcatagataccaaggacaaaagtctgaaaacggtgagtagtggcgcaaaaaaatccttcgagctgctgtccgagtcagacggagcgttaatggaacaccccgaggtgtcacaagttcgaaggaaaacagtggagttcaacttgacagatatgcccgagatcccagaaaaccatttaaaggagccgctggagcagagtccaacgaatattcacactacactgaaggaccatatggacccctattgggcactggagaatagagatgaggcccactcatag

SEQ ID NO: 215929 - DNA, 1758 bp, Artificial Sequence
  Description of Artificial Sequence: Synthetic coding sequence
atgacgatcacatatacttctcaggtggcaaacgctagactggggagtttcagtcgcctgttgctgtgctggcgtggatccatatataaactcttgtacggggagttccttatctttctcttatgctactatattatccgcttcatctacaggttggccctcactgaagaacagcagctgatgtttgaaaagctgactctctattgtgatagctatattcagctcattccgatctcatttgtcctagggttttacgtaacacttgtggtgacacgatggtggaaccagtacgaaaacctcccgtggcctgatagactcatgagtttggtgagcggattcgttgagggcaaagacgagcagggaaggctgctccgtagaacccttatccggtatgcaaatctgggaaacgtgctcatattaaggtccgtcagtaccgcagtatacaagagatttccctcggcccaacatctggttcaggccggattcatgacacctgccgagcataaacagttggaaaaactgagtttaccacataatatgttttgggtgccctgggtctggttcgcaaacctctctatgaaagcatggctgggcggaaggattcgcgaccctatccttttacaatcactccttaacgagatgaacactctcagaactcagtgtggacatctgtatgcctatgattggatcagtatacccttggtctacacccaggtggtcacagtcgccgtgtattcctttttcctgacttgtctggtgggccgacaatttttgaaccccgctaaagcctacccgggtcatgaactggacctggtcgtgcctgtctttaccttcttgcagttttttttttacgtcgggtggttgaaggtcgcagagcaactgattaacccgttcggagaggacgatgatgattttgagactaattggattgtggatcggaatttgcaagtgagcctgctggccgtcgacgaaatgcatcaggacctgccaaggatggaacctgacatgtactggaacaagcccgagccgcagccgccttacacagccgcatctgctcaatttaggcgagctagctttatgggcagtacattcaacatttctctcaataaggaggagatggaatttcagccaaaccaggaggacgaggaggatgcgcatgccggaattatcgggagattcctcggtctccagtcccacgaccaccacccccctagagctaatagtagaactaagctgctttggcccaaaagggaatctctgctccacgagggactgccaaaaaatcacaaggctgccaagcagaacgtgcgcggacaggaagataacaaagcatggaaactgaaggcagtggacgccttcaagtctgctcccctgtaccaacggcctggctactactcagccccacaaaccccactgagtccaacacctatgttctttccactcgaacctagcgccccttccaaattgcactctgtaacaggcatagataccaaagacaagtctctgaaaaccgtgtccagtggggctaagaagagttttgaactcctgagtgagagtgacggtgcactgatggaacaccctgaggtaagtcaggtacgcagaaagacggtcgagttcaacttgaccgatatgcccgagatccctgaaaaccacctgaaggaacccctggagcagagccccacaaacatccatactacactgaaggaccacatggatccttactgggcgcttgaaaatcgcgatgaggcacatagctag

SEQ ID NO: 215930 - DNA, 813 bp, Artificial Sequence
  Description of Artificial Sequence: Synthetic coding sequence
atgaccatcacttatactagtcaggtcgctaacgcgaggctgggatccttcagtagactgctgctgtgctggcgcggtagtatttacaagttactctatggcgaattcttgatcttcctgttgtgttattacattatccgcttcatctatcggcttgcactgacagaggaacaacagctgatgttcgaaaaactgaccctgtactgcgactcgtacatccagctcatcccaatctcctttgtactgggcttttacgtcactctggtggttactaggtggtggaaccaatacgaaaatctgccgtggcccgaccgattgatgtctctggttagtggatttgtggagggaaaggatgagcagggcagattgctccgccgaacattaatacgctacgctaacctcggaaacgtgctcatcctgagatctgtgtcgacggccgtgtacaaaagattccccagcgctcagcacctcgtccaggccggttttatgacacccgctgagcacaagcagttagagaagttgtccttaccccataacatgttttgggtgccctgggtgtggtttgccaatctgtctatgaaggcgtggctgggtgggcgtattagagacccgatcctgctgcaaagtctgctgaacgaaatgaatactctccggactcagtgcgggcatctgtatgcctacgactggattagcatccccctcgtctacactcagccagagcagaggggcgacggagtgccagcacagagtgggggacgcggtggctgtagccggtggcaccactggccacttccccgacccgctgtgccctag

SEQ ID NO: 215931 - DNA, 1815 bp, Artificial Sequence
  Description of Artificial Sequence: Synthetic coding sequence
atgtttgagaagctcacgctctactgcgactcatatatccagttaatacccattagctttgtgctcggtttctacgtgaccctggtcgtgacgcggtggtggaatcagtacgagaacttaccatggccagacaggctgatgagcctcgtctccggctttgtggaagggaaggacgaacagggcagattgctgcggaggacattaattcggtatgctaatctgggcaacgttctgattttgcgcagcgtgtctacggccgtgtacaaaagatttcctagtgcccagcatctagttcaggcaggctttatgacacctgccgaacataagcagcttgagaagcttagtttgccccataacatgttctgggttccatgggtctggttcgctaatctgagtatgaaggcctggttaggaggccgtattcgggatcctattctgctgcaaagccttctaaatgaaatgaacacacttcgaacccagtgcggacacctatatgcatatgactggatttcaatacccctggtatacacccaagtcgttaccgtggccgtctactcattttttctgacctgcctggttggccgacagttcctaaatcctgctaaagcataccccggacacgagctcgacctggtggttccggtgttcaccttcttgcaattttttttttacgtgggatggctcaaagtggccgaacagttgatcaacccttttggcgaagacgacgacgactttgaaacaaactggatcgttgacaggaacctccaggtgtctctgcttgctgtcgacgaaatgcaccaggacttgcctagaatggaaccagatatgtactggaataaaccagagccccagcccccttacacagctgcttccgcccaatttagacgtgctagcttcatgggaagcacttttaatatctccctgaacaaagaagaaatggagtttcagcctaaccaggaagacgaagaagatgcccatgccggaatcatcggacgattcctgggactccagtctcacgaccatcacccaccaagggcaaactcaaggacgaaattgttgtggcctaaaagagagtcactgctgcacgaaggcctgcccaaaaatcacaaggccgctaagcaaaatgtcagaggacaagaagataacaaggcttggaaactgaaagccgtcgacgccttcaaatcggcccctttatatcagaggccaggatattatagcgctccccagacacccttgtcccccactcccatgttcttccctctggagcctagcgcaccatctaagctccactccgtcacaggcattgataccaaggataagtcactgaaaacagtgagctccggggctaaaaagtcctttgagttactctcggagtcagacggggctctgatggagcatccggaagtcagccaggtacgcagaaaaaccgttgagtttaatttgacagatatgcctgagattcctgagaatcatcttaaggagcccctcgagcagtccccaacgaatatccacacgaccctaaaagatcatatggatccctactgggcactggagaataggtccgtcctccacctgaaccagggccattgcatagccctctgccctacccccgcttcgctcgctctgtcattgcccttccttcacaacttcctcggatttcatcattgtcagtcaactttggacttgagaccggcactcgcttggggtatttacctggcgacattcaccgggatactcggtaagtgtagcgggccattccttaccagtccctggtatcaccccgaggatttcttgggtccaggcgaaggcagatag

SEQ ID NO: 215932 - DNA, 1530 bp, Artificial Sequence
  Description of Artificial Sequence: Synthetic coding sequence
atgacagttacttacaccgcaagggtggcaaacgctagattcggcggttttagccagttgctcctgctgtggcgaggctctatctataaactgctgtggcgggaattgctgtgcttcctcggtttctacatggctctgagcgcagcctaccggtttgtcctgaccgaagggcagaagcgatatttcgagaagctcgtgatctactgtgaccagtacgccagcttgattccagtgagttttgtgctcggattttacgtgaccctggtggtgaaccggtggtggtcacagtacctctgcatgcctctgcctgacgctctaatgtgtgtcgtggctggcacggtgcatggccgtgatgatcgcggtcgcctgtatcgcagaacattgatgcgatatgccggtctgtcagcagtgttgattctgagatctgtttctacggccgtgttcaaacggttccccactatcgatcacgtggtcgaagccggtttcatgactcgcgaggagcggaagaagttcgagaacttgaatagcagttataacaaatactgggtaccttgtgtttggtttagtaacctcgccgcacaagcccgtcgcgagggtcgaattagagacaattccgctttgaaactgctgctcgaagaactgaatgtcttcaggggtaagtgcggcatgctcttccattacgattggatatccgttcccctcgtatacacgcaggttgtgaccatcgccttgtattcatattttttggcatgccttatcggaaggcaatttcttgaccccgctcaggggtacaaggaccacgatctggacttgtgcgtccccatctttacgttgctgcagttcttcttttatgcgggttggcttaaagtagcggagcaactgatcaaccctttcggagaagacgatgacgatttcgagaccaatttccttattgatcggaatttccaagtctcgatgttggccgttgatgagatgtacgacgacttggctgtcctggaaaaggatctgtattgggacgcagctgaggccagagctccatatactgccgctacagtttttcaactgcgccagccatccttccagggttcaacttttgacatcactctggcaaaagaggatatgcagtttcagagattggatgggctggacgggcctatgggcgaagcgcctggagattttctgcagcgcctcctgccggcaggtgcaggcatggtagcaggtgggccactaggacgcagactttctttcctgctgagaaagaacagctgtgtgtcggaggcatcaaccggagcttcctgctcctgtgctgtggttcctgagggtgccgctccagaatgctcctgcggagacccactcctggaccccggtctcccagagcccgaagctccgcctcccgctggtcccgagccactgactctcattccagggccagtggaacccttcagcatcgtgaccatgccgggtcctagaggccctgcccctccctggctacctagcccaatcggtgaagaggaagagaacctcgcatag

SEQ ID NO: 215933 - DNA, 1530 bp, Artificial Sequence
  Description of Artificial Sequence: Synthetic coding sequence
atgaccgtgacttacacagccagggtggccaatgcgagatttgggggatttagtcagctgctgctactttggaggggctctatttataagctgctgtggagagaactgttgtgcttcttaggcttctacatggcgttgtctgccgcttaccgctttgtgctgacggagggccagaagcgctacttcgaaaaactggtaatatattgcgaccaatatgcctcgctcattcccgtgtcttttgtgttgggattctatgtcacgttagtcgtgaatagatggtggtctcaatacctttgcatgcccttaccggacgccctgatgtgtgtcgtggctggtaccgtgcacggcagggacgatcgcggtaggttgtaccgcaggacactgatgcgctacgctggtctgagcgccgtgttaatcctccgcagcgttagtaccgctgtatttaaaagatttcctaccattgatcatgtggtcgaggcgggttttatgaccagggaagagcggaaaaagttcgaaaacctgaacagttcctataataagtattgggttccttgcgtgtggttttctaatctggcagcccaggctcgcagggaagggaggatacgtgataacagcgctctgaaactgctcttggaggagctgaacgtgtttcgcggtaaatgcggaatgcttttccactatgattggatctccgtaccactcgtttacactcaggtggtgaccatcgctctgtattcctatttcctggcttgcctgatcggccgacagttcttagaccctgcacaggggtataaggaccacgacctcgacctttgtgttcctatctttacactcctgcagttctttttctacgcaggttggttaaaagtggccgaacaactgataaatccttttggagaagatgacgacgattttgaaacaaacttcctgatcgaccgcaatttccaagtatcaatgctggctgttgacgaaatgtatgacgatctcgccgtgctcgagaaggatctttattgggatgcagcagaagccagggcgccttacaccgcagccactgtgtttcagttaagacaaccatcctttcagggatccacttttgacatcaccttggcaaaagaggacatgcaattccagagactcgacgggctggacggccctatgggggaggcccctggcgatttcctccagcgcttgctgcctgctggcgcagggatggtggcagggggacccctagggaggcggttaagtttcttgctgcgcaaaaatagctgcgtcagcgaggcctctactggcgcaagctgctcctgcgcagttgtgcctgagggggctgctcctgagtgttcgtgtggagatccactgctagaccccggactgcctgagcccgaagccccacccccagctggacctgagccacttaccctaatcccaggcccagtggaacccttctcaattgtgacaatgccagggcctagaggccctgctccaccttggctcccctctccaattggggaagaagaggagaacctggcctag

SEQ ID NO: 215934 - DNA, 1530 bp, Artificial Sequence
  Description of Artificial Sequence: Synthetic coding sequence
atgacagtgacttacacagccagggtggcaaatgctcggttcggcggtttcagccagttgttgttattatggagaggctctatatacaaacttctgtggcgcgaacttctctgttttttggggttctacatggcgctttcagcagcctatcgctttgttctgactgaaggccagaaacgatattttgagaagttagttatttactgtgaccaatatgccagcctcatccctgtgtctttcgtcctcggcttctacgtaacgctcgtggtgaatagatggtggagtcaatatttatgtatgccacttcccgacgcgctgatgtgcgtggtggcaggaactgtccatggcagggacgaccggggaagactgtatagaaggaccctaatgagatatgctggcctgagtgctgttctgatcctgcgttcagtaagtaccgctgtgttcaaaaggtttcctactattgatcacgtggtagaagcaggctttatgaccagggaggaaaggaaaaaattcgagaatctgaatagctcctataataagtattgggtgccttgtgtgtggtttagtaatctggctgcacaggcccgtcgcgagggacgaatccgggacaactctgcccttaagttgctgctagaggaactaaacgtgttccggggtaagtgtggcatgctattccactacgattggatttcggtgccattggtgtacacccaggtggttaccatcgcactatatagttacttcctggcctgcctgatcggcagacagttcctggaccccgcacaaggttataaggaccacgatttagacctgtgtgttcccatcttcacacttctgcagttcttcttctacgccggttggctgaaagtcgcagagcaactgattaacccattcggtgaggatgatgacgattttgaaacgaactttttgatcgaccgaaattttcaggtgagcatgttggcagtcgacgagatgtacgatgacttagctgtgctagagaaagatctgtattgggacgctgccgaggcgagagcaccatacacagccgcaacggtgttccagctcaggcaaccgagcttccaaggaagcaccttcgacattaccctggcgaaggaggacatgcagtttcagaggttggatggactggacggacctatgggagaagcccctggagacttcctgcaaagactccttcctgccggagcaggaatggtggcaggtggcccattggggaggcgactaagttttcttcttcgcaagaatagctgcgtaagtgaggcaagcacaggagcctcctgttcatgtgcagtcgtcccagaaggagctgcccctgagtgcagctgtggtgaccccctgctggaccctggtctgcccgaacccgaggctccaccgccagccggacccgaacctctgacactcatccccggtcccgtagagcccttcagcatcgtaactatgcctggacctagaggtccggctcctccgtggctccccagccccattggtgaagaagaagagaaccttgcatag

SEQ ID NO: 215935 - DNA, 219 bp, Artificial Sequence
  Description of Artificial Sequence: Synthetic coding sequence
atgttcctaatatccagctcggtacacggctccgacgaacatggaaggctgctgcggaggacactgatgagatatgttaatcttaccagcctcctgatatttcgtagtgtgagtaccgcagtgtacaagaggttcccaaccatggaccacgtggtggaggcagagcgcactggaatgaagcccattttacctagttcattcgagatgcagagcttttag

SEQ ID NO: 215936 - DNA, 2007 bp, Artificial Sequence
  Description of Artificial Sequence: Synthetic coding sequence
atgacagttacttattcaagtaaggttgccaatgcaaccttttttggtttccatcgtctgcttctcaagtggagaggcagtatctataaactgttgtaccgcgagttcatcgtattcgctgtgctgtatacggcaattagtctcgtgtatcggctgttgctcacgggtgtgcagaaaaggtacttcgaaaagctgagcatctattgtgacaggtatgctgagcagatcccggtgacattcgtgctgggattctacgtgacgcttgtggtgaaccgatggtggaaccaattcgtgaatctgccttggccggaccgcttgatgttcttaatctcctcctccgtccacggcagcgacgaacacggacgcctcctcaggaggacacttatgagatacgttaacctgacctctctgctcatatttcggagcgtttccacagctgtgtataagcggttcccaacaatggatcatgtggtcgaggctgggtttatgaccacggacgaacgaaaactttttaaccatttgaagtctcctcacctgaagtactgggtcccatttatctggttcggaaatctggctacaaaggctagaaacgaaggcagaatcagggatagtgtggaccttcagtcactaatgacggagatgaacagatatagatcatggtgtagtttgctcttcggttatgactgggtcggaattccgttagtctacacgcaggtggtgacgcttgccgtctacacttttttctttgcttgtctgatcggaagacagtttctggaccctactaaagggtacgctgggcacgatctcgacttgtatattccaatatttaccctactgcagtttttcttctacgctggatggctgaaggtggccgaacagctgataaaccccttcggcgaagatgatgacgacttcgaaacaaactggtgcattgacagaaacctccaagtctctctgcttgcagtggacgagatgcacatgtcactcccaaagatgaagaaggacatttattgggatgactcggctgcgaggcccccttacaccctggccgcagccgattattgcatccccagtttcttaggatctactgttcaaatgggcctgtcaggatcagatttcccggatgaggaatggctgtgggattacgagaagcacgggcatcgtcactcgatgatcagaagggtgaagcgctttttatctgcacacgaacatccaagctctccgagacggagaagctatcgcaggcagacctctgacagtagtatgttcctgccgagagatgatctatcacccgctagagacctcctagatgtaccaagtaggaatccaccgagggcctctcccacctggaaaaagtcctgcttccctgagggatcccctacccttcatttctctatgggagagttgtcaactatcagggagacctcacagacttcgacactgcagagtctgacccctcaaagctcagtccggactagtccaatcaaaatgcctctcgttccagaagtgctcattacagccgcagaggcgccagtgcccacttctgggggttatcaccacgatagcgctacttccatactgtcttcagagtttactggagtccagccatcgaaaaccgaacagcagcagggccctatgggttcaatcctgtcccccagtgagaaggaaacgccgcctggagggccttccccccaaacggtgagtgcctctgccgaggaaaacatctttaattgcgaggaggaccctggcgatacattcctgaaacgttggtcattgcccggattcctgggtagctctcacacctctttgggcaatctgtcgcccgatccaatgtcctcacaacctgcgctgctcatcgacaccgaaacctcctctgaaatctctggaattaatatcgtggccggatcaagggtcagttccgatatgctttatctgatggagaatttggatacaaaagaaaccgacattattgagctcaataaagaaaccgaggagagccctaaatag

SEQ ID NO: 215937 - DNA, 1197 bp, Artificial Sequence
  Description of Artificial Sequence: Synthetic coding sequence
atgaccgtgacgtattcgtcaaaggttgccaatgccactttttttggcttccatagactgttactgaagtggcgtggcagcatctacaaacttctttaccgagagttcattgtgttcgctgtcctctacacagcgatttctctggtatacagactgctcctgaccggtgtccaaaagaggtattttgagaagctgtccatttactgtgaccggtacgctgagcagatccccgtgacctttgtgctgggtttctacgtgacactggtggtcaacagatggtggaatcagttcgtcaacttaccttggcctgatcgcctgatgtttctgatcagctcatctgttcatggatccgacgaacacggacggctgttgagacgaactttgatgcgatatgtcaacctcacctctctcttaatcttccggtctgtgtctactgcagtgtacaagagattccctactatggaccatgtggtggaagccggtttcatgaccacggacgagcgcaagctttttaatcacctgaagtcaccccaccttaagtattgggttcctttcatctggttcgggaacctggcaaccaaagcacggaatgaggggagaatcagggactctgtggatctgcagtctttgatgacagagatgaaccgctaccggtcttggtgtagcctgctgttcggttatgattgggtagggattcccctcgtgtatactcaagtggtgacacttgctgtctacaccttcttctttgcctgtttgattgggaggcaatttctggatcctaccaaaggatacgctgggcacgacctggatctgtatatccctattttcactctgctgcagttcttcttctatgcagggtggcttaaagtggcagagcagctcatcaatcctttcggcgaggacgacgacgactttgaaacaaattggtgcatcgatcgcaatctgcaagtgtcactgctggccgtggatgagatgcacatgagcctgccaaagatgaaaaaagatatatattgggatgactctgcagcccgacccccttacacattggctgctgccgactactgcatcccatccttccttgggtcaacggtccagatgggcaagcagatgccgaaaaacgaatggaagatggaagatattaaaattccgctcccacagccacagtttcagtgtgccaaatccgatcccggaggttag

SEQ ID NO: 215938 - DNA, 219 bp, Artificial Sequence
  Description of Artificial Sequence: Synthetic coding sequence
atgttcctgatttctagcagtgtgcatggaagcgacgaacacggtaggctgctgcgcagaactctcatgagatacgtcaacttaacatcactgcttatattccgctcagtatctacggccgtgtataagaggtttccaaccatggatcatgtggtcgaggctgaaaggactgggatgaagccgattctgcccagcagtttcgagatgcagtccttctag

SEQ ID NO: 215939 - DNA, 1368 bp, Artificial Sequence
  Description of Artificial Sequence: Synthetic coding sequence
atgaccactgacgaaagaaagcttttcaaccatttgaaaagtccgcacctaaagtattgggttcctttcatatggtttggtaacctggccacaaaggcaaggaatgagggccgtatcagagacagcgtggacttgcaaagcctcatgaccgagatgaaccgctacagaagctggtgctccttgctgtttgggtacgactgggtcggtattccactggtgtacactcaggtcgcggaacaattgattaatccttttggtgaagacgacgacgattttgaaactaactggtgcatcgatagaaatctgcaggtgagcctacttgctgtcgacgagatgcatatgagcctgccgaagatgaagaaggacatttactgggacgactctgccgcacgcccaccttataccctcgcagccgcagactactgtattccgagtttcttaggttccacagtgcagatgggactgtctgggtctgattttcccgacgaggaatggctgtgggattacgaaaagcatggccatcggcattccatgatccggagagttaagagatttctgagcgcacatgagcacccgagttcccctcgtagaagatcttaccgacgacagactagtgattctagcatgtttctcccgagggatgacctcagccctgcacgggacctgctagatgtgcccagtcgcaatcctccgagggcaagcccaacatggaagaaatcttgtttccctgaaggctcaccgaccctgcacttctctatgggcgagttgtcgaccatccgggagacctcccagacatccacactgcagagtctcactccccaaagttctgtgaggaccagcccaatcaagatgcccctggtcccggaggtgctgatcacagccgctgaagcccctgttcccacttccgggggttatcaccacgactctgccacatccattctgagttccgaattcacgggggtgcagccttctaaaactgagcagcaacagggtcccatgggtagcatccttagtccctcggagaaggaaacacccccaggagggccaagtccccagaccgtttctgccagtgccgaagagaatattttcaactgcgaggaggatccaggcgatactttcttaaaacggtggtccttgccaggattcctgggctcgagtcatacgtctctgggcaatcttagccctgaccccatgtcatctcagcctgctctgctgatagatacggaaacttcttccgagatttccggaataaatatcgtagccggttcgagggtgtccagtgacatgttatacctcatggagaatctggacacaaaggaaacagatatcattgaacttaacaaagagacagaagagtcaccaaagtag

SEQ ID NO: 215940 - DNA, 219 bp, Artificial Sequence
  Description of Artificial Sequence: Synthetic coding sequence
atgttccttatcagctcctccgtgcatggttcagatgaacacggacgcctcctccggcgtactctcatgagatatgtgaacttaaccagcctgctgatatttagaagcgtcagcactgctgtgtataagcggttccctactatggaccacgttgttgaagccgagcgcactggaatgaagcctatcctcccatcctcatttgagatgcagtctttttag

SEQ ID NO: 215941 - DNA, 1422 bp, Artificial Sequence
  Description of Artificial Sequence: Synthetic coding sequence
atgactgtgagttacacccttaaggtggccgaagcccgatttggcggattcagtggcttactgttgaggtggcgtggaagcatttacaagctgctgtacaaggaattcctgctgtttggcgctctttatgcagtgctcagcataacttataggctcctcctcacccaggagcagaggtatgtatatgctcaggtggcccgttactgcaaccgatcagccgacttgatccctctctctttcgtgctgggattttatgttaccctggtggttaaccgttggtggagtcagtatactagcataccactgccagaccagctgatgtgtgtgatctcagccagcgtccatggcgtggatcagagaggaaggcttctgcgtcggacgctgatccggtacgccaatctcgccagcgtcctggtactcagatctgtaagcacccgcgtgcttaaacgcttcccaactatggaacacgtggtcgatgcaggctttatgagccaggaggaaagaaagaagttcgagtctcttaagagtgattttaataaatactgggtgccctgcgtgtggttcaccaatttggccgctcaggctagaagggacggacggatccgcgacgacatcgctttgtgtctgttgctggaagagctgaacaaatacagggcaaaatgctcaatgctatttcactacgattggattagcattccactggtgtacactcaggtcgttaccatcgccgtctattccttcttcgccctttctctcgtcggccgtcagtttgtagagcccgaagccggagccgcaaagcctcagaaattgctcaagcccggacaggaacctgctccagcgctcggcgatcccgatatgtacgtgccactaactacattattacagttcttcttttatgctggctggttaaaggtggcggagcagataataaatcccttcggggaggatgatgacgatttcgagaccaaccagctaattgacagaaatttgcaggtgtcactgctttctgtggacgagatgtaccagaacctgccacctgcagagaaggatcagtattgggatgaggatcagccccagcccccttataccgtggctaccgctgccgaaagcctgcggccaagttttctcggctctacctttaacctgagaatgtccgatgatccagagcagagtttgcaggtcgaagcatctccgggatctgggagacctgcaccggctgctcagacgccactcctgggccgtttcctcggggtcggtgctccatctccagccataagcctccgtaactttggtagggtgcgtgggacacccaggccccctcatctcctgaggttccgtgcagaagaggggggtgaccccgaggctgcagcccgaatcgaagaagaatcggctgagagtggcgacgaagcgctggagccctag

SEQ ID NO: 215942 - DNA, 294 bp, Artificial Sequence
  Description of Artificial Sequence: Synthetic coding sequence
atgtatctcggtattacgccttcagtaacatgcaataactcttctaagaacgaattctccttgatcttggagaaaaatccactggtggagttcgttgaggaattacccgcaggtaggtccagcttgtgctattgtaacctgttgtgcggtatcatcaggggagccttagaaatggtccatctggcagctgatgtcaccttccttcaggatcgactcaagggggattcagtgactgagatcggaatcacatttttaaaaaagcgggacgaaaagaaataccgcggtaagaaatag

SEQ ID NO: 215943 - DNA, 546 bp, Artificial Sequence
  Description of Artificial Sequence: Synthetic coding sequence
atgtcacggcctgcccaccgaagacctgagtaccacaaaataaacaaagatctctttgttctgacttatggcgcactggtagcccagctctgcaaagactacgagaaggatgaagatgtaaatcagtacctggacaagatggggtatggaataggcacccgacttgttgaagactttctggccaggagctgcgttggacgctgccattcttattccgaaattatagacattatcgcgcaggttgcctttaagatgtacctggggatcactccatcagtcacttgtaacaacagctctaagaacgagttttcgttaattctggagaagaatcctctagtggagtttgtggaggagctgccagcgggacgatccagtctgtgctattgcaatctgctctgcggcataataaggggagcactggagatggtacacctggctgcggatgtcactttccttcaggaccggttaaagggggactccgtcactgaaatcggcatcacgttcctgaaaaaacgcgacgagaaaaaatacaggggtaaaaagtag

SEQ ID NO: 215944 - DNA, 504 bp, Artificial Sequence
  Description of Artificial Sequence: Synthetic coding sequence
aataaggatctcttcgtgctgacttacggcgcactggtggcccagttatgcaaggattatgaaaaggatgaggacgtcaatcagtatctcgacaagatgggctatggtataggcacacggctagtagaagatttcctagctcgaagttgcgtgggaaggtgccacagctattcagagatcatcgatatcatagcccaggttgctttcaagatgtatctcgggatcacaccaagcgtgacttgcaataatagttccaaaaatgagttttctctcatcctcgaaaagaatccgttagttgagtttgtggaagagctgccagccggaagaagttccctgtgttattgcaatttgctctgtggaattataaggggagccttagagatggtgcacctggctgccgatgtgacatttttgcaggacaggctgaagggtgattctgtgaccgaaattggaatcacatttctgaaaaagagagacgagaagaaatatagaggcaaaaagtag

SEQ ID NO: 215945 - DNA, 1497 bp, Artificial Sequence
  Description of Artificial Sequence: Synthetic coding sequence
atgcgcccaccggcatgttggtggcttctggcccctcccgcactactggcactacttacgtgttccctcgcctttggcctcgcatccgaggataccaaaaaggaagtgaagcaaagccaggatctggagaaaagtggcatttccaggaaaaacgacattgatctcaaagggatcgtgtttgtgattcaatcccagtccaatagctttcatgctaaacgcgctgaacaactgaaaaaaagcatccttaagcaggccgctgatttgacacaggagctgccctctgtccttctgctccatcagttagcgaagcaggagggagcatggacaatcctgccactcctgccacacttcagtgttacatatagcagaaattcttcatggatctttttttgcgaagaagagacacgcatccagatccctaaattgctagaaacactcagacgctatgacccaagtaaggagtggtttctaggaaaggcgctccacgatgaggaggctaccattatccaccactacgctttctccgaaaaccccaccgtgtttaaatatcccgatttcgccgctggatgggcactgtctatcccccttgtcaataaactgaccaaacgattaaagtccgagagtctgaaatccgattttaccatagacctgaagcacgagattgctctgtacatctgggacaagggtggtggaccccctctcacgcctgttccagagttttgtacgaacgacgtggacttctattgtgctactaccttccactctttccttcccctgtgccgaaaacccgtgaaaaaaaaggatatcttcgtggccgttaagacgtgtaagaagttccatggcgaccgcattcccattgtcaaacaaacctgggagagtcaggcatcattgatcgagtattattcggactataccgagaactctatccccaccgtagatctggggatccccaatacagatcggggacattgcggaaaaactttcgcaatactcgagaggttcctgaacaggtcacaggacaagaccgcatggcttgttattgttgatgacgacactttaattagcatttcacgactgcagcaccttctttcttgttatgatagcggggagcctgtctttctgggagaacggtacggttacggtctgggcacgggcggatactcatatataacaggcggaggaggaatggtcttcagccgcgaagccgtgaggcgcctcctcgccagtaagtgtcgatgctacagtaacgatgcgcctgatgacatggttctcggcatgtgcttttcgggtttaggcatccctgtgacccattcacccctgtttcaccaagccaggccagtagattaccctaaggactacttatcacaccaggtccccatttccttccacaaacattggaatattgatccagtcaaagtgtattttacatggttggccccatcagatgaagacaaggcccgtcaggagactcaaaagggcttccgggaggagctgtag

SEQ ID NO: 215946 - DNA, 1005 bp, Artificial Sequence
  Description of Artificial Sequence: Synthetic coding sequence
atgccgaaacgccgagacattctggcaatcgtacttattgtgctcccttggaccttgctgatcacagtctggcatcagtcgaccttggcccctctgcttgctgtccataaagacgagggcagtgacccacggcgagaaacccctcctggcgctgaccctcgtgaatattgcacaagcgatcgggatattgtggaggttgtccgcacagaatacgtctatacgcggccacctccatggagcgatacgttgcctacaatccacgtcgtcactcccacctattcgagacctgtgcagaaagccgaactgaccagaatggccaacacattgctgcatgtcccgaacctgcactggctggtggtcgaggacgccccaagacgaactccgctgacagccaggctcctgagagatacaggtctgaactacacccatctgcacgtggaaaccccgagaaattataagcttaggggcgacgcaagggatccacggataccaagaggcacgatgcaacggaacttagctttgcgctggttgcgcgagacctttccgagaaatagtagtcagccaggggttgtgtactttgctgacgatgacaacacatactccctggagctcttcgaggaaatgcggagtactaggcgggtgagcgtgtggcctgtcgcctttgtaggagggttgcggtacgaagccccaagagtgaatggcgctggcaaagttgtcggatggaagacagtgttcgatccacacaggccattcgctatcgatatggcaggctttgctgttaacctgcggttgatacttcagaggtcccaggcctactttaagctcagaggtgtcaaaggtggctaccaggagagctctctcctacgtgagttggtaaccctgaatgatctcgaacctaaggctgccaattgtacgaaaatcttggtctggcacactcgtaccgagaagccagttctcgttaatgagggcaaaaaaggtttcaccgatccaagtgttgagatttag

SEQ ID NO: 215947 - DNA, 1005 bp, Artificial Sequence
  Description of Artificial Sequence: Synthetic coding sequence
atgcccaaaagaagggacattctggctatcgtattaattgtcctgccgtggacacttctgataaccgtgtggcatcaatctaccctcgctcccctactcgccgttcacaaagatgagggctctgatcccagacgcgagacccctcccggagccgaccctcgcgagtactgcacgtcagatcgagacattgttgaggtcgttcggacggaatatgtatatacacgacctcctccgtggtctgatactctgccaactatccacgtggtgacccctacctacagcagacctgttcagaaagctgaactgacaagaatggctaatactctgctgcacgttcccaacctgcactggctcgttgtcgaagatgcacctcgccgaacacccctgacagccaggctgctgagggacaccgggctcaattatactcacctgcacgtggagacccccagaaactataaattacgcggtgatgcacgggaccctcgtattccccgtggcacaatgcagcggaacctggctttgagatggcttagggaaacttttccacgaaacagttctcaacccggagtagtctattttgcagatgacgataatacctattctttggagctcttcgaggagatgagaagcaccagacgcgtttctgtctggcccgtggcattcgtgggcggactcagatatgaggctccacgcgtgaacggagcagggaaggtggtcggatggaaaaccgtgttcgatcctcacagaccattcgccatagacatggccggattcgcagttaacctccgcctcatcttgcagagatctcaggcgtactttaagcttcgcggagttaagggcggatatcaggaaagctcacttctgcgtgagcttgtcactctcaacgacctggagcctaaggcagctaactgcacaaagatcttagtgtggcacacaagaaccgaaaaacccgtcttagtcaacgaagggaaaaaaggatttacagatccatcagtcgaaatttag

SEQ ID NO: 215948 - DNA, 1005 bp, Artificial Sequence
  Description of Artificial Sequence: Synthetic coding sequence
atgcctaagaggagggatattcttgccattgtcctcattgtcctgccgtggactctgctgatcacagtgtggcatcagagtacactggccccactgctcgcggtccacaaggatgaaggatctgaccctagacgtgagacccccccaggtgccgatcccagggagtattgcacgtccgacagagatatagtcgaggtggttcgcactgagtacgtttatacacgtccacctccttggtctgacacactgccaaccatacacgtggtgacccccacctatagccgtcctgtccagaaggctgagcttacaagaatggcaaacacactgttacacgttcccaacttgcattggctggtggtagaagatgctcctcggagaactcctctcaccgccaggctgttgagagatactggcctgaattatacgcacctccacgtcgaaacccccaggaactataaactgaggggcgacgctcgggatcccaggatcccacgaggtacgatgcagcgcaatttggcgctgcgctggctgcgagagacgtttcctcgcaacagcagtcagcccggagtggtgtatttcgccgatgacgacaacacatactccctcgagctattcgaggaaatgagaagtacccgcagagtgtctgtgtggcccgttgcattcgtgggaggacttagatatgaagccccacgcgtcaacggggcaggtaaggtcgttggctggaaaactgtgtttgatccccaccggccatttgcaatcgacatggccggatttgccgtgaacctccgtctgatactgcagcgctctcaggcatattttaagctgcggggagtgaaaggaggctatcaggagagtagtctgctgcgagagcttgtcaccctcaacgacttggagcctaaagctgcaaactgcacaaagattctggtctggcatactcgcaccgagaaacctgtactggtgaacgagggcaagaagggcttcacagacccaagcgttgagatctag

SEQ ID NO: 215949 - DNA, 1044 bp, Artificial Sequence
  Description of Artificial Sequence: Synthetic coding sequence
atgggcaatgaggagccatgggtgcagccagctctcgaaatgcccaagcggagggacattctggcaattgtcctcatcgtgttgccttggacccttctgattaccgtgtggcatcagtccactctggccccactgctcgcagtgcataaagatgaggggagtgatccacgaagagagaccccacccggtgccgatcctcgggaatattgcacatccgatagagatattgtagaggtagtgcggaccgagtacgtctatacacgccctcctccttggtcggatacactcccaacgattcacgtggtgacacccacctacagtagacccgtacagaaggccgaactaacccggatggctaataccctgttgcatgtgccaaacctgcattggttagtagtcgaggatgcacccagacgtactcctttgacagccagacttctccgcgacactggccttaattatacccacctccatgttgaaacccctcggaattacaaactccggggtgatgccagggatccgaggattcctcgaggcaccatgcagcgaaacctggctctcagatggctcagggaaacattccctcgaaactcttctcagcctggagtggtttattttgctgatgatgacaacacgtattctctggagcttttcgaagagatgaggagcacacggcgagtgtctgtttggcctgtcgcatttgttggcggactgaggtacgaggcgcctagggtgaatggtgcagggaaggtggtgggttggaagacggtgtttgacccccacaggccattcgccattgacatggctggttttgcggtaaacctccggctgatattgcagcgtagtcaagcttatttcaaactgcggggtgttaaaggcggttaccaggaatcttcgctgttgagggagctggtgacacttaatgacctcgaacccaaggcagctaattgcacaaaaattctggtttggcacaccaggactgagaagccggtcctggtaaacgagggaaagaagggattcacggacccatccgtggagatttag

SEQ ID NO: 215950 - DNA, 1008 bp, Artificial Sequence
  Description of Artificial Sequence: Synthetic coding sequence
atgaagctaaagctgaaaaatgtgttcctggcgtacttcctcgttagtatcgctggcctcctgtacgccctggtacaactgggccagccatgtgattgtctccccccactacgggctgctgccgagcagttaaggcaaaaggatctgcggattagccagctacaagctgagctccgaaggcccccacctgccccagcacagcctcccgagcccgaagcactgcctacaatttacgtggttaccccaacatacgccaggctggtccagaaggcagagctggtccgcctttcacagacactctctcttgtgccacggttacattggctgctcgtggaagatgctgaggggcctacccctcttgtaagtggtcttctcgccgctagcgggctgctgtttacacatttagtggtgctgacacctaaggcacagaggctacgtgagggggaacccggttgggtccacccgagaggggtggagcagagaaacaaagcgctggattggttgagaggaagaggcggagctgttgggggagagaaggacccccctccaccaggtactcagggggtcgtgtacttcgcagacgacgacaacacttattctcgcgagctgttcgaagagatgcgttggacacgaggggtctctgtatggcctgttggactggtcgggggactgcggtttgagggccctcaagtccaagatggccgagtcgtcggtttccacacagcttgggaacccagtcgccctttcccagtggacatggctggatttgcagttgctctgccgcttctgctcgacaagcctaacgctcaatttgattctacggccccaagaggacacctcgagagctctttactgagtcacctggttgaccctaaggaccttgagccacgggcagctaactgcactagggtcttggtctggcacacgaggaccgagaaacccaagatgaagcaggaggaacagctgcagcgtcaggggagggggagcgatcccgcaattgaggtgtag

SEQ ID NO: 215951 - DNA, 948 bp, Artificial Sequence
  Description of Artificial Sequence: Synthetic coding sequence
atgaaactcaagctcaagaacgtcttcttagcgtattttttggttagtatcgctgggcttctatatgccctggtgcagctgggacagccatgtgattgcttgccccctctgcgcgctgcagcagaacagttgcgtcaaaaagatttgaggatcagccagctacaggctgaactaaggagaccccctcccgctccggctcaacccccagagcccgaggcgctcccgaccatttacgtggttaccccgacatatgcgagactggtgcaaaaggcagaactggtccgcctgtctcagacactatccctcgtgcctaggctccattggttgctggtggaagatgccgaagggccaacccctctggtgagcggcctgttggcagccagtggcctgttgttcactcatctcgtggttcttaccccaaaagcgcagcgactgcgggagggcgagcctgggtgggtacatccaaggggggtcgagcaacgcaataaagctctagactggctgcgtgggagggggggagctgtcggtggcgagaaggacccccctccgcctgggacacaaggggttgtatacttcgctgacgatgataatacttactcacgagaactgttcgaggaaatgcggtggactaggggcgtgtccgtgtggcctgtggggctggtaggaggactgcgctttgaaggacctcaagttcaggatgggcgagtggtgggattccacaccgcctgggagcccagtcgtccttttcccgtggacatggccggtttcgccgtggctctgcccctgctattggacaagcccaacgctcagtttgattctacagctcccaggggacacctggaatcctccctgttgtcccatctggtggacccgaaagatctcgagccgagggctgccaattgcaccaggactgaaagcaggtgcgtgactcaggccggagtacagtag

SEQ ID NO: 215952 - DNA, 2997 bp, Artificial Sequence
  Description of Artificial Sequence: Synthetic coding sequence
atgggcagtcctcgggcagcccgtccgccactactgctgcgcccagttaagttgctgaggaggagattcagattactgctggctctggctgtggtaagcgttgggttgtggacactatacctcgagctcgtcgccagcgcacaggtcggaggtaatcccctaaaccgcagatacgggtcctggagagagcttgccaaagccctggcaagtcgcaatattcccgcagtggatccacacctacagttctaccaccctcaacgcctaagcctcgaggaccatgacattgaccagggtgtgagttcaaactcctcatatctaaagtggaacaaacctgtgccatggctgtctgagttccgaggcagggccaacttacacgtgttcgaagactggtgcgggagttccattcagcagctacgcaggaatctccacttccccctgtaccctcatattcgaactaccctgaggaaacttgccgtctctccaaagtggacaaattatggactccggatttttggatacttgcatccattcactgacggcaaaatccagtttgcaatcgcggcagacgacaatgcggaattttggctgtccctggatgatcaggtctcagggctgcagttgctcgctagcgtaggaaaaacaggaaaggagtggaccgccccaggtgaatttggcaaattcagatctcagataagcaaaccggtgtccctgagcgcctcgcaccggtactatttcgaagttctccataagcagaacgaggaaggcacagatcacgtcgaagtggcctggagacgaaatgaccctggagcgaaattcacgataatcgatagcctcagcctgtcgctgttcactaatgaaaccttcctgcagatggatgaagttggccatatcccccagaccgctgcttcacacgttgacagctctaacgcattgcccagagacgagcagcctccagcagacatgctgaggccagaccccagggatactctctatcgagtccctctgatccccaaaagtcatctgagacacgtcttacccgactgcccttataaaccttcttacttagtagacggtctccccctgcagcgataccaggggctcaggttcgtccatctgtctttcgtgtacccaaatgattacacccgattgtcccacatggagacacataataagtgcttttatcaggaaaacgcgtactatcaagacagattttcattccaagagtatattaaaatcgatcagcctgagaaacaagggctggaacagccaggcttcgaagaaaatctcctggaagagagccaatatggtgaagtggccgaagagaccccagcttctaacaaccagaatgctaggatgctcgagggcaggcagacacccgcaagtacactcgagcaagacgcaacggattatcgcttaagaagccttaggaagcttctggcccagccaagagagggactcctcgcacccttttctaagcgtaatagcacagcttcattccctggtcgcaccagtcatattcccgtgcagcagcccgagaaacgtaagcaaaagccgtctcctgagcccagccaagactcccctcattctgacaaatggcctccaggacacccagtgaaaaacctgccccaaatgcgtggcccaaggcctaggccagccggagattcaccacgaaagactcaatggctaaaccaggtcgaaagctatatagccgagcaacgtaggggcgataggatgagaccgcaggcacctggcagggggtggcatggggaggaagaagttgtcgcagctgcgggacaggagggccaggtggagggagaagaggagggagaggaagaggaggaagaagaagatatgagcgaggtgttcgaatacgtcccagtgttcgatcccgtggttaactgggaccaaactttctcagcacgcaatctggattttcaggctctccgaaccgactggattgacctgagctgtaacacttcgggaaacctactgttgcctgagcaggaagccctggaagtaacccgggtcttcctcaaaaagctcaaccagaggagcagaggcaggtaccaacttcaacggattgtgaacgtagaaaagcggcaggaccagctgcgtgggggtcgctacctactcgaattagagctgttggagcaaggccagcgcgttgttcggctaagtgagtatgtgtcggcaagaggatggcaaggcatcgatcccgcaggcggagaggaagttgaagccaggaatctgcaaggccttgtgtgggatccccataatcggaggcgccaagttttgaatacaagggctcaagaacctaaactgtgctggccacaggggttcagctggtcgcacagagccgtggttcacttcgtggtcccggtcaagaatcaagcgaggtgggtgcagcagttcataaaagatatggagaatttattccaagtgaccggggacccccattttaacatcgtgatcaccgattactccagcgaagatatggatgtggaaatggcactgaagcgatccaagctgagatcttatcagtatgtgaagctgagtgggaatttcgaaagatcagcagggctccaggcaggaatcgatctcgtgaaggaccctcattccataattttcttgtgcgacctgcatatacacttccctgcaggcgtcatcgacgccattaggaaacactgtgtggagggtaaaatggcatttgcaccaatggttatgaggcttcactgtggcgctaccccccagtggccggagggctattgggaagtgaatggcttcggattattaggcatttataagagtgacttggaccgaattgggggaatgaatacgaaagagtttagggacagatggggcggagaagattgggagctgctcgaccgcattctacaggcagggttggacgtggagcggctttctctgaggaactttttccatcacttccactcaaagcggggaatgtggagcaggcgccagatgaagacactttag

SEQ ID NO: 215953 - DNA, 306 bp, Artificial Sequence
  Description of Artificial Sequence: Synthetic coding sequence
atgagcaggagtgtcgccttggccgttcttgcactgctttctctgtctggactcgaagccattcaacgaacaccaaaaattcaggtgtacagccgtcaccctgccgaaaacggtaagagcaactttctcaactgttacgtgtcaggattccatccatctgacatcgaagtggatctcttaaagaatggagaacgaattgagaaggtggaacactcagatctcagtttctccaaggactggtcattctacctgctctattacacagagtttacgcccacagagaaaatgagcatgcccgctgtttag

SEQ ID NO: 215954 - DNA, 369 bp, Artificial Sequence
  Description of Artificial Sequence: Synthetic coding sequence
atgtctaggtcagtggcactggcagtgcttgcattattaagcctgagcgggctggaggccatccagcggacaccaaagattcaagtttattccaggcaccccgctgagaacggtaaatctaacttccttaattgttacgtatcaggtttccacccctccgatattgaagtggatctactcaaaaatggggaaagaattgaaaaggttgaacatagcgatctgtcgttcagcaaagattggtccttttacttattgtattacaccgagttcactccaaccgagaaagacgagtacgcctgcagggtcaaccatgtcaccctctctcagcctaagattgtaaagtggggaaaaagttatatccttttatag

SEQ ID NO: 215955 - DNA, 360 bp, Artificial Sequence
  Description of Artificial Sequence: Synthetic coding sequence
atgtcccgctctgtcgcactggcggttctcgccctcttgagtctgtccggactggaagctatccagaggacgccaaagatacaggtctactcccgacatcccgcagagaacgggaagagtaacttcctcaattgctacgtgagtggctttcacccctcagacatcgaggtagacctgctcaagaatggagagaggattgagaaagtcgaacacagtgacctgtccttctccaaggactggagcttctaccttctgtattatacagagtttacacccacagagaaagacgagtatgcttgtagggtcaaccacgtgacactttcacagcccaagattgtgaaatgggatcgcgacatgtag

SEQ ID NO: 215956 - DNA, 369 bp, Artificial Sequence
  Description of Artificial Sequence: Synthetic coding sequence
atgtctcgatccgtagcacttgcggtactcgccttactttctcttagtggcttggaggcgatacagcggaccccgaagattcaggtgtacagcagacatcctgctgagaacgggaagagcaactttcttaattgttacgtctccggctttcaccccagcgacatcgaagtggatctcttgaagaatggagaaagaatcgaaaaggtagaacattcggatctcagtttctcaaaagattggtcattctacctgctgtactatactgaatttacgccgaccgagaaggatgaatacgcctgtagagtgaatcacgtgacgctgagtcagccaaagattgtcaagtggggcaaatcctatatcctgttatag

SEQ ID NO: 215957 - DNA, 360 bp, Artificial Sequence
  Description of Artificial Sequence: Synthetic coding sequence
atgagccgttctgtggcattagccgtccttgcattgctctctttgtcaggcctagaagcaatccagcggacacccaagatccaagtttactcaagacaccccgctgaaaatgggaaaagcaacttcctgaactgctatgtgtccggcttccacccctctgacatagaagtggacctgctgaaaaacggcgagcgtatagagaaagtagagcactcagacctcagcttctccaaggactggagtttttacctactttactacacggaatttactcctacagagaaggatgagtatgcgtgtcgggtcaatcacgtgactctatcccagcccaagatagtgaaatgggatagagacatgtag

SEQ ID NO: 215958 - DNA, 360 bp, Artificial Sequence
  Description of Artificial Sequence: Synthetic coding sequence
atgtctcgatcggtggcgttggcggtgctggctctgctgagcctttcaggcctcgaggccattcagcggaccccgaaaattcaggtgtactcacggcatccagccgaaaacgggaagtcaaacttcctcaactgttacgtttctggcttccatccgtcagacatagaagttgacctgctaaagaatggggagcggatcgaaaaggttgaacatagcgatctgagcttctccaaggattggtctttttacctgttatattacaccgagtttacccccacagaaaaagatgaatacgcttgccgcgtgaatcacgtgaccctgtcccagccaaagatcgtgaagtgggacagggacatgtag

SEQ ID NO: 215959 - DNA, 1644 bp, Artificial Sequence
  Description of Artificial Sequence: Synthetic coding sequence
atggacatcatcttcggcaggaaccgcaaggaacaactcgagcctgtcagggccaaggtgacaggtaaaatccctgcatggctccaaggaactctgctccgcaacggcccaggaatgcatacagtgggcgaatcgcgctataatcactggtttgatgggctggctctgctgcatagtttcactatcagagatggagaggtttactatcgctctaagtatctccggtctgacacatacaacaccaacatagaggctaaccggattgtggtcagtgaattcggaacaatggcgtaccccgacccatgcaagaatatcttctcaaaggcgtttagctacttaagccataccatccccgatttcacagataattgcttaatcaacattatgaagtgcggtgaagacttctacgctacgtccgagactaattatatccgcaaaatcaaccctcagaccttagaaacattagagaaggttgattaccgcaagtatgtagccgtcaatctggccacctcacacccccactatgacgaggctggaaacgttctgaacatgggaactagcattgtcgagaagggtaaaacgaaatacgtgatcttcaagatacccgctaccgtcccagagggtaaaaaacaaggaaagtctccatggaagcacacagaggtgttttgtagcatcccctctagatctctactctcacccagttattatcacagtttcggcgtgacagaaaattatgtcatctttctggagcagcctttcaggcttgacatcctgaagatggcaactgcgtacatccgtcgaatgagctgggcaagttgtcttgcattccaccgagaagaaaaaacgtacattcatatcatcgatcagcgcacacggcagccagtacaaaccaaattctacaccgacgcaatggtggtgtttcatcacgtcaatgcatacgaggaagacgggtgtattgtgtttgacgttatcgcatacgaagacaattcactgtaccagctcttttatctcgctaacctcaaccaagatttcaaagaaaacagccgactcacatctgtacccacgctcagaaggtttgctgtccccctccatgttgacaaaaatgcagaggttggaacaaatctgattaaagtagcaagtactactgctactgcactcaaggaggaagatggccaagtctattgtcagccagagtttctgtatgaagggcttgagctgcctcgggtgaactatgcgcataatgggaagcagtatcgctacgtattcgctacgggagtacagtggagcccgattcccacaaaaattattaaatatgacattctcaccaagtcaagccttaagtggagggaggacgattgttggccagctgaaccgctgtttgtcccagctcccggagcaaaggacgaggatgatggggtaattttgagtgccattgtatccactgatcctcagaaactgcctttcctcctgattttggatgcgaaatcttttaccgagctagccagggccagcgtggacgtagatatgcacatggatctccatggcttgttcattacagacatggactgggacaccaagaagcaggcggcatcagaggagcagagggatcgggcaagcgattgtcatggggctccattgacctag

SEQ ID NO: 215960 - DNA, 1437 bp, Artificial Sequence
  Description of Artificial Sequence: Synthetic coding sequence
atggctgcaggcaaccccgcaccccagtgggcctgggacgctcactcgtggggggtgcaaatccagcccctggtccgcagaccttgtcctgcccctcagctccatcaccagcggagagcgttttcatatctgtcccatacaattcccgatttcactgataactgtctgataaatatcatgaaatgtggtgaggatttctacgccactagcgagactaactacattaggaaaattaatccacagaccctagaaactctggaaaaggtagattaccgcaaatatgtggctgttaatttagccacatcccaccctcattatgatgaggccggaaatgtgctcaacatggggacttccattgtggagaagggaaaaacaaaatatgtcatcttcaaaatcccagctacagtccccgaagggaaaaagcagggtaaaagtccctggaaacatactgaggtgttttgttccataccaagccgtagtcttctgtcgccatcctactatcatagttttggggtcaccgaaaactatgtgatttttttggaacagccatttcgattagacattttgaagatggccactgcatatattagacgaatgtcgtgggcatcttgtctcgccttccacagggaagaaaagacctacatacatattatagaccagagaaccagacagcccgtgcagactaagttttacacggatgctatggtggtgtttcatcacgtgaacgcctacgaagaggacggctgcattgtatttgatgtaatcgcctacgaagataatagcctgtaccagctgttttacctggccaacctgaatcaggacttcaaggaaaacagcagactgacctccgtcccgaccttgaggcgttttgccgtgcctctgcacgtggataagaatgctgaggtcggaaccaatctgattaaggtggctagtacaaccgcaaccgcactcaaggaagaggacggacaagtgtactgtcaacctgagtttttatacgaggggctcgagctgccgagggttaactacgcccacaacggaaaacagtataggtacgtgtttgcaaccggagtgcagtggagccctatcccaactaaaatcatcaagtacgacatcttaacaaaatcgtccctgaaatggagggaagacgactgttggcccgctgagcctctgttcgtcccagctccaggagccaaagatgaggatgatggtgtgatcctctctgctattgtgagtacagacccacaaaaacttccttttctgctaatcctggacgcgaagtcttttaccgagctggcccgagccagtgtcgatgtggatatgcatatggacttgcacggcctgtttatcacggatatggattgggacactaagaaacaggcggcttccgaagagcagcgagatagagcaagtgactgtcacggagctccattaacatag

SEQ ID NO: 215961 - DNA, 1740 bp, Artificial Sequence
  Description of Artificial Sequence: Synthetic coding sequence
atgttttttcgagtctttctgcattttattcgaagccactccgctactgcagtggacttccttccagtcatggtccacagactccccgtgtttaaacgttatatgggaaatacccctcagaagaaggcggtatttgggcaatgtcgcggactgccatgcgtagcccctctgctgactacagtggaggaagcaccccgagggataagcgcccgtgtgtggggacactttcccaagtggctaaacggcagcttattacgcataggtccagggaagtttgagttcgggaaggataaatataaccattggtttgacggaatggccctgctccaccaattccgtatggctaaggggaccgttacctatcggagtaaattcctgcagagcgatacctacaaagcaaactctgccaaaaatcgtatcgtgattagcgaatttgggacgctggccctgcctgatccttgtaagaacgtattcgaacgattcatgtcaagattcgaactgccaggcaaggccgctgccatgactgacaacacgaatgtgaactatgtcaggtacaagggggactactatctttgcactgaaacaaactttatgaataaagtcgatattgagactttggaaaaaactgagaaggtcgactggtccaaattcattgccgtcaacggggcaacagcacatcctcattatgatctagatggtaccgcatataacatgggaaactccttcggcccttatggttttagctataaagtgataagagtgccgccagagaaagttgacctcggagagacaatccacggagtacaggttatctgtagcatcgcctcaaccgaaaaagggaagcccagctattaccatagcttcgggatgacccggaattacatcatattcattgaacagccacttaaaatgaacctctggaagatcgccactagtaaaatcaggggcaaagcattctctgatggaattagctgggagccacaatgtaacacgcgtttccacgtggtggaaaaacgtactggccagcttctgcccggtcgctattatagtaagccattcgtcacgttccaccaaatcaacgcatttgaggaccaaggatgcgtcatcatcgacctctgctgccaagacaacggacgcaccctggaggtctaccaacttcagaacctaaggaaggctggggaaggcctcgaccaggttcacaattcagccgctaaaagctttccacgacgctttgtcctccccttgaatgtatccttgaacgctcctgagggcgacaacttgtcccccctgtcatatacttccgcaagtgccgttaagcaggccgacggcaccatttggtgctcccacgagaatctgcatcaagaagatctggaaaaggagggagggattgagttcccacaaatatattacgacaggttttccgggaagaagtaccacttcttttacggctgcggtttcagacacttggttggagattccctcatcaaggtcgatgtggtcaacaaaactctgaaagtgtggagagaggacggcttttatccaagcgagccagtgttcgtccctgctcccggtaccaatgaggaggacggcggtgtgatcttgtcagtagtgattacaccaaaccaaaatgagagtaactttatcctggttctggatgctaagaattttgaagaacttggaagagccgaggtcccagtacagatgccatatggattccacggtacatttatccccatctag

SEQ ID NO: 215962 - DNA, 1638 bp, Artificial Sequence
  Description of Artificial Sequence: Synthetic coding sequence
atgggtaacacaccacagaagaaggcagtctttggccagtgtcgtgggctgccttgtgtggctcctttgttaactaccgttgaggaggcccctagaggaatatctgccagagtttggggtcattttcctaagtggctcaatggctctctgttgcgcatcgggccaggcaaatttgaatttggaaaagacaagtataaccattggttcgacggcatggccttgctgcatcagttccggatggcaaaaggcaccgtaacttaccggtccaagttcctccaaagcgacacttataaggctaattctgccaagaatcggatagtcatctcagaatttggcacattggccctgcccgacccttgcaaaaacgtcttcgaacggtttatgtcccgttttgaactgcctggcaaggccgctgcgatgaccgataatactaacgtgaattatgtgcgatacaagggagattactatctgtgtactgagacaaacttcatgaataaggtagacatagagacattggagaagaccgagaaggtcgattggtctaagttcatagcagtgaatggcgctaccgcccacccccactacgatctggatgggactgcttacaacatggggaatagtttcggaccctacgggttctcctacaaggtaatcagggtgccacccgagaaggtggacttgggagaaacaatccatggggttcaggtcatatgctctatcgcgtcaacggagaagggtaagccctcttattaccactcatttggcatgaccaggaattacatcatttttatcgaacaacccttgaagatgaacctatggaagatcgccacgagcaagatcagggggaaggcgtttagcgacgggatcagctgggaaccccagtgcaacactcgattccatgtggtcgaaaaaaggactggtcagttgttaccagggaggtactatagtaagccattcgtgacctttcatcagatcaatgctttcgaggaccagggatgtgtcatcatcgacttgtgttgccaagataatggtaggaccctggaagtgtatcaattgcagaacctgcgaaaggccggtgaaggtctggaccaggtccacaattcagcggcaaaatcattccccaggcgatttgtgctcccccttaacgtgtcgctgaatgcacctgagggtgataatctgagccctctctcttacaccagcgcctccgcagtgaaacaagctgacggaacgatttggtgttcccatgagaatctgcaccaggaagatctggagaaagaaggcggtatcgagttccctcaaatttactacgacagattttcagggaaaaagtatcattttttctacgggtgcggatttcgccatttagtcggggattctctgataaaagttgatgttgtgaacaaaacactgaaggtgtggcgagaggacggcttctatccctcagaacctgtgttcgtacccgcaccaggaaccaatgaagaagacggcggtgttatcttgtccgttgtcattaccccaaatcagaacgagtcaaattttatcctagttttggacgctaagaattttgaggaactgggcagggcagaggtgcccgttcagatgccatatggattccacggcacgtttatcccaatttag

SEQ ID NO: 215963 - DNA, 1638 bp, Artificial Sequence
  Description of Artificial Sequence: Synthetic coding sequence
atgggtaataccccccagaaaaaggccgtttttggtcaatgccgagggctgccctgcgtggcgcctttgcttaccactgtggaggaggcaccgagagggattagcgccagagtgtggggacacttccccaaatggttgaacgggagcctattaaggatcggccctgggaaatttgagtttggaaaagacaaatacaatcactggttcgacgggatggctcttctgcaccaatttaggatggccaaggggactgtcacttatcggtcaaagtttctgcagtcagatacttataaggccaactcagcaaagaaccgtattgtgatcagcgaattcgggaccctggcactgcctgacccgtgcaaaaatgtgtttgaacggtttatgagcagattcgaactaccaggaaaggcagctgccatgaccgacaacaccaacgttaattacgtgcggtacaagggagactactatctttgcaccgaaacaaattttatgaataaagtggacatcgagaccctggaaaagacggagaaggtggactggtctaagttcattgccgtcaatggtgcaactgctcacccacactatgatttagacggtaccgcctacaacatgggcaatagttttggaccttacgggttttcttacaaagttatcagggtcccccctgagaaggtggatctgggtgagacaatacacggggtgcaggtgatctgctccatagctagcacagaaaagggtaagccctcctactatcattcctttggtatgacaagaaactacattattttcatcgagcaaccacttaagatgaacctgtggaagatcgcaacctctaaaatccggggaaaagccttttctgacggcattagctgggagcctcagtgcaacactagattccacgttgtggaaaagcgaaccggccagctactgcccggtaggtactacagtaaaccctttgtgacgtttcatcaaattaacgccttcgaagaccaaggctgcgttatcatagatctctgctgtcaggacaacgggagaactcttgaagtgtaccaactccagaacttgcgcaaggccggtgagggattagatcaggtgcacaactccgcggctaaaagtttccccaggcgcttcgtactccctctcaacgtaagcctcaatgctccggaaggagataacctgtcaccgctaagctacacaagcgcttcggcagtgaagcaagctgatgggacaatatggtgtagtcacgagaacctccaccaggaggatctggaaaaagaagggggaatcgagttcccccagatttattacgatcgcttttctggaaagaaatatcacttcttttatggctgcggcttccgacatctggtgggggactctttaatcaaggtagatgtcgtgaataaaacgctgaaagtttggcgggaggacggattctacccatccgagcctgtgttcgtgcccgcacctggcaccaacgaagaagacggcggtgtgatcttgagtgtggtgatcacccctaaccagaatgagtcaaacttcattctcgttctggatgcaaagaactttgaagagctcggaagggccgaagtgcccgtccagatgccatacggctttcacggaacgtttatcccgatctag

SEQ ID NO: 215964 - DNA, 1620 bp, Artificial Sequence
  Description of Artificial Sequence: Synthetic coding sequence
atggggaatacaccacaaaaaaaagcagtatttggacagtgcagaggcctcccatgtgtggcacccttactcactaccgtcgaagaggcaccccgtggaatttcagccagagtttggggtcacttcccgaagtggctcaacggctcgctgctccggatcggccctggaaagtttgaattcggcaaagataagtacaaccactggttcgatgggatggctctgctacatcaattcaggatggcaaagggcaccgtcacatatagaagcaagtttctccaaagcgatacatataaagcaaatagtgctaaaaatcgaatcgtcatctcagaattcggcacccttgcgttgccagatccctgcaagaatgtgttcgagagatttatgagcaggtttgaactcccaggaaaagctgccgcaatgactgacaacacaaatgttaactatgttagatacaagggcgattattatctgtgcacagaaacaaacttcatgaacaaggtggatatcgaaacgttggaaaagacggagaaagttgactggtcgaaattcatcgccgtaaacggcgcaacagcacacccccactacgatctggatgggaccgcttacaacatggggaatagcttcggaccctacggatttagttacaaggttatacgggtgcccccagagaaagttgacttgggagaaacaatacacggcgtgcaggttatatgcagcatagcctccaccgagaaaggaaaaccctcttattatcatagctttgggatgaccaggaattacattatatttatcgagcaacccctgaagatgaatctgtggaagattgcgaccagcaaaatacgagggaaagctttcagcgatggtatttcttgggagccgcaatgcaatacgagattccacgtagttgaaaaaaggaccgggcagcttctgcccggacggtactattctaaaccgtttgtgacctttcatcagattaatgccttcgaagatcagggatgtgtaatcattgacttgtgttgccaggacaatgggcgtacattagaagtatatcagctgcagaaccttaggaaggcaggcgaaggcctagatcaggtacataactccgcagcgaagagcttcccccgaaggtttgtgcttccacttaatgtttcccttaacgcgcctgaaggagacaaccttagcccacttagctatacatcggcatctgcggtcaagcaagccgacgggacgatctggtgtagtcacgaaaatttgcaccaagaagatttggagaaggagggcggtatcgaatttccccaaatctattatgacaggttctctgggaaaaagtaccattttttctacggctgtggcttcaggcacctggtgggggacagtttgatcaaggtggatgtggtttggcgggaagacggattctacccttcggagcctgtcttcgtgccagctccgggtactaatgaagaggatgggggtgtgatcctttctgttgttattacacccaatcagaacgagagtaattttattttggtgctggacgctaagaacttcgaagagcttggcagggctgaagtgcccgttcagatgccgtacggctttcatggaaccttcatccccatctag

SEQ ID NO: 215965 - DNA, 1638 bp, Artificial Sequence
  Description of Artificial Sequence: Synthetic coding sequence
atgggaaatacccctcaaaaaaaggctgtgttcgggcagtgccggggactcccatgcgtggccccacttttgacgaccgtcgaggaagctcctagggggattagtgcaagggtctggggtcacttcccaaaatggcttaatggatcccttctcaggattgggcctggcaagtttgagttcggcaaggacaaatataatcactggttcgacggcatggcgctgcttcatcaatttaggatggccaagggaaccgtcacatatcgttccaagtttctgcagtctgatacttataaggccaacagtgcaaagaacagaattgtcatcagcgagtttgggacactcgctttgcctgacccttgcaagaatgtcttcgagcgtttcatgagcaggtttgaattgcccggtaaggccgctgcaatgactgacaataccaacgtgaactatgtgcggtataagggagactattatctctgtacggaaacgaattttatgaataaagtggacatcgaaactctggagaaaaccgaaaaggttgattggtctaagtttatagccgtcaatggcgctactgcccacccccattatgacttggatggaacggcctacaacatgggaaactcattcggcccatacggtttttcatacaaggtcattagagtcccacccgagaaggtggacttgggcgagactatccatggcgtacaggttatatgcagcatagcttctactgagaagggcaaaccgtcctactaccatagctttggcatgaccagaaactacattatctttatcgaacagcctcttaaaatgaacttgtggaagattgcaacctcaaagattcgaggcaaggcctttagcgatggaatttcatgggagcctcagtgtaatacccgatttcacgtggtggaaaagcgaacaggccaactcctgcccggacggtactatagcaagccctttgtcactttccaccagatcaacgcctttgaagatcagggctgcgtcattatagacttatgctgccaagataacgggcgtacacttgaggtctatcagctgcagaaccttagaaaagctggcgagggtctggatcaggtccacaacagtgctgcaaaatcttttcccaggcgtttcgtgctcccgctgaacgtatccctcaatgcccctgaaggagataacctctctcccctaagctatacctccgcgtccgccgtgaagcaagctgatggcaccatatggtgcagccatgaaaatttgcaccaggaggacctggagaaagagggaggtatcgaatttccccaaatctattatgataggttctccggcaagaaataccactttttttacggctgtggatttcggcatttagtgggagacagtctcatcaaggtggacgtcgtcaacaagaccctgaaggtgtggagggaagacggattctacccttccgaacccgtgtttgtaccggcacctggtacaaatgaggaagacgggggagtaatactgtctgtggtcataacccctaaccaaaatgagtccaatttcatcttggtcctggatgctaagaatttcgaagaactaggacgcgctgaagtaccggtgcagatgccgtatggctttcacggtacatttattcccatatag

SEQ ID NO: 215966 - DNA, 1221 bp, Artificial Sequence
  Description of Artificial Sequence: Synthetic coding sequence
atgccgccagtcgggggaaagaaagctaaaaaaggaatactggaacggcttaacgctggggaaattgtgattggggacggaggcttcgtgtttgccctggagaagagaggatacgtcaaggccggaccatggactcccgaagctgccgttgagcacccggaagcggtgaggcaactgcatcgtgagttcctccgcgctggttccaatgttatgcaaaccttcaccttctacgctagcgaggataaattggagaacagaggtaactacgtcctcgagaagattagcggacaggaagttaatgaggcagcctgtgatatcgcccgacaggtcgctgacgagggagacgccctggttgccggtggtgtcagtcagactccttcgtacttatcttgtaaatccgaaacagaggtaaagaaagtttttctgcagcagttggaggtttttatgaaaaagaacgtagactttctgatagcagagtatttcgaacacgttgaggaggctgtttgggcggttgagacgctgattgcctcaggcaagcccgtcgcagcaacgatgtgtatcggtcccgaaggagatctgcatggcgtaccccctggtgagtgcgccgtgagacttgtaaaggccggagccagcatcatcggggtaaattgccactttgacccaacgatttccctgaaaacggttaagcttatgaaagagggactcgaagctgcacgcctgaaagcgcatctaatgtcccaacctctggcctatcacacccctgactgcaataagcaaggatttatcgatctccccgagtttccttttgggctggaaccgagagtggcgacaaggtgggatattcagaaatatgctcgggaagcatataacctcggcgtccggtatattggagggtgctgtggctttgagccataccacatcagagcgatagcagaggagctagcccctgaaaggggatttctgcctcccgctagtgaaaagcacgggtcctggggctccgggctggacatgcacaccaagccatgggtgagagctagagcgcgaaaagagtattgggaaaacctgcggattgcttcaggcagaccctataacccatccatgtcaaaacctgacggttggggtgtcacaaaaggaaccgccgaactgatgcagcaaaaagaggcgacaaccgagcaacagctgaaagagctgttcgaaaagcaaaagttcaaatctcagtag

SEQ ID NO: 215967 - DNA, 612 bp, Artificial Sequence
  Description of Artificial Sequence: Synthetic coding sequence
atgccaccggtcggcggtaaaaaagcaaaaaagggtatcctcgagagactcaatgctggggagatagttataggagacggtggcttcgtttttgcactcgaaaaacgtggatacgtgaaagccggaccctggaccccagaagcggcagtggagcaccccgaggccggagcatctatcatcggcgttaactgccatttcgaccccacaatctcacttaaaaccgtcaagctcatgaaggaggggctagaagccgctagactcaaggcccacctaatgtcacagccccttgcttaccacacccctgattgcaacaagcaggggttcattgacctgcccgaattcccttttgggctagaacctgagttaccgccagacgggatttttaaaaatactccagagcgccctaccacttggggatctgggaccctagcgggtgccgtagatctctcgccaaccacctcgggtcagctgcagcggagctggccccagaagggcgctttttgtcatcagctgcagaagaatatggcggcaggtgaagtggtctggacttgtacacctaaccccggattggagcaaggtcctggcaggaacacaggccgaattttcggatag

SEQ ID NO: 215968 - DNA, 1092 bp, Artificial Sequence
  Description of Artificial Sequence: Synthetic coding sequence
atggcaccagcaggaaggccgggagccaaaaagggcatccttgaaagactagaaagtggtgaagtggtgatcggagacgggagctttctaatcaccttggaaaaacgaggctatgttaaggctggactgtggacaccagaggcagttattgaacaccccgacgctgtgcgccaactgcacatggaattcctgagggcgggaagtaacgtaatgcagactttcaccttttcagcatcagaagacaacatggagtctaagtgggaagatgtgaacgccgctgcatgcgacctggcccgtgaggtcgccggaaagggagacgcattagtggctggcggaatatgccaaacaagcatttacaaatatcagaaggatgaagctaggattaagaaactgttccgccagcagttggaggtctttgcttggaagaatgttgatttcttgatcgccgagtactttgagcatgtggaagaggcggtgtgggccgtcgaagtgctgaaggagtctgatcgacctgtggccgtcacaatgtgcattggaccagagggcgatatgcacgatatcacccctggcgagtgtgccgtacggctggtgaaggccggtgctagtatagtcggggtgaactgcagattcggcccagacacatcgctgaagaccatggagctcatgaaagagggtttagagtgggctggtctgaaggcccatctcatggtgcagcctctgggcttccacgccccagattgcggaaaggaaggatttgtcgatctgccagagtatccgttcgggctggagagtcgagtggccaccagatgggatatccagaagtacgcacgggaagcctacaacctcggggtgcgctatataggcggttgttgcggatttgaaccttaccacatcagggccattgcagaggagctcgcacctgagcgcggatttctgccaccagcctccgaaaaacatgggagctggggctccggcctggacatgcataccaaaccttggatccgtgcacgcgcaagaagggagtactgggagaacctcctgcctgccagtggaaggcccttttgtccatccctgagtaaacctgacttctag

SEQ ID NO: 215969 - DNA, 900 bp, Artificial Sequence
  Description of Artificial Sequence: Synthetic coding sequence
atggcccctgctgggagacctggagccaagaagggcatcctagaaaggttagaatcaggcgaggttgtcatcggcgacggtagcttcctcattacactggaaaagcggggttatgtaaaagctggactgtggaccccagaagccgtgattgagcacccagatgcagtgcgtcagctacacatggaatttctccgcgctgggagtaatgtgatgcaaaccttcactttttcagcttcagaggacaatatggaaagtaaatacttcgagcatgttgaggaggcagtgtgggccgtggaagtccttaaagaaagcgaccggcctgtggctgtaactatgtgcatcggtcccgagggcgatatgcacgacatcacccctggggagtgtgctgtgcgactggtgaaagcgggagccagcattgtcggggtcaactgccggttcggtcccgacacctcactcaagacgatggagctgatgaaggagggtctggagtgggccggtttaaaagctcacctgatggtgcagccactgggcttccacgctccagactgtggaaaagagggcttcgtagatctgcctgaatatcctttcggcctggagtccagagtcgcaactcgctgggacatacagaagtacgcccgtgaggcatataacctgggggtgcgctacattggtgggtgttgcgggtttgagccatatcacatcagggcaatagccgaagagctcgccccagaacgcggatttctaccacccgcatcggaaaagcacggttcctggggctccgggcttgacatgcacacaaagccatggatacgggctcgagcccgtcgggagtattgggaaaacctgctgcccgcaagtggtagacccttttgcccatctctctcgaagcctgacttttag

SEQ ID NO: 215970 - DNA, 639 bp, Artificial Sequence
  Description of Artificial Sequence: Synthetic coding sequence
atgattatagggggaatagatcactccctctacaccggcagcctgtggtatactcccatccgtcgcgaatggtattacgaagtaataatcgtccgcgtggagataaacggccaagatctgaagatggactgcaaagagtataattacgataaaagcattgtggatagtggcactacgaacctgcgcctgcccaaaaaggtcttcgaagcagccgtgaagagcattaaagctgcctcttcaactgagaaattccccgatggcttctggcttggagaacagctggtgtgttggcaggctggcactactccttggaatattttccccgtgatctccctatatctgatgggcgaagtgactaaccagagctttaggataacgatcctcccccagcagtatctgcgctggaaaatgtggccgcgaccgaaaacaacggtcacctgccaccttaccgttatccacgggcattgctatggatcgtgttaccatggtggattgctgcttagcctgatagggccagagaatgaacttgcactactctcggcgctcgcaatgtgcacaatgagctccggtaggcaacgatggaaggcttgtcatcttggacacggcaggctgtggctgcagcactccaccgatcgttag

SEQ ID NO: 215971 - DNA, 1506 bp, Artificial Sequence
  Description of Artificial Sequence: Synthetic coding sequence
atggcacaggccctgccttggctacttttatggatgggggcaggagtcctgccagcccatgggacgcagcatggaatccgcctgcctctgcgctcaggacttgggggtgctcccctcgggttgagattaccccgtgagactgatgaagaacccgaagaacccggtagacgagggtctttcgtggaaatggtcgacaacctccgaggtaagtctggccaagggtactatgtagagatgaccgtgggcagccctccacagactctcaacattctggttgacaccggcagttcaaatttcgctgtcggggcagctccacaccccttcctccacaggtattaccaaagacagctctcaagtacctatagggatctgcgcaaaggggtgtatgttccttacacccagggcaagtgggagggagagctgggcactgatctcgtgagcattcctcatggccctaatgttaccgtgcgtgctaacattgctgctattaccgagagcgacaagttttttataaacggctcaaattgggaagggatcctgggcttggcctatgcggagatcgcacggcctgacgactcgcttgaacccttttttgattctctggtgaaacagactcatgtgcctaatctgttctcgttgcagctctgtggcgcaggattcccattaaaccaaagtgaggtgctcgcttcagtggggggtagcatgatcattggcggaattgaccactctctgtacaccggctccttatggtacacccccataaggcgggaatggtattatgaggtgataatcgtgcgcgtcgaaattaacgggcaggacctcaaaatggactgcaaggagtacaactatgacaaaagcattgtcgattcaggtacaactaacctgaggttgcccaagaaagtctttgaggccgctgtgaaaagcatcaaagccgcttcgtccactgaaaagttcccagacggcttctggcttggagagcaactcgtttgttggcaggcgggtactactccatggaacatattccccgtgatctccctgtatttgatgggggaggtgactaaccaatcttttagaattaccatattgccacagcagtacttaaggccagtggaggatgtcgccacatcgcaggacgattgctacaagttcgcaattagtcagtcatctaccggcactgtgatgggcgctgtgatcatggaaggattttatgtcgtgttcgaccgggcaagaaagaggatcggctttgcagtcagtgcatgccacgtccatgacgagtttcggacagccgcagtagaagggccttttgtgacactagacatggaggattgtgggtataacatcccccagaccgacgagagtaccctgatgacgatagcttacgtgatggccgcaatttgcgctttgttcatgctgcctctgtgtctgatggtttgtcagtggtgttgccttcgctgcctgcgtcaacagcacgacgatttcgcagacgacatcagcctcttaaaatag

SEQ ID NO: 215972 - DNA, 1299 bp, Artificial Sequence
  Description of Artificial Sequence: Synthetic coding sequence
atggcccaagcactgccgtggctgcttctgtggatgggcgctggagttctgcccgctcacggtacacagcacggcataagactacccctgagaagcgggctcgggggtgcacctctcgggttgcgcctgcccagagaaacggacgaagaacccgaagagcccggacggaggggctcgtttgtggagatggtcgataacctccgcggtaagtcaggacaggggtactatgtggagatgaccgtgggtagcccacctcaaacacttaatatccttgtggacactggctcaagtaattttgctgtgggcgctgcccctcatccattcctgcacaggtactaccagcgacaactctccagcacatatcgcgaccttcggaaaggggtatatgtgccctacactcagggaaaatgggagggtgagctcggaacagatctgctgtgcggggcagggttccccttaaaccagtccgaggttttagccagcgtgggcggtagtatgattataggcggaatcgaccactccctgtacactgggtcactttggtatactcctattcgcagggaatggtactacgaggtcatcatagtaagagtagagataaacggacaggacctgaaaatggattgtaaagaatacaactacgataagtcgattgttgattctggaactactaacctgagactccctaaaaaggtcttcgaggctgccgtcaagtctatcaaggctgctagttccacagagaaattccctgacggcttctggcttggggagcagctggtctgctggcaggctggcacaacgccttggaatatctttcctgttatctcactgtatctgatgggcgaggttacgaatcagagcttccgcattaccatccttcctcagcagtatttacgtcccgtggaagatgtcgccacctctcaggatgactgctataaattcgcaatatcccagtcctccacagggactgtgatgggggctgttataatggaaggcttctatgtggtttttgaccgcgctaggaaaagaatcggcttcgctgtgagcgcatgtcatgtgcacgacgagtttcgcacagccgcagtggaagggccattcgttaccttggatatggaggattgcgggtacaatatcccccaaaccgacgaaagcacactgatgactatcgcatatgttatggccgcaatttgcgctctctttatgcttcccctgtgtctgatggtctgtcagtggtgttgcctgcgatgccttaggcagcaacacgatgattttgcagatgatatctcacttctgaaatag

SEQ ID NO: 215973 - DNA, 1374 bp, Artificial Sequence
  Description of Artificial Sequence: Synthetic coding sequence
atggcccaggcattgccatggttgctcctgtggatgggagccggtgtcctgccagcacatgggacgcaacacggtatcagactgcccctgcggtcaggcttgggtggcgcacccctggggctgcgcctccctcgcgagacagacgaggaacctgaggaaccaggccgaagagggagttttgtggaaatggtggacaatctgcgagggaaaagcgggcaaggatattatgtcgaaatgactgtcggatcgcccccacagactttgaacattctggtcgataccggttcatcaaactttgctgtgggagctgcccctcatcctttcctgcatcgctactaccagaggcaactcagcagcacttatagggatctgagaaagggcgtgtacgtgccctacacccagggaaaatgggagggcgagctgggcacagacctacccgacgattctctggaaccattctttgattccctcgtgaaacaaacacacgtcccaaatttgttctccctgcagctctgcggagccggatttccacttaatcagtccgaggtcctggcaagtgtcgggggtagcatgatcataggcggaatcgaccactcactgtacacaggctctctctggtatacacccatccgcagggaatggtattacgaagttatcatcgttcgcgtggagataaatggacaagacttaaaaatggattgtaaggagtataattacgacaaatccatcgtcgatagtggaacaaccaatctgaggctgccaaagaaggtctttgaagcggctgtgaagtctattaaagcagcatcttctaccgaaaaattccccgatggcttttggctaggggagcaactagtctgctggcaagctggcactacaccgtggaacatctttccggttatatcactttatttgatgggcgaagtgacaaatcagagctttcggatcaccatcctcccccagcagtacctgaggcccgtggaggacgttgccaccagtcaggacgattgttataaatttgctattagtcagtctagtaccggtaccgtaatgggggctgtgatcatggagggcttctatgtggtgtttgatcgagcgagaaaaaggatcggcttcgccgtttccgcctgtcatgtacacgacgagtttcgcacagccgctgtcgagggtccttttgtgaccctcgatatggaagactgcggatataacatcccccagacggacgaatctacacttatgactatcgcatacgtgatggctgccatctgcgcgctgttcatgttaccattatgcctcatggtgtgccaatggtgctgtctccgttgcttacggcagcagcacgatgactttgccgatgacatctcattgctgaaatag

SEQ ID NO: 215974 - DNA, 1431 bp, Artificial Sequence
  Description of Artificial Sequence: Synthetic coding sequence
atggctcaggctcttccttggctgctgctgtggatgggtgcaggagttctgcccgcacacggcacacagcacggaatccggctaccactccggagtggcttgggtggagcacccctgggcctccgactgcccagagagacggacgaggagcctgaggagcctggacgtcggggtagcttcgttgagatggttgataatttgagaggcaagagtgggcagggttactatgttgagatgaccgtcggttcacccccacagacgctgaatattttggttgacaccggctcatccaatttcgccgtcggtgccgcaccgcacccatttctccacaggtactatcaaaggcagctctctagcacctatagagacctgcgaaagggcgtctatgtaccatatacacagggaaagtgggagggggagcttggaacagatttggtctcaatcccccacggacccaatgttacggtccgggctaatatagccgcaattacggagagcgataaattctttatcaacggatctaactgggagggcatactggggctggcctacgccgaaattgctagactgtgtggtgccggatttcctctcaatcagtcggaagtgctcgcaagcgtggggggaagtatgattataggagggattgaccatagcctctatacgggatctctatggtatacccccatccggagggaatggtactacgaagtgattatcgtgcgggtcgagatcaatggccaggatctcaaaatggactgcaaggaatacaattacgacaaatcgatcgtggactcaggcaccactaatttgcgactccctaaaaaagtgtttgaggctgctgtcaagtcaataaaagccgcttccagcaccgaaaagtttcccgacggcttctggttgggtgagcagctcgtgtgctggcaggccggaactactccctggaatatttttcccgtgatcagcctctacctcatgggggaagtaacaaatcagtctttccggattaccattctcccccagcaatatcttcgaccagtggaagacgtagctacttcacaggatgattgctataagttcgctattagtcagtcctccacaggaacagtgatgggagccgtaataatggagggcttttatgtggtcttcgatagggcaaggaagcgaatcggattcgcagtgtccgcctgccatgtacatgatgagtttcggacggccgcagtggaggggccatttgttactctcgacatggaggattgcgggtataacatcccacagacagacgagagcacattgatgactatcgcctacgtgatggctgctatttgcgccctcttcatgcttcccctatgccttatggtctgtcagtggtgctgtctgcggtgtctgagacagcagcacgacgatttcgccgatgacatctccctgctaaaatag

SEQ ID NO: 215975 - DNA, 1131 bp, Artificial Sequence
  Description of Artificial Sequence: Synthetic coding sequence
atggttccatttatctatctgcaagctcactttactctgtgttccggttggtcttcaacatatagggacttacgtaaaggcgtctacgtgccttacacccagggaaagtgggaaggagagctgggaactgatctggtgagtatcccacatggacccaacgtgacagtccgagctaatatagctgctatcacagaatcagataaattctttatcaatggttcaaactgggagggaattttaggcctcgcttacgcagagattgccagactgtgcggcgctggcttccctcttaaccaaagcgaagtcttagctagtgtaggagggtctatgatcattggaggtattgaccacagcttatacacaggttcactctggtacacacctattagaagagagtggtattatgaagttatcatcgtcagggtggaaattaacggtcaggacctcaaaatggattgcaaggagtacaactatgataaaagtatcgtggactcgggaaccaccaatttgaggctcccaaagaaagttttcgaggcggcagtgaaaagcatcaaggccgcatctagtaccgagaagtttcctgatggcttttggctcggtgagcagttggtgtgttggcaagctggcacgaccccctggaatatcttccccgtgatttccctgtacctcatgggcgaagtcacaaaccagtctttccgaatcactattctgccccaacagtatctgcggcctgtggaagacgttgcaaccagccaagatgattgttataagtttgccatcagccaatcatctacaggtacggtaatgggagctgtgatcatggaaggcttctatgtcgtgttcgatagggcgcgtaagcgcatcggctttgctgtatctgcgtgtcatgtgcacgacgagttcagaaccgcagccgtcgagggtcccttcgtcacgttggatatggaagactgcggatacaatataccccagacggatgagtccacattgatgacgatcgcttatgtgatggctgcgatctgcgccttattcatgttgcctctctgtctgatggtgtgccagtggtgttgccttcgttgtctgagacagcagcacgacgacttcgccgacgacatttccttactgaaatag

SEQ ID NO: 215976 - DNA, 1191 bp, Artificial Sequence
  Description of Artificial Sequence: Synthetic coding sequence
atgggggcattagccagggccctcctcctacctctgctcgctcagtggttgctgagggcagcccctgagctggccccagcaccgttcacacttcccttgagagttgctgcagccaccaatcgggtggtggcaccaacacctgggcctggaactccagctgaacgccatgctgacggactcgcacttgccctggagccagcgctggcttccccagctggtgcagcaaatttcctagctatggtagataatttgcagggagactctggaaggggatactacttggaaatgcttatcggtacaccgcctcagaagcttcagatcctagttgatacagggtcttcgaactttgcagtggccggaaccccacattcgtatatcgacacttacttcgacaccgagagatcgagcacttacagatcaaaaggttttgacgtgacagtcaagtacactcaggggtcctggaccggctttgtgggcgaggatctcgtaacgatccccaagggatttaacacaagtttcttggtgaacattgccaccattttcgagtccgaaaacttctttctccctgggataaaatggaacgggatattgggacttgcgtatgctactctggcaaaaccatcctcctcgctggaaacgttcttcgactcgttggtcacccaggccaatatccccaacgtctttagtatgcagatgtgcggcgcaggtttgcccgtcgccggaagcggaacaaacggcggttctctcgtgctgggaggtatcgagccgagcctctataaaggggacatctggtacacaccgatcaaagaggagtggtactatcaaatagagatactgaagctggagataggtggacagagccttaacctcgactgtcgggagtacaacgccgacaaggctattgtagatagtgggactacacttcttcgcctgcctcagaaagtgttcgatgcagttgttgaggctgtggcgagggcttccctaatccccgagttcagcgacggcttttggaccggatcccagctcgcatgttggactaactcagagaccccatggtcatattttcctaagatttctatctacctgcgagacgagaatagcagccgaagttttagaatcactatcctgccccagaagcttcaggtgctgcaatgtttaaaattccctggactaagccagcagcggatgtag

SEQ ID NO: 215977 - DNA, 1557 bp, Artificial Sequence
  Description of Artificial Sequence: Synthetic coding sequence
atgggggcactggccagggctctcctgctccctctccttgctcagtggttactaagggcggctcccgaactggcgccagccccattcaccctgccccttagggtggctgccgcaacaaacagggtagtggctccgacaccgggaccaggtactccagctgaacgtcatgctgacggccttgctttggctctggaaccagcactggcttcccccgctggggcagccaacttcctcgccatggtagacaacctccagggcgactcaggtcgaggctattatctcgagatgctgattggaacacccccacagaaactgcagatcctggtggacactggctccagcaacttcgctgttgcgggtactccgcactcctatatagacacatatttcgataccgagcgatccagcacataccgcagcaaaggctttgacgtgacagtgaaatatacccagggcagctggaccggctttgttggcgaggatctggtgacaattccaaaaggtttcaacacatcattccttgtcaatatcgccactatcttcgaatccgaaaacttcttccttccgggaatcaagtggaatggcatcctcgggctggcctatgccactttagcgaagccgtctagctccttggagacattttttgactccctggtcacacaggccaacatccccaatgtgttctccatgcagatgtgcggtgcaggcctgcccgttgccggatccgggacaaatggcggaagccttgtattgggtgggatcgagcctagcctctacaaaggagacatttggtatacccctataaaggaggagtggtattaccaaattgagattttaaagctggagatcggcggacagagcctaaacctagattgccgagagtacaacgcggacaaggccattgttgactcaggcacaaccctactgcggctgcctcagaaagtcttcgacgctgttgtggaggctgtagcacgcgcttcacttatacctgagttctcagatggattttggactggtagccagctggcttgctggactaactccgagaccccctggtcctatttccccaaaatcagcatctatcttagagacgaaaactcatcccggtcgttccgcattaccatcttacctcagctttatatacaaccgatgatgggggcaggtctcaattatgagtgctatagatttggtatcagcccgagcaccaacgcgttagttattggggcaaccgtgatggaggggttctacgtgatttttgaccgcgctcagaagcgcgtgggttttgctgcctcaccgtgtgcagaaatagctggggcagcggtgagcgagatcagcggcccattttccacagaggacgtcgcctcaaattgcgttcccgctcaatctttgagcgaaccgatcttatggattgtgtcgtacgcattgatgagtgtgtgtggggctatactgctggttctaatcgttttgttgctgctccccttccggtgccagagacgccctcgcgatcctgaggttgtgaatgacgaatcctccctagtgcgccaccggtggaaatag

SEQ ID NO: 215978 - DNA, 1407 bp, Artificial Sequence
  Description of Artificial Sequence: Synthetic coding sequence
atgggcgctctggccagagccctgctgctccctctccttgctcagtggttgctcagagccgctccggagctggcacctgctccgtttacattgccactccgggttgccgcagctacaaaccgagtcgtagctccaactccagggcctggaactccagcagagcggcatgctgatggcctggcactggcgcttgaaccggcactggcctccccggctggcgctgccaacttcctcgccatggtcgacaatctgcagggggatagtgggcgtggatactacctggaaatgctaatcggcacacccccacagaaactacagattctcgtagataccggatcctctaatttcgccgtagcaggaacaccacattcctacattgacacctatttcgatacagagaggtcctcaacgtaccggtccaagggatttgatgtgaccgttaaatacacacagggaagctggactggcttcgtgggtgaggacttggtgacaatcccaaaagggttcaatacctcatttttggtcaatatcgctacaattttcgagagcgaaaacttcttcttacccggaatcaaatggaacggcattctgggcctggcctacgcaacacttgccaaaccctctagcagcctcgaaaccttctttgatagcctcgtcacccaagctaacatccccaacgttttttccatgcaaatgtgcggagctggattaccagttgctggcagcggcactaatggcggttctttggtgctcggaggcattgagccttccctatataagggagacatttggtatacgcctatcaaggaagagtggtactaccagatcgaaatattgaaactggaaatcgggggacaatctctcaatctcgattgcagggagtacaatgccgataaggcaattgtggactctggaacaacccttctgagattaccgcagaaagtgttcgatgccgtggtggaggccgtggcaagggcttccctgctgtatatacagcctatgatgggcgctggcctgaattacgaatgctacagattcgggatctctccctcgactaacgctctcgttattggagctactgtgatggaggggttctatgtgatctttgaccgcgctcagaaacgagtggggttcgcagccagcccgtgtgccgagatcgctggtgccgctgtttccgagattagtgggcctttctcgacagaagacgtcgctagcaactgcgtgccagcccaaagtctgagtgagcctattctttggattgtgtcttatgctctcatgtccgtgtgtggagccatcctcctggtgctgatcgtgcttttactccttccgtttcggtgccagcgcagaccccgagatccagaggtcgtgaacgatgaaagttccctcgtgcgccacagatggaagtag

SEQ ID NO: 215979 - DNA, 1272 bp, Artificial Sequence
  Description of Artificial Sequence: Synthetic coding sequence
atgcttatcggaacacctccacagaagctgcagatcttggtggataccggctctagtaattttgcggtggcaggcacaccccattcttatatagacacatattttgacacagagcgatcttcaacctataggagcaagggcttcgacgtgactgtgaagtacactcagggatcttggaccggttttgtcggagaagatcttgtgacaatccctaaagggttcaatacttcttttttggtcaatatcgccacgattttcgaatcagagaactttttcttgccagggataaagtggaatgggattctggggctggcttacgcaacactggccaagcctagttcatcgctggaaaccttcttcgattcactagtgacacaggccaacattcccaacgtctttagtatgcaaatgtgcggggctggtctgccagttgccggaagcggaacaaacggcggaagtctggtgctgggcggtattgaacccagtctgtataagggggatatttggtacactcccataaaagaagagtggtactaccagatcgagatcctgaaacttgagataggcggacagtctttaaacctggattgtagggaatacaacgcagataaggccatcgtagactctggaaccacccttctgcgattaccccagaaggtattcgacgcagttgtcgaggccgttgctagggcatcgctgattcccgaattttctgacggattttggaccgggtctcagctggcttgctggaccaacagtgagacaccgtggtcatattttcctaagatttctatatacctaagagacgagaatagctctcgctccttccgaattacaattctgccacaactgtacatccaaccaatgatgggcgctggtctgaactatgaatgttacagattcgggatttctccttccaccaatgccctggtcattggcgctacagttatggagggcttttacgtgatttttgaccgagcccaaaaaagggtcggatttgctgccagcccctgcgcagagatagctggagccgcagtaagtgaaatctccggccctttttctaccgaggacgtggcttcaaattgtgtgccggcacagagtctcagtgaacctattctatggatcgtgagttacgctcttatgtcagtgtgtggggctatcctgctcgtgttgatagttttgctgctgctccccttcagatgccagcgcagaccaagagatccagaagtcgtgaacgacgagagctccctggtacggcatagatggaagtag

SEQ ID NO: 215980 - DNA, 576 bp, Artificial Sequence
  Description of Artificial Sequence: Synthetic coding sequence
atgccgcgttcactttggctgggctgtagcagtctcgcagacagcatgcccagccttcggtgcttatacaatcccggtaccggcgcacttaccgcctttcagaatagctccgaacgggaagactgcaacaatggagaaccacctcgaaaaatcataccagaaaaaaactctcttcgccagacatacaacagctgcgccaggctgtgtcttaatcaggagaccgtttgtctggcctccacagccatgaaaactgagaactgcgtggccaagaccaagctcgccaacggaacttcttcaatgatcgtgcccaaacagcggaaactcagtgcctcttatgagaaagaaaaagagctatgtgtgaagtattttgagcagtggtccgagtcagaccaggtggagttcgttgaacatctgatttcccaaatgtgtcattatcagcacggacacattaactcgtacctcaagcctatgcttcagagggactttatcacagcgctacctgcgagagggttggaccacatcgctgagaatatactgtcttacctcgacgccaaatctctctgtgctgccgagtag

SEQ ID NO: 215981 - DNA, 1818 bp, Artificial Sequence
  Description of Artificial Sequence: Synthetic coding sequence
atggatcccgcagaggcagtactccaagagaaagctctgaaattcatgtgctcaatgcctcggtctctctggctcgggtgctcatccctcgctgactcgatgcccagtttgcgctgtctgtacaaccctgggactggcgcattgacagcattccagaactcctccgaaagagaggattgcaacaacggagaaccaccaaggaagatcatcccagagaagaatagccttcgtcagacctacaactcctgcgcaaggctctgccttaaccaggagaccgtctgcttggctagtacggctatgaaaactgaaaactgtgtggctaagaccaagcttgccaacggcacctcatctatgattgtccccaaacagaggaaactgagtgcttcttatgagaaggagaaagaactctgtgtaaagtattttgagcaatggagtgagagcgatcaagtcgaattcgtggagcacctgatctctcagatgtgtcactaccagcacggacacattaattcgtatctgaagcccatgttgcagagggattttatcactgctctcccagctcggggactggaccatatagctgagaatattctgagctacctggacgccaaatcgctttgcgctgcggagctggtgtgtaaagagtggtaccgggtcacaagcgacggcatgctctggaaaaaactgatcgaacgcatggttagaaccgactccctctggagaggcctggccgagcgtcgcggatggggtcagtacctcttcaagaacaagccgcctgatggcaacgcccctccaaacagtttttatagggccctgtacccaaagataatccaggacattgagaccatagagagcaactggcgatgcggtaggcacagcttgcagcggatccactgcagaagcgaaacaagtaagggggtttactgcctgcaatacgatgatcagaagattgttagtggtcttagagataacaccattaaaatatgggacaagaataccttggaatgtaaaaggatcctcaccggtcatacgggttctgtgttgtgcctccagtacgatgagagggtcattattaccggcagtagcgacagcacggtgagggtgtgggacgtgaacaccggggagatgctgaatacattaattcatcattgtgaggccgtcctgcacctcaggttcaacaacggtatgatggtgacctgtagtaaggaccgcagcattgcagtctgggatatggcttctcccacggacatcaccctgagacgcgtactggtcgggcacagagcagccgtgaatgtcgttgatttcgatgacaagtatattgtgtccgcttctggggaccggacaatcaaagtgtggaacacctccacgtgtgaattcgtgaggacactaaacgggcataagagaggcatagcatgcctgcagtatcgggatcggctcgttgtatccggctcaagcgacaataccatcaggctctgggatatcgagtgcggcgcttgtctccgggtgctggagggccacgaagagctcgtgaggtgcatccggtttgataacaaacgcatcgtgagcggcgcatatgacgggaaaattaaagtgtgggatctcgttgcggctctcgatcccagggctcccgcagggacactttgcctgcgtacactggtggaacactctggaagggtctttcggctccagttcgacgaattccagattgtgtcctctagtcacgacgatactatcttgatctgggacttcctcaatgatccggctgctcaagctgagcccccaagaagtccttctcggacgtacacttatattagcagatag

SEQ ID NO: 215982 - DNA, 1695 bp, Artificial Sequence
  Description of Artificial Sequence: Synthetic coding sequence
atgtgctccatgcctcggtctctgtggttgggatgtagttctctcgcggattctatgccatccctacgatgcctctacaaccccggtaccggggctcttaccgcctttcagacatacaactcatgtgcccgtctgtgcttaaaccaggagacagtatgtctggcatccacagccatgaaaacggagaattgtgtcgcaaagacaaagttggccaacggcaccagcagcatgattgtgccgaagcagagaaaactcagtgcatcttatgagaaggaaaaggagctttgcgtgaagtattttgagcagtggtctgaaagcgatcaagtcgaattcgttgaacatctgatatcccagatgtgccattaccaacacggccatatcaatagctacttgaagccaatgctgcaaagagatttcatcactgctctgccggctagagggctcgaccacatcgccgaaaatattctgtcctacctggacgcaaagtctctgtgcgccgcagaactggtctgtaaggagtggtaccgcgtgaccagcgacggtatgctgtggaaaaaactcatagagaggatggtccggacagatagcctctggcgagggctcgccgagcggaggggttgggggcagtatttgtttaagaataagcccccagatggcaacgcccctcccaatagtttctatagagctctgtacccaaagataatacaggacatagaaaccattgaaagcaactggaggtgcggcaggcactcactgcaacggatacactgtaggagtgaaacatctaaaggggtgtattgcctacaatacgacgaccagaaaatagtgtccggactgcgagataacactatcaaaatttgggacaaaaacaccctggagtgcaaacgtatcctgacagggcacaccggaagcgtgctgtgtcttcagtatgatgagcgggtgattattaccggaagctcggattccaccgtccgggtctgggatgtgaacaccggcgagatgttaaataccttaatccatcactgcgaagctgtgcttcatctccgcttcaacaacggcatgatggtgacgtgcagtaaggacagatccatcgcggtttgggatatggctagcccgactgatattacactccgtagggtgcttgtgggacatagggcagctgttaatgtagttgattttgatgataaatatatcgtttctgcttcaggcgatcgcacgatcaaagtttggaatacttctacatgcgagttcgtgaggaccctgaatggccataaacggggaattgcctgtcttcagtatagggaccggctggttgttagcgggagctccgataatacaatacgcctctgggacattgagtgcggggcatgccttagggtgcttgaaggccacgaggaactggtgcgctgcattagattcgataacaagaggatcgtgagcggtgcttacgacggaaagataaaagtgtgggatctggtggctgccctggatccacgagccccagccggaaccctgtgtctgagaactttggtggaacatagcggccgagtgttccgattgcaatttgacgaattccaaatagtgtcttcgagccacgatgatactatactcatctgggacttcttaaacgaccctgctgcccaggccgaaccccctaggagcccgagccgaacctatacttacatttcgagatag

SEQ ID NO: 215983 - DNA, 1710 bp, Artificial Sequence
  Description of Artificial Sequence: Synthetic coding sequence
atggaccccgctgaggcagtcctccaggaaaaagccctcaaatttatgaactcttcagagcgggaggattgtaataacggagagcctccgaggaaaattatccctgagaagaactccctcagacagacttacaattcttgcgccagactgtgccttaaccaggaaactgtgtgcctcgcgagtacagccatgaaaacagagaactgcgtggccaagaccaaactagccaatggaacgagctctatgattgttccaaagcaacggaaactttcagcctcctatgagaaggagaaggagctgtgcgtcaagtacttcgaacaatggtccgaatcagatcaggttgagtttgttgagcatttgatcagccagatgtgccactatcagcacggccatatcaacagctacctaaaacccatgttacaaagagacttcatcaccgcactcccggcaagggggctcgaccatattgcagaaaacatactctcttacctagacgccaaatctctctgtgcagccgaactcgtgtgcaaggaatggtacagggtgacatcagacggaatgctgtggaagaagctcattgagaggatggtccggacagattccctgtggagaggcctcgccgagagacggggatgggggcagtatctgttcaagaacaagcccccagacgggaatgcgcctcccaatagcttttacagagcactctaccccaagatcattcaggacatcgagaccatcgagtccaactggcgatgtggaaggcattcccttcagaggatccactgcagaagcgaaacttccaagggtgtgtattgtctccaatacgacgaccagaagattgtgagcggcctgcgggacaatactattaaaatttgggataagaatacactagagtgcaagaggatattgacaggtcacacagggtccgtgctgtgcctccagtatgacgagcgagtgatcattacaggcagctccgattcaacagtcagagtgtgggacgttaacaccggcgagatgttaaacaccctcatccatcactgtgaggctgtcctccacctgcgctttaataacggaatgatggtcacatgtagcaaggacagatccatagcagtgtgggacatggccagcccgactgatattacgctccggagagtgctggtgggacatcgggcagctgttaatgttgtggatttcgatgacaagtatattgtgtccgcaagtggtgacaggactattaaagtgtggaacacgtccacatgtgaattcgtcaggaccctgaatggccacaaaagaggcattgcgtgcttgcagtaccgggatcggctggtagtgtctggttcttctgacaatactatccgactatgggacatcgagtgcggggcttgcctgcgcgtgttggaaggacatgaggagctggttaggtgtatcaggttcgataataaaagaatcgtttcaggagcttatgatggcaaaattaaagtatgggacctggtggccgctctggatcccagagcacccgcaggcacactgtgtctgagaacactggtggagcactctgggagagtttttaggctgcaattcgacgagtttcagattgtgtcttctagccatgacgatacaatcctgatttgggactttctgaatgatccggcagctcaggcggaacctcctcgttcgccgtcacggacctacacctacatatccagatag

SEQ ID NO: 215984 - DNA, 126 bp, Artificial Sequence
  Description of Artificial Sequence: Synthetic coding sequence
atggatcccgctgaagccgttctgcaggaaaaggccttgaagtttatgacctataatagttgtgcccgactttgcctgaaccaagagactgtttgtcttgcttcaaccgcaatgaagacagagtag

SEQ ID NO: 215985 - DNA, 327 bp, Artificial Sequence
  Description of Artificial Sequence: Synthetic coding sequence
atggtcacattactgccaatagagggtcaggaaatccatttctttgagatactagagtcagaatgcgtgctatacaccggctggatcgagcgggcatccggctcctctatttaccctgaggctaaagcccgactccccctggaggcactcctggggagcaacaaagagcctatgcttcctaaagagaccgttttgtcactcaagaggtataatttgggctccagcgccatgaagcgcaatgtgcccggacatgtcctgcagcgcccttcctacctcacaaggatacaagtcacactcttatgcaatagctctgctgaggcgctgtag

SEQ ID NO: 215986 - DNA, 1521 bp, Artificial Sequence
  Description of Artificial Sequence: Synthetic coding sequence
atggaacagctggacgtttttatctccatcaaacccaagcccaagcagcccagtaagtccgtgattgtaaagagtgtggagcgcaatgctctaaacatgtacgaggcgcgaaaatgcttgcttgggctcgaaagcagcggcgtgacaatcgccacatctccctcccccgcatcgtgccctgccggtctagcttgcccctcattggacatactggcttctgctggcctgggcttaactggactcggtctgttagggccaaccaccttgtcactgaatacctcaactacccccaacagcctgcttaacgcgttgaactcttctgtgtcgccactgcagtcaccttcttccggcaccccctctcctaccctttgggctccccctttggccaacacctcttcagccactggattcagcgccatcccccatttaatgatcccctccactgcgcaggcaacactaactaatatcctgctgagcggtgtgcctacctacggccataccgccccttcccccccaccaggcctgacacctgtggatgttcacatcaatagcatgcagaccgagggtaagaagatatcggccgctcttaacggccacgcccagtctcccgacataaagtacggggcaatatcaacgtccagcctcggggagaaggttctctccgcaaaccacggagatccctccattcagacctccgggtcagagcagaccagccctaagtcctctcctactgaagggtgtaacgacgcttttgtcgaggtcggtatgccgagaagtccatctcacagcggcaatgctggagatctgaaacagatgatgtgtccctccaaggtctcttgcgcaaagagacagacagtggaactgctccaaggtaccaaaaacagccaccttcatagcacagatcgactcctgagcgacccggagctctctgctactgagagccccctagcagacaagaaagccccaggctccgagcgggctgcagagcgcgcagccgcagcacagcaaaactcagagagggcccacctggctccaaggtccagttatgtaaacatgcaggcctttgattacgaacagaagaaactcctagcaacgaaggccatgctgaagaagcctgtggttactgaagttcgcacccccacaaatacatggagcggattgggatttagcaagtcgatgcctgctgaaactattaaagagctgcgcagggcgaatcacgtgtcgtacaagcccaccatgaccaccacgtatgagggaagttcaatgtctctctcaagaagcaacagtagggaacacctcggaggaggttccgagagtgacaattggcgggatcggaatggcataggacctggcagtcactcagagttcgctgcgtccattggttccccaaaacgtaaacagaataaatcttctgaaagatgtgttctgtgcacacttctgggcattcctcgccttgagtgcgtgtacctaggttggtccattaccgactgtgggctttcagactttaaatgcttggtgtag

SEQ ID NO: 215987 - DNA, 2925 bp, Artificial Sequence
  Description of Artificial Sequence: Synthetic coding sequence
atggcagctcaaggggagcctggctacttagccgctcagagtgatcccggatcaaacagcgagcggtctaccgactcaccagttcctggctccgaggacgatttagtggccggtgccactctccattccccagaatggagcgaggaacggttcagagtggatcgtaagaaacttgaggctatgttgcaggcggctgccgagggtaagggccgatctggagaggatttcttccagaagattatggaggagacaaatacccagattgcatggccgtccaagcttaagatcggcgcaaagtccaagaaggatcctcacattaaggtgtcaggcaaaaaagaggacgtgaaagaagccaaagagatgattatgtcagttctggatactaagtcaaaccgggtgacacttaaaatggacgtgtcccacacagaacactcccatgtgattggaaaaggtggaaacaacatcaagaaagtcatggaagagacaggatgtcatatacatttccccgactccaacagaaataatcaagccgaaaaaagcaaccaagtgagtattgcaggtcagccagctggggtcgagtctgctagggtaaggatacgagagttactgcctctcgtactgatgttcgagctgcccatcgctggcatcttacagcccgtgccagacccaaattccccaagcattcagcacatatcccagacctacaatatatccgtgagcttcaagcagcggagcagaatgtatggcgctactgtcattgttcggggttctcagaacaacacctccgctgtcaaagagggcacagcaatgctcctggagcatctggccggatcccttgctagcgctatacctgtgtccacccagctggatatcgccgctcagcaccacctgttcatgatgggacgcaatggctccaatatcaaacatatcatgcagaggaccggtgcacaaattcatttccctgacccctccaaccctcagaagaagtctacagtttatctgcaaggcaccattgagtctgtgtgcctggcccgacaatatctgatgggctgtctgcccctggtactaatgtttgacatgaaagaggagattgaagtggatccacaatttatcgcacagttgatggagcagttagacgtcttcatctcaattaagccaaagcctaagcaaccctcgaagagtgtcattgtgaagtccgtcgaacgtaacgccctcaatatgtatgaggcaaggaagtgtctcctgggcctggagtcctccggtgtgactatcgcaacttcgccttctccagctagttgtccagccggactggcgtgccccagtctcgatatccttgcttccgctggccttggtctgacagggctgggactgctcggtcccacaacattgagtttaaatacatcaaccacacccaattcccttttaaatgctctgaacagttcagtttccccactgcaaagcccatcttccggaaccccaagcccgactctgtgggcgcctcccctagctaacacttctagcgctacggggtttagcgcaattccccatctcatgatcccgtccaccgcgcaagcgacactgactaatatactgctgagcggggttcccacgtacggtcacactgcacctagtcccccacccggacttactccagtggatgtgcacattaactcaatgcagaccgaaggcaagaagatttcggcggctctgaacggtcatgcccagtctcctgatatcaaatatggggctatcagcacatccagtctcggcgaaaaggtgctatcagcaaaccacggagacccatctattcaaacatccgggtcggagcagacctctccgaagtcctcccctacagaaggctgcaacgacgcttttgtcgaggtcggaatgcctagatccccgtcccacagcggcaatgctggggatctaaagcaaatgatgtgcccatccaaagtcagttgtgctaagagacagacagtggagctgttgcaaggcaccaagaattcacatctccattccacggaccgcctgctcagtgaccccgagttaagcgccacagagagcccactagcagataaaaaggccccaggctccgagcgcgctgcggagagagccgcagcggctcagcaaaactcggagcgcgctcatctggctccaagaagctcctacgtcaacatgcaggccttcgactacgaacagaagaagctcctggccaccaaggcaatgctgaagaagcctgtcgtcacagaagtgcgtacaccaacaaacacgtggagcgggctcggcttctctaagtctatgcccgcagaaaccattaaggaactgagacgtgccaaccacgtgagctacaagcccaccatgactacaacatacgaaggctccagcatgagcctaagtagaagcaattctcgggagcacctggggggagggtccgagagcgacaactggagagatcgtaatgggatcggtcctggaagccatagcgagttcgccgcaagtattgggtcccccaaacggaagcagaataagagcaccgaacactacctatcttcatctaattacatggattgcattagcagtttaacagggtcaaatggctgtaatctgaactccagcttcaaaggttccgacctgcccgagctgttctcaaagctcgggttagggaaatatacagatgtgttccagcagcaggaaatcgacctgcagacattcctcactctgactgatcaggacctgaaagagttgggtataacaacattcggggctagaagaaagatgctgctcgccatcagtgagctaaataaaaatcgacggaaacttttcgagtctccgaacgccagaacctccttccttgaaggcggagccagtggtagactccctcggcagtatcactccgatattgcctctgtctccgggcgatggtag

SEQ ID NO: 215988 - DNA, 2928 bp, Artificial Sequence
  Description of Artificial Sequence: Synthetic coding sequence
atggccgcagaggaagttttacagactgtggaccactacaagaccgagatcgaaaggctcaccaaagaactgaccgagacaacgcatgagaagatccaggccgctgaatacggtttggttgtactagaagaaaagcttaccttaaaacagcagtacgacgagctggaagctgaatacgattcattaaagcaagagttggaacaactgaaagaggcttttggccagagctttagcatccaccgcaaagtcgccgaggacggcgaaacacgggaggagaccctacttcaagagagcgcaagtaaggaggcatactatttaggcaaaatattggagatgcagaacgaattgaaacagtcacgtgctgtggtgaccaatgtacaggctgagaacgaaagactgactgcagtggttcaggacttgaaggagaacaatgagatggtggagctgcaaaggatccggatgaaagatgaaatccgcgagtataagtttcgcgaagctcggctgcttcaggattatacagaactcgaggaagagaatatcactttgcagaagctggtttccacccttaagcagaaccaagtggagtatgaggggctgaaacatgagattaagcggttcgaggaagaaactgtattattaaattcccagctagaggacgctatccggttgaaggaaattgccgagcaccagctggaggaagcgctggagactctgaaaaatgagagggagcagaaaaataatttgcgcaaggagctgagtcaatacatttctctgaacgataaccatatttcaatcagcgtagacgggcttaaatttgctgaagacggctccgagccgaataacgacgataagatgaatggccacattcacggccctctagtgaaactcaacggagactacagaacgcctaccctgcgtaaaggagaaagtcttaacccagttagtgatctattctcagaactcaacatttctgagatccagaaactcaaacagcagctgatgcaggtagagagggagaaagccattttgctagccaatttgcaggaatctcagactcaactagagcatactaagggtgcactcaccgagcagcacgaaagagtgcaccggttgactgagcatgtgaatgctatgcgcggactccaaagctctaaagaactcaaagccgagcttgatggagaaaagggccgagactcaggagaagaggcacacgactatgaagtcgacatcaatgggctggagattcttgaatgcaaataccgcgtcgccgtcactgaggttatcgacctaaaagccgagatcaaagccttgaaggagaagtacaacaagtcagtagagaattacacagatgagaaggctaaatacgagtcaaagattcaaatgtatgatgaacaggtcacaagcctcgaaaagacaacgaaggagtcaggggaaaaaatggcccacatggagaaagagcttcaaaagatgacctcaatcgcgaatgaaaaccattccactctgaatacagcccaggacgagttagtgacattttctgaggagctggcccaactctatcaccacgtgtgtctgtgcaataacgagacacccaatcgcgtgatgttagattactacagacagtcccgtgtgacacgctctgggtctctgaagggtccagacgacccccgtgggcttctatctcccagactggcccgtcgaggagtgagcagccctgtcgagacccggaccagttcagaacccgtagccaaagagtccaccgaggcctctaaggaaccatctcctactaaaacgccaaccatcagtcctgttatcactgcgccacctagctcacctgtcctggataccagcgacatccgtaaagagccaatgaatatctacaatctgaacgctatcataagagatcagattaagcacctgcagaaggccgtggaccgcagtctgcaactgtcgcgacagagggcagcggcaagagagctggcaccgatgatagacaaggacaaggaagccctgatggaagaaattcttaaactcaagtccttgttaagtacaaagcgggaacagatcgccaccctgcgtgccgtgctcaaagcaaacaaacagacagccgaggtagctctggctaatttgaagaacaagtacgaaaacgaaaaggcaatggtgaccgaaactatgacgaaactccggaacgagcttaaggccctaaaagaagatgccgcaaccttctctagtcttcgggctatgtttgcaacccggtgcgacgagtatgtgacacagcttgatgagatgcagcggcagttagcggctgcagaggatgaaaagaaaactctgaatacactgttacgaatggccattcaacagaaattggccctgacccagcggctagaggacttagagtttgaccacgagcagtctaggcgaagtaagggtaagctgggcaaatccaagatcggctctccaaaggtttccggagaggcaagtgtgactgttcctactatagatacctacctgctgcatagccagggaccccaaacccctaacatccgcgtaagtagtggcacccagaggaagcggcagttctcaccgtccctgtgtgaccagagcagaccgcgaacaagtggagcttcctacttgcagaatctcctccgagtccccccagaccctacgtctaccgagtctttcctcctaaaaggccctccctctatgtccgagtttattcagggccaccggctgtccaaggaaaagcggctgactgtggcaccgcctgattgccagcaaccagccgcttctgtgccgccacaatgttcgcaactcgcgggaagacaggattgcccgacagtaagtcccgacacagcccttccagaagaacaaccacacagcagcagtcagtgtgctcctctgcactgtctctctaagccccctcacccctag

SEQ ID NO: 215989 - DNA, 2484 bp, Artificial Sequence
  Description of Artificial Sequence: Synthetic coding sequence
atggccgcagaggaagttctgcagacggtggatcactacaagactgagatagaaaggctcacgaaggagctgactgagactacccatgaaaaaatccaggcagcagagtacgggctcgtcgttcttgaggagaaactcacactgaaacagcagtacgatgagttggaagccgagtatgacagcctcaaacaagaattagagcaattgaaggaggctttcggacaaagcttttcaattcatcgaaaagtcgcggaagacggcgagactcgtgaagagaccctcttgcaggaatctgcatctaaggaggcatattaccttggtaagattttggagatgcaaaacgagcttaagcagagccgagcggttgtcacgaacgttcaggcagaaaatgagcgactcacagccgttgtccaggacctgaaggaaaacaacgagatggttgagctccaacgcataaggatgaaggacgaaattcgggaatataagttccgggaagctagactgctacaagattacacagagctcgaggaggagaacataactcttcagaaacttgtttcaacactgaaacagaaccaggtcgaatatgagggtctcaaacacgagatcaagcgctttgaggaagaaaccgtcctcctgaactcccaattagaggatgctatcaggttgaaagagatcgctgagcatcaactggaggaggctcttgagacgctaaagaatgagcgggagcagaaaaataatttgagaaaagaactctcacagtatatttctcttaatgacaaccacattagcatctcggttgatggcttgaaattcgcagaggatggatctgaacccaacaatgatgacaagatgaacggtcatatccatggcccacttgtgaagcttaacggggactataggacacccactctgcgaaagggtgagagcctgaaccctgtgtccgatctgtttagcgaactgaatatatcagaaatccaaaagcttaagcaacaactgatgcaagtcgagagggagaaagccattctgttagcaaatctgcaggaatcccagacccagctcgagcataccaaaggagctctgaccgagcaacacgaacgagtgcacaggcttaccgagcacgtgaatgccatgcggggactgcagtcaagcaaggaactgaaggccgagctggatggagagaaggggcgtgactccggagaggaggctcatgactatgaggtcgacatcaacgggctggaaatcctcgagtgcaaatatagagtggctgtcaccgaagtgattgatttgaaggccgagatcaaggcactgaaggagaagtacaacaagtccgtcgaaaattatacagacgagaaggccaagtacgagtctaaaatacagatgtatgacgaacaggtgacctcactggaaaagacaaccaaggagtctggggagaaaatggcccacatggaaaaggaactccagaaaatgacctccatcgctaacgagaatcattctacgctcaacactgcccaggatgagctggtaacatttagcgaggagttagcccagctttatcaccacgtgtgtctgtgtaataacgaaacacccaaccgggtcatgcttgattactacagacaaagcagagtcacaaggagcggaagtctcaaggggcctgacgatccaagagggttactgtccccccgtcttgcgagaaggggagtatctagtccagtcgagacccggaccagctccgagccggtggccaaggagtcaacagaagcctcaaaagagccgtctcctacgaaaacccctacaatcagccctgtaataaccgccccacctagctccccggtgctcgacacctccgatatcagaaaggagcccatgaacatatataatctgaatgcaatcatcagagaccagatcaagcatttgcagaaagctgttgataggtcgctgcagctgagccgccagcgagctgccgcacgcgagctggcacccatgattgacaaagacaaggaggctttgatggaagaaattttaaaactcaagtctctgctttcaacgaagagggagcagattgccacccttagagctgtcctcaaagctaataaacagaccgctgaagtcgcgctggctaatcttaaaaataagtatgaaaacgagaaagccatggtcacagaaaccatgaccaagctgagaaatgagcttaaggccctgaaggaagacgcggcaaccttctctagtctgcgtgccatgtttgccaccagatgcgacgaatacgtaacacaattagacgagatgcagagacagctcgcagcggcagaagacgagaaaaagaccctgaacactcttctcagaatggctatccagcagaaactggcgttgactcagcggcttgaggatctcgaatttgaccacgaacagtctcggagaagcaaaggaaaactggggaagagcaaaatcgggtctcctaagacaatcttcactttcccactatag

SEQ ID NO: 215990 - DNA, 2508 bp, Artificial Sequence
  Description of Artificial Sequence: Synthetic coding sequence
atggccgcagaagaggtgctccaaaccgtggatcactataagaccgagatagagaggttgaccaaggaattaacggaaaccacacatgaaaaaatccaggctgccgaatatgggctagtggtgctcgaagagaaactgacacttaagcaacagtacgatgaactggaggccgagtacgactctttaaagcaggagctcgagcagctgaaagaagcctttgggcagagtttttctatccatcggaaggttgcagaggacggcgaaacaagagaggagaccctgctacaggagtccgcatccaaagaagcatactacctcggcaagatcctggagatgcaaaacgagctgaagcagtcccgggctgtagtgactaacgtacaggcagaaaacgagcgcctgacagcagtcgtgcaggacctcaaggaaaataacgagatggtcgagctccagcgcattagaatgaaagatgaaatccgtgagtacaagttccgcgaagcgagactgctgcaggactatacagaattagaggaagagaatattacactgcagaaactggtgtcgaccttgaagcagaaccaggttgaatacgagggccttaagcatgagattaaaaggtttgaagaggagaccgtgctcctgaattctcagctggaggacgctatacgtctgaaagaaatcgctgagcatcagcttgaggaagccctggaaaccctgaagaatgagcgggagcagaaaaataacctcaggaaggaactgagtcaatacatctcgctgaatgataatcatatttctattagcgttgatggcctgaagtttgccgaggatgggtctgaacccaataacgatgacaagatgaatggacacatccacgggccactggtaaagctgaacggcgactaccggaccccaactctgaggaagggcgagagcctgaatccagtttccgacctcttcagcgagctgaacataagcgagatccagaagctgaaacagcaacttatgcaggtggagagggaaaaagcgatcctccttgcaaacttacaagaatcacaaacccagttagaacacactaagggggcactgactgagcagcacgagagggtgcacaggctgactgaacatgtcaacgccatgaggggactgcaaagtagtaaagaactcaaagcggagcttgatggagagaaaggacgggacagcggagaagaagcacacgattacgaagtcgatattaatgggcttgagatcttggagtgcaagtaccgcgtagccgtcactgaggttatcgacttaaaggccgaaattaaggcactgaaagaaaaatacaataaatctgtcgagaactatacagacgaaaaggccaaatatgaaagtaagatacagatgtatgacgagcaagtgacttctctggagaagaccactaaggaatctggggaaaagatggcccacatggagaaagaactacaaaagatgacctcaatcgccaatgagaaccactctactctaaacactgcgcaggatgaattggtgaccttctctgaggagctagctcaactgtaccatcacgtatgtctgtgtaataatgagactcctaaccgcgtcatgctcgactactaccgccagtctcgcgtcaccagatcgggaagcttaaaggggccagatgatcctcggggactcttatctccgaggctggctcggagaggtgtaagctctccggttgaaactcgcacgtcgtctgaacctgtggccaaggagagtacggaggccagcaaagaaccctcaccgactaaaacacccaccatttcccctgtgatcacagcccctcctagttcacccgttctggacacatccgacattcgaaaagagccaatgaacatctacaatctcaacgcaataatccgtgatcagatcaagcacctccaaaaggctgtcgatcgctccctccaattatctcggcagagggccgcagctcgagaattagcaccaatgatcgataaagacaaagaagcccttatggaagaaatcctgaaactgaagtccctgctgtcaaccaagcgcgagcagatcgccacattacgtgccgtactcaaggccaataagcagacggccgaggtggccctggccaacctgaagaacaagtacgagaatgaaaaggccatggtgactgagaccatgactaagctcaggaacgaattaaaggccctgaaagaggatgcggcaaccttcagttccctgcgagccatgttcgcaacaaggtgcgatgaatatgtgacccagttggacgagatgcagcggcagctcgccgcagcagaagatgaaaaaaagaccttgaacactctgctgcggatggctatacagcagaaattagctctgactcaaaggctcgaagacttggaattcgaccacgaacaatcgcggagatctaagggcaaacttggaaagtcaaagattggttccccgaaaatcgttagctctttgctccctccctacaggcattccgcacacaattag

SEQ ID NO: 215991 - DNA, 2568 bp, Artificial Sequence
  Description of Artificial Sequence: Synthetic coding sequence
atgtctgccccaagtgaagaggaggaatatgccaggcttgtgatggaagcacagccagagtggctgcgcgcagaagtcaaacggctgagccacgaactggccgagacaacaagggagaaaatacaagccgctgaatatggactcgccgtcttagaagaaaagcaccaactgaagttgcagttcgaggaactggaggtcgattacgaagccatccgtagcgagatggaacagctgaaagaggctttcggccaggcccatacaaaccacaagaaggtagccgctgacggagagtctcgagaagaatccttgattcaggagagtgcttctaaagaacagtactacgtaaggaaagtgctggagctccaaacagagctcaagcaattaagaaacgttctcacaaacacccagagcgaaaacgaacggctcgctagcgtggcccaagagctcaaagaaatcaaccagaatgtggaaatccagcgcggaaggttaagggacgacataaaagaatacaaatttcgggaggcaagacttctgcaagattattccgaattggaagaagaaaatatctcacttcaaaagcaggtgagcgtcctacgacagaaccaggtagagttcgaggggctcaaacacgaaatcaagcggctcgaagaagagaccgaataccttaatagccagctggaagacgcaattaggttaaaagagatcagtgaacgtcagttagaagaagccctggaaacactcaagacggagagggaacagaagaattccttgaggaaggagcttagtcactacatgtctattaacgactcattttatacatcccacctacatgtgagcttggacggcctgaaattctctgatgatgcagccgaaccaaataacgacgcagaggcgcttgtaaacgggttcgagcatggcggtctggcaaagttgccacttgacaacaagacgtctactcccaaaaaagaaggcttagcaccgccttccccttcgcttgtttctgacttgctgagtgagctcaatatcagcgagattcagaaacttaagcagcagcttatgcagatggagagagaaaaggcaggcttgttggcaaccctacaggatacgcaaaagcagttggagcatactcgcggtagtctgtctgagcagcaggagaaggtgacaagactcactgaaaacttaagcgcccttagaaggctacaggcttccaaagagagacagacagcactggacaacgagaaagaccgggatagccacgaggatggggactattacgaagtggatattaacggccctgagatcctggcctgtaagtaccacgtcgccgtggcggaagcaggagagttgagagaacagttgaaggcgctgaggagtacacacgaggcacgcgaagcacagcacgcggaggagaagggtagatacgaagctgagggtcaggcgctgacagaaaaagtctcactcttagaaaaggccagccgccaagatcgcgagttgctcgcgagactcgaaaaggagcttaagaaggtgtctgacgtggccggagagactcaggggagtttatcggtggcccaggacgaactagttacgttttccgaggaattggccaacctgtaccatcacgtgtgtatgtgcaataacgaaactcccaaccgagttatgcttgattactatcgggagggacaaggaggtgcagggcgtacctctcctgggggaaggacaagcccagaagcacgtgggaggcggtcccctatcctactgcctaaagggctgttggctcctgaagctggcagggccgatgggggaacgggggacagctccccctcaccgggatcctccctccccagccctctgagcgatccacggcgagagcctatgaacatttataatctcatcgccattatacgtgatcagataaaacacctgcaggcggctgttgatagaacaaccgagctctcaaggcaacgcattgccagccaggaacttggacctgctgtggataaagacaaggaggccctgatggaagaaatactgaagctgaaatccttactcagcaccaaaagagagcaaataactacgctcaggactgtactgaaagcaaacaaacaaactgctgaggtagcactcgccaacctgaagtcaaagtatgagaacgagaaagctatggtgacagaaactatgatgaaactgcgaaatgagctgaaagccctcaaagaggacgctgccaccttctcttccctcagagcgatgttcgcaactcgctgtgatgagtatattacacagctggacgagatgcaacggcagttagctgccgcagaggacgaaaaaaagaccctgaactctctcctccgcatggctatccagcagaagttagctttgacccagcggttggagttattggagctggatcacgagcagactcgccgaggtcgggcaaaagccgcacccaagactaagcctgctactccctcggtttcccacacctgcgcgtgtgcctccgatcgcgctgaaggcaccgggctggccaaccaagtcttctgttccgagaagcactcaatctactgtgactag

SEQ ID NO: 215992 - DNA, 2475 bp, Artificial Sequence
  Description of Artificial Sequence: Synthetic coding sequence
atgtccgctccaagtgaggaggaggagtatgccagactggtgatggaggcgcagccggagtggctgcgggcagaggtgaaacgtctttcccacgagcttgctgaaactacccgagagaagatccaggccgcagagtacggattagcagtcttagaggaaaagcatcagcttaagctccagtttgaggagctggaggttgattatgaggctatccggagcgaaatggagcaacttaaggaggccttcggccaggcacacactaaccacaaaaaggtggccgcagacggcgagtcccgtgaagagtctctgatccaagaaagcgcgtctaaggagcaatactatgtgcggaaagttctagagttacaaactgaactcaagcagctgcggaatgtgctaaccaacacccagagtgagaacgagagactggccagtgttgcacaggaactcaaggagattaaccagaatgtggagatacagaggggacgtcttagggacgacattaaagagtacaaatttcgggaggcgagactgttgcaggactacagtgaactcgaggaagagaacatctcactgcagaagcaggtgagcgtgctccggcagaatcaagtggaattcgaagggctgaaacacgaaatcaaacggctggaggaggagaccgagtacctgaactcgcagcttgaagatgctattcgacttaaggaaatttcagagcgacagctagaggaggcactggagaccctcaaaacggagcgtgagcagaagaattcactgaggaaggaactgagccattacatgtcaatcaatgactccttctataccagccatctccacgtgtcgcttgacggcctcaaattttctgatgatgcagccgagccaaataacgacgctgaggcactcgtcaacggcttcgagcacgggggtctggccaaactgccgctggataataaaacatcaacacctaagaaggaggggctggcacccccatcaccctccctggtgtctgaccttctctcagaactcaatatttcagagattcagaagctgaagcaacaactcatgcagatggaaagagaaaaggccggattactagccacactgcaggatacacagaagcaactcgagcacacccgaggctccctgtcagaacagcaggaaaaggtgacgcgactgacagagaatctgagcgcgctaaggcgactgcaggccagtaaggaaaggcagactgccctggacaatgagaaggatcgagatagtcacgaggacggcgactattacgaagtggacatcaacgggccagaaatccttgcatgtaagtatcacgtggccgtggcagaagccggtgagctaagggagcagctcaaggctcttagatcaactcatgaagcccgtgaggcccagcacgccgaggagaaaggcagatatgaagccgagggtcaggcccttactgagaaagtgagtctgctagaaaaagccagtaggcaggaccgcgagttgctcgctcggctggagaaagagttgaaaaaggtcagtgacgttgccggtgaaactcaggggtccctatccgttgcccaagatgagcttgtcacgttcagcgaggagttggcgaatctctatcaccacgtgtgcatgtgcaataacgagacgcctaaccgcgtaatgctagattactaccgggagggccaggggggagcgggtcggacgagccccggtgggcgtacttcccccgaagcccgagggaggcgtagccccatcctgttgcctaaggggcttttagcccctgaagctgggcgagccgacggcggtacaggggactcttcgccctcccctggtagttcccttcccagtccactgtctgacccacggagggagccaatgaacatttacaatttaatcgcaattatacgagatcagatcaaacatctgcaggccgctgttgaccgcaccactgagttgagccgccagcgcatcgcatctcaggaactgggcccagctgtggataaggataaggaagccctcatggaggagattcttaagctcaaatctctgctatccacaaagagagagcagataacaacactccgtacagtgctgaaggccaacaaacagacagccgaagtggctctggccaatctgaaaagtaagtacgagaatgaaaaggcaatggtaactgaaaccatgatgaagctgcgcaacgagttgaaagcattgaaggaggatgctgcaacattttcaagcctccgggcaatgttcgccacacgctgcgacgaatacataacacagctggacgagatgcagcgccagcttgccgctgccgaagatgaaaagaaaaccctgaactccttgttgagaatggccattcagcagaagctagcactcacccaacggctagagttgctcgaactcgatcacgaacaaactaggcggggtagagctaaggccgcaccaaaaactaaacctgccacacccagcctgtag

SEQ ID NO: 215993 - DNA, 1107 bp, Artificial Sequence
  Description of Artificial Sequence: Synthetic coding sequence
atgtggccgctctggcggttagtgagtctgctggccctgtcccaggcgctgccatttgagcagcggggattctgggatttcactttggatgacggccctttcatgatgaacgacgaggaagcctccggggctgacacatccggtgtcttggacccagactccgtaacccccacctactccgcgatgtgccccttcgggtgccattgccatctgcgagttgtccagtgcagtgatctgggcctcaaatctgtcccaaaggaaataagccccgatacaaccctgctggatctgcagaacaacgatatctcagaactgagaaaggatgatttcaaaggcttgcagcacctgtacgcccttgtcctcgtcaataacaagatttcaaagatccatgagaaggcgttctcgcctctgcgaaagcttcagaagctgtatatcagtaaaaaccacttagtggaaatccctcctaacctgccctccagcctcgtcgaactaaggatccacgacaatcgaatccgcaaggtcccaaaaggcgtcttctcgggattaagaaacatgaattgcatagaaatgggcggaaaccctctggagaactcaggatttgagccaggagcttttgatggactcaagctcaactacctgaggatctccgaagccaaactgaccggcattccaaaagacctgccagaaaccctgaatgagctccatctcgatcacaataaaatccaagccatcgaacttgaggatctgttgcggtattcgaagctctaccggctgggtcttgggcacaatcagatacgaatgatcgagaacggctcgctgtctttcctgccaaccctgagggaattgcatctggataataacaaactggcacgcgttccgtccggactgcctgacctgaaactcttacaggtcgtgtacctgcacagtaacaacatcacgaaggttggagtcaacgacttttgtccgatgggatttggcgttaaaagagcatactataacgggattagcttgtttaacaatcccgtgccttattgggaggtgcagccggctactttcaggtgcgtgaccgatagactcgcgattcagttcggtaattataagaagtag

SEQ ID NO: 215994 - DNA, 924 bp, Artificial Sequence
  Description of Artificial Sequence: Synthetic coding sequence
atgtgtccttttggatgccattgccacctaagggtggtgcagtgtagcgacctgggcctgaagtctgtgcccaaggagattagcccagacacaactctgttggacctccagaataacgatatcagcgagcttaggaaggacgattttaagggactgcagcatctctacgcactggtgctcgtcaataataaaattagcaagatccacgagaaagccttcagtcctctccgtaaactgcagaagctgtatatcagtaagaaccacttggtcgagattcccccaaatctgccatcttcgctcgtggagctgagaatacatgacaacaggatacggaaggtaccaaagggtgtgttttcgggtctaaggaacatgaattgtattgagatgggcggtaaccccttggaaaactccggtttcgaaccaggggcttttgacggacttaaacttaactacctacgtattagcgaggcgaaactgaccgggataccaaaggaccttccagagacactgaacgaactgcacctggaccataacaaaatccaagctattgagctggaggacctgttaaggtactcgaagctctacaggcttgggttgggtcacaaccagatacggatgatcgagaatggttccctgagtttcctgcctactttgagagagctgcacctggataacaataaactggctagggttcctagcgggctgccggacctgaaactgctgcaagtggtctacctgcactccaataatataacaaaagttggagtgaatgatttctgccctatggggtttggcgttaagagagcctattacaatggtatttccctgtttaacaatcccgtcccatattgggaagtgcaaccagcaaccttcaggtgtgtaaccgaccgattagcaattcagttcggcaattataagaagtag

SEQ ID NO: 215995 - DNA, 924 bp, Artificial Sequence
  Description of Artificial Sequence: Synthetic coding sequence
atgtgccctttcgggtgccattgtcacctgcgggtcgtgcagtgcagtgatctcggcttaaaatctgtgcctaaagagatcagccctgatacaacccttctggatttgcaaaataatgacatttcagagcttaggaaggacgactttaaaggcctgcagcacctgtacgcgctcgttctggtgaacaacaagataagcaagattcatgagaaggccttctcaccattgaggaaattacagaagctgtacatctctaagaatcatttggtggaaatacccccaaacctgccctcctccctggtagagttacgcattcatgataaccggatcaggaaagtccctaaaggagtattctccggtctccggaatatgaactgcatagagatgggaggaaatccactggaaaactccggtttcgaacccggagcgtttgatggcctgaaacttaattatttacgaatctctgaagctaagttgactggcattccaaaagatctcccagaaaccctgaacgagctgcacctggatcataacaagatccaggcaatcgagctggaagatctgctccgatactctaaactgtacaggctgggcctggggcataaccaaattcggatgatcgaaaacggttcccttagtttcctcccgactttgcgagaactgcacttagacaataacaaattggcccgagtgccatccggccttccagatctcaagctactacaggtggtttacctgcactctaacaatatcacaaaagttggcgtgaatgacttctgtcctatgggctttggggttaaacgagcctactataatggcatctctttgtttaacaatccagtgccttactgggaggtccaaccagcaaccttccggtgcgtcaccgaccgactagctatccagttcggcaactataaaaagtag

SEQ ID NO: 215996 - DNA, 717 bp, Artificial Sequence
  Description of Artificial Sequence: Synthetic coding sequence
atgtggccactgtggcgcctcgtcagcctgctggcactgtctcaagccttaccattcgaacaaaggggtttctgggattttactctggacgacggccctttcatgatgaatgacgaggaagcttctggggctgatacttccggggtcctggatcccgacagtgtgactcctacatatagcgcgatgtgccccttcggttgtcactgtcacctgcgcgtggtccagtgttccgatcttgggctgaagagtgtgcccaaggaaattagtcctgatacaacacttcttgacctccagaacaacgacatttccgaactgaggaaggatgacttcaaggggctgcaacacctgtacgttcgtagctgggaagagcccgctggcttgcagcagagagcaggcgttagggcactcgtcctcgttaacaacaaaatttcaaagattcacgaaaaagccttctcacctttgcgtaagctgcagaaactctacatttccaagaaccatcttgtggagatcccaccaaatctccccagctctctggtcgagcttagaatccacgataacaggatacggaaagtcccaaagggcgtgtttagcggcttgagaaatatgaactgcattgagatgggtggtaaccccctggagaactcaggatttgagccaggagcttttgatggcctgaaattaaattacctgaggatctccgaagccaaactgacatag

SEQ ID NO: 215997 - DNA, 1257 bp, Artificial Sequence
  Description of Artificial Sequence: Synthetic coding sequence
atgatacagctcacagctaccccggtcagcgctttagttgacgagccagtgcacataagagctacaggcctcataccttttcagatggttagcttccaagcttcactcgaagatgaaaatggtgatatgttttacagtcaggcacattatagggccaacgaattcggcgaggtggacctgaaccatgctagcagtctcggcggtgattacatgggagtgcaccctatgggcctgttctggagtctgaagcccgagaaactgctgactcgccttctgaagcgagacgtaatgaacaggcctttccaagtgcaggtgaagctatatgatttagaattaattgtgaacaataaggtggcgtcggccccaaaagcctctctcacactggagaggtggtatgtcgcaccgggtgtgacccgcatcaaggtgcgtgagggccgacttaggggagctctgttcctgccacccggagagggcctgttccctggagtgattgatctgtttgggggactcggaggcctgctcgaattcagggcgtcactgcttgcctcgcgagggttcgcatccctggcgctagcctaccacaattacgaagacctgccaaggaagcccgaggttaccgacctggagtacttcgaagaggccgcaaacttcctcctgcgccatcctaaagtattcggatcaggagtgggggtggtgtcagtgtgccagggcgtccagatcgggctatcaatggccatctatctgaaacaggtaacggcaacggtcctgataaatggcaccaattttcctttcgggattccccaggtgtatcacggccaaattcatcagccattacctcattctgctcagctgatatcgaccaacgccctcggcctgctcgaactgtatagaacctttgagacaacacaggttggagcgagtcaatatctgttccctatcgaagaggcacagggacaattcctgtttatcgtgggggaaggggataaaaccatcaacagtaaagcacacgctgaacaagccattggccaactcaagcgacacggcaaaaacaactggaccctgctgagttatccaggcgctggtcatctcatagagcccccttattctccattgtgttgcgctagcacaactcacgatctgcggttgcattggggcggtgaggtgataccacatgccgcagcccaagaacatgcttggaaagagattcagcggttcctgcgtaagcacctcatccccgacgtcacctcccaattatag

SEQ ID NO: 215998 - DNA, 1257 bp, Artificial Sequence
  Description of Artificial Sequence: Synthetic coding sequence
atgattcagctcacagctacaccagttagcgctttggtcgatgagcccgtacacatccgcgcaactggcttgattccgtttcagatggtgtctttccaggcatcactggaggatgagaatggcgatatgttctactcccaggctcactacagagccaacgagtttggcgaagtggacctcaaccatgcctcatcccttgggggagattacatgggcgtccaccctatggggctgttttggtccttaaagccggagaagctgctgacgcgactgttgaagcgtgacgtgatgaacaggccctttcaggtgcaggttaaattatacgacctggagctgattgtcaacaataaagtggccagcgctccaaaagcaagtcttacgctcgagcgctggtacgtagctcccggtgtgacaagaatcaaggtgagggaaggaaggctacgcggtgctctgtttttgccaccaggtgagggattgtttcctggggtcatagacttattcggcggactgggaggacttctagaattcagggcatcccttctggcgagtcgaggcttcgcctccctcgcactggcctatcacaattacgaggacctaccccgaaagcctgaggtaactgacctggaatacttcgaggaagccgcaaacttcctgttgaggcacccgaaggtttttggctcgggagttggtgtagtctccgtgtgtcagggggtgcagattggcctgtcgatggctatttacctgaagcaagtgactgccaccgtcctgatcaacggtacaaactttccattcggcatcccacaggtttatcatggacaaattcatcagcccttgccacattccgcacagctcatctctaccaacgccctggggttactcgaactgtaccggaccttcgagaccacacaagtcggagctagtcagtatctatttcctatagaggaggcgcagggccagtttctttttatagtaggggagggggacaagaccatcaactctaaagcacatgctgaacaggcgatagggcaactgaaaaggcacggcaaaaacaactggaccctcctgtcctatcctggcgcagggcacctcatagaacctccttatagccctctctgctgcgctagtacaacccatgatcttcgactgcactggggaggtgaggtgattccgcacgccgcagcacaagagcatgcctggaaagaaatccaaaggtttctacgcaagcatctaataccggacgtgacttcccagctgtag

SEQ ID NO: 215999 - DNA, 891 bp, Artificial Sequence
  Description of Artificial Sequence: Synthetic coding sequence
atgaatgccgaacctgagcgcaagtttggcgtcgtggtcgtgggagtgggccgtgcgggttccgtgcggatgcgggatctgcgcaaccctcatccctcctccgccttcctgaacttgatcggttttgtctcccgcagagaattgggcagtatcgatggggtccagcaaattagcttagaagacgcactatcttctcaagaagttgaagtggcatacatctgctcagagagtagttctcacgaggactatattcgtcagtttcttaacgctggcaagcacgtgctggtggagtatcctatgactctgtccttggcagcagctcaagaattgtgggagctcgcggagcaaaagggaaaggtgctacatgaagagcacgttgagctcctcatggaagaattcgcatttttaaagaaagaggttgtgggcaaggacctcttgaaggggtcgctcttgtttaccgcgggacctctggaagaggaaaggttcggtttccccgctttctccggcattagccggctcacatggttagtgagcctgtttggggaactgtccctggtatcagccacactggaggaacggaaagaggaccaatacatgaagatgactgtgtgtctggagaccgagaagaagtcccccctgagttggattgaagaaaaaggacccggactgaaaaggaaccgttatctctctttccattttaagagcggcagcttggagaatgtcccaaatgtcggagtcaacaaaaatattttcctgaaagatcaaaatattttcgtgcagaaactcctgggccagttcagcgagaaggagcttgccgctgagaagaaacgcattctgcattgtttgggcctagctgaagagatacagaaatattgctgttctagaaaatag

SEQ ID NO: 216000 - DNA, 891 bp, Artificial Sequence
  Description of Artificial Sequence: Synthetic coding sequence
atgaatgctgagcccgagagaaagttcggggtcgttgtcgtgggcgtgggcagagccggatcagtcagaatgagggaccttcggaaccctcacccttctagcgcctttctcaaccttatcggatttgtgtctcgtagagagctgggttccatagatggagttcagcagatcagtctggaggacgcgctatccagtcaagaggtcgaggttgcttatatctgcagtgaatcttccagtcacgaggattatattcggcagttcctcaacgctggaaaacatgtcctggtggaatacccaatgacactatctctcgcggcagcacaggagctgtgggagctggcagaacagaagggaaaggtgctgcacgaggagcacgtggaattattgatggaagaattcgcgttcctgaagaaggaggtcgtaggaaaggaccttctgaagggatcccttctcttcacagccggtcctctagaagaggagcgcttcggattccccgcatttagcggtatctctaggctcacgtggctagtgtcgttgttcggcgaactttctctggtcagcgctaccttagaggagagaaaggaagaccagtatatgaaaatgaccgtttgtctggagaccgaaaagaagtctcctctgagttggattgaggagaaagggcctggattaaaacgaaacaggtatcttagctttcattttaaaagcggctcactggagaacgtgccaaacgtaggagtgaataagaatatcttcctgaaggaccaaaacatctttgtccagaagctgctcggccaattctctgagaaggagctggctgctgaaaagaagaggatcttacactgccttgggctcgctgaagaaatccaaaagtattgctgttctcgcaaatag

SEQ ID NO: 216001 - DNA, 309 bp, Artificial Sequence
  Description of Artificial Sequence: Synthetic coding sequence
atgaatgcagagcctgagcgcaagttcggggtcgtggtcgtgggcgtggggcgagcaggttcagtgaggatgcgggatctgaggaaccctcatccctcttctgcctttctcaatcttatcggcttcgttagtcgcagggaactggggagtattgatggcgtccagcagatcagtctcgaggatgccctgtcttcccaagaggtcgaagtggcatacatctgcagtgagtcctcatcacacgaagactacattcgacagttcttgaacgcaggcaagcacgtgcttgttgagtacccgatgactctctag

SEQ ID NO: 216002 - DNA, 621 bp, Artificial Sequence
  Description of Artificial Sequence: Synthetic coding sequence
atggcagtaaagaagatcgcgatatttggggctaccggccagaccggactaaccacactggctcaggcagtgcaagcaggttatgaggtaaccgtgctagtgagagattcatctaggcttccgtctgagggtccgagacccgcacatgttgttgtgggtgacgtcctgcaggctgctgatgtagataagacagttgctgggcaagacgcggtgatcgtcttgctgggtacaaggaacgacctgtcccccaccaccgtgatgtcagaaggagcacgcaacatcgttgctgccatgaaggcccacggcgtcgataaggtggtggcttgcacatctgccttccttttatgggatcccacaaaggtgccaccacggttgcaggctgtgactgatgatcatatacggatgcacaaggtcttgagggagagcggactgaagtacgtagccgttatgcccccacacatcggcgatcaacctttaaccggcgcatacactgtgaccctggatggtcgcggtccatccagagtcatctcgaagcacgatctgggacactttatgctccgctgccttaccacggacgagtatgacggacactctacctatccgtcccaccaataccagtag

SEQ ID NO: 216003 - DNA, 399 bp, Artificial Sequence
  Description of Artificial Sequence: Synthetic coding sequence
atgggctcccttatgctcctgttcgtcgaaacaactcgtaattcctcggcatgcatattccccgttatcctcaatgaactctctagcaccgtcgagacgataacacactttcctgaggtcacagatggagagtgtgtctttcctttccattacaagaacggcacctactacgactgtataaaaagtaaggcaagacacaagtggtgcagcctgaataagacctacgagggctactggaagttttgctcagcagaagacttcgctaactgcgtgttcccattttggtaccgcaggctgatctactgggagtgtactgatgatggtgaggcttttggaaagaagtggtgtagtctcaccaaaaatttcaataaagataggatctggaaatattgcgagtag

SEQ ID NO: 216004 - DNA, 429 bp, Artificial Sequence
  Description of Artificial Sequence: Synthetic coding sequence
atggctgctgccgcagagggagtgcttgcaacgagatctgatgagcccgcacgcgacgacgctgctgttgaaactgctgaggaggctaaagagcccgcagaggcggacattacggagctgtgccgagatatgttttccaaaatggcgacctatttgacaggtgagcttactgcaacaagcgaggattacaagttactagagaacatgaataaattaacttcgttaaagtatctggagatgaaggatatcgctataaacatttcaaggaacttgaaagacctcaaccagaagtacgccggacttcaaccctacctggaccagatcaacgtcatagaggagcaggtggcagccctggaacaggctgcctacaagctagacgcgtatagtaagaaactagaagccaagtataagaagttagaaaaaagatag

SEQ ID NO: 216005 - DNA, 225 bp, Artificial Sequence
  Description of Artificial Sequence: Synthetic coding sequence
atgaacaaattgacttccctgaagtacttagagatgaaagacatcgctatcaatatctcaaggaatctcaaagacttaaaccagaagtatgccggactccagccgtatttggaccagatcaacgtaatcgaggagcaggttgctgctctagaacaggcagcctacaaactcgacgcatactcaaagaagctggaagccaagtataaaaaattagagaagagatag

SEQ ID NO: 216006 - DNA, 225 bp, Artificial Sequence
  Description of Artificial Sequence: Synthetic coding sequence
atgaataagctgacttctctcaagtacctggagatgaaagatatcgctatcaacatcagtagaaacctaaaggacctgaatcagaagtacgccggtctgcagccctacttggaccagattaacgttatcgaagagcaggttgccgcactagaacaggccgcttacaagctcgatgcctactccaaaaaactggaagccaagtacaagaagcttgaaaaacgctag

SEQ ID NO: 216007 - DNA, 300 bp, Artificial Sequence
  Description of Artificial Sequence: Synthetic coding sequence
atgttctcaaaaatggcaacatatttgaccggcgaactcacggcgacttcggaagactacaagttactggagaatatgaacaagctgactagcttgaagtacctggagatgaaggacattgccattaacatttctcgcaatctcaaggatctaaatcagaaatacgcaggattgcagccatatctggaccagattaatgttatcgaggagcaggtggcggctctcgagcaggctgcttataaactagatgcttactccaaaaagctggaagccaagtataagaaattagagaaacgttag

SEQ ID NO: 216008 - DNA, 609 bp, Artificial Sequence
  Description of Artificial Sequence: Synthetic coding sequence
atggcaagtcagggccgacggaggcggcctcttaggcgcccagaaactgtcgtgcctggcgaggccaccgaaaccgactctgagaggtcagcctcatcgtcagaggaagaggagctgtatctgggccctagcgggcctactcgcggtcgacctacggggctcagggtggccggtgaggccgctgagactgacagcgagccagagccggaacctgagccaacagcagctccacgggatctgcctcccctggtcgttcagagggaatccgcggaagaagcttgggggactgaagaggccccagcgcctgctcctgcaaggagcctgcttcaacttcggctggcagagtcccaagccaggctcgatcacgacgtggcagcggctgtttccggagtctaccgacgcgcaggcagagatgtcgccgctctggcgagccgccttgccgcagctcaagccgctgggcttgcggctgctcacagtgtgcgcctcgcgagaggtgatctctgtgccctcgctgagagactcgacatcgtagccggttgccgcttgctccctgatatccgcggagtaccagggacagagcccgagaaggatcctggacctcgagcctag

SEQ ID NO: 216009 - DNA, 1632 bp, Artificial Sequence
  Description of Artificial Sequence: Synthetic coding sequence
atggctcatgcgcacatccaggggggacgcagagctaaaagtagatttgtggtttgcattatgtccggagcacgttctaaactagcattgttcctgtgcggttgttatgtggtggcactcggagctcatactggagaggagtccgtggcggatcaccatgaggctgagtactacgtcgccgcagtatatgagcatccgagcattctgagcctcaaccccttagctttgatttcccgacaggaggcattggagctcatgaaccagaatttagacatctatgaacagcaggtcatgaccgctgcacaaaaagacgtacaaattattgtgtttccagaagacggtatccacggttttaattttacaagaacctccatctatcccttcttggacttcatgccctcaccacaggtcgtaagatggaacccctgccttgagccccaccgcttcaacgacaccgaagtgctgcaaaggttgagttgcatggccattcgaggtgatatgttcctggtggccaatctcggtaccaaggagccctgtcatagctctgacccccgttgccctaaggacggccgttatcagttcaacacgaatgtggttttttctaacaatggcaccctggtggaccgctatagaaagcataacctgtactttgaggctgcctttgatgtcccgcttaaagttgacctgatcaccttcgacacaccctttgccggacggtttgggatttttacatgcttcgatatcctgttctttgaccccgctatccgcgtcctgcgcgattacaaagtgaaacatgttgtgtatcctaccgcatggatgaatcagcttccactcctggccgctattgagattcagaaggcattcgctgtagcattcggaatcaatgtcctggcggctaatgtgcaccaccccgtgctgggcatgaccggaagtggaatacatacaccactcgagtcattttggtaccacgacatggagaatccaaaatcccacctcatcatcgcgcaagtggctaagaaccctgtgggcctgatcggagccgagaatgctactggcgagacagacccttctcactccaaattcctaaagatcttgtcgggggatccttactgcgagaaagatgcccaggaggtgcattgcgacgaggctacaaagtggaatgtgaacgcacctccaactttccatagtgaaatgatgtacgataattttactctcgtcccagtctggggtaaggaaggttacttgcacgtttgttcaaacggcctgtgctgttatctcctgtatgaacggccaactctgagtaaggagctgtacgctctaggggtgttcgacggtctccacacggtgcacggaacctactacattcaggtttgtgcccttgttaggtgcggcggtttggggtttgacacttgtggacaggagatcacggaagccacagggattttcgaattccatctgtgggggaatttcagcacttcttatattttccctctgttccttacctcaggtatgactctcgaggtgcccgaccagcttggttgggagaacgaccattatttcctaaggaagagcagacttagctctggcctcgtcacagcggcactgtacggaaggctgtatgagagggattag

SEQ ID NO: 216010 - DNA, 1572 bp, Artificial Sequence
  Description of Artificial Sequence: Synthetic coding sequence
atgtctggggcacggtccaagctggctctgttcctctgcggttgctacgtagtcgcactgggggcacacactggcgaggagagcgtggcagaccatcatgaagcagaatactacgtcgcagctgtatacgaacacccctccattctttcattgaatcccctggcactgattagcagacaggaagcactcgaactgatgaatcagaacttggacatctacgagcagcaagttatgacggccgctcagaaagatgtacaaatcatcgtgttccccgaagatggtattcatgggttcaattttacacgaacctcgatctaccccttccttgacttcatgcccagcccacaggtggtccggtggaacccatgcctggagcctcatcggtttaacgataccgaggtgctgcagcgccttagctgtatggccattagaggtgacatgttcttagtagccaatctcgggaccaaagaaccttgccactccagcgatcctaggtgccctaaagacggccgttatcagtttaacacaaacgtggtgttctcaaataacggaacactagtcgaccgctaccggaagcataacttatacttcgaggcagcttttgacgtgcccctgaaggtcgatttgatcacttttgacaccccctttgctggaagattcggcatcttcacatgctttgatatcctgtttttcgatcctgccataagagtgctccgtgactataaagtgaaacatgtggtctaccctaccgcatggatgaaccagctccctctcctagccgctatcgaaatacagaaggcctttgccgttgcctttggtattaatgtgctggcagccaatgtccaccatcccgtgctcggaatgactgggtccggtattcacacccctttggagtcattctggtaccatgatatggaaaatcccaaatctcacctcatcatcgcccaggttgccaagaatcctgttggactcatcggcgcagaaaacgccactggagagacggatccgtcccactccaaattcctgaagatcctgtccggggatccttactgtgaaaaagacgcccaggaggtgcattgcgacgaggcaaccaagtggaatgtcaatgcacccccaacctttcactcagagatgatgtacgataatttcacactcgtccctgtctggggcaaagaaggctacttgcacgtgtgtagtaatggtctttgttgttacctcctttacgagcggccaacactgtccaaggagctttacgccctgggagtcttcgacggtctgcataccgtccatggaacatattatattcaggtctgtgctctggtgcgatgcggtgggcttggattcgacacatgcgggcaggagatcaccgaggcaacgggcattttcgagttccatctgtggggtaatttcagcactagctacatctttccactgtttctgacctccgggatgacattggaggtaccggatcagctgggttgggagaatgatcattactttcttcgcaaatcgaggcttagttccggcctggtaacggcagcgctgtatggtagactttacgaacgagattag

SEQ ID NO: 216011 - DNA, 1638 bp, Artificial Sequence
  Description of Artificial Sequence: Synthetic coding sequence
atggcaagaaaggagacgcaactcatcatcaaaatgaaccacttagcaagatttgttgtgtgcataatgagtggagctcgatcaaaactagccctctttctgtgcggatgttacgtggtggctctaggcgctcataccggggaggaatccgtcgcggaccatcacgaggctgaatactacgttgccgctgtgtacgaacatccttcaatcttgtcattaaatccgctggcccttatcagccgccaagaggccctggaactgatgaatcagaacctggatatatacgaacagcaggtgatgacagcagcccaaaaggatgtgcagatcatcgtcttccccgaggacggaatccacggcttcaactttacgagaacctctatttacccgtttctggatttcatgccatctcctcaagtggtcagatggaatccatgcctggagcctcaccgctttaatgacaccgaggtgcttcagcgtctgtcctgcatggccattcggggagacatgttcctcgttgctaacctggggaccaaggagccgtgtcactccagtgatcccagatgccccaaggatggcagataccagttcaacacgaacgtagtgttctccaacaatggaactctggtcgacaggtatcgcaaacataacctatatttcgaggctgccttcgacgtacccttgaaagtagatctcatcactttcgacacgccatttgccggacggttcggcatttttacttgctttgatatactctttttcgatcctgcgataagggtgctgcgggattacaaagtcaagcatgtagtctaccctaccgcctggatgaatcagctcccgctgctggcagctatagagatccagaaggctttcgccgtggccttcggcattaatgtccttgccgcaaacgtgcaccacccggtgctgggaatgacaggttccggaattcacaccccactggagagcttctggtatcatgacatggagaatcctaagtcgcatcttatcattgctcaagtggcgaaaaaccccgtgggcctgattggtgcagaaaatgccactggtgagactgacccctctcatagcaaatttctcaagatcttgtcaggagacccttactgtgagaaagatgcgcaggaggtgcattgtgacgaagccaccaaatggaatgtgaatgcacccccaacattccattctgagatgatgtacgacaattttaccctggtgccagtgtggggcaaagaaggctacctgcacgtgtgctctaatgggctttgctgctacctgctatatgaaagacccacattgtctaaagaattgtacgctcttggcgttttcgacggcctgcacacggtacatggtacttattacatccaagtgtgcgccctcgtgcgatgcggcggtctcggatttgatacttgcggccaggaaatcacggaagcgacaggtattttcgagtttcatctgtggggtaacttcagcacgagctatatttttcccctcttcttaacctccgggatgacgctagaggttccggaccaactgggatgggaaaatgaccactactttctgcgaaagagcaggttgtctagcggtctggttactgctgctttatatggacggttgtatgaaagagattag

SEQ ID NO: 216012 - DNA, 1638 bp, Artificial Sequence
  Description of Artificial Sequence: Synthetic coding sequence
atgccagaaggcggtgggacttcgcggaggcttctgccaatgcaatcgagattcgtcgtatgcatcatgagcggggcacgtagtaagctggctctcttcctgtgtggatgttacgtggtggcccttggtgcccacactggggaggagtccgtagcggaccaccatgaggccgaatattacgtggctgcagtctatgaacaccctagcattctctcgcttaaccctctggcactgattagcaggcaggaagcgctggagctcatgaaccagaacctggatatttatgagcagcaggtgatgaccgcagcccagaaggacgtgcagatcattgtgtttccagaagacgggatccacgggttcaattttacacgaacatccatctatccattcttggacttcatgcccagccctcaggttgttaggtggaacccttgcctggaacctcatcggtttaacgatactgaagtactccaacggctcagctgtatggcgattagaggtgacatgtttctggtggcgaatctgggaaccaaagaaccatgccactcgtccgatccacgttgccctaaggacgggagatatcagttcaacacgaacgttgtgttctcaaataatggcaccttagtggatagatataggaagcacaacctctatttcgaagctgcttttgacgtaccgctgaaggtggacctgatcaccttcgacactcctttcgcaggacgttttgggatcttcacatgcttcgacatcctttttttcgacccagcaatccgtgtactgagggattataaggtgaaacatgtcgtctacccaaccgcctggatgaaccagttacctctgctcgccgcaatcgagatccagaaagcctttgccgtggctttcggaattaacgttttggccgctaatgttcatcaccctgtgctagggatgacaggaagcgggatccacacacccctggaatctttttggtaccacgacatggagaatcctaagtcccatttgatcatcgcccaggtggctaagaaccccgtgggcttgattggcgcagagaacgcgaccggcgaaacggaccccagtcattctaagtttttgaagatcttgagcggcgatccatattgcgagaaggacgcccaagaagtgcactgcgacgaagctacaaagtggaatgtaaatgcccctcctacattccattctgaaatgatgtacgataatttcacgttggtcccagtgtgggggaaggaagggtatctccacgtgtgtagcaatggactttgctgttatttgctgtatgagcgtcccaccctaagcaaggagctatatgcgctcggcgtgttcgatgggttgcacacagtccacggaacctattacattcaggtttgtgcccttgtcagatgcgggggactgggtttcgatacatgcggccaggagattacggaggctacagggattttcgaatttcatctgtggggcaacttcagcacctcttacattttccccctctttctcacgtccggcatgaccctggaagtgccagaccagttgggatgggagaatgaccactattttcttcggaaaagccgcttatcctccggcctggtaaccgcggcactatatgggagactctacgagagggactag

SEQ ID NO: 216013 - DNA, 585 bp, Artificial Sequence
  Description of Artificial Sequence: Synthetic coding sequence
atgccccgaaatctgttgtactctctcttaagctcccatttgagtccccactttagtaccagtgttacttcagctaaggtggccgtgaacggcgtgcagttgcactaccagcaaacaggagaaggcgaccacgccgttctgctgcttccagggatgctggggtccggagagaccgattttgggccacagctgaaaaatctcaataagaagctttttaccgttgtagcatgggatcctcggggttatggtcacagtagaccccctgaccgtgacttcccagcggactttttcgaacgggatgcaaaagatgcagtcgatctcatgaaagccctgaagttcaagaaagtgagcctcctggggtggtctgatggagggatcactgctctaattgccgctgccaaatacccctcttatatccacaagatggtgatctggggcgctaacgcctatgtgacggatgaggactccatgatttatgaagggatcagggacgtcagcaagtggagtgaacgtacccgaaaacccctggaggcactgtatgggtggagccttaccctctcacctggttggaatgctatggcttag

SEQ ID NO: 216014 - DNA, 825 bp, Artificial Sequence
  Description of Artificial Sequence: Synthetic coding sequence
atgccccgtaacctgctgtattccctgctttcttctcatctgtccccacactttagtacctctgtaacctccgccaaagtggcagtaaatggggtgcagctccactatcagcagacaggtgagggcgaccacgccgtgttgttgctgcccggaatgctaggtagtggcgaaactgacttcggcccacaattaaagaacttgaataaaaagctctttactgtggtggcctgggacccacgtggctatggacattcacgcccacccgatcgcgacttcccggctgacttcttcgagcgcgacgctaaagacgctgtggacctcatgaaggctctgaagtttaaaaaggtttccctgctaggctggtctgacggcggaatcactgccctgattgcagccgcaaagtacccgagctatatccataagatggtgatttggggcgcaaacgcctatgtgaccgacgaagactcaatgatatacgagggcatccgtgacgtgtccaagtggtccgagcggactcgcaaaccccttgaagccctgtatggctatgactattttgccaggacttgtgaaaagtgggtggatggaataagacaatttaagcacctcccagacggtaacatctgccggcacctgctgcctagggttcagtgtccagccctcatcgtccacggcgagaaggatcctctcgtgccaaggtttcacgccgacttcatccataaacatgtgaaagggagtcgactgcatctcatgcccgagggcaagcacaatctgcacctgcgattcgccgacgaattcaacaagcttgctgaggatttcctgcaatag

SEQ ID NO: 216015 - DNA, 876 bp, Artificial Sequence
  Description of Artificial Sequence: Synthetic coding sequence
atggtggcagtgttgggcggacgcggagtacttcggctcaggctgttattaagtgctcttaagccagggatccatgttccccgagcagggcctgcggcagctttcggcacttcggttaccagcgcgaaagttgccgtgaacggcgtgcaactgcactatcagcagacaggcgagggagaccacgcagtccttcttttgcccggtatgctgggtagcggcgaaacggactttggcccacagctgaaaaacctaaacaagaagctgttcacagtggtggcctgggacccacgtggctacggacatagcaggccccctgatcgagattttccagctgatttttttgagagagacgcgaaggacgccgttgatctgatgaaagccctgaaatttaagaaagtgtccctccttgggtggtccgacggcggaatcaccgcgttaattgcagcagccaaatacccctcttacatccataagatggtaatatggggtgccaacgcatacgtgactgacgaggatagtatgatttatgagggcattcgcgatgtgagcaaatggtctgaacgaacccgtaagcctctagaagcgctctacgggtatgactacttcgccagaacttgcgaaaaatgggttgatggcatcaggcagttcaagcatctgcccgatggcaacatatgcagacacttgttgccccgtgtgcagtgtccagcgctgatcgtccatggcgagaaggaccccctagttccgaggtttcacgccgatttcatccataagcatgtgaaaggcagtagactccaccttatgccggaggggaagcacaacctccatctgcggttcgccgacgagttcaataagttagcagaagatttccttcagtag

SEQ ID NO: 216016 - DNA, 264 bp, Artificial Sequence
  Description of Artificial Sequence: Synthetic coding sequence
atgtactgtctacagtggctcctgcccgttcttctcatccccaagcctctcaaccccgctctctggttcagccacagcatgtttatggggttttacctcctctcatttctcctcgagcgtaagccatgcaccatctgtgcgcttgtgttcctggcagctctgttcttaatttgctacagctgctggggcaactgctttctgtatcattgttcagacagtcctctgcccgagagcgcccacgaccccggtgtggtagggacgtag

SEQ ID NO: 216017 - DNA, 264 bp, Artificial Sequence
  Description of Artificial Sequence: Synthetic coding sequence
atgtactgcctgcagtggctgctccctgtgcttctaattccgaaacctctgaacccagccctgtggttttcccactcaatgttcatgggtttctacctgctgtccttcctgcttgaacggaagccttgcactatttgcgccctcgttttcctcgccgcattgttcctaatatgctatagctgctggggcaactgcttcctctaccactgtagcgattcacctctcccagagtccgcacatgatcccggagtggttggtacttag

SEQ ID NO: 216018 - DNA, 264 bp, Artificial Sequence
  Description of Artificial Sequence: Synthetic coding sequence
atgtactgtctgcagtggttgctcccagtactccttatccccaagccactaaaccccgcactttggtttagccactccatgtttatgggattttacctgctttcgttcctgttggagcgcaagccctgcaccatctgtgccttggtgttcctcgcagccctgtttctcatttgctattcctgctgggggaattgctttctgtatcactgttccgatagcccgctaccggaatccgcacacgatccaggtgttgtgggtacctag

SEQ ID NO: 216019 - DNA, 264 bp, Artificial Sequence
  Description of Artificial Sequence: Synthetic coding sequence
atgtattgcctccagtggttactccccgtcctgctgataccgaagcctctcaaccctgctctctggttctcccactcaatgttcatgggcttctatctgctaagtttcttgctcgaaagaaaaccgtgcacaatatgcgctctagtattcctggccgctctgtttctcatatgctattcatgttgggggaattgttttctttatcattgtagtgacagccccctaccggaatcggctcatgatcccggtgtagtaggcacctag

SEQ ID NO: 216020 - DNA, 264 bp, Artificial Sequence
  Description of Artificial Sequence: Synthetic coding sequence
atgtactgcttacaatggttattacccgtgctattaatccctaaaccgctcaaccccgcactctggtttagccacagcatgttcatggggttctacctgttgtcctttcttctggagagaaagccatgcacgatctgcgccctggttttcctggccgcacttttcctgatttgctattcttgttggggcaattgttttctctaccactgtagtgattccccactacccgaatcagcccacgaccccggagttgtgggtacatag

SEQ ID NO: 216021 - DNA, 189 bp, Artificial Sequence
  Description of Artificial Sequence: Synthetic coding sequence
atgtactgtctgcaatggctattgcccgtgctgctcatcccgaagcccctgaatcccgctctctggttcagccacagcatgttcatggggttctatctgctgagcttccttttggagcgtaagccttgtacaatttgtgcattggtcttcctggccgctctgtttctgatttgctacagctgttggtag

SEQ ID NO: 216022 - DNA, 264 bp, Artificial Sequence
  Description of Artificial Sequence: Synthetic coding sequence
atgtattgtttacaatggcttctcccagtgttacttattcctaagccgctgaaccccgctctgtggttctcgcacagcatgttcatgggattttatctcttgtccttcctcttggagaggaagccctgcactatctgtgccttggttttcttggctgctctgttcctcatctgctactcttgttggggtaactgttttctgtatcactgcagcgacagccccttaccagagtctgcgcacgatcctggagtggtgggaacgtag

SEQ ID NO: 216023 - DNA, 264 bp, Artificial Sequence
  Description of Artificial Sequence: Synthetic coding sequence
atgtactgtttgcagtggcttttaccagtgcttttaatcccaaaacctctgaaccccgcactgtggttttcccacagtatgtttatgggattctacctcctgtcgttccttctggagagaaaaccctgtaccatctgcgcactggtgtttttagcggctctgttccttatctgttactcgtgctggggcaactgcttcctgtaccattgctcagattcccctctccccgagagtgcacacgacccgggtgttgtgggtacctag

SEQ ID NO: 216024 - DNA, 237 bp, Artificial Sequence
  Description of Artificial Sequence: Synthetic coding sequence
atgtactgtctgcagtggctgctgccagttttgctgatacctaagccactcaatcccgctttgtggtttagtcactctatgttcatgggattttacctactatcctttctgctggagcgaaagccctgcaccatttgcgctctcgtgtttctcgccgctctctttttgatctgctactcttgctgggggaattgctttttgtatcattgctctgactctcctcttcccgaaagctag

SEQ ID NO: 216025 - DNA, 24 bp, Artificial Sequence
  Description of Artificial Sequence: Synthetic coding sequence
atgtattgcctgcagtggctttag

SEQ ID NO: 216026 - DNA, 1368 bp, Artificial Sequence
  Description of Artificial Sequence: Synthetic coding sequence
atgagttctagcggcctcaatagcgaaaaagtggcggctttaatccagaagctcaactctgacccccagttcgtgctggcccagaacgtgggcaccactcatgatctgttagacatctgccttaagagagccaccgtccagcgggcacagcacgtgttccagcatgccgtgccacaagagggaaagcccataacaaaccaaaaaagcagtggtcggtgttggatattctcttgtttgaacgttatgagacttccgtttatgaaaaagttgaatattgaagaattcgagttcagtcagtcatacctcttcttctgggataaagtggaacgatgttatttttttttaagcgcgttcgttgataccgctcagagaaaagaacctgaagatgggaggcttgtgcagttcctgctgatgaacccggctaatgacggcggtcaatgggacatgttggtgaacatcgtggaaaaatacggggttattccgaaaaagtgttttccggagtcttatacgaccgaggccacgcgacgaatgaatgatatcctgaaccataagatgagagagttctgcatccggctgcggaatctcgtgcatagtggggctaccaagggggagatctctgccacacaggacgtaatgatggaagagatctttagggttgtctgcatctgcctgggcaacccacccgagacctttacgtgggagtatcgggacaaggacaagaattaccagaaaatagggccaattacgcctttggaattctacagagaacacgttaagcctctgtttaatatggaagataagatctgtctcgttaatgatccccgaccacagcataaatataataaactctacactgttgaatacctgtccaatatggtgggtggcagaaaaacactgtataataaccagccgatcgactttcttaaaaaaatggtggcagcttccatcaaggatggcgaggccgtgtggttcggatgtgacgtgggcaagcacttcaactctaagttgggcctttccgacatgaatttgtacgaccacgagctggtgtttggagtttcactgaagaacatgaataaggcagaaagacttacttttggagaatctctgatgacccacgcaatgacctttaccgctgtaagcgagaaagatgatcaggatggggctttcacaaagtggagagtagaaaattcctggggtgaggatcatggccacaaaggttatctctgcatgactgacgagtggttctctgagtacgtgtacgaagtcgtcgttgatcgcaagcacgtgcccgaggaggtgcttgctgtacttgagcaggagcctatcattttgcccgcttgggatcccatgggcgctctggcagagtag

SEQ ID NO: 216027 - DNA, 1107 bp, Artificial Sequence
  Description of Artificial Sequence: Synthetic coding sequence
atgtgtagctcaactccctgcccacgccgtgcttcccaaagtcccacccggagggcgcaggtagagcgctgttacttttttttatctgcgttcgttgacacagcacagaggaaggaaccggaagatgggagactggtacagttcctcctgatgaatcccgcaaatgacggtggacaatgggatatgctggtcaatatcgttgaaaaatacggggttattcctaagaagtgtttcccagagagttacacaactgaggcaactcgcaggatgaacgatattctgaaccacaaaatgagagagttttgtataaggttacgaaatctcgtacattcaggcgctaccaagggagagattagtgctactcaggatgtgatgatggaagagatcttccgagtcgtgtgcatctgcctcggcaacccccctgaaacttttacatgggagtatcgggacaaagacaaaaactaccagaaaataggacctatcacccccctggagttctaccgcgaacacgtgaagcctttgtttaacatggaggacaaaatttgtctggtgaacgaccccagaccgcagcataaatacaacaagttatataccgtggagtacctctcaaatatggtaggagggcgaaagacactgtacaataaccagcctattgactttttgaagaagatggttgccgcttctattaaggatggagaggccgtgtggtttggctgtgacgttgggaaacattttaacagcaaactgggtctgagtgatatgaacctatacgatcacgagcttgtgttcggcgtgtccttgaagaatatgaacaaagccgagcgcttaactttcggggaatccctcatgacccatgcaatgacttttacggctgtttcagagaaggacgaccaggatggggcttttaccaagtggcgagttgagaatagctggggagaagaccacgggcacaaaggctatctgtgcatgactgacgaatggttttccgagtacgtgtacgaagtagtcgtggaccggaagcacgtgcctgaggaggtacttgccgtgcttgagcaggagccgattatcctgcctgcatgggaccccatgggggcactcgcagaatag

SEQ ID NO: 216028 - DNA, 2241 bp, Artificial Sequence
  Description of Artificial Sequence: Synthetic coding sequence
atggccggaagccggggagccggtcggacagcggctccttctgtgcgcccagagaagaggagatccgagcctgagctggaacctgaacccgaacccgaaccaccgctgctatgcacttcacccttgagccacagtaccggaagcgacagtggggtgtctgattccgaagagtcagtgttctcagggcttgaggactcaggaagcgacagcagcgaggacgacgatgaaggagacgaagaaggtgaggacggagccctggatgacgaggggcactccgggattaagaagacaaccgaggagcaggtgcaagcatccactccttgccctcggacagagatggcaagcgctagaattggggatgaatacgcagaggatagctcagacgaggaggatatccgaaatacggtcggaaatgtcccactagaatggtatgatgatttccctcacgttggctatgatttggacgggaggcggatatataagcctctccgcacgcgtgatgagctggaccagtttctggacaaaatggatgatcctgactattggaggaccgttcaggaccctatgactgggcgagacttgcggctgactgatgagcaggtagctctggtcagacgcctccaatccggacagttcggagacgtgggcttcaatccatacgaacctgccgtggatttctttagcggtgatgtcatgattcacccagtcaccaacaggccagcagacaagaggagcttcatcccgagcctcgtagagaaggagaaggtttcacggatggtgcatgctatcaagatgggatggatccagccccgtcggcctagggatcccactccctccttctatgatctttgggcccaggaggaccccaacgcagtgctagggcgacataaaatgcacgtccctgctccgaaactggccttgcccggacacgctgagtcctacaacccaccaccggaatacctattgtcagaggaggagaggcttgcctgggagcagcaagagccgggagaacggaaactctcgttcttgcccagaaagtttcccagccttcgagccgttccagcttatggaagatttattcaggaacgcttcgagaggtgtttggacctgtacctgtgtcctcgtcagcgcaaaatgcgggttaatgtggatcccgaagatctaatccccaaactaccacgccctagagacctccaaccatttcctacctgccaggccttagtctatagagggcacagtgatctcgtacgttgtctctcggtctccccaggaggacagtggctggtttcgggcagcgatgacggctctctgcgcttatgggaggtcgccactgccagatgcgtgcgtaccgtccccgttggtggtgtggtcaagtcagtcgcctggaatccatcaccggctgtctgtctggtcgccgctgcagtggaggacagcgtgcttctcctgaaccctgcactgggcgacagactcgtggcaggctccaccgatcaacttctctccgcctttgtcccccctgaggaaccccctcttcaacctgctaggtggttagaggcttccgaggaagagcggcaggtcgggctgagactgcggatttgtcatggtaagcctgtaacccaagtgacttggcacgggagaggggattacttggctgtcgtgctggcaacccagggacatacgcaagtgctcattcatcagctcagcagacgaagatctcagagcccctttagacggtcacacgggcaggtgcagcgtgtcgcgtttcacccagcacgtccattccttctggttgccagtcagcggtctgttcgcttgtaccatctgcttagacaggaactgaccaagaaactgatgcccaactgtaagtgggttagtagcctagctgtgcatcccgcaggagacaatgttatctgcggaagctacgattccaaattagtatggtttgacctcgatctctccacaaagccctatcgaatgttgcggcaccacaaaaaggcactcagagctgtagccttccatcctaggtaccccttgtttgcaagcggctccgacgacggaagtgtcattgtttgccacgggatggtgtacaacgacctgctccagaacccgctgcttgtcccggtcaaggtgctaaaaggccatgtgttaacccgcgatctaggagtgctggatgtgattttccatcctacacaaccctgggtgttctctagcggggctgacggcacagtgaggctatttacttag

SEQ ID NO: 216029 - DNA, 1083 bp, Artificial Sequence
  Description of Artificial Sequence: Synthetic coding sequence
atgaattacacagaaagctcacctcttagggagtcaactgcaatcggttttacaccggagctggagtctatcattccagtgcccagcaataaaactacctgcgagaattggcgggagattcatcaccttgtgtttcacgtcgccaacatctgcttcgcagtcggattggtgattccaactaccctgcatctgcacatgatatttctgagaggaatgttaacactgggatgcaccctgtatatcgtgtgggcaacactgtatcgctgcgccctcgatataatgatctggaacagcgtattccttggtgtaaatatactccacttgagctatctgctgtacaaaaaacgacctgttaaaattgaaaaggagctgagcggcatgtaccggagactgttcgagcccttgcgggtccctccagatctcttccgccgattgactggccagttttgcatgatccagacattgaaaaaaggtcagacctacgccgctgaagacaaaacgagtgttgacgacagattgtccatattactcaagggcaagatgaaagtcagttaccgtggtcactttctgcataacatttatccgtgtgcctttatcgatagtccagagttcaggtctactcagatgcataagggcgagaagtttcaggttacaattatcgcagacgacaattgccggttcctttgttggtcacgcgaacgcttgacctatttcctcgagagcgagccgtttctatacgagatttttcgttacctgataggtaaggacattaccaacaaactctactctctgaacgatcccactctgaatgacaagaaagcgaaaaagctggaacatcaactgtccctgtgcactcagatcagtatgctggaaatgaggaattcaatcgcctcttcttctgatagcgacgatggcttgcaccagtttctgagaggaacctcctcaatgtccagtcttcacgtttcaagcccccaccagcgagcatccgccaagatgaaacctattgaggagggagccgaggacgacgacgacgtgttcgagcctgcaagtccgaataccctcaaggtgcatcagctgccatag

SEQ ID NO: 216030 - DNA, 1083 bp, Artificial Sequence
  Description of Artificial Sequence: Synthetic coding sequence
atgaattacaccgaatcatctccccttcgggaatcaaccgctatcggcttcactccagagcttgagtcgatcatccccgtgccctcaaataaaaccacgtgtgaaaattggagggagattcatcacctggtgttccacgtcgctaacatctgttttgcagttggactcgtgattcctacaaccctccacctgcacatgatctttttgcggggaatgctaaccttgggatgcacactgtacatcgtttgggctactctctaccgctgtgctttagacataatgatatggaacagtgttttcttaggcgtgaacatcctgcatctgagctacctgctttacaagaaacgcccagtgaaaatcgagaaggagctgtcagggatgtatcggcgattattcgaaccgttgagggtgcctccagacttattccggagactgaccggtcaattttgtatgattcagactttgaagaagggacaaacttatgccgcagaggacaaaacaagtgtggacgaccgattgtccatcctactgaaaggcaagatgaaagtatcttacagagggcattttctgcacaatatctacccgtgtgcatttatcgacagtcccgagtttagatcgactcaaatgcacaagggggagaaattccaggttactattatcgccgatgacaactgtcggttcctctgctggtcaagagagagacttacgtactttctggaaagcgaacctttcctgtatgaaattttccgctatctgattggtaaggatattacaaataagctatattccttgaacgaccccacactgaatgacaagaaggctaagaagctcgaacaccagctgagcctgtgtactcaaatctctatgctggaaatgagaaattcaatagcgagtagcagtgacagtgatgacggcttgcaccagtttctgagggggacttcttcaatgagctccctccatgtctctagcccacaccagcgagcaagtgcaaaaatgaagcccattgaggagggcgctgaagatgatgatgatgtgtttgaacccgcatcacccaacactctgaaagtccaccagctaccctag

SEQ ID NO: 216031 - DNA, 1083 bp, Artificial Sequence
  Description of Artificial Sequence: Synthetic coding sequence
atgaactataccgagagttcaccgttgagagagtccaccgccatcgggttcactccagagttggagtctataattccggttcctagcaacaaaactacttgcgaaaactggagagagatccatcacctggtgttccacgtggcgaatatctgtttcgctgtcggactggtcatccccaccacactccatctgcatatgatatttctcagagggatgctcactctgggctgtacactgtatattgtgtgggccaccctgtatcgatgtgctctggatatcatgatctggaacagcgtgttcttaggggtaaacattctgcacctcagctatttgctatacaagaaaagaccagtgaagattgaaaaagaactgagtggcatgtacagacgacttttcgagcctctccgggtgccccctgatctcttccgcagactgacaggccaattctgcatgatccagaccctcaagaagggccagacatacgccgcagaggataagacctctgtggatgatcgcctgtcaatcttgcttaaagggaagatgaaggtgtcctacaggggccatttcctacacaacatctatccatgcgcgtttatagatagccctgagttccgctccactcagatgcacaagggagagaaatttcaagtcaccatcatagccgacgataactgcagattcttgtgctggtcccgtgagcgcctcacatactttctcgaaagtgagccctttctatatgagatatttcggtacctgatcggcaaggacattaccaataagctgtattctcttaacgatccgactctgaacgacaaaaaggctaaaaagctcgagcaccagctatccctttgcacacagatcagcatgctggagatgagaaattcgatcgccagctcctcggacagcgatgatggcctgcatcaatttcttagaggcacctctagcatgtcatccctccacgtgagttcgccccaccagcgggctagtgccaagatgaagcccatcgaggagggggctgaggatgatgatgacgtctttgaaccagccagtccgaacacactcaaggtgcaccaactcccatag

SEQ ID NO: 216032 - DNA, 783 bp, Artificial Sequence
  Description of Artificial Sequence: Synthetic coding sequence
atggaccgccacagctcctacatcttcatctggctgcagttagaattgtgcgccatggcggtgttgctcaccaaaggcgaaatccgctgttactgcgacgccgctcactgcgtggccaccgggtacatgtgtaagtcggagctcagtgcctgcttcagcagacttctagaccctcaaaattcaaattcccctctaactcacggctgtctggacagcctcgctagcaccaccgatatatgccaggccaaacaggccaggaatcacagcgggaccacgattccaacactcgaatgctgccacgaggacatgtgtaactatcgcggtttgcacgatgtcctcagcccgccacggggagaggcaagtgggcagggaaaccgctatcagcatgatgggagccgcaatctgattaccaaggtgcaagagctcaccagcagcaaggaactctggtttcgggcagctgtgattgcagtccctatcgcaggaggcctgatccttgtcctcctgattatgctggctttacgtatgctacggagcgagaataaaaggctccaagaccaaagacaacagatgttgtcacgactgcattattcattccacgggcaccactcaaagaaaggacaggtcgcaaaactcgatttagagtgcatggtccccgtgtccggtcatgaaaattgctgtctgacctgcgacaagatgcggcaggcggacctctctaatgacaaaatcctcagcctcgtgcactggggaatgtatagtggccacggcaagctagaattcgtctag

SEQ ID NO: 216033 - DNA, 744 bp, Artificial Sequence
  Description of Artificial Sequence: Synthetic coding sequence
atggacagacactcttcttatattttcatctggctgcagttggaactgtgtgcgatggctgtcctgctaacgaagggagagattaggtgctactgtgacgccgcacactgtgtggccacaggctacatgtgtaagtccgagttgtccgcttgcttttcccgcctactcgatccccagaattcaaacagtcctcatatttgccaagccaagcaggcacgaaaccactccggaactactattcctacacttgagtgctgtcatgaggacatgtgtaattatagaggcctccatgatgtgctgtcccctccccgaggtgaagccagcggacaaggcaaccgttatcagcacgacggctcccgcaatcttatcacaaaggtccaggagctaacaagtagcaaggagctgtggtttcgggcagctgtgatcgcagtgcctattgccggtggtttgatcctggtactacttattatgcttgctctgcgaatgttacggagcgaaaataagagattacaggatcaacgacagcagatgctgagtagattacactatagttttcacggccatcattccaaaaaggggcaggtagcaaagctcgacctggaatgcatggtacccgtgagcgggcatgaaaattgttgcctgacttgcgacaaaatgagacaggcggatctctcgaacgacaaaatcttatcactagtgcattggggcatgtattctggccacgggaagcttgaatttgtgtag

SEQ ID NO: 216034 - DNA, 2058 bp, Artificial Sequence
  Description of Artificial Sequence: Synthetic coding sequence
atgctgtggttctcgggcgttggcgctctggctgaaaggtactgcaggcgttcaccgggaattacatgctgcgtgctgctgctgctgaattgcagtggggttcccatgagtctggcttcctcattcctgactggtagcgtcgctaaatgtgaaaatgagggcgaggtgctccaaatcccgtttatcaccgataacccatgtattatgtgtgtgtgcctaaacaaagaagtgacttgcaagcgggaaaaatgtcctgtgctgtcccgcgactgtgccctggcgatcaaacagcgcggagcctgctgtgaacagtgcaagggctgcacctatgaaggaaacacctacaactccagcttcaagtggcagtcaccagccgaaccttgcgttctgcgccaatgtcaggagggagtggtgaccgagtccggcgtgaggtgtgtggtccactgcaaaaaccccctcgaacaccttggcatgtgttgtcccacctgccctggctgtgtgttcgagggtgtccagtaccaggaaggcgaagaatttcaacctgaggggtcaaagtgcactaaatgcagctgtacaggaggcagaacacagtgcgtgcgggaggtctgccctatcctgagttgtccccagcatttatctcacataccaccaggccagtgctgcccaaagtgccttggtcaacgaaaggtgttcgacctgccatttgggtcgtgtctgtttagatctgatgtgtatgataatgggagctcctttctgtacgacaactgtaccgcctgcacatgtagagatagcaccgtggtgtgcaaacgaaagtgttcccatcccggtggctgcgaccagggacaggaggggtgttgtgaagagtgcctgcttcgagttccccctgaggatataaaagtttgcaaattcgggaacaagatctttcaggacggtgagatgtggagcagcatcaactgcactatctgtgcatgtgtgaaaggacggacagagtgtcggaacaaacagtgcattcctatcagctcatgtccgcaggggaagatcctcaacaggaagggatgttgtcctatctgcaccgagaaacccggtgtgtgcaccgtctttggcgacccccactacaataccttcgacggccgaacctttaactttcagggcacttgccagtacgtgctgaccaaggactgttcatctcctgcttctccattccaagttctggtgaagaacgacgcccgacgcacgcgtagcttctcatggactaaatcagtggagctcgttttgggggaatccagagtttcactgcagcagcacctcaccgttcgttggaacggatcccgaattgctttaccctgcagagcccctcatttccacatcgatctcgacggatacttgctgaaagtgaccactaaagctggtctggagatcagttgggatggcgacagctttgtggaggtcatggccgcaccccatttaaaaggcaagctctgtgggctgtgtggtaattataatgggcataaaagggacgatctcatcgggggagacggcaactttaaattcgacgtcgacgattttgccgagtcctggagagtcgaaagtaatgaattttgcaacagaccgcaacggaagcccgtgcctgagctgtgtcagggaacggtgaaggtgaaattgcgcgcacatcgtgagtgccaaaagctaaagagctgggagttccagacctgccacagcacggtggattatgccaccttctaccgatcatgtgtcactgacatgtgcgagtgcccagtgcacaaaaattgctactgtgagagtttcctcgcgtatacccgcgcttgtcagagggagggtataaaggtgcattgggagccgcagcagaactgcgccgctacccagtgcaagcacggcgctgtctatgacacctgcggacccggatgcattaagacctgcgacaattggaacgagattggaccatgtaacaagccctgtgtcgcgggatgtcactgccccgcaaacctggttctgcataagggcaggtgtatcaaacctgtgctctgccctcagaggtag

SEQ ID NO: 216035 - DNA, 2058 bp, Artificial Sequence
  Description of Artificial Sequence: Synthetic coding sequence
atgctgtggttctctggagtgggggctctagccgaaagatactgcaggcgatcacccggaatcacctgctgtgtcctgttactgctgaactgctctggcgtgccgatgagcctggctagctcatttctcacggggagcgtcgctaagtgtgagaacgaaggggaggttctgcagatcccctttattaccgataacccctgcattatgtgcgtctgcctaaacaaagaagtcacctgcaaaagagagaaatgccccgtgctgagccgagattgcgcactggctatcaagcagagaggcgcatgttgcgaacagtgtaaaggatgtacttacgaagggaatacctataactctagttttaagtggcagtcgcccgctgaaccctgtgtgctgcggcagtgtcaggagggtgttgttactgagagtggagtgagatgcgtggtgcattgtaaaaacccgctcgaacatctgggtatgtgctgccctacctgtcccggatgtgtgtttgaaggtgtgcagtatcaggaaggggaggagtttcagccagagggctctaaatgcactaaatgcagttgtacaggaggcagaacacagtgtgtccgggaggtctgtcccatcctgagctgcccccagcatctcagccacatcccccctgggcagtgctgccctaaatgcctcggccagcgtaaagtcttcgacttaccttttggttcttgtctcttcaggagtgatgtgtatgacaacggatccagctttctgtatgacaactgcaccgcttgtacttgccgagactccacagtggtatgtaagaggaaatgttcccacccaggcggatgcgaccagggccaggaaggatgttgtgaggagtgtttgctacgcgttccacctgaagacattaaggtgtgcaagtttggaaataaaatctttcaggatggggagatgtggagctccattaattgcaccatatgcgcgtgtgttaaaggaaggaccgagtgccggaataagcagtgtattcctatttcatcatgcccccagggcaagatcctgaacagaaaagggtgctgtccaatatgcaccgagaagcctggggtgtgcacagtgtttggcgacccccattataatacttttgatggacgcactttcaactttcaaggtacttgtcagtacgtcctgactaaagattgttctagtcccgcttcgcccttccaggtactggtcaaaaacgatgcccgtcggaccagaagcttttcgtggaccaaaagtgttgagctcgtgctgggcgagagcagggtgtcccttcagcagcatctgactgtgaggtggaatggctccagaatagccctgccatgccgggcacctcactttcacatcgacttggacggatacctgttaaaggtgacaacaaaggcgggtcttgaaattagttgggatggtgactccttcgtcgaagtcatggctgcaccacacctaaagggcaaactctgtggtttgtgcgggaactataatggtcataaacgagacgatcttattgggggagatggtaattttaagttcgacgtcgacgacttcgctgagtcctggcgtgtggagtccaatgaattctgcaacaggcctcagcgcaagccagtccccgagctttgccagggaacagtgaaggttaaactgagagctcatagggaatgtcagaagttgaaatcatgggagttccaaacttgccactctaccgtggattacgcgacattttatcggtcatgcgtcacagacatgtgtgagtgtcccgtgcataagaactgttactgcgagtcattcttggcatacacccgggcttgccagcgcgaaggcatcaaggtgcactgggagccccagcagaactgtgccgctacgcagtgcaaacacggggctgtttatgacacatgcggtccaggatgtattaaaacctgtgacaattggaacgaaatcgggccatgtaataagccgtgcgtcgctggatgtcattgccctgccaatttggttctccataaggggaggtgtatcaagcccgtgctgtgcccacagagatag

SEQ ID NO: 216036 - DNA, 2028 bp, Artificial Sequence
  Description of Artificial Sequence: Synthetic coding sequence
atggatacaaaaagcattctggaagagctgctgcttaagaggtcacagcagaaaaagaaaatgtcccctaataattacaaggaaaggctgtttgtgctgaccaagaccaatctttcttattatgaatacgataaaatgaagaggggatcccgaaaaggttccattgagataaaaaaaattcgctgcgtggagaaagttaatctggaagaacagacgccagtggaacggcagtatcccttccagattgtttacaaggatggtctgctgtacgtgtacgctagtaatgaagagtccaggagccagtggctgaaagccctgcaaaaagaaatccgaggtaaccctcaccttttagttaagtatcacagcggatttttcgtggacggcaagttcctctgttgtcaacagagttgtaaggctgcacctggttgtactctttgggaggcttatgccaatcttcacacagccgtgaatgaggaaaaacatagagtacctacctttccagatcgcgtgcttaagatcccaagggccgtgccagtgttgaaaatggacgccccttccagctccaccactctggcccagtacgacaacgagtctaagaaaaattacggttctcagccaccctcatcatcgacatctttggcccagtatgattctaatagtaaaaaaatttatgggagccagccaaacttcaatatgcagtatatccctagagaagactttcccgactggtggcaggtccggaagttgaagtcatccagttcgagcgaagacgtggcatcctcgaatcagaaggagcggaacgtcaatcacacgaccagcaagatttcttgggaatttcctgaatcctcatctagtgaggaggaggaaaatctggatgactacgattggtttgcaggtaatatcagtcggtcccaatccgagcagctgcttcgacagaaggggaaagaaggtgctttcatggtacggaatagttcccaggtgggaatgtacactgtgtcgctcttcagtaaagctgtgaatgacaaaaagggcacggtcaagcactaccacgtccacaccaatgccgagaacaagctttaccttgctgagaattactgctttgattctattcctaagttgatccattaccatcagcacaactctgcgggaatgatcacccgactgagacatcctgtcagtacaaaggctaataaagtgcctgattctgtttcactaggcaacggaatctgggagctaaaacgagaagaaatcaccctcctaaaagagctcggcagtgggcagtttggcgtcgtacagctggggaaatggaagggacagtacgacgtggctgtcaaaatgataaaggagggctccatgagcgaggatgagtttttccaggaggctcagaccatgatgaagctgagccaccctaaactcgtcaagttttatggcgtgtgctctaaggaatatccgatttacatcgtgaccgagtacatttcaaacgggtgtctgcttaattacttgaggagccacgggaaaggtctggagccttcccagctcctggaaatgtgttacgacgtgtgtgagggcatggcgttcctcgagagccaccagtttattcacagggaccttgctgctcggaactgcctcgtcgatagggatctctgcgtgaaagtgagcgatttcggcatgactcgatacgtgctcgacgaccagtacgtttcgtcagtagggactaagttccctgtcaagtggtccgctccagaggtcttccactactttaaatactccagcaagtccgatgtatgggctttcgggattttgatgtgggaggtcttcagcttgggcaagcagccctatgacctgtacgacaattcccaggtggtgctcaaagtgtcacaaggccacagactttaccgcccacacctcgcttccgacacgatctaccagatcatgtactcatgctggcatgagctgccggaaaagcggcctactttccagcagctcctctcctctatcgagcccctgcgcgagaaagacaagcactag

SEQ ID NO: 216037 - DNA, 2028 bp, Artificial Sequence
  Description of Artificial Sequence: Synthetic coding sequence
atggacacgaagtcaatcttggaggaacttctactgaagaggtctcagcagaagaagaagatgtctcccaataactacaaagaacgcctgtttgtcctcactaaaaccaacctgtcctactacgagtacgacaaaatgaaacggggaagccggaaaggcagcatcgagatcaaaaaaatccggtgtgtggagaaagttaatctcgaggagcagactcctgtggagagacagtacccctttcagattgtgtacaaggacggactgctctacgtgtatgcaagtaatgaggagtccagatctcaatggctgaaagctctgcagaaggagataagaggaaatccacacttactggtaaaataccattccgggtttttcgtggacggaaaatttctgtgttgtcagcagtcttgcaaagccgcacccggatgcacactgtgggaggcgtatgccaatttgcatacagcggtgaacgaagaaaaacacagagtgcctaccttcccagacagagtattaaaaatccccagagccgttccagtccttaaaatggatgccccttcttcatccactactctggctcagtatgataatgaaagtaagaagaattacgggagccagccgccttcaagctccacttctctggcgcagtacgactctaactcgaagaagatctacggcagccagcccaattttaacatgcaatacataccaagagaggacttccccgattggtggcaggttaggaagctgaagtccagcagcagttccgaagacgtggcatcttccaaccagaaggagaggaacgtgaatcatacaaccagtaaaatttcgtgggagttccctgagtcctccagctccgaggaggaagaaaacctggacgattatgactggtttgcgggaaatataagccgctcacagtctgaacaattgctgcgtcagaaaggaaaagaaggagcctttatggtcagaaactcttcccaagtgggaatgtatacagtatccctgttttccaaagcagtgaacgacaaaaaaggtactgtgaagcactatcatgtgcataccaacgcggagaacaaattatatctcgctgagaattattgctttgacagtatacccaagctcattcattaccaccagcacaattccgccggtatgatcactcgactgagacacccagtttctacaaaggctaacaaggtccccgattctgtgagtctcggaaatggcatttgggagcttaagcgcgaagaaattacactgctgaaagagctggggtctggacagttcggtgtggtgcagctgggcaagtggaaaggacagtacgacgtcgctgttaaaatgattaaggagggttccatgtcagaggacgaattcttccaagaagcgcaaaccatgatgaaactaagtcaccctaaattggtcaaattttatggagtctgtagtaaagagtaccccatttacattgtgaccgagtatataagtaatggatgcctcctgaactatctgagaagtcacggcaaggggctcgaaccatctcagctgttggaaatgtgctacgacgtttgcgaagggatggcgttccttgaaagtcatcagtttattcatcgcgacctggccgctcggaactgtctcgttgaccgcgatctctgtgttaaagtatctgattttgggatgaccaggtacgttctggatgaccagtacgtatcctctgtgggaacaaagtttcccgtcaaatggtctgcccctgaagtgtttcattattttaaatactcatcaaaaagcgatgtgtgggctttcgggatacttatgtgggaagtattttcccttggcaagcagccgtatgatctgtatgacaattcacaggtggtcttgaaagtctctcaggggcataggctgtatagaccccatctcgcgtctgataccatctaccaaattatgtacagctgctggcatgagctgcccgaaaagagaccgactttccagcaactccttagcagcatagagcccctgagagaaaaagataaacactag

SEQ ID NO: 216038 - DNA, 2028 bp, Artificial Sequence
  Description of Artificial Sequence: Synthetic coding sequence
atggacaccaaatctatcctggaagaattgcttcttaaaagatcccagcagaaaaagaagatgagtccaaataactacaaagagagattgttcgtgctcaccaagaccaatttaagttattatgaatacgacaagatgaagcgcggatccaggaaagggtctatcgagatcaaaaagatcaggtgcgtggaaaaagtcaatctggaagaacaaacgcctgtcgagaggcaatatcctttccagatcgtctacaaggacggccttctttacgtctacgctagcaatgaagagtcccggtctcagtggctgaaggctttgcagaaagagatcagagggaacccacatctcctcgtaaagtatcattccggatttttcgtggacggcaagtttctttgttgtcagcagagttgcaaggccgctccgggttgcaccctatgggaggcctacgccaacctccacacagctgtcaatgaggaaaagcatagagtcccgacctttccagaccgcgtgcttaagattcccagagcggtacctgttctgaaaatggatgcaccatcatccagcaccactcttgcccagtacgacaacgagtcgaagaaaaattatggatctcagcctccatcctcctccaccagcctggcacagtacgattcaaacagcaaaaagatctacggaagtcaacccaactttaacatgcagtacatcccaagggaggacttccctgattggtggcaagtgcgcaagctgaagtcatctagttcttcggaggatgtcgcctcaagcaaccaaaaggaaagaaatgtcaatcatacaacctctaaaatcagctgggaattcccagagagcagcagcagtgaggaggaggaaaatctcgatgattacgactggttcgccggaaatattagccgctcacagtctgaacagctgctgaggcaaaaaggaaaggagggcgcatttatggtgcggaatagctcccaggtggggatgtacacagtgtccttgtttagtaaggctgtcaatgacaagaagggcactgttaaacactatcacgtccatacaaatgccgagaacaaattgtatctggcagaaaattactgttttgattccatccctaagctcatacattaccaccagcataacagcgctggcatgattactaggctgcgccatccggtgtcaaccaaggctaataaagtgcctgactctgtttctttgggaaacggaatatgggaacttaagcgcgaggagatcacattgctaaaagagctggggtctggacagtttggcgtcgttcagttgggcaagtggaagggccaatatgatgtggctgttaaaatgataaaagagggtagtatgagcgaagatgagttctttcaggaagcccagactatgatgaaactgtctcatcccaagcttgtgaaattctacggagtgtgctcgaaagagtatccaatatacattgttacagaatatatcagcaacgggtgcctgctgaactacctaagatctcatggaaaagggttagagccttcccagcttctcgaaatgtgttatgacgtgtgcgagggtatggcttttctggaatcccaccagtttattcacagagacctggcagccagaaactgcttggtagacagggacctatgcgtcaaagtgagtgattttgggatgaccagatatgtgttggacgaccaatacgtgagtagcgtaggtactaagtttcccgtgaaatggtccgcccctgaggtattccactatttcaagtattcttctaaaagtgatgtttgggctttcggcattttaatgtgggaggtgttcagcctgggaaaacagccttatgacctctatgataattcccaagtggtgctcaaggtgtctcagggccacaggctgtaccggcctcatcttgcctccgacaccatataccagattatgtattcttgttggcacgagctaccagagaaacgtcctacgttccagcagctgctgtccagtattgaaccccttcgagaaaaagataagcactag

SEQ ID NO: 216039 - DNA, 525 bp, Artificial Sequence
  Description of Artificial Sequence: Synthetic coding sequence
atgaccgaacttgagtaccctaagggcagttcaattatgcctgccgctggcaccatgtatttgactacatcaactgggtacccatatacatatcataatggggtggcgtacttccacacgcctgaagttacatccgttccaccgccatggccaagccgctccgtgtgtagttcaccagtaatggtcgcacagcctatttatcagcagcccgcttatcactatcaggccactactcagtacttgcccggacagtggcagtggtccgtgccacaaccaagcgcatcatctgctccgtttctctatctccagcccagcgaagtaatctaccagccagttgagattgcacaggatggcggatgcgtcccccctcctctctcattaatggaaacttcagtgcccgaaccctatagtgatcacggagtccaagcaacttatcaccaggtttacgcgccatcagccatcaccatgcctgcccctgtgatgcagcctgaaccaatcaagactgtgtggtccatacattactag

SEQ ID NO: 216040 - DNA, 888 bp, Artificial Sequence
  Description of Artificial Sequence: Synthetic coding sequence
atggaaacagagagcggtccccaaacttcaaaccagatgcagacagatagcctgtctccctcgcccaatcctgtaagccccgtcccactgaacaatcctacatctgccccacggtacggaaccgtgatcccaaatagaatatttgtgggaggtatagacttcaagaccaacgaaagcgacctcagaaaattcttcagccaatacgggtcggtcaaggaagtcaaaatagttaacgaccgggctggcgtctctaagggctatggatttgtgaccttcgaaacccaggaggacgcgcagaaaatcctccaagaggccgagaaattgaactataaagacaagaagttaaacattggaccggcaattcgaaagcagcaagtagggatccctcgaagtagcatcatgcccgctgccggtactatgtacctgactactagcaccggatacccatatacgtaccataacggagtcgcctattttcacacaccggaagtaacatccgttcctccgccatggccctcccgaagcgtgtgctcctcacctgtaatggttgcccagccaatctatcagcagcctgcctaccactatcaggctacaacacagtacctcccgggacagtggcagtggtccgttccccagccatctgcatcatcagctccattcctgtacctgcagccctctgaagttatctaccagcccgtggagatcgcacaggatggagggtgcgtccccccacctttatctttaatggagacatctgtgccagagccttatagtgatcacggggtgcaggcaacttaccatcaggtgtatgctccctccgcaattacaatgccagcacctgttatgcagccggagccaattaagaccgtgtggagcatccactattag

SEQ ID NO: 216041 - DNA, 852 bp, Artificial Sequence
  Description of Artificial Sequence: Synthetic coding sequence
atgcagaccgattccctgtctcccagcccaaatcctgtttctcccgtgccactgaacaatccaacctctgccccacgatacggcacagttatcccgaatcgcatatttgtggggggtatcgactttaaaacaaacgagtcggacttgagaaaattcttttcccagtacggtagcgttaaggaggttaaaattgtcaacgatagagctggagtgagtaagggttatgggtttgtgactttcgagacgcaggaggacgcccagaaaatcctgcaggaggcagaaaaactaaattataaggacaaaaagctgaacatcggaccagcaattagaaaacagcaggtgggcattccccgaagctcgataatgcccgcagcagggacaatgtacctcactacgagcacaggttacccctacacttatcataatggcgtggcgtacttccatactcctgaggtgacctcagttccaccaccctggccatcacgatcagtatgcagctccccagtaatggttgcgcagcccatttaccaacagcccgcttatcattatcaggcaaccacgcagtacctgcctggccagtggcagtggtcagttccccaaccatccgcgtcaagcgctccattcctttatctccagccctctgaggtgatatatcagcctgtggaaatcgctcaggacggcggttgcgtgcctcctccgctgtctcttatggagacttcagtgccagagccctattcagatcatggcgtccaagccacgtatcaccaggtgtacgcaccttcagcaatcacaatgcccgcacccgtgatgcagcctgagcccattaaaaccgtgtggagcatacattactag

SEQ ID NO: 216042 - DNA, 852 bp, Artificial Sequence
  Description of Artificial Sequence: Synthetic coding sequence
atgcagaccgactccttgtctccttctccgaaccccgtgagccctgtgcctctgaataaccccacatctgccccaaggtacggcactgtgattcctaacaggatttttgtggggggtatagattttaagaccaacgagagcgatctgcgaaagtttttttctcagtacggcagcgtgaaggaggtcaagatagttaatgatcgcgctggagtgagtaaaggctacgggttcgtgacctttgagacgcaggaggatgcacaaaaaattcttcaggaagctgagaaacttaattacaaagacaagaaattgaatatagggccagctatacgcaagcagcaagtggggatccccaggagtagtatcatgcccgcagcaggtactatgtacctgaccacgtcaacaggttacccgtatacctaccacaacggcgtagcttattttcatacacctgaggtgaccagtgtccccccaccgtggcccagcagaagtgtgtgctcctctccggtgatggtggcccagccaatctaccagcagcctgcctaccactaccaagccacaacccagtacctgcccggtcagtggcaatggtcagtgccccaaccttccgcatcaagtgcaccctttctatacctgcagccttctgaggttatctaccaaccagtcgagatcgcacaggacggaggttgcgtccccccaccgctgtcgctgatggagacctcagtgccagaaccgtactcagaccatggagtgcaggccacgtaccatcaggtctatgctcccagtgcgattactatgcccgctccagtcatgcaaccagaaccgatcaaaacagtgtggagcatccattattag

SEQ ID NO: 216043 - DNA, 414 bp, Artificial Sequence
  Description of Artificial Sequence: Synthetic coding sequence
atgttaagcggtcgactagtattgggactggtgagtatggccggacgagtgtgcctctgccagggtagcgccggtagcggtgccatcgggccagttgaagccgcaattcgaactaagttagaagaggccctgagtcctgaagtgctggaactgcggaatgaatcgggcggtcacgctgtcccccctgggtctgaaacgcactttcgcgtagctgtggtaagctctagatttgaggggctgtctcctctccagcgccataggctggtgcatgccgctctcgctgaggaactgggaggccctgtccatgccctggctatccaggccagaacccccgctcagtggagagaaaatagccaactggacactagcccgccttgtctgggcggtaacaagaaaacccttggaacaccgtag

SEQ ID NO: 216044 - DNA, 414 bp, Artificial Sequence
  Description of Artificial Sequence: Synthetic coding sequence
atgctctcaggaagactagtgctgggcctggtgtctatggcaggtcgggtttgcttgtgtcagggcagtgcagggagcggagctattggccctgtcgaggccgctatcagaaccaaactcgaggaggccctctcccctgaagtcctcgaactcagaaacgagagtggaggtcacgctgttcccccaggaagcgaaacccactttagagttgccgtggtaagttcacgatttgagggcctgagtcccctgcagcgccatcggctggtgcatgcggcactcgccgaagagctgggcggaccagtacacgcgctcgccatccaggccaggaccccagcccagtggagagagaattcccagttggacacatctcccccttgcctgggaggaaacaagaagaccttgggcacaccttag

SEQ ID NO: 216045 - DNA, 414 bp, Artificial Sequence
  Description of Artificial Sequence: Synthetic coding sequence
atgctgagcggcaggttggttctcggtctcgtgtccatggctgggcgtgtgtgcctctgtcaggggtccgccggatcaggagctattggccctgtggaggccgctatacggaccaagctagaggaggctttgtctcctgaagtgttagagctgcgaaacgaaagcggtggccatgccgttcctccgggttcggagacacatttccgggtcgctgttgtgtcgtcgagatttgaaggcctttccccactccagagacatcggctcgtgcatgcagcgctcgccgaagaactgggagggcctgtccacgcacttgcgattcaggctcgcacacctgctcagtggcgggagaattctcaacttgatacctcgcccccttgtctggggggaaataaaaagacgctgggcactccctag

SEQ ID NO: 216046 - DNA, 459 bp, Artificial Sequence
  Description of Artificial Sequence: Synthetic coding sequence
atggcttccgccaagtcgctcgataggtggaaggcaaggctgctcgaaggtggttccactgccctgacctacgccctggtgcgggcagaagtctccttccctgccgaggtcgctcctgtcagacagcaggggtccgtggctggggctagggctggtgtggtctcactgctcgggtgtaggagctcatggactgccgcaatggaactctctgcagagtaccttcgagaaaaactgcagcgggacttggaagccgaacatgttgaggtggaggacacaaccctgaaccgttgctcttgttccttccgcgtgctggtcgttagtgcaaaattcgagggcaagccacttctgcagaggcatcgcctggtcaatgcctgtctggccgaggagttgccgcacattcacgcttttgagcagaagacactcacacccgaccaatgggctcgcgagcgtcagaaatag

SEQ ID NO: 216047 - DNA, 306 bp, Artificial Sequence
  Description of Artificial Sequence: Synthetic coding sequence
atggcagcctggtcccccgctgccgctgcaccactgctaagaggtatcaggggactcccacttcatcatcgcatgtttgcaacacagactgaaggcgagttgcgggtgacacagatccttaaggagaaattcccacgtgctactgcgattaaggtaaccgacatctcgggcaccaagcgcaggaaccagcgcgacgcgtggattgccgatatatacctgtgccctcagaccctgacaactccatggctccataggtgctgttgtttaagaccttggatgaacttcaccgacattatcttaccctag

SEQ ID NO: 216048 - DNA, 324 bp, Artificial Sequence
  Description of Artificial Sequence: Synthetic coding sequence
atggcggcatggagtcctgcagccgctgcaccactcctgagagggatccggggtctgccgttgcatcaccgcatgttcgcgacccaaacagagggcgaacttagagtgacccagattttgaaagaaaaattcccacgggctacggctataaaggttactgatattagcggtggatgtggcgctatgtacgagatcaaaatcgagtccgaggagttcaaagagaaaagaacggtccaacaacaccagatggtgaatcaagcactcaaggaggagatcaaggagatgcatggccttcgcatatttacttctgtcccaaagagatag

SEQ ID NO: 216049 - DNA, 1200 bp, Artificial Sequence
  Description of Artificial Sequence: Synthetic coding sequence
atggctcagagacagcctcatagcccaaaccaaaccctgatcagcataaccaacgacaccgaatccagctcttcagttgtcagtaatgacaatactaacaaggggtggagcggagacaatagtcctggtattgaagccttatgcgctatctacatcacatatgctgtgatcatctctgtgggaatcctgggaaacgccatcctgatcaaagtcttcttcaagactaagtctatgcagactgtgcccaatatttttatcaccagcctggccttcggggacctactgctgttgctgacttgtgtgcctgtggacgctactcactatttggccgaggggtggctgttcggtaggattggatgcaaggtactgtcctttattagattgaccagtgtgggcgtctccgtgttcaccctgaccatcttgtcggccgacagatataaggctgtggtgaaaccactcgaacggcagccatctaacgctatccttaaaacttgtgttaaggcgggatgtgtttggatagtttcaatgatatttgcccttccagaggccatattcagcaacgtgtacacatttagggaccccaacaaaaacatgaccttcgagagctgcacatcataccccgtgagtaagaagcttctccaggagatccacagcctgctgtgcttcctggtgttctatatcatcccgctgtcaatcattagcgtgtactacagtctgatagcaagaacactgtacaagtcaacactaaacatacccacagaggaacaaagccacgcccgaaagcagattgagtcaaggaaaagaatcgctcggactgtattagttctagtggccctgttcgccttatgctggcttccaaatcacctgctttatctgtaccacagctttacaagtcaaacatatgtagatcccagtgcaatgcacttcattttcacaatattctctagggtcttagcattttctaattcctgcgtaaatccttttgctctgtactggctgtccaagtcctttcagaagcactttaaggctcagctgttctgctgcaaagcagagcggcctgaaccacccgttgccgatacttctctcacaaccttagctgtgatgggaacagttcctggaaccggctccattcaaatgagcgagatttccgtcacctcttttactggctgtagtgtcaaacaggccgaggaccgtttctag

SEQ ID NO: 216050 - DNA, 303 bp, Artificial Sequence
  Description of Artificial Sequence: Synthetic coding sequence
atgcgggctctcactcttcttgccctgctagctctggctgccctctgcatcgccggtcaggcaggcgcaaaacccagtggagccgagtcttcaaaaggagccgcttttgttagcaaacaggagggcagtgaggttgtcaaacgccctcgacgttatctataccagtggttgggcgctcccgtgccttatcccgaccccttagaaccccgtcgtgaggtttgtgagctgaatcctgattgtgacgagttagcagaccatattggtttccaagaagcttatagaaggttttacggcccagtatag

SEQ ID NO: 216051 - DNA, 957 bp, Artificial Sequence
  Description of Artificial Sequence: Synthetic coding sequence
atggcagcccaagggtgtgctgcaagtagactacttcagctgctgctccagttgctgctgctgctgttgttactggcggctggtggcgcacgggctcggtggcggggtgagggtacgtccgctcacctacgagatatcttcttgggtagatgtgccgaatatcgcgctttactaagtcccgaacaaaggaacaaaaactgtactgcaatctgggaggctttcaaggtagcactggacaaagacccatgcagcgtactcccttctgactatgacttatttattaacctgtcacggcactccatacccagagacaagagcctgttttgggaaaatagccatctgctggtaaatagctttgccgataacacccggaggttcatgcccttgtccgacgttctgtacgggagagtcgctgacttcttatcttggtgtcgccagaagaacgactctggcctggactaccagtcatgtcctaccagcgaagattgcgaaaataacccggtggatagcttttggaaaagagcttccatacagtactctaaggacagtagtggcgtgatccacgttatgctgaatggatcagaacccaccggcgcttatcccattaagggatttttcgccgattatgaaattcccaatttgcaaaaagagaagatcactcggatcgagatctgggtgatgcacgagatcggcggaccaaatgtggaaagctgcggggaaggatctatgaaggttctggaaaaaagacttaaggatatgggctttcaatacagttgtatcaacgattatcggccagtgaaactgctgcagtgtgtagaccatagtacccatcccgattgcgctctaaagtccgcggcagccgctacccaaagaaaggcaccttctttatatacggagcagcgcgcaggcctcattatccctctgttcttggtgctggcttcaagaactcagctgtag

SEQ ID NO: 216052 - DNA, 543 bp, Artificial Sequence
  Description of Artificial Sequence: Synthetic coding sequence
atggcctcgacgtcctatgattactgtcgggtgcccatggaagatggagacaagaggtgcaagttgttgctggggatcgggattctcgtgctactaatcattgttatcctgggcgtgcccctgatcatatttacgataaaagctaactctgaggcatgtcgagacgggctgagagccgttatggaatgcaggaatgttacacacctgctgcagcaggaactgacagaggctcagaagggattccaggatgtcgaggcccaggctgctacctgcaaccacactgtgatggctttgatggcctcactggatgccgaaaaagcacaggggcaaaagaaagtggaggagctcgaaggcgaaattactactctgaatcacaaactccaggacgctagtgcagaggtggaaaggctgagacgcgagaaccaggtattgtctgtgagaatagctgacaagaagtattatccttcttctcaagattcatcttcggcagctgcaccccaacttctgattgtgctgcttggattatcggcactacttcagtag

SEQ ID NO: 216053 - DNA, 651 bp, Artificial Sequence
  Description of Artificial Sequence: Synthetic coding sequence
atggcttcaacgtcatacgattactgccgagtcccaatggaggatggcgacaagagatgcaagctgctgctgggaataggtattctggttcttttaattatcgtgatcctgggggttcccctaatcatattcacgattaaggctaatagcgaggcgtgccgggacggcctgagagcagttatggagtgtaggaatgtaacccatctcttgcaacaagagctgactgaagcccagaagggatttcaagatgtagaagctcaggcagccacctgtaaccacacagtgatggcgttgatggcctccctggatgctgagaaagcccagggccaaaaaaaagtcgaagagctggagggcgagatcactactttaaaccacaagttgcaggatgcttcggctgaagtggagaggctgcgacgagagaatcaggttctgtcagtgcgcatcgccgataaaaaatattacccttcctcacacttcccttcaacaccccagtcaagactgcaaactcagctcacgaccctgaaaatagaaatggacgaagccaaggctcagggcactcagatgggggctgagaacggagcacttactggagcgctcgggtgtaagggagtaggtagagatagaagcggtagaagtttgggggagtcatag

SEQ ID NO: 216054 - DNA, 1179 bp, Artificial Sequence
  Description of Artificial Sequence: Synthetic coding sequence
atggtgctcctttctattttgcggatcctctttctttgcgagctggtgctgtttatggagcaccgcgcacagatggctgagggtgggcagtcctcgattgcactgttagcggaagcccctaccctgccactgattgaggaactgttagaagaatcaccaggcgaacagcccagaaaacctcggctattgggccacagtttgcgatatatgctggagctttaccggcgaagtgctgactcacatgggcaccctcgcgagaatcgtacaatcggggcaacaatggtgagattggtaaagcctctaaccaacgtagcacgccctcaccgcggaacttggcatatccagattctaggattcccactcagacccaaccgcggactttaccagctagttcgggcaaccgtggtgtatcggcaccacctgcagttaacgcgatttaatttatcttgccatgttgagccttgggtacaaaagaatccaaccaatcactttccttcctctgagggggattcatccaaacctagcttgatgagtaatgcttggaaggagatggatattacccagctagtgcagcagcgcttctggaacaataaaggtcatagaatcctgcggctgagattcatgtgccaacagcaaaaagactctgggggtttagagttatggcacgggaccagcagcttggatatcgctttccttctgttatattttaatgacacccacaaaagtattcggaaagctaaattcctacccagaggtatggaagagtttatggaaagagaatccctgctcagaagaactcgccaggcagatgggattagcgccgaagtaacagctagtagctctaaacatagcggacccgagaacaatcaatgctccctgcacccttttcagatttccttcaggcaactgggttgggatcactggatcattgccccacccttttacacccccaactactgcaaggggacgtgcctgcgggtgctacgcgatgggctgaattccccaaaccacgctattatacagaacttaattaaccaactggtggaccagtctgtacctcgcccttcctgcgtgccctataagtatgttccaatatctgtgctgatgatagaagccaacggctccatattgtataaggagtatgaaggcatgattgccgaatcatgtacgtgccggtag

SEQ ID NO: 216055 - DNA, 1419 bp, Artificial Sequence
  Description of Artificial Sequence: Synthetic coding sequence
atggccggtgcgagccggttgctttttctgtggttgggctgtttctgcgtctcccttgctcagggggaacgccctaagccgccattcccagaactaaggaaggccgtgcccggtgaccgtacagctggcggagggcctgacagtgagctgcagccccaggacaaagtttccgagcatatgctgaggctctatgatagatattctactgtacaggctgcccgtacgccagggagtcttgaaggtgggtcccagccttggagaccaaggctcctccgagagggtaacactgtaagatccttccgggcagccgcagccgagaccctagaaagaaaaggcctctatatctttaacctgaccagtctgacaaagtcggagaacattctttcggcaacactgtacttttgtatcggcgagctgggcaatatctctctgagttgccccgtcagcgggggatgtagccaccacgcgcagcgtaaacacatccaaatagatctgagcgcatggacacttaaattctctcgcaaccagagccagcttcttggtcacctttccgtggacatggccaaatcgcacagagatatcatgtcctggctgagcaaagatataacgcagctgttaagaaaggccaaagagaatgaggagtttctgatcggttttaacatcacctccaagggtaggcagcttcctaagcgccgtcttcctttcccagagccatacattttggtctatgcaaacgatgccgcaatctcagagcctgaaagcgtcgttagcagtctccagggacatcgcaacttcccaaccggtacagtgcctaagtgggattcacatatcagggcagcccttagtatcgaacggaggaaaaagagaagcacaggagtactgttgcccctgcagaacaacgagttgcctggtgccgagtatcagtataagaaggatgaagtgtgggaagaacgcaaaccttataagaccctgcaggcacaagccccagagaaaagcaaaaataaaaaaaaacagcgcaaagggcctcacaggaaatctcagacattacagttcgatgagcagactctgaaaaaggccaggcgaaaacaatggatcgagcctaggaactgtgcgagaaggtacttaaaggtagattttgcagatataggctggtctgagtggattatttccccgaaatctttcgacgcctattattgtagcggcgcttgtcagtttcccatgcctaagtctcttaaaccgtccaaccatgcgaccatccagagcatcgtgcgcgctgttggagtggtcccagggattcccgaaccatgttgtgtaccggaaaagatgagttcgctctcgatactgtttttcgacgaaaataaaaacgtggtcctcaaagtgtatcccaacatgactgtggagagctgcgcatgtagatag

SEQ ID NO: 216056 - DNA, 213 bp, Artificial Sequence
  Description of Artificial Sequence: Synthetic coding sequence
tgcttcttctattatctgaaatctttgaaaccctctaaccatgccacaattcagtcaattgttcgcgctgtgggagtggttcctggcatccctgaaccatgttgcgtacccgaaaaaatgtcttctctctctatactcttttttgacgagaataaaaatgtcgtcctcaaggtatacccgaatatgacagtagaatcttgtgcatgtcgatag

SEQ ID NO: 216057 - DNA, 1227 bp, Artificial Sequence
  Description of Artificial Sequence: Synthetic coding sequence
atgatacccggtaaccggatgctgatggtggtgctgctgtgtcaggtgttgctcggcggagcgtcacatgcctcgctgatcccagagacgggcaagaagaaggtggcagagatccaggggcacgcaggcggaaggcgctcaggtcaaagccatgagttgctgcgcgatttcgaagcaacattgctgcagatgtttgggttacgacgtcgcccacagcccagcaaatccgcagtgatccctgattacatgagagacctctacaggctccaaagcggcgaagaggaggaggagcagatccatagcactgggttggaatatccggagcgccctgcgtcacgggcaaacactgtgcgtagtttccatcatgaggagcatctagagaatatccccggtacctcagaaaactctgctttcaggtttctttttaatctgtcgtcaattcccgagaatgaggtaatatcctccgccgaactcaggcttttccgtgagcaagtggatcaggggcctgactgggagaggggattccatcggatcaacatatatgaagtcatgaagccacccgctgaggtcgttcccggacaccttatcactaggttactggacacgcgtctggtgcatcacaacgtgacccggtgggaaacattcgatgtttcacccgctgtcctgcgctggacccgggaaaaacagcccaattacggtctcgcaattgaggtgacacacctgcatcagacacgtacacatcagggccagcatgtaagaatttctcggtccttaccacaggggtccggcaactgggcccagttgaggcccctcctcgtgaccttcgggcacgacggacggggtcatgcgctcactaggcgcagaagggcaaagaggagccccaagcaccactctcagcgcgctcggaagaaaaataagaattgtcgcaggcactcactgtatgtggacttcagcgacgtgggctggaacgattggatcgtagcccctccgggttaccaggccttttactgccatggcgactgtcccttccctctggccgaccaccttaattccactaatcatgcaattgttcaaacattagtgaatagtgtcaacagttctatccctaaagcgtgctgcgtcccaacagaactgtcagccatctctatgctgtatcttgacgagtatgataaagtggtgctcaagaattaccaggaaatggtggtcgagggatgtggctgccggtag

SEQ ID NO: 216058 - DNA, 1227 bp, Artificial Sequence
  Description of Artificial Sequence: Synthetic coding sequence
atgatccccggtaatcggatgctgatggttgttctgttatgtcaagtgctactagggggagcctcacatgcttccttaatacccgaaaccgggaaaaagaaggtggctgaaatccagggccatgccggtgggaggcggtccggacaaagtcatgagctgttaagagactttgaagcaaccctccttcaaatgtttggattaaggagaagaccacagcctagcaaaagtgcagtgattccagattacatgcgcgacttgtataggcttcaaagtggggaggaagaggaggagcaaattcactcaactggactggagtatccagaacggccagcgtcaagagctaataccgtcagatcattccatcacgaagagcacttggagaatatccctggcaccagcgaaaattctgcctttcgattcttattcaatttgtcctccattccggagaatgaggtgatttcttctgccgagctgcgactgttccgagaacaggtcgatcaggggccagattgggaaagaggcttccaccggatcaatatttatgaggtcatgaagcccccagccgaagtggtaccagggcacttgataacgcggctgctcgacactaggctggtgcaccataacgtcacccgttgggaaacgttcgatgtgtcgcccgcagtccttcggtggaccagggaaaagcaaccgaactacggtcttgcaatagaagtgacacacttacaccagaccagaactcatcagggtcaacacgtgagaatcagtcggagcctgcctcaggggagcggaaactgggcccaactgcgccctctgctcgtgacctttggtcacgacggtagagggcacgcgttaacaaggcgaagacgagccaaacggtcccccaaacaccacagccaacgggcaaggaaaaagaataaaaattgtagaaggcattcactttatgtggacttttctgacgtgggctggaacgactggattgtggctccccctggttatcaggccttttattgccacggtgattgtccattccccctcgccgaccatctgaattctacgaaccacgccatcgtgcagaccctggtgaattctgtgaattcatcgattcctaaagcatgttgtgttcctactgagttgtcggccatcagtatgctgtacctcgacgaatacgataaagtcgtcctaaaaaattaccaggagatggtggtggaaggttgcggctgccgatag

SEQ ID NO: 216059 - DNA, 1227 bp, Artificial Sequence
  Description of Artificial Sequence: Synthetic coding sequence
atgatccccggtaaccgcatgctaatggtcgtcctcctctgtcaagtgctgttgggcggagcctcccatgcaagcttaattcccgagactggcaaaaagaaggtcgcagagattcaggggcatgccggagggaggcgatcggggcaaagccatgagctcctcagagactttgaagcgacattgctgcagatgtttggcctgcgtagacgcccacagccatcaaagtcggcagtcattccggattatatgcgcgacctataccggctccagtccggggaagaggaggaagagcagattcacagcacgggactggagtatcctgagagaccagcctcccgcgctaacaccgttcgatcctttcaccacgaggagcatctcgaaaatatcccaggcacgtccgaaaactcggcgtttcgttttctgtttaatctttcttccatacctgagaacgaagtgatctcatcagccgaactcagactgtttcgagagcaggtcgaccagggaccagattgggaaagaggtttccatcgtatcaatatctacgaggtgatgaagcctcctgctgaagtggttcctggccacctcataacacggttactcgacactcgccttgtccatcacaacgtgactcgatgggaaacattcgatgtttctccagcagttctccgctggacaagggagaaacaacccaattacggactggcgattgaagtgacccacctgcaccaaactcgcacccaccaagggcagcatgttaggatttcaaggtcattgccacagggttctggcaactgggctcagctgcgccctcttctggtgacatttggtcacgatggtcgcggtcacgcgctcactaggagacggagagccaagcgatcaccaaagcatcatagtcagcgtgcccgaaaaaaaaataagaattgtcgccgacactccctgtacgtcgatttcagcgatgtaggctggaacgactggatcgtagcaccgcctggataccaggcattctactgccatggcgactgtccattccctctagccgatcacctcaatagcacaaatcacgctattgtgcaaactctagtcaactccgtaaactcctctataccgaaagcttgctgcgtgcctactgagctatcagccatcagtatgctatatctggacgagtatgacaaagtcgtccttaagaactaccaggagatggttgttgaggggtgcggttgcagatag

SEQ ID NO: 216060 - DNA, 1227 bp, Artificial Sequence
  Description of Artificial Sequence: Synthetic coding sequence
atgattccagggaatagaatgctgatggtcgtgctgctctgccaggtgctcctgggcggtgcttctcatgcctcactgatccccgagacaggcaaaaaaaaagtggctgagatacagggtcacgctggcggacgccgatcgggccaatctcacgagcttctgagggacttcgaggctactttactgcagatgtttggactgcgcagaagacctcagccttcaaagtctgctgtcatccccgattacatgagagacctgtacagacttcagagtggggaggaagaagaagaacagatacactcaactggtctggagtacccggagagacccgcaagccgcgctaatacagttaggtcctttcatcacgaggaacatcttgagaacatccccggaacatccgagaactccgcctttcgcttcctgttcaacctgtcctctatccctgagaacgaggtaatcagttccgcagaacttcggttgtttagggagcaagtagatcaggggcctgactgggagcgcggtttccatcggatcaatatttatgaagtgatgaaaccaccagcagaggtcgtgccgggacacctgataacgaggctgctagatacccggctggtgcatcacaatgtcacccgctgggaaacttttgatgtgtctccagccgttttgcggtggacccgagagaaacagcctaattatggcttggccattgaggtgacacatcttcaccagactcgcacacatcaaggacaacatgtccgcattagccgctccctaccccagggcagcgggaactgggcacagctgcggccactgctcgttactttcggacacgatgggcgtggccatgccttgacccggagaagacgagctaagcggagtcctaaacatcactcccagcgcgctcggaaaaagaacaaaaactgtagacggcactcactgtatgtagacttttctgatgttggttggaatgactggatcgtcgcgcctcctggataccaagcgttctattgccatggggattgtccctttcctttggcggatcatctgaacagcaccaatcacgcgatagtccagaccttagtgaattccgtcaattcaagtattcctaaggcctgctgcgttcccacagagctctcagccataagcatgctgtatctggatgaatatgacaaggtagtcctcaaaaactaccaggagatggtggtcgaaggttgtggctgccggtag

SEQ ID NO: 216061 - DNA, 333 bp, Artificial Sequence
  Description of Artificial Sequence: Synthetic coding sequence
atgatccctgggaatcgtatgctgatggtggtgttactttgtcaggtgctcctgggtggagcgtcccacgcatcactcatcccagagactggcaagaaaaaagtcgcagaaatccagggtcatgccggaggcagacgtagcgggcaatcccacgagctactcagggacttcgaggcaacactgctccagatgttcggtttacgcaggaggccacaaccctccaagagcgccgttatccccgattacatgagagacctgtacagacttcagtccggcgaggaagaagaagagcaaatccacagcacaggcctggagtatcccgaacgcccttag

SEQ ID NO: 216062 - DNA, 1365 bp, Artificial Sequence
  Description of Artificial Sequence: Synthetic coding sequence
atgcacctgacggtctttctgcttaaaggaattgtgggatttctttggagttgttgggtcctagtcggttatgccaaaggcggtctgggagataaccatgtgcattcctccttcatctatcggcgactgcgaaaccatgagaggagggagatccagcgcgaaattcttagcatactggggttaccgcacaggcctcgtcctttttcacctggcaagcaggcctccagcgccccactgttcatgctggatctgtataacgctatgacaaatgaagagaacccagaggaatccgaatactctgttcgggcttctctggctgaagaaactaggggagccagaaaaggatacccagccagtcctaacggctacccaaggaggattcagctgtcaagaaccactcccctaactacccagtcccctcccctagcctccttacatgacaccaatttcctgaacgacgcagacatggtcatgagctttgttaatcttgttgaaagagataaggactttagccaccagcggagacattacaaagagttcaggttcgacctgactcagatcccgcatggggaggctgtcaccgccgctgagtttagaatctacaaagaccgctccaataacaggttcgagaatgaaaccatcaagatcagtatttaccagatcataaaggaatatactaatagagatgccgacctgttcctgctagatacacgtaaagctcaggccttggatgtgggctggctggtgttcgatataacagtcacgagcaaccattgggtaataaatccacagaataatcttggactgcaactgtgcgcagagacgggagatggcaggtctataaatgtcaagagtgcgggactggtagggcgacaagggccacagagcaagcaaccttttatggtagcattctttaaggccagcgaagttttgcttcgctccgtacgtgcggctaataaacgcaaaaaccaaaataggaataagagctcttctcatcaggattcatctcggatgagcagtgtgggagactacaacaccagtgagcagaaacaggcgtgcaagaaacacgagctttacgtgagttttagagaccttggctggcaggactggatcatcgctccagaaggctacgctgctttctattgcgatggcgaatgttcattcccattaaacgcccacatgaacgctacaaaccacgctatagtacagaccttagtccatttaatgtttcccgaccacgtgcctaagccctgttgtgccccaacgaagctgaatgctatttctgtcctgtacttcgatgatagttccaacgtgattctgaagaagtatcgtaatatggtggtacggtcctgcggctgtcactag

SEQ ID NO: 216063 - DNA, 1254 bp, Artificial Sequence
  Description of Artificial Sequence: Synthetic coding sequence
atgcatttgacagtgttcctacttaaaggcattgttggattcctgtggtcctgctgggtgcttgttgggtacgccaagggcggacttggcgacaatcatgtgcacagttctttcatatacagacgcttgagaaatcacgaaaggcgggaaattcagcgggagattttgagtatcctgggactacctcatcgcccacgcccatttagtcccggaaagcaagcatcttctgctcccctgttcatgctggacctgtataacgcgatgaccaacgaggagaacccggaggagagcgaatacagcgtgcgagcatcactcgccgaggagactcggggagcccgaaagggctatcccgctagtcctaatgggtaccctaggcggatacagctctccagaaccacccctcttacaacccaatcgccccctctagcttcactacatgacactaattttctgaatgatgctgatatggtgatgagcttcgttaacctggtcgaacgggataaagatttcagccatcagcggcgacattataaggagttccggtttgacctcacacagattccacacggggaggccgtcaccgccgctgagtttaggatttacaaggaccgatcgaataatagattcgagaatgaaaccataaagatctccatctaccagatcattaaagagtatactaatagagacgccgaccttttcctgctggacactcgcaaggcacaagccctggacgtgggctggctggtctttgatattaccgtgacttccaatcattgggtgatcaatccccaaaacaatcttgggctgcagttgtgtgcagagacaggagatggccgaagcatcaatgtgaagagtgccggactcgtgggtcgccaagggccacaaagcaaacagccttttatggttgcattctttaaggcctctgaggttctgctccggtctgttcgggcagctaataaacgtaagaaccagaaccgtaacaagagttcatcccatcaggactcctctcggatgagctctgtgggagattacaacacgtccgagcagaagcaggcgtgcaagaagcacgaattatatgtctcctttcgggatttgggatggcaggttcatctgatgttccctgaccacgtgccaaagccatgctgcgcccctaccaaactgaacgccatctccgtgctttactttgatgattcgagtaacgtgatactgaagaagtaccgcaacatggttgttagaagctgtgggtgtcactag

SEQ ID NO: 216064 - DNA, 1542 bp, Artificial Sequence
  Description of Artificial Sequence: Synthetic coding sequence
atgccaggactgggtcggagagcccagtggttgtgctggtggtggggactgctgtgtagttgctgcgggccacctcccttacgccctccgctccccgcagccgcagccgcagcagccggtgggcagctgctgggcgacggcggtagccccggacgtacagagcagccccctccctctccgcagtcctcaagcgggttcctttatcgcaggctcaaaactcaagagaaaagagagatgcagaaggaaatcctctctgtgctgggtttacctcatagacctcgacctttgcacgggctgcagcaaccacaaccccctgcactgcgtcaacaggaagaacagcagcagcagcagcagctgcctcgtggggagccacccccagggagactgaaatcggcaccgctttttatgctagacctatacaacgcccttagcgccgacaatgacgaggacggagcttccgaaggcgagcgtcagcagtcgtggccacacgaggcggctagctctagccagagacgacaaccaccgcctggtgctgcgcatcccctgaaccgaaaatctttgctggcacctggaagtgggagtggaggggcttctccattaacgtctgctcaggattctgcttttctgaacgacgcggatatggttatgagctttgtgaacctggtcgagtacgacaaggaattttccccgagacagaggcaccataaggagtttaaattcaatctttcccagatcccggagggcgaagttgtgacagccgctgaattcaggatctataaggactgcgtgatgggcagcttcaaaaatcagacattccttatttcaatctatcaggttttgcaggagcaccagcatcgtgattccgatcttttccttctggacacaagagttgtttgggcatctgaagagggctggctcgagtttgatattactgcaacatccaatctctgggtggtgactccccagcataatatgggtcttcagttatctgtagtgacaagagatggcgtacatgtgcatcccagagccgctggcttggtgggtcgagatggcccttatgataaacagccctttatggttgccttctttaaggtgtcagaggtgcacgtaaggaccactcggagcgcctcctctcgcagacgtcagcagtcccgtaaccgtagcacccagtctcaggacgtggctcgggtctccagtgcttccgactacaactcttcagagctgaaaacagcttgtcgtaagcatgagctgtatgtttcattccaggatttgggttggcaagactggattatcgctcctaagggctatgccgctaactattgtgatggtgaatgtagtttccctttaaatgcccacatgaatgccaccaaccatgcgatcgtgcagacactggtgcacttaatgaatccagagtatgtgcccaaaccatgttgcgcccctaccaaattgaacgcaatctcagtgctgtactttgatgataactctaacgtgatcctcaagaaatatcggaacatggtagtccgggcttgcggctgtcattag

SEQ ID NO: 216065 - DNA, 1308 bp, Artificial Sequence
  Description of Artificial Sequence: Synthetic coding sequence
atgcagaaggagatcctgtcggtactgggtttacctcataggcctcgtcccttgcatggcctccaacagccccaaccacccgctttgcgccagcaggaggagcagcagcaacagcagcagctcccgaggggagagccccctcctggtcgtctgaaatccgcgcctctgttcatgctggatctctataatgcactcagcgctgataacgatgaggatggggcttctgaaggggagcgccagcagtcctggccccacgaggctgcatcctcatcacaaaggagacagccgcctcctggcgcagcccatcccctcaatagaaaatccctcctggcccctggaagtggctcagggggagcaagcccccttacaagcgcccaggattccgccttcctgaacgacgctgacatggtcatgtcattcgtgaacctcgtggagtatgataaggagttctcccccagacaaagacaccacaaggagttcaaattcaatctgagtcagatcccagagggggaggtggtgacagccgctgagtttagaatatataaagactgcgtgatgggcagcttcaagaatcagacatttctcattagcatataccaggtgctgcaggaacaccaacacagggatagtgatcttttcttgctcgatactagagttgtgtgggcctcagaggaaggctggcttgagttcgatataaccgccacctcaaacctgtgggtggtgactccccagcacaacatgggcctgcagctctccgtggtgacacgcgatggtgtccacgttcatcccagagccgctggcctggtcggacgtgatggcccttacgataaacagcctttcatggtggctttttttaaggtgagcgaggttcatgtgagaacaacccggtctgcttctagcagacgtaggcagcagagtagaaatcgtagcacccagagccaggatgtcgccagagtaagctctgcctccgactacaactcctctgaattgaaaaccgcatgtaggaaacacgagctgtacgtgagttttcaggatcttggttggcaggactggatcatcgcacccaaaggttatgcggctaactactgtgatggcgagtgcagtttcccactcaatgctcatatgaatgctactaatcatgccatcgtccagactcttgttcacctcatgaatccagagtacgtgccgaagccttgttgtgctcccaccaagcttaatgcaattagcgtcctctatttcgatgacaatagtaacgttatcctcaagaaataccgaaacatggtggtgagagcttgcggctgccactag

SEQ ID NO: 216066 - DNA, 1431 bp, Artificial Sequence
  Description of Artificial Sequence: Synthetic coding sequence
gccgcaggaggccaactgctgggagacggaggcagcccgggtcgcactgagcagcctcctccgtcacctcagagcagctctggattcctctatcgtcgccttaaaacacaggaaaaacgggaaatgcagaaagaaatcctaagcgtgctgggtctcccgcatcgcccacgccctctccacggactacagcagccacagccacctgcactgcgccagcaagaggaacagcagcagcaacagcagctccccaggggcgagccccctcccggacgtttgaaatccgccccattatttatgctggacctatataatgctctgtcggcagacaacgacgaagacggcgctagcgaaggcgagcgccagcagtcctggccccatgaagccgcatcgagctctcagagacgtcaacctcccccaggcgctgcgcacccactcaacagaaaatctctgttggctcccggatcagggagtggaggcgcttcgccgcttactagtgcccaggattccgcatttctgaacgacgctgacatggtcatgagtttcgtcaatctggtagaatatgataaagaatttagtcctaggcaaagacaccacaaagaatttaagtttaacctttcccagataccggaaggagaggtagtcacagctgccgaattccggatttacaaagattgtgtgatggggtcatttaagaatcagacttttctgataagcatatatcaggtccttcaagagcatcagcacagggactcggaccttttcctcttggacacacgggtggtgtgggcttctgaagaaggatggctggaatttgatattactgcaacgagtaatctgtgggttgtgaccccgcagcataacatgggtctacagctgtcggtggtgacccgggatggagtgcacgtgcacccaagggctgctggcttggtcggccgtgatggtccctacgacaagcagcctttcatggtcgcttttttcaaagtgtccgaagtgcacgtaaggacaaccagatctgcaagtagccgaagacggcagcagagccgaaacagatcaacacagtcccaagatgtggccagagtatcctccgcctctgattataacagcagcgaactgaagactgcttgtaggaaacacgagttatacgttagcttccaggatctcggatggcaggattggatcatcgcccctaagggctacgcagctaactactgtgatggcgagtgcagcttccctctgaacgcccatatgaacgcgaccaaccatgccattgtacagacactggtgcatctaatgaatcccgaatatgttcccaaaccatgttgtgcgcctactaagctgaatgcaatctctgtgttatactttgatgacaattcgaatgtcattctcaagaagtatcggaacatggttgtgagggcctgtgggtgccattag

SEQ ID NO: 216067 - DNA, 2505 bp, Artificial Sequence
  Description of Artificial Sequence: Synthetic coding sequence
atggaggaaaagacccagatcaagacctttctgggaagtaagctgccaaagtatggtacaaaatcagtcagatctactctacagccaatgcccaacggaaccccagtgaacctgttgggaacttctaagaactccaacgtgaagtcctatatcaagaataacgggtcagattgcccaagctcccattctttcaactggcggaaagccaacaaataccagctttgtgcacaaggtgtcgaggagcctaataacacacagaattcacatgacaagataatagatcccgaaaagcgcgttcccactcagggaatgttcgacaagaatggaattaagggtggtctgaagtccgtgagtctatttacctctaaacttgccaagccgagtaccatgttcgtgagcagcaccgaggaactgaaccagaaaagtttctcaggtccatctaacttaggaaagttcaccaaaggtaccctccttggacgcacttcatattcatcaatcaataccccgaaaagtcaactgaatgggttctatggaaatcggtccgccggatccatgcaacgtcctcgggcaaacagctgtgctactcggtcttcttccggtgaaagtttagcacagagtcccgattccagcaagtccatcaactgtgaaaaaatggtgcgctcacagtctttcagtcattccattcaaaatagctttcttccgccatccagcattactcggtcacacagtttcaaccgggctgtggatctgaccaaaccttaccagaaccagcagctatctatccgcgtccctcttcggtcgagcatgttgacacgcaatagtcgacagcccgaagtgctgaacgggaatgagcaccttggatacggcttcaaccgcccttatgctgccggtgggaagaagttggcactgcctaacgggcctggcgtcacctcaaccctgggctacagaatggtccacccatccttgcttaaatcttctcggagtcccttctctggaaccatgacagttgacgggaacaaaaattctcctgccgacacctgcgtggaggaggacgcgaccgtgttggccaaggatagagcggcaaataaggaccaggaactgattgagaacgagagttaccgcacgaagaacaatcagacaatgaaacacgacgctaaaatgaggtatctctctgacgatgttgacgacatcagcttgagtagcttaagctcctccgataagaatgaccttagcgaggatttttctgatgactttatagatatcgaggactcgaacaggactcggatcactccagaggagatgtccctgaaagaagagaagcacgagaatggtccccctcaagacatgtttgattccccaaaggagaatgagaaggctttctcgaagacagacgagtggatcgacataagtgtgagcgataggagcgagtgcaccaaacacaccagtggcaataatcttgtcagtcctgacaccgattatcgcgcagggtcttcctttgaactatctccatctgactcatctgacggcacctacatgtgggacgaggaaggactcgagccgataggaaacgttcatcccgtcgggagttacgagtccagcgagatgaactcaatcgatatcctgaacaacctggagagttgcgacctggaagatgacgatctgatgctggatgtcgacctccctgaagacgcacccttggaaaacgtggagtgcgataatatgaaccggtttgacaggcctgacagaaatgttcgccagccccaggagggattttggaagagacccccacaacgatggtctggtcaggaacactatcatctttcacacccagaccattaccaccatcacgggaagagtgatctgagcaggggatcaccttacagggagtcacccctggggcactttgaatcatacggcggtatgcccttcttccaggctcagaagatgttcgtggatgttcctgaaaataccgtaattctggatgagatgacgctgcgccacatggtccaagactgcactgcagtgaagacccagctgctcaagctgaagcgcttgctccatcagcacgatggtagcggttctctccacgacatacagttgtccctgccttcgagccccgagcctgaagacggggataaagtgtacaaaaatgaggatctcctcaatgagattaagcagcttaaggacgaaatcaagaagaaagacgagaaaatacaactcttggagctccagctggccactcaacacatctgtcaccagaaatgcaaagaggagaagtgcacatatgccgacaagtacacacagaccccttggcgccgaatcccaggaggatatagcgccccttccttctctccctggcagggctcatttcaaggtattccgaggactgttccaccccacagaaggcagacctcctctacaacagctttccagcagccttcccaaactcatcgatctcaccccggaaaaacaaacaaggctacaacatatcggggtcctcagtag

SEQ ID NO: 216068 - DNA, 1599 bp, Artificial Sequence
  Description of Artificial Sequence: Synthetic coding sequence
atgcctcagctgtatatctatatccgcctcctgggtgcctacctgttcatcatcagcagagtccagggccagaacctggacagtatgctgcacggcacagggatgaaatctgattctgaccagaagaagtccgaaaatggcgtgactctggctccagaagataccctaccatttctcaagtgttactgcagtggacactgtcctgatgatgcgatcaacaatacttgtattactaatggtcactgtttcgccatcatagaggaagacgatcagggagaaacaactctagcaagtggctgtatgaagtacgaaggaagcgattttcagtgtaaggattccccaaaagcccaactccgccgaacaatcgagtgctgcagaactaacctttgtaaccaatatttgcagccgactctgccaccagtcgtcatcggtcccttttttgatgggtccatccgatggcttgtgctcctgatttctatggcagtctgcataatcgccatgattatattcagttcatgcttctgctataaacactactgcaagagtatctcctcgaggcgcagatacaatcgtgatttggaacaagatgaggcattcatacccgtgggtgaaagtttaaaggatctgattgatcaatcacaaagcagcggtagcgggtctggcctgccattacttgtgcagcgcacaatagcaaagcaaatccaaatggtgaggcaggtgggcaagggacggtatggcgaggtatggatggggaaatggcgcggtgaaaaggtggcagttaaagtgttctttactaccgaggaggcgtcatggtttcgggaaaccgaaatttatcaaacagttcttatgagacacgaaaatatcctcgggtttatcgcagctgatattaagggcacagggtcatggactcaactgtatttgattaccgattatcatgagaatggaagcctctatgactttttaaaatgcgcaaccctggacacgagagctctgttgaagctggcgtacagcgcagcatgcggtctctgtcacctgcataccgaaatttatggtactcagggaaagcctgctatcgcacatcgcgatctcaaatcgaagaacattttgattaagaaaaatgggtcctgctgtattgccgatctgggtctggctgtcaaattcaacagcgacaccaacgaggtggatgtaccgctgaacacgcgggtgggaacaaaaagatatatggcccctgaggtcctcgatgaatcgctgaacaagaaccattttcagccctatatcatggctgatatctactccttcggactgatcatttgggagatggcgagacggtgtattacaggcggtatcgtggaggagtaccaattgccgtattataacatggtgccctcagatccttcctacgaagacatgagagaggtagtgtgcgtgaagagactgaggcctattgtgtctaaccgctggaacagcgacgagtgcctgagagccgtgctgaagttgatgtccgagtgctgggcccacaacccagcaagcagacttacagcattacggataaaaaagaccctggccaagatggtggagtctcaagatgttaaaatctag

SEQ ID NO: 216069 - DNA, 3117 bp, Artificial Sequence
  Description of Artificial Sequence: Synthetic coding sequence
atgacgagttcactccagcgcccttggcgtgtcccttggctgccctggaccattctgttggtctcaaccgccgctgcatctcagaaccaggaaagactctgcgcgtttaaagatccctaccaacaagatttggggataggcgagtcgcggatctcccacgaaaatgggactatcctgtgttctaagggatctacctgttacggcctttgggagaagtccaaaggagacatcaaccttgtgaagcaaggttgctggtcccacataggtgaccctcaagaatgccactatgaggagtgtgttgtcaccactacccccccttcaatccagaatggaacttacaggttctgttgctgctccactgacctttgtaatgttaattttactgaaaactttccccctcctgacacaactccgcttagtcctccccacagcttcaaccgagacgagacgatcattatcgctcttgcttccgtaagtgtcctcgccgtcttgattgtcgccctgtgcttcggctacaggatgctgactggggatcgcaagcagggtttacattcaatgaacatgatggaggctgctgcttccgaaccgtccctcgatctggataatctgaagctactggagttgatcggaagagggaggtacggcgctgtatacaagggcagcctggatgaaagacctgtcgcggtgaaggtgttctcctttgctaataggcaaaactttataaacgaaaaaaatatctaccgggtgcccctaatggagcacgacaacatcgcccgattcatcgtgggagatgaacgagtgacagctgacggccgaatggagtacttgctggtcatggagtactatccaaatgggtccctgtgtaagtatctgtctctgcataccagcgattgggtctcttcctgtcggctggcccactcagtaacaaggggtctggcgtacttgcacaccgagctgccacgaggtgatcattataagccagctatctcgcaccgcgatctcaacagcaggaatgtactcgtgaaaaatgacgggacttgcgttatctcggattttggcctgtccatgaggctgaccgggaatagactggtgagacctggggaagaggacaatgcagctatttctgaggttggtactatcagatatatggcacctgaggttctcgagggtgccgttaatttgcgcgactgtgaatctgcactgaagcaagtcgacatgtatgctcttgggctcatctactgggagatcttcatgcgatgcacagacttattccctggtgaatctgtgccggaataccagatggcctttcaaactgaggttggtaaccatccaacatttgaggacatgcaagttctggtgagtcgagagaaacaacggcctaagtttcctgaggcttggaaagagaactctctggccgtaagaagcctaaaggaaactatagaggattgctgggaccaggacgcagaagccagactcaccgctcaatgcgccgaggagagaatggcagagctgatgatgatctgggagcgcaataaaagcgtttcccctaccgtgaacccaatgagcactgctatgcagaatgagcggaacttaagtcacaatagacgcgtgcccaagattggtccataccctgactacagctcctcctcatacatcgaagactctatccaccatacggatagcatagtgaagaacatttcttcagagcattcaatgtcctctacccccctgaccatcggcgagaaaaatcggaactctataaactacgagcggcagcaagctcaggcaagaattccatctccagagactagtgtaactagcctgagcactaacacaaccactaccaatactactgggttgaccccctctacggggatgaccactatatctgaaatgccctatcctgacgagacaaatctgcatactacgaatgttgcccagtctattggccctacaccagtttgcctgcaacttactgaagaagacctggagaccaataagctagaccctaaagaggtggacaaaaatctgaaggagagttccgacgagaatctcatggaacactcgctcaagcagtttagcggaccggatcctctctcctctacctctagcagcttgttgtatcccttaattaagctggcagttgaagccacggggcagcaggattttacccaaactgcaaacgggcaggcctgcctaattccagacgttctgccaactcagatctatccgctgcccaagcagcagaatctcccaaagcggcctacctcccttcctttaaacacaaagaattccactaaagaaccccgactgaagttcggaagcaaacacaagagcaatctgaagcaagtggaaacgggagtggctaagatgaacaccattaacgctgcggagcctcatgtggtgaccgtgaccatgaatggcgttgccggacgaaatcactccgtgaactctcatgctgcaactacccagtatgctaatggcactgttctgagcggccagacgacaaatatagtgacgcacagagcgcaggaaatgctccaaaatcagtttatcggagaagatactaggctgaacatcaactcttctcccgacgagcatgagccgctacttcgccgtgaacaacaagctggacatgacgagggagtgttggatcgtctcgtggatcgacgcgaacggccattggagggcggacgtaccaattccaataacaataattctaacccttgctccgaacaggacgtgttggcccagggagtccccagcaccgctgctgatccagggcctagtaagcctagacgggctcaacgacccaactcgctcgatttgtcagctaccaacgtgctggacggttcgtcgattcagatcggggagtccactcaggatgggaagtcaggtagcggggaaaagattaaaaaacgggtcaagaccccttacagccttaagaggtggaggccgagcacttgggtgattagcactgaatcgctcgattgcgaagtgaacaataatggctccaacagggctgtacattctaaatcctcaaccgccgtctacctggctgaagggggtacagccacaaccatggtgtccaaggacatcggtatgaactgtctctag

SEQ ID NO: 216070 - DNA, 2337 bp, Artificial Sequence
  Description of Artificial Sequence: Synthetic coding sequence
atgtcgtctggcgcaaaggaaggagggggtgggtcccctgcttaccatctcccacacccacatccccatccgccacagcacgcccagtatgtggggccttacagactggagaaaacactgggaaaaggccagactggcctggtgaagcttggggtacattgtattactgggcagaaggtggcgattaaaatagtgaaccgtgagaaactaagcgaaagtgttctaatgaaagtcgaacgggagatcgccattctgaagctgattgaacacccacacgtcttaaagttgcatgatgtgtacgaaaacaagaagtatttgtatcttgtgctggaacatgtgtctggaggcgaactttttgactaccttgtgaagaaaggacgcctgacccccaaggaagcccgaaagtttttccgacagatcgtaagtgctctcgacttctgccatagttacagcatctgtcacagagacctgaagccagaaaatcttctgctggacgaaaagaacaacattcgtatcgccgacttcggaatggccagtctccaagttggagactcacttcttgagacctcgtgcggtagtccccattatgcctgccccgaagtgatcaagggcgaaaaatacgacggtaggagagccgacatgtggagctgcggtgtgatcctgttcgccctcctggtaggtgcccttccgtttgatgatgataacctcaggcaactgctggagaaggtcaagagaggtgtctttcacatgccgcattttattcctcccgactgtcagagcctgctgcgtggaatgattgaggtggagccggagaagcggctgagccttgagcagattcaaaaacacccatggtatctgggtggtaagcacgagccagacccctgcctggaaccagcccctggtaggcgggtggcgatgcggtctcttccttcaaatggagaattagatcctgatgtcctggagtctatggcatcattaggctgctttcgggaccgcgagcgtctacatcgagaacttagatccgaagaagagaatcaggagaagatgatctattatcttctgttagaccgtaaagaaaggtacccctcctgcgaagatcaagacctgccaccgcgaaacgacgttgaccctccacgcaaacgggtcgattcgcctatgctcagcagacatggtaagcggaggcccgaaaggaaatccatggaagtcctttcgatcaccgatgcaggcggaggaggatctcctgtgcctaccagacgagccttggagatggcacagcattcacagcgatcccgcagcgtatcaggggcatccactggcctctctagctctccactgtcaagtcctcggtcacctgtcttctccttctctcctgaaccaggagcaggcgacgaggctcggggaggaggctcccctaccagcaaaacccaaacattgccttctagggggccacggggaggaggcgcaggggagcaaccgcctccaccaagcgcacgttcaactcccctgcccggacctccaggttcccccaggtcttccggcggaacgccattacattctcctcttcatacaccgagggcctcacccactggaaccccaggcactactccgccaccctcaccaggtggcggagtcggcggagccgcttggcgctcaaggctaaattccatcaggaacagcttcttaggctctcctcgcttccatagacggaaaatgcaggttccaactgcagaggagatgtcctcactgactcccgaatcgagtcccgagcttgctaaaaggtcctggttcggtaactttatatctctggataaagaagagcaaatctttctcgttcttaaggataagcctttgtcttcaatcaaagcagacatcgtccatgccttcttgagtattcccagtttatcacattctgttctgagtcaaacgagcttcagagcagaatataaggctagcggtgggccttctgtgtttcagaagccagtgagatttcaggtcgatatctcatccagcgaggggccagagcctagccctagaagggatggctcaggaggcggagggatctacagcgtcactttcaccttgatttctgggccaagtagacgatttaaacgagtagtggaaaccattcaggcccagctgttgtctacccacgaccaaccctctgttcaggcactggctgatgagaaaaacggtgctcagactagaccagccggagcaccacctcgatccctgcagccgcctccaggcagacctgaccctgaattatcaagctcaccacgtcgcggacccccaaaggacaaaaaacttctcgccaccaatggtactcccctgccctag

SEQ ID NO: 216071 - DNA, 1422 bp, Artificial Sequence
  Description of Artificial Sequence: Synthetic coding sequence
atgcgctcattaccctccaatggtgaactggacccagacgtccttgagagtatggctagcttagggtgttttcgtgaccgcgaaaggctccacagagagctgagatccgaagaggagaatcaagaaaagatgatttactatctgctgctggaccggaaagagcggtacccctcgtgtgaagaccaggatctcccacctcgcaatgacgtcgatccaccacgaaaacgcgtggattctccaatgctgagccgtcatgggaagcgcaggccagagcggaagagcatggaagtgctgtccattaccgacgcgggtggtggagggagtccagtgccaacgagacgcgctctggaaatggctcaacactctcaaaggtccaggtccgtcagtggcgctagcactgggctcagctcaagcccactgagtagtccccgatctccagtgttttcctttagcccggagcccggagccggagacgaggcgagaggtggaggtagccctacaagtaagacccagacactgccttcccggggtcccagaggcggaggtgcaggcgagcagccccctcctcctagcgccaggagcacccccctccccggaccaccgggttctccacgcagctcaggtggtactcccttacattcgcccctgcatactcccagggcctcacccactggaacaccaggaacaacaccgccaccctcacctggcggaggcgtggggggagcagcttggagatctcggctgaatagtatccgcaatagctttctgggaagtccgagattccatagaaggaagatgcaagttccaaccgccgaagaaatgagcagcctcactcccgagagctcacctgagctagccaagcggtcctggttcggtaacttcatctcccttgataaggaagagcagatattccttgtgctcaaagacaaacccctatctagcattaaggcagacatcgtgcacgccttcttgtctatacctagcctcagccatagtgtgctgagccaaacaagttttcgggctgaatataaggcgagtggaggtccaagtgtctttcagaagccagtgcgcttccaggtagacatttcttctagcgagggaccagaaccaagcccacgcagggacggatctggcggtgggggtatttatagcgtcaccttcaccctcatttccggcccatctcggaggtttaaaagggtggtagagactattcaagcacagttactgagcacccacgaccagcccagtgtccaagccctggccgatgaaaagaacggcgctcagacccggccagctggagccccaccgagatctcttcagccgcctcccggtcggcctgaccctgaactctcttccagccccaggcgcggtcccccaaaagacaaaaagttgctggccactaatgggacccccttgccatag

SEQ ID NO: 216072 - DNA, 1422 bp, Artificial Sequence
  Description of Artificial Sequence: Synthetic coding sequence
atgaggtccctgcccagtaatggcgagctggacccagatgtgcttgagtcaatggcctcactgggatgttttcgagacagggagcggctccatagggaactgcgatctgaggaagaaaatcaggaaaagatgatttattatctcttgttggatcgtaaagaacggtacccctcctgcgaggaccaggatttgccccctcgcaatgatgtggacccccctaggaaacgcgttgatagcccaatgctgtcccggcatgggaagaggagacccgaaagaaaaagcatggaggtcttgtcaatcacagacgccggaggcggagggagcccggtccctacgcgcagggcgcttgaaatggcccaacattctcagagatcccggtctgtgtctggcgcatcaaccggcctgtccagttcgccactgagcagccctagaagtccagtcttcagcttttcccccgagccaggagcgggtgatgaggcccgaggcggaggcagtcccacttccaagacacagactttaccctcacggggtcctagggggggaggcgcaggggaacagcctcccccaccctcagcccgttccacgcctctccctggccctccgggatctcctagatccagcgggggaacccccctgcactcaccactgcatacgccacgagcatcacccaccggaaccccaggtacgacacctccacccagcccaggcggtggtgttgggggagcagcctggagaagtagactcaactcaattagaaacagtttcctcgggtcgcctcgctttcaccgccgtaagatgcaggtcccgaccgccgaagaaatgtcatcactaacccccgagtcctctccggagctcgccaaaaggagctggttcggtaattttattagcctcgacaaagaggaacagatctttctggtactgaaagacaagcctttatccagcatcaaagcagacattgtacatgccttcctatccattccaagcctaagtcatagcgtcctctcccaaacgtctttcagagctgaatacaaagccagcggcggaccttccgttttccagaagcccgttcggttccaggtggacatatcgagtagtgagggccctgaaccgtcaccacggagagatggttctgggggtggaggcatctatagtgtcacattcaccctcatcagcggtccgagcagacgatttaagagggtggtggagactatacaggctcagctcctttctacccatgaccaaccaagcgtccaggcccttgccgatgaaaaaaatggggctcaaacaagacccgcaggtgcgcctcctaggtctttgcaaccacctccaggaaggccagaccctgagttgtcgagcagcccgagaaggggtccccctaaggataagaaattgctcgccactaatgggacaccattgccttag

SEQ ID NO: 216073 - DNA, 2976 bp, Artificial Sequence
  Description of Artificial Sequence: Synthetic coding sequence
atgaggcatcgcgtgtgtagaggccgatctgggcagggacggaggcgcagctccgtgatcccttggcccgtccccaaacatgtgggttgggtggtgctcctgggatgtggaggaagtggaacctccatcctggtggtgtctatcgtgggctcaggactaattaaggcgatggccccagctgaaattctgaacgggaaggagattagcgcccaaatccgcgctaggctcaaaaatcaggtaacacagctgaaagagcaggtcccaggcttcacaccacgcttggccatcctccaagtaggaaacagagatgactctaatctttatattaatgtgaagctaaaagccgctgaggaaatcggcattaaggccactcacataaaattgccccgtacaaccacggagtcagaggtgatgaagtacatcacaagtttaaacgaggactctactgtacacgggttcctggtacagctgccccttgatagcgagaattccattaatacagaagaggtgattaatgctatcgccccagagaaggatgtagatggtctaacatccataaatgctggtaaactggcaaggggagacctcaacgattgcttcatcccatgcacacctaaaggatgcctggaacttattaaggaaacaggcgtacccatcgccggaagacatgcggttgtggtgggcagaagcaagattgtgggtgccccaatgcacgacctgttgctgtggaataacgctacagttaccacttgtcactctaaaaccgcacaccttgatgaggaagtgaacaaaggcgacattctggtcgtcgctactggtcagcctgaaatggtcaaaggtgagtggatcaagcctggcgctattgtgatcgactgcggaattaactacgttccggacgacaagaaaccaaacggccgaaaggtcgtgggggacgtggcttacgatgaggcaaaggaaagagcttcctttatcacccccgtaccaggaggggttggccctatgacagtggccatgctaatgcaatcaacggtagaaagtgccaagagatttctggagaagttcaagccaggcaaatggatgattcaatataataacctcaatctgaaaacacctgtgccaagcgacatagatatctcccggtcctgtaagcctaaaccaattggcaagctggcgagggaaatcggactgctgagtgaggaggtggagctgtatggtgagaccaaggccaaggtcctcctttctgcactggaacgcctaaagcataggccagacgggaaatacgtcgttgtaaccgggattacgcctacacctctcggagaaggaaaaagcacaactacgattggactggtccaggccctgggggctcacctgtatcagaatgtcttcgcctgcgtccgccagccaagccagggtcctacctttggaattaaagggggagctgcgggtggcggatatagccaggtgatacctatggaggaatttaaccttcatctgactggtgacatccatgctatcactgccgctaataatctagtggccgctgccatcgacgctagaatctttcacgagttgacacaaacagataaagcactcttcaaccggttagtcccatccgtgaacggtgtacgacgattctctgacatccagattcgacggcttaaaaggctcggcatcgagaaaaccgatccaaccactttgactgatgaggaaatcaaccggtttgctcgcctggacattgatcctgaaacaattacctggcaacgagttttagacactaacgataggtttcttagaaagataactatcggccaggcgcctaccgagaagggccacactaggaccgcacaattcgatatctccgtggccagcgagatcatggcagtacttgcactgaccacatccctcgaggacatgcgcgaacggctcggtaaaatggtggtcgcttcaagcaagaagggagagcctgtgagcgcagaagatttaggggtgtcaggagctctaacggtcctcatgaaggacgccatcaaaccgaatttgatgcagaccctcgaagggactccagtgtttgtccacgctggaccattcgcaaacatcgcacatgggaacagctccatcatcgcagatcgcattgctcttaagttggtcggtcctgaggggttcgtggtgaccgaagctgggttcggcgcagatatcgggatggaaaaattctttaatattaaatgccggtacagcggactctgcccacatgtggtagttctggtggccaccgtgcgagccctaaaaatgcatggcggtggacccaccgtcaccgccggtctgccattgcctaaggcctatatccaggaaaacttagagttggtggagaagggcttctcgaacctgaagaaacagattgagaacgcacggatgttcggcatccctgtagtagtggccgtgaacgccttcaaaacagatactgagtctgagctagacctgatttcgcgactttctcgcgaacacggagcttttgatgcagtgaagtgtacacactgggctgagggtggtaaaggagccctggcactggcccaggccgtgcagcgggctgcacaggctccttctagctttcagctgctgtatgatctcaagctgcccgttgaggataagatcagaataatcgcacagaagatctacggcgcagatgatatcgagttactgcctgaagcacaacataaggccgaggtgtatacgaaacagggttttggcaacttacccatttgtatggcaaaaacccatctctccctatctcataatcccgaacaaaagggagttccgacaggtttcattttaccaatcagagacattcgggcatctgtgggtgcaggcttcttataccctctcgtcggcacaatgtctactatgcctgggctcccaactcggccttgtttctatgacatagacctcgaccccgaaaccgagcaagtgaatggtttattctag

SEQ ID NO: 216074 - DNA, 1176 bp, Artificial Sequence
  Description of Artificial Sequence: Synthetic coding sequence
atgttctctccctggaagataagcatgtttctatcagttcgggaagatagcgtgccgacgacagccagtttctcggctgacatgctcaacgtgactttgcagggccctaccctgaacggaacttttgcacagtccaagtgcccgcaggttgagtggctgggctggctcaatactatccaacctcccttcttgtgggtattgttcgtgctggcaacactggagaatatatttgtcttatccgtcttctgcctgcacaaatcctcctgtacggttgccgagatctatctgggcaatttagctgccgcagacttgatcctggcatgtggactgccattctgggccatcaccatttctaacaactttgactggctgtttggagaaacgctatgccgcgttgtcaatgcaattatttccatgaatctgtactcctctatatgctttctgatgctagtgagcatcgatagatacctcgccctcgtgaaaactatgagcatgggacgtatgagaggagttcggtgggccaaactgtactccctggtgatttggggctgtaccttactcttgagcagcccaatgctcgtgttccggaccatgaaggaatatagcgacgaaggccataacgtgaccgcatgtgtcatatcctatccatccttgatttgggaagtgtttactaacatgctgctgaacgtcgtgggctttcttctgcccctcagcgtgataactttttgtacgatgcagataatgcaggttctgaggaacaacgaaatgcagaagttcaaggagattcagaccgagaggcgcgcaacagtccttgtgctggtggtgcttctcctctttatcatctgttggttaccttttcagatcagcaccttcctggacacattacatcggctgggaatcctcagctcttgtcaggatgagaggataatagatgtcattacgcagattgccagtttcatggcttattcaaattcctgtcttaaccccctggtctacgtgattgtgggtaaaaggtttcgcaagaagtcttgggaggtataccaaggggtttgccagaagggcggatgccggtccgaaccaatccaaatggagaacagtatgggaacactacggaccagtatctccgtggagagacagatccacaaactgcaggactgggctggatcaagacagtag

SEQ ID NO: 216075 - DNA, 1095 bp, Artificial Sequence
  Description of Artificial Sequence: Synthetic coding sequence
atgctcaacgtgaccctgcagggcccaactctaaatggaactttcgcccagagcaaatgccctcaggtggagtggctcggctggctcaacaccattcagcctccattcctctgggtcctgttcgtgttagcaactctggaaaacatcttcgttctctcagtgttctgtttacacaagagctcttgtactgtcgcagaaatttaccttggtaatctggcggcagcagatttaattctggcttgtggactgcccttctgggcaatcaccatcagcaacaacttcgattggctattcggagaaacactgtgccgcgtcgtgaatgctatcatctctatgaatctctactcgtctatctgctttctcatgctggtctccatagaccgctacttggctttggtcaaaacaatgtcgatgggacgcatgaggggcgtgcggtgggccaagctgtattccctggtcatctggggttgcacccttctgctgtcttcaccaatgctcgtgtttagaacaatgaaggagtactcagacgaggggcataatgttaccgcttgtgttatctcctatccatctctgatctgggaggtttttacaaacatgctcttgaatgtcgtaggattccttttgccactgtctgtgatcactttttgtacgatgcaaattatgcaggtgctgagaaacaatgagatgcagaagttcaaggaaattcaaaccgaaagacgcgctaccgttttagtgctcgtggtactgttgctgttcatcatctgctggctgccattccagatttcaacatttcttgacacactccaccgactgggtattctgtcatcctgccaggatgaacggatcattgatgtgattacacagatagcaagctttatggcttattccaactcctgcctcaatccactggtttacgtgattgtgggcaagcgattcagaaaaaaatcttgggaggtgtaccagggagtgtgtcagaaaggcggttgtaggtcagaacctattcagatggaaaactccatgggcaccctccggacatctattagcgtcgaacggcagattcataagctccaggactgggcagggtctagacagtag

SEQ ID NO: 216076 - DNA, 1095 bp, Artificial Sequence
  Description of Artificial Sequence: Synthetic coding sequence
atgctgaatgttacactacaaggtccgacgctgaacggcactttcgctcaatcaaagtgtccccaggtcgaatggctaggttggctaaacacaattcagccaccttttctttgggtgctattcgttctcgccacgctggagaatattttcgttttatcagtattctgtctgcataaatcatcctgcactgtggctgaaatatatcttggcaatctcgccgctgccgatctgattctggcatgcggcctgcctttctgggcaataaccatcagcaataatttcgactggctatttggggagaccctgtgcagagtggtgaacgccatcatcagtatgaacctgtattcctctatatgcttcctgatgctggtttctattgacaggtatctggctctcgtcaaaacaatgagcatggggagaatgagaggcgtgcgttgggcgaagctgtactcactagtgatctggggatgcacgctgctactttcttcgcctatgctggtgtttaggaccatgaaggaatactctgatgaggggcacaacgttacagcttgtgtcatctcctacccatctctcatctgggaggtgttcaccaacatgctgctaaatgttgtagggtttctgttgccactcagcgttatcacattttgtacaatgcagatcatgcaggtcctccggaataatgagatgcaaaagttcaaggagattcaaacggagcgaagggccacagttcttgtcctggtagtgttactgttgttcatcatctgctggctgcctttccagatcagcacttttctggacacccttcatagacttgggatcctgtccagctgccaggatgaaaggataatcgatgtgatcacccagatcgcctcctttatggcctactctaactcttgtttaaacccgttggtgtacgtcatcgtgggcaagcgcttccggaaaaaaagctgggaagtataccagggggtgtgccaaaagggcggatgtcggagcgagcccattcagatggagaactcaatggggacactccggacgtcaatctccgttgagagacagattcataagctccaagactgggctggtagtaggcagtag

SEQ ID NO: 216077 - DNA, 1176 bp, Artificial Sequence
  Description of Artificial Sequence: Synthetic coding sequence
atgttcagtccctggaagatttctatgttcctctcagtgagggaagatagcgtgcccactaccgcgagtttctcagccgacatgcttaatgtcaccctccagggccctaccctaaatggtacttttgcacagagtaaatgccctcaggtggaatggctcggctggctgaatacgattcagcctccattcctatgggtgcttttcgtcctggccactttggaaaacatcttcgtgttgtcagtattctgtctccataaatcctcttgcacagtggccgagatctatctggggaacttggccgctgcagacctcatcctggcttgtggcttgcctttctgggccattactatttccaataacttcgattggctttttggcgagactctctgtagagtcgtaaacgcgattatcagtatgaatctgtactcctcgatctgcttcttgatgcttgttagtattgacaggtaccttgctctggtgaaaaccatgagcatgggtcgcatgaggggcgtgcggtgggccaagttgtattccctcgtgatctggggttgtacacttctcttgagttctccaatgctggttttccgtaccatgaaagaatactccgacgaggggcacaatgtcaccgcgtgcgtcatttcatacccgagtctgatctgggaagtgttcaccaacatgttgctgaacgtagtcggttttctattgccccttagcgtcataacattttgcactatgcaaatcatgcaagtgctgcggaacaacgagatgcagaagtttaaggaaatccagacggaacgcagagccactgtgttggttctcgtggtcttgctgttgttcattatttgttggcttccctttcagatatcaacatttcttgacacgctccatagattgggcatactcagttcatgccaggatgaacgtattatcgacgtgattacacagatagcgtctttcatggcatacagcaatagttgcctcaatcctctggtgtacgtgattgtcggcaagcgcttcaggaagaagagctgggaagtgtaccagggtgtttgccagaaaggtggttgtcgtagcgaaccaattcagatggagaattctatgggcactctgcgtacctctatttcagtggaacggcagatccacaaactgcaggattgggccggaagccggcagtag

SEQ ID NO: 216078 - DNA, 684 bp, Artificial Sequence
  Description of Artificial Sequence: Synthetic coding sequence
atgggaggtaaactctcaaagaagaagaaaggctataacgtgaacgatgagaaggctaaagagaaagacaaaaaggccgaaggcgctgccactgaggaggaaggtacacctaaagagagcgagcctcaggcggcagcagaacctgccgaagctaaagaggggaaagagaagccagatcaagacgccgaggggaaagctgaggaaaaagagggagagaaagatgctgccgctgcgaaagaagaggctcctaaggccgaaccggaaaagacagagggagccgcagaagccaaggctgaaccgccaaaagcacctgaacaggaacaggctgcccctggaccagccgctgggggtgaggctccgaaagcagcggaggccgcagctgctccagcagaatctgcagcgccagccgctggagaggaaccaagtaaggaggagggggaacccaagaaaacggaggctccagcggctcctgccgctcaagaaaccaagtccgatggagcccctgcctcagactctaaacccggaagctcggaggcagccccatcttctaaggagacaccagctgccacagaagccccaagcagcacacccaaggcccagggacccgcagcctccgcagaagagcccaagcctgtggaggcacctgcagcgaactccgatcagacagtgaccgtgaaagagtag

SEQ ID NO: 216079 - DNA, 522 bp, Artificial Sequence
  Description of Artificial Sequence: Synthetic coding sequence
atggggggtaagttaagtaaaaagaagaaaggctacaacgtcaatgatgagaaagccaaagagaaagataagaaggctgagggtgctgcaacagaggaggagggcactcccaaggaatctgagccacaggccgcagccgaacccgcagaagcaaaggaaggaaaagagaagccagatcaggatgcagaaggaaaggctgaagaaaaggaaggcgagaaggatgccgctgctgccaaggaagaagccccaaaggccgaacctgataaagaggagggggaaccaaagaaaactgaggcccctgccgctcccgctgcccaggaaaccaaaagtgatggtgctcctgcttccgatagcaaacctgggagctctgaagcggctccttcgagcaaagagaccccagccgcaacagaggctcccagctctaccccgaaagcacaggggcctgcggctagcgcagaagaacccaagcctgtcgaggcgccagctgctaactcggaccagacagtcactgttaaggagtag

SEQ ID NO: 216080 - DNA, 543 bp, Artificial Sequence
  Description of Artificial Sequence: Synthetic coding sequence
atggggtgtggaggtagcagagcggacgcgattgaaccgagatactacgagtcctggacccgggaaaccgaatcgacctggttaacctatactgattcagacgctccccctagtgctgctgcaccagacagtggacctgaggccggtggattacactcggtgttggaagctgagaaatccaagattaaagcgccaacagactctgtgagcgatgaaggcctcttctccgcatccaagatggcgccactcgctgtgttctcacacggaatgctggaggacgggctccctagcaacggagtcccaagaagcacagccccaggcggtatcccaaaccctgaaaaaaagaccaactgcgaaacccagtgtcctaacccccagtctctctcctctggcccactgacccaaaaacagaacgggctgcaaacaactgaagcaaaacgcgacgccaagaggatgccagcaaaggaagttacgattaacgttaccgatagcattcaacagatggaccggtcacggaggataaccaaaaattgcgttaactag

SEQ ID NO: 216081 - DNA, 438 bp, Artificial Sequence
  Description of Artificial Sequence: Synthetic coding sequence
atggggtgcggaggtagtagagccgatgcaatagagccgcgatattatgagtcctggacgcgcgaaaccgagtctacatggctcacttataccgacagcgacgccccaccaagtgccgcagcgcctgacagcggtccagaggcgggagggttacatagtggcatgctggaagacggactgccttcaaacggcgtccccaggagtaccgcgccagggggaatccccaaccccgagaaaaaaaccaattgcgagactcagtgccctaacccacaaagcctgagttcaggtccgctcactcagaaacaaaacggactccagactaccgaggccaagcgggacgcgaagaggatgcctgccaaagaagtgactataaacgtaaccgattctatacaacaaatggatcgatccagacggatcactaagaattgtgtgaactag

SEQ ID NO: 216082 - DNA, 165 bp, Artificial Sequence
  Description of Artificial Sequence: Synthetic coding sequence
atgggatgtggtggcagtagagctgacgcaatagagccgcgatactacgagtcatggaccagagagactgaaagcacatggctgacatacactgactcagatgctcctccctctgcagctgccccagactccggaccagaagctggcggtctccatagtggctag

SEQ ID NO: 216083 - DNA, 387 bp, Artificial Sequence
  Description of Artificial Sequence: Synthetic coding sequence
atggagtctaaggaggaacgcgcactgaataatctcatcgtggagaatgtaaatcaagagaatgatgagaaagatgagaaagagcaagttgccaataagggagagcctcttgcccttcctcttaacgtctcagagtactgcgtgccaagaggcaacaggagaagatttcgggtgcggcagcccatcctccagtaccgttgggacataatgcatcgtttgggcgagcctcaggcccgtatgcgagaggagaacatggagagaatcggtgaggaagtacgtcaactgatggaaaagttgcgggaaaagcagctcagccactcactgagggccgtgtccactgatcccccacatcacgaccatcatgacgagttttgcttgatgccatag

SEQ ID NO: 216084 - DNA, 387 bp, Artificial Sequence
  Description of Artificial Sequence: Synthetic coding sequence
atggaaagcaaggaggagagggcattgaacaatctcatcgtcgaaaatgtaaaccaggaaaacgatgaaaaagacgagaaggagcaagtcgcaaacaagggggaaccactcgccctcccgctgaatgtgtctgagtattgtgtgccaagaggcaatagacgccgttttcgagtccggcaaccgatcctgcaataccggtgggacattatgcaccgtctgggtgagcctcaggctcgtatgcgggaagaaaacatggagcgcatcggagaagaagtgaggcaactcatggagaaactgcgcgaaaagcagctgagtcatagcctgagggccgtgtccaccgacccccctcaccatgaccaccatgatgaattctgtctgatgccttag

SEQ ID NO: 216085 - DNA, 306 bp, Artificial Sequence
  Description of Artificial Sequence: Synthetic coding sequence
atggaatccaaagaggagagagccctgaataatcttatcgtcgagaacgtgaaccaggagaacgatgagaaggatgagaaggaacaggtcgccaataagggggaaccactcgccctccctctaaatgtaagcgagtactgtgtgcccagggggaatcgccgaagattcagggtaagacagcccattttgcagtaccgttgggatataatgcaccgactcggcgaaccccaggcacggatgagggaggagaacatggagcggatcggggaagaagttagacaactcatggaaaagctgcgtgaatag

SEQ ID NO: 216086 - DNA, 483 bp, Artificial Sequence
  Description of Artificial Sequence: Synthetic coding sequence
atgcagaaaatggttgtgtgcggagcaaagtgctgcggagacgctcctcatgttgaaaatcgggaggaggaaaccgctagaattggacctggggtgatggaatccaaggaagagagagccttgaacaacttaatagtcgagaacgttaaccaggagaacgacgaaaaggatgagaaagagcaggtcgccaacaagggcgaacccctggcactcccactgaacgtcagcgaatattgtgtgcctcgcggtaaccgaaggagatttagggtcaggcagccaatattgcagtaccgctgggacatcatgcacagattaggagaaccccaagccaggatgagggaggagaatatggagcgcatcggtgaggaagtgaggcagcttatggagaagctgcgtgaaaagcagctttctcacagcctccgggcagtttcaactgacccaccacatcatgaccaccatgacgaattttgtttaatgccttag

SEQ ID NO: 216087 - DNA, 378 bp, Artificial Sequence
  Description of Artificial Sequence: Synthetic coding sequence
atggaaagcaaagaaaagcgcgctgtaaacagtctctcgatggagaacgccaaccaggaaaacgaggaaaaggaacaggtggcaaacaagggagaacccctagcactgcctctcgatgcgggtgagtactgcgtgcccaggggaaacaggagaagatttcgcgttcgacagcccatactgcaataccgctgggacatgatgcaccggttaggcgaaccccaggcaagaatgcgtgaagagaatatggagcgcattggtgaagaggtgcgacaattaatggaaaaactgcgcgagaaacagctgtctcattccctgagggcagtcagtacagatccacctcaccacgatcaccatgacgaattttgcctcatgccctag

SEQ ID NO: 216088 - DNA, 363 bp, Artificial Sequence
  Description of Artificial Sequence: Synthetic coding sequence
atggaatctaaggaggagttagcagccaataatctcaacggcgaaaatgcccagcaggaaaacgaaggcggtgagcaagcccctacccaaaatgaggaagagagtaggcacctcggcggtggtgaagggcagaagccaggcggaaatattagaagagggcgagtacgaagactcgtgccaaacttccgttgggcgattcccaataggcacatcgagcataacgaggctcgggatgacgtggagcgttttgttgggcagatgatggagataaagaggaaaacaagagagcagcagatgcgtcattacatgcggttccagacccccgaacccgacaatcactatgacttctgtttgatcccttag

SEQ ID NO: 216089 - DNA, 363 bp, Artificial Sequence
  Description of Artificial Sequence: Synthetic coding sequence
atggagtcaaaggaggagctcgccgctaataacctgaatggtgagaatgcccagcaggaaaacgaggggggagagcaggcccctacacagaatgaggaagaatcaagacacttaggcggaggggaaggacaaaaacccggtggaaacattcgaagagggagagttagacggctcgtgcccaatttccgctgggctattccaaacagacatattgagcacaacgaagccagagatgatgttgaaaggttcgtcggacaaatgatggagattaagcggaagacccgggaacagcagatgcgccattacatgagattccaaacacccgaacctgacaaccattatgatttttgtctgattccatag

SEQ ID NO: 216090 - DNA, 336 bp, Artificial Sequence
  Description of Artificial Sequence: Synthetic coding sequence
atggagaatgttcccaaggagaacaaggtcgtggagaaggcccctgtccagaacgaagcacctgcactggggggaggggagtatcaggagccagggggtaatgtgaagggggtgtgggcacctcccgctcctgggttcggggaggacgtcccaaacagactggtggataacatcgacatgatcgacggcgatggggatgacatggagagattcatggaggagatgcgagaacttcgaaggaagataagagaacttcagctcagatactcactgagaattctgatcggagatcctccacaccatgatcaccacgacgaattttgcctgatgccttag

SEQ ID NO: 216091 - DNA, 336 bp, Artificial Sequence
  Description of Artificial Sequence: Synthetic coding sequence
atggagaacgtgcccaaagaaaacaaagtggtggagaaggctcctgtacaaaatgaagctcctgccctggggggaggagaataccaggagccgggagggaatgtgaaaggtgtctgggctcctcccgcacctggattcggagaagatgtcccaaatcggctggtggataacatcgacatgatcgatggcgacggggatgatatggagaggtttatggaggaaatgcgagaacttcgcaggaagattagggagcttcaactgcggtacagcctgaggatcttaatcggagatccgcctcaccacgaccaccatgacgagttctgccttatgccttag

SEQ ID NO: 216092 - DNA, 378 bp, Artificial Sequence
  Description of Artificial Sequence: Synthetic coding sequence
atggaccataagccattattacaggagcgcccacccgcttataacttagaggcaggccaaggcgactatgcctgcgggccacacggatatggtgctattccagccgcacctccacctcccccatacccctatctggtgactgggattccaacacaccacccccgagtctacaatatccactcccgcacagtgaccaggtatcccgcaaatagtatcgtcgtggtgggaggatgccctgtgtgccgggttggtgtgctggaggattgttttaccttcttgggcatttttctagccattattctgttccccttcgggtttatctgctgttttgccctgagaaaacgcagatgtccaaattgcggagcaactttcgcgtag

SEQ ID NO: 216093 - DNA, 297 bp, Artificial Sequence
  Description of Artificial Sequence: Synthetic coding sequence
atggaccacaaaccactcctgcaggaaagacctcccgcttataatttggaggctggtcagggtgattacgcatgtggccctcacggttatggtgccattcccgcagcaccccctccacctccatacccttatctggtgaccggaattccgacccaccatcccagggtctacaatatccactccaggaccgtgacacggtaccctgctaattccatagtcgtggtgggcggttgccccgtatgtcggcatcagcggagcagttggctatacacctacccactcagggtctgtacgtag

SEQ ID NO: 216094 - DNA, 1536 bp, Artificial Sequence
  Description of Artificial Sequence: Synthetic coding sequence
atgtcacgcggtccagaggaggtaaataggctcacagaatctacataccgcaacgtcatggagcagttcaatcctggattgaggaatctcattaatctcggcaagaactacgagaaggctgtcaatgccatgatcctcgcaggtaaggcttactacgacggtgtggccaaaattggtgaaattgccacgggtagccccgttagcacggagcttggtcacgtgctgatcgagatcagcagtactcacaagaaattgaacgaatcattagacgaaaatttcaaaaagttccataaagaaattattcacgaactggagaagaagatcgaattggatgtcaagtacatgaacgcaacccttaagcgctaccagaccgagcacaaaaataagcttgaaagcttggagaaaagccaggctgaactcaaaaagattcggaggaaaagccagggatcgcgtaatgcactgaaatatgagcataaagagatcgagtacgtggaaactgtgactagcaggcagagcgagatacaaaaattcatcgccgacggatgtaaagaagcactgcttgaggagaagagaagattctgcttcctggtggataagcattgtggatttgccaaccatatacattactatcacctccagtccgcagaattgctgaactctaaacttccacgctggcaagagacttgcgttgatgccatcaaagtgcccgagaagatcatgaacatgatagaggagattaaaacccccgcatctacaccagtgtctgggaccccacaggcgtctccaatgattgagaggtcaaatgtggtgcggaaggactatgatacacttagtaaatgttctccaaagatgccccctgctccctccggacgcgcttacacctctccacttattgatatgttcaataatcctgccactgcagctcctaacagccagagggtgaataattcaactgggacctccgaagaccctagccttcagcggtccgtaagtgtcgccactggcctgaatatgatgaagaaacagaaagtaaagaccatttttccccacaccgctggctcaaataagacactgctttcctttgcccagggggacgtcatcacacttctgatccccgaagagaaggatgggtggttgtatggtgagcacgacgtgagcaaggctcggggatggtttccttcatcatacacaaaacttctggaagagaacgagaccgaagcagttacggttcctaccccgtcccctaccccggtgcggtccatctctaccgtcaatctgtcggagaactcctccgtggttatcccgcctcctgattatctggaatgcctgtcaatgggagcggcagcagatcgtcgagcagactctgccagaaccacttccacttttaaggcccctgcttccaagccagagactgccgctcctaatgatgcaaacggcactgccaagcctcccttcctctcaggcgagaatccatttgcaaccgtcaaacttcgcccaactgtaacgaacgaccgatctgctcccataataagatag

SEQ ID NO: 216095 - DNA, 4656 bp, Artificial Sequence
  Description of Artificial Sequence: Synthetic coding sequence
atggaaaacactggttggatgggcaagggtcataggatgacccctgcttgccctctactcttatccgttatcctgtcgttgcgcctggcgacggcctttgacccggctcctagtgcttgctctgctctggctagcggagtgctgtacggcgcttttagcctacaagatcttttccccaccatcgcctctggttgctcctggacactggagaaccccgacccgacaaagtatagtctgtatctgcgtttcaatagacaagagcaggtgtgtgcgcatttcgcccctcgcctgctgcctctggaccactacttggtcaattttacgtgtctcaggccaagcccagaggaagccgtcgcacaagctgaaagcgaggttggaagaccggaggaggaagaggccgaggcagccgcaggtcttgagctctgcagcggttcaggcccattcacttttctgcatttcgacaaaaacttcgttcagctctgcctcagtgcagagccttcagaggctccgcgactcttggcacccgctgctttggcattcagatttgtcgaggttctgcttattaacaacaataatagctcccaatttacttgtggcgtgctttgtcggtggtcagaagagtgcggcagagccgctggtcgggcttgcggtttcgcccaacccggttgctcttgtccaggcgaagctggcgctgggagcactactaccacctctccaggaccgcctgccgcacataccttgtctaacgcccttgtgcccggaggtcctgccccaccagcagaggcggacctgcacagtggatctagcaatgatctctttacaactgaaatgaggtatggtgaggaacctgaggaagagcctaaggtcaaaacgcaatggcccaggtccgcggatgaacccggtctctacatggcacagacaggcgaccctgccgctgaagaatggtcgccttggtctgtgtgtagccttacgtgcggtcaaggcctccaggtgcgaacaagatcttgtgtttcatctccttacggcacgttgtgctcaggtccactgagggaaacgcgcccatgtaataattctgccacatgtccagtgcacggcgtatgggaggagtgggggtcatggtccttgtgctcccgcagctgtggtcgtggttcccgctccagaatgcggacgtgcgtcccaccgcaacatgggggaaaggcatgcgaaggccctgaattacagaccaaattgtgttccatggctgcttgtcctgttgagggtcagtggctggagtgggggccttggggtccatgtagcacatcgtgtgctaacgggactcaacagaggtcaaggaagtgttcagtggccggaccagcctgggcaacatgcaccggcgcattgactgacacacgggagtgctctaatttggagtgccccgcaaccgacagcaagtggggcccatggaacgcctggagcttgtgttccaagacatgcgacacaggatggcaacgaagattccgaatgtgtcaggcgactggcacacaaggctatccatgcgagggtactggggaggaagtgaagccgtgcagcgagaaaaggtgcccagcttttcacgagatgtgtagagacgaatatgtgatgttgatgacctggaagaaagcagcagctggtgagatcatttacaataaatgcccacctaatgcatccggttctgcctcccgccgatgtctcctgtctgctcagggcgtggcgtattggggcctgccgtcttttgccagatgcattagccacgagtataggtatctgtacctctccctgagggaacacctggctaaagggcaacggatgctagctggtgagggaatgtcacaggtggtgcgctccttgcaggaactactagcgcgacggacttactactccggggacttactcttcagtgtagacatcctacgcaatgtgacggatacatttaaacgggctacctacgttccatccgcagatgatgtgcagaggtttttccaagtagtctcattcatggttgacgctgagaacaaggaaaagtgggatgatgcacagcaagtctctcccggatctgtgcatcttctcagagtcgtggaagactttattcatctggtgggtgatgctctgaaggcatttcaatcctccctgattgtgacagataatctggtaattagcatccaaagggagcccgtttccgcagtttcctcggacatcacctttcctatgcgaggaagacgaggaatgaaggattgggtgcgccactccgaagatcgtctgttcctaccaaaggaggttctgagcctcagcagccctggtaaaccagcaacatccggtgcagctgggtcccccggacgaggccgagggccaggcaccgtgcctccaggaccaggccatagtcaccaacgcctgctacctgcggacccagacgaatcaagctatttcgtcatcggagctgtcctgtatcgtactttgggtttaattcttcctccgcctcgcccacccttagccgtgacatcaagagttatgaccgtcactgtcagaccaccaacccagccccctgcagagcccctcattaccgtggagctcagctacatcatcaatggaactacagatccccattgcgcatcatgggattactccagggcagacgcttcttcaggcgactgggataccgagaactgtcaaactttggagacccaggcagcccacactcggtgtcagtgccagcatttatctacattcgccgtgttggcccagccacccaaggacctcaccctagagctcgccggaagcccatctgtgcctctggtgattgggtgtgccgtgtcttgcatggcacttcttaccctgctggccatatatgcggctttttggaggtttataaagagcgaacggtccatcatcttactgaatttctgtctgagtatacttgccagcaacattctcatcctggttggacagagcagggttctctccaaaggagtctgcacaatgactgctgccttcctacacttcttttttctgagctccttctgttgggtgcttaccgaggcctggcagagctacttggcggtgattgggcgaatgcgaaccagactcgtgcgtaagagattcctctgcctgggatggggcctgcccgctctggtggttgcagtgtctgttggcttcacgaggacaaagggctacggcacctcttcgtactgttggctgtctttggaagggggactattgtatgccttcgttgggcctgccgctgtgatcgtgctagtcaatatgctgatcggcatcatcgtctttaacaagttgatggccagggatggcatctcagataagtcaaaaaagcagagagccggtgcatctctgtggtcatcttgtgttgttctgcccctcctggctctgacctggatgtccgccgtcctcgcaatgaccgataggagaagcgtgctgttccaggccttgttcgcagtattcaactccgcacaaggatttgttataaccgccgtccactgtttcctacgtcgtgaagttcaggatgtggtgaaatgccaaatgggagtctgcagagccgacgagtctgaagattctcctgatagttgcaagaatggtcagctccaaatactcagcgattttgaaaaggatgtggacctagcatgccagaccgtcttgttcaaagaggttaatacctgcaaccccagtacaatcaccggtacgctcagcagactaagcttggacgaggacgaggaacctaagtcctgcctggtggggcctgagggttctctgtcattcagccccctgccaggcaatatcctggtgccaatggcggcaagcccgggacttggggaaccccctccccctcaagaagccaatccggtgtatatgtgcggcgagggtggcctgcggcagctggacctgacgtggctgcggcctactgagccaggctccgagggcgactacatggttctgcccagacgaacattatctttgcagccagggggtggcggaggtggaggtgaggacgcccctagagccaggccggagggcacgcccagacgggcagccaaaaccgtggctcacacagaaggataccccagtttcctcagtgtggatcactctggtcttggcctcggacctgcttatggatctctccagaacccctatggcatgacctttcagcccccacctcctacaccatcggcgaggcaggtgcctgagcctggtgagcgttcccgcacaatgccaaggacagtgccgggtagcacaatgaaaatgggcagcttagagcgcaaaaagctcagatattctgacctggattttgaggttatgcacacacgaaagcgccattctgagctttaccacgagcttaatcagaaatttcacacgtttgacaggtatcgaagtcagtcaactgccaagcgcgagaagcggtggtcagtgtctagcggaggcgcagctgagcgctccgtgtgtaccgataagccctccccaggtgaacgcccaagcctgtcccagcacaggcgccatcaatcctggtccaccttcaaatccatgacgctcggaagcctgcccccaaagccacgcgaaaggcttaccctacatagagctgccgcttgggaaccgaccgagccacctgacggcgactttcagacagaggtttag

SEQ ID NO: 216096 - DNA, 4755 bp, Artificial Sequence
  Description of Artificial Sequence: Synthetic coding sequence
atggagaatactggctggatgggaaagggccaccgcatgacccccgcatgccctctcttgctttctgttattctgtccctcagacttgcgactgcgtttgatcccgctccctcagcatgtagcgcactcgcctccggagttctgtacggcgcatttagtctccaagacctgttccccacgatcgcatccgggtgctcttggacactcgagaatcccgaccctacgaagtacagcttatacttgcgctttaacagacaggagcaggtttgcgctcacttcgctcccagactccttccgttagatcactatctggtgaactttacctgtctgagaccgagtccagaagaagcagtggctcaggcggagtccgaagtgggcaggccagaagaggaagaagcggaagcagccgctgggctggagctttgctccggcagcggtccttttacctttctgcacttcgataaaaatttcgttcaactctgcttaagcgcagagccctcagaagccccaaggttattggcaccagcagcattggctttcagatttgtcgaagtactgcttataaacaacaataacagctcccagttcacttgcggtgtgttatgccggtggagcgaggaatgcggaagggcagccggacgcgcatgtggcttcgcccagcccggttgttcatgtcccggagaggcgggagccggatcaaccacaactacttctcctgggcctccagctgcccataccctgtccaacgctctggtgccaggcggacccgcaccaccggcagaggctgacctgcactctggttcttctaatgatctgttcacaactgagatgcgatacggcgaggagcccgaagaggagcccaaagtgaaaacccagtggccccgtagtgccgacgaacccggactatacatggcccagacaggagacccggcagctgaggagtggtccccctggagcgtgtgctcactcacttgtggccagggactccaggtgcgcacccgttcgtgcgtctctagcccttatggcaccctgtgcagtggacccctcagagagactagaccgtgcaataacagtgccacctgtcccgttcacggggtgtgggaagaatggggtagttggtctctgtgtagtcggtcgtgtggtcgaggaagtcgctcacggatgaggacttgcgtacctccacagcacggcggaaaagcttgtgaaggccctgagttgcaaaccaagctctgttcaatggcggcttgccctgttgaaggccaatggctggagtggggaccgtggggcccatgcagcacatcctgtgccaacggcacacagcaaagatccagaaagtgctcagtggctggtcccgcatgggctacttgcaccggggctcttactgacacaagagagtgctcaaacctcgaatgtcccgctacagactccaagtggggcccatggaatgcttggtcactatgtagtaaaacctgtgatacgggatggcaacggaggttccgcatgtgccaagccaccggcacacagggctatccctgcgaaggtaccggagaggaagtaaagccttgtagcgagaagaggtgccctgcattccatgaaatgtgtagggatgaatacgttatgctgatgacatggaagaaagcagctgctggcgagatcatctacaataagtgtccccctaatgctagcggcagtgccagcaggagatgtcttctgtccgcacagggcgtggcttattgggggctgcccagtttcgctcgctgtatctctcatgaatatcgctacttgtacctgagtctgagggagcacttggctaaggggcagcgaatgctggccggagaggggatgagccaggtggtccggtcactccaggaactgctggcgagaagaacatactattccggcgacctgttattttctgtggatattctgcggaatgtgacagatacctttaaaagagccacctatgtcccaagcgccgacgacgtgcagcgcttcttccaggttgtgtcatttatggtggatgctgaaaacaaggaaaaatgggatgatgctcaacaggtgagtccgggttctgtccacctgctgcgtgttgtagaggattttatccatctcgttggcgatgctctcaaggctttccagtcttcactcattgtgacagataatctcgtcatcagcatccagcgcgagcccgtgagtgcggtttcatccgatataacgttccccatgagagggaggaggggtatgaaagattgggtcaggcattccgaggaccgcctgttcctaccaaaagaggtgctgtcactttccagcccgggtaagcccgctacttcaggtgccgcaggctccccagggaggggaagggggcctggtaccgttccacccggacccggtcattctcaccagcggttattacctgcggatccagacgagagcagttacttcgtcattggggcagtgctataccgcacactgggcctgatcttgccaccacccagaccgccactggcagttacctctagggttatgaccgtcacagttcgccctcccactcagcccccagcggagcccctcattaccgtggagttatcctatattataaacgggacgactgatccacactgcgcaagctgggactattctagggcggacgcatcttccggtgattgggatacagagaactgtcagaccctggagacccaggcggctcatactaggtgccaatgccagcacctgtctacctttgccgtgcttgcgcagccccctaaggatcttactctggagctggctggatcccctagcgtccctttagtcataggatgtgcagtatcctgcatggctctcctcaccctgttagccatctacgccgcattctggcgttttatcaagtcagagaggtcaatcatcctgttgaacttctgtctctctatccttgcatccaatattctcatccttgttggacaaagccgggtgctgagcaaaggtgtgtgcacgatgaccgctgccttcctgcacttctttttcctgagttccttctgctgggtactgaccgaggcgtggcagtcttatctcgctgtcatcggcagaatgcggacgcgcttagttcggaaacgttttctttgtctcgggtggggtttgcccgcattagttgtggctgtgtcagtgggttttacacgtacaaagggctatggaacaagctcatactgttggctttccttggaaggtggattactctatgcattcgtgggacccgcagctgtaattgttctggtcaatatgctgatcggaatcatcgtattcaacaagctcatggcacgcgacggcataagcgacaagagtaagaaacagcgcgctggatctgaacgttgcccctgggccagcctgctcctcccctgcagcgcctgtggcgcagtgccgtccccactcctgtcttcagcctccgccagaaacgctatggctagcttgtggtctagctgtgttgtcctcccactcctggcactaacatggatgtcagcagttctggctatgacagaccggagaagtgtactgtttcaagctttgttcgcggtgtttaactccgcccagggcttcgtgatcaccgccgtccattgcttcctgcgtcgggaggttcaggatgttgtcaagtgtcagatgggcgtttgcagggcagacgaatccgaggacagcccagatagctgtaagaatggtcagctccaaatactctccgattttgaaaaggacgtggatctggcatgtcagaccgtcttattcaaggaggtgaacacatgtaatccatccactattaccggaaccttgagtcgcttgtccttagacgaggacgaggagcccaagtcctgtctggtcgggcctgagggttccctgagtttcagtcccctgcccggtaacattcttgtgcctatggcagccagtccgggactcggggaaccgccacccccacaggaagcaaacccagtgtacatgtgtggagaagggggtctccgacagctggacctaacatggctgagaccgactgaacctggctcagagggggactacatggtactccctcgcaggaccctctccctccagcccggaggaggcggtggcggaggggaagatgcccctagagcaagacctgagggcaccccacgtcgggctgccaaaaccgttgcccatactgaggggtacccatctttcctttctgtggatcactccggcttaggcctcggtccagcttacggttctctgcagaacccatatggtatgactttccagcctcctccccctaccccatcggccagacaggtgcctgaaccaggcgaaagaagtcgcacaatgccacggaccgtgccaggctccacaatgaaaatggggtcactggaacgaaagaaactgcgctattccgaccttgacttcgaagttatgcacaccagaaagcggcactcagagctctatcatgaactcaaccagaaatttcacacatttgaccgttacaggtcacaatctaccgcaaaacgtgaaaagagatggagtgtctcttcggggggagctgcggagcgttccgtgtgcaccgataagccctctccaggcgaacgaccctcattatcccagcacagaaggcaccagtcatggtcaacttttaagtcaatgacattgggttcactgccacctaaacccagggaaaggcttacattgcacagggccgcagcctgggaaccaaccgaacctcctgatggagacttccagaccgaagtttag

SEQ ID NO: 216097 - DNA, 4758 bp, Artificial Sequence
  Description of Artificial Sequence: Synthetic coding sequence
atggaaaatactggttggatgggcaaaggtcacagaatgactccagcctgccccctactgttgtcagtaattctttccttgcgacttgctactgcctttgaccctgccccaagcgcatgcagcgccctcgcatcaggcgttctatacggggcattctccctgcaggatttgtttccaactatcgcatctggctgttcctggaccctcgaaaacccagacccaaccaagtacagcctgtacctgagattcaaccgccaagagcaggtttgcgcacattttgccccaaggttactgccgttagaccattatcttgtgaactttacttgcttgaggccctctcccgaagaagccgtcgcccaggctgagtctgaagtaggtagacccgaagaggaagaagcggaggcggcagcaggcctggagctgtgctccgggagcggcccatttactttcctccattttgacaagaacttcgtgcagctctgcctgtctgccgagccttccgaagcccctcgactactggccccagccgcactagcatttcggttcgtggaagtcctgctgattaataataacaacagttcccaattcacttgtggcgtgctctgcaggtggagtgaagaatgcggtagggccgcaggaagggcttgtgggttcgcccaacctggctgttcatgccccggtgaagccggagctggaagcaccaccacaacatcaccgggtcccccagccgctcacacattatcaaatgctctggtcccagggggacctgctccccctgcagaagctgatctgcatagcgggtccagcaatgaccttttcaccaccgaaatgcgatatggagaggagcctgaggaagaaccaaaggtgaagactcagtggccgcgtagtgccgacgagcccggtctttatatggcacagaccggggaccccgctgctgaggagtggtccccttggagtgtgtgcagtctaacatgcggacagggtctacaagtccgcacgcgctcctgtgtatcatccccttacggtactctttgcagcggcccactgcgcgaaacaagaccatgtaacaactctgctacatgtccagtgcacggcgtttgggaagaatgggggtcatggtcgttgtgttcacggagctgcggcagaggcagccgcagccgcatgagaacgtgcgtccctcctcaacacggcggtaaagcctgcgagggtccagagctgcagactaagctctgtagtatggccgcttgcccagttgaggggcagtggctcgagtggggcccatggggcccatgcagcactagttgtgccaatggcactcagcagagatcaaggaagtgctccgtggcagggcctgcatgggccacatgtactggtgcgctcacggacactagagaatgctcaaatctggagtgccccgcaacagattctaaatggggcccttggaacgcgtggagtctgtgtagcaaaacttgcgatacaggctggcaacgcaggttcagaatgtgtcaggccactggtactcaggggtacccatgcgaaggaaccggagaagaagttaaaccctgctccgagaagaggtgtccagcttttcacgaaatgtgccgtgatgaatacgtgatgctgatgacttggaagaaagcggcagcaggtgagatcatttataacaaatgtccccctaatgcaagcgggagcgcttcccgccgatgcctgctctcagcacaaggcgtcgcatactgggggcttcccagtttcgccagatgcatatcacacgaatatcgttatctttatctcagcctgagggaacacctggcgaaggggcagcggatgcttgcgggagagggaatgtctcaggtcgttcgctccttgcaggagcttctggctcgccgaacctattatagtggcgatctgctcttcagcgtggatatcctgcggaacgtcacggatacgttcaagcgagccacctacgtccccagcgctgacgacgttcagcgattttttcaggtagtgagcttcatggtggatgcagagaataaagagaagtgggacgatgcccagcaagtttcccctggatcggtgcacctattgcgcgtggtggaggactttatccacctggttggtgacgctctgaaggccttccagtcctcgctcattgttaccgataacctggtgatttcaatacagagggaaccagtttctgcagtttcttcggatatcactttccctatgcgtgggagacggggaatgaaagattgggtgcgccatagtgaagatagactcttcttgcccaaggaagtactttcgctttcttctcccggaaagcccgctacctccggcgcagctggaagccctggccgaggacgaggccctggcaccgtgccccctggaccaggtcattcccatcagagacttctgcccgcagaccccgacgagtccagttactttgtgattggtgcagtcttgtaccggacgctgggcttgatcctccccccaccacgcccacctcttgctgttacctctagagtgatgaccgtcactgtacgccctccaacgcaaccgcctgcggagcccctaatcactgtggaactgtcatatataattaacgggactactgacccacactgtgcctcctgggattacagcagagccgatgcatcttctggcgattgggacaccgagaattgccagaccctggagacccaggccgctcacacacgctgtcaatgccagcatctgtccacctttgcagtgctcgctcagcctcccaaggacctcactcttgaacttgccggtagtcccagtgttcctctggtgatcggctgcgccgttagttgtatggcactcctgacgttattggccatctacgccgctttttggagattcataaaatccgaaagatctatcattctcctgaacttttgcttgtctatcctcgcatccaatatcttgatcctggtaggccagtcacgcgttctgagtaaaggggtgtgtaccatgaccgcagcctttctccattttttctttctcagcagtttctgctgggttttaaccgaggcttggcagagctatctggcagtgatcggcagaatgagaacacggcttgtccggaagagatttctttgcctggggtggggactgccggcactggtggtggccgtctctgtgggctttaccaggactaaggggtatggaacttcatcctactgttggctgagccttgagggtggtttgctttacgcatttgttggcccagctgctgtcattgttcttgtcaacatgcttattggcattatagtgttcaataagctcatggccagagacggtatatccgataagtcaaaaaagcagagagctggctccgaacgctgtccatgggcctctctgcttctcccatgcagcgcctgcggagccgtcccatcccccctcctgtcttccgcgtccgccagaaatgctatggcttccctgtggtcatcatgcgttgtgctcccccttctggctctgacctggatgagcgccgttctggctatgacagatcgtcggtccgtcctttttcaagcattattcgccgtctttaactctgctcagggattcgtgattaccgctgtgcattgttttttaagaagggaagtccaggatgtcgtaaaatgccagatgggtgtctgccgtgccgacgagagcgaagactcccctgactcatgtaaaaatggacaattgcaaatactgtctgacttcgaaaaagacgtggacttagcctgccagactgtcctgttcaaggaggtgaacacttgtaatccctcgaccattaccggcaccctgagcagactgagcctggatgaggacgaggagcctaaatcctgcctggtaggccctgagggctcgctgtcctttagcccactacctgggaatatcctggttccaatggctgctagtccgggtttgggtgagcctccaccaccacaggaggccaatccggtctatatgtgtggagagggcggactgagacagttggatttaacatggctccggccaactgagcctgggagtgagggagattatatggtgttgcctagacgcacactctccctgcagcccggtggtggtggcggaggcggagaggatgcccctcgtgcaagacctgagggaacgcctagaagagctgctaaaaccgttgcacacacagaaggatatccctctttcctttccgtcgatcattctggtctgggtctcggcccagcttatggatccctccaaaatccgtacggtatgacttttcagccaccaccaccaacaccctctgccagacaagtgcctgaaccaggggagcgaagccgaactatgccacggaccgttccaggaagtactatgaagatgggtagcctcgagaggaagaaattaaggtattccgacctcgactttgaaaaggtcatgcacaccaggaagcgacactcagaactgtaccatgaacttaaccagaaatttcatacttttgaccgataccgatcccagagcactgccaagcgtgagaaacgatggagtgtgtcaagtggcggtgccgctgagcgcagcgtgtgcaccgacaaacccagccctggagaacgcccttccctgtcgcaacacaggaggcatcagtcctggtcaacgttcaaatctatgaccttagggtccctgccacctaagcctcgcgaacgccttactctgcatagagcagcagcctgggagcccacagagccacccgacggagactttcaaacggaggtatag

SEQ ID NO: 216098 - DNA, 4665 bp, Artificial Sequence
  Description of Artificial Sequence: Synthetic coding sequence
atgacccctgcttgcccgctcctgctgtccgtcatactgagcttacgactggctacagcattcgacccggctccctctgcatgttctgctctggcctctggcgtgctctatggcgctttctcgctccaggatttgtttccaactatcgcaagcggctgcagctggacactggagaatcctgatcccaccaaatactccctttacctcaggttcaacaggcaggagcaggtgtgtgcccactttgcccctagactcttgcccttggatcactacctagtgaattttacatgcctgcggccatctcccgaggaagccgtcgcacaggccgagtctgaagttggacggcctgaggaagaggaagcagaagctgcggcaggcttagagctctgttccggttctggcccttttacattcctccatttcgacaaaaacttcgtccagctttgtctctccgcagaaccatctgaggctcctaggctgctcgcaccggctgcgctagcattccgcttcgtcgaggtcctcctgatcaataataacaattccagccagttcacctgcggcgtgctttgtcgctggtctgaagaatgtgggagagcggcagggcgtgcatgcggatttgcacaaccgggatgctcatgtccgggagaggccggagctgggagcacgaccacaacttctccaggcccaccagcagcccatactctgtccaacgcgctcgtcccaggaggccctgcccctccggctgaagccgacctacactcaggctccagcaatgacctatttacgacagaaatgaggtacggggaagagcctgaggaggagcccaaagtgaaaacccagtggccacgctcagccgacgaacctggactgtacatggcgcagacaggagaccctgccgcagaagaatggtctccttggtccgtgtgcagcctaacatgcggccaggggctgcaagtgaggacgagatcttgtgtgagctccccctacggcacactctgcagcggcccattgagggaaacccgcccatgtaataatagtgccacatgtccggtccacggggtgtgggaagagtggggctcttggagcctgtgctctcggtcctgtggaaggggttcgagatcccgtatgcgcacgtgcgtgccgcctcagcatgggggtaaagcctgcgagggaccggaactgcagactaaattgtgctctatggcggcatgtcctgtcgaggggcaatggctcgagtggggaccctggggtccatgctcaacctcctgcgccaacgggacccagcaacgttctcggaaatgtagtgtcgccggtcccgcttgggctacttgcaccggcgcactgaccgataccagagagtgttctaaccttgagtgcccagccacggactccaaatggggcccttggaatgcttggagtctgtgttctaaaacctgcgatactgggtggcaaagacgttttcgcatgtgccaggccacaggaacccaagggtatccctgcgagggaaccggagaagaggttaaaccctgtagtgagaagagatgcccagcttttcatgaaatgtgtcgtgacgaatacgtgatgttgatgacttggaaaaaggccgctgccggagagatcatctacaataagtgcccgccaaacgccagcggaagcgcttctagacgctgcttacttagtgctcaaggggtcgcttattggggattaccgtcttttgcccgttgcatcagccacgaatatcggtacctgtacttgtccctgcgcgaacacctggcaaaaggtcagagaatgcttgcaggcgaaggcatgtcacaagtggtgaggtccctacaggaactcctggctaggagaacctactactctggagatttgttattctctgtggatatccttcgcaatgtcacagatacctttaagcgtgccacctacgtaccttctgcagacgatgtccaaagattctttcaggttgtttcttttatggtggatgccgagaataaggaaaaatgggacgacgcgcagcaggtgagccctggctccgtgcacctgttgcgggtagttgaagattttatccacctcgtaggcgacgccctgaaagcattccagtcaagcctgatcgtgacggataatctggtcatcagcatccagagggaacctgtgtccgctgtgagcagcgatataaccttccctatgagaggaaggagggggatgaaagattgggtgcggcactccgaagacaggcttttcctacccaaagaagtcctcagcctcagctcgcctgggaagcccgcaacaagcggggctgcaggcagcccaggacgcggacgcggtccagggactgtgccgccaggccctggacattctcaccagagactactcccagctgatccggacgagtcgtcttacttcgtcattggcgcagtcttgtaccgaacactgggacttatcctgcccccaccaaggccaccactggctgttacatcaagagtcatgaccgttactgtgcgccctccaacgcagcctcccgctgagcccttaataacggttgagctgtcctacatcattaatggaacaacggacccgcattgcgctagctgggattactcccgggcagatgcttcttcaggtgattgggacactgagaattgccagacccttgaaactcaggcggctcacacacgctgccagtgccagcacctgtctacgttcgctgtcctcgcacagccccctaaagatctcacgctggaactggctggttctccctccgtccctttggtgatcggatgtgccgtatcctgtatggcgctgctcacactgctggcaatctacgccgctttctggagattcattaagagcgagaggtcaattattctgttaaacttctgtttatctatcttggcatctaacatcctcattctggtgggccaaagccgagtgttaagtaagggggtttgcacaatgaccgcggcttttttacacttcttctttttgtctagcttttgttgggtgctgactgaggcttggcagtcatacctagccgtcatagggaggatgcgtacacgacttgtcagaaagcgttttctgtgcttgggatggggactccctgctctggtggtggccgtgagcgtgggcttcacaaggactaaaggttacgggacaagctcttattgttggctctcgctggagggtggcctcctctatgccttcgtgggtccagccgcagtgattgtgttagttaatatgctgatcggaattatcgtgttcaacaagctgatggcccgagacggcatctccgataagagtaagaagcagagggccggttctgaaagatgcccttgggcatcgctgctgttgccttgtagtgcctgtggagccgtgccatctccgttgctctccagtgcgagcgcacgaaatgccatggcctcactttggtcctcttgcgtggttttgccccttctggccctgacctggatgtctgctgtgcttgccatgactgacagacggtcggttctgtttcaggctctgtttgctgtattcaatagcgctcagggcttcgtgatcaccgctgtgcactgtttcctgcggcgagaggtacaggacgtagtgaagtgtcaaatgggcgtttgtcgggcagatgagtccgaagattctccagattcatgtaaaaacggacagttacaaatcctgtcggattttgagaaggacgttgatttggcctgccaaactgtactcttcaaggaagtgaacacctgtaacccttctaccatcacaggcaccctttcacgactgtcactcgacgaagatgaggaacccaagagctgcttggtcggcccagagggatccttatctttttctcctctcccaggaaacatcctggtgcccatggccgcttcccctgggcttggtgagccgcctccaccacaggaggctaatcccgtctacatgtgcggggaaggaggactgaggcaattagatctgacctggttaagacctaccgagccaggatcggaaggagactatatggtgctgcccagaaggacactgtcattacagccaggtgggggaggaggcggaggagaggatgccccaagggctcggccagaggggactccgaggcgcgcagccaaaaccgtggcgcacactgagggttatccatcatttctttctgtggaccacagcggcttgggcctgggtccagcttacggctcactacagaacccgtacggtatgacctttcaaccacctcccccaaccccctcagcaaggcaggtccctgagccgggtgaacggtcacgtaccatgcctaggacagtgcctgggagtactatgaagatgggctccttggagcgaaagaaactgcgatacagcgatctggactttgagaaggttatgcatactaggaagaggcactcagaactttatcacgagctaaatcagaaatttcacacttttgaccgctatcggtcccagtcaactgcaaaagacaagccatccccaggggaacgaccatctctaagtcagcatagaaggcatcagtcctggtcgacatttaaatccatgacccttggtagcctcccccctaagcccagggagaggctcactcttcatcgcgcagctgcctgggaaccaaccgaacctcccgacggcgacttccagacagaggtctag

SEQ ID NO: 216099 - DNA, 4401 bp, Artificial Sequence
  Description of Artificial Sequence: Synthetic coding sequence
atgactccagcatgtcccctgctgctaagcgtgatccttagtttacggctagcaactgccttcgacccagccccatccgcctgttcagctctcgcctccggggtgctctatggggctttcagcttacaggacctgttccccactattgcatcgggatgttcatggaccttggagaaccccgatcccacaaagtactctctttacttgagatttaaccggcaagagcaggtctgtgctcactttgccccacggcttttacccctagaccactatctggtgaatttcacctgcttgcgcccttcccctgaagaggccgtggcgcaggccgagtccgaagtcggacgaccagaggaagaagaggctgaagccgcagcgggtctggagctctgctctgggagcggaccattcacttttttgcacttcgacaagaacttcgtccagctgtgcctgtcagctgagccgtctgaggcaccgaggctgctggccccagcggcactcgcattcagattcgtggaagtcctcctgatcaacaacaataactcatctcaatttacgtgtggggtcctctgtcggtggtccgaggaatgtggaagagccgcaggtcgtgcctgtgggtttgctcagcccggttgttcatgtcccggtgaagccggagccggatccacgacaacaacatcacccggacccccagcagcccacactctgtcaaatgccctggtgccaggcggacccgctcctccggctgaagctgaccttcactcaggttcaagcaatgacctcttcacgactgagatgaggtatggcgaagaacctgaagaggaaccaaaagtgaagacacagtggcccagaagcgctgacgaacctgggctgtacatggcccagacaggagatcccgctgccgaagagtggtctccatggtccgtctgtagtctaacttgtggtcaaggcctccaagtgcgaacacggtcatgcgtgagctccccgtacggaactctgtgttccggccctttacgggaaacgcggccttgcaacaacagtgctacctgccccgtggagggccaatggctcgagtggggcccatggggcccttgttcaacatcctgcgcaaatggaacccagcagcgctctcgtaaatgctctgtagcgggacccgcttgggcaacgtgtacgggtgccctcacagatactagggagtgctctaacctcgagtgccctgcgaccgactctaagtggggtccttggaacgcatggtccctgtgctcgaagacatgtgacactggttggcaacggcgtttccgaatgtgccaggcaacaggtactcagggctatccttgcgaagggacaggggaagaggtgaaaccttgctcagaaaagaggtgtcctgccttccacgaaatgtgcagggacgagtatgtgatgctgatgacatggaagaaggcagctgccggagagatcatctacaacaaatgtccacccaatgcaagcggctctgctagccggagatgccttctgagcgcccagggggttgcttactgggggctgcccagcttcgctcgctgtatttcccatgagtatcggtacttatacctatcgcttcgcgagcacctggcaaagggacaaagaatgcttgcaggggaagggatgagtcaagtagtcaggagtctacaggagttgctggcgaggcggacatactatagcggcgacctcctcttctccgtggacatactgagaaacgtgacagatacatttaagagagccacatacgttcccagtgccgacgacgtgcagagattcttccaggtggtgtcatttatggtagacgccgagaacaaagagaagtgggatgatgcccaacaggtttcccctggcagcgtgcatttgctgcgcgtggtggaagactttatccatcttgtaggggacgcactgaaggccttccagtcgagcctcatcgtgacagacaacctggtgataagtatccagcgcgagccagtctccgcagttagttctgacattaccttcccaatgcggggacggcgtggcatgaaggactgggtgaggcattccgaggatcgactttttttgcccaaggaagtgttgagcctttcctccccaggaaagcccgctacttccggcgcagccggttccccaggtagaggccgaggccctggaacagtcccaccaggcccagggcatagtcatcagcgcttacttccagcagaccctgatgagagctcctactttgttatcggagccgttctgtaccggaccctggggctgattttgcctcctccacggcctccacttgctgttacaagtagagtcatgactgtgacagtccggccaccgactcaaccccctgccgagcccctgataactgtcgaactttcatatataattaatggaaccacagatccacactgcgcatcctgggactactccagggcagatgccagctccggcgattgggatacagagaactgtcagactcttgagacccaagccgctcataccagatgccagtgtcagcacctctcgacattcgcagtactcgcccagcctcctaaagatctgactctggaacttgccggatccccatccgttccgctggtgattggctgcgccgtcagttgcatggccctcctgacccttctagccatttatgctgcattttggcggtttattaagtccgagagatccattatcttactgaatttctgcctgtctattctggccagcaacatccttatcctagtaggacagagtcgggttctttcaaagggcgtatgcacgatgacagctgctttcctgcactttttcttcttaagctctttctgctgggtccttacggaagcttggcagtcctaccttgctgttatcgggagaatgaggacacgactcgtacgtaagcgctttctatgtttgggatgggggctccctgctctggtagtagccgtctctgttggatttactcgtacaaagggctacggtacgtcctcctactgctggctctcactggagggcggactcttatatgcatttgtgggaccagctgcagtcatcgtgctggtgaacatgctgatcgggatcattgtcttcaacaagctgatggccagagatggaatttccgataaatctaagaaacaacgggcaggagcgagtctctggtcatcctgcgtggttcttcccttacttgccctgacttggatgagcgccgtgctggcaatgacagatcgcaggtccgtactcttccaggcgctcttcgccgtcttcaatagcgcacaggggttcgtgataactgcagtgcactgttttctgagaagggaggtgcaagatgtggtgaaatgtcaaatgggggtgtgtcgcgcagacgaaagtgaagactctcccgactcttgtaagaacggtcaactccagatcctttcagactttgagaaggacgtcgatcttgcatgtcagaccgtgctgtttaaagaagtgaacacgtgcaatccgtcaaccattactggaactttatcgcgactatcgctggacgaggatgaggagcctaaaagctgtctggtgggccctgagggttctctgagcttctcgcctcttcccggtaatatcctagtcccaatggctgcttcacctggcctcggagaaccacccccaccccaagaagcaaacccagtctacatgtgcggcgaaggcggactgcggcagttagatctgacttggctgcgtcccacagagcccggaagtgagggagactatatggttctccctcggagaaccttatcacttcagccaggagggggtggaggcggaggtgaagatgctccacgcgctcgtccagagggcacaccaaggcgggcagccaagaccgtagcccacaccgagggctatcctagtttcctgagtgtagatcattcaggattaggccttggacccgcatatgggagcctacagaacccctatggaatgaccttccagcccccacctccgactccttcagccagacaggtcccagagcctggggagcggagtcgtacaatgccaaggacggttccaggatctaccatgaagatgggctctctggagcgtaagaagctacggtattctgatttagacttcgagaaggttatgcacacacgcaagaggcatagcgaactctaccatgagctcaatcagaaatttcatacattcgataggtacagatcacagtcgactgcgaaggataaaccatcccccggtgagcgccctagccttagccagcacaggcggcaccagtcctggagcactttcaagagcatgacactgggaagtctacctcccaaaccacgggagcgtctgacattacatcgggcagctgcgtgggagcctaccgagcctccggacggagactttcagactgaggtatag

SEQ ID NO: 216100 - DNA, 4500 bp, Artificial Sequence
  Description of Artificial Sequence: Synthetic coding sequence
atgactccagcgtgcccgctgctactgtctgtaattctgtccctgcgcctcgctacagctttcgaccccgctccatccgcatgtagtgcactggcatccggcgtgttgtatggagcttttagcctgcaggatttgttccccaccatcgcttccggatgctcatggaccctggagaaccccgacccaacgaaatactcactgtacttaaggttcaatcggcaggaacaggtgtgtgcacacttcgcccctcggctgctacccctggaccactacctggtgaattttacatgtctcagaccctcccccgaggaagcagtcgcccaggccgagtctgaggtcgggcgtccggaagaagaagaggctgaagctgcagccggactggagctgtgcagtgggagtgggccattcacttttttgcactttgacaagaacttcgtgcagttatgcctgagtgccgagccaagcgaggcaccgaggttgctcgcacctgctgccttagccttccggttcgtggaagtcttgctgatcaataataataactcctcccagtttacctgcggcgtcctgtgcagatggagcgaagagtgcggaagagccgcaggcagggcctgcggcttcgcccagcccggttgttcctgtcccggtgaggcgggtgctggtagtaccaccacaaccagcccgggaccgccagctgcacatacgctgagtaatgcccttgttcccggtggaccagctcctccagccgaggccgatcttcattccgggtctagtaatgacttgtttaccaccgagatgcggtacggcgaggaacctgaagaggaacctaaggtgaaaacacagtggccaagaagtgctgatgaaccgggactgtacatggctcagaccgtgcatggagtctgggaggagtggggctcttggtctctatgctctaggtcttgtggtcgtgggagccgcagccggatgaggacgtgtgtccccccacaacatggaggtaaggcctgtgagggcccagaactccagaccaaactgtgctccatggccgcatgtcctgtggagggtcagtggttggaatgggggccttggggcccatgttccacatcttgcgccaatggcacgcagcagcgctccagaaagtgctcagtcgctggccctgcttgggcaacttgcacaggggcactcaccgacactagggagtgtagcaacctggagtgcccagccaccgattccaaatgggggccatggaatgcctggtctctctgttcaaagacatgcgacaccgggtggcagagacggtttagaatgtgccaagcaactgggactcagggatacccctgcgaggggacaggagaggaagtgaaaccttgtagcgaaaagcgctgcccggctttccacgagatgtgccgggacgaatatgtcatgttaatgacatggaagaaggcagctgctggtgaaatcatatacaataaatgtcctcccaacgccagtgggagtgctagccgcaggtgcctcctgagcgcccaaggagttgcctattggggtcttccttctttcgcacggtgtatttcacacgaatacagatacctgtatctatctctgcgggagcatttggcaaagggtcagagaatgctcgccggtgaggggatgagccaggtggtccgctccctgcaggagctcctggcccgaaggacctactattccggagacctcttgttttctgtggatatcctacggaacgtcaccgacaccttcaaacgggctacttatgtgccctctgccgatgacgtacaacggttcttccaagtcgtctcctttatggtggatgccgagaacaaggagaaatgggacgatgctcaacaggtcagtccaggctcagttcacctgctaagggtggtggaagatttcatccacctggtgggagacgccctgaaggctttccaatcctcattaatcgttaccgacaacttggtcatctcaatacagcgtgaacccgtcagcgctgtgtcgtcggacatcacctttcctatgcgaggtcggaggggcatgaaggactgggtccgacacagcgaagatcggttattcctgcccaaggaggtgctgtcgttatcttctcccggaaaaccagcaacttcaggcgctgcgggaagtcctggccgaggacggggacccggtacagtgcctcccggacccggacattctcaccagcggctgttaccggctgacccagatgagtctagttacttcgtgatcggtgcggttctataccgtactctggggcttatcttgccccctcctaggcccccattggctgtgacttctagagtcatgaccgtgaccgtgcgaccacctactcagcctcctgcggagccattgataactgtggagctgtcttacatcatcaatgggaccactgatccacattgcgcatcttgggattattccagggcagacgcatccagcggagattgggatacagaaaattgccagacactggaaactcaggcggcacatacaagatgccagtgccagcatctgagtacctttgccgttttggcccagccgccaaaagaccttacactggaactggctggatccccttcagtacctctcgtgattggctgcgctgtttcgtgcatggctctattgacccttctagcgatctacgccgcattctggagatttattaagagtgagcgatcgattattcttctgaatttctgcttgtccattctggcaagcaacatactgattttggtgggccaaagtcgggtgctgtcaaaaggagtatgtaccatgacagcggcttttctgcacttctttttcctgagctctttttgctgggtgctaacagaggcctggcagtcttatttggcagtcattggtcgcatgcggactcggttggtcagaaagcgatttttatgtctggggtggggtctccccgcacttgtagtggccgtatctgtagggttcacccgcacgaaagggtatggcaccagtagttactgctggctgtctcttgaggggggattgttatatgcttttgtggggccagccgcagtgatcgtgctagttaacatgctgatcggcattatcgtgtttaacaagcttatggccagggatgggatctccgataagtcaaagaagcagcgggctggctcagagcgctgcccatgggcctccctcctcctgccttgcagcgcatgcggtgctgtaccctcccctttgttgtcctccgcaagtgccaggaacgccatggcttccctctggtcttcatgcgttgtgttacctttgctggctctgacatggatgagcgcggtgttggccatgaccgacaggaggtctgtcctgttccaggcactctttgcggtgtttaactccgcccaaggcttcgtcataactgccgtccactgttttctccgaagggaagtgcaggacgttgtaaagtgccaaatgggggtatgcagggcggatgagtctgaggatagccccgattcctgtaagaacggccaattgcagattctgtccgacttcgagaaggacgtggatcttgcatgccagaccgtgctttttaaggaggtgaacacctgtaatccttccacaatcacgggaactctgtcaaggctatccctcgatgaagacgaagagcctaaatcatgcctggtgggacccgaaggctcactcagctttagccccttacccggtaacatcctcgtgcccatggccgcttctccaggtctaggggagcctccaccccctcaagaggcgaacccagtgtatatgtgtggggaggggggattgcggcagctggatctgacctggcttcggcctaccgaacccggttctgagggtgactatatggtgctgcctagaagaacactctcactgcaacctggcggaggcggaggcggtggtgaagatgctcctcgagcgagacccgagggcacaccaaggagggcagcaaaaacagttgcacacactgaaggctatccgtctttcctgtcagtggatcactctgggttgggactgggcccagcctatggcagtcttcagaatccctatggtatgaccttccagccccctccaccgaccccttcggcacgtcaggtcccggagccaggagagcgatcacggaccatgccacgaacagtgccaggatcaactatgaagatgggcagcttggaaagaaagaagttgcggtatagtgatttggactttgaaaaagtaatgcataccagaaagaggcattcagaactgtatcacgaactaaaccagaaattccatacattcgatcggtatcggtcccagagtaccgccaaagacaaaccctctcccggagagcgcccaagtcttagtcagcatagacgacaccagtcttggtctactttcaagtcaatgaccctgggctcactgccaccgaagcctagagagcgcctgaccctgcatagagccgctgcatgggagccaacagagcccccagatggcgactttcagacagaagtgtag

SEQ ID NO: 216101 - DNA, 4503 bp, Artificial Sequence
  Description of Artificial Sequence: Synthetic coding sequence
atgttatctttacgtgggccagatactcacgggaagggccataggatgaccccggcttgtcctctgctactcagtgtgattctctctttgaggcttgccacggccttcgatcctgccccaagcgcctgctccgccctagccagcggtgtgctctacggagccttctctcttcaagatctgttccccacgatcgcatccggctgttcttggaccttggagaacccagaccccaccaaatactccctttacctgcgtttcaaccggcaggagcaggtgtgcgctcatttcgcgccacgcttgttaccactggatcactacctggtgaactttacatgcctgcgtcccagcccagaagaagcagtcgcacaggcagagagcgaagtgggtaggcctgaggaagaagaagctgaagccgctgctggactggagctgtgttctggctcaggccctttcacattccttcactttgataaaaattttgtccagctgtgtctgtctgcagagcctagcgaagccccaagactgctggcaccggcagcgttagctttccggtttgtcgaagttttgctgatcaataacaataactccagccagttcacctgcggggtgctgtgtcgttggtcagaggagtgtgggagggccgcaggacgcgcttgtggttttgcccagcccggttgcagctgtccaggagaggccggtgcaggcagcaccactaccacctcaccgggaccacctgctgctcacacattgtccaatgcactagtgcccggaggacctgcccctccggctgaagctgatctgcatagtggatctagtaacgacctgttcactactgaaatgagatacggagaagaacctgaggaagagcccaaggttaagactcagtggccacggtcagcagacgagcctggtttgtatatggcgcaaacagtacatggtgtctgggaagagtgggggagttggtccctgtgctctcgttcatgcggtaggggtagccgaagcaggatgaggacttgcgttcctcctcagcatggcggaaaggcgtgcgagggacccgaactgcagaccaagctgtgctccatggctgcatgcccagtagaggggcagtggctggagtggggtccctggggaccgtgctcgactagttgcgccaatggcactcagcagaggtccaggaagtgcagcgtggcgggtccggcatgggctacctgcaccggcgctctcacggatacaagagagtgttcgaatctggagtgccctgccacggactcaaaatggggcccttggaatgcctggtcattgtgctctaaaacatgcgatacaggttggcagagacgatttcggatgtgccaagcaaccggaacacaaggctacccctgcgagggaacaggcgaggaggtcaaaccttgctcggaaaagagatgcccagcattccatgagatgtgcagagacgagtatgttatgctcatgacctggaagaaagcagctgcaggcgaaatcatctacaacaaatgcccaccaaatgcttcgggtagcgcctctcggaggtgtttgctgagcgcgcaaggagtggcctattgggggttgccatctttcgcccgttgcatctcgcatgagtacagatatctttatttgagcctacgggagcatctggctaagggacagaggatgcttgcaggagaaggcatgagccaggtagtgcgatccttgcaggaactgctggcccgtcgcacatactattccggcgatttgttgttctccgtcgacattcttaggaatgtgacagacaccttcaaacgggctacttacgtcccctcagccgacgatgtccagcgcttcttccaggtggtgagcttcatggtcgatgctgaaaataaggagaagtgggacgacgcgcagcaggtgtcgcctggttcagtgcacctgttgcgtgtcgtggaggattttatacatttggtcggagatgctctaaaagcgttccagagtagcctcatcgttaccgataacttagttatttctatccaacgtgaaccagtgtcagctgtctcatccgacattactttcccgatgaggggcagacggggaatgaaggactgggtgcgacactcggaggaccggctctttctccctaaggaagtgctgtctctgagctctccgggaaaacctgccactagcggcgcagcaggctccccaggcagagggagagggccaggcaccgtccccccaggcccaggacacagccaccagagactgctcccggcagacccggatgagtctagttactttgtgattggggcagtgctctacaggactctgggacttatactaccacctccgagacccccattagctgtgacgagtagggtaatgacagtaaccgtaagaccccctacacagcctccagctgaacccctaattacggtggaattaagctacattattaatgggacaaccgacccccactgtgctagctgggactacagcagagccgatgcaagcagcggggattgggatacagagaattgccaaacgctggaaactcaagctgcacatacccgctgccaatgtcagcacctgtccaccttcgcggttctggctcagcctccaaaagatctaacactggaactcgcgggaagcccttccgtaccgctagtaattgggtgcgctgttagctgcatggccctactaacactgttggctatttatgctgctttctggagatttattaagtccgagcggtctatcatcctgcttaacttttgtctcagcattttggcctcaaatatactgattctcgtggggcagagcagggtgctctctaagggtgtctgtacgatgactgctgccttcttgcattttttcttcctaagctctttttgctgggtcctgactgaggcatggcaatcttacctggccgttatcggcagaatgcgaaccagactggtgcgtaaaaggttcctatgtctgggctgggggctgcctgccctcgtcgtcgccgtgagtgtgggtttcacacgtaccaaaggctatgggacctcttcgtattgctggcttagtctagaggggggtctgctgtatgcattcgttggacccgctgcggttattgttctcgtgaatatgctgatcgggatcatcgtgtttaataagctcatggcccgagatggaattagtgacaagagtaagaaacagagggcaggggcatctctttggtcaagctgtgtggttttacccttgttggctctcacatggatgagcgccgtcctagccatgacagaccggaggagcgtgctgtttcaggctctgttcgccgtgtttaactccgcacagggatttgtgatcactgccgtgcactgctttctccggagagaagttcaggacgtggtcaaatgccaaatgggggtgtgtagggccgatgaatcagaagactcacctgatagctgtaagaacggccagttacagatcctcagcgacttcgaaaaagacgtcgatctcgcatgtcagaccgtactttttaaggaagtcaacacgtgcaatcctagcactatcacgggaaccttaagccgcttaagtctggacgaggatgaggaaccgaaatcgtgcttagttggccctgagggcagcctttctttctcgccactgccgggaaacattctggtgcccatggcagccagcccaggcctgggggagccacctccacctcaggaggctaatcccgtgtatatgtgcggcgaaggcggactgcggcagttggatctaacttggctgagaccaacagagcctggaagcgaaggcgattatatggtcctgccacgcagaaccctgagcttgcagcctggaggtggtggcggagggggtgaggacgctcctcgggcaagacccgagggaacacctcggagggccgctaagacagtggcccatacagagggatacccctcattcctcagcgtggaccattcgggtctgggcctaggtcccgcttatgggtctcttcagaatccatatggcatgaccttccagcctcccccacccacaccttcagcaagacaggtgccggaacctggcgagcgctcacggactatgccaagaaccgtccccggttccacaatgaagatggggagcctggagcgtaaaaaactccgatattctgacttggatttcgaaaaagttatgcatacaaggaaacgacatagcgaactttatcacgagttgaatcagaaatttcacacatttgacaggtatagaagccagagcactgccaaacgtgagaaacgctggtctgtctcaagcggtggagccgcagaaaggtccgtgtgcaccgataaacccagccccggtgagcggccttctctgtcacagcaccgtcgacaccagtcctggagtacatttaagtctatgaccctcggttctctgcctccaaagccacgcgagcggctgacattgcacagggcagctgcctgggagcccactgaacctcctgatggcgattttcagaccgaggtgtag

SEQ ID NO: 216102 - DNA, 2544 bp, Artificial Sequence
  Description of Artificial Sequence: Synthetic coding sequence
ggcaaggggcaccggatgacacccgcttgcccgctgcttctcagcgtcatcttgtcattgcggctggcaacagccttcgatcctgcaccgtctgcctgctccgcgcttgctagcggagttctctatggggcattcagtcttcaagatctgttccctactatcgcctcagggtgttcttggacactcgagaatcccgacccaaccaaatacagcctgtatcttcgtttcaaccggcaggagcaggtttgtgcccacttcgccccacgtctccttcctttggatcattatctggttaactttacctgtctgagacctagccctgaagaggccgtcgcacaggccgagagcgaagtcggtcgccctgaggaagaagaagccgaggcagccgcaggcctagagctctgtagtggctccgggcctttcacttttctgcattttgacaaaaatttcgtgcaactctgtttgtccgcagagccgagtgaggcacctcgcctcttagctccggcagccctggcttttcggttcgtggaggtgctattgattaataataacaacagttctcagttcacctgtggcgtgctatgtcgatggagtgaggagtgtggcagggccgcaggaagggcctgtggtttcgctcaacctggttgttcgtgccccggagaagccggtgcaggatccactacaaccaccagccccggaccaccggctgctcataccctgagcaatgctctggtccctggaggcccagcgcctccagcagaagctgacttgcactccgggtccagtaacgatctatttaccaccgagatgaggtatggcgaggaacccgaagaagagccgaaggtcaagactcagtggcctcggtcggcggatgaacctgggctttacatggcccagacaggggatcccgcagccgaagaatggagcccatggtctgtgtgtagtttaacttgcggccagggccttcaagtacggactcgcagctgtgtgtctagcccatacgggactctctgttctggtccactgagggagacccggccatgcaacaacagtgctacttgtccagtcgaaggacagtggctggagtggggaccgtggggcccttgcagcacatcctgcgctaacggcacccaacagaggagccggaagtgtagtgttgccggacccgcttgggccacgtgcaccggggcactaactgacactagagaatgtagtaacctggaatgcccggcaacagactcaaagtggggaccatggaatgcctggtccctatgtagtaagacctgtgacaccggctggcagagacgcttccgcatgtgccaagcaacagggacccagggctacccttgtgagggcacgggtgaggaagtgaagccttgctctgagaagcgttgcccggcattccatgaaatgtgtcgggacgagtatgttatgctgatgacctggaaaaaggcggcagcaggagagataatctataacaaatgccctcctaacgctagcggctccgccagtaggcgctgtctcctttccgcccagggtgtggcctactggggactcccatctttcgctcggtgtataagtcatgagtacagatatctgtacctgagccttagagagcacctggctaagggacaaaggatgctcgccggagagggtatgtcacaggtagtaaggtcactgcaggagctgctcgcacgcaggacttactactctggcgatttgctcttctccgtcgacatcctgaggaacgtgacagatacattcaagcgcgctacttatgtgcccagcgcggacgacgtgcagcggtttttccaggtggtcagcttcatggtggatgcggagaataaggagaaatgggacgatgcccagcaggtgtcgccaggctctgtccatttgcttcgcgtagtcgaagactttatccatctggtgggtgatgcattgaaagcgtttcaatccagcttgatcgtgaccgacaacctcgttatttccatccagcgcgaaccggtctcagctgttagcagcgacataaccttcccgatgaggggcagacgaggtatgaaggattgggtacggcactccgaggaccgcctttttcttcccaaagaggtgctgtctctttcctcaccaggtaagcccgctacgtcaggtgctgctggctctccgggacgaggccgtggtccaggaactgtgccccctgggcctggacacagccatcaacggctcctgccggctgaccccgacgaaagttcctactttgttattggcgctgtgctttataggactctcgggctgatattgccccctcctcgtcccccactcgcggtcacttctcgcgtcatgactgtgacagtcagaccacccacacagcctcccgcagaaccgctgattactgttgaactgagctatatcataaacggcacaaccgatccgcactgcgccagttgggattactctcgagcggacgcttcgtctggagactgggatacggaaaactgtcagacactcgagacacaggccgctcacacaagatgccagtgccagtag

SEQ ID NO: 216103 - DNA, 6 bp, Artificial Sequence
  Description of Artificial Sequence: Synthetic coding sequence
atgtag

SEQ ID NO: 216104 - DNA, 3528 bp, Artificial Sequence
  Description of Artificial Sequence: Synthetic coding sequence
atggctcagactgtgcatggtgtgtgggaggagtggggcagttggtcgctgtgttcccgtagctgcggtcgagggagcaggtccagaatgcgcacctgtgtcccccctcagcacggcggtaaggcttgtgagggaccagagttacagacaaagttatgctctatggcagcttgccccgtcgagggacagtggcttgagtggggaccatggggaccatgcagtaccagttgcgctaacggcacacagcagaggagtaggaagtgtagtgtggccggaccagcttgggccacttgcactggagcgctcaccgatacccgcgaatgttctaatttagagtgtccggcaaccgatagcaagtggggaccctggaatgcctggtcgctctgttctaagacatgtgataccgggtggcaacgcaggttcaggatgtgtcaggctaccggtacccagggttatccatgtgaggggactggagaggaagtaaagccttgctccgaaaagaggtgccccgctttccacgaaatgtgcagagacgaatacgttatgttaatgacatggaaaaaagccgcagctggggagattatctataataagtgtcctcctaatgcttctggatccgccagtcgaagatgtctgctgtccgcacaaggggtggcctactgggggctcccgagtttcgccaggtgtatctcccacgagtatagatacctctatctttccctgagagagcatctggccaagggacagcggatgttggccggagagggcatgagtcaggttgtacgatcccttcaggagctgttggcacgaagaacctattactcaggggaccttctgttcagtgttgatattctgaggaatgttaccgatacgtttaaaagagctacatatgtgcccagtgccgatgacgtgcaacgattcttccaggtcgtgagttttatggtagacgccgagaacaaggagaagtgggatgacgcccagcaggtgtctccagggtccgtccacttactgcgggtggtcgaagattttatacaccttgtgggggatgcccttaaggcatttcagtctagcctgatcgtcacagacaatctcgtcatctcgatccaaagagaaccagtaagcgccgtgtcttccgatatcacatttcccatgagggggaggcggggtatgaaggattgggttcgtcacagcgaagatagactgttcctgcccaaagaggtcctctccctgagttcacccggtaagcctgccacatcaggagcagcaggatcacctggcaggggcaggggcccagggactgtgccccctgggccaggacattctcaccaacgcctgcttcccgcagatccagacgagtcaagttacttcgtcatcggcgctgttctgtacaggaccctcgggctgatcttaccaccgcctcgtccgcctctcgcagtaacatcgcgcgtcatgacggtgacagttcggccacccacgcagccgccagcagagcctctcatcacggttgaactgtcctatattattaatggaacgacagatccccactgcgcatcttgggactatagccgggctgatgccagctctggcgactgggacacggagaactgtcagacactcgagacgcaggccgcacacactaggtgccagtgtcagcacctttcaacctttgccgtactcgcacagcctcctaaagaccttactctagaactggcagggtcacctagtgttcctctagtgattgggtgcgctgtttcctgtatggctctactgaccctcttggctatctatgccgcattctggcgcttcattaaaagcgagcgcagcataattctgctaaacttctgccttagcattcttgcgtccaatatcctaattttggtgggccaatctagagtgctgagcaagggtgtctgcaccatgaccgccgcttttctgcatttcttttttctaagctcattttgctgggtacttacagaggcatggcagagctaccttgcggtgatcggaaggatgagaaccaggctggtgcgtaagaggttcctgtgtttgggttgggggctgcccgctctagtggttgctgtgtctgtcggtttcacaaggaccaaagggtatggtacatctagttactgttggctgtctctcgaaggtggcctgctgtacgcctttgttgggcctgccgcagtcatcgtgctggtgaacatgctcattggcattattgtcttcaacaagctgatggctcgggacggcatctcagacaaatccaaaaagcagcgggctggcgcatctctgtggagtagctgtgtcgtacttcctctgttagccctgacatggatgagcgcagtgctggccatgacagaccggcgtagtgtgttatttcaggccttgttcgccgtcttcaacagcgcccaaggttttgtgattaccgcagtgcactgcttcctgcggagggaggtgcaagacgtggtaaagtgtcagatgggggtgtgcagagctgacgagagtgaggactcgcctgattcatgcaaaaacgggcaactgcagattttaagtgactttgagaaggacgtggacttagcttgtcagacagtcctatttaaggaagttaacacctgcaatccttcaacgattacaggcactctcagtcgcctgagcctcgacgaggacgaagaacccaagtcttgcctagtcggaccagaggggagcctttctttctcaccccttccaggcaacattctggtgccgatggccgcatccccaggccttggtgagcccccaccaccacaggaggccaaccccgtgtacatgtgtggggagggcggtctacgacagctcgatctaacctggctccggcctacagagcccggaagtgagggcgactatatggtccttccacggagaacacttagcctgcagcccggtggtggcggaggcggtggggaagacgctcctcgggcacgacccgagggtaccccaagaagagccgcaaagaccgttgcccacactgagggttacccatcgttcctgagtgtagatcattcaggattggggctgggccctgcatacggatctctgcagaacccatatggcatgaccttccagccccctccacccacccccagtgcgcgtcaggtcccggagccaggggagcggtcccggacaatgccgaggactgtgcccggtagcaccatgaagatggggtcactggagagaaagaaactgcgttatagcgatttagactttgaaaaggtgatgcacacccggaagcgacacagtgaactttatcatgaactcaatcaaaaatttcatacatttgatagatatcgctcacagagcacagcaaaggacaaacccagccccggtgagcggccttccttatcccagcaccggcgtcaccaatcttggagcacctttaagtcgatgacacttggcagtcttcccccaaaaccacgggagaggctgactcttcacagggctgcagcctgggagcctactgagccccctgacggagacttccagactgaagtgtag

SEQ ID NO: 216105 - DNA, 4656 bp, Artificial Sequence
  Description of Artificial Sequence: Synthetic coding sequence
atggagaatacaggctggatggggaagggacaccgtatgacgcccgcatgcccactgctcctatctgtgattctttccctgagactcgccaccgctttcgatcccgctccatcggcttgttccgctcttgcatcaggtgtcctctacggggcttttagcctgcaggacctgtttcccaccatcgcatctgggtgctcttggacactggagaacccagatccaactaagtattctctgtatctgcgatttaatcgccaggaacaggtgtgtgcccactttgccccacgccttctgcctttagatcattatttggtcaacttcacttgcctgaggccttcgccggaagaagccgttgcccaggcagagtccgaagtcggaagacccgaagaagaagaagcggaggccgctgctggattggagctctgctccggttctggtccctttaccttcttgcactttgataagaacttcgtacaactttgtcttagtgccgagccgtcagaggccccacggttgctggcacccgcagccttggcattcaggttcgttgaagtattgctaattaacaacaataattcatcgcagttcacatgtggcgtgctgtgtcgatggtcagaagagtgtggacgtgctgctggacgcgcttgtggatttgcacaaccaggctgttcctgcccaggtgaggcaggagccggtagcaccacaacgacctcaccgggaccccctgcagcccataccctgagcaatgccttggtgcccggaggacctgctccaccagctgaagctgatctacattctggttcttcgaatgacctgttcaccactgaaatgagatatggcgaggagccagaagaagaaccaaaagtgaagactcaatggccaaggtccgccgacgagcctggcttgtacatggcacaaactggagaccctgcagcggaggagtggtcaccctggtcagtttgctcattgacgtgtgggcaagggctccaagttcgtaccagatcatgtgtctcatccccttatggcaccctttgcagtgggccactgcgcgagacacgcccttgtaacaattcagccacatgtcctgtccatggggtctgggaagaatggggttcttggtcgctctgttctaggtcctgtggccgagggagccggagtaggatgaggacctgtgtgccgcctcaacatgggggaaaggcctgtgaggggcctgaactccagactaaactctgctccatggctgcctgcccagtcgaaggccaatggcttgaatggggtccctggggtccttgttcgacaagctgtgccaatggcacccagcagcgatcgcgaaagtgtagcgtcgcaggccctgcgtgggccacatgtacgggggctctgaccgatacccgggaatgctccaatctggaatgcccggcaactgacagcaaatggggaccatggaacgcctggtccctctgctctaagacctgtgatacgggttggcagaggcgctttcgcatgtgccaggccacgggcacccagggatatccttgtgagggaactggtgaggaagtgaagccatgcagcgagaagaggtgtccggcattccacgaaatgtgccgtgacgaatatgtaatgcttatgacatggaagaaagcagccgctggcgagatcatctacaataagtgcccaccaaacgctagcggctctgcaagcaggcggtgcctgctcagcgctcagggggtggcgtactggggtctcccatcttttgccagatgcatttcacacgaatacaggtatctctatttatctctcagagagcacctggccaaaggccagagaatgctcgccggagaaggcatgtcgcaagttgtgaggtcactgcaggaactactggctaggcgaacgtactactcaggcgatctgctcttttcagttgatatactgaggaatgttacggacaccttcaagagggcaacatacgtgccctccgccgacgacgtacagagattctttcaggttgtgtcattcatggtggacgccgaaaataaagagaaatgggacgacgcccagcaagtctctcccggatcggtccatcttttaagggtggtggaggacttcatccaccttgtcggcgacgctcttaaagcatttcagagtagtttgatcgtcactgacaatttggtgataagtatccagagggaacccgtctctgccgtttcttccgatattacatttcctatgcgaggacggagaggaatgaaagattgggtccgtcactctgaggatcggctgtttctgccgaaagaggtcctgtctctgagctccccgggaaagcccgcaacttctggcgcagcgggaagcccagggaggggtaggggacctggtactgtcccccctggcccaggccactctcaccagcgtctcctccccgcagatcctgacgagtcaagctattttgtgattggcgcagttctgtacagaaccctgggcctgatactacctcctccacgtccccctctggctgtcacctccagggttatgaccgtcacggttcgacccccaacacagccacctgcagagcccttaattacagtcgaattgtcatacatcatcaatggcacaactgacccccactgcgctagctgggactactctagagctgatgcgtcttctggcgactgggatacggagaactgtcagactctcgaaacccaggccgcacatacccgctgtcagtgccagcatctaagcacattcgctgtgctggctcagcctccaaaggatttaacactggagttggctggctctccctcagtgccgctggtgattgggtgcgccgtgtcatgcatggcgcttctcactcttttggctatttacgcagcgttctggcgctttatcaagagcgagagatcgatcatcttgctaaacttctgtctgagcatccttgcctcaaacatcctaattctggtaggccagtccagagtgctatccaagggagtttgtacaatgactgctgctttccttcattttttcttcctgtcgagcttttgttgggtgctaacagaagcttggcagtcctatctcgctgttatcggccgtatgcgcaccaggctcgttcgaaaaagatttctctgtctggggtgggggcttccagcacttgttgtggcggtctccgtggggttcactcgcactaaaggctacggaaccagctcatactgctggctgagcctagaagggggtctgctgtacgctttcgtgggacccgcagccgtcatcgttctcgtgaacatgctgataggaatcattgtgtttaataaactcatggcacgagacgggatttcggacaagagcaagaagcagagggccggagccagcttgtggtcatcttgcgtggtgctcccactgttggctctgacatggatgtcggcagtcctcgcaatgaccgatcggagaagtgtgctctttcaggcactattcgccgtgttcaattctgcccagggcttcgtaattacagctgtacattgcttcctgcggagggaagttcaggacgtcgttaaatgccagatgggggtgtgtagagctgatgaatctgaggactcccctgactcatgcaagaatggccagctgcagatcctgtctgattttgaaaaggacgtcgatctcgcctgccagaccgtgttgttcaaggaggttaacacctgcaatccatccactattaccggcacactatctcggctctcactcgacgaagatgaggagccgaagtcttgtttggttggaccagaaggatctctgtcattcagccctttgccgggaaatatcctcgtgcctatggctgcaagcccaggcctcggcgaaccccctcctccccaggaagcgaatccagtgtacatgtgcggcgaaggcggacttaggcaattagacctaacttggctgcggcctaccgagccgggatccgaaggagattacatggttcttcccagacgaacactcagcttacagccaggagggggaggtggcggaggcgaggatgccccacgggcacgcccagagggcacccccagaagggccgctaagacggtggcacacacagagggatacccctcttttctgagtgtcgaccattccggtctggggctgggtcccgcttatggatctcttcagaacccttacggcatgactttccaacctcccccaccaacgccgtcagcacggcaggtgcctgaacctggtgagaggagtcgtactatgcccagaaccgttcccggatcaactatgaagatgggctccctagagcgcaagaagcttagatattccgacttggacttcgaagtgatgcacaccagaaaaagacacagtgaattgtaccatgaactcaatcagaaatttcatacattcgatcgatatagaagtcaatcaacggccaaaagggagaaaaggtggtcagtgtctagcggcggagccgcagaacggtctgtatgtacggataagcccagtccaggcgagcgtcccagtttgtctcagcaccgcaggcatcagtcctggtcgacatttaagtccatgactctgggttctttacctcctaagccaagagagcgtctgacccttcatagggccgctgcatgggagcccaccgagccacccgacggggactttcagaccgaagtgtag

SEQ ID NO: 216106 - DNA, 2187 bp, Artificial Sequence
  Description of Artificial Sequence: Synthetic coding sequence
atgctgctccctcaggggaaagaggctgtagaaggcaaaaagtgccagggcaggcagcgcagagcgggactgtctgaggtatggagtaggaaactgagaaatgagtccctgggcacctggtcaacacagggctgcaagacggtgctgactgatgccagccatacgaagtgtctgtgtgatagactgtccaccttcgctatcctcgctcagcaacctagagaaataataatggagtcctctggcactccaagcgtcacattgatcgttggcagtggtttatcatgcctagccttgatcaccctggccgtggtttacgccgcactatggcggtacatccggtccgaacggtcaatcatcttaatcaatttctgtctgtccattatttcctctaacatcttaattcttgttggccaaacccagactcacaataaaagcatctgcacaaccactacagccttcctccattttttctttctggcaagtttctgctgggtgctgaccgaagcctggcagagctacatggccgtcacagggaagatccgaacgagactgattcgcaagcggtttctgtgtcttggatgggggcttccggctctggtcgtggccacatctgttggctttaccagaacgaaagggtacggcaccgaccactactgctggctgtcactggagggaggtctgctttacgcattcgttggacctgccgcagcagtggtcctcgttaacatggtcatcgggatcctcgttttcaacaagctcgtgagtagagacggtatcctggacaaaaagctgaaacaccgggctggccagatgagtgagccgcacagcgggttaaccctcaaatgcgcaaaatgtggagtggtgagtacgactgcactcagtgcaactaccgcttcaaacgcgatggcatccctttggtcctcttgtgtggtcctgcctctgcttgctctgacttggatgagcgctgttttggctatgactgacaaaaggtctatcctctttcagatcctctttgccgtcttcgatagcctgcaaggattcgtgatcgtgatggttcattgcattctgagaagggaagtacaggacgccttcaggtgtagactgaggaactgccaggacccaattaacgccgacagctccagtagctttccaaatgggcatgcacaaatcatgacagattttgaaaaggacgtcgatatagcgtgtcgcagcgtcttacataaagacataggcccatgccgcgctgccactattaccggtacactcagtcgtattagcttgaatgatgacgaggaagagaaaggcacaaatcccgagggcctgagttacagtacactccctgggaacgtcatcagcaaggtgattatacaacagcctacaggtctgcacatgcctatgagcatgaacgagctgagtaacccatgtctaaaaaaagaaaactctgagctacgcagaacagtgtatctatgtacggacgacaacctgaggggcgctgatatggatattgtccaccctcaagagcgtatgatggagagtgattatattgtgatgccacgcagtagcgtgaacaaccagccttccatgaaagaggaatcaaagatgaatatcgggatggagacactacctcacgaaaggctacttcactataaggtgaaccccgagttcaacatgaacccacctgtgatggaccagttcaacatgaacctagaacagcatctcgcaccccaggagcatatgcagaacttgccgttcgagcccaggacagccgtgaagaacttcatggctagcgagctggatgataacgctggtctctcacgctcagaaaccggctcaacaatcagtatgagctctctagagcgtcgcaagagtaggtattcagatctggattttgaaaaagtgatgcacactcgtaagcgccacatggagctcttccaggagctgaatcagaagtttcagactctggaccggtttcgagatatcccgaatactagctcaatggaaaatcctgcccctaataaaaatccatgggatacctttaaaaatccctccgagtacccccattataccaccataaacgtgcttgacaccgaggctaaagatgcccttgagttacggccagccgagtgggaaaagtgcctaaatctcccactggatgtacaggagggcgactttcagaccgaggtttag

SEQ ID NO: 216107 - DNA, 4569 bp, Artificial Sequence
  Description of Artificial Sequence: Synthetic coding sequence
atgaaagccgtaaggaatctgcttatatacattttttctacttacctcttagtgatgttcggattcaacgccgcacaggacttttggtgctctaccttggtcaaaggggtaatttatggtagctacagcgtctccgaaatgtttcctaaaaactttactaattgtacctggacacttgaaaatcctgatccaaccaaatactctatttaccttaagtttagcaaaaaagacctgtcatgcagcaactttagcttattggcctaccagtttgaccatttcagccacgaaaaaattaaagacctcttgagaaagaatcatagcatcatgcagctatgcaacagcaaaaatgcttttgtatttctgcagtacgacaaaaacttcatccaaatacggagggtgtttcccacgaacttcccgggactgcagaagaagggcgaggaggatcaaaagagcttctttgagttccttgtgctcaacaaggtcagcccatcccagttcgggtgtcacgtgctgtgcacatggctggagtcttgcttaaaaagcgaaaacggcagaaccgaaagttgtggaatcatgtatactaagtgcacctgcccacagcacctgggagaatggggcattgatgatcaaagcttgatcctgctgaacaacgtcgtcctgcccctcaatgagcagacagaagggtgtctgacacaagagctgcagaccacacaggtgtgcaacttaactcgcgaggcaaagcgcccaccaaaggaggaatttggcatgatgggggaccacactattaagtcacagagacctagaagcgtgcacgagaaacgagtgcctcaggaacaggccgacgccgctaagttcatggctcagaccggcgaatctggcgttgaggagtggagccagtggtccacctgtagcgtgacatgcgggcagggctcacaggtgcgcaccaggacatgtgtctcgccctacggaactcactgcagtggtcccctgagagaatcccgtgtctgtaacaacaccgcgctatgcccagtgcacggagtttgggaagaatggagcccatggtcattgtgttctttcacatgtggcaggggccagagaacacggacgcgctcttgtacgcctccacagtacggcggacggccttgcgagggcccagagacccaccataaaccatgtaacattgccctgtgccctgttgacggacagtggcaagagtggtcttcatggtcccagtgttcagtgacatgctctaacgggacccaacagaggtcccggcagtgcactgccgcagctcacggtggctccgagtgcagggggccttgggcggagtctcgagagtgctacaaccccgagtgtacagccaatggacagtggaaccagtggggccattggagtggttgcagcaagtcatgcgatggcggttgggagcgtcgcattcggacttgccagggtgctgtcattactggacagcagtgtgagggcacgggtgaggaggtacgaaggtgtaatgagcaacggtgtcctgcgccttacgagatttgcccggaggactaccttatgtccatggtctggaaaaggactcccgctggggatctggcattcaaccaatgccccctgaatgctactgggacgacttcgcgcaggtgctcgttatccctgcacggtgtggccttctgggagcagcctagcttcgctcgctgtatttccaacgagtaccgacacctgcagcacagcattaaagagcacctcgccaaaggccagaggatgctcgctggcgacggcatgagtcaggtgactaagacgctcctggatctgacgcagaggaagaacttttatgcaggagatttgttaatgtccgtggagatccttcgaaacgtgactgacacattcaagagggcctcctatatccccgcatcagatggagttcagaatttcttccagattgtgtcaaacttgctcgatgaagagaataaggaaaaatgggaagacgcacaacagatctaccctggatctattgagctgatgcaggtcattgaagacttcatacacattgtaggcatgggcatgatggatttccaaaacagctatctgatgactggaaacgtggtcgcttccattcagaaattacccgctgcgtcagttctgacagatattaactttcctatgaaggggaggaaagggatggtggattgggccaggaactctgaggaccgcgtggttattcctaagagtatctttaccccagtctcctctaaggagctggacgagtcctctgtgtttgtcctgggggcagtgctgtacaaaaacctggacctcatccttcctactctcaggaactacacagttattaattctaagatcattgtagtaacgattcggccagagcccaagacaacggactctttcttggaaattgagttggcccatctggccaatggcacactgaacccctactgtgtgctgtgggacgattcaaaaactaacgaaagtttgggcacctggtccactcaggggtgtaagactgtcctaacagacgcgagccacaccaaatgcctgtgcgacaggctatctacctttgccatactcgctcagcagcctcgggagatcattatggaaagttccggcacgcctagtgtgactctgattgtgggcagcggcctgtcgtgcttagccttgattacactggcagtcgtttatgctgccctgtggagatacattagatcggagaggtcaatcatcttgataaatttctgcctaagtataattagcagtaacattcttatcctggtggggcagacacagacccataataagagtatttgcacgaccactacagcatttctccacttctttttcttggctagcttttgctgggtcttgactgaggcctggcaatcctacatggccgtgacaggaaagatccgtacccggctcatcagaaaacgcttcctgtgcctggggtgggggctcccagccttagtcgtagctacctctgtgggctttaccaggactaaaggctacgggactgatcattattgctggctcagtctggaaggagggctgctgtacgctttcgttggacccgcagccgctgtcgtgctcgtgaacatggtaatcggcattctggtgtttaacaagctcgtatccagggacggcatcctcgacaaaaaactcaagcatcgggcaggtcaaatgagtgagccccactccggcctaactctgaagtgcgctaagtgcggcgtggtgtccactaccgctctgtctgctacaacagcgtccaacgctatggccagcttgtggagctcttgcgtggtgctccctctgctggccctcacgtggatgagcgccgtgcttgccatgactgataagcggtcaattttattccagatattgttcgcagtgtttgactctctgcagggtttcgtgatcgtaatggttcactgtattttgcgtagggaggtccaggatgcctttcgttgtcgcctgcgcaactgccaggacccaattaacgccgatagctccagcagcttccccaatggccacgcccagatcatgaccgattttgagaaggacgtggatattgcatgccgctcagtcttgcacaaggatatcggcccttgccgcgcagctacaatcaccggaacgttgagccgcatttcactcaatgatgacgaagaggagaaaggaacaaaccctgagggcctgtcctatagtactctgcctgggaacgtcatcagcaaagtgatcattcagcagcctaccgggctgcacatgcctatgagcatgaacgagctgtctaacccttgcctaaaaaaggagaacagcgaactgcgcaggactgtctacttgtgcaccgacgataacctgagaggggcagatatggatatcgtgcaccctcaagagagaatgatggaatctgactatatagtgatgcctagaagctcagtgaacaatcaaccctctatgaaggaggaatctaaaatgaacatcggcatggagaccctgcctcatgaacgtcttctacactataaggtcaacccggagttcaatatgaaccccccagtcatggatcagttcaatatgaacctagaacagcatctggcgccacaggagcacatgcagaatctgccgttcgaacctcggactgccgtgaagaattttatggcaagcgagcttgatgacaatgctggactctcacgatccgaaaccggttccaccatctcgatgtctagcctggagcgcagaaaatcccggtatagcgacttggactttgaaaaggtgatgcatactagaaagaggcatatggagttattccaggaacttaatcagaagttccagactttggataggttccgggacatcccgaataccagttcaatggaaaatcctgccccaaacaaaaatccttgggacaccttcaaaaacccctccgagtacccgcactatacaacaatcaatgtcctggacaccgaggccaaagatgccttagagctcaggcctgccgagtgggagaaatgcctgaatctgcccctggacgttcaggagggtgactttcagaccgaagtttag

SEQ ID NO: 216108 - DNA, 1461 bp, Artificial Sequence
  Description of Artificial Sequence: Synthetic coding sequence
atggtgattggcatcctcgtattcaataagcttgtctcaagagacgggatactggacaagaaattaaaacacagagctggccagatgagtgagccgcattcaggattgactctcaagtgtgccaagtgtggggtagtgagcaccactgcactgagtgcgaccacagccagcaatgcaatggcctccctttggtcctcatgtgttgtgctgcccctgttggcgttgacatggatgtccgcagtacttgcaatgacagataaaaggagcatacttttccagatcttatttgcggttttcgactctctgcaaggattcgtgattgtgatggtgcactgtattcttcgtcgggaggtgcaggatgcattcagatgccgattgcgtaattgtcaggatcctatcaacgccgactccagtagctcctttcccaacgggcatgcacagatcatgactgacttcgaaaaggatgtggatatcgcgtgccgctccgtgctgcataaagatattggaccttgccgagctgccaccatcaccggtacgctgtctcgaatatcactgaatgacgacgaggaggaaaagggaacaaaccctgaagggctgtcctacagtacccttcctggaaatgtcatctccaaggtaataatacagcagcctaccgggctgcacatgccgatgtcaatgaatgaactatctaacccatgtctaaagaaggaaaactccgagctgaggaggacggtgtatctgtgtaccgatgataacctcaggggggcagacatggatatcgtccatccacaagagaggatgatggagtctgattacattgtcatgccgaggtcatcagtgaacaatcagcccagtatgaaagaggaaagtaaaatgaacattgggatggaaactcttccccatgagcggttgctgcactataaggttaaccccgagttcaacatgaatccaccagtgatggatcaatttaacatgaatctggagcagcaccttgccccacaagaacatatgcagaatctcccgtttgagcccaggacggcagtcaagaattttatggcctcagaacttgatgacaatgctgggctgtcgaggtctgagacgggatccacgatttcaatgtcaagcctagagagacgtaagagccggtactcagatcttgatttcgagaaggttatgcataccaggaagcggcacatggagttgttccaggaactgaaccagaagttccagacactagatcgcttccgcgatatccctaacaccagttctatggagaatccggcaccgaataagaacccatgggacaccttcaagaatcccagcgaatatcctcattatactaccattaacgtactcgacacagaagctaaggacgccctggagctgcgtcctgctgaatgggagaagtgtcttaatttgcctctagatgttcaggagggcgatttccagactgaggtgtag

SEQ ID NO: 216109 - DNA, 978 bp, Artificial Sequence
  Description of Artificial Sequence: Synthetic coding sequence
atgaaggctaaagacttgatcgtgactcctgcgactattttgaaagagaagcccgatcccaacaacctcgtctttgggactgtattcacagaccatatgctgacagtggaatggagtagtgaatttggatgggagaagccacacattaaaccacttcaaaatctgtctctgcatcccggatcgtcagctcttcactatgcagtggaggtctttgacaaggaagaattgctggaatgcatccagcagctggtaaagttggaccaggagtgggtgccctactctacaagcgcctcactttatattaggcctacgtttattggcacagaaccatcactgggtgtgaagaaacccacaaaggcactcctctttgtcttactgtcccccgtgggcccatacttctctagtggtacctttaatcctgtgtcactctgggcgaacccaaaatacgtaagagcttggaagggagggaccggcgattgcaaaatgggtggcaactatggatcaagcctgttcgcacaatgcgaggcagtggacaatggatgccagcaagtgttgtggctgtatggcgaggatcaccagattacagaggtaggcaccatgaacctctttctttattggatcaatgaagacggggaggaggaactggctactccccctctggacggtattatactcccaggagtgacccgacgttgcatcttggatttagcgcaccaatggggagaattcaaagtgtctgaacgctatcttaccatggacgatctgaccacagctctggaagggaatagggtgcgggagatgtttgggtctggcaccgcctgtgttgtatgtccggttagcgacattctgtacaaaggcgaaactatccacatccctacaatggagaacggaccaaagctcgcaagtagaattctgagtaaactgactgacatccaatacggccgtgaggagtccgattggaccatagtactgtcctag

SEQ ID NO: 216110 - DNA, 1158 bp, Artificial Sequence
  Description of Artificial Sequence: Synthetic coding sequence
atggattgttcaaacggctgctctgctgagtgtaccggcgagggcggaagtaaagaggtcgtcgggacattcaaggccaaagatctgattgttaccccggctactatcctgaaggagaagcccgatcccaataaccttgttttcgggaccgtgttcaccgaccacatgctaaccgtagagtggagctcagagtttggctgggagaaaccacatataaagccactgcagaatctgagccttcatccaggcagttctgcactccattacgccgtcgagctgttcgaaggacttaaagcattccgtggcgtcgacaacaaaattcgccttttccagcctaacctgaatatggacaggatgtaccgttcagctgtgcgcgctactttgcctgtttttgataaggaagagttgctcgaatgtattcaacaactggttaaattggatcaggagtgggtgccctacagcacctcagcgtctctgtatatcaggcctaccttcatcggcaccgaaccttctcttggcgttaaaaagcctacaaaggccctgctgtttgtgcttctcagtccagttggcccttacttttcgtccggtacgttcaaccccgtttcactgtgggccaaccctaagtatgttcgggcttggaaaggcggtaccggtgactgtaagatgggcggaaattatggcagctctcttttcgcacagtgtgaggccgtggataatggatgccaacaggtactttggttgtacggagaagaccaccaaataacggaagtgggcacaatgaacctgtttctgtattggataaatgaagatggcgaagaagagctggcaaccccgcctctggatggaataatcctgccaggggtcaccaggcgatgcatcctggacctggctcaccagtggggcgagtttaaagtgagcgaacggtacctgacaatggacgacttgaccaccgccctcgaagggaatcgggtaagggagatgttcggcagtggcaccgcgtgcgtggtttgcccggttagcgacatcttgtacaagggggagactatccatatccctacaatggaaaatggccctaagctggctagccgcatcctcagcaaactgaccgacatccaatacggacgtgaggagtccgattggacaatcgtgctttcttag

SEQ ID NO: 216111 - DNA, 1197 bp, Artificial Sequence
  Description of Artificial Sequence: Synthetic coding sequence
atggcctcccccctcaggtccgctgctgctctggctcgtcaggactgttcgaatggatgcagcgcggaatgcactggagaggggggatctaaagaggttgtgggcacctttaaggctaaagatctcatcgtcacccctgcaaccatcctgaaagaaaaacccgatccgaataatctggtgtttggtacagtattcacagaccatatgcttacagtcgagtggtcgtcggaatttgggtgggagaaaccccacatcaagccattgcagaatctgagcctgcatcctggctcctctgctctccactacgcagtcgaattatttgaaggccttaaagcattcagaggagttgacaacaaaatacggctgttccagccaaacctgaacatggacaggatgtatcggagcgccgtccgagccacactgcctgtgttcgacaaggaagaactcctggagtgtatccagcaactagtcaaattggaccaggagtgggtgccatattctacttctgcttccctgtatattcggccaacattcatcggaacagaaccaagtctaggtgttaagaaacccactaaagctttgctgtttgtcctcctttctcctgttggcccatattttagtagcggaacatttaatcctgtttcgttgtgggccaacccgaaatacgtacgggcttggaaaggtgggactggggactgtaagatgggaggaaactatggctcttctttatttgcacagtgtgaggcagtggacaatggctgccaacaggtactgtggttatacggtgaggatcaccaaatcacggaagtcggaaccatgaatcttttcttgtactggataaatgaagacggcgaagaggagttggcaaccccacctttggacggaattattctgcctggggtgacacggcgttgcatcttggatcttgcacaccaatggggagagtttaaagtgtccgaaaggtacctgacgatggatgatctgactacggcgcttgaggggaaccgggttagggaaatgtttggttctgggaccgcttgcgttgtttgtccggtgtccgacatcctgtataagggcgaaactattcatattccaacaatggaaaacgggccaaagttagcctcccgaattctctccaagcttaccgatattcaatatggtcgggaggaatccgactggaccattgtcctgtcctag

SEQ ID NO: 216112 - DNA, 1050 bp, Artificial Sequence
  Description of Artificial Sequence: Synthetic coding sequence
atgaaggattgtagtaacggttgtagcgcagagtgcaccggagagggtgggagcaaggaagttgtggggacttttaaggccaaagacctgattgtgaccccagcaacgattctcaaggaaaagccagatccaaataatcttgtgtttgggacggtgtttaccgaccatatgcttactgtggaatggagcagtgagtttgggtgggagaaacctcatattaagccccttcagaacctgtcgctccatccagggagttccgcccttcattacgccgtggaagtctttgataaggaagagctcctggagtgcatccagcagctggtaaagctggaccaggaatgggttccttattcaacatctgcaagcctgtatattaggcccacgttcattggaactgagccgagccttggagtaaagaagcccacaaaggcgctcctgtttgttctgctgtctcctgtgggtccctacttttctagcgggacgttcaatcccgtctcactttgggccaacccaaaatatgttcgcgcatggaagggtggcactggcgattgcaagatggggggaaactatgggtcctctctgttcgctcaatgtgaagcagtggacaacggctgccagcaggtactctggctatacggagaggaccatcaaataacagaagtgggtacaatgaatctgtttctttattggattaacgaagatggcgaagaagagttagccactccgccactggatgggataatactgcccggagttactcggcgttgcatcctggacctggcccaccagtggggcgagttcaaggtgtctgagcggtacctgacaatggatgatctgacaacggctctggaggggaacagggtgcgcgagatgttcgggtccgggacagcttgtgttgtgtgtccagtctctgacatcctgtataaaggtgagacaatccacattcctaccatggagaacggtccaaagctggcgtcccgcatattaagtaaattgactgatatacaatacggccgtgaggagagcgactggacgatcgttctgtcttag

SEQ ID NO: 216113 - DNA, 1161 bp, Artificial Sequence
  Description of Artificial Sequence: Synthetic coding sequence
atgaaggactgttcaaatggatgttcagccgaatgcaccggcgagggaggatccaaagaagtcgtcggcacatttaaagccaaggatctaattgttaccccagcaacgatcctcaaagagaaaccagatcctaacaacctggtcttcggtaccgtgtttactgaccacatgcttacagtggaatggagctcagagttcggatgggaaaagccccatattaagcctttgcagaacctgtcactgcatcctggtagctcagcactgcactacgcagtggagctctttgagggtcttaaagccttcaggggcgtcgataataagattagactgtttcagcctaacctcaacatggatagaatgtaccggtccgccgtgcgggctacattgcccgtgtttgataaggaagagctgctcgagtgtatccagcaactggtgaaattagatcaagagtgggttccatactctacttccgcatccctttacatccgcccaaccttcatcggaactgaaccatctttaggtgtgaaaaagcctaccaaggccctcctgtttgtgctgttgtctccagttggaccttactttagttcagggactttcaaccccgtctctctttgggccaatccaaagtatgtcagagcttggaagggcggtacaggagactgtaaaatgggtgggaattacggctcctccctatttgcgcagtgcgaggccgttgataacggttgccaacaggttctatggctttacggagaggatcaccaaattaccgaagtcgggacaatgaacctgtttctatattggattaacgaggatggggaggaggaactcgccactccaccgctcgacggcatcatactgcccggagttaccaggcgttgcatactggaccttgcccaccagtggggtgagtttaaggttagcgagaggtacttaacgatggacgatttaacgactgcactggaaggcaaccgagtgagggaaatgtttggaagcggtactgcctgtgtcgtctgtccggtgagcgatatcttgtataagggagaaaccatccacatcccaaccatggaaaatggcccaaagctggcgagtcggatcttgtctaaactcaccgatatccagtatgggagagaagagagcgactggactatcgtgctttcctag

SEQ ID NO: 216114 - DNA, 1179 bp, Artificial Sequence
  Description of Artificial Sequence: Synthetic coding sequence
atggccgcagccgcattggggcagatctgggccaggaagctgctgagtgtgccctggctgctgtgtggccctagacgttatgcatccagtagtttcaaggccgctgatcttcagctcgagatgactcagaagccgcacaagaagccagggccaggagaacccctagtttttggaaaaactttcaccgaccatatgctcatggtggaatggaatgacaaggggtgggggcagccacgcatccagccattccagaatctaacgctgcatccagctagttcttccctgcactactccctgcaactgttcgagggaatgaaggccttcaaaggtaaagaccagcaggtaagactcttccgcccatggcttaatatggaccggatgctgaggtccgccatgcggctgtgcctgccctcctttgataaactcgagcttctggaatgcatcaggaggctgatcgaagtcgacaaagactgggtgcccgacgcggcagggacatctctttacgtgcgccctgtattgattggtaacgagccgagcctgggggtgtcgcagcccacacgggctctgttatttgtgatcctctgccccgtcggggcttattttcccggtggctccgttactccggtgtcgttactcgccgaccccgcattcattagggcatgggtcggcggtgtcgggaactacaagttgggcggaaattacggccctaccgtcctcgtgcagcaggaggcgctgaaaagaggttgcgagcaagttctctggctgtacgggcctgaccaccagctgaccgaggttggaacgatgaatatctttgtgtactggacacatgaggatggggtgctggagctcgtgactccacctctcaacggcgtaatcctgccgggagtggtcaggcagagccttttggatatggcgcagacgtggggggagttcagggtggtagagaggacaatcactatgaaacagctgctccgggcattggaagaaggcagagtgagagaagtgtttggatcaggtactgcttgccaggtttgtcctgtacatcgaatcctttacaaagaccgtaacctccacattcccacaatggaaaacggaccggagctgatcctgagatttcagaaagagctgaaagagatacagtatggtatacgggctcacgaatggatgttcccagtttag

SEQ ID NO: 216115 - DNA, 1059 bp, Artificial Sequence
  Description of Artificial Sequence: Synthetic coding sequence
atgactcagaaacctcataaaaaacccggtcctggtgaacccctcgtgtttggaaaaacttttactgatcacatgttaatggtggagtggaatgataagggttggggacagccgaggatccagccttttcagaatttaaccctccatccagccagctcaagtttacattacagcttgcagctgtttgagggaatgaaagcattcaaaggaaaggaccagcaggtccgtctgtttcgcccatggctcaatatggatcgaatgctgcgatccgcgatgcggctctgcctgccaagctttgataagctggagctgctggaatgtatccgtcgattaatcgaggtcgacaaagactgggttcctgatgccgctggaacttccctttacgtccgcccagtactcatcggaaatgaaccatccctcggagtgagtcaacccacacgtgccctgttgtttgtcattctgtgcccagtgggagcctactttcctgggggttctgtaacaccggtgagcttgttagcagaccccgcatttatacgggcatgggtagggggagttgggaactataagctgggtggaaattacgggcctactgttctggtccagcaggaggctctcaaaagaggctgcgaacaggtcctctggctttacgggccagaccaccagctgactgaagttggtaccatgaatatcttcgtgtattggactcatgaggacggcgtcctagaactggtgacccccccacttaatggggttatcttgcccggtgtggtgcgccaatctttactggacatggcacagacctggggggagttcagagttgtggagagaaccattacaatgaagcagctcctgcgggcattggaggaaggccgagtccgcgaggtattcggttcaggcaccgcatgccaggtgtgcccagtgcaccgcattctatataaagatcgcaatctacacattcccaccatggaaaatggtcctgagctgatactccgcttccagaaagagctgaaagagatccagtatggaatcagagcccacgaatggatgtttccagtgtag

SEQ ID NO: 216116 - DNA, 903 bp, Artificial Sequence
  Description of Artificial Sequence: Synthetic coding sequence
atggctgccgcagctcttggacagctatttgaaggaatgaaggcttttaagggtaaggaccaacaggtcaggttattccgaccttggttgaacatggatcgaatgttgaggagcgctatgcgcctgtgtctgccctctttcgataaattggaactgcttgaatgcatccgacggttgatagaagtggataaggactgggtcccagatgcagccggaacttctctctatgtccgccctgtgcttatcgggaatgaaccttctctcggtgtctcccaacccactcgggcattgcttttcgtgattctgtgccctgtgggggcatacttccccggaggttcagttacgcctgttagcctcttagcggatcccgctttcataagggcgtgggtggggggagtgggtaactacaaactcggtgggaattacggaccaacagtcctggtgcagcaagaggcactgaaaaggggctgcgaacaagtgctgtggctgtacggccctgatcaccaattaaccgaagtgggaaccatgaacatctttgtctattggacccacgaggatggcgtactagaactggttacccctccactcaacggtgtcattctccccggagtggtgcgccagtcactgctggatatggcgcagacctggggggagtttagggtggtcgagagaacaatcaccatgaagcagctgctccgcgcactcgaggagggtcgtgtccgggaagttttcgggagcggtactgcctgtcaggtctgtcctgtccaccggatcctgtacaaggacaggaatctgcatattccaacgatggagaatggcccagaactcatcttgcgcttccagaaagaattgaaagagatccagtatggaatcagagcacatgaatggatgtttcccgtgtag

SEQ ID NO: 216117 - DNA, 1338 bp, Artificial Sequence
  Description of Artificial Sequence: Synthetic coding sequence
atggcggtcgccatcgccgcagcccgagtctggaggctgaaccggggtctttctcaggccgcactgttgcttcttcgccaaccaggggctcgcggtctcgcgagatctcatccacccagacaacagcaacaattctcctccctcgacgacaagccgcaatttcccggtgcatctgctgaattcatagataagctggaattcatacagccaaacgtgatatctggaataccaatttaccgcgtgatggatcgccagggacaaatcattaacccaagtgaagatcctcacttgccaaaagagaaggtgctcaaactttacaaaagcatgacactcctgaacacaatggaccgaattctctatgaatctcagcgacaggggagaatctctttttacatgacaaactatggtgaggaggggacccacgtgggttccgccgcagccctggacaacacagatctcgtgttcggtcagtatcgcgaggccggtgttttgatgtacagagattacccgctcgagctgtttatggcccagtgttacggcaacatcagcgatttgggcaaggggaggcaaatgcctgtccattacggttgtaaagagcggcactttgttactatttcctctccgctcgctacacagatacctcaggcagtcggtgctgcctatgctgctaagcgtgccaatgccaacagagtcgttatatgctactttggcgagggcgcagcttctgagggggatgcacacgctggatttaacttcgccgcaacgctggaatgccccatcattttcttttgccgcaataacgggtatgccattagtactccaacttccgaacaatacaggggggacgggatcgccgcaaggggcccaggttatggaatcatgtccattagggtggatgggaacgacgtttttgctgtgtacaatgctactaaagaggcccgaagaagggccgtagccgagaatcagccatttctgatcgaggccatgacatatcgtatcgggcatcacagcacatccgatgattccagcgcttataggagtgtagatgaggtgaattattgggacaaacaagatcatcctatatcccgactgaggcactacctactgtctcagggctggtgggacgaagaacaggagaaagcgtggaggaagcagtcccgaagaaaggtgatggaagcgttcgagcaagcggaaagaaaacccaagcccaatcccaacctgctgttctccgacgtttaccaggaaatgccagctcagctgagaaagcagcaagaaagcctcgctcggcacttgcagacttacggggagcattatcctctggatcacttcgacaagtag

SEQ ID NO: 216118 - DNA, 1212 bp, Artificial Sequence
  Description of Artificial Sequence: Synthetic coding sequence
atggctgtcgccattgcggcagcaagggtgtggcgcctcaatcgagggctgtcacaggccgctctgctgctgcttcggcaacctggcgcaagggggctggccagatctcaccccccacgccaacaacagcaattttcctcactcgacgataagcctcaattccccggagctagcgcagagtttattgataagcttgagtttatccagccaaatgtgatttccggcatcccaatctatagggtgatggacagacaaggacagatcataaaccccagcgaggacccacatctaccaaaggaaaaggtccttaagctgtataagtctatgactttgttaaacacaatggaccgcattctgtacgaatcccagagacagggcagaataagcttttacatgaccaactacggtgaggagggaacgcatgtgggatcagccgcagcattagacaatacagatttagtgttcggacagtacagagaggcaggggtgctcatgtatcgagactatcccctagaactgttcatggcccagtgttacggtaatatttctgacctcggaaagggcagacagatgcctgtgcactacggctgtaaagaacggcatttcgttacgatctcaagccccctggccacacagataccccaggctgtcggtgccgcatacgccgcaaagcgggctaatgctaatcgggtagtgatctgctatttcggtgagggcgcagccagcgaaggtgacgctcacgcgggatttaatttcgccgctactctggagtgtcctatcatctttttctgtcgtaataatggttatgctatcagcacgccaacttctgaacagtataggggagacggaatcgccgcacgtgggcctggatatggtatcatgtcaattcgcgttgatggtaatgatgttttcgcggtttatacagccaccggcggtccaaaggcacgagcctccgtagggccttcgtccccttccactactgggacatgtggaatcatgatgcctctgcatgcaatgggactgtggcaccctgtctctcaccagcaggaactgtcagccgcacctaagcctaagggtacaacaaagcccattctcgagtcatacttgaagagtcatttactgggacacagccggtaccagctttacatccaccaggatgctgtccgaagagagaagccccagagcaatttgaacagggagtcactgatttag

SEQ ID NO: 216119 - DNA, 1179 bp, Artificial Sequence
  Description of Artificial Sequence: Synthetic coding sequence
atggcggtggtggctgccgctgccggttggctcctgaggctgagggcggctggagccgaggggcactggcgacgcctgcctggagcgggactagccagaggattccttcatccagccgcaaccgtggaggatgcagcccagagacggcaggtagctcactttaccttccagcctgaccctgagccgcgagagtacggacaaacccaaaagatgaacctgtttcaatccgtgacttccgccctggataattcactcgctaaggatccgaccgcagtcatctttggggaggatgtggccttcggtggtgtattcagatgtactgtgggtctacgcgataagtatggcaaggacagagtatttaatacgccattatgtgaacaaggaattgtcggatttgggataggtatcgcagttaccggcgctacggcgattgcggaaattcagtttgccgactacatattccctgcttttgatcagatcgttaatgaagcggctaagtatcgctatagatccggcgacttgtttaactgcggctctctgactatcaggagcccatggggatgtgtgggccacggtgctctctatcatagtcagtctcccgaggcttttttcgctcactgcccaggtatcaaagtcgtcattcctagaagtcccttccaagctaaggggctcctcctgagctgcatagaagacaagaatccctgcattttctttgagccaaagatcctgtacagagccgctgccgaagaggttcccatcgagccgtataatatcccattatcccaggcagaggtgatccaagaaggcagcgatgtaactcttgtggcttgggggacacaagtacacgttattcgggaggttgcctcaatggctaaagaaaagctcggagtcagctgcgaagtgattgatctgagaaccatcatcccatgggatgtggatacaatctgtaagtccgtgatcaaaaccgggcgactgctgatatctcacgaggcaccactaacaggcggttttgctagcgaaatttccagcacagtgcaggaggagtgctttcttaatctcgaagcccctataagtcgtgtatgcggatatgatactcccttccctcatattttcgagccattttacattccggataagtggaaatgttacgatgcgctgaggaagatgatcaactattag

SEQ ID NO: 216120 - DNA, 1179 bp, Artificial Sequence
  Description of Artificial Sequence: Synthetic coding sequence
atggccgtagttgccgctgccgctggttggctgcttaggcttcgtgctgcaggcgctgagggccactggcggcgactcccgggagccggattggccagaggcttcctgcacccggctgcaactgtggaggacgccgctcagcgacgccaggtggctcactttaccttccagccagaccctgagcccagggaatatgggcaaacacaaaagatgaacttgtttcagtcagtaacaagcgctctggataattctcttgccaaggatcccactgccgtcattttcggggaggatgtggcgttcggaggggtctttaggtgtactgttgggctgcgtgataaatacgggaaggaccgggtgttcaatacccccttatgcgagcagggcattgtgggatttgggatcggaatcgccgtaaccggcgctaccgcaattgccgaaatccaatttgctgactacattttccccgctttcgaccagatcgttaacgaagctgctaaatacaggtacagatccggtgaccttttcaactgcgggtctctcaccatcaggtcgccctggggatgcgtcggccatggcgcactgtaccactcccagtccccagaggcctttttcgcgcattgcccaggcattaaagtagtcatacctcgctctccattccaagcgaaaggtctgcttttgtcttgcatagaagacaagaatccatgcatcttcttcgagcccaaaattctctaccgagcagccgctgaggaggtccctatagaaccgtataatatccccctgtcccaagcagaggtgatccaggaagggagtgacgtcaccctggtggcctggggcacacaggtgcacgtgatcagagaggttgcatctatggcgaaagagaaattgggcgtgagttgtgaggtaattgacctacgcacaatcataccatgggatgtagatactatctgtaagagtgtgattaaaaccggtaggctgttaatatctcatgaagcccctctcaccgggggatttgcctcggagattagctccaccgtgcaggaagagtgtttcctaaacttagaagccccaatatcccgggtctgtgggtatgatacacccttcccccacatctttgagcccttctatatccccgataagtggaagtgctacgacgctctaaggaaaatgatcaactattag

SEQ ID NO: 216121 - DNA, 657 bp, Artificial Sequence
  Description of Artificial Sequence: Synthetic coding sequence
atggctgtcgtggctgccgctgcaggatggctactcagactgagagctgccggagcggaaggccattggaggagactgccgggagctggtttggccagaggattcctgcaccctgctgccaccgtagaggacgctgctcagcgtcgccaggttgcccacttcacttttcagcctgatcctgaacccagggagtacggccaaacgcagaagatgaacttattccagtctgtgacttctgccctggacaattctctagccaaggaccccacagccgttatatttggtgaagatgtggcctttggcggtgtattccggtgtactgtgggtctgagagacaaatatgggaaggaccgggtctttaatacacccttatgcgagcaaggcattgttggcttcgggataggaatcgccgtcactggggcaactgccatcgccgaaattcaatttgcggactatatcttccccgcattcgatcaaatcgtcaatgaggcggcaaaatacaggtacaggtctggagacttgttcaactgtggatctctgacaatccgatcaccttggggttgcgtgggccatggtgccctctaccattcacaatccccggaggccttcttcgcacactgccctgggatcaaaatcaaggtgatcagtctaagctag

SEQ ID NO: 216122 - DNA, 969 bp, Artificial Sequence
  Description of Artificial Sequence: Synthetic coding sequence
atgaacttgttccagagcgtgacctctgccttagataacagtctcgcaaaagaccctactgcggtgatatttggggaggatgtggcttttggcggagtatttcgttgtacagtgggcctacgagacaaatacggaaaagatagggtgtttaacactccgctctgcgagcaggggatagtcggttttggaattggcattgccgtgacaggtgctaccgccattgccgagatacagtttgctgattacatctttcccgctttcgatcagatcgtgaacgaggctgctaagtatcgataccggtcaggggatctgttcaattgcggctcgctgaccatacgtagcccttgggggtgtgtgggtcacggcgctttataccatagtcagagcccagaagcttttttcgcacattgtccaggcatcaaggtggtcattccacgttcaccattccaggctaagggcctgctcctgtcgtgtatcgaggacaaaaatccatgtatattttttgagcccaaaatcctgtaccgcgctgccgcagaggaggtgccaatcgagccatacaacatacctttaagccaggccgaagttatacaagaagggtccgatgttacgctggtggcttgggggactcaagtgcacgtcatccgagaggtggcatcaatggcaaaggaaaagctgggtgttagctgcgaggtcatcgacctgagaacaatcatcccctgggatgtggacactatttgtaagagtgtgatcaagaccggcagactgctgataagccacgaggcccctctcacagggggtttcgcaagtgagatctcttcgactgtccaggaggagtgttttcttaacctggaagcccctatctcacgggtgtgcgggtatgacaccccattccctcacatctttgaacctttctacatccctgacaaatggaagtgttatgacgcgctgcgcaaaatgatcaactattag

SEQ ID NO: 216123 - DNA, 657 bp, Artificial Sequence
  Description of Artificial Sequence: Synthetic coding sequence
atggccgtcgtggccgcagccgctggctggctgctgcgcctcagagccgcaggagctgagggccactggaggaggcttccaggagccggtctggcaagagggttcctgcaccccgcagccaccgtggaggatgctgcacagcgaagacaagtcgcccattttacattccagccagaccctgaaccacgggaatatggccagacacagaaaatgaacctgttccagagcgtaactagcgctctggataatagcttagctaaggacccaactgcagtgatctttggtgaggacgtggcttttggcggtgtgtttagatgcacagtcggactgagagacaaatacggcaaggatcgcgtctttaacacgcccctgtgtgagcaggggatcgttggattcggcatcggtattgcagtgaccggcgctacagccatcgccgaaatccagttcgcagactacatcttccctgcgtttgaccagatcgtcaacgaggctgcaaagtacagatatcgctctggggatctgttcaattgcggctctctgacaataaggtctccctggggctgcgtgggccacggagccctctaccactcccagagtccggaggcttttttcgcccattgccccggtatcaagattaaagttatctctctcagctag

SEQ ID NO: 216124 - DNA, 1779 bp, Artificial Sequence
  Description of Artificial Sequence: Synthetic coding sequence
atgtctgtcagtctggtcgtcattcgcctcgagctggccgaacattcaccagttccagcagggtttgggttttctgctgctgccggtgaaatgagcgacgaagagatcaaaaagacaacgttggcctctgcagtggcctgcctggagggcaagtccccaggcgagaaggttgccattattcatcagcacctgggacgccgagaaatgacagatgtgatcatcgaaacaatgaagtctaaccctgatgaacttaaaactacagttgaggagagaaaatcatccgaagcatccccaactgcacaaagatctaaggatcattccaaggaatgcattaatgccgctccagacagcccctccaagcagctgcctgaccagatcagtttttttagtgggaacccatccgtcgagatagtgcatggaatcatgcatttgtataagacaaacaagatgacctccctgaaggaagacgtcaggcgcagcgctatgctatgcatcctgactgtgcccgcagccatgacatcgcatgacctgatgaagtttgtagccccatttaatgaagtcatcgaacagatgaaaatcattagggacagcacgcctaaccagtacatggttctcattaaattcagagcccaggccgatgccgatagtttttatatgacctgtaatgggagacagttcaactccattgaggatgacgtttgtcaactggtgtatgttgaaagagcagaggtgctgaaaagtgaagacggcgcaagcctccccgtcatggacttgacagaactgcccaagtgcaccgtatgcctagaaagaatggatgagagcgtaaatggcatcctaacaaccctgtgcaatcattcgttccactctcagtgtctgcagcgctgggatgacaccacatgcccagtgtgcagatactgccagacacctgagccggtggaggaaaacaagtgcttcgaatgcggcgtgcaggagaatctgtggatctgtctcatttgtggccacattggatgcggccgatatgtgtcaagacacgcttacaaacacttcgaagagacgcagcatacctacgcaatgcaactaaccaaccaccgcgtctgggattatgcaggcgacaactatgtgcataggctggtggcttccaagactgatggcaaaatcgttcaatatgaatgcgagggggatacatgccaggaggagaaaatcgacgccctgcagctcgaatactcctacctactgacctcacagttagagagtcagagaatctactgggagaataaaattgtgagaatcgagaaagatacagccgaggagatcaacaatatgaagacaaaattcaaagagaccatcgaaaaatgtgataatctggagcacaagttgaacgatctgctgaaggagaagcagtctgtggagcggaaatgtactcagctaaataccaaggtggccaaactcacaaatgaattgaaagaggagcaggagatgaataaatgcctacgggctaatcaagtcctgctgcaaaacaaactcaaggaggaggagcgagtattgaaagagacatgtgaccagaaggatcttcagattacagagatccaggaacagctgcgagatgtcatgttctatctcgagacacaacaaaaaattaaccacctcccagccgagacccgacaagaaattcaggagggccaaatcaatattgcaatggcaagtgcctccagccctgcatccagcggcggatcaggaaaacttccgagccgcaaaggccgatcaaaacggggtaaatag

SEQ ID NO: 216125 - DNA, 1242 bp, Artificial Sequence
  Description of Artificial Sequence: Synthetic coding sequence
atgcatttatacaaaactaataagatgacctctcttaaggaagatgtgcgcagaagcgcaatgctgtgcatcctgactgtcccggcagccatgacctcccatgacctcatgaaatttgtggcgccttttaatgaggtgatcgagcagatgaaaattatacgcgactccacccctaatcagtatatggtgctgattaagtttagagctcagggggcttccctgccagtgatggatctgacagagctgcccaaatgtactgtgtgtttagagaggatggatgaatccgttaatgggatcttaaccacactctgtaaccattcattccatagccaatgtttacagcgctgggatgatacaacctgtcccgtctgtagatattgtcagacccctgaacctgtagaagaaaacaagtgctttgagtgcggcgtacaggagaatctttggatttgcctgatctgtggccacatcggttgtggcagatatgtgtcaagacacgcatacaaacacttcgaagagacccagcacacctacgcgatgcagctgacaaaccaccgcgtgtgggactacgctggagacaactatgtgcaccgcttggtcgcaagcaaaacagatggcaagatcgttcagtacgagtgtgagggcgacacttgccaggaagagaagatagatgcactgcagttggaatattcatatctcctaacctcacaattagagagccaaaggatttactgggagaataaaatagtgagaattgagaaagatactgcagaggaaatcaataatatgaagaccaagttcaaggaaacaatagagaagtgcgataacttggagcacaaactgaacgacctgctgaaagaaaaacagtcagtggagaggaaatgcacacagttgaacacaaaagtggcaaaactgactaatgagttgaaggaagagcaggaaatgaacaagtgcttgcgggctaaccaggttctgctgcagaacaagcttaaagaggaggagagagttttgaaggagacatgtgatcagaaagaccttcagattactgagatccaggagcagctgagggacgtgatgttttatcttgagactcaacagaagatcaatcatctgcccgctgaaacccgtcaggaaatccaggaagggcaaattaacatagctatggccagcgcaagctccccagcatcttccggtggcagcggaaagttgccatcacgaaagggcagatctaaaaggggcaaatag

SEQ ID NO: 216126 - DNA, 2136 bp, Artificial Sequence
  Description of Artificial Sequence: Synthetic coding sequence
atgaataagggctggttggaactggaaagcgacccaggcctgttcaccctattagtggaggactttggtgtcaagggcgtccaggtcgaggagatctacgacttgcagtccaagtgccagggacctgtgtatggattcatctttctctttaaatggattgaagagaggcgttccagaagaaaagtgagtacactggtcgacgacacaagtgtgatcgatgatgatatcgtgaacaatatgttctttgcccatcaacttattcctaattcctgtgctacacacgctttgttgtcagttctgctcaattgcagttctgtcgatctggggcctaccctatccaggatgaaagacttcaccaaaggttttagccctgaaagtaagggctacgctatcgggaatgccccagagctggctaaggcccacaacagccacgcccgaccagaaccacggcacctgcctgagaagcagaatggtctcagcgcagttcggacaatggaagctttccactttgtttcctatgtccccattaccggtcggctgtttgaactggacggcttgaaggtgtatcccatcgatcatggaccttggggcgaggacgaagagtggactgataaagcccgtagggtgattatggagaggatcgggttggctactgccggtattaagtacgaggctcgcctgcacgttcttaaggtcaacaggcaaaccgtgctcgaggctctccaacaacttataagagtgacacagccagagctgatccagacgcataagagtcaggagagccaactcccagaggagtcaaagtctgcttctaataagagtccactcgtgctggaggccaatcgcgctccagctgccagtgaaggcaaccacacagatggtgcggaggaagccgcagggtcttgcgcccaggcacctagccatagccctcctaataaacctaagctggtggtaaagccaccagggtccagtctgaacggggtgcatcctaacccaacccccatcgtccagcgcctgccggcattcctggacaatcacaattacgccaaaagtcctatgcaggaagaggaggacctggcagccggtgtaggtagatctcgggtgcccgtgagacccccacagcagtatagcgacgacgaagacgactacgaagatgatgaggaagatgacgtccagaatacgaatagtgccctgcgatacaaaggaaaagggacaggtaaaccaggagcgctatcgggctctgccgacgggcagctgtcagtcttgcaacctaatacaatcaacgtgttggcagagaagctaaaggaatcccagaaggacctcagtatcccgctgtcaataaagaccagcagcggagctgggtcacctgctgtcgccgtccccactcactcccaacccagccctacaccctcaaatgaaagcactgacactgcctccgagattggatccgccttcaactcccccctcagatcacccattcgttcggctaacccaacacgtcctagcagcccggtgacttcacacatatccaaggtcctctttggagaagacgatagcctattgcgggtcgactgcattcgctacaatcgggctgtaagggaccttggaccggtcatatctaccggactcttgcacctagcggaggacggagtgctgtcgcccctggcactgactgaaggagggaaaggaagcagtccctccatccggcctatccagggaagtcagggcagcagctcccccgtcgaaaaggaggtagtggaagccacagactcacgagaaaagacagggatggtccgtcctggcgaaccattatctggcgaaaaatatagccctaaggaactacttgccctgcttaagtgtgttgaggctgagattgcaaactatgaagcctgtttaaaggaagaggtcgagaagaggaaaaagtttaaaatagatgatcaacgacgcacacacaattacgatgagttcatctgcaccttcatcagtatgctggctcaggagggcatgctggctaatctggttgagcagaatatatccgtgaggaggcggcaaggcgtgtctatagggagacttcataaacagaggaagcctgacaggaggaagcgtagccggccatataaagcaaaaagacagtag

SEQ ID NO: 216127 - DNA, 2190 bp, Artificial Sequence
  Description of Artificial Sequence: Synthetic coding sequence
atgaacaaggggtggctggagctggaaagcgaccctgggttgttcactctcctggtggaggactttggagtcaagggagtccaagtagaggaaatttatgaccttcagtctaagtgccagggtccagtttacggttttattttcctattcaaatggatcgaggaacggagaagccgccgtaaggtttccaccctcgtggatgacacatctgttatagatgatgacattgtgaataacatgtttttcgcccaccaattaatccctaacagctgtgcaacacacgccttgctgagtgtgcttttgaattgctccagcgtggatctaggaccaacactcagccgcatgaaggatttcaccaagggcttttctcctgaaagcaaaggatatgctataggcaatgccccagagttagcaaaggcccataatagtcacgcacggccagagcccaggcacctgccagaaaaacaaaatgggctctccgcagtacgcaccatggaagctttccactttgtgagttacgttcccataacagggagattatttgagctagatggtctgaaagtctatccaattgaccatgggccatggggagaagatgaagagtggacagataaggcccgaagggtgataatggaaaggattgggcttgccacagcaggcgagccttaccatgatattcggttcaacctgatggccgtcgtgcctgatcgtaggattaagtatgaggccagattgcacgtactaaaagtaaataggcagacagtgctagaggcattacagcagctaatcagagtgacccaacctgagctaatccagacccataagtcccaggagtcccagctgcccgaggagtccaagtcggcctctaataaatcgccactggtgctcgaagcaaatcgtgcccctgctgcttcagagggcaaccacactgatggggcagaagaggccgctgggagctgtgcacaggctcccagccactctcctccaaacaagccaaagttagtagtcaagcctccagggagcagccttaacggagtgcaccccaatcccactccgatcgtacagcggctgccagccttcctggacaatcataactacgccaaaagccctatgcaggaggaagaggacctcgcagctggcgtgggcagaagccgggtgccagttaggcctccccagcaatatagtgacgatgaagacgattacgaagatgatgaggaggatgacgtgcagaatactaacagcgccctgaggtacaaaggaaaggggaccgggaaaccaggcgcactcagcggaagcgcagatgggcagctttcagtgttacaacctaacaccattaacgtgttagccgagaagctcaaggagtcccaaaaggatcttagtattcccctttcaatcaaaacgtcgtccggagctggcagccccgctgtggctgtacctacgcacagccaaccgtctccaaccccaagcaacgaatccacagacactgcctctgagattggatccgcctttaattcacctctacgaagccccattcgctctgctaaccccacccgtccctcctctcctgtaacctcccacatcagcaaagtgctgttcggagaagacgactcactcctaagggtcgattgcatcaggtacaaccgagccgttcgcgaccttgggccagtgatttccaccggcctgctccacctggccgaggacggtgttctgtccccgcttgccctgacagagggaggcaaggggtcttcaccgtccatcaggcccatccagggcagtcagggcagctcgtctcccgtagaaaaggaggtggttgaggccaccgacagccgagaaaagacaggcatggtcagaccaggagagcccttaagcggtgagaagtacagtccgaaagagctgttggccctcctgaaatgtgttgaggccgagatcgccaactatgaagcctgtctgaaggaagaggtagagaaacggaaaaaatttaagatcgacgaccaacgcagaacccacaattacgatgagttcatttgcaccttcattagtatgctagcccaggaaggtatgctggcaaacctggtcgagcaaaacatcagtgtacgcaggcggcagggtgtgtcaatagggaggctgcacaaacagaggaagcctgaccggcgtaaaagaagtcggccttacaaggccaagcgccagtag

SEQ ID NO: 216128 - DNA, 879 bp, Artificial Sequence
  Description of Artificial Sequence: Synthetic coding sequence
atggccgtgcaggtggtgcaggctgtgcaggccgttcacctagagtcagacgctttcttggtgtgtctcaatcacgccttatcaacggaaaaagaagaggttatgggattatgcattggggagcttaacgatgacacatcccgtagcgatagtaagttcgcttataccgggacagagatgcggaccgtcgcagaaaaggtggatgccgtgagaatagtgcacattcatagcgtgatcatccttcggcgaagcgataagagaaaggaccgggtggagatctccccagagcaattaagcgctgcctcaacagaagccgagaggctggccgagctcaccgggcgacccatgagagtcgtgggttggtaccactcacaccctcacattactgtttggcccagccacgtggatgtgagaacccaggcaatgtatcagatgatggaccagggattcgtcggtctgatattttcgtgctttatagaggacaagaacactaagactggcagggtgttatatacatgctttcagagcattcaggcacagaagagtagtgagtatgaacggattgaaattccgatccacattgtaccccacgtgaccatcggcaaagtttgtttagaaagtgccgtggagctcccaaaaatcctgtgccaggaggagcaggacgcgtatcgacggattcatagtcttactcatcttgactccgttaccaagatccataacggcagtgtgtttaccaagaatttatgctcacagatgtctgcagtttcaggtcccttattgcaatggttggaggacaggctcgagcagaatcaacagcatcttcaagagctacagcaggaaaaggaagagctgatgcaggaactatcttccctggaatag

SEQ ID NO: 216129 - DNA, 876 bp, Artificial Sequence
  Description of Artificial Sequence: Synthetic coding sequence
atggccgtgcaggttgtacaggccgttcaagcagtccacctggagtccgatgcctttctggtttgcctcaaccatgccttgtcgacagaaaaagaggaagtgatggggctgtgtattggggaactaaacgacgacacaaggtccgactctaagttcgcttacaccgggacggaaatgaggacagtagctgagaaagttgacgctgtgcgtatcgtgcatattcactctgtaatcatactccgtcggtccgataaaaggaaggaccgcgtggagattagccctgagcagctcagcgctgcttctacagaggctgaacgccttgctgagttgacggggagacctatgcgcgtcgtggggtggtatcattcccacccgcatatcactgtgtggcccagccacgttgatgtgaggacccaggccatgtaccagatgatggatcagggttttgttggcctcatattcagctgttttatcgaagacaagaacactaagacgggcagggtattgtacacctgttttcagtctattcaggcacagaaaagctctgaatatgaaaggatcgaaatcccaattcatatcgtgccccatgtgacaattggcaaggtctgcctcgagagcgccgttgaactcccaaagattctgtgccaagaggagcaagatgcttataggagaatacactccctgacacatctggatagcgttaccaagattcacaacggctctgtcttcactaagaacttgtgctcgcagatgtccgccgttagcgggcctctgctgcagtggttagaggatcgactagaacaaaatcagcagcacctacaggaacttcagcaggaaaaagaagagttaatgcaggagctgtcgtccttggaatag

SEQ ID NO: 216130 - DNA, 951 bp, Artificial Sequence
  Description of Artificial Sequence: Synthetic coding sequence
atggctgtgcaggtagtgcaagccgtgcaagccgtgcacctagaatccgacgctttcctagtctgtctgaaccacgccctgtccacggagaaggaggaggtgatgggcctgtgcattggcgaattaaacgatgacacgcgctccgacagcaaattcgcttatactggcaccgaaatgaggacagtagcagagaaggtggatgctgtcagaatagttcacatccattccgtcataatactcagaaggtctgacaagcggaaagatagggtcgagatcagccccgagcagctgtcggccgcttctaccgaagctgaacggctggccgagttgactggacgtcccatgagagtggtaggctggtatcactcacatccacacatcactgtttggccctcccacgttgatgtaaggactcaagccatgtaccagatgatggatcaggggttcgtaggattgatatttagctgttttatcgaagacaagaacaccaaaaccggacgggtcctgtacacatgtttccagtccattcaggcccagaagagctctgaatccctgcatggccctcgagatttctggtcttcttctcagcatatcagcatcgagggccaaaaagaagaagaacggtatgaacgtattgagataccaattcatatagtgcctcacgttacaattggaaaggtttgcctggaatcggctgtcgagctgccaaaaatattgtgccaggaagaacaagatgcgtatagacgcattcatagtctgactcatctggatagtgtgacgaagattcacaacggaagtgtattcactaagaacttatgtagtcaaatgagcgctgtgagcgggccactgttgcagtggctagaggacaggctggagcagaatcaacaacatcttcaggaactgcaacaagagaaggaagagttaatgcaggaactgtccagccttgaatag

SEQ ID NO: 216131 - DNA, 954 bp, Artificial Sequence
  Description of Artificial Sequence: Synthetic coding sequence
atggcagtacaagtggtgcaggcagtccaggctgtccacctggaatccgatgctttcctggtgtgcctgaatcacgcactctcaactgagaaggaggaagtgatgggcctctgcatcggtgaagtgagctccccgtctagatccgattctaagtttgcctatactggcactgagatgcgtacagtggctgagaaagtcgacgcagtgcgcatagtgcacattcactcagtgatcatcctgcgcagatccgacaaaaggaaagaccgcgtggaaatcagtcccgagcaactatccgcagcctccaccgagacccacaggctggccgaactcaccggacggcctatgcgggtagtgggttggtaccatagccaccctcatatcaccgtctggccctcacatgtggacgtgcggacccaagcaatgtaccaaatgatggatcagggctttgtcgggttgatcttctcttgctttattgaagacaaaaatactaaaacagggcgtgtgctttacacgtgctttcaaagtattcaggctcaaaaatcatcagaaagtctgcacggccctagagatttttggagcagtagccagcacatttccattgaggggcaaaaagaggaggaaagatatgagaggattgagatacctatccatattgtaccgcatgtaacaattggaaaggtgtgtctggagtcggcggtggaattgcctaaaatcctttgccaagaggaacaggatgcctatcgcagaatacattctcttacccacttggatagtgtgaccaaaatacacaacggaagcgaagtatttactaagaatctttgtagccagatgtccgccgtgtccggtcctcttctgcagtggttagaagaccgactggagcagaaccagcagcacctgcaagaattgcagcaggagaaagaagagctgatgcaagagctctcaagccttgagtag

SEQ ID NO: 216132 - DNA, 747 bp, Artificial Sequence
  Description of Artificial Sequence: Synthetic coding sequence
atggccgtgcaagtcgttcaggccgttcaggccgtacatcttgagagcgacgcttttctcgtctgtctgaatcatgcactgtctaccgaaaaggaagaagtaatgggcttgtgcatcggcgaagtttcgagcccaagccgctcagacagtaagttcgcctataccgggacagagatgcgcaccgttgccgagaaggtggacgcggtgcgaatagtccacattcactccgtaataatcctgaggagatctgacaaacggaaggacagagtcgaaatctcacctgagcagctcagtgctgcaagcacagaaacacatcgcctggccgaactgaccggtaggcctatgcgcgtagtgggctggtatcactcccacccacatataactgtgtggcctagtcacgtcgatgtaaggactcaggctatgtatcagatgatggaccaggggtttgtggggcttattttttcatgctttattgaagataagaatactaagacagggcgtgtcctatacacgtgtttccagtctatccaagcccaaaagtcaagcgaccttacacatctggatagtgtaacaaaaatccacaacggaagcgaggtattcacaaaaaatttgtgttcccagatgtctgctgtgtccgggcctttactccagtggctggaagaccgtctcgaacaaaaccagcagcatcttcaggagcttcagcaggagaaagaggagttgatgcaggagctgagctctctggagtag

SEQ ID NO: 216133 - DNA, 1845 bp, Artificial Sequence
  Description of Artificial Sequence: Synthetic coding sequence
atgggaaaccagatgtccgtcccccagcgggtcgaggaccaagaaaatgaaccagaagcagaaacttaccaggataacgcctcagctctcaatggagtgcccgtggtggtctccacacatactgtgcagcatctggaggaggttgatctcgggatatcagtaaagaccgacaatgtcgctacaagtagccccgagaccaccgaaataagcgccgtggctgacgccaatggaaaaaatctgggaaaggaggcaaagcccgaggcacctgcagctaagtcccgattctttttaatgctttcccggccagtgccaggtagaacgggcgaccaggctgcagatagttccctcgggtcagtaaagctggacgtgtcttccaataaagcccctgccaacaaagacccttctgaatcctggacactgccagttgcagccggtccaggccaggacactgacaaaacccccggacacgcaccagctcaagataaggtgctgtcagctgctcgcgaccccaccctgctgccacctgagaccggtggcgcagggggagaggctccatccaaaccaaaggattcctctttcttcgacaagttcttcaagctggataaggggcaggagaaggttccgggagattcccagcaagaggcgaagagagcagagcaccaggacaaggttgacgaggtgcccggactaagcgggcagtcagacgatgtgcctgcaggtaaagatatcgtggacggtaaagaaaaagaggggcaggaactgggtaccgccgactgctcggtgcccggagatcctgaaggtctcgaaacggcaaaggacgattctcaggccgcagcgatcgccgagaataacaattctataatgtctttcttcaagacccttgtgagtcccaacaaggcagagactaagaaggatccagaggatacagccagcaaggccgagagcgtttgcgacgggcaggccggacagaagacctcggaaatacaggcaagaggaaccaagaaaaaacacctggactcacctcgtctgggcctggcctttaggaagttttttcggcataagggcgctgagaaatctcccacgaccagcgccgacctgaagtccgacaaagccaactttacctcacaagaaacacagggcgcaggcaaaaattctaagggatgtaacccctccggacatacgcaatcagtgaccactcccgaaccagccaaggaagggaccaaggagaagtccggaccgaccagcctgcccttaggtaagcttttctggaaaaaggttgtatgcgaatcccccgttgagatcattaagtccaaagaggtggaaagtgctctccagacagtggatctaaacgagggggacgccgcaccagagccaacagaagcgaagctcaagcgcgaggaatcaaagcccaggacatctctcatggctttcctccgccaaatgacttcggattccacggaaaagaccattactccaccggagccggaaccaactggggctccacaaaagggcaaggaagggtcttctaaagataagaagtcagcagccgagatgaacaagcaaaaaagtaataaacaggaggccaaagaacccgcacagtgtaccgaacaggccaccgttgataccaattctctccagaacggcgataagttgcagaagcggcctgaaaagcgacagcaatccctgggagggtttttcaaggggctggggcctaaacgcatgctggacgctcaagtacagactgatccagtgtccattggtcccgtgggtaaaagtaaatacacaggaaaatgcgtgttctcccatgtcaagaagaaatggccatttcaggaatggagctattag

SEQ ID NO: 216134 - DNA, 1755 bp, Artificial Sequence
  Description of Artificial Sequence: Synthetic coding sequence
atgggaaatcagatgtccgttcctcaacgggtggaagaccaggagaatgagcctgaggcagagacatatcaggacaatgcatcggcccttaacggggtacctgtcgtggtctccacacataccgttcaacatcttgaagaggtggacttgggaatatctgtgaaaaccgacaacgttgccaccagctcccccgaaaccaccgaaattagtgcagtagcagacgccaatggaaaaaacttaggaaaggaggcgaagccagaggcacccgcagctaaaagcaggttcttcctgatgcttagtaggccggtgcccggacgcacaggcgaccaagctgcggactcctccctcggttctgtcaaactggatgtatcctcgaataaggcacctgctaataaggacccctcagagagctggacccttccagtggccgctggccctggacaggatacggataaaacccctggtcacgctccggctcaggataaggtactcagcgccgctcgggaccctacactgctgccgccagagacagggggtgccggaggagaagcacctagcaaaccaaaggattcctcgtttttcgacaaattttttaaattagataaaggtcaggagaaggtacctggtgattcccaacaggaggctaagcgcgctgaacaccaggacaaggtggacgaggtgccgggactgtccggtcaaagtgatgatgtgccagctggcaaagacatcgtcgacggcaaggaaaaagaaggccaagagcttgggaccgctgattgttccgtccctggggatccagaaggcctagaaactgccaaagacgacagtcaggccgctgcaatcgccgagaataacaactctatcatgagcttctttaaaaccctggtgtctcccaacaaggcggaaaccaaaaaggaccccgaagacaccggcgctgaaaagagtcctaccactagtgccgatctgaagtctgacaaggctaacttcacttctcaggaaacccagggggctgggaaaaattccaagggctgtaacccaagcggtcatacccagagcgtaacaactccagagcctgccaaggaaggtacaaaagagaaaagtggcccaactagtctgcccctcgggaaactgttttggaaaaagagtgtcaaggaggactcagtgcctacaggggctgaagagaacgtagtctgcgagtcacccgtagaaatcatcaagtctaaagaggtggagagcgcgctgcagaccgtggatctcaatgagggtgacgctgcaccagagccgacagaagccaaattgaagcgtgaagaatccaaaccaagaacctccctgatggcattcttaagacagatgagcgtaaagggagatggagggatcactcactctgaggaaataaatggaaaagattcttcgtgccaaactagtgacagcacagaaaaaaccatcaccccaccggagccagagccaacaggggcaccgcaaaaaggcaaagagggatcatccaaggacaagaagtccgctgcagaaatgaacaaacagaagagtaataagcaagaggctaaggagccagcccagtgtaccgagcaggcaaccgttgatacgaactccttgcagaacggggataaacttcagaagcgccctgagaagcggcagcaaagcttggggggatttttcaagggtttggggcctaagcggatgctagacgcccaggtgcaaacagaccctgtctctattgggcctgtaggaaagtctaaatag

SEQ ID NO: 216135 - DNA, 495 bp, Artificial Sequence
  Description of Artificial Sequence: Synthetic coding sequence
atgttgagtagaccagtgccagggcgtacaggggatcaggccgctgattcttctctgggctccgtaaaactcgatgtatctagtaataaggctccagccaacaaagacccgagtgagtcctggacactgccagtagctgctggacccggacaagatacggataaaacacccggtcatgcccctgcacaggacaaggtgctgtcagccgctcgggaccctaccttattgcctccagagaccgggggtgctgggggagaggcacctagcaagcctaaagatagcagctttttcgataaatttttcaagcttgacaagggtcaagagaaagtgcccggagactcccagcaggaggcgaagcgggcagaacatcaggacaaagtcgatgaagtgccgggtctctcaggacagagcgacgatgtgcccgcaggcaaggtgagtgtgccccgttgcatacacctggtgcttaacgcctgctcaggtgcgcttatgggctag

SEQ ID NO: 216136 - DNA, 753 bp, Artificial Sequence
  Description of Artificial Sequence: Synthetic coding sequence
atgagctttttcaaaaccctcgtgtcccccaataaagcagaaacaaagaaagatccagaagataccgcctctaaagccgagtccgtgtgcgatggtcaggctgggcagaaaacctcagaaatccaagccaggggcacaaagaaaaagcatctcgattcccccagactaggcttggcttttcggaagttcttccggcacaagggggcagaaaaaagccccactaccagcgcggatctgaaatcggataaagccaatttcacctcacaggaaacccagggtgctggaaaaaattctaaaggttgcaacccctccgggcacactcagagtgtcaccacacccgagccagctaaggagggcactaaggaaaagagcggacccacctctctgccgctggggaagctgttttggaaaaaaacctccgacagtaccgagaaaactatcacaccgccagagcccgaacctactggggcaccacagaaaggtaaggagggtagttctaaagacaagaaaagtgccgcagaaatgaacaagcaaaaatccaataagcaagaagccaaagagcctgcgcagtgcacagagcaagctactgtggacaccaattcactgcagaacggggacaaattacagaaacgaccggagaaacggcagcagtctctggggggatttttcaaggggctgggaccgaagcgcatgctggacgcccaagtgcaaaccgaccctgtttccatcggaccagttggtaagtccaaatag

SEQ ID NO: 216137 - DNA, 1155 bp, Artificial Sequence
  Description of Artificial Sequence: Synthetic coding sequence
atgagtgctccaatcaagctgcagcgcaccaagacccaggtgagagctggccactttcgctggcaactcgacagaggacgaacgcagatcaagcctcagggaacacctcgacccaaaacgcggtctagccttccacccggaatacctcggttctctcatctgagacagggtgagcaagaggaaaagcttcctccatccccgagaaccccttttttcgacaagttctttaaactcgacaaaggccaagaaaaagtccccggagattcgcagcaggaagcaaagcgggctgaacatcaggacaaagtggatgaagtcccagggctgagcggccagagcgatgacgtgccagccggtaaggacatcgtggatggcaaggagaaggagggtcaggagctaggaaccgcggattgctccgtgcctggcgatcccgaaggactggagacggcaaaagatgattcccaagccgcagccatcgctgagaacaacaatagcattatgtccttctttaaaacccttgtgagccctaataaagctgagacaaaaaaggatcctgaggataccggcgctgaaaagtctcccaccacctccgccgacctgaagagcgataaagccaattttacttcgcaagagacgcagggcgcagggaagaacagtaagggatgtaatccatccgggcatactcagtctgtgacaacccctgagcccgctaaggagggaaccaaggagaagagtgggcctacctccttgcctctggggaagttgttttggaagaaatccgtgaaggaagactctgtgcctaccggcgctgaggagaacacgtccgacagtaccgagaagactattacccctcccgagccagagccaactggggcaccccagaaagggaaggagggaagctccaaagacaagaaaagtgcagctgaaatgaacaaacaaaaaagcaacaagcaggaggcaaaggagccagcccagtgcactgaacaggcgactgtggacacaaactcacttcagaacggagacaagttgcagaaacggccagagaaaagacagcaaagcctgggaggtttcttcaagggccttggtcctaagaggatgcttgacgctcaggtgcagacggaccctgtgtctataggtcccgtgggaaagtccaagtag

SEQ ID NO: 216138 - DNA, 678 bp, Artificial Sequence
  Description of Artificial Sequence: Synthetic coding sequence
atggccggtacaggccttgtagccggagaggtggtggtggatgccctgccgtattttgatcagggatatgaggcaccaggagtgcgcgaggcagctgctgcactcgtggaagaagagactcggcgataccgacctacaaaaaactacctgtcctatctgactgcgcctgattatagtgctttcgagaccgatattatgaggaatgagtttgagagactggcagctcgtcagcccatcgagttgctcagcatgaaacgttatgaactccccgctcctagttctggccagaagaacgatattactgcttggcaggaatgcgtcaataattctatggcccagttggagcaccaggccgtgaggatcgagaatttagaattgatgagccagcacggctgcaacgcttggaaggtgtacaacgagaacttggtgcacatgatcgaacacgcccagaaggagctgcaaaaattacgtaaacacatacaggatttgaattggcaacggaaaaatatgcagctcacagcaggctccaagctgcgtgagatggaatctaactgggtcagtctggtctccaaaaactatgagatcgaaagaaccatcgtccagcttgagaatgaaatctatcagattaaacaacagcacggtgaggctaataaggaaaatatccgccaggatttctag

SEQ ID NO: 216139 - DNA, 477 bp, Artificial Sequence
  Description of Artificial Sequence: Synthetic coding sequence
atgcagagaacaggcggtggtgcccctaggcctggtaggaaccacggactgccaggctccttgaggcagcccgacccagtggccctcttgatgctgctggtggacgccgatcagcccgaacccatgcgaagcggcgctcgagagctcgctctgttcctcacacctgaacctggggcagaggccaaggaagttgaagaaaccatcgaggggatgttgcttagactcgaggaattctgctctctggccgatctgatcaggtctgacaccagccaaatcttagaagagaacattcccgtgctgaaggctaagctgaccgagatgagaggaatttacgctaaggtcgatagactcgagaaatcaccggctcctgttcctgtcacatatgaactgcccactctgtacaggacagaggattatttccccgttgatgccggtgaagcgcagcaccacccgaggacttgccctagacccctgtag

SEQ ID NO: 216140 - DNA, 570 bp, Artificial Sequence
  Description of Artificial Sequence: Synthetic coding sequence
atgcagcgcacagggggaggagccccaaggcccggacggaatcatggcctccctggatctctgcggcagccggaccccgtggcactgttgatgctgctggtagacgcagaccaaccagaacccatgagaagtggtgcgagggagctcgcactcttcctcacacccgagcccggtgctgaggcgaaggaagtggaagagaccatagaagggatgctcctgcgccttgaagagttctgcagcctggctgacctaattagaagcgacacatcccagattttggaagaaaacatcccagtgctgaaagctaagcttaccgagatgaggggcatctacgctaaggttgatagacttgaggccttcgttaagatggtgggtcatcatgtggctttccttgaagcagacgtattgcaggccgaaagagaccatggagcatttccccaggccctgcggagatggttgggttcagcagggttaccttctttccgcaatctagagtgtagtggagccattctggcccattgcaatttgagactgagtgggtctagtgattctcccgcaagcgcctcttag

SEQ ID NO: 216141 - DNA, 636 bp, Artificial Sequence
  Description of Artificial Sequence: Synthetic coding sequence
atgcagcggacgggcggtggagcacctcggccaggcaggaaccatggtttgcctggatcgctccgccagcctgaccccgtcgccttgctcatgttgctggtggatgcagaccagccagaaccaatgcgaagcggtgctagagagcttgcattattcctgacgcctgagcctggggcagaggccaaggaggtggaggagacaatcgagggcatgctactgcggttagaagagttttgtagtctcgcggatctgattaggtccgacacttctcagatccttgaggagaatatcccagttctgaaggctaagctaaccgagatgagagggatctatgcgaaggtggatcggcttgaagctttcgttaagatggtcggtcatcacgtggcattcttagaagctgacgtgcttcaggcggaaagggatcacggggcatttcctcaggccctgcggcgttggctcggatctgcagggctgccctccttcaggaatgttgagtgctccggcacaattcccgcaaggtgcaacctccggctaccaggtagttccgacagccccgcaagtgcatcacaggtagccggtataactgaagtgacatgcacaggcgctcgggacgtgagagctgctcacacagtttag

SEQ ID NO: 216142 - DNA, 612 bp, Artificial Sequence
  Description of Artificial Sequence: Synthetic coding sequence
atgcagcggaccggcggaggcgctccgcgacccggacggaaccatgggctacctggatcactgagacagccagatccagtggcgttactgatgctgttggtggacgccgatcagcccgaaccaatgaggtcaggcgctagggaactggccctgttcctgacacctgaaccgggtgccgaggccaaggaggtggaagaaacaattgaaggcatgctcttgaggttggaggaattttgttcccttgccgacctgattcgatcagatacttcacaaattttggaggaaaatatcccagttctgaaagccaaactaactgaaatgcggggaatatacgcgaaggtcgaccgtctcgaggcatttgtgaaaatggtcggccatcatgttgctttcctggaggctgacgtgctccaggccgaaagagaccacggagctttcccccaggcccttagaagatggttagggagcgccggactgccaagctttcggaacaagagcccagcccctgtgcctgtgacctatgagctccctactttgtaccgcactgaagattatttcccggtggacgccggtgaagctcagcatcaccccagaacatgccctcggcctctatag

SEQ ID NO: 216143 - DNA, 627 bp, Artificial Sequence
  Description of Artificial Sequence: Synthetic coding sequence
atgactggccgagtgtgcagagggtgcgggggaacagatattgaactggacgctgcccgaggtgacgcagtgtgcaccgcctgcggatcagtgctggaggacaacatcattgtgtctgaggtccagttcgtggagagcagcggcggaggatcttccgccgtcggccagttcgtctccctggacggagccggtaagactccaacgctggggggaggatttcatgttaatttgggcaaggaaagccgggctcagacactgcaaaacggcaggcgtcacatccaccacctcggcaatcagctccagctcaaccagcactgccttgacactgctttcaacttttttaaaatggccgtttcccgacatctcacccggggtcggaagatggcccatgtgatcgccgcatgcctgtatttggtctgtaggactgagggcactccccatatgctgttagatttgtcagacctgctgcaggttgattctctcagaccagcttcgttccccacctggggctgcgacctgggtgtggtcactagggtggtcacaggagtttatccaaggtgcctacacgcaagccaatggcccgtgtgtgccgcttgtcctgtcaggaaattctggtctgtaggatag

SEQ ID NO: 216144 - DNA, 1689 bp, Artificial Sequence
  Description of Artificial Sequence: Synthetic coding sequence
atggccgtttctcggcacctaaccaggggcaggaaaatggcacatgtgatcgccgcttgcttgtacctggtgtgcaggactgaggggactccccatatgctcttagatctgagtgacttactacaggtgaacgtttatgtgttaggcaagacattcctactattggcccgtgaactgtgtattaatgcgcctgctattgatccctgtctatatattcctaggttcgcacaccttctggaatttggcgagaagaaccatgaggtctccatgacggccctccggctgttgcagaggatgaagcgtgactggatgcacaccgggagacgcccttccggcctgtgtggggctgctctgctcgtggctgcacgtatgcacgattttcgcaggacggtaaaagaagtgatcagcgtcgtgaaggtgtgtgagagtacgcttagaaaacggctcacagaatttgaagacactccgactagccagctgacaatcgacgaatttatgaaaattgatttggaggaagagtgcgatcccccatcttacacagctggccagagaaaactgcgcatgaagcagttagaacaggtactgtctaagaaactggaggaggtggaaggtgaaatctcctcctaccaagacgccattgaaatcgaattagagaattctcggccaaaagccaagggcggactggccagtctggctaaggatggctctacagaagacaccgcttccagcctgtgtggagaagaagacaccgaagatgaagaactggaggcggcagcatcccacctgaacaaagatttgtatagggagctgcttggcggtgctcccggttcttcagaggctgccggaagccccgagtggggcggacggccacctgcactggggagcctcctggacccactacccactgccgcatccttagggatttctgattccatcagggaatgtatttcaagccagagctctgatccaaaggatgcctccggcgacggtgagctggacctgagcggaattgacgacctcgagatcgaccgctacattctgaacgagagcgaagctcgagtgaaggctgaactatggatgagagagaacgccgaatacctgagagaacagcgggagaaagaggctcgaattgccaaggagaaggaattagggatctataaagaacacaaaccaaagaaaagctgcaaacggagagagcccatccaggcctcgacggcaagagaagccatcgagaagatgctcgaacaaaaaaagatttcttccaagatcaattattccgtactgcggggattgtcaagcgccggtgggggaagcccgcaccgagaggatgcacagcctgagcactcagctagcgcaaggaagttatctcgcaggcggactcccgcaagcaggtccggtgctgaccccgtaacgtccgtcggaaaacggctccggcctctggtctccactcagccggctaaaaaagtagctacgggggaggctctgctgccttcctcccctaccttaggagcggagcccgctcggcctcaggccgttctcgtagaatctggtccagtgtcgtaccatgccgatgaggaggctgatgaagaggaaccagatgaggaggatggtgagccctgtgtcagcgctctgcagatgatggggagcaacgactatggctgtgacggcgacgaagacgatgggtactag

SEQ ID NO: 216145 - DNA, 408 bp, Artificial Sequence
  Description of Artificial Sequence: Synthetic coding sequence
atgacggccctacggttactgcaacgcatgaaaagggattggatgcacaccggacgcaggccctcaggactgtgcggggcagcattgctggtggccgctagaatgcacgacttccgaaggacggtaaaggaggtgatctcggtggtcaaggtctgcgaatctacgctgagaaaacgactgaccgagttcgaggatactcccacctcacagttgacgatcgacgagttcatgaaaattgatttggaggaggaatgcgaccctccgccaatcgaagagggaggtcagactgaagccagggagcccccacaagcctcctcctgggaaggtccatcaactactcgccgacgtagtcaactgtggcacggctgtcctgggtgtgggaggggtggctttactctgtgcccttag

SEQ ID NO: 216146 - DNA, 723 bp, Artificial Sequence
  Description of Artificial Sequence: Synthetic coding sequence
atgacaggcagggtttgtaggggatgcggtgggactgacattgagcttgacgcagccaggggcgacgccgtctgtacagcctgcggatcagttttagaggacaatattattgtcagtgaggtgcaatttgttgagtcttctggaggcggatcttccgctgtggggcaatttgttagcctcgatggcgctggaaaaacacccaccctggggggtggattccacgtgaatctcggtaaagaatccagggcccagacactccagaacggaagacggcacatccatcatctgggcaatcagcttcagctaaaccagcattgcctcgacacagcttttaatttctttaagatggccgtatcacgccatctcactcgtgggagaaaaatggcacatgtcatagctgcctgtctctacctggtctgccgcaccgagggaactccacacatgctgctagatttgtcagacctcctgcaggtggactcactgagacctgcatcctttcctacttggggttgcgacttgggggttgtaactcgtgtggtgactggtgtgtatccccgatgcccaagaatttccgtcgccggactttgttgcctgccgtcccaggaggtgctagtgtgtaggatgagaggactgcatgacatgggcgtgacagtcagagatctgtgggagtgtgggtccccttggcaagagcatctgcctatgctgggcactgttgggtgctag

SEQ ID NO: 216147 - DNA, 555 bp, Artificial Sequence
  Description of Artificial Sequence: Synthetic coding sequence
atgacagcccttagactcttacagagaatgaagcgggactggatgcataccggaagacggccatccgggttgtgtggagcagcccttctggttgcagcccgtatgcatgacttccgaagaaccgtgaaagaggtgatatcagttgtaaaggtttgcgagagcaccctccgcaaaaggctaaccgagttcgaggacaccccgacatcccagcttaccatcgacgaattcatgaaaatagatctggaggaagagtgcgatccacccagttataccgctgggcagaggaaactccggatgaaacagctggaacaggtcctgtctaagaagctcgaggaggttgaaggtgaaatcagtagctaccaggacgcaatagagatcgagcttgagaactctcccccttctcggagggagggaaggcggaggcccgagtcgctgcccagaccattgcggggtaaagcccctgtgccactcgtgggtggcctgagctctggcatggctgcgcctgacgttgctgagggggctagtccttgcgtactccggagaggctggccttag

SEQ ID NO: 216148 - DNA, 1953 bp, Artificial Sequence
  Description of Artificial Sequence: Synthetic coding sequence
atgactgggagggtatgtagaggatgtggaggcacggacatcgaactcgacgcagccaggggagatgccgtctgtaccgcatgcggtagtgtcctggaggataacatcatcgtgagcgaggtgcaattcgtcgagtctagcggagggggaagcagcgccgtgggacagttcgttagtcttgacggcagaaggcatattcaccatctgggtaaccagctccagcttaatcaacactgccttgacaccgcttttaatttctttaaaatggccgtgagccgacatctgacccggggaaggaagatggctcacgtcattgctgcatgcttgtacttagtctgcaggactgaaggcaccccccatatgctgctcgacctttccgatcttctacaggtgaatgtgtacgtcctgggcaagactttcctcttactcgctagagaactatgtattaacgctcctgccatagatccttgcctttacattcccaggttcgcccacctgctggaatttggcgaaaaaaatcacgaagtgagtatgaccgcgctccggctcctgcagcgtatgaagcgcgattggatgcacacaggccgaaggcctagcggtttgtgcggggctgccctccttgtggccgcaaggatgcacgatttccgaagaacggtgaaagaggtcatttcagtggtcaaggtgtgcgaatcaactttacgcaagaggctgacagaatttgaagacactcctacctctcagctgacaatagatgagttcatgaaaatcgacctggaagaggaatgtgaccctcctagttacactgccggacagagaaaactccgaatgaaacaactagaacaagtgctgtcaaaaaagctcgaagaggtggaaggcgagatatctagttaccaggacgccatcgagattgagctcgagaacagtcgacctaaagcgaaggggggacttgctagtctggccaaggacggctctacggaggacaccgcttcttcactgtgcggcgaggaggatacagaagatgaagaactcgaggcagctgccagccatcttaataaggacctgtacagggagctgttgggcggagcccctggcagcagcgaggcggcaggttcacccgaatggggtggcagaccaccagcgctgggcagtcttcttgaccccttacctacagccgcttcactgggaatttccgacagtattagggagtgtattagcagtcaaagttcggacccaaaggacgcatccggggatggggagctggacctgagtggaatcgacgatcttgagatagaccgctacatcttgaacgagagcgaggccagagttaaagccgagttgtggatgcgagaaaacgctgagtatctccgggaacagcgggaaaaggaggctcgtattgccaaagaaaaagaactcggtatttacaaagaacacaaacccaaaaagtcatgcaaaagacgcgagcctattcaagccagcacagcacgagaagcaatcgaaaaaatgctcgagcagaaaaaaatcagcagcaagattaattactctgtcctgagagggctgtccagcgctggcggtggctctccacatcgcgaagacgcccaaccagagcactcagctagcgctcgcaagctgtctcggagaaggactcccgcttcgcgttcaggagccgaccccgtgacctccgtcggaaagcggctaagacccctagtgtccactcagcccgctaaaaaggtcgcaacgggtgaggccttattgccctcttctcccaccctgggcgcagaacctgccaggccccaggctgtcctcgttgaaagcggacccgtatcctatcatgctgatgaggaggccgatgaggaggaacctgatgaggaagacggcgagccatgtgtttccgcactacaaatgatggggagcaacgattatgggtgcgatggtgacgaagatgacggatattag

SEQ ID NO: 216149 - DNA, 1422 bp, Artificial Sequence
  Description of Artificial Sequence: Synthetic coding sequence
atgacagccttacgcttacttcaacggatgaaacgggattggatgcatacagggagaagaccatctgggctttgtggggctgctcttttggttgctgctcgcatgcatgattttcgcagaaccgtaaaggaggtgatatcagtcgtgaaagtgtgtgaaagcacccttcgcaagcgtctgacagaattcgaagataccccaacctcacagttgactatcgacgaatttatgaagattgatctggaggaggagtgtgatccacccagctacaccgcgggacaaaggaagctgaggatgaagcaactggagcaagtcctgtccaaaaagctggaggaagtcgaaggagagatctctagctaccaggacgcgattgaaatcgagctagagaacagccgcccaaaggctaaagggggattggccagcttagcgaaggatgggtcaaccgaggatactgcttccagcctatgcggcgaagaggatacagaggacgaggaactagaggctgctgcgagtcatcttaataaagacctgtaccgagagcttcttgggggagcaccgggatctagcgaggctgccggatccccagaatggggcggtcggcctccggctctcggatctctgcttgatcctttgcctaccgcagcttccttagggatcagcgacagtatccgggagtgcatttcatctcagtcatcagaccctaaagatgccagcggagatggtgagttggatctttccggtatcgatgacctggagatagaccgctatatattaaatgagagtgaagccagggtgaaggctgaactatggatgagagagaatgccgagtatctgagggaacagcgcgaaaaggaagcacgtatagctaaggaaaaagaactggggatctacaaggaacacaaacctaagaagagttgcaaacggagggagcccattcaagccagcacagctcgagaggccattgagaaaatgctcgagcaaaaaaaaatttccagcaagatcaattactccgtgctgcggggactatcttcggcaggcggaggctcgccacatcgtgaggacgcgcagccggaacacagcgcaagtgccagaaagttaagcagacgtagaaccccagcttccagatccggtgcagatccagtgactagcgtggggaagcggctcagaccgctcgtttcaacccagccggctaagaaggtggcaaccggggaggcccttcttccctccagccctaccctgggcgcagaaccagccagaccccaggctgtattggtggaatccgggcctgtaagctaccacgctgacgaagaggcagatgaagaggagccggacgaggaagatggggagccttgcgtgtcggccctacagatgatgggctctaacgattacggatgtgatggcgacgaggatgacggatattag

SEQ ID NO: 216150 - DNA, 1755 bp, Artificial Sequence
  Description of Artificial Sequence: Synthetic coding sequence
atggctgtctcacggcatctgaccagagggcgaaagatggcgcacgttattgccgcttgcctataccttgtgtgtagaactgaaggtactcctcacatgctgctggatctgtccgatttgttacaggtgaatgtttatgtcctgggtaagacttttttgctgctcgccagggagctgtgcataaacgcgcctgccatcgatccctgtttgtacatccctaggttcgcacacctactggaattcggagagaaaaatcatgaggtctccatgaccgctctaagactgctgcaacggatgaagagggactggatgcataccggacggagaccgagcggtctttgtggcgcagctctgttggtagcggcaagaatgcatgattttcggagaactgtcaaggaggttatttcagtggttaaagtttgcgagtctacactgaggaagcggctgactgagttcgaggacacgcccactagccagcttaccatcgacgagttcatgaagatcgacctcgaagaggagtgcgaccccccatcatacacagccggacagaggaagttgcgcatgaagcagctggaacaggtgctaagtaaaaagttagaagaggtagaaggtgaaatctcttcataccaagacgctattgagattgagctggaaaattctcgtccaaaagcaaagggtggactggctagcctggctaaagacggaagcacagaggatacggcgtcatcattatgtggagaggaagacacagaggatgaagagctggaagcagcagccagtcatctgaataaagatttatatagggagctactcggtggcgctccgggttcttccgaggcagccggttcacccgaatgggggggaaggcccccagctttgggctcactcctcgatccattaccaaccgccgcaagcctggggatctctgactccatacgcgaatgtatttcttcgcagagttccgacccgaaggacgcatcgggagacggagagcttgacctgagcggcattgatgacctggaaattgataggagagacctctccatgccacgttgtgcgaaggccaagtcgcagccccactttcccgtactggcccagtacatccttaatgaatctgaggccagggtcaaagcagagttgtggatgagggagaatgccgaatatttgcgtgagcagagggaaaaggaagctagaattgctaaagagaaggagctgggaatatataaggagcacaagcccaaaaaatcctgcaaacgcagggaacctatacaagccagcaccgccagagaggccatagagaagatgttggagcagaagaaaatcagttcaaaaattaactactcagttttacggggtctcagtagcgctggagggggatctccccatagagaagatgcccagcccgagcattccgcttcagctcgcaagctttctcgacgacggacccctgcgagccgtagtggcgcagacccagtgacatcagtcggcaagagactgagacccctggtaagcacccagcccgctaaaaaagttgccacaggcgaagccttactgccttcttctcctacactcggtgccgaacctgctcggccacaggccgtgctcgtcgaatctgggcctgtctcataccatgccgacgaagaagcagatgaagaggagcctgatgaagaggacggcgagccttgtgtgtcggctctccagatgatgggtagtaatgattatgggtgtgacggagacgaggatgatggctactag

SEQ ID NO: 216151 - DNA, 1320 bp, Artificial Sequence
  Description of Artificial Sequence: Synthetic coding sequence
atgcacgatttccggagaactgtcaaggaagtgatctccgttgttaaggtctgcgagtctaccctcagaaaacgattaactgaattcgaggacactccaacttctcagcttaccatagatgaattcatgaaaattgatctcgaggaggagtgtgatcctcctagctatacagctggacagaggaagctccgcatgaaacagttagaacaggtgctgtccaaaaagctggaggaggttgagggcgaaatttctagctatcaagacgccatcgagatagagttagagaacagcagaccaaaagcaaagggcggactggctagcctggctaaagatgggtccacagaggacacggcaagcagcctttgtggggaagaggatacagaggatgaggagttggaggccgctgcaagtcatcttaacaaggatctgtacagggagttactgggaggtgcaccgggaagttccgaagcagcaggcagcccggagtggggcggtaggcccccagcgctcgggtctctgctcgatcctcttccaaccgctgcatcactgggaatctcggactccatacgggagtgcatttctagtcagtcctctgacccaaaagatgcctccggagacggcgagctggacctgtctggcattgatgatctggaaatcgatagatatatccttaacgaaagcgaggccagagttaaagccgaactgtggatgcgcgagaacgcagaatatctgcgggagcaaagagaaaaagaagcaaggattgccaaagagaaagaattaggtatatataaggagcacaaacccaaaaagtcctgcaaaagacgggagcctattcaagcaagcactgccagagaggcaatcgagaagatgcttgagcaaaaaaagatctcttctaaaattaactatagcgtgctgcggggtcttagcagtgccggagggggttcacctcacagagaagatgcccaaccagagcactccgctagtgctaggaagctctctaggaggaggacaccagcctcccgctctggcgctgaccccgtgacctccgtaggcaaacggttgcggcctctggtctcgacgcagcctgcaaagaaggtcgctactggtgaagcgctattgccaagcagccccacgctgggggcagaacctgccagacctcaggcagtgttagtggaaagcggccctgtttcttatcacgccgacgaggaggcggatgaggaagagcctgatgaggaggacggagaaccttgtgtgtccgcacttcagatgatgggtagcaatgattacgggtgtgacggtgacgaggacgacgggtattag

SEQ ID NO: 216152 - DNA, 2034 bp, Artificial Sequence
  Description of Artificial Sequence: Synthetic coding sequence
atgacgggaagagtctgtcgaggctgtggtggcacggacattgaactggacgctgctcgtggagacgccgtctgcaccgcctgcggtagtgttctggaagacaatattatcgtgagcgaagtacaatttgtggagtccagcggcggtggcagtagtgccgttggtcagtttgtgtctttggacggtgctggcaaaacacccaccctgggtggcggttttcatgtaaatcttggaaaggagtcacgggctcagacactgcagaatgggagacgccatatacatcatttgggaaaccaactgcagttaaatcagcactgtctcgacaccgccttcaactttttcaagatggccgtgtctagacacttaaccagaggcaggaaaatggcccatgtcatcgctgcctgtctatatctggtatgcaggactgaaggtacacctcacatgcttctagacttatcggatctgctgcaggtaaacgtgtacgtactcgggaaaaccttcctgttattggcacgggagctctgcatcaatgcgcctgcgatcgacccatgtttatatatccctcgcttcgcgcacttgctggaatttggcgagaagaaccatgaggtgagtatgactgcccttaggctcttgcagagaatgaagagggattggatgcatacgggaagacggccaagtgggctgtgtggggctgctctgcttgtggccgcacggatgcatgacttcaggcggacagtgaaggaagttatcagcgtggttaaggtttgcgaatcaacattgagaaagcgactaaccgaatttgaggacactcccacatcacagcttaccatagatgaattcatgaagatcgatttagaagaggaatgcgatcccccttcttacactgccggacagcgcaagctgcgcatgaagcagttggagcaggttctgtcaaaaaaattggaagaggtggaaggagagatttcctcataccaggatgcaatcgaaatcgagctggaaaactcccgcccaaaggctaagggcggacttgcatcactggcaaaagatgggtccacagaagatacagcgagcagcctttgcggcgaggaggacaccgaggatgaagagctggaagctgcagcctctcacctaaataaggacttgtaccgcgagctgttgggcggtgctccaggaagctccgaagcggctggcagccccgagtggggcggaaggccacccgcactgggctctctcctggaccccttacctacagcagcatctttaggcattagtgattcaataagggaatgcataagttctcagagctctgatccaaaggacgccagtggcgatggcgagctggacttaagcggcattgacgacctggaaatcgacaggtacatcctgaatgaatccgaggcaagagtgaaggcagaattgtggatgcgggagaatgcggagtatttaagggagcagcgggagaaagaggcaaggatcgccaaagagaaggagctgggaatttacaaggagcataagccaaagaaaagttgcaagcgacgggaaccgatccaagcttctactgctcgcgaggcaatcgagaaaatgttggagcagaagaagatatcatccaagatcaattatagcgtcctgcggggactgtccagcgccggaggcggatcacctcaccgggaagacgcacagccagaacattctgcttccgctaggaaactttcaaggaggcggacaccagcctcacgcagcggagccgatccggtgacttctgtaggcaaacgattgcgcccactcgtatccacgcagccagcaaaaaaggttgcaacaggcgaagccctgttgccgtcatctcccacactgggggcagagcctgcgagaccccaggcagtcttggttgaaagtggtcctgttagctaccacgccgacgaggaagccgatgaggaagaacctgatgaggaagatggcgaaccatgcgtttctgcactgcaaatgatgggctctaatgactacggctgtgatggtgacgaggacgatgggtactag

SEQ ID NO: 216153 - DNA, 612 bp, Artificial Sequence
  Description of Artificial Sequence: Synthetic coding sequence
atgagggaaaacgctgagtacctgcgagaacaaagggagaaggaagctagaatcgccaaggagaaggagcttggcatttataaagaacataagcccaaaaaaagctgcaagcgacgcgagcctattcaagcatcaaccgccagggaggccatcgaaaagatgttggaacagaagaaaatttcgtcgaaaatcaattattctgttttacgaggcctgtcttctgccggtggcggtagcccgcatagggaggacgcccaaccagagcactcagccagcgctcgcaaactgtcacggagacgaacgcccgcaagcagaagcggcgctgaccctgtaacttctgtcggtaagcgcctgcgtccattggttagtacacagccggcaaagaaggtcgccactggcgaagctctgctgccaagtagccctaccctcggggctgagcccgctaggccccaggcagtgttagtagagtccggtcctgtatcctatcatgccgacgaggaagcagacgaggaggagcccgacgaggaggacggcgaaccctgcgtgagcgccctgcaaatgatgggctcaaatgactacgggtgtgacggcgacgaagatgatggctactag

SEQ ID NO: 216154 - DNA, 714 bp, Artificial Sequence
  Description of Artificial Sequence: Synthetic coding sequence
atgacagcactgaggttgcttcagcggatgaaaagagattggatgcacacaggcaggcgcccttctgggctgtgcggggctgccttgctggtcgcagctagaatgcacgatttccgtcggaccgtgaaggaagtgatctctgtcgtgaaagtttgcgagagtaccctaaggaagcgtttgactgaatttgaggatacccctacgagccaactcaccatagacgagtttatgaaaatcgatctcgaggaagaatgcgaccccccttcttacactgcaggccagcggaagttaaggatgaagcagctagaacaggtgctcagcaaaaaacttgaagaggtagaaggcgaaatcagctcctatcaggacgccattgagatcgagctggaaaattctcgccctaaggccaagggagggttagcaagtttggcaaaagatggatcgaccgaggatactgcctctagtctatgtggggaggaagacacggaggatgaggagctagaagccgcagcgagccatctaaacaaagacctctaccgggagttattagggggagctccaggttcttctgaggcagctggatcccccgaatgggggggtagacctccagctttagggtccctattggaccctctaccaactgcagcaagcttgggaatctctgattcaattagagaatgcatctcttctcaatccagcgaccctagtgaattctag

SEQ ID NO: 216155 - DNA, 138 bp, Artificial Sequence
  Description of Artificial Sequence: Synthetic coding sequence
atgaccgcccttcgcctgctacagcggatgaagcgcgattggatgcacacaggacggaggcccagcggactctgcggcgcagccctgctagtagctgccaggatgcatgattttaggcgaaccgtaaaggaagtatag

SEQ ID NO: 216156 - DNA, 45 bp, Artificial Sequence
  Description of Artificial Sequence: Synthetic coding sequence
atgacagccctgcggctgttgcagcgcatgaagcgcgactggtag

SEQ ID NO: 216157 - DNA, 468 bp, Artificial Sequence
  Description of Artificial Sequence: Synthetic coding sequence
atgacggccctgcgccttctccagagaatgaagcgggactggatgcataccgggagacgcccatccggtctgtgtggcgcagctctactcgtagcagccaggatgcatgattttcggagaacagtgaaggaggtgatctctgttgtgaaagtgtgtgaaagcaccctgagaaaacgcctgaccgagttcgaggacacccccaccagccagcttactatcgacgagttcatgaaaattgatctggaggaggaatgcgacccaccaagttataccgcgggacagaggaaactgcgcatgaagcaactcgagcaggtgctcagcaagaaacttgaggaagttgagggtgagatctcttcataccaggacgcaatagaaatcgaactggaaaacagtaggccgaaggccaaggggggtctggcgtctcttgccaaagacggatcgaccgaagacaccgcctcctcattgtag

SEQ ID NO: 216158 - DNA, 8306 bp, Artificial Sequence
  Description of Artificial Sequence: Synthetic coding sequence
atggccctggtgctggaaatcttcactctgttggcctcaatatgttgggtctctgcgaacattttcgagtatcaagtggacgcacaacccctccggccttgtgaacttcagagagaaacagccttccttaagcaggccgattatgtcccccaatgcgcggaggacggaagctttcagactgtgcaatgccagaatgacggcaggtcatgctggtgtgtgggggcaaatggctccgaagtgctcggaagccgccagcctggacgccctgtggcatgtttgagtttctgccagctccagaaacagcaaatcctattgtcaggctacatcaatagtaccgatacctcttatcttccccaatgccaagactctggagactatgctccagtccaatgtgatgtgcagcaggtgcagtgttggtgcgtcgatgcagaaggaatggaagtgtatggcacaaggcagctaggcaggcctaaacgatgcccacgcagttgcgagatcaggaacaggcggctgttgcatggtgtgggcgacaagtctccccctcagtgttctgccgaaggagaatttatgcctgttcagtgcaagtttgtgaacacgaccgacatgatgattttcgatttggtacactcttacaaccggttcccagacgccttcgtgacatttagctcatttcagagaaggtttcccgaggttagtgggtactgccactgcgccgactcacaaggccgagagctcgcagaaacaggactggagctcttactggacgagatctacgatacaattttcgccggtctggaccttccatctacatttacagaaacgacattatacagaattctgcagcggaggtttcttgccgtccagagcgtaatcagcggaagattccgctgcccgaccaagtgcgaggtggagaggttcaccgccaccagctttggacatccatacgtaccctcttgccggagaaacggagactaccaggctgtccagtgccagaccgaaggtccttgttggtgcgtggatgcccagggaaaagagatgcatgggactcggcagcaaggggaacccccttcctgcgccgaaggccaatcctgtgcctccgaacggcaacaggctctctctcgactgtatttcggtacatccgggtatttcagccaacacgatttattttcgagtccagaaaagcgctgggcatccccacgtgtggccagattcgccactagctgcccgcctaccataaaggagctgttcgtcgacagtggccttttaaggcctatggttgaagggcagagccaacagttctccgtttccgaaaatctgctcaaagaagcaattagagctatcttcccgtcacgtggtctcgccagactcgctttgcagtttacaaccaaccccaaacgactacaacagaacttatttggcggtaagttcctcgtgaatgtgggccagttcaacctgtctggcgctcttggcacccgcggtacttttaactttagccaattttttcagcagttaggactagccagttttttgaacgggggacgacaggaggatcttgctaaaccgctgtctgtggggcttgatagtaactcttcaaccggaactcccgaggctgcaaagaaggatggaacgatgaacaaaccgaccgtcggcagtttcggcttcgaaatcaacctgcaggagaaccaaaatgccctgaaatttctggccagcctgctggagctgcccgagttcctcctgttcctgcagcacgcgatcagtgtcccggaagacgtcgccagggatctcggtgacgtcatggagacagttctatctagtcagacttgtgaacaaacacctgagcgcctcttcgtgccctcgtgtaccaccgaaggaagctacgaggacgtacagtgcttcagcggcgagtgctggtgtgtaaacagttgggggaaagaactcccgggaagcagagtgcgtggcggacagccaagatgtccaaccgactgcgaaaagcagagggctagaatgcaatcactgatgggctcccagcccgcaggctccactctgttcgttcccgcttgcacaagtgagggacatttcctccccgtccagtgtttcaactctgagtgttattgcgttgatgcagagggccaggctatcccagggacgcggagcgcgatcgggaaaccaaagaagtgccctactccttgccagctgcagagcgagcaggcttttctgagaactgtgcaggcgttactgagcaactcttccatgctccctactctgtctgacacgtacattccacagtgttcaaccgatggacagtggcgccaggtacagtgtaacgggccaccagaacaggtgtttgagctctatcaacgctgggaagcccaaaataagggacaggacctgaccccggcaaagctactggtgaaaatcatgtcctacagggaggcagcctctggtaacttctcactctttattcagtctctttacgaagcaggccagcaagacgtcttccccgtcctgtctcagtaccccagccttcaagacgttccattagctgcactggaagggaagcggcctcagcccagagagaatatcctgcttgagccttatcttttttggcagatactcaatggccagctgtcacagtatccaggttcatattctgacttttcaacacctctcgcacatttcgatctgcgaaattgttggtgtgtggatgaagccggacaggaactcgaaggaatgcggagtgaaccttctaagcttccgacgtgccccggaagctgcgaggaggctaagctccgggttcttcagttcataagggagacggaagaaatcgtgtccgcctccaacagttcacgttttcctctcggggagtcgttcctcgttgctaaaggcatcaggctccgtaacgaggacctgggtctgcccccactcttccctccacgggaagctttcgccgagcagttcctgcggggaagcgactacgccattcgcttagccgcacagtcgaccctgtctttctaccagcggaggaggttctcacctgacgacagcgccggtgcctcggcgctgcttagatctggcccttacatgccccaatgtgacgctttcggcagctgggagccagtgcagtgccacgccggaacaggccactgttggtgtgttgacgaaaaaggaggtttcatccccggatcgctaaccgccagatcactgcagatcccgcagtgcccaacaacttgtgagaaaagccgcacttccggtctactcagttcctggaagcaggctcggtctcaggaaaatccttctcctaaagatctcttcgtgcccgcttgcctggagaccggggagtacgcgagacttcaggcgagtggggcaggcacttggtgcgtcgatcctgccagcggggaagagctgaggccagggagctccagcagtgcacagtgtcccagtttatgcaatgttctaaagagtggggtattatcacgacgggtgtctccaggatatgtcccggcatgccgcgcagaggacgggggtttcagcccggttcaatgtgatcaggcgcaaggctcatgttggtgcgtgatggactccggagaggaagtgcccggaacaagagttacagggggtcaaccagcctgtgagtccccaagatgccctcttcccttcaacgcctccgaggtcgtcggaggaaccatcctctgcgaaaccatttccgggccaacaggctccgctatgcagcagtgtcagctgctttgccgacagggtagctggagcgtcttcccacccggtccccttatttgctcattagaatcaggtaggtgggagtcccagcttcctcaaccacgggcatgtcaacggccacagctctggcagacgattcaaacgcagggccactttcagcttcagctccctccgggtaaaatgtgttccgccgattacgcggatctgctgcagacattccaggtatttatcctcgacgagttgactgctcgtgggttttgtcaaatccaggttaaaaccttcggaaccctggtgtctattccagtgtgcaacaattcatctgtccaggtggggtgtcttacacgagaaagactgggcgtgaatgtgacttggaaaagccgcctcgaagacatccctgttgctagtctgcctgacttacacgatatcgaacgagccctagttggtaaagaccttctggggagattcactgaccttatccagtctggctcattccaactgcacctggacagcaaaacattccctgccgaaactattagatttctacagggagaccattttggcacctctcctagaacctggtttggttgctctgagggcttttatcaggtgctcaccagcgaagcctcgcaggatggcttgggctgcgtaaaatgcccagaagggtcttactcacaagacgaagagtgtattccatgtccagtcggcttctaccaggagcaggccggttccctagcatgtgtgccttgccctgtgggacgaacgactatttcagctggagcctttagccaaacccactgcgtcacagattgtcagcgtaatgaggcaggtttgcagtgtgaccagaatggccagtacagggcatcacagaaggatcgcggttctggcaaagccttctgcgtagatggggagggaagacgactcccctggtgggagacagaagctccattggaggactcacagtgtcttatgatgcagaaattcgagaaggtgccagaaagtaaggtgatttttgacgccaacgcgcctgtggcagtgcggtcaaaagtgcctgattctgagtttccagtcatgcagtgtctcaccgattgtactgaagacgaggcttgttcttttttcacggtgtctacaacagagccagagatttcctgcgatttctatgcctggacttccgacaatgtcgcgtgtatgacctctgaccagaaacgtgacgccctcggaaacagcaaagcaactagttttgggagcctaaggtgtcaggtgaaagtccggtcgcacggtcaagacagcccagcagtgtacctgaagaaggggcagggctccaccaccacactgcagaagcgcttcgaacccacaggttttcaaaacatgctctccgggctgtacaatccaatagtgttttctgcctccggagccaatttgactgatgcccatttgttttgtttgcttgcatgcgatcgagacctatgttgcgacggctttgtcctcactcaggtacaaggcggagcaatcatctgtggtttgctgagctcacccagcgtcctgctatgtaacgttaaagattggatggaccctagcgaagcttgggctaatgccacatgtccaggtgttacgtacgatcaggaatcccaccaggttatcctcagactgggtgaccaggaatttattaagtctctaaccccgctggaaggcacgcaggatacatttaccaacttccagcaagtctacctgtggaaagactctgatatgggctctcgtccagaaagcatgggctgtagaaaagatacagtgcccagacctgccagccccacggaggccggtctgactacggagctcttcagcccggtggatctgaatcaggtgatcgtcaatggcaaccagagcctgtcttctcagaaacattggctcttcaaacatctattttcagcacagcaggctaacctgtggtgcttgtcccgctgcgtgcaggagcactccttctgccagctcgccgagatcacagagagcgcgtccctgtactttacctgcaccctttatcccgaagcccaggtatgcgacgatattatggagtctaacgctcagggatgtcgcctgatcctccctcagatgccaaaggctctgtttcgcaagaaggtgatccttgaggacaaagtcaagaatttctacaccaggctgccttttcagaagctgatggggatctcaattcgcaataaagtgcccatgtcagagaagagtatttccaacgggttcttcgaatgcgagagacgctgcgacgccgatccatgttgtactggcttcgggttcctgaacgtgagtcagctaaagggaggggaggtgacctgcctcaccctcaactccctggggatccagatgtgctccgaagaaaacggaggcgcttggagaatcctggactgtggctcacctgatatagaagtgcacacctatccctttgggtggtatcaaaagcctatcgcccagaataacgccccatcgttttgcccattggtcgtgttacccagtttgactgagaaggtcagcctggacagttggcagagcctcgccttgagcagtgtggtcgtggatccgtcgatccgtcattttgatgtggcacatgtgtcgaccgcagcgactagtaactttagtgccgtgagagatctgtgcctgtccgagtgttcccagcacgaagcctgtctcatcaccacgctgcaaacccagcctggagccgtcaggtgtatgttctacgccgatacccagagctgcacccacagcttacagggacagaattgccggttgttacttagagaggaggccacgcatatttacagaaagcccggaattagcctactaagctacgaagctagcgtgccatccgtccccatctctacacatggcagactgttaggccgttcacaagccatccaggtcggcacctcttggaagcaggttgaccagtttctaggtgtgccatacgccgctcccccactcgcagagcggagattccaggcgccagagcccctgaactggaccggatcttgggatgcaagcaagcctcgggcttcctgttggcagcccggtactagaacctccactagccctggggtttcagaagactgtttgtacctgaacgtgttcattcctcagaatgtcgcccctaacgccagcgtgctggtgtttttccacaacaccatggacagggaagagagcgaaggttggccggcaatcgatggctccttcttagccgctgtggggaacctgatcgtggtgactgcctcctaccgcgtgggggtattcggctttctgagcagcgggtccggtgaagtttctggcaactggggactcctggatcaggtcgccgctctgacctgggtgcagacacacattcgcggattcggcggtgatccaaggcgcgtgtccctcgctgccgataggggcggtgctgatgtggcaagcatacatctcttgaccgcaagagcaactaattctcagctttttcggcgagcagtactcatggggggttccgcactcagcccagcggcagttatcagccacgagcgggctcaacagcaggcaatagctttggcaaaagaggtgtcttgcccaatgtcctcgtcccaggaagtggtgtcctgcctccgccagaaacccgcaaacgttttgaacgacgcccagactaagctacttgccgtgtccggaccgtttcactattggggtcccgtgattgacgggcattttctgcgtgagccgcctgccagggccctcaagagatctctttgggtcgaggttgatttgctgataggaagttcccaggacgacggacttatcaatcgagccaaagcagtcaaacagttcgaggaatcacgtggccgaacgtcatccaagaccgcattctatcaggccctgcaaaactccctggggggagaggactctgatgctcgcgtggaggctgcggctacatggtattacagcctagagcattccaccgacgattatgcgtctttttcccgggctctcgaaaacgccactcgcgattatttcatcatatgtccaatcattgatatggcttccgcttgggcaaagagagcaagaggaaatgtctttatgtaccacgccccagagaactacggccatggctctctagagctattggccgacgtgcagtttgcgctcgggctccccttttacccggcatatgagggccagtttagcctggaagagaagagcctcagcctgaagattatgcagtatttctctcactttatacgaagcggaaaccctaattacccctatgagttctctagaaaggtgcccaccttcgcgacgccttggcccgattttgtcccgagagcaggcggagagaattataaagagtttagtgagctgctgccaaatcgccagggcctgaaaaaagctgactgtagtttctggtctaagtacatctctagcttaaagacatctgcggacggagctaagggaggccaaagcgccgagtccgaggaggaggagctaactgctgggagcgggcttagggaggatctgctgtctcttcaggaacccggatcaaaaacctattcaaaata

SEQ ID NO: 216159 - DNA, 1191 bp, Artificial Sequence
  Description of Artificial Sequence: Synthetic coding sequence
atgccaggtcgaggaaggtgcccagactgtgtggtgacagagggtgtcttgacaacaaccttcagcgacgagggcaacctgcgcgaggtaacgtactcgagaagcacaggagagaacgaacaggtgtcacgtagccagcagaggggcctgagaagggtcagagacctatgcagagttctgcagctgccacctaccttcgaggacaccgcagtggcctattaccaacaggcctataggcattcgggtatcagggctgctaggctccagaagaaagaggtgctagtggggtgctgcgtgttgattacctgccgacagcacaactggcctttaacgatgggcgctatttgcacactgctctacgccgacctggatgtgttctcttccacatatatgcagatcgtcaaactcctgggtcttgacgtcccctctctctgtctcgcggagttggtgaaaacttactgcagtagctttaagttgtttcaggcctccccaagtgttcctgctaaatacgtggaagacaaagagaagatgctgtctcgaacgatgcaactggtggagttagctaacgagacctggctcgttactggaagacaccccctacccgtcatcacagctgccacgttcttagcctggcagagcctacagccagctgatcgattgtcctgttctctggctaggttctgtaagctagccaatgtggacctgccttacccggctagcagtagacttcaggaacttctggccgtgctgttgcggatggccgaacagctggcatggcttagagtcctccgtctcgacaagcggtccgtggtcaaacacatcggcgatctgctgcaacacaggcagtccctggtccgctccgcatttcgggacgggacagccgaggtggaaacccgggaaaaggaaccacctggctggggtcagggtcagggcgagggtgaggtgggcaacaatagcctgggcctgccgcagggcaagcgcccagcctctccggctctgctcttgcctccctgcatgctgaaatcccccaaaaggatttgcccggtaccccctgtcagtaccgtgacaggggacgagaatatatcagattctgaaatcgaacagtacttgagaactccccaggaggtgagggattttcagagagctcaagccgcacgccaagcggcaacaagcgttcctaatccaccttag

SEQ ID NO: 216160 - DNA, 1698 bp, Artificial Sequence
  Description of Artificial Sequence: Synthetic coding sequence
atggccgaggggaaagccggaggtgccgctggcctgtttgccaagcaagtgcaaaagaaattctcccgagctcaggagaaggtgctccagaagctcgggaaggcggttgagactaaggacgagagatttgaacagagtgcttcaaacttctatcaacagcaggctgaggggcacaagctatacaaagacctgaagaacttcctgagcgctgttaaggtaatgcacgagagtagcaagcgggtatccgagaccctccaggagatttactcctctgagtgggatggacacgaagagcttaaagcaatcgtgtggaacaatgacctgctgtgggaggactatgaggagaaactagctgaccaagcagtgcggacgatggaaatctacgttgcccagttttccgagataaaggagcggatcgccaagcggggaaggaagctggtagactatgatagtgcaaggcaccatctagaagccgtccagaatgcaaagaagaaagatgaggcaaaaacagcaaaagcagaggaagagttcaataaagcacaaacagtgttcgaggatctaaaccaggagctgctagaggagctaccaatcttgtataacagtagaatcgggtgctatgtaacgatttttcagaatattagcaatcttcgagatgtattctaccgggaaatgagtaagctaaaccacaacctgtatgaggttatgtccaagctggaaaaacaacactccaataaggtttttgtggtgaagggccttagctcctcgtcacgccgatccctggttatcagcccccctgtcaggaccgcgacagtgtcttctcccctgacctcgcccacctccccctctacactgtccctgaagtcagaatctgagtcagtcagcgccacagaggatttggcccctgacgccgctcagggggaagataacagcgagattaaggaactgctggaggaagaggagatcgagaaggaaggttccgaagctagctcctcagaagaggatgaacctctccccgcttgcaacggtcccgctcaggctcaacccagccctacaacagaacgagccaaatcacaggaggaggttctcccctccagcacaacaccctccccagggggtgcgctgagccctagtggccagccatcgagctccgcaaccgaggttgtgctccggactcgaacagcaagcgaggggtcagagcagcccaagaaaagggctagtattcagaggacctccgcccctccttctcgacctcctccacctcgtgctaccgcctcacccaggccctcttcgggcaacatcccctcatcccctacggccagtggaggaggttcccctacatccccgagggcaagcctgggtaccggaaccgcaagccctcggacctcccttgaagtgtctccgaatcccgaacctccagagaagcccgtgagaactccggaggctaaagagaatgagaatattcacaatcaaaaccctgaagagctttgcaccagcccaactctgatgacgtctcaggtagcctcagagcccggagaggccaagaaaatggaggacaaagagaaagataataagctgatatccgcaaattcttctgaagggcaagaccagctgcaagtttccatggtacctgagaacaataacctgactgctcccgagcctcaggaagaggtatctactagcgagaacccacagctgtag

SEQ ID NO: 216161 - DNA, 1602 bp, Artificial Sequence
  Description of Artificial Sequence: Synthetic coding sequence
atggcagagggcaaggccggtggcgctgctgggttgtttgctaagcaagtccagaaaaagttctcacgtgcgcaagaaaaggtcttgcagaaattggggaaggcagtagagaccaaggatgaaaggtttgaacaatccgccagcaacttctaccagcagcaggccgagggccacaagctttataaggacttgaagaactttctgagcgcagtcaaagtgatgcatgagtccagcaaacgcgtcagcgaaactctgcaggaaatctattcgtccgaatgggacggacacgaggagctgaaagccatagtatgggaaagaatagctaagcgtgggaggaaattggtcgattacgatagcgcccgtcatcacctcgaggctgtccaaaacgccaaaaagaaggacgaagcgaaaactgccaaggccgaggaagagttcaataaggcacaaactgtgtttgaggatttgaaccaagagttacttgaggagctgcctatcctgtacaatagccgcattggctgctacgtaaccatctttcagaatattagcaatctgcgggacgtgttttatagggagatgtctaagttgaaccacaatttgtatgaagtgatgagcaagctagaaaaacagcactcaaacaaagtgttcgtcgtgaaaggcctaagcagctcttcccgcaggtcattggtgatctcaccacctgttcggaccgctactgtttccagccctttgacctctcccacctctcccagcactctttcacttaaatccgaatctgaatcggtgagtgcaaccgaagatctagcaccagacgccgcacagggagaggacaactctgagatcaaggaacttctggaggaggaagagatcgaaaaagaagggagcgaagctagctctagcgaggaagacgagcctctgcctgcatgtaatggccctgcccaggcccagccttcgcccacaaccgagagggcaaagagccaggaagaggtgctgccatcatctaccactcccagccccggaggcgcactgtctccttctggacaaccctctagttcagcgacggaagtggtgctgaggaccagaactgcctcagaaggatcagagcaacccaagaagcgcgcttccatacagcggacaagtgctcccccttcgcgccctccgccaccaagagccaccgctagcccaagaccaagcagtggaaatatcccgtcaagcccaactgcctcaggcggtggaagcccgaccagccccagagcatctttgggaaccggaaccgccagcccaaggaccagcctcgaagtctcacccaatccggagccccctgaaaaacccgtacggacgcccgaagcgaaggagaacgagaacatccacaaccagaacccagaagaattgtgtaccagcccaacactcatgacctctcaagttgcttccgagcctggtgaggccaagaaaatggaggataaagagaaagataataaattgatctcagccaatagcagcgagggccaggaccaactgcaggtgtcaatggtgccagaaaataacaacctgaccgcccctgagccacaagaggaagtctccacgtctgaaaatcctcagctttag

SEQ ID NO: 216162 - DNA, 1620 bp, Artificial Sequence
  Description of Artificial Sequence: Synthetic coding sequence
atggttctccagaagctggggaaggctgtggaaacgaaggacgaaagatttgagcagtctgcatctaatttttaccaacaacaggctgagggtcacaaactgtacaaggacctcaagaactttctgagcgccgtgaaggtgatgcatgagagttccaaacgagtgtcagagaccctgcaagagatttattctagtgaatgggacggccacgaagaactcaaggccatcgtttggaacaatgatctgctatgggaagactatgaagagaaactggcagaccaggctgtgagaaccatggagatttatgtggcgcagttcagtgaaatcaaggaacggatcgccaagcggggaagaaaactcgttgattatgactccgctaggcaccatctggaagctgtgcagaacgccaaaaagaaggacgaagcgaaaaccgccaaggctgaagaagaattcaataaggcccagactgtcttcgaggatcttaaccaggaacttttagaggagctccccattctatataactcacgtatcgggtgctatgttaccatcttccagaacatctccaacctgcgagatgtgttttacagggaaatgagcaagctgaatcataacctgtatgaggtcatgtcaaagctggagaagcagcattcaaataaagtcttcgttgtcaaagggctcagttcatcatccagacggtctctcgtcatatctccaccagtgagaactgccacagttagttctcccctgacttccccaacgagcccctccaccctaagtctgaagtcagaatccgagtctgtgtccgcaaccgaggacctcgccccagatgcggctcagggcgaggataactctgaaatcaaagagctcctggaagaggaggagatcgaaaaagaagggtcagaggcaagtagttcagaagaggacgagcccctgccggcttgcaacgggcctgctcaggcccagcccagtccaactacagagagagccaaatctcaagaggaagtgttaccctcttctaccaccccgagcccgggaggcgcattatcgcctagcggccagccctcttcgtccgccaccgaggtggtcctgagaacaagaaccgcaagtgaagggtccgaacagcctaaaaaaagagcctcgatacaaaggacatcagcacccccttcccgcccacccccacctcgagccaccgcttcacctaggcccagcagtggtaatatcccaagttctcccaccgcttcaggaggcggaagtcccaccagccctcgcgctagtctgggtactgggacagcatcgccgagaacatccctcgaagtgtctccgaatccggagccacccgagaaacctgtaaggactcctgaggccaaagaaaatgagaatatccataatcagaacccagaggaattgtgtacttctcccacccttatgacaagtcaggtcgctagcgagcccggagaagctaagaaaatggaggacaaggaaaaggacaataagttgatatcagccaattctagcgaagggcaggaccaactccaggtgagcatggtgcccgagaataataacttgacagcccctgagccgcaggaggaggtctctacttctgaaaacccccagctttag

SEQ ID NO: 216163 - DNA, 762 bp, Artificial Sequence
  Description of Artificial Sequence: Synthetic coding sequence
atgagctggatcccttttaagatcggtcagcctaagaaacagatcgtgccgaagacggttgagagagacttcgaaagagagtacggcaaactccagcaactcgaggagcaaactcggcgtctccagaaggacatgaagaaatcaacagatgccgatcttgccatgtccaaaagcgctgtgaagatatctctcgacctcctgagtaaccctctctgcgaacaagaccaggacttgctgaacatggtcacagccctcgataccgccatgaagagaatggacgcatttaaccaggaaaaggtgaaccaaatccaaaaaaccgtcatcgagccattaaaaaagttcggctcagtgtttccttcgttgaatatggcggtaaagcgcagggagcaagccctgcaagactatagaaggctgcaagccaaggtggaaaagtatgaggagaaggaaaaaacaggtcctgtcctggcaaagcttcaccaggccagggaggaattgagacctgttcgggaggacttcgaagcaaaaaatcgtcagctgctggaggaaatgccacgattttacggatctcggttggattattttcagccctcttttgagagtctaataagagcacaagtcgtgtattattctgagatgcataagatcttcggagatctgagccatcagctcgaccagccgggtcactcggacgagcaaagagagagggaaaacgaagctaagctgtccgagctccgcgctctctcaatcgtggccgacgactag

SEQ ID NO: 216164 - DNA, 600 bp, Artificial Sequence
  Description of Artificial Sequence: Synthetic coding sequence
atgtccaagtccgcggtgaagatatcactggatctgctatctaacccactttgtgagcaggatcaggatttgctgaacatggtcacagccctggacacagcaatgaagcggatggacgcgtttaaccaggagaaagttaaccagattcagaaaaccgtgatcgagccactgaagaaattcgggagtgtgttcccttctctaaacatggctgttaagagaagggaacaagccctccaagattaccggaggctccaggcaaaagttgagaaatatgaagagaaagaaaagacagggccagtgctggccaaactgcaccaagcccgtgaggaactgcgacccgtgcgggaagacttcgaggccaaaaaccgacaattgctggaagagatgcccagattctatggctcccgattggattattttcaaccctccttcgaatccctcatcagggcacaggttgtgtactacagcgaaatgcacaaaatctttggagatctttcgcaccagctcgaccagccaggccatagcgacgagcaaagggagagggaaaatgaggctaaactgtcagagctcagggcccttagcatcgtggcggatgactag

SEQ ID NO: 216165 - DNA, 2343 bp, Artificial Sequence
  Description of Artificial Sequence: Synthetic coding sequence
atgacgcatacgaggcgcaaatccctgcctatgctcagctccggcctcacagggcgtcgagaaccgctccagatggaggactccaatatggagcaaggagtcgagggtgttgaacccggtatgcctgaaagccctgggcacctcacaggcaggagaaagaattatcccttgagaaaacggcctctggtccctgaaaagccaaaggcatgtaaggtcttgcttacgagactggagaacgttgctggccctcgatctgccgatgaggcagatgagctgccgcctgatctgccaaagcctccaagcccagcaccctcctctgaagacccgggacttgctcagccgaggaaaaggagactggcatcgttgaatgctgaggcccttaacaacctgctgctggagcgggaggacacttctagccttgccggaacaagacgcagccgggctggggatccgcataggtcccgggatagggacagagcgaccggaggatggagctcaagcaagaaacgacccaggctgggtgatttggggggagggtctcgagatctcagccccgagcctgcacccgatgaaggtcctcgccgtgatggtgaccctgcgcctaaacgtctggcctcactcaacgcggcagccttccttaaactttctcaggagagggagctgccactgcggctgcctcgtgcccacgccgaggttgacggcaggagcacagaaccacctgcccctaaggcccctcgacccaagtggcctaaagtaaatggcaaaaactaccccaaggcttggcagggggctagcagcggtgaagcagccggacccccagggtggcagggctgccccgacgaaccatggccatccgcaacgccgtgcggaccctcagtgcagccatcccatcagcctcttagcaaggccttggaaagcccactggggctgcggcctcacctgccgctgttgatgggaggtcaagcagcacttaagcctgaaccgggtcggcctggcgaagagtctcccgcacctaaacaggaattacaccagccaagttttcccacgccccaactgagcccccttccaatgccgggaaatcctgcggattacaatgggctgtgcgtcggcccagaattaacagccctgggatctttctatttgtattgtggacaggaaggactgcagtgcggcggatactccccttgcccaatgcttcctgaggggaaactttcccctgtggcagccccacacgaagagggattattactagcaccatcaagcgtgcctagtggaaccccatttcagcatcccccatggggatcctccagatactgtagctccgaagacacaggggtgaatgggtactccatatgcggtgtgcttccgctgtctgttacgcacgcagggaccacctgcggcggttgcccatacaagatgccgtttgctgcagaggggtgtcgttccctgggccagctggagtttccacttcccgaagcaggccatccagcctcccctgcccaccccctgctgggctgccccgtcccttctgtccctcctgctgctgagcccgtgccccatctacagaccccaacaagtgaaccccagacggttgctcgcgcttgccctcagagtgcaaaacccccttcaggatctaagtctgggctgagaacggggagctcgtgcagacacactgctcggtcaaaagccgctagaaggccgagccacccgaagcagcctcgcgtgcaaaggcccaggccgaggcgacgcaggcggaggcggaccaacggctgggtgccagtgggcgcagcctgtgaaaaggccgtgtatgtgctcgacgaacccgagcctgccatcagaaagtcttaccaagccgtcgagaggcatggggagaccatccgggtgcgcgatactgtcctgctgaaatcagggcctaggaagacttcgacaccctatgtggccaagatttctgcgctatgggagaaccctgagagcggcgagctgatgatgtccctcttgtggtactaccggccagaacacctgcaggggggacggtcacctagtatgcacgagccactccaaaatgaggtctttgcctccaggcatcaggatcagaacagcgtggcttgtatcgaggagaaatgctatgtactcacattcgctgaatattgccgcttctgtgctatggcaaaacgtcggggtgaaggcctgccttcccgcaagacagctctggttcctccttccgctgattattccacccctcctcatcgcactgttcccgaggataccgatccggagttagtgttcctctgcagacatgtgtacgacttccggcacgggagaattcttaaaaaccctcagtag

SEQ ID NO: 216166 - DNA, 2340 bp, Artificial Sequence
  Description of Artificial Sequence: Synthetic coding sequence
atgacccatacgcgtagaaagtctctacctatgctgagctccgggctcaccggcaggagggaacccctccaaatggaggacagtaacatggaacaaggtgtagaaggcgtggagccgggaatgccggaaagccctggacacctaacgggtaggagaaagaactatcccctgcgcaagcgacctttagtccctgaaaagcccaaagcatgcaaagtgcttctcaccagacttgagaacgtggccggaccgaggagcgccgatgaagcagatgagcttccccctgacctaccaaagcccccaagcccagcaccttcctctgaggatcctggtctcgcccagcccagaaagaggaggctggcatcactcaacgctgaagccttaaacaacctactcctcgagagagaagacacttcgagtctagccggaactagaagaagcagagccggagacccgcacaggagccgcgatagagatcgtgccactgggggatggtctagctctaaaaagaggcccagactgggcgatctaggaggagggtctagggacctgagcccagagcccgcaccggatgaaggccctcgtcgggatggcgaccctgccccaaagcgattggctagtttgaatgctgctgccttcttgaagttaagccaagagagagagctgccactgagactcccgagggcccatgcagaggtggatggccgttccaccgagcctcccgcaccgaaggcccctaggcccaagtggcctaaggttaacggaaaaaattaccccaaggcttggcagggtgcgtctagtggagaggccgcaggccctcctggttggcaggggtgtcctgacgaaccatggccatccgcaaccccctgcggcccaagtgtgcagccctcacatcagcccctcagcaaagccctagagagcccactggggctaagaccccatctgcccctgctcatggggggacaggcagcgcttaagccagaacctggacgacccggagaggagagccccgctcccaaacaagaactccaccagccctcctttcccacaccccaacttagcccactgccgatgcctggcaatcccgcagactacaacgggctgtgtgtcggccctgagctgacagccctgggctcattctatctttattgcggacaggagggattacagtgcggaggatatagcccatgcccgatgctgccagaggggaaattatcaccggtggcagcaccacacgaagaaggactgcttctcgcgcctagctccgtccctagcggaaccccatttcagcaccctccatggggctcatctagatactgctcctctgaagacaccggtgtaaacggttactcaatctgtggcgtcctccccctttctgtgacccatgccggaacaacctgcgggggttgcccatacaagatgcctttcgctgccggatgcaggagtcttggacagctggaattccccttacccgaagctggacaccctgcctcaccagcccaccccttgctgggttgtccagtaccatctgtgccacctgcggctgagcctgttccccatctgcagaccccaactagcgagccacagacggtagccagagcgtgcccccagtcagccaagcctcctagtgggtccaagtcgggactgagaacgggaagttcttgccgacacaccgcgagatccaaggcagccagacgcccaagccaccctaagcaacctagagtccagaggccgaggcccaggcgcaggaggcgtcgacggaccaatggatgggttcccgtgggggcagcatgtgaaaaagcggtgtatgtgctggatgaacccgaacctgctatcagaaagtcctaccaagccgtggagaggcacggagaaaccattagggtgcgcgacaccgtgctattaaagtccggacctcggaaaacttctactccctacgtcgctaagattagtgcactgtgggagaatccagagtccggcgaattaatgatgagcttactgtggtattaccgcccagagcacctccagggcggtcgttctcctagcatgcatgaacctcttcagaacgaggtcttcgccagcaggcaccaggatcagaactcggtggcttgcatcgaggaaaaatgttacgtgctgacattcgctgaatactgtcggttttgcgccatggccaaaagacggggtgagggcctcccaagtcggaaaaccgcactggttccaccttctgccgactacagcacccctcctcacaggaccgtgccagaagacaccgacccagagcttgtttttctgtgtcggcatgtgtatgattttcggcatggtcgcatccttaaaaatcctcaatag

SEQ ID NO: 216167 - DNA, 4575 bp, Artificial Sequence
  Description of Artificial Sequence: Synthetic coding sequence
atgcctcttctgcaccgtaaaccctttgtgagacagaagccacccgctgatctaaggccggatgaggaggtcttctactgcaaggtgacaaacgagatcttccgccattatgatgatttcttcgaacgcacaatcctgtgtaactctttggtttggagttgtgccgtcactgggcgtcccggactcacttaccaggaagctctcgagtctgaaaagaaggcacgtcaaaacctgcagtcctttcccgagccactgattattcctgttttgtacctgacgtccctgactcatcggtcccggttgcacgagatttgtgatgacatctttgcctacgtaaaagaccgctacttcgtggaggagacagttgaggtgattcggaataatggggcacgtctgcagtgtcgtatcctggaggtgttgccaccatcacaccagaatggattcgccaacggacatgtgaatagtgtggacggagagacgattataatatctgacagcgacgactccgagacgcagagctgttcatttcagaacgggaagaaaaaggacgcaatagacccactgttgtttaagtacaaagtgcagcccaccaagaaggagctgcacgaatccgccatcgtgaaagcaacccagatctctcgaagaaagcatctttttagcagggacaagttaaaactttttctcaagcaacactgcgaaccacaggatggagttatcaagattaaggcctcctccctgagtacttacaagatcgccgagcaagacttcagctacttttttcccgacgacccccctacatttattttcagcccagccaacaggaggcgagggaggccccctaaacgcatccacattagccaggaggacaacgttgcaaacaaacagaccctggccagttacagatcaaaagcaaccaaggagcgggacaagctcctgaaacaggaagagatgaagagcctagcattcgagaaggccaagctgaagagagagaaagctgacgccctggaagccaaaaagaaggagaaagaggataaggagaaaaagcgtgaggaacttaagaagatagtcgaggaggagcgactcaagaagaaagaagaaaaggaaaggctgaaggttgagagagagaaagaacgagagaaactgcgggaggagaaacggaagtatgtcgagtatctgaaacagtggtccaagcctcgggaagatatggaatgcgatgatctaaaggaattacccgagcccacccctgtgaaaacgagactgccgccagagatcttcggggatgctttgatggttcttgaatttctgaacgcttttggcgagctctttgatctgcaagatgagtttccggatggcgtaaccttggaggtgctggaggaggctctcgtcggcaatgattcagaaggccctctctgtgaactcctcttttttttcttaactgcaatcttccaggcaatcgccgaggaggaggaggaggtggccaaagagcaacttacagatgcagataccaaggggtgctccctcaaaagcctggatttggattcttgtacactgagcgaaatactaagactgcacattctggctagtggagctgacgtgacatcagcaaacgccaagtaccggtatcagaaacgaggtggcttcgatgctacggatgatgcatgcatggagttgcggctttccaacccttctctcgttaagaagctttcttctacaagcgtgtatgacttgactccaggagagaagatgaaaatcttgcacgccctgtgtggtaagctgcttacactggtctcaacccgcgatttcatagaggattatgtcgacatactgagacaggcaaagcaagagttcagagagttgaaagctgaacaacatagaaaagagagggaggaagctgcagcaagaatccgtaaacgcaaagaggagaaattgaaagaacaggagcagaagatgaaggaaaagcaggaaaagctcaaagaggatgagcaacgaaacagtaccgcagatatctcgatcggtgaagaggagagggaagacttcgataccagcattgaatccaaggacacggaacagaaggagctggaccaggacatggtaaccgaggatgaggacgatccaggatctcataagcggggtcgaagaggcaagcgcggacagaacggcttcaaagagtttacgaggcaagagcagataaactgtgtcactagagagcccctgacggccgacgaggaggaggcactgaaacaggaacatcagcgtaaggaaaaagaattgctggaaaagatccagagcgctattgcttgtactaacatatttccactggggagagaccgcatgtatcggaggtactggatcttcccatccataccgggtctctttatagaggaggactattctggccttactgaggatatgcttctgccgaggcctagctccttccaaaacaatgtacagagccaggatccccaggtgagcacaaagacaggggaaccgttaatgagcgagagtaccagtaacatagaccagggaccaagagatcattccgtgcaattgccaaagcccgtgcataagccaaatcgctggtgcttttactcttcgtgtgagcagctagatcagctgatcgaggcactcaattctagagggcacagagaatccgcccttaaagagacactgctacaagagaagtcgagaatctgcgcacagttagctcggttttccgaagagaagtttcacttctccgacaaaccccagcccgatagcaagccgacatactctcggggacgcagctccaatgcttacgatccaagtcagatgtgcgccgagaaacagttggaactgaggctgcgggatttcctgctggatatcgaagatagaatctatcagggcaccctgggagcgataaaagtcacagatagacacatttggagaagtgctctcgaatccggcagatacgagctgctatctgaggagaataaggagaacggtatcattaagacggtgaatgaagacgttgaagagatggagatagacgagcaaaccaaagtgattgtaaaggatcggctgctaggtattaagaccgagacaccttctacagttagcaccaatgcctcaacccctcagagtgtctcgagcgtagtgcattacctggccatggctctgtttcagatcgagcagggcatcgaaagacgcttcctgaaagctcctttggacgcctctgactccggtagatcttacaaaacagtgttggacaggtggagggaatcgttactgagctcggcaagcttatctcaagtttttctgcatctcagcaccctagacagatctgtcatatggtccaagtccattctgaatgcacgctgtaaaatatgccgcaaaaagggtgacgctgagaacatggtactgtgcgacggatgtgatcgtggccatcacacctactgtgtgcgacccaaactgaaaacagtgccagaaggggattggttctgccctgagtgcagaccaaagcagagatccaggcgcctctcctctaggcagcgaccatctcttgaatcggatgaagacgtagaagacagcatgggtggcgaggacgatgaggtggacggtgatgaggaggaagggcagtctgaggaagaggagtacgaggtcgagcaagatgaggatgactcccaggaggaggaggaagtttcactacccaaacgaggccgaccccaggtccgccttcctgtcaagaccaggggaaaactttccagctccttctcgtcgaggggtcaacagcaagagccgggtagatacccgtcccgtagtcagcagtccacaccaaagacgaccgtgtcttcaaagacggggcgtagccttcgcaaaattaattcagcccctccaacagagacaaaatcactcagaatagcctccaggagtaccagacactcacacgggcctctccaggctgatgtctttgtggaactcttgagtcctcggagaaagcgtagaggcaggaaaagcgcaaacaatactcctgagaactctccaaattttccgaactttcgtgtgatagcgacgaaatccagcgagcaatcccgctccgtaaatatcgcatcaaaattgtcgttgcaggagagcgaaagtaagcgtaggtgtcggaagcgacaaagccccgagccaagccctgttacattgggcagacggtcttccggcaggcagggaggggtccacgagctttcagccttcgaacaactggtggtcgaactggtacggcacgacgatagttggcctttccttaagctggtgtccaaaatccaggtgcccgattattacgacataataaaaaagcccatcgctcttaatatcattagggagaaggtcaataaatgcgaatacaaacttgcctccgaattcatcgatgatattgagcttatgttctccaattgcttcgaatataaccccagaaatacatccgaggctaaggccggtacacgactccaggcattctttcacattcaagctcagaagctgggcttacacgtgactccatcaaatgtagatcaggtttcgacgcccccagcagccaagaagtctcggatctag

SEQ ID NO: 216168 - DNA, 4671 bp, Artificial Sequence
  Description of Artificial Sequence: Synthetic coding sequence
atgcctctcttgcatcgtaagcccttcgtgagacagaaacccccagccgacttgagacccgacgaggaggtcttctactgtaaagtgacaaacgaaatttttagacactacgacgactttttcgagcgtaccatcctttgcaacagcctggtttggtcctgcgcggtgaccgggcgacctggtctcacgtatcaggaggccctggagtctgagaagaaagctcgtcagaatctgcaatcctttcctgagcctctgattatccctgtgctctatctgacaagcctgactcaccgcagccggctccatgagatctgtgacgacattttcgcttatgtgaaagaccgctacttcgtggaggagacagtcgaagttatacggaataacggagccaggctacagtgcagaatattggaagtgctgccgccttcccatcagaacgggttcgccaacggacatgtgaatagtgttgacggtgaaactatcatcatttcagattctgacgatagcgagacccagagctgctcctttcagaatggtaagaagaaggatgctattgacccacttctttttaagtataaagtccaaccgactaaaaaggagctccacgaatccgccatcgtaaaagcaacccagattagtaggcgtaagcatctgttttctcgggataaacttaagctgtttctaaaacagcattgtgagccccaggatggggtgattaaaatcaaggctagtagcctgtccacatacaagatagccgagcaggatttctcctacttttttcctgacgatcctcccactttcatctttagccccgctaaccggagacgtggaaggccgccaaaacgaatacatatttctcaggaggacaatgtggctaacaagcaaactttagcaagctacaggtccaaagccacgaaggaacgcgacaagttacttaaacaggaagagatgaaatcgctagcctttgagaaagccaaactcaagagagagaaggccgacgccctggaggctaagaagaaggagaaggaggacaaggagaagaaaagggaggaattgaaaaagatcgtcgaggaagagcgtctgaagaaaaaagaggagaaagaaaggctgaaggttgaaagagagaaagagcgtgagaaacttagagaagagaagaggaagtacgtcgaatacctgaaacaatggagcaagcctagggaggacatggaatgtgatgatctgaaagaactgccagagccaacacctgttaagacacggctgcctcctgagattttcggggatgccctgatggtgctcgaattcctgaacgcgtttggcgaattattcgatcttcaggacgaattccctgacggggtcaccctggaggtgctcgaagaagctctggtaggcaacgacagcgagggccctctttgtgagctcttgttcttctttctcacagcgatcttccaggccattgcagaggaggaggaagaggtcgcaaaagaacagctgactgacgccgacactaaagacctcacggaagccttagacgaggatgctgatcccaccaagagtgcattatccgctgttgcgtcattggcagcagcatggccacaacttcaccaggggtgttcactgaagtcattggatctggacagctgcaccctttctgaaatcctcaggctgcacatcctcgcgtcaggcgctgatgtgacctccgccaatgcaaaataccggtatcaaaagaggggcggttttgacgccaccgacgatgcctgtatggaactgcggttatccaacccgagccttgtcaagaaactgagctccactagtgtctacgacctgacccccggagagaagatgaaaatcctgcatgcgttatgcggaaagctgctgaccctggtctccacaagagactttatagaagactatgtggacattctgcgtcaagcaaaacaggagtttcgggagctaaaagcagagcagcacaggaaggagagagaggaggcagcggctcggattagaaagcgcaaagaggaaaagttaaaagagcaggagcagaaaatgaaagaaaagcaggaaaagcttaaggaagacgaacagagaaactcgactgctgacatcagcattggcgaagaggagagggaggattttgacacctcgatcgaaagtaaggacacagaacagaaggaactggatcaggacatggtcacggaagacgaagatgaccctggtagccataagagaggacgacggggaaaacggggacaaaacgggttcaaagagtttaccaggcaggagcagattaattgtgtaacaagagagcccctaacagccgatgaggaagaggccctgaaacaggaacatcagcggaaagagaaagagctgttggagaaaatccagtccgcaatcgcgtgcacaaatattttcccactcggaagggataggatgtatcgcagatattggatctttccctccatcccaggattgttcattgaggaagattatagcggattaacagaggacatgctgctgcctcggccatcttctttccagaacaacgttcaatctcaagacccgcaggtgtctacaaagacgggtgaaccgctaatgtcagagtcgacttctaatattgatcagggccctagggaccacagtgtgcagctgcccaagccagtccataagcccaacaggtggtgcttctacagcagttgtgaacagttagaccaactgatcgaggcactcaactcccgagggcaccgtgagagcgcgttgaaggagactctgttgcaggagaaatctcggatctgcgcccagctggcacgcttctcagaagaaaagttccacttctctgacaagcctcagccggactccaagccaacctatagtcgcggacggtctagtaacgcctacgatccttcccagatgtgtgccgaaaagcagttagaactgcgacttcgggacttccttctagacatagaagatcgcatctaccagggaacactaggcgcaatcaaggtcacagatcggcacatttggaggtcagccctcgagtcgggtcgatatgagcttctaagtgaagagaacaaggaaaatgggattattaaaaccgtaaacgaggatgtcgaggagatggagatcgatgaacagacaaaggttatcgttaaggacaggctcctgggcattaaaaccgagacgccctcaactgtgtccaccaatgcctcgactccacagagcgtgtcttcagttgtccattacctggccatggctctctttcagatagagcaggggatcgaaaggcggttcctgaaagcgcctttagatgcctccgacagcgggagatcttacaagactgtgctcgaccgctggagagagagcctgctttctagtgcgagcctgagccaagtcttcctgcacttatccacgttggaccgcagtgtcatttggtccaaatcaattctcaacgcccgatgcaaaatctgccgcaaaaagggtgacgccgaaaatatggtgctgtgcgacggctgcgatcgagggcaccacacatattgtgtgaggcctaagttgaagactgtgcccgagggggactggttctgtccagaatgtaggccaaagcagcgctcccgacgcctgtcctctagacagcggccaagtttggagagcgacgaagacgtggaggacagtatgggaggcgaggacgacgaggtggatggggacgaagaagaggggcaaagtgaggaagaggaatatgaagtcgagcaagacgaggacgacagccaggaagaggaggaagtttcactcccaaagagagggagaccacaggttaggctccctgttaagaccaggggtaaactgagcagctccttttcctcgcgtgggcaacaacaggaacccggtcgataccccagtaggagtcaacagagcactcctaagaccactgtctcctcgaaaaccggtagaagccttaggaagataaactctgcgcctcccactgaaacaaagtcattgcgcatcgcgagtcgcagcactcggcactcccatgggcctctacaggctgacgttttcgtggagttgctgtccccaagaagaaagagaaggggtcgcaagagtgcaaataacactcctgagaactccccaaattttcctaactttagggtcatcgccaccaagtcgagtgaacaaagcagaagtgtgaatatcgcgagcaagctgagcctgcaggaatccgaaagcaaaaggagatgcagaaagcgccagtccccagagccatctcccgtcaccttgggaagacggtcatcagggaggcaaggtggagtacatgagctcagtgcctttgagcagctggtagtggagttagtgcgccatgacgattcatggcctttcctgaaattggtgtccaagatccaagttcccgactattatgatatcattaagaagcccattgccctgaacataattcgcgaaaaggtgaataaatgtgaatacaagctcgcctcagagttcattgacgacatcgaactcatgttctctaactgctttgagtacaacccgcgaaacacatctgaggccaaggccggaaccagactgcaggcctttttccacatccaggcacagaagttagggctccacgtcaccccttctaatgtcgatcaggtttcgacaccacccgcagccaaaaagtcacggatttag

SEQ ID NO: 216169 - DNA, 4671 bp, Artificial Sequence
  Description of Artificial Sequence: Synthetic coding sequence
atgcccttgctgcatcgcaagcccttcgtccggcagaaacctccagcggacctgcgtcccgatgaggaagtcttctactgcaaggtcacaaacgaaatatttaggcactatgatgacttctttgaacggaccattctgtgtaacagccttgtctggagttgcgccgttacgggtcggcctggacttacttaccaagaggcgttggagtccgagaaaaaagctaggcagaatttgcagtcttttcccgagcctctcatcattccggtgttgtacttaacatctctcactcaccggagtcgtttacatgagatctgcgacgatattttcgcctatgttaaagaccgctactttgtggaggagaccgtggaggttataaggaataatggcgctcgcctccagtgccgcatcttagaggtcttgccacctagtcaccaaaacgggtttgctaacgggcacgtcaactcagttgacggcgagaccattatcattagcgatagtgacgattccgaaactcagtcctgcagctttcagaacggcaaaaagaaggatgccattgaccctctgctgttcaagtacaaagttcagccgactaaaaaggagcttcacgagtctgccatcgtgaaggcaacccagatctcacgtagaaagcacctgttttccagggataagctaaaattattcctgaaacagcattgtgagcctcaggacggtgttataaaaatcaaggccagctcacttagcacttataagatagccgagcaagattttagctacttttttcccgatgatcctcccacatttatcttcagtccagcgaatagaagaaggggaagaccaccaaagagaattcatatctctcaggaggacaacgtcgccaacaaacagacactggccagttatcggtcaaaggccacgaaggagcgcgacaagctcctgaaacaggaagagatgaagagcctggcttttgagaaggctaaactcaaacgagaaaaagctgatgcacttgaggccaagaaaaaggaaaaggaagataaggaaaagaaaagagaggagctgaaaaagattgtagaagaggagaggttgaaaaagaaggaggagaaggagaggctgaaggtcgaaagagagaaagaacgtgagaagctgagggaagagaaacggaagtacgtggagtacttgaagcagtggagtaagccccgagaagacatggaatgtgacgacctgaaggagctgcctgaaccaacaccagtcaaaactaggctgccgccagagatttttggcgatgccttgatggtactcgagtttttgaacgcttttggcgagttgtttgacctgcaggatgagtttccggatggagtgacactggaagtacttgaagaggccctcgtcggaaacgattccgaggggccactttgtgagctgctgtttttcttcctgaccgcgatttttcaggcaatcgcagaagaggaagaagaggtggccaaggaacaattaaccgatgccgatactaaggacctgactgaagccctggacgaagatgctgacccaactaaatccgcccttagtgcagtagcttccctggccgctgcttggcctcagctccatcagggatgtagcctgaaaagcctcgacctggattcatgcactctcagcgaaatcctcaggcttcacatcttggcatccggcgctgatgtcacctccgcgaacgcaaagtacaggtaccagaaaagaggaggcttcgatgccactgacgatgcttgcatggagctcagacttagcaacccttcacttgtgaaaaagctgtcaagtacctctgtgtatgaccttacccccggtgagaagatgaagatcttgcacgccctgtgcgggaagttactgaccttagtgtcaacccgcgatttcatcgaggattacgttgatattctgaggcaggccaagcaggagtttcgcgaattgaaggcagagcaacaccggaaggagagagaggaggcggctgctaggatccgcaagaggaaagaggagaagctgaaagagcaagaacagaaaatgaaagagaaacaagaaaaactgaaagaagacgagcagagaaacagtaccgccgatatatccattggcgaagaggagagagaagatttcgacacaagcattgagtccaaagacacggaacagaaggagctggatcaagatatggtgacagaggacgaggacgaccccggatcccacaaaagaggaagacggggaaaaaggggacagaatgggtttaaggagtttactagacaagaacagattaattgtgtcacccgggaaccgctcactgcggatgaggaagaggccctaaaacaagaacaccaacgcaaagaaaaagaactccttgagaagatccagtcagccatagcgtgcactaacatcttcccccttggcagggaccggatgtaccgcaggtactggattttcccaagcattcccggactgtttattgaagaagactacagcggtttgaccgaagatatgttgctgccacgtcctagctcttttcagaataatgtgcaatcacaggacccccaagttagtaccaagactggagaaccactgatgtccgagagtactagtaatatcgaccaggggccaagggaccactcagtacagctgcccaagcctgtacacaaacccaatcggtggtgcttctatagttcttgcgaacagctggaccaattgatcgaggcactgaattcgcggggacaccgggagtctgctcttaaagaaaccctcctgcaagaaaagtcgcgtatatgcgcccagctggcacgattctccgaggaaaagtttcacttttctgataaaccacaacccgactccaagccaacctactctcggggaaggtcctctaacgcttatgacccgagtcaaatgtgcgcagagaaacagctggagctgagactcagggacttcctgcttgatatcgaggaccgcatctaccaaggcactctcggcgctattaaagtcacggatcggcatatctggcgaagtgctcttgagtctggtcgatacgaacttctctccgaagaaaacaaagaaaacggaatcatcaaaacagtaaacgaggatgtcgaagaaatggaaattgatgagcagaccaaagtgatcgtgaaggacagactgttgggtataaagaccgagactccgtctacagtgagtacgaacgcaagcactccacagagcgtcagctccgtagttcattacctagcaatggccttgttccagattgagcagggaatcgagcgccgatttcttaaagccccactggatgctagtgacagtggacggagttataagactgtcctggatcgctggcgggagagcttgttatcctctgctagcctgagccaagtgttcctgcacctgtctacgctcgaccgctctgtcatctggtccaagagcattttgaacgccaggtgcaagatatgtcggaaaaaaggcgacgcagaaaacatggtgctgtgcgacggctgcgatcgaggtcaccatacgtactgtgttcggccaaaactgaaaactgtgccggagggcgattggttctgccccgaatgccggcctaaacagcgttctcggagactcagctcacggcagaggccctctctggaatctgatgaggacgtcgaggatagcatgggtggagaagatgatgaggtcgacggcgatgaagaggagggccagtctgaggaagaagagtacgaagttgagcaggacgaggatgattcccaggaagaggaggaagtcagtctgcctaaaagaggcaggccgcaagttcgattacctgttaagactcgcggaaagttgagcagctcttttagcagtcggggtcagcaacaggagccgggaaggtacccgagtcgttcccagcaatccactccgaagaccaccgtgagttctaaaaccggccgaagtctgcgtaaaataaattctgcccctccgaccgaaactaagtcattaaggatcgctagcagatctactcggcactcccatgggcctctgcaggccgacgtattcgtagaactgctgtcccccagaagaaaacgcaggggcaggaagtctgctaataataccccagagaactcccccaactttccgaattttagggtcatcgcaactaaatcctccgagcagagcaggtctgtcaatatcgcctccaagcttagccttcaagaaagcgagtcaaaacgaaggtgccgcaagagacagagtccagagccctccccagttacgctaggccgacgaagcagtggtcgacagggtggcgtgcatgaactttcggcttttgaacagcttgtggtggagctggtgcgccacgacgactcttggccattccttaagctggtgtccaaaattcaggtgcctgattactacgatatcatcaagaagccaatcgccctgaatataatccgagaaaaagtgaacaagtgcgagtataagctcgctagtgaattcatagatgacattgagttaatgttctctaattgcttcgagtacaatccccgaaacaccagtgaggctaaagcgggaactcggcttcaggctttttttcacatacaggcccaaaaactcggactacacgtaacacctagcaacgtcgatcaggtgagcaccccacctgccgctaagaagtcacggatatag

SEQ ID NO: 216170 - DNA, 3702 bp, Artificial Sequence
  Description of Artificial Sequence: Synthetic coding sequence
atgaagagtttggctttcgaaaaggccaaacttaaacgggagaaagcagacgccctggaggccaaaaagaaggaaaaagaggataaggagaaaaagagggaggagctcaaaaaaatagtggaagaagaaagactgaaaaagaaagaggaaaaagagcgacttaaggtggagcgcgaaaaggaaagagagaagcttagagaggaaaagcgaaagtatgttgaatacttgaaacagtggtccaagcccagagaagacatggagtgtgacgacctgaaagagcttcccgaaccaacgccggttaaaacacgactccctcctgaaattttcggcgatgccctgatggtactcgaatttctcaacgcctttggcgagctgtttgacttacaagatgagttcccagacggcgtgacattggaggttctagaggaggcactggtgggcaacgacagcgaaggacctctttgcgagctcctcttctttttcctgacagccattttccaggctatagccgaagaagaagaggaagtggctaaagagcagctgactgatgccgataccaaaggctgttcgctcaaatcactcgatttagacagttgcaccctgtccgagattctgagactgcatatccttgcatccggtgccgatgtgaccagcgcaaatgctaaataccgatatcagaaacgaggaggattcgacgctacagacgatgcatgcatggagctccgcttatcaaacccctccctagtgaaaaagctcagtagcacgagcgtttacgatctcacccccggagagaaaatgaagatcttgcacgcattgtgcggcaaactgctgacactggtcagtacacgggacttcatcgaagattatgtcgatattctgcggcaggccaagcaggaattccgcgaactaaaagctgaacagcacaggaaggagcgcgaagaagctgcagcaagaattcgaaagaggaaagaggaaaaactcaaggagcaagaacaaaagatgaaggaaaagcaagagaaattaaaggaggatgagcagcgcaactccactgctgacattagcattggggaggaggaaagggaggacttcgacacttctatagaaagtaaagacacagaacagaaagagctcgatcaggatatggtgacggaggatgaggacgaccctggtagtcataagcgcggaaggaggggtaaaagggggcagaacgggttcaaagagtttacaagacaggaacagataaactgtgttactagggaaccactcactgccgacgaggaagaggcccttaaacaagaacatcagaggaaagagaaagaactgctcgagaagatccagagtgctattgcatgcaccaatatttttccattaggcagagatcggatgtaccgacgctactggatcttcccaagtattccagggctgttcatcgaggaagactatagcggactgacggaagacatgctgcttccgcgtccgagttcctttcagaacaacgtacagagtcaggacccccaggtgagcactaaaacgggcgagccactgatgagcgagagcaccagtaacatcgatcaaggtccgagggatcacagcgtgcagctgcccaagccagttcacaaacccaaccgttggtgtttctattcttcctgtgagcagctggatcagttaattgaagccttgaatagtcggggtcaccgggagtcagccctgaaggaaacactgcttcaagagaaaagccgcatctgtgcccaactcgctcggttctctgaggagaaattccatttttccgacaagccccagcctgactcaaagccaacatattctcgtggccgatcaagtaatgcctacgaccccagtcagatgtgtgccgagaagcagctcgaactccgtctgcgtgactttctgctcgacattgaagatcgcatctaccagggcacattgggtgccatcaaggtaactgatagacacatatggcgcagcgccttggagtcgggcaggtacgaactgctctccgaggagaataaagaaaacggcatcattaaaaccgtgaacgaggatgtagaggagatggaaatcgacgaacagacaaaggtcatcgtgaaagacaggttgctcggtataaagactgaaaccccttcaacggtctctaccaacgctagtacacctcagtctgtgtcatctgtcgtgcactacctcgcaatggcgctatttcagatcgaacaggggatcgaacgcagattccttaaggcaccacttgacgcctctgattcaggcaggagttacaagacggttctggatcggtggagagaaagcttactgtcgtcggctagcctctctcaggtgtttctccacttgtccactttagatagatccgtcatctggagcaagtcaatcttgaacgcgcgttgtaaaatctgtcgcaaaaagggcgacgcggagaatatggtgctttgcgacgggtgtgatcggggacaccatacatattgtgtccggcctaagctaaaaacagtgccagaaggagattggttttgtccagagtgcagaccaaagcagaggtcccggaggttgagttcccgacagaggccgtccctggaaagtgacgaggatgtggaggattccatgggaggtgaggacgatgaggtagatggagacgaggaggaaggacagtcagaggaggaagaatatgaagtagaacaagatgaggacgatagccaagaggaggaagaggtttccctccccaagaggggaaggccacaggttagactcccggtcaaaaccagaggcaaactgtcctccagcttctctagccgcggacagcagcaggaacccggaagatatccttcaagaagccagcaatctacaccaaagaccactgtgtcttccaagaccgggcgttcccttaggaaaatcaattccgctcctccaaccgagactaagagtctccggatcgcttctaggagcacgcgtcacagccacggtccactccaggcagacgtgttcgttgagttactgagccctcggaggaaaagaaggggtcggaagtcagcgaataatacccccgaaaattctcccaactttcctaattttagagtaatagcaacaaaaagcagtgaacagtcccggtccgtaaacattgcctcaaagctctctctgcaggagagtgagagtaaacgccgatgccgaaagagacagtcgcctgaaccatctcctgtaacactcggtcgaaggagctctgggcgtcagggcggtgttcacgagttgtctgcctttgaacagctggtggtggagctagtgaggcacgatgactcatggccttttctcaagctagtttccaaaattcaagtgcccgattactacgacataattaagaaacccatagccctcaacattatcagggagaaggtgaataagtgtgaatacaagctcgcatcggagttcatagacgatatcgaacttatgtttagcaactgcttcgagtacaacccacgtaatacgtcagaggcaaaggctggaacaaggctgcaggcgtttttcatcttcagactgaaatctctggactctactagccacccagtaatgtggaccaaattagcacatcataggttacggaagtcccatgaatctgactttgtgctcctgaaggacatttttgaggagaaacagattgtgcatgagaacggaactctgaatcatgctgtgtag

SEQ ID NO: 216171 - DNA, 4452 bp, Artificial Sequence
  Description of Artificial Sequence: Synthetic coding sequence
atggcccctctcctgggcagaaagccctttcctctggttaaaccattacccggagaagagccactgttcacgatcccccatactcaggaggcatttagaaccagagaagagtacgaggctaggctggagcgatatagcgagcgaatttggacatgcaagtctacggggtcctcccagctgactcacaaagaggcttgggaggaggaacaggaagttgctgaactccttaaggaggagtttccagcatggtatgaaaagcttgtgctagagatggtgcaccacaacacagcctccctggaaaagctcgtggacacagcatggctggagattatgacaaagtacgccgtcggagaagaatgcgacttcgaggttggcaaggagaagatgctgaaggtgaagatcgtgaagattcatcctcttgagaaggttgatgaggaggccacggagaaaaaatcagacggggcttgtgattcgccctcaagtgataaggagaacagctcacagatagcccaggatcaccaaaagaaggaaaccgtcgtgaaagaggacgaggggaggcgggaatctataaacgatagggcgcgtcgatccccccgaaagctgcccacgtcactcaagaagggtgagcgtaaatgggcccctcccaagttcctgcctcataagtatgacgtcaagctacagaacgaagacaagatcattagtaatgttccggcagattctttgatccggacggaacgccctcccaacaaagaaattgtccgctactttatcaggcacaatgcactccgcgcaggaacgggggaaaatgccccttgggtcgtagaggacgaactagtcaaaaagtacagtcttccctccaagttttcagattttctcctggacccgtataagtatatgacactcaatcccagcacaaaacggaaaaataccggcagccccgatcggaagccttcaaagaagtcaaagactgacaattcaagcctgtcttccccgctcaatccaaaactttggtgtcacgttcatttgaagaagtcgctcagcggctctccactcaaggttaaaaatagcaagaacagcaagagtcccgaggaacacctcgaggaaatgatgaaaatgatgagccctaacaaactacacactaattttcatatcccgaagaagggcccacctgcaaaaaagcccggtaagcattctgacaagccactgaaggccaaaggacggtcaaagggcatactgaacggccaaaaaagcacgggcaacagcaagagccccaaaaagggcctgaagaccccaaagacgaaaatgaagcagatgacactgctggatatggcgaagggaacacagaaaatgactcgcgcaccacgtaattcaggtggaactccacgtacgagcagtaaacctcacaagcacttacccccagccgcactgcacttaatcgcctattacaaggagaataaagaccgggaagacaagcggagcgccctgagctgcgtgatttccaagactgccaggttactttcttctgaggatcgggcacgcctccccgaagagctgagaagccttgtccagaagagatatgaactcctggagcataagaaaaggtgggcctcaatgtcagaagagcagcggaaggagtacctaaagaagaaacgggaagaactcaaaaagaagctgaaggaaaaagccaaggagcggagggaaaaggagatgctcgaaaggcttgaaaagcaaaagcgctatgaggatcaggagctgaccggtaagaatctgcccgcttttcggctggtggatacaccagagggactgcctaatacactgttcggagacgtcgcgatggtcgtagaatttttgtcgtgttacagcggcctactgctgcctgatgctcagtaccccattaccgctgtctccctgatggaggccctttctgcagacaagggcggatttctgtatctgaaccgagttctcgtgattttgctacagaccttgttacaagatgagatcgccgaggattatggtgaactagggatgaagctgagcgagatcccccttaccttgcatagcgtgagcgaactggttcgactgtgcttgagacgatcagacgtacaggaggagagcgagggttccgatacggatgataacaaagacagcgccgcttttgaagacaacgaagtccaagatgaatttctcgaaaagctggaaacaagcgagttctttgagctgacatccgaggagaagcttcaaatccttacagctctctgtcaccgcattttaatgacctactcagtacaggaccacatggagactagacagcagatgagcgccgaactgtggaaagaacgcctggcagtgttgaaggaagagaacgacaaaaaacgggctgagaaacagaaaaggaaagagatggaagcaaaaaacaaggaaaatgggaaggtggagaacggacttgggaagactgacaggaagaaagaaattgtgaaattcgaaccccaagttgacaccgaggcggaggacatgatctctgccgtgaagagccggagactgctagccatccaagctaaaaaggagagggaaatacaggagcgcgagatgaaggtaaaactggaaagacaggcggaagaagaacgtatccggaagcataaggccgcagccgagaaagcatttcaagaaggcattgcaaaagcgaaactggtcatgcgcagaaccccgatcgggaccgatcgaaatcacaaccgatactggctcttttccgacgaagtacctggacttttcatagaaaaaggctgggtgcacgactccattgactacagattcaaccatcattgtaaagaccacactgtatccggtgacgaggactattgcccaaggagcaaaaaggctaatcttgggaagaacgccagtatgaatacccagcacgggactgctaccgaggtggccgtcgaaactacaacgcccaagcagggccagaacctctggttcctctgcgattcacagaaggaattagacgaactattgaattgtttgcatcctcagggcattcgtgagtcacagcttaaggaacgtttggagaagcggtaccaggacattatccacagcattcatttggctagaaagcccaatctcggcctcaaatcatgcgatggtaaccaggagctcctgaactttttgcgaagtgacctcatcgaggttgccactcggctgcagaaggggggactgggctatgtagaagaaacaagtgaatttgaagcaagagtgataagtctggaaaaactgaaagacttcggggaatgtgtcattgctttacaggcatctgtgataaagaagtttctgcaagggtttatggcaccaaaacaaaagcgacgtaagctccagtcagaagatagtgccaagactgaggaagtcgatgaagagaaaaaaatggtggaagaagcaaaagtcgcatctgcgttggagaaatggaaaacagctattagggaggcccagacattctctaggatgcacgtgttgttgggaatgctggacgcatgcataaagtgggatatgagcgcagagaatgctagatgtaaggtttgtaggaagaagggtgaggatgacaagctgatcctgtgcgacgaatgcaacaaggctttccatctgttttgcctccgtcctgcgctatatgaagttcccgatggggagtggcaatgccctgcttgccaacccgctactgctagaaggaattctaggggcagaaattacactgaggaatcagcttcagaagacagcgaggacgacgagtctgatgaggaagaggaagaggaggaagaagaggaggaggaagaggactacgaggtggccggattgcgtctgcgtccgagaaagaccatccgtggaaaacacagcgtgatacccccagcggctcgctcggggagacgcccaggaaagaagcctcactccacccgtagatcccagcccaaagccccacccgtggacgatgccgaagtggacgaactcgtactgcagacgaagcggtcctcacgcaggcagtcactcgaactccagaaatgcgaggaaattttgcacaaaattgtcaagtacagattttcatggccatttagggaaccggtgacgcgcgacgaagcggaggactactacgacgttatcacccaccctatggatttccagactgtgcagaataagtgcagttgcggttcatacaggtccgtgcaggaattcttaaccgacatgaagcaagtcttcacaaacgcagaagtttataattgcagggggtctcatgttctctcttgtatggtaaaaacggagcagtgtctagtggccctattgcacaagcatcttcctgggcacccttacgtgagaaggaagcggaaaaaatttcctgatcggttggctgaagatgaaggcgattccgaacctgaggcagtaggacagagtcgaggaagacggcagaagaaatag

SEQ ID NO: 216172 - DNA, 4452 bp, Artificial Sequence
  Description of Artificial Sequence: Synthetic coding sequence
atggcaccgctgctcgggagaaaaccttttcctctagtgaaacccctcccgggtgaagagcccttgtttacaatcccgcatactcaggaggccttcagaacccgcgaggaatacgaggctcgcctggaaagatatagcgaacgcatctggacctgtaagtcgacaggctcgtcacaacttacacacaaggaagcctgggaagaagagcaagaggttgccgaacttcttaaggaggagtttccagcctggtacgagaaattggttttagagatggtgcaccacaacactgcctctctcgagaaactggtggatacagcctggcttgagatcatgaccaagtatgctgtaggggaggagtgtgacttcgaggtcggcaaggaaaaaatgctaaaggtcaagatagtgaaaatacaccccttagaaaaggtagatgaagaggcaactgagaaaaagtctgatggtgcctgtgatagtccaagttctgataaggagaactcttcgcaaattgcacaggaccaccaaaagaaggagacagtggttaaggaagacgaggggcgacgcgagtccatcaacgacagggccagacgctctcctagaaagctgcccacgtctctgaagaagggcgaacgaaagtgggcccctcccaaattcctgcctcacaaatatgacgttaaactgcagaatgaagataaaattatcagtaatgtgcccgctgattctctgattcgaacagagcgccctcctaacaaagagatagtccgatattttattcgacataatgccttgcgcgctggcactggagagaatgccccatgggtggtcgaggacgagctagttaagaagtacagtctaccttctaagttctcggactttttgcttgatccgtacaaatatatgaccttaaatccctctaccaaaaggaagaataccggttcacctgaccggaagccttccaaaaagtcaaagaccgacaacagctctctgagtagtcccttgaatcccaaactatggtgccacgttcatttgaaaaaatcgctctctggctctccattaaaggtgaaaaacagcaagaactccaagtcccctgaagagcatttggaggagatgatgaaaatgatgtctcccaacaaattgcacactaactttcacatccctaagaagggtcccccagccaagaaacccggtaagcatagtgataagccattaaaggccaagggacgcagcaaagggattttgaacggacagaagtccactggcaactcaaaatcacctaagaaagggctcaaaaccccgaaaactaaaatgaagcagatgaccctattggacatggctaaggggactcaaaaaatgacccgagctcctcgcaattcaggcggaactcctcgcacatcctctaaaccacataagcacctgcctccagccgctctgcatcttatcgcatattacaaagaaaacaaggaccgggaagacaagcgtagcgccctctcttgtgtgatctctaaaaccgccaggctactatcatcggaagaccgggctcgactacccgaggagctgcgcagcctagtgcagaagcggtatgagctgcttgagcacaaaaaaaggtgggcaagtatgtccgaggaacaacgcaaagagtacctcaaaaagaagcgggaggagctgaaaaaaaagctgaaggagaaagcaaaggagaggcgagagaaggaaatgcttgaacggctcgaaaaacagaagagatatgaagaccaagagctgactggcaaaaacctgcccgcattccgactcgtagatacacccgagggtcttcccaacacactgtttggggacgtcgcgatggtggtggagttcctgagctgctatagcggtctactgctaccagatgcccaataccctattacagccgtctcactcatggaggccctatctgccgacaagggcggatttctgtacctcaacagggtgcttgtgatcctgcttcagactctgcttcaggacgaaattgcagaagactatggggagctgggcatgaagctcagtgagatcccactcacccttcattccgtcagcgaactcgtacgactgtgtcttcgacgaagtgatgtgcaggaggagtccgagggaagtgataccgatgacaacaaggactctgccgctttcgaagataatgaggtccaggacgaatttcttgaaaaattggagaccagtgaatttttcgagctgaccagtgaggagaagctacaaatccttacagcactgtgtcacaggatcttgatgacatattccgtccaggaccacatggaaaccaggcagcaaatgagcgctgaactctggaaggaaagactagctgtcctcaaggaagaaaacgacaagaaacgagctgagaaacaaaaacggaaagaaatggaggccaagaacaaggagaacgggaaagtagaaaacgggctcggtaagacagataggaagaaggaaatcgtgaaatttgaaccgcaggtcgacacagaggcggaggacatgatcagcgctgtgaaatcacggaggctgctcgcaatccaggcaaaaaaggaaagagagattcaggagcgcgaaatgaaagtaaaactcgagcggcaagcagaagaggagcgaattcggaagcacaaagccgcagctgagaaagcgtttcaagagggcatcgccaaagcgaagctggttatgcgacgcaccccaatcgggaccgaccgcaatcacaataggtactggctcttcagtgatgaagttcctggcctgtttatcgagaagggctgggtccacgacagcattgattatagatttaatcaccattgcaaggatcacactgtgagtggggacgaggattactgtcccagatcgaagaaggccaatctaggaaagaatgcctccatgaacacacagcacggaacagctacagaagtggccgtggagacaactacacctaagcagggacagaacttgtggttcctctgcgatagccagaaggagctcgatgaactgctcaattgcctacacccccaaggtatacgtgaatctcagctgaaggagcgcctcgagaagcggtatcaagatataatccattcaatccatctagcaaggaagccgaacctggggcttaagtcatgcgatggtaaccaggaactgctgaattttctgaggagcgatctgatcgaagttgccaccagactgcagaagggaggtctcggctacgtagaggagacttctgagtttgaggctagagtgatatcccttgagaaactcaaagattttggggaatgcgtgatcgcgctccaggccagtgtgatcaagaaattcctgcaggggttcatggcccctaaacagaagagaagaaagcttcagtctgaagatagcgccaaaaccgaggaggtggacgaagaaaagaagatggtggaagaggctaaagtcgcgtccgctttagagaaatggaaaaccgcgataagagaggcccagactttcagcaggatgcacgtccttctgggaatgcttgatgcctgtattaagtgggatatgtcagccgagaatgccaggtgcaaagtctgccgtaagaaaggcgaggacgataaactgattttgtgtgatgaatgtaataaagcctttcatctcttctgcctgcgacccgcactgtacgaagttcctgacggcgaatggcaatgtccagcctgtcagcccgctactgctcggagaaactctcggggaagaaattacacagaggaaagcgcaagcgaggatagtgaggacgacgaatctgacgaagaggaagaggaggaggaggaagaggaggaggaagaggactacgaagtggcaggactcaggctgcgacccagaaaaactatacggggtaagcacagtgtgattccccctgccgctaggtccggcaggaggcccggaaaaaagccacattccacgagaagatctcagcctaaggccccaccggtggacgatgctgaagtcgatgagctcgttctgcagaccaagcgatcttcgagacgtcagagcctggaactgcagaagtgcgaagaaatcttgcacaagatcgtgaagtatcgtttttcgtggccctttcgggaaccagtaacgcgggatgaagcagaggactattatgatgtcataactcatcccatggactttcagactgttcagaacaagtgttcgtgcggatcgtaccggagtgtgcaggagttcctgactgacatgaagcaggtgttcactaacgccgaggtgtacaattgccggggttcccatgtactgagttgcatggtcaaaaccgaacagtgcctggtggctctgctccataagcatctgcctgggcatccttatgtgcgtcgcaaacgtaaaaagtttccagaccgcctcgcagaagatgagggcgactctgaacccgaggccgtagggcaatctaggggcagacggcagaagaagtag

SEQ ID NO: 216173 - DNA, 5622 bp, Artificial Sequence
  Description of Artificial Sequence: Synthetic coding sequence
atggaagccaacgaccactttaatttcaccgggcttcccccagcccctgcggcaagcggactgaagccgtcccctagtagcggagagggtttgtatacgaatggtagtcccatgaatttcccacagcagggcaagtccctgaacggggacgtcaatgtgaacggactctcgaccgtgtcacacactacaaccagcggtattctcaacagcgcgcctcactccagcagcacctcccatctgcatcacccctccgtggcctatgactgcctttggaattattcacagtacccctccgccaaccccggtagcaatctaaaagacccacctctgctgtctcaatttagtgggggacagtatcctctaaacggaatcctcggcggatcccgccagccgtcttcaccatctcacaacacaaacctgagggctggatctcaggagttttgggcaaatggcacacagtcgcccatggggctcaattttgactcacaggaactttatgattctttccccgatcagaacttcgaggaagtggggtccggaatccaccccgatgaggcggctgaaaaggaaatgactagcgtggtggctgaaaatggaaccgggttagtcggcagcttggagttggaggaggaacagcccgaacttaaaatgtgcgggtataatggatccgtgccaagtgtcgagtccttgcatcaggaagtgtcagtgctagttcctgatccaactgtctcttgtttggatgatccttcacacttgccggaccagcttgaggatacacctattctgagcgaggactcactcgagcctttcaacagtctggcccctgagcccgtgtcaggcggactatatgggattgacgacactgaattgatgggtgctgaggataagcttccattagaagactctccagtgatcagtgccctcgactgtccctcactgaataacgccactgccttctctctattagcagacgacagccaaacaagtacgtctatcttcgcaagtcccacgtcacccccagtcctgggtgagagcgtgcttcaggacaattccttcgacttgaataatgggagtgacgctgaacaggaagagatggagactcagtctagcgacttcccacccagcctgactcagccggctccggaccagtcctctaccatccagctacatccagcaacttcacccgctgtttccccaacaacatctcccgctgtgagtctggtggtcagcccggctgcttcgccggagatatcaccggaagtctgcccggctgctagtactgttgtttcgcctgcagtttttagcgttgtgtcacctgcatctagcgccgttcttcccgcagtgtctctcgaggtgcctctgactgcaagcgtaacctcccctaaagctagcccggtcacttcccccgctgccgcattcccaacagctagccctgcgaataaagatgtgtcatcctttctggagactacagccgacgtggaggagatcaccggcgaaggtctcacggcatccggttcaggtgatgtaatgcgtcgtagaatcgccacccctgaggaggtccggctgcctctccagcatgggtggcgcagagaggtgagaattaagaagggcagtcaccggtggcaaggcgagacctggtattacggcccatgtggaaaacgcatgaaacagtttcctgaggtgattaagtacttgtctagaaacgtggttcacagcgttaggagggaacacttcagcttttcccccagaatgcccgtgggtgacttcttcgaggagagagacacgccggaagggcttcaatgggttcagctcagtgcagaagaaatccccagccgcatacaggcaatcactggcaagaggggccgaccaaggaatactgaaaaagctaaaaccaaagaggtgcccaaagttaagagaggccgaggcaggccccctaaggtaaagattaccgagttgctgaacaaaactgacaaccgaccactgaagaagctggaggctcaggagaccctcaatgaggaggacaaagccaagatcgctaagtctaagaagaagatgcggcagaaggttcaaaggggcgagtgccagacaaccatccaggggcaagctcggaataagaggaagcaggagacaaagtcactgaaacagaaagaagcaaaaaaaaagagtaaagctgagaaagagaagggaaagaccaaacaggaaaaacttaaagagaaggtaaaacgcgagaagaaggagaaggtcaaaatgaaggaaaaagaggaggtgactaaggctaaacccgcttgcaaggctgacaagacactggccacccagcggaggcttgaagagaggcagaggcagcagatgattttggaggaaatgaaaaaaccaaccgaggacatgtgtcttaccgatcaccaaccgctgccggatttcagcagggtgcctgggctgactctgccttccggagcgttctcagattgccttaccatcgtcgagttcctccattcattcggcaaggtcctgggattcgatccagccaaagatgtgccctcccttggagtgctgcaggagggactactgtgccaaggggactcactgggagaggtccaggacctgctggtgcgcctgctgaaggcagccctgcatgatcccggttttcctagttattgtcagtcattgaagatcctgggggaaaaagtgagtgaaattcccctcaccagagataatgtatcagagatacttagatgcttccttatggcttacggtgttgaacctgctctgtgtgataggcttcggactcagcctttccaagcgcagccccctcaacaaaaagctgccgtcttggctttcttagttcatgaactgaacggatccactctgattatcaacgaaattgataaaaccctcgaatcaatgtcctcatacagaaaaaacaagtggattgtggaaggaaggttgcgcagattaaagactgtgttggcaaagcgcacgggccgttctgaagtggaaatggaaggacccgaagaatgtctgggtaggagacgctccagcagaataatggaagaaacctcgggaatggaagaggaagaagaggaagagtctatagcggctgtcccagggcgtaggggcaggagggatggagaggttgatgcaaccgctagcagtatccctgagctggagcggcaaattgaaaaattgagtaaacggcagctcttttttagaaaaaaattgctgcactcatctcaaatgctgcgagcagtgtctctggggcaggataggtatcgcagacgatattgggttctaccctacttggccggaatattcgtcgagggcactgaggggaatcttgtgccggaagaggtgattaagaaggaaaccgactccctgaaagtggccgcacatgcttcactcaaccctgccctattttctatgaagatggagctggccggatctaatactactgcgagtagccctgcacgggcacgcggaaggccacgtaagaccaaaccaggcagtatgcaaccgaggcatttgaaatctccggtgcgcggacaggatagcgagcaaccccaggctcagctgcagccagaggctcagctgcacgccccagcccagccccagccccaactgcagttacagttacagagccacaagggatttctggaacaggaggggtctcccctgtctctgggccagtcccagcatgatctgagtcaaagtgcattcctaagttggctgagtcagactcagtcgcattccagcctactgtcctccagcgtcctaacacctgatagtagccccggaaaattggaccctgctccttcccagccacctgaagagcctgaacctgatgaggccgagtccagccccgaccctcaagccctctggttcaacatttcagcccaaatgccctgcaatgccgcaccaacccctcctccagcggtatctgaagaccagccaacgcccagcccccagcagttggctagttcaaaacctatgaatcgtccgagtgcagcaaatccctgttctccagttcagttcagctccaccccattggctggtctggctccaaagaggcgggcaggcgacccgggtgagatgccccaaagccctactgggctgggccagcctaaaaggagggggaggccaccttcaaaattttttaaacaaatggaacaacgatatttaacccagctaacagcgcaacctgtaccgccagaaatgtgctcaggctggtggtggattagagatcccgaaatgctggatgcgatgctgaaagccctccaccccaggggcattagagagaaagcactgcacaaacatttgaataagcaccgtgatttccttcaagaagtctgtctgcggccatccgccgaccctatcttcgagccaagacagctgcctgcttttcaagaagggatcatgtcttggtcacccaaggagaagacctatgagacagacttagccgttttgcagtgggtggaggagctcgagcagagggtcatcatgagcgacttacagatcagaggttggacatgcccgtcgccagactccactcgagaagatttggcctactgcgagcacctgagtgatagccaggaggatattacttggcgcggtcgaggacgggagggattagctccacagcgaaagaccaccaacccactggatctggctgtgatgcggctggcagctctagaacaaaacgtagagaggcgctatcttagggagcccttatggcccacacatgaggtggtgctcgaaaaggctctgctgtcaacaccgaatggcgctccggagggtactaccacagaaatttcttatgagatcacacctcggattcgggtatggaggcagaccttggagagatgcagaagcgctgcccaagtgtgcctctgcctgggacagctcgagcgctctatcgcctgggaaaagtctgtcaataaggttacttgtctcgtctgcagaaaaggggacaatgacgagttcctactcctatgcgatggatgtgatcggggatgtcacatatattgtcatcgtccaaaaatggaggccgttcccgaaggtgattggttttgtaccgtatgtctggctcagcaagttgaaggagaatttacacagaagcccggatttcctaagagggggcagaagcggaaatctggatactctctgaacttttccgagggagacgggaggagacgacgagtgctgttacggggaagggaatccccagcggcagggccacgctactctgaagaaggcctctctccttctaaaagaaggagactttccatgcggaatcatcatagcgacctaaccttctgcgagataatacttatggagatggagagccatgacgctgcatggcctttcctggagcctgtaaatcctcgtctagttagcggatatcggagaattatcaagaaccccatggatttttccaccatgcgggagcggctgctgcgtggcggatacacatcatctgaagagttcgccgctgatgccttactggtgttcgacaattgccagacctttaacgaagacgactcagaagtgggaaaagctgggcatataatgaggcgattcttcgagtcgcgatgggaggagttttatcaaggtaaacaggcaaatctctaa

SEQ ID NO: 216174 - DNA, 2514 bp, Artificial Sequence
  Description of Artificial Sequence: Synthetic coding sequence
gtccctggccgacgaggccgaagggatggcgaagtggacgcgacagcaagtagcattccggagttggaaagacagatcgaaaagctgtccaaacggcagctgttctttcgaaagaagctgcttcactcaagtcaaatgctccgcgctgtctccctggggcaggataggtataggcgacgatactgggtgctgccatacctcgccggtatatttgtggagggaacggagggaaacttagtcccagaagaagtgatcaaaaaggagacagactcactgaaggtcgcggcacatgcgagcctgaaccctgcactgttttccatgaagatggagctggctggctctaacactacagcttcaagtccagcccgagccaggggacggcctaggaagaccaagcccggaagcatgcagcccaggcaccttaagtccccagtgcggggacaggactcggaacagcctcaggcccagttacagccggaagcccagttacatgcgcctgcgcaaccacagcctcagctgcagcttcagctgcaaagccataaagggtttcttgagcaggagggcagcccgctgagcctagggcagtcgcaacacgacttatctcagtccgcatttctcagttggctcagccagacccaatcccattcttcccttttgagcagttccgtgcttacacccgacagctcccctgggaaacttgatcctgctccgtcacagcccccagaagaaccagaaccagatgaggctgagtcaagcccggatccccaagcactgtggttcaatataagcgctcagatgccatgtaatgccgcacccactccacctccggctgtgagtgaggaccagccaaccccgtccccccagcagctggcgtcatctaaacctatgaacagacctagcgctgccaatccatgttcccctgtgcagttctcttctacacctctggctggcttagctccaaaacggagagccggtgaccccggtgaaatgcctcagagccccactgggcttggtcagcctaaaagacggggacgtcctccttccaagttcttcaagcagatggagcaacgatacttgacccagttgacagcacagcctgtgcctcccggatggtggtggatccgggatccagagatgctagacgcaatgctgaaagccctgcaccccagaggaattcgggagaaagccctgcacaaacacctgaacaagcacagagacttcctacaagaggtgtgcctgcgccctagtgccgatcccatctttgagcctaggcagctgcccgcttttcaggaagggatcatgtcttggagcccaaaggagaaaacgtacgaaacagatctggcagttttacaatgggtggaggagctggagcagagggtgattatgtctgatctccagatccgcggatggacctgcccctctcccgattcaactcgcgaagatctggcatactgcgaacacctttctgacagtcaggaagatatcacttggcgaggccgagggagagagggcctagcacctcaaagaaagacaaccaatcctttggacttggcggttatgcgcctcgccgctttagagcaaaacgtggagcgccgatatctgagagagcccctctggcccactcatgaggtggtgttagaaaaggctttgctgagtacacctaatggggcacccgaagggacaacgacagaaatctcgtacgaaatcaccccgaggattcgagtgtggcggcaaacactggagcggtgccggtccgctgcgcaggtgtgcttgtgcctcggccagctggagaggtcgatcgcctgggaaaaatccgttaacaaggtcacgtgcctcgtgtgtaggaagggcgataacgacgagttcttgctgctttgtgacggatgcgatcgaggctgtcatatatattgccaccgcccaaagatggaggctgtgcccgagggcgactggttttgcacagtgtgtctggcacaacaggttgagggcgaatttactcagaagccgggattcccgaaacgaggtcagaaacgcaaaagcggctattcgctgaatttctccgaaggcgatggccgacgtcgaagggtactactgagaggcagggaatcccctgccgctggaccaagatacagtgaggaaggcctctcacctagcaagagacggaggctgagcatgaggaaccatcacagcgatctcacattttgtgagatcattctgatggaaatggagtcacatgacgccgcttggccctttttagagcctgtcaatcctagactggtgtcgggatacaggagaatcatcaagaatcctatggattttagtactatgcgagagcggctgctccgagggggttacacgtcttctgaggagttcgccgcagacgcactgctagtgtttgataactgccagactttcaatgaggatgacagtgaggttggcaaagccggacatattatgcgtcgattcttcgaatcgaggtgggaggagttttaccagggaaaacaggccaacttatag

SEQ ID NO: 216175 - DNA, 5717 bp, Artificial Sequence
  Description of Artificial Sequence: Synthetic coding sequence
atggaaatggaggcaaatgaccactttaatttcaccggcctgccacccgctcccgctgcgtctggcctgaagccgtcaccatcctctggggaaggattgtacactaacggaagtcctatgaatttccctcagcaggggaagtcattaaacggcgacgttaatgtgaacggtttaagtacagtctcgcatactacaacaagtggcattctgaacagcgcgccacatagctcttctacctcccacctgcatcatccaagcgttgcctatgactgcctgtggaactacagtcagtacccctccgccaaccccggaagcaatttaaaggatcctccattgctgagtcaattcagcgggggacagtatcctctgaacggcattttaggcggaagccgccagccctcgagcccaagccacaacacaaaccttagagcgggatctcaggagttctgggctaacggaacacagagcccaatgggcctcaactttgacagccaggaactgtacgatagctttcctgaccagaacttcgaagttatgcctaacggccctccaagttttttcacttcgcctcagacctcccctatgctgggatcctcgatccaaacgtttgcacctagtcaggaagtgggatctgggatacatccggatgaagccgcagaaaaagaaatgacctctgtggtggccgaaaacgggaccggactggtcggctcactcgaattggaagaggagcagcccgagttgaaaatgtgcggttacaatggctcggtgccgtctgtagaatcactgcatcaggaggtatctgtgcttgtcccagacccgactgtctcttgcttggatgatcccagccaccttcccgatcagctcgaagacacccccatcctgtcagaagattcacttgaaccatttaattcgttagcacctgaaccagtgtctggcggactgtatggaattgatgacacagagctgatgggggcagaagataaattaccccttgaagactcgcccgtaattagtgccttggattgtccgagtctcaacaacgctactgccttctcccttctggctgacgacagccagacctccactagtatttttgcgagtcccactagccccccagtccttggagaatccgtgcttcaagataactcatttgacctcaacaatgggagcgacgcggaacaggaggagatggaaacacagagctctgatttcccaccttccctcacacaacccgcacctgatcagagctcaacaatccagctgcacccggcaacaagtcctgccgtgagtcccaccaccagtcccgctgtctctctggttgtatcccccgcagcgagtcccgagatttcgccagaggtgtgccctgccgctagtaccgtcgtaagcccagcagtgttctccgtggtgagcccagcctcttcagctgtgttacctgccgtcagcctcgaagttccattaacagcctcagtgactagtcctaaggcctctcccgtaacgagccctgccgctgcatttcctactgcctcaccggcaaacaaggatgtcagctcatttcttgagacgaccgccgacgtagaggaaatcaccggcgaggggctgactgccagtggctcaggagacgtgatgcgcagacgcattgcaacccctgaagaagtccggctgcccctgcagcacggctggcgtcgagaggtgaggataaaaaaaggtagccatagatggcagggagaaacctggtattatggcccatgtggcaaacgcatgaagcagttccccgaggtgattaagtatctgtcacgcaatgtagtacattccgtgcgcagggagcatttctccttctctccccgaatgccagtgggtgacttcttcgaggagagagatacacctgagggattgcagtgggtccagttatccgcggaagagatcccttcaaggatacaggcgatcactgggaagcgtggccgacctagaaataccgagaaagccaaaactaaggaagtaccaaaggtaaagagggggagggggcgtcccccaaaggtgaaaattaccgagctgctgaataaaacggacaaccggccactcaagaagctggaagctcaggagaccctcaacgaggaagacaaagccaagatcgctaagtctaagaaaaaaatgcgacagaaggtgcaacgcggagaatgccagactaccattcagggccaggcgaggaataaaaggaaacaagaaacaaagtccctaaaacagaaggaggctaagaaaaagtccaaagccgagaaggaaaaggggaagaccaagcaggaaaagctgaaagaaaaagttaaacgagagaagaaggagaaggtcaagatgaaggagaaagaggaggtgacgaaggcaaaaccagcttgcaaagccgacaaaacactggcaacacagagaaggctggaagagcgacagaggcagcagatgatcctggaggagatgaagaagccaaccgaggacatgtgcctgacagaccaccagccactcccagatttttctagggttccaggtctcactctgcctagtggggcattttcagattgcctcacaatcgtagagtttttacacagctttgggaaggtgcttggcttcgaccccgcaaaagatgtgcccagcctgggcgttctgcaggaaggactcctctgccagggcgactctctaggtgaagtgcaagacctactcgtgcgattgcttaaagcagctctccatgatcctgggtttcccagttactgtcagtcactcaaaatccttggggagaaggtatcggaaattccgttaacccgtgacaacgtatccgaaattctgaggtgttttctcatggcctacggggtagagccagctctatgtgatcgcttgcgcacacagccatttcaagcacagccgcctcagcagaaagcagccgtgctggcgttccttgtccatgagttgaatggtagcactctgatcatcaacgaaatagataagaccctcgaatctatgtcctcttacagaaaaaacaaatggatcgtggaaggtcgtctgagaaggctgaaaacagtgctggcaaagaggaccggccgtagcgaagtagaaatggaagggccagaagagtgcctgggcagacgacgcagcagtcggatcatggaggagacttcgggcatggaggaggaagaagaagaggagtcaattgctgcagtgcctggacgtcgcggtagacgcgacggggaggtggatgccacggcctcctccatcccagaactcgaaaggcaaatcgaaaagctctcaaagaggcaactgttctttaggaagaaactgctgcactccagtcagatgctgcgcgctgtttcgctaggtcaggatcgctacaggcgtaggtattgggtgctgccttacctggccggtatctttgtcgaaggtaccgaaggtaacctggtacctgaggaggtgattaaaaaagagacggattccctcaaggtcgcagctcatgcgtctctcaacccagctctgttctctatgaaaatggaacttgccggaagcaacactaccgcatcaagcccggcacgagcgagaggccgtccaagaaagactaagcctggctctatgcagcccagacatctaaagagccccgtgcggggacaggattccgagcagccgcaggctcagttgcagcccgaggcccagttacacgctccggcacaaccgcagccccagcttcagctgcaactgcaaagccacaagggctttctcgagcaagaaggatcaccactgagcctgggccagtcccaacatgacctgtcacagtccgccttcctcagctggctgagtcagacccagagtcactctagtctcttgtctagctctgtgctgacccccgattccagcccgggtaagctggaccctgctccttcccagcccccagaagaacctgaacctgacgaggctgaaagtagcccggacccccaggccctgtggtttaacatttctgcacagatgccctgtaacgccgctcccactccccctcctgctgtgtcagaggaccagcctaccccgtcaccacagcaacttgcttctagtaagccaatgaacaggccaagtgccgcaaatccatgcagtccagtccagttcagctcaactccactggctggtctggcccctaagaggagggccggagatccaggcgagatgcctcagagcccaacaggtttgggacagccaaagaggcggggtaggcccccttccaagtttttcaagcagatggaacagcgctatctaacccagttaacagcacagcctgtgccccctgaaatgtgttcaggctggtggtggatcagagacccagaaatgctggacgccatgctgaaggccttgcacccccgagggatcagggaaaaggcacttcataaacacctcaacaagcatcgcgatttcctccaagaggtttgcctgaggcccagtgcagaccccatctttgaacccagacagcttcccgctttccaggaggggatcatgtcttggtcccctaaggaaaagacatacgaaaccgacctggccgtgctacagtgggtcgaggagctcgagcagcgcgttattatgtccgacttgcagattcgcggatggacatgtccttcccctgatagcacaagggaggacttggcatattgcgagcacctgtctgatagtcaggaagacatcacatggcgtgggcgtggtagagaggggctggcaccccagaggaagactaccaaccccctggatctggcagtcatgcggctggccgctttggagcagaatgtggagcgacggtatctcagagaacctctctggcctacccacgaggtggtgctggagaaggcgttgctgtccacgccgaacggcgctccggaagggacgaccaccgaaatttcctatgaaatcacacctcgcatcagagtgtggcgacagacactggagcggtgccgcagcgccgcacaagtgtgcttatgcctggggcagctcgagagatccatagcctgggagaagtctgtgaacaaagtgacttgtctcgtgtgtcgaaagggagacaatgatgagttcctcctcctgtgtgatggctgtgaccggggatgccacatttactgccaccgacccaaaatggaagcagtacctgagggggactggttctgtaccgtgtgtctggcacaacaggtggaaggcgagtttacccaaaaaccaggtttcccaaagcgcggacaaaagcgaaaatccggttactccttgaacttctctgagggggatgggagacgcagacgggtcctcctgcgcggaagggaaagccctgcagctggtccccgatattcagaagagggtctgagcccctcaaagagaagaaggctcagtatgaggaatcaccacagcgacttgacgttttgtgagattatcttgatggagatggagtcccacgacgcggcttggcctttcctcgaacccgttaacccccgtctggtatcgggctatcgccgaatcatcaagaaccccatggactttagtaccatgcgagaacggctcctgcggggtggatatactagttctgaggagtttgctgccgacgcactgcttgtgtttgacaactgccagaccttcaatgaggatgattctgaggtgggcaaggcaggtcacattatgagacgattcttcgaatcacgctgggaagaattttatcaaggaaaacaggcaaatctgta

SEQ ID NO: 216176 - DNA, 6206 bp, Artificial Sequence
  Description of Artificial Sequence: Synthetic coding sequence
atggaatcaggtgaaagactgccgtcaagcgccgcatcctccaccactccaacgtctagctcaactccctccgtggctagcgtggtctcaaaaggcggtctgtctaccggagtggcttctctgagctctaccataaatccatgtgggcacttatttaggactgcaggagaccagccctttaacctcagtaccgtcagctccgcctttccaatggttagccatcctgtgttcggtctgcactccgctagctcaggccatagtgaatttggcggactgggtactctgggcacaccaacagccctggctgcacacccccagctagcttcattccctgaatggtggaggaccacagacgcacacacacgaactggagccacgttcttcccacccctgctgggcattcccccattattcgcacccccagcccaaaaccacgacagtagctcattccactctaggacctcaggtaagtctaatagaaacggtcccgagaagggtgtcaacgggtcaattaatggttcaaacacgagctctgttatcggtatcaatacctccgtactgtccaccactgcttcctcttctatgggccaaaccaagtcaacatcttcggggggaggaaatcgcaagtgtaaccaggagcaatccaaaaaccagccactggacgcacgggtagacaaaatcaaggataagaagcctcgcaagaaggcaatggagagctcatcaaattctgattctgacagcggcacttccagcgacacctcaagcgagggaattagctcctccgattctgatgacctggaggaagacgaagaggaagaggatcagtccatcgaggaatccgaggatgacgattcagacagtgaaagtgaggcccagcataaaagcaacaaccaggtcctacttcatggaatctcagatcccaaggctgatggacagaaggccaccgaaaaagcacaagaaaaacgaatccaccagcctctgccactagccagtgagtcacagacccattctttccagtctcagcagaagcagccccaggtgctctcacaacagctgccattcatcttccagtcaagccaggccaaggaggagtccgtcaataagcatacgtcggtgattcagtccacggggctggtgagtaatgtgaagcccctttcgttggtgaaccaggctaaaaaggaaacctatatgaaactcattgtgccctcccctgacgttctgaaagctggcaacaagaacactagcgaagagagttctttgctgacctcagagctgagatccaaacgggagcagtataaacaggccttcccatcgcagctcaaaaagcaggagtccagcaagtccctgaaaaaagtgatcgcagccctgagcaaccctaaggcaacttccagctcacctgcccaccccaagcagacactcgagaataatcatccaaatccgtttcttacaaacgccctattaggaaaccaccagcccaatggagtgatacagagcgttatccaggaggctccgttggccctgaccacgaaaaccaagatgcaaagtaagataaacgagaacattgctgctgcgtcctccaccccattttctagtcccgtcaacctcagcaccagcgggaggaggacccctgggaaccagacacccgtgatgcctagcgcttcccccatcctgcactctcagggcaaagagaaggccgtgtcaaataatgtaaaccccgtgaagacccagcatcattcccatcctgccaaatccctagtcgagcagttcaggggaaccgattccgacatcccttcctctaaggattcggaggactccaacgaagatgaagaggaggatgatgaggaggaagatgaggaggatgacgaggatgatgagtccgatgactcccagtccgggacgtcaaagaggcgacgggtcactgatgaaagagagttgcggatccccctcgagtatggctggcagagagagactcgaatcaggaactttggtgggagactgcaaggagaggttgcctactatgctccttgcgggaagaagctgcggcagtatcccgaggttatcaagtacttgagcagaaatggaattatggacatttcacgggataacttcagcttttcagccaagatacgcgttggggacttttatgaagctagagatggaccccagggcatgcagtggtgcctgcttaaggaagaagatgtgataccacgcatcagggccatggagggcaggagagggcgtccaccgaaccctgatcgccagcgagctcgtgaggagtcaaggatgcggcgtagaaagggcaggcctccgaacgtgggcaacgccgaattcctcgataacgctgacgctaagctgctgcggaagcttcaggcacaagagatcgcccgacaagccgctcaaattaagcttctgcgtaagctgcagaagcaggagcaggcccgagtagcaaaagaggcaaaaaagcagcaagctataatggccgctgaggaaaaaaggaaacagaaggaacagatcaagataatgaaacagcaggaaaagatcaagagaatccaacagatcaggatggagaaagaattgcgggcacagcagatactggaggccaagaagaagaaaaaggaagaggccgcaaacgccaagctactggaggcagagaaaagaatcaaagaaaaggagatgagacgacagcaagctgtcctgctgaaacaccaagaacgagagcgcagacgccagcatatgatgttgatgaaagcaatggaagctaggaagaaggcagaggagaaggagcgcctcaagcaggagaaacgagatgaaaaaaggctaaataaagaacgcaagctggaacagaggagactggagttggagatggccaaggaactgaaaaagccaaatgaggacatgtgtctagcagatcagaagcccctccccgagctgcctaggattccgggattagtcctgtccggcagcaccttctccgactgcctgatggtggtccagtttctgaggaacttcggtaaagtgctcggattcgatgtgaatattgatgtcccaaatctgtccgtactgcaggaaggacttctgaacattggggacagtatgggggaggttcaagacctattggtgcgactcttgagtgcagcggtctgtgaccctggattgattactgggtataaggctaaaacggctctgggcgaacatttgctaaacgttggagtgaatcgggacaatgtctcggagattctgcagatatttatggaggcacactgcggccagactgagttgacagaaagtctcaaaactaaagcctttcaggcacacacgccagcccaaaaggcctccgtgctggctttcttgattaatgagctcgcctgcagcaaaagcgtcgtcagcgagatcgataagaatattgattatatgtcaaacctccgtagggacaagtgggtcgttgagggcaaactgagaaaacttcgtattatacatgcaaaaaagactggtaagagggatacctctggcggtatcgacttgggtgaagaacagcaccccctgggaaccccaactcccggacgcaagagaaggcgcaagggcggagacagcgattacgatgatgacgacgacgatgacagtgatgatcagggggacgaggatgatgaggatgaagaggataaggaggataagaaaggcaagaaaaccgatatctgcgaggatgaggacgaaggcgatcaggccgcaagcgtcgaggagctggagaaacagattgagaagttgagcaagcagcaatctcagtataggagaaaactcttcgatgctagtcactcgctgaggagcgttatgtttgggcaggatagatatcgccgtagatattggattcttccacagtgtggcggtatcttcgtggaaggtatggagtccggggagggtctcgaggagatcgctaaggagcgcgagaagttgaaaaaagccgagtctgtgcagataaaggaagagatgttcgagaccagtggtgatagcctgaactgctcaaacacagaccactgcgagcagaaggaagatcttaaagagaaagataacaccaacctgtttcttcagaagcctggatcgttcagcaagctctctaaacttttggaggtagctaagatgcccccagagagtgaggtgatgactcctaaaccaaatgcgggtgctaatggctgcacattgagttatcagaactcaggaaagcattcactggggtcagttcaaagcactgctacccaatcgaacgtggagaaggctgattccaataacttgttcaatacggggtccagcggccctggtaagttctactcacctcttcctaacgaccagctgctcaagacattaactgaaaagaataggcagtggttttcacttctgcctcgcacaccatgtgacgacacatctctcacacacgctgatatgtccaccgcctcactggttacaccacaaagtcaacctccatcaaaatccccctctcccacccctgcaccccttggatcatccgcccagaacccagtgggcctgaacccattcgcgttatcccctcttcaggtgaaaggaggtgtatccatgatgggcctacagttctgtgggtggcccacaggcgtggttacttccaatattccgttcaccagctcagtgcctagcctgggctctggtctcggcctcagtgagggaaacggaaactctttccttacttccaacgtggccagctccaaaagcgaatctcctgtgccacagaacgagaaagccacttcagctcagccggcagctgttgaggtggcgaaacccgtggattttccttcccccaaacccattccagaggagatgcagttcggttggtggaggataattgatcctgaagatctgaaagccctgttaaaagtgctgcatttgagaggtatccgggagaaggccctgcagaagcagattcagaagcacttagactatatcacacaagcctgcctcaaaaataaggacgtcgctattattgagctgaacgagaacgaggaaaaccaggtgacaagagacattgttgagaattggtccgttgaagagcaggctatggagatggacctttctgtgcttcagcaggtggaagatctggagcgacgggtcgcatctgctagcctgcaggtaaaagggtggatgtgcccagaaccagctagcgaaagagaggatctcgtatatttcgagcacaagagcttcactaagctttgcaaggagcacgacggagagttcactggtgaagatgaatcatctgcccatgctctcgagcgcaaaagcgataatcctctggacatcgctgttacaagactcgccgacctggagcggaacattgagaggagaattgaggaggacatagcccctgggctcagggtttggaggagagctctcagcgaggcgagaagcgccgctcaggtggctctgtgtattcaacaactgcaaaagtctattgcatgggagaagagcatcatgaaagtgtattgtcaaatatgcagaaaaggggataacgaggaactcctcttgctatgcgacggatgtgataagggctgtcacacctattgccatagaccgaagatcactaccatcccagatggagattggttttgccctgcatgtatcgcgaaggcttccggccagaccctcaaaatcaaaaagctacatgttaaaggcaaaaaaacaaacgagtccaagaagggtaagaaagtcaccctgaccggtgatactgaagatgaagattctgcctccacttctagctccctgaaaaggggaaacaaggatctcaagaagaggaagatggaggagaatacgtctatcaacttgtccaaacaggaatcttttacctccgtgaaaaaaccaaaaagggacgattccaaagacctcgctctctgctctatgatactgaccgaaatggaaactcacgaggatgcctggccgtttctactgcctgtgaacctgaaattggtgccgggttacaaaaaagtaatcaaaaaaccgatggatttctctacaatccgcgaaaagctgtcatcagggcagtacccaaatctggaaacattcgcgctggatgtcaggctggttttcgataactgcgaaacattcaacgaagacgacagtgacatcggaagagccggacacaatatgcgcaagtactttgaaaaaaagtggacagacacttttaaagtatctta

SEQ ID NO: 216177 - DNA, 6404 bp, Artificial Sequence
  Description of Artificial Sequence: Synthetic coding sequence
atggagtcgggagagcgcctgccttccagtgcagccagttcgaccactccgacatcttcctcaaccccctccgttgcgagcgttgtgtcaaagggaggtttatccaccggtgtcgcctccctgagtagcacaatcaacccttgtggccacctcttccggactgcaggggaccagccttttaacttgtctacggtatcatctgcattcccaatggtctctcaccctgtttttggtcttcattcggcaagtagcgggcactctgagttcggcggtctaggcactctagggactccaactgcactggccgcacacccccagctggccagcttccctggagctgaatggtggaggacgacagacgcacatacccgcaccggcgcaactttcttccctcccctgcttggcatccccccactgtttgcaccacctgcccagaatcacgacagctcttccttccactcccgcacatcaggaaaatccaatagaaatggcccagaaaagggcgtaaacggatccatcaacggatctaatactagttcagtgatcggaatcaatacatctgttctcagcacaactgcaagttcttcaatggggcaaacgaagtccacaagttctggtggcggaaatcgaaaatgtaatcaagagcagtctaagaaccagccactggacgcacgagtagacaaaatcaaggataagaagcctcgaaagaaggctatggagagctcgtccaatagcgatagtgactcaggtacaagtagcgatacgtccagcgagggaattagctctagtgattctgatgacctggaagaagatgaggaggaagaggatcagagcattgaagagagcgaggacgacgattccgacagtgaatcagaggcccagcacaagtctaataatcaggttttacttcatggcataagcgacccgaaggcagacggccagaaagcaacagagaaagctcaggagaaacgaattcaccagccgctgccgctggcgtctgagagccagactcattctttccagagccaacaaaagcagccacaggtcctgagccagcaactcccatttatttttcagagttctcaggctaaggaagaaagtgtgaacaaacatactagcgtgattcaatcaaccgggttggtttcgaacgtaaagcccttgtccctagtgaaccaagcaaaaaaagaaacatacatgaagctgatagttccatcccccgacgtgctaaaggccggtaacaagaatactagtgaagaaagctcattgctgacctcagagctgcgtagtaagagggaacagtacaagcaagcttttcctagccagctaaagaaacaggagagctccaagtccctcaaaaaagtaattgccgctctgtcaaatcctaaggcaactagctccagtcctgcgcaccctaagcagacactggaaaacaaccacccaaatccattcctgacaaacgctttgttggggaaccaccaacccaatggcgtgatacagtctgtgatccaagaggcccctctggcccttaccaccaagactaaaatgcagtcaaaaataaatgaaaacatcgcagcagcgtcaagcacgcctttttccagcccggttaacttgagcacctccggacggcgtacccccggaaatcaaaccccagtgatgccatctgcttccccaatcctccacagtcagggtaaggagaaggccgtctcaaataacgtaaatccagtcaaaacccaacatcactcacaccctgctaaatctcttgtcgaacagtttagaggcaccgattcagacattccctcatcaaaggactccgaagactcgaatgaagacgaggaagaagacgacgaagaagaagatgaggaagacgacgaggacgacgaatccgacgattctcaaagtgagtccgactcaaattcagaatccgacaccgagggctctgaagaggaggacgatgacgacaaagatcaggacgagagtgactccgacacagagggggagaagacttctatgaaactgaataagactacgagttctgtcaagagcccttctatgagtctgaccgggcatagcacccctaggaatctccatatcgccaaagccccaggctcagccccagcagccctgtgttcggaaagccagtctccggctttcctcgggacctcctcaagcacattaacgtcatcccctcatagcgggacaagcaagaggcggagagtgacagacgagagggagcttaggattccattggagtacggatggcagcgagaaacacgcatccggaacttcggaggcaggctgcaaggggaggttgcttattacgccccttgtggaaagaagctcaggcagtaccccgaggtgattaagggaatgcagtggtgtctgctgaaggaggaggacgtgatcccgagaattcgcgctatggagggtcggaggggcaggccaccaaatcctgataggcagagggcccgagaagaatcgcgcatgaggcgacgtaaaggcaggcctccaaatgtcggcaacgccgaatttctagataacgccgacgccaaactgctgcgaaagttacaggcccaggagattgcccgacaggccgcacagatcaagcttttgaggaaactccaaaaacaggaacaggcaagggttgccaaagaggccaagaaacagcaggccataatggctgccgaggaaaagagaaagcagaaggaacagatcaagatcatgaagcagcaggaaaaaattaaacggattcagcagatccggatggagaaagagctgcgggctcaacagatcttggaagcaaagaagaaaaagaaagaggaggccgctaacgccaagctgcttgaagccgaaaaaaggatcaaggaaaaggaaatgaggcggcaacaggcagtcctactgaagcatcaggagcgagaacgtaggcgccaacacatgatgttaatgaaggcaatggaagccagaaagaaggctgaagagaaagaacgcttgaaacaggagaaaagggacgagaagcggctcaacaaggaaagaaaactggagcaaagaaggctggaactggagatggctaaggaactcaagaagccgaacgaggacatgtgtcttgccgatcagaagcccctgcccgaactccccaggattcccggattagtgttgtccggctctacgtttagcgactgcttaatggttgtacagtttctgcgtaacttcggcaaggttttgggtttcgatgtaaacatagatgtgccaaatctctctgtgctgcaggaggggctgctgaacataggtgactctatgggagaggttcaagatttgttggtgaggctactgagcgcagctgtatgtgatccaggccttattacaggctataaggccaaaactgcattgggtgagcacttgctgaatgtgggcgtcaatcgggataacgtaagtgaaatcctgcagatcttcatggaggcacactgcggtcagacagagcttactgaaagtctgaagacaaaagccttccaggcacacacaccagcccagaaggcaagcgtgttagcatttctcattaatgagctggcctgcagcaagagtgtggtgtctgagatagataaaaacatcgactatatgagtaatctgcggagggataagtgggtggtcgagggaaagctccgaaaactcaggataattcacgccaagaagacgggcaagcgcgatacctcaggaggcatcgacctgggggaggagcagcatccattgggtacccccactcccggaagaaaaagacgtcgcaagggcggagattcggactatgatgatgacgatgatgatgactcggacgatcagggggatgaagacgacgaagacgaggaagataaggaggacaaaaaaggtaagaaaacagatatctgtgaggacgaggacgaaggcgaccaagccgcttcagtcgaagagctggagaagcaaatagagaaattgtcaaagcaacagagccagtataggagaaaactttttgacgcatctcactctctgagatcagtgatgtttggccaagaccgatacaggagacggtactggattctgccacaatgcggcggtatcttcgtcgaaggcatggaaagtggggagggccttgaagagatcgccaaagagagggagaagctgaagaaggcagagtccgtgcaaataaaggaagagatgttcgaaacctctggagattccctgaactgttctaacaccgatcactgtgagcagaaagaggatcttaaggagaaagataacactaacctgttcctgcagaagcccggaagcttttcaaagttgtcgaagctgctggaggttgccaaaatgcccccagaatccgaagtgatgacacccaaaccaaatgctggcgctaatgggtgcaccctgtcctaccaaaattctggaaaacatagtctgggctccgtgcagtctactgccactcaaagcaatgtggaaaaggccgattcaaacaatctttttaacactggaagcagtggtcccggtaagttctacagcccactgcctaatgatcagctgttgaagaccctcaccgaaaagaacaggcagtggttttccttgctgcctcgcaccccatgtgacgatacctccctgacacacgcggatatgagtactgcttccctggttactcctcagagccaacccccttctaagtctccaagccctaccccagctcctttaggatccagcgcccagaacccggtgggtctgaacccattcgctttgagccccttgcaggtcaaaggaggagtatctatgatggggctgcagttctgtggctggcccaccggggtggttacaagtaacattccatttacctcaagcgtgccctccttgggcagtggcctgggattgagcgaaggcaacggaaacagctttctgacttcaaacgtagcctcgtccaaatccgaatcgcccgtcccccaaaacgaaaaagcaacgagcgcccagccggctgccgtagaggtagctaaaccagtagacttcccctcccccaaacccatcccggaggagatgcagtttggctggtggcgaatcatcgacccggaggatctgaaagcccttcttaaggttctgcacctaagaggcataagggaaaaggccctgcagaaacagattcaaaaacacctggattacatcactcaggcatgcctgaaaaacaaggatgtcgccattattgaacttaacgagaatgaagagaaccaggtgacacgtgacatagtcgagaattggagcgtcgaagaacaggctatggaaatggacctcagtgttctgcagcaggtagaagaccttgaacgtcgtgtcgcttctgcctcactgcaagtgaaagggtggatgtgtccagagcccgcatccgagcgggaggatcttgtctattttgagcataagtccttcactaagttgtgcaaagagcacgatggagagttcacaggcgaagacgaatccagcgctcacgcactggagaggaaatcagataatcctcttgacatcgctgtgacgaggctggctgacctggagcgcaatatcgaaaggagaattgaagaagatattgccccaggcctgagggtgtggagacgggcactgtctgaggccagaagtgcagcacaagtggcactgtgcatccaacagctgcagaagagcatcgcctgggagaagtctattatgaaggtgtattgtcaaatctgtagaaagggcgataacgaggagctcctcctgttgtgtgacggctgcgacaaaggttgtcacacgtattgccaccgccctaaaattaccaccattcctgacggcgactggttctgccctgcttgcattgccaaagcatccgggcagaccctgaaaatcaagaaactgcacgtgaagggcaagaagaccaatgagtcaaagaaggggaagaaagtcacacttaccggagatactgaagatgaggacagtgcctccacaagttcctcccttaagcgtggaaataaagacctaaagaagcgaaaaatggaggagaatacctccattaatctctctaagcaggaaagtttcacttccgttaaaaagcccaagagagacgatagtaaggaccttgcattatgttcaatgattctcacggaaatggagactcatgaggacgcgtggccatttttgttgccggtaaacctcaaactggttccaggctataaaaaagtaattaagaagcccatggactttagtacaatacgcgagaagttaagttcaggtcaatatcctaacctggaaacttttgccctcgatgtgagactggtgtttgacaactgtgagacctttaacgaagacgactcggacatcggacgtgcaggccataacatgcggaaatactttgaaaaaaagtggaccgacacctttaaagtctccta

SEQ ID NO: 216178 - DNA, 6398 bp, Artificial Sequence
  Description of Artificial Sequence: Synthetic coding sequence
atggaaagtggtgaaagacttccctcctctgcagcctccagtaccacccccacaagtagcagcacaccatcagttgcgtctgtggtgtccaaagggggattgtccactggggttgcatccctgagtagtacaattaacccttgcgggcatctttttcgcaccgccggagatcagccattcaacctgtcaaccgtatcttcagctttcccaatggtctctcacccagtttttgggctgcacagcgcctcctcgggtcacagtgaatttgggggactgggtacgctgggcacccccactgccctcgctgcccatccccagctggcttcctttcccgagtggtggcggactacagatgctcacaccaggaccggcgcaacttttttcccgccactgctcggcattcccccactgttcgcccctcctgcccagaatcatgattcttcctcctttcactctcgaaccagtggaaaatctaatcgcaatgggcctgaaaagggagtcaatggtagtatcaacggcagtaatacatctagtgttatcggaataaacacgtcagtgttgtctaccaccgcctcctctagcatggggcagaccaagtctacctcatcaggagggggaaatcggaaatgtaatcaggaacagtcaaaaaaccagcctcttgacgctagggtggataagattaaggacaaaaagcctaggaagaaggctatggagagctctagcaactcagactcagattccggcaccagttccgataccagcagcgaaggaatctcatcaagcgactccgacgatctagaggaggatgaggaagaggaggatcaaagcattgaggagtctgaagatgatgactccgactccgagagtgaggcgcaacataaaagtaataaccaagtgcttttgcacggcatctccgacccaaaggcggacgggcaaaaggccaccgagaaagcccaggagaaaaggatacatcagccccttcccctcgcctccgagtcccagacgcattcgtttcagagtcagcagaagcagcctcaggtgttgtcccaacagcttcctttcatctttcaaagtagtcaagccaaggaggaatcagtgaataaacataccagcgtgatacaaagcacaggcctcgtcagcaatgtaaaacccttgtcactggttaatcaggccaagaaggaaacctacatgaagcttattgtgccttcccccgatgttctgaaggcaggcaataagaatacctccgaggaatcctctttgctgacttcagagctgcgcagcaaaagggaacaatataagcaggccttcccctcacagctgaagaagcaggaaagctcaaagagtcttaagaaagtgattgctgcgctgtctaaccccaaggccacttcatcttcacctgcccacccaaagcaaaccctggagaataatcatcccaatccgtttttaaccaacgcccttctcggcaaccaccagccaaatggtgtaattcagtccgtgattcaggaggcccctctggccctgacgacgaagacaaagatgcagagcaaaatcaacgagaacattgctgcagcctcttcaacacccttcagctctcctgttaatctgtcgacatccggacggagaactccgggaaatcagacacctgttatgccatcggcttcccccatcttacatagtcagggaaaggaaaaggccgtttccaataacgttaacccagttaagacacagcaccattcgcaccccgcaaagtctctggttgagcagtttcggggtacagattcagacattccctcttcgaaagacagtgaggacagcaatgaggatgaggaagaagacgacgaagaagaagacgaagaagatgacgaggacgacgagagcgatgattcccagagcgagtccgactctaactcagagtccgacacagaggggagtgaagaagaagacgacgatgacaaagatcaggatgagtcagacagcgatactgagggcgaaaaaacctcaatgaaactaaataagactacctcttcagtgaagtccccttcaatgtcactgaccggccacagcacacccagaaatttgcacatcgccaaggcaccaggctccgctccagcggctctctgcagcgagagtcaaagtccagcatttctagggacatcttcttcaactcttacatcttcaccacactccggcacctctaagcgccgtcgcgtgactgatgaacgcgagttacggattcccttggagtatggttggcaaagggaaacaaggatacgtaatttcggcggacgactgcagggagaggtggcctactacgccccatgcggtaagaaactgagacagtatccagaagttataaagggtatgcagtggtgcctcctgaaggaggaggacgtcatacccaggattagagctatggagggtagacggggaaggcccccaaaccccgataggcagagagcaagggaagagtcccggatgcgcaggagaaagggcaggccccctaatgtggggaacgccgaattcctggataacgctgacgcaaaactactccgaaaactacaggcgcaggagattgctcggcaggcagcccaaattaagctcttgcgaaaattacaaaagcaggagcaggctagggttgcaaaggaggcaaaaaagcagcaggccattatggctgccgaagagaagcggaagcaaaaggagcagatcaaaataatgaagcagcaagagaagattaaacgcatacagcagatccgtatggagaaagagctgcgcgctcagcagattttagaagcaaaaaagaagaagaaggaggaagcagcgaatgccaaactgcttgaagcagaaaaacggatcaaggaaaaggagatgcgcaggcagcaggccgtcctgctgaagcaccaggagcgcgaacgccgtcgccagcatatgatgttaatgaaggctatggaagcgcgtaaaaaggcggaagagaaagaacgcctgaaacaggagaaacgggatgaaaagcgtttaaacaaggagcggaaacttgagcaacggagactggagctggaaatggccaaagagctgaaaaagccgaatgaagatatgtgtctcgccgatcagaagccgctccccgaactaccgaggattccaggcctggtgctttctgggtcaactttctccgattgcctgatggtggttcagttcctgaggaactttggaaaggtcctgggctttgatgtcaacatcgatgtgcccaaccttagtgttctgcaggaaggtctcctgaatatcggagattctatgggcgaggtgcaagacctcctggtccgcttactgtcagctgcggtgtgcgatcccggattgatcaccggatacaaggccaaaaccgcactgggcgaacacctgcttaacgttggggtgaatcgagataatgtcagtgagatccttcagatcttcatggaagcccattgtggccagactgaactgaccgaaagcctgaaaacaaaggcctttcaggcacacacccccgctcagaaggctagcgttctggcctttcttatcaatgagctagcgtgcagtaaatccgtcgtctccgagatcgataagaacattgactacatgagcaacttgagacgggataaatgggtcgtggagggcaaactgcgtaaactgagaattatccacgctaagaagacaggaaaaagggatacctctgggggtattgatcttggggaagagcagcacccacttgggacaccaacacccggacgcaagaggcgcaggaagggcggtgactcagactacgatgatgacgacgatgacgatagcgatgaccagggagacgaagacgatgaagacgaggaagataaggaagataagaaaggtaagaaaactgatatttgtgaagacgaagatgagggtgatcaggccgctagtgttgaggagttagaaaagcagatcgaaaagctgagcaagcagcaaagtcagtacaggcgtaagctgttcgatgctagccattccctgaggagcgtcatgttcggtcaagacagatatagaaggcgatactggatcctgccacagtgtggcggaatttttgttgagggaatggaatccggagagggactcgaagagatcgcaaaagagcgcgaaaagttgaaaaaagccgagagtgtgcaaatcaaggaagaaatgttcgagacctcaggtgatagtctgaactgctcaaacactgaccactgtgaacagaaagaagatctgaaagaaaaagacaacacaaacctttttcttcagaagcctgggtccttctcaaagctctctaaactgctcgaggtggctaaaatgccaccagagagtgaagtgatgaccccaaagccaaacgctggagccaatggatgcaccctgtcctaccagaattctggaaagcactccctcggctctgtgcagtcgacagccactcagtcaaacgttgagaaggcagattccaataacctctttaacaccggctctagcggcccagggaaattctactcacccttaccaaacgatcagctgcttaagacccttacagagaagaaccggcagtggttcagcctgttgcccagaacaccatgcgatgataccagtctgactcacgcggatatgagtacagcgagcctggtgacacctcagtcccagccaccatcaaaaagcccctcgccgaccccagcccctctggggtccagcgcccagaatccagtgggtcttaaccccttcgccctctctcccctccaggtgaagggaggtgttagcatgatgggattacaattttgcgggtggcctacaggggttgtcacttcaaatatcccatttacctcaagtgttccgagcctgggttcaggcttgggtctcagtgagggaaacggtaattctttcctgacctcaaatgtggcaagctccaagtctgaatccccagtgccccaaaacgaaaaggccacatccgcacagcccgctgccgttgaggtggccaagccagtcgatttcccaagccctaaaccaattccagaggagatgcagtttggatggtggcgaattatcgacccagaggacctgaaggccctgctgaaagtcctacacctgcgcggtatccgagagaaggccctgcagaaacaaattcagaaacacctggactatatcactcaggcctgccttaagaacaaagatgtagcgataatcgaattgaatgaaaacgaagaaaatcaagtgactagggacattgtggagaactggtctgtggaggaacaggcaatggagatggacctttctgttctccaacaggtggaagatcttgagcgtcgggtggctagcgccagcctccaagtgaaggggtggatgtgccctgagcctgcttcagaacgcgaggatctggtgtatttcgagcacaaatcttttacgaaactgtgcaaagaacatgacggagaatttactggggaggacgagagttccgctcacgccctcgagaggaaatccgataacccactggacatagctgtgaccagactcgcagatctggagcggaacatcgaaaggagaatagaggaggatatcgctcccggactgcgggtttggagaagagcattgagtgaggcacgttctgcagctcaggttgctctgtgcattcagcagctgcagaagtccatcgcgtgggaaaagagcatcatgaaagtctactgccagatctgtagaaaaggcgataacgaagagctgctcctgttgtgtgacggttgtgataaggggtgccacacctactgccatcgacctaagatcacgacgatccctgatggcgactggttttgccctgcctgtatcgctaaagccagcggccagacactcaagataaagaagctgcacgtcaaaggcaagaaaacaaacgaatctaaaaagggaaaaaaagtgacactgactggcgataccgaagacgaggacagtgcaagtacctccagctcgctcaaacgcggaaataaagatctcaagaagcgtaaaatggaggaaaatacctcgatcaatctcagtaagcaagaatcatttacctctgtaaagaaacccaagcgcgacgatagcaaggatctggccctgtgttccatgatcctaactgagatggagacacacgaggacgcttggccatttcttctgcctgtaaaccttaagttagttccagggtataagaaggtgattaaaaaacccatggattttagtactattcgcgagaagctgtcatccggtcagtaccccaatctcgagacattcgcactagatgtgcggttggttttcgataattgcgaaactttcaatgaggatgatagtgatatcggtagagccggtcataatatgagaaaatactttgagaaaaaatggaccgacactttcaaggtgtccta

SEQ ID NO: 216179 - DNA, 6506 bp, Artificial Sequence
  Description of Artificial Sequence: Synthetic coding sequence
atggagtcaggcgaacgcctgccatcgtccgccgcttccagcacgactccaacgtcttcttcaaccccaagtgtagcgagcgttgttagcaaaggcggtctaagcacgggggtggcctcactgtcctcaaccatcaatccttgtggccacctattcaggacagccggagatcaaccctttaatttgagcaccgtctcgtcggcatttcccatggtgagccaccccgtctttggtctgcattccgccagctccggtcactccgaatttggcggtctcggcaccctaggcacccccaccgccctcgctgcccacccacagttggcctcgttccccggagccgaatggtggcgaaccacagacgctcatacaagaaccggggctactttctttccccctctgctgggcattccccctctgttcgcaccccctgctcagaaccacgattccagctcctttcatagccgaacgtccgggaagagcaaccggaatggcccagaaaaaggcgtcaacggatccattaatgggtccaacacctccagcgtgatcgggattaacactagtgtgctctctactaccgcctcatcttcaatggggcagacaaagagtacctcgagcgggggtggaaaccggaagtgcaaccaggaacagagcaaaaaccagcccttagatgccagggttgataagataaaagacaaaaaaccgagaaagaaggccatggaaagcagcagcaactcagattcagattcagggacatccagtgatacttctagtgagggcatatccagtagcgactcagacgatttagaagaggacgaggaggaagaagaccagtcgatcgaagagtcagaggacgacgattcagatagtgagtctgaagcccagcataagagtaataatcaggtcctgttgcacggaattagcgacccgaaggccgatgggcagaaggccactgagaaggcacaggaaaagcgtatccatcagcctctgccgttagcatccgagtcacagactcacagcttccaatcacagcagaagcagcctcaggtcctgtcccagcagctgccatttatcttccagagcagccaagcaaaggaagagtccgttaataagcacactagcgtcatacagtcaacgggtctagttagtaacgtcaagcctctgtctcttgtgaatcaggcaaaaaaggaaacttacatgaagttaattgtcccatctcctgatgtgctcaaagcaggcaacaagaacacctccgaagagagctccctactgacttcagagctccgaagcaaaagagaacagtacaagcaggcttttccaagccagctcaagaagcaggaaagttcaaaatctctcaagaaagtcatcgcagcgctgagtaatccgaaggcaacctcctctagtccggctcaccctaagcagactctcgagaacaaccatccaaaccctttcttgacaaatgcccttctaggcaaccatcagcccaatggggttatacaaagcgttatccaggaggctcccttagccctcactactaaaacgaaaatgcagagcaagatcaacgagaacatcgcagccgcttcgtcgactcccttttccagcccagtcaacctgagcacgagcgggaggaggaccccaggtaaccagacgcctgtgatgccctcagcatctcccattctgcacagccaggggaaggagaaggctgtgtcaaataatgtgaatcccgtgaagacgcagcatcacagtcacccagcgaagagcttggtagagcagtttcgtgggaccgactcagacattcctagctcaaaagactcagaggactccaacgaggatgaagaagaggatgacgaggaagaggatgaggaagatgacgaagatgatgagtcagacgattcccaatcagagtccgactctaattctgaaagcgataccgaggggtctgaggaagaagacgatgatgataaggaccaagacgaatcggactctgataccgaaggcgagaaaacatctatgaaactgaataaaactacatcctccgtcaagtcgccatccatgtctctgacaggtcactccactccaagaaacttgcatattgccaaagctcctggctctgccccagcagcgttgtgctcagagagtcagtctccagccttcctcggaaccagctcgtccacgctaacgtcatccccgcattcaggcacctctaaaaggaggagagtgaccgatgagagagagctgcgtatccctctcgaatatggctggcagcgcgaaactaggatccgtaactttgggggacggttacaaggcgaggtggcgtactacgcgccttgcggcaaaaaactacggcagtaccccgaggtaatcaagtatttatcccgaaacgggatcatggatatctcacgggacaatttctcgtttagtgccaaaatcagagtgggagacttctacgaggccagggatgggcctcaggggatgcagtggtgcctcctgaaagaggaggatgtgatccccaggatccgcgctatggagggacgacgaggtaggccccctaatccggacagacaacgagcgcgtgaagaaagccgtatgcgcaggagaaagggaagacctcccaacgttggcaatgcagagtttctggataacgccgatgctaaactcctccgaaagctccaggcccaggagatcgctcggcaggcagctcagatcaaactcctccgcaagctccagaagcaggagcaggcacgagtagctaaggaggccaaaaaacagcaggccataatggccgcagaagagaaacggaagcaaaaggaacagatcaaaattatgaagcagcaggaaaagataaagaggatccagcagatccgtatggagaaggagctgcgggctcagcaaattcttgaagccaaaaaaaagaaaaaggaagaggccgcaaacgcaaaactccttgaagcagagaagcggattaaagaaaaggaaatgcgtcgccaacaggcggtgctcctcaagcaccaggaacgtgaaagaaggaggcaacatatgatgttgatgaaagcaatggaagcaaggaaaaaagcggaggaaaaggaacgactgaagcaggagaagagggatgagaagagactcaacaaggagcgaaaactcgagcagcggcgtctggagttagagatggcaaaagagctgaagaaacccaatgaagatatgtgtctcgctgatcaaaagcctctgcctgagctcccaaggatcccaggcttggtcctgagcggatccaccttctcggattgtcttatggtggttcagttccttcgtaacttcggcaaagtcttaggatttgacgtgaacatagacgtacccaacctctccgttttgcaggaggggctcctgaacattggtgattcgatgggtgaagtccaggatctgctggtccgactgctgagcgctgctgtctgtgatccgggactgattactggatataaagcaaaaactgctctgggggagcatttgctgaatgttggagtaaatcgtgacaacgtgtccgagattcttcagattttcatggaagctcattgtggtcaaacggagctcactgagtccctgaagacgaaggcctttcaggcgcacacaccagctcaaaaggcctcagtgcttgcttttttgatcaacgagctggcttgttctaaatctgtagtttctgagattgataaaaatattgactacatgtcaaacctacgcagagataaatgggtggtagaaggcaagctgcgaaaattaaggataattcacgcgaagaaaactggaaaaagggatacctcaggaggaattgatctgggtgaagagcagcaccccttgggaaccccaacccctggtagaaagcggaggcgaaagggaggagactcagattacgacgacgatgacgatgatgacagcgatgaccaaggcgacgaggacgacgaagacgaagaggacaaagaagataagaaaggtaaaaagacggacatatgtgaggatgaggacgaaggggatcaagccgcatctgttgaggaactggagaagcagatcgagaaactgtccaagcagcagtcacagtatcgcaggaaactattcgacgcaagccactcactccgttcagttatgtttggacaggatcggtacaggaggcggtattggattcttccccagtgtggcggtatcttcgttgaaggcatggagagcggtgagggactggaagaaatagctaaggagagggagaaactcaaaaaagctgaatctgttcagattaaagaagagatgttcgagacgagcggtgatagcttaaattgcagcaacacagatcattgtgagcagaaagaagatctgaaagagaaggataacaccaacctgttcttgcaaaagccgggatcattttctaaattgagcaaacttttggaagtggcaaagatgccccctgaatccgaagtcatgaccccgaagcctaacgctggcgctaacggctgcacacttagttaccaaaactctggcaaacatagcttgggctccgtgcagtcgacagccacccagagcaatgtagagaaggccgactcaaataacctgttcaacactggatcatctggtcccggaaagttctattcccccttgcctaacgaccagttgttaaaaacccttactgaaaagaatcgccaatggttttcgcttctgccaagaactccatgcgatgatacaagcctaacgcatgccgacatgtcgaccgctagcctggtcacaccccagtcacaacctccgtccaagtccccctctcccacccctgccccactaggtagcagcgcccagaacccagtggggctgaatcctttcgccttgagcccactgcaggtgaagggtggcgtttctatgatgggtctgcagttctgcggctggccgactggtgtggtcacaagcaatatccctttcacttcttctgtcccctctctagggtcaggcttagggctctctgaaggaaatggcaacagttttctcacctcaaatgttgcaagttccaagtccgagagtccagtgccgcagaatgagaaggcaacaagcgcacagcccgcagccgtggaagttgctaaaccagtagatttcccatcgcccaagcctatcccggaagaaatgcagttcggatggtggaggatcattgatcccgaagatctaaaggctctgttgaaggtgctgcacctgcgcggaatcagagaaaaggctctgcaaaaacaaattcagaaacacctcgattacatcacgcaggcttgcctaaaaaacaaggacgtcgctattatcgaattgaatgaaaacgaagagaaccaagttacccgggacattgtggagaattggagcgtggaggagcaggccatggaaatggatttgtccgtcctacagcaggttgaagacttggagaggagggttgcctctgcgtctctgcaggtgaaaggatggatgtgccccgaacccgcaagcgaacgggaagacttggtatactttgaacacaaaagctttactaaactttgcaaagaacatgacggggaattcactggagaggacgaatctagtgcacacgcactcgaaagaaaatctgacaatccgttggatattgcagtaactcgcctggctgatctggaacggaacatcgaaaggcgcattgaagaagatatcgcccctggtctgcgggtctggcgtcgggcactatccgaggcaagaagtgctgcacaagttgccctgtgtattcagcagctgcaaaaatctatcgcctgggagaagagcataatgaaagtgtattgtcaaatttgcagaaaaggtgacaatgaggagctgctcctgctgtgcgacggttgcgataaaggttgtcacacctattgtcatcggcctaaaatcaccacgattcccgatggggattggttctgtcccgcttgtatcgctaaagcaagcggccagaccctgaagatcaagaagctgcatgtgaaagggaagaagacaaatgaaagcaaaaaaggaaagaaggttacactgaccggggacaccgaggacgaagactctgcaagtacatctagttcactcaaaagagggaataaggacctcaagaagaggaaaatggaggagaataccagtattaacctgtccaagcaagaaagttttacttctgtcaaaaaaccgaagcgagacgattccaaagacttagccctctgttccatgatcctcacagaaatggagacacacgaagacgcgtggccgtttctgctgccagtgaacctcaagctagtgcctgggtacaagaaggtgatcaaaaagcctatggatttctcgacgattcgcgagaagctttctagcggtcagtacccaaacttggagacgtttgcattagatgtgcggctcgtctttgacaactgcgagacatttaatgaagacgatagcgatataggacgagcgggacataacatgagaaagtacttcgaaaagaagtggacagacaccttcaaggtgtccta

SEQ ID NO: 216180 - DNA, 432 bp, Artificial Sequence
  Description of Artificial Sequence: Synthetic coding sequence
atggaatctggtgaaagactaccaagttccgccgctagcagtaccacaccaactagttcttctactcccagcgttgccagcgtcgtcagtaagggtggactctcgacaggggtggcctcactctcttcgactattaacccttgcggacacctgtttcgtacggcaggagatcagccttttaacctgtctaccgtctctagcgctttccccatggtttcacatcccgtgtttgggcttcattccgcctcctcaggccactctgagtttggtggtcttggcacactggggacacccacagcccttgccgcacacccccaactggcttccttccctggtgcagagtggtggcgcactaccgatgcccatacacggacgggggctacatttttccccccactcctcggcattcccccacttttcgcacccccttag

SEQ ID NO: 216181 - DNA, 1563 bp, Artificial Sequence
  Description of Artificial Sequence: Synthetic coding sequence
atggaaagcggcgagagactcccatccagcgccgcatcctcaacaacccccactagctcctccacgcccagcgtggcaagtgtggtgtcaaagggcggactctctacgggcgtcgcgagcttgtcctccaccatcaatccttgcggcgcagaatggtggcgaacaactgatgcccatactaggaccggtgccactttctttcccccattgttaggcattccaccactcttcgccccaccagcacagaaccatgatagcagctcgtttcacagtaggacctccggaaaaagcaatcgtaacggaccggagaagggagtgaacggctctataaacggaagcaacacctcatcggtgatcggcattaacacgagtgtcttatcaaccacagctagttcttctatgggtcagaccaagtcaaccagcagtggaggcggaaacaggaaatgtaaccaggaacagagcaaaaatcagccgcttgatgcacgcgtggacaagatcaaggataaaaagccgcgtaagaaggctatggaaagctcctcaaattcagactccgactctggcacatcatcagatacatcctctgaaggaatatcctcatctgacagcgacgacctggaagaggatgaggaagaagaggaccagtctattgaagagtcagaagatgatgatagcgattccgaaagtgaagcccagcacaaatccaacaaccaggttctgctgcatgggatctcagatccaaaggccgacggacaaaaggcaacagagaaggcccaggagaagcggattcaccagccactgcccctcgcctcagaatcccagacacacagcttccagtctcaacaaaagcagccccaggtgctgtcccagcagctgccatttatcttccagtcttctcaagctaaggaagagagtgtcaataagcacacttcagttattcagagcacaggcctggtgtcgaatgtgaagccccttagtctggtcaatcaggctaaaaaggagacatatatgaaactaatcgtgccctctcctgacgtgctgaaggccggaaataagaatacctccgaagaaagctccttactgacatcagagttgcgaagtaaacgcgagcaatacaagcaggccttcccgagtcagctgaaaaaacaggaaagtagtaagtctttgaagaaagttatagctgctctctcgaatcccaaagcaacttcctccagtcctgcacatcccaagcaaaccctcgaaaacaaccacccgaacccctttttaacaaacgctttgttgggaaaccatcagccaaacggggtgattcaatctgtcattcaggaagctcccctcgccctgactacaaagacaaagatgcaaagcaagattaacgaaaatatcgctgcagcctcatccaccccctttagctctcctgttaacctctccacgtctgggaggcgaactcccggaaaccagacgcctgtcatgccctcagcgagcccaattttgcattctcagggcaaagaaaaggccgtttcaaataacgtcaacccccgtaaaatgatgaaaaagaaaatgcgctag

SEQ ID NO: 216182 - DNA, 3645 bp, Artificial Sequence
  Description of Artificial Sequence: Synthetic coding sequence
atgggcgtggacttcgacgtgaagacattctgtcacaatttacgcgctacaaaacctccttatgagtgtcccgtcgaaacatgcaggaaagtgtacaagagttattctggtatagaatatcacctttaccattatgaccacgacaacccaccgcctccccagcagacccctctgagaaagcacaaaaagaaaggccgacaaagtcggccagccaacaaacaatctcctagtccgtctgaggtatcgcagtcccctggcagagaggtgatgagctacgctcaggcacagcgtatggtggaagtggatctgcacggcagagtgcacaggatctccatatttgacaacctcgacgtcgtgtcggaggatgaggaggcccctgaggaagcccctgagaacgggtccaacaaggagaacaccgaaactcctgcggcaacgccaaagagcggcaaacacaagaacaaagaaaaaaggaaggattccaaccaccatcaccaccataacgtatctgccagcacaaccccaaagttgccggaagtggtctaccgggaactggagcaggatacccccgatgctcctcccagacccaccagttactatcgatacattgaaaagtcggctgaggagttagatgaagaggtcgaatacgacatggatgaggaagactacatctggttggacattatgaatgagcgtaggaaaactgaaggtgtaagcccaattccacaggaaatcttcgagtatcttatggatcgcttagagaaagaatcttacttcgagagccataacaagggggatcctaatgcactggtggacgaagacgccgtctgttgtatttgtaatgatggagagtgccagaatagcaacgtgatcctcttctgtgacatgtgcaacctggctgtccaccaggaatgctacggggttccatatattccagagggtcagtggctgtgtagacggtgtcttcaatccccttctcgggctgtcgattgcgctttatgtccaaacaagggcggagctttcaaacagaccgacgacggccgttgggcacacgtcgtctgtgccctctggattccagaggtgtgcttcgccaacactgttttcctggagccaatcgatagcattgagcacatccctcccgctcggtggaagcttacttgttatatctgcaaacagaggggttccggcgcatgcattcaatgtcataaggctaactgttatactgcatttcatgttacctgcgctcagcaggcagggctctacatgaaaatggagcccgtccgtgagaccggagccaatgggacctctttcagtgtgcggaagaccgcatattgcgacatccatactccacccggtagtgcgcgtagactgcccgcactgagtcacagcgagggggaagaggacgaggacgaagaagaggatgaaggaaaaggctggtcatctgaaaaggtgaaaaaggctaaagccaagtccagaattaagatgaagaaggcacgcaagattctggccgagaagagggctgccgcaccggtggtctccgtgccttgtattccccctcaccgactgagcaagatcaccaaccggctgacgattcaacggaaatcacagtttatgcaacgcttgcactcttattggaccttaaaacgccagtctcggaatggcgtgccactgctgcgacgattgcagacacatctccagagtcagcgaaattgcgatcaggtcggcagggatagcgaggataaaaactgggctctcaaggagcagctgaagtcttggcagcggctgcgtcacgacctggagcgagctaggttgctggtcgagctgattcggaaacgcgaaaaactaaagagggagacaatcaaagtacaacagatcgcaatggaaatgcagctgaccccttttctcattctgttaaggaagacacttgagcagctgcaggagaaggatactgggaacatcttttctgagcctgtgccactcagcgaggtgccggattatttggatcacattaagaaaccaatggatttcttcacgatgaaacaaaacctcgaggcctaccgctacctgaattttgacgacttcgaggaggacttcaatctcatcgtgagcaactgcctgaagtacaatgctaaggataccatcttctatcgggctgcagtgcgtctccgcgagcagggcggagccgtgcttcggcaggcccgaagacaggctgaaaagatgggaatcgactttgagaccgggatgcacattcctcactctcttgctggggacgaagccactcatcatactgaggatgccgctgaggaggagcgattagttttgttggaaaatcagaagcacctccctgtggaggagcaactgaagctgcttcttgaacggctcgacgaggtgaacgcctccaagcagagtgtgggcaggagcaggcgagctaagatgatcaaaaaggagatgaccgcgctgcggagaaagctggctcatcagcgagagaccgggagggatggcccagagcggcacggtccttcgagtcgtggaagtctgaccccccatccggcagcctgtgataaggatgggcagactgactctgccgctgaagaatcaagcagtcaggaaaccagcaaggggctcggtcccaacatgtcaagtacccccgcacatgaagtcggcagaaggacttcagtcctcttttccaagaaaaatccaaaaactgcgggacccccaaagcgccctggcagaccccctaagaatcgtgagtcacaaatgactccctcccacggaggaagtcctgttggacctccccagctcccaatcatgtcctccctgcggcagcgcaaaaggggccgtagccctagaccctcatccagtagcgattctgatagcgataagagcacagaagatcccccaatggacttaccagctaatgggttttcaggagggaaccaaccagtgaagaaaagctttctggtatataggaacgattgctcactgcctcgttcttcctctgactccgaatcgagcagctcgtcttcaagttccgccgctagtgatcggacatctactactccatcaaagcagggacgaggaaaaccctctttctctaggggtaccttccccgaagacagctccgaggatacgtccggcactgaaaacgaagcatacagcgttgggactgggagaggtgttggccactccatggtgcggaagagcttaggtcgtggcgctgggtggctgtccgaggacgaggattcccccctggatgcccttgacttggtctgggctaaatgtcggggatacccgagttaccccgcacttattatcgatccaaagatgccacgagaaggcatgttccaccatggtgttcccatccctgtgccccctctggaggtgctaaaactaggagaacagatgacacaagaagctagggaacacctgtatcttgtgctattttttgataataagagaacgtggcagtggctcccacggacaaagctggtcccactgggagtgaaccaggacctggacaaggagaagatgcttgaggggagaaagagcaacataaggaagagcgtgcagatagcctatcacagggcactgcagcatagatcaaaagtgcagggggaacaatccagcgagaccagcgactccgactag

SEQ ID NO: 216183 - DNA, 3663 bp, Artificial Sequence
  Description of Artificial Sequence: Synthetic coding sequence
atgggagtggattttgatgttaaaaccttttgccacaatctgagggccaccaagccaccctatgaatgccccgtggaaacctgccgtaaagtctacaaaagctattcgggaattgagtatcacctttaccactacgaccacgacaaccctcctcccccacagcagacccccctccggaagcacaagaagaagggacggcagtctaggcctgccaacaagcagagtccctccccaagtgaggtttctcaatcacccggacgggaagtaatgagctacgcccaggcccagcgcatggtcgaagtggaccttcatggtcgggtgcaccggatctccatttttgataacctcgatgtggtttctgaggacgaagaggctcctgaggaagccccagagaatgggagcaataaagagaatacagagactcccgcagcaactcctaagtcaggtaagcataaaaacaaggagaaaaggaaagattcaaaccatcatcaccaccataatgtgtcggccagcaccactcctaagctacctgaggtcgtatatcgcgagctggagcaggacactcccgatgctccccctagaccaacgtcgtactatagatacattgaaaaatccgcagaggaattggacgaggaagttgagtatgatatggacgaagaagattatatttggctagatattatgaatgaacgtcggaagacagaaggagttagtcccatccctcaagagatctttgagtatttgatggatagactggagaaagaatcttacttcgaaagtcataacaaaggcgacccgaacgccctggtcgacgaagatgctgtttgttgtatctgcaacgacggtgagtgccagaacagcaatgtaatactgttttgcgacatgtgcaacctcgcagtgcaccaggagtgttacggcgtcccctacattcctgaggggcaatggctatgtcgtagatgcctgcaatcaccctctagggccgtggactgtgccctgtgccctaacaagggaggggcattcaaacagacagacgatggcagatgggctcatgtcgtgtgcgctctttggataccagaggtctgcttcgcgaacacagtttttctggaaccgattgattcaattgagcatattcctcccgctaggtggaagttgacatgctacatctgcaagcagcgcggatcaggggcatgtatccagtgccacaaggctaattgctacacagcctttcacgtcacctgtgcacagcaagcagggctctacatgaagatggagcccgtaagggagactggcgcaaatggaacgagttttagcgtgcgcaaaacagcctattgtgacatccacactccccctggaagcgctaggagactacctgcgctgtctcactccgagggggaggaggatgaggatgaagaggaagacgaaggaaagggctggagcagtgagaaagtcaagaaagccaaagcaaaatcccggattaaaatgaaaaaggccagaaagattctcgcagaaaaacgcgcagccgctcctgtggtgtccgtgccctgtattccacctcaccggttaagtaagataaccaatcgcttaactatacagcgtaagtcgcagttcatgcagcgactgcatagctactggacattgaaacggcagtctcggaatggggtgcctctgctccgccgattacaaacgcatttgcagagtcagcgcaactgtgatcaggtgggtagggactccgaggataagaattgggcactcaaagaacaactcaaatcttggcagaggctccgccacgatctggaacgggctcgcctattggttgaattgattagaaagcgggagaagctaaagcgggagaccataaaggtccagcagattgcaatggaaatgcagcttacaccctttttgattcttttgagaaagacacttgaacagttgcaagagaaggacacaggaaatatttttagtgagcccgtgcctttatccgaagtgaccgagttagatgaggtgccagattatctggaccacatcaagaaaccaatggacttttttaccatgaagcagaacttggaggcctacaggtaccttaacttcgacgacttcgaggaagatttcaatctcatcgtatccaactgcctgaagtacaatgcaaaggacacaattttttacagagccgcagtgagactgagagaacagggaggtgccgttctccgccaagcacgacgccaggctgagaagatgggtatcgatttcgagacaggaatgcacattccccactccctcgccggtgacgaggccacgcaccacactgaggatgccgcagaggaggaaagactggtacttttggagaatcagaaacacctccccgtggaggaacaactgaaactcctgctggaaagactagacgaagtaaatgcgagcaagcagagcgtcggcaggtctaggcgcgcaaaaatgattaagaaggagatgaccgccttacgccgaaaattggcgcatcaacgcgagacagggagagatggcccagaaagacatggccctagcagcaggggtagcttgacgccgcatcccgcagcctgcgacaaagatgggcagactgactcggccgcagaagaaagttcatcccaggagacttcaaaggggctcgggccaaacatgtcatccacacccgcacacgaagtgggcaggcgcaccagcgtcctgttctcaaagaagaatcccaaaacagctggcccacccaaaagaccgggaaggcccccaaagaacagagaatctcagatgaccccatcacacgggggatcccccgtgggcccaccacagcttcctatcatgagcagcctgcgacagcggaagcgcggacggtcacccagacccagcagttccagcgatagcgacagtgataaaagcacagaggatccacccatggatctgcccgctaacggcttcagtggcggaaaccagcccgtaaaaaagagcttcctcgtctacaggaacgactgctccctgcccaggtcttcatcagattctgaatccagttcctcctccagctcatctgcagcctccgataggacaagcacgactccttcgaagcagggcagaggcaaaccttcctttagccggggaaccttccccgaagactcatccgaggatacctctggtactgagaatgaggcctacagtgtgggcacagggaggggtgtgggacactccatggttcggaagagtctggggcgtggagcagggtggttgtcagaagacgaagacagccctctggacgcactggacctggtttgggcaaaatgcagagggtatccttcatatcccgcactgataattgatccgaagatgcccagagaagggatgtttcatcatggggtcccaattccagttccgcctcttgaggtgttaaaacttggcgagcagatgacacaagaggctcgagaacacctgtacctcgtcctgttctttgataataaacgaacttggcagtggctgcctaggactaagcttgtgccactaggagtgaaccaggatcttgataaagagaaaatgttggagggccgaaagagtaacattagaaagagcgtgcaaatagcctatcaccgggctcttcagcaccggagcaaggtgcagggggagcagtccagcgagacttcagattccgattag

SEQ ID NO: 216184 - DNA, 303 bp, Artificial Sequence
  Description of Artificial Sequence: Synthetic coding sequence
atgggcgtggattttgacgtgaaaacgttttgccataatctgagagctaccaagcccccttacgagtgccctgtagagacctgtcggaaggtctacaagtcctactctggaatcgaataccacctttaccattacgatcacgataatccaccacctcctcagcagacccccctcagaaaacataaaaaaaaaggacgacaatcgagacccgctaacaagcagtcaccttctcctagtgaggtgtcccagtctccaggcagggaagtgatgagctacgcccaagcacagcggatggtagagtag

SEQ ID NO: 216185 - DNA, 318 bp, Artificial Sequence
  Description of Artificial Sequence: Synthetic coding sequence
atgggagtcgatttcgatgtcaagaccttttgtcataacctccgggcaactaagcccccttacgaatgccccgtggagacatgcagaaaagtgtataaatcctactctggtattgagtatcatctgtatcattacgatcatgacaatccacctcctcctcagcagacaccgctccgaaaacacaaaaagaaggggaggcagagccgacccgcaaataaacagagcccatcaccctctgaggtgtctcagtcccctggtcgggaggtcatgtcttatgctcaggcccagcgtatggtggaagtggacttgcatggttag

SEQ ID NO: 216186 - DNA, 3645 bp, Artificial Sequence
  Description of Artificial Sequence: Synthetic coding sequence
atgggggtagactttgatgtcaaaaccttctgtcataaccttcgagccactaaacccccttacgagtgccctgtggagacctgtcgaaaggtgtacaagtcttacagcggaattgagtaccacctctaccactacgaccacgataatccgcctcctcctcaacagacccccctacggaaacacaagaagaagggcaggcaaagcaggccagccaataagcagtccccatctccgtctgaggtcagtcagtctcccggtcgggaggttatgtcctatgcccaggcacagcggatggttgaggtcgatttacacggtagggtgcaccggatttcaatctttgacaatctcgacgtcgtcagcgaggacgaagaggctccagaggaggccccagagaacggcagcaataaagagaacacagaaacccccgctgccacaccgaaatccggcaaacacaaaaacaaggaaaagcggaaggactccaatcatcaccatcaccataatgtaagcgcgagcacgaccccgaaactccccgaagtggtgtatcgtgagctcgagcaggacactccagatgctccccctagacccaccagttattaccgctatatcgagaagagtgccgaggaactggacgaagaagtggagtatgatatggacgaggaggattatatctggctcgacattatgaatgaaaggcggaaaaccgagggagtctcacccatccctcaggagatattcgagtatcttatggatcgtctcgagaaagagagctacttcgaaagccacaataagggagacccaaatgccctcgtcgacgaggacgcagtttgttgcatttgcaatgatggggaatgccaaaattctaatgttatactattctgcgatatgtgcaatctggcagtacatcaggaatgctacggagtgccatacattcctgaaggccagtggctgtgtagaaggtgcttgcagagcccctctcgggctgtcgactgcgcactgtgcccaaataagggcggagccttcaagcagaccgatgatgggagatgggcccatgtggtttgcgccctatggatcccagaggtgtgctttgccaacacagtgtttttggaaccaatcgattctatcgaacacatcccaccagcacgatggaaactcacctgctacatttgcaaacagcgcggaagcggagcctgtatccagtgtcataaggccaactgctacacagccttccacgtaacatgcgcccaacaggctggtttgtatatgaagatggaacctgtgagagaaaccggggcaaatggaacttcattcagcgtccggaaaaccgcatattgcgatatccatactccccctggctcagcaagacgcctgcctgctcttagccatagcgagggcgaagaggacgaggacgaggaagaagacgaagggaaaggatggtcctctgaaaaggtaaaaaaggccaaagccaaaagcaggatcaagatgaagaaggctcggaaaatcctagcggaaaagcgagcagcggcacccgtggtctccgtaccgtgcatccctccacataggctaagtaagataaccaatcgcttaactatccagagaaaatcccagtttatgcaacgactacatagttactggaccctgaaacgccagtcaagaaatggcgtgccgcttttaaggaggctccagacccacctgcagtctcagcgtaactgtgatcaggtgggtcgtgattccgaggacaagaactgggcattaaaagagcagctaaagtcttggcagaggctgaggcatgacctcgaacgggctcggctgctcgtcgagttgattagaaagcgagagaagctcaaacgggaaacaattaaggtgcaacagatcgccatggagatgcagctgactccctttttaattctcctccggaaaactctggaacaactgcaggaaaaagatactggaaacatttttagcgagccggttcctctctctgaggtccccgattatctggatcatataaagaagcccatggatttctttaccatgaagcaaaatttggaggcttatcgctatttgaactttgacgactttgaagaggacttcaatctcatagtctcaaattgcctaaagtataatgcaaaagacacaattttctatcgggcagcggttcgcttgagggagcaggggggtgccgtgctgcggcaggccaggcggcaggcggagaaaatggggattgattttgagactggaatgcacatacctcacagtcttgcaggagatgaagcaacgcaccacaccgaagacgctgctgaggaggagcgactggttttgctcgaaaatcaaaagcatcttccggtcgaggagcagctcaaactcctgttggagcgcttagacgaggtaaacgcaagtaaacagtctgtcggcaggtcccgccgtgctaaaatgatcaagaaagaaatgaccgccctaaggcgaaaattagcccaccaacgggagacaggcagagatgggccagaaaggcatggccctagcagtcgtgggtcccttacgccccacccagccgcttgtgataaggacggacagaccgattccgccgcagaggaatcgagtagtcaggaaacaagtaagggtctcgggcctaacatgtctagcactcccgctcacgaggtagggcgacggaccagcgtactgttttccaagaaaaatccaaaaactgcaggtcctcctaagcgccctgggcgacctccgaagaacagggagtcccagatgaccccttcccatggcggatcacctgtcggcccacctcagctcccaatcatgtcgagcctgcggcagagaaaaaggggacgttcacctaggccaagttctagctcagatagcgatagcgacaagtctacagaagatcctcctatggatctgcccgcaaacggcttctcgggcggaaatcagcccgtgaagaaatcgtttctggtgtaccgtaatgattgtagtttaccgaggtcatcgtccgatagtgagtcttcttcctcgtcttcaagttccgccgcaagtgaccgtacgtcaactactccatctaaacagggaagaggaaagccttccttcagccggggtactttcccggaggattcctctgaggatacaagcggtaccgagaacgaggcctactccgtcggaacgggaagaggggtcggtcactcaatggtgcggaaatccctgggacggggtgccggttggctgtcagaggacgaagatagcccactggacgcgctggacctggtgtgggccaagtgtagggggtatccttcataccctgccttgattatcgatcccaaaatgccacgcgagggtatgttccatcacggtgtgcccattcccgtccctccgctcgaagtgctaaagttgggcgaacagatgacccaggaggcacgagagcatttataccttgtgctctttttcgacaataagaggacatggcaatggctgccacgcacaaaactggttcctctgggggtaaaccaagacttagataaagaaaagatgctcgaaggcagaaaatccaacatccgaaagtcggtgcagatcgcttaccaccgtgcactgcaacatcggtcaaaagtgcagggcgagcaaagtagcgagaccagcgatagcgattag

SEQ ID NO: 216187 - DNA, 5408 bp, Artificial Sequence
  Description of Artificial Sequence: Synthetic coding sequence
atggccgcagctcctactcagattgaggcagaactgtattatctcattgcaagatttttacagagcgggccatgtaacaaatctgcacaggttctggtccaagagctggaagagcatcagttgattcctagaagactagactgggagggcaaagagcatagacggtcttttgaagacctggtcgcagccaatgcacacatacccccagactatcttctgaaaatatgcgaacgaatcggacccctcctggataaagagatcccacagtcggtgcctggagtgcagacactgctgggggtcgggaggcagtccctgctgagggacgccaaagattgcaagtccacgctatggaatggaagcgctttcgcagctttgcatcgcggtcgcccaccggagcttcccgtcaactacgtcaagcctcccaacgtcgtgaatattacctccgcgagacagctgaccggatgctcccgctttggccacatctttcctagtagtgcatatcaacatataaaaatgcataagaggatattaggacacctgtccagcgtatattgcgtcgccttcgatagaagcggacgcagaatatttaccggcagcgacgattgtctggttaagatctgggcaacagacgatggccgtctgctcgccacactccgtggacactctgcagagatttccgatatggcggtgaactatgagaatactctgatcgctgccggttcttgcgacaaggtagtacgcgtgtggtgcctcaggacctgcgctccggtggctgtactgcagggccactctgcgtctatcacgagcatacaattctgcccaagcaccaaagggaccaatagatacttaacatctaccggggcagatgggaccatctgcttttggcaatggcatgttaagacaatgaagttccgcgacagaccagtgaagtttaccgagcgaagccgtcctggcgtacaaattagctgcagttcctttagctcaggcggaatgtttatcacaacaggcagtacggatcacgtgattcgtatatactatttgggatctgaagtgcccgagaagattgctgaactggaaagtcatactgataaagtggtggcggtacagttttgcaataatggggacagtctgcggttcgtgagcggatcaagggacggtacagccaggatatggcaatatcaacagcaggagtggaagagtatagtgctggacatggcaacaaagatgaccggtaataacctgccatccggtgaagataaaattaccaaattaaaggtcactatggtggcttgggaccgctacgacaccaccgtgatcacagccgtcaacaacttcctcctgaaggtatggaattctatcacaggacaactgcttcacactctcagcggccacgacgatgaagtgttcgtcctggaggcccacccctttgatcagaggatcatcttgagcgctggccacgatgggaatatcttcatctgggacttggatcgaggtacaaagattcggaattatttcaacatgatcgagggccagggccatggcgctgtcttcgactgcaagtttagtccggatggcaaccacttcgcctgcactgattctcatggccacttactgctttttgggtttggctgtagcaaatattatgaaaaaatcccagaccagatgttctttcataccgattaccggcctctgattcgagatgctaacaattatgtcttggacgaacagacacagcaggcacctcatctgatgcctcctcccttcctcgtggatgtggacgggaacccacatccgacaaagttccagaggttggtgcccggaagagagaactgcaaagacgaacagctgattccacagctgggttacgtggcaaatggcgacggagaggtcgtggaacaagtgataggccaacagacaaatgaccaggacgaaagcatcttggatggtattattcgtgagctccagagagagcaggacttaagattaattaatgagggcgacgtgccacacctgcccgtgaaccgggcatactcagtcaatggggcattgcggtcccccaacatggacatctctagttctcccaacatccgcctgcgcagacactcttcccaaatagaaggagtgaggcaaatgcacaacaacgcacctcgatctcagatggctacagaaagagatcttatggcctggagccgccgagtggtagttaacgagttgaacaacggcgtgtctcgggtgcaggaagaatgtagaactgcaaaaggggacattgaaatttccctgtatacagtagagaagaaaaaaaagcctagttacacaacccaacggaacgactacgaaccttcgtgcggccgtagccttcgccgaacgcagcggaaacgccagcatacttaccagactcgcagtaatattgagcacaattcacaggcatcctgtcagaactccggcgtgcaggaagactctgactcaagcagtgaagaggatgagaccgttggcacatctgatgctagcgtggaggaccctgtcgttgagtggcagagcgaatctagttcttccgattcttccagtgaatattcggattggacagccgatgccggaatcaacctgcaacccccaaagaggcagaccaggcagacgacgcgcaagatctgttccagcagcgacgaagaaaacctcaagtctctggaagagcgccagaaaaaaccgaagcagacccgcaagaaaaaaggaggacttgtttctatcgcaggagaaccaaacgaagagtggttcgctccccaatggattctcgatacgattcccaggcgctcccccttcgtaccacaaatgggggatgaattgatctactttagacagggccacgaagcctacgtccgcgctgtcagaaagtccaagatctattctgtcaatttgcaaaaacagccttggaataagatggacctcagggagcaggagtttgtaaaaattgtgggaattaagtacgaagtcggcccaccaaccctgtgctgcctcaagctggcatttcttgatcccattagtggaaaaatgacaggcgaatccttttctatcaaataccatgatatgcccgacgtgatcgattttttggtactccatcaattttataacgaggccaaggaaaggaactggcagattggagaccggttccgaagcatcattgatgacgcctggtggtttggcacagtagagtctcagcaaccctttcagcccgaatacccagattcatcttttcagtgctatagtgtccactgggacaacaacgaacgggaaaagatgagtccatgggacatggagccaattccggagggtacagcattccctgacgaggtgggcgcaggcgtgcccgtaagtcaggaagagctgaccgcactgctgtacaagccacaggaaggggagtggggtgcccattcacgcgacgaggaatgtgagcgtgtgattcaagggatcaatcacttgctcagcctcgatttcgccagtccgttcgccgtgccagtcgatctttctgcatacccactgtattgtacagtcgttgcctatccaactgacttgaacaccatccgcagaaggcttgaaaatcgtttttaccggaggatatctgctctgatgtgggaggtccgctacatcgagcataacgcccgaacgtttaatgagccagactccccaattgttaaagcagcaaaaatcgtgacagacgtgcttcttaggttcataggtgatcaatcctgtacagatatcttggatacctacaacaaaataaaggctgaggagagaaactctactgatgcagaagaagacaccgaaatcgtggatctggactctgacggccctggcacaagctcgggcaggaaggtcaaatgccggggtcggaggcagagtctcaaatgtaatcctgatgcatggaagaagcagtgcaaggagctgctgtcactgatttacgagagagaggacagtgagccgttccggcaaccagcggacctgctttcataccccggacaccaggaacaggaaggcgaaagctcggagtcagtggtgcccgagaggcaacaagattccagcctgtcggaggactaccaggacgtcatcgatactcctgtcgatttctccacagtgaaggagaccctagaggctgggaactatggctccccactggagttctacaaagacgtccggcagatcttcaacaattccaaggcctatacatctaacaaaaaatcacggatctactctatgatgttgagactgagcgccttgttcgaatctcacattaagaacatcatctcagaatataaaagcgctatccagtcacagaaacggagacgcccaaggtaccgcaagcgccttagatcctcgtcttcatccctgtcctcgtctggggcaccctcacccaagggcaaacaaaagcagatgaagttgcaaccaaaaaatgaccaaaacacatctgtctcacacgccaggacatcctcaccgttttcctcccctgtgtcagatgctgccgagggtctgtctctctatctgttggacgacgaacccgacgggcctttctctagtagtagctttgggggatactcccgatccgggaacagccacgacccaggaaaagccaaatcattccgcaacagagttctgcctgtgaagcaggaccacagtcttgatgggccactaactaacggcgatggaagggaaccacggacaggcattaaaagaaaactgctttctgcgtcagaagaggacgaaaacatggggggagaggacaaagagaagaaagagaccaaggaaaaaagccacctttctacgtccgagtctggagaactggggtcgtccttatcaagcgagtccacatgtggatctgatagcgactctgagtccacgtcaagaacagaccaggattatgttgacggcgatcacgattacagcaagttcattcaaacaaggccaaagaggaagcttcgaaagcaacacgggaacgggaaaagaaattggaagacccggggaactggagggagaggccgttggggccgttgggggcgttggtctaggggtggaagaggccgtggcggtcggggacggggtagcaggggacggggagggggtggcacccgcggacgcggtagggggaggggcggtcgaggcgcttcccgtggcgctacacgggctaagcgagccaggattgcggacgacgaattcgatacaatgttctcagggcgattctctcgtcttccccgtatcaaaacaaggaaccagggtcggcgaaccgttttgtataatgatgactctgacaacgacaattttgttagtaccgaagatcccctgaacctaggtacttcccggtctggacgggttcggaagatgaccgagaaggcacgagtttcccatctcatgggatggaactacta

SEQ ID NO: 216188 - DNA, 2406 bp, Artificial Sequence
  Description of Artificial Sequence: Synthetic coding sequence
atgcttcagaacgttactccgcacaacaagttgcctggtgaagggaacgcgggtctgctcggcttgggacccgaagcagcagcaccaggaaaacggatccggaagcccagcctactgtacgagggttttgaatcgcctaccatggcttcggtaccagcactccagcttacgccagctaatccgcctcctcctgaggtgtccaatcctaagaaacccggaagagtgaccaatcagcttcagtatcttcacaaggtcgtcatgaaggccttatggaagcaccaattcgcatggccatttcgtcagcccgtggatgcagtgaaactaggtttgcccgattatcataagatcataaaacagcctatggatatggggacgataaagaggaggcttgagaacaattattattgggccgcatctgaatgtatgcaagacttcaatacaatgttcaccaactgctacatctacaataagcctactgacgacatagtgctcatggctcagaccctggaaaagattttcctccagaaggtagcttccatgcctcaggaagagcaagagctcgtcgtgaccatccccaagaactcacacaagaaaggcgctaaactcgcggcactgcaaggatcggtgacaagcgcgcaccaggtaccagcggtaagctctgtgtctcatacagcactctacacaccccctcccgaaattcctacaaccgtactgaatataccacatccgtcggtgatcagttcaccgctgcttaagtcgttgcacagcgctgggcctcccctccttgctgttaccgccgcaccaccagcccaacccctggccaaaaagaaaggtgtgaaacgtaaggcggatacaacaactcctactcccaccgccatcctcgcgccaggtagccccgcaagccctcctgggtctctggagcccaaagccgcaagactcccccctatgcgaagagaatccgggagaccgatcaaaccccctcgcaaagacctacccgactcgcagcagcagcatcagagtagcaagaaagggaagctctctgaacaactcaagcactgtaacgggatcttgaaagagctactgtccaaaaaacacgcggcttacgcctggcccttctataaacccgtagatgccagtgcgctagggctacatgattatcatgatatcatcaagcaccccatggacttgtccactgtaaagaggaaaatggagaaccgggattatagagacgcgcaagagttcgccgctgatgtcaggttgatgttcagcaactgctacaagtacaatccgcctgatcatgacgttgtggctatggcgaggaagttgcaggatgtgttcgagtttcgatacgccaagatgcctgacgagcccctcgaacctggtcctttacccgtgtcgactgctatgccacctggcctcgccaagagttcaagtgagtcctcatccgaggaatcaagctctgagtccagtagcgaggaagaagaggaagaagatgaggaagacgaagaggaagaggaaagcgagagtagtgatagcgaggaagaacgggcacaccggctagccgagctgcaggagcagctgagagccgttcacgagcagcttgctgctctgtcccagggcccaatcagtaagccaaagcggaagcgtgaaaagaaagagaaaaagaagaagcggaaagctgaaaagcacagaggacgcgcaggtgccgatgaggatgacaaagggccacgggcaccccgacctcctcagccaaagaagtccaaaaaggccagtggtagcggaggaggctctgccgctttgggaccatcggggttcggaccaagtggcggtagcgggacaaagctcccaaagaaggccacgaaaacagcacctcctgcgctaccaactggctacgacagtgaggaggaggaggaaagtcggcctatgagttacgatgagaagagacaattatctttagacatcaataagttgcccggtgaaaagcttggccgtgtggtgcatatcattcaggctcgggagccatctcttagagacagtaacccggaggagatcgaaatcgattttgaaacgctcaaaccaagcacattaagagaactcgaacgttacgtgcttagctgcctgagaaaaaaacccaggaagccatatacgattaagaagcccgtaggaaaaaccaaggaggagttggcactggaaaaaaaaagggagctcgagaagcgactgcaggatgtgagcgggcagctaaattccacaaagaagccgccaaagaaggcaaatgaaaaaactgagtcttcttcggcgcaacaggttgccgtgagcaggctgtctgcctcaagctccagtagcgattcttcatcgtctagctcctcctcctcaagtagcgacacatccgacagcgattctgggtag

SEQ ID NO: 216189 - DNA, 2406 bp, Artificial Sequence
  Description of Artificial Sequence: Synthetic coding sequence
atgctgcaaaacgtgactccccacaacaagctgcctggagaaggaaatgctgggttgttagggctgggtccggaggccgcagctcctggtaagcggatacggaaacctagcttgctgtacgagggctttgaatccccgactatggcatcagtgcctgccttgcagctgacacccgctaatccaccccctccagaggtgtcgaaccccaagaagcctggcagggtgacaaatcagcttcaatacctgcacaaagtcgttatgaaagccctctggaagcaccagtttgcctggccattccgacagccagttgatgccgtcaagctcggcctcccggactaccataaaattattaaacagccgatggatatgggcaccattaaacgacggctggaaaacaactattattgggccgcatcagagtgcatgcaggacttcaatacaatgtttactaattgttatatctacaataaacccactgatgacatcgttctgatggcccagactctagaaaagatcttcctccagaaggttgcatctatgccacaggaagagcaggaattggtcgtaacaatccctaagaactcacacaagaaaggcgctaagctggctgctctgcagggctccgttacatcagcccatcaggtgccagccgtgtcttctgtaagtcacaccgctctttataccccccctcccgaaatcccgactactgtcctcaatataccacatccaagcgttatctcttcgccactactcaagtccctgcacagtgccggaccccctctgctagccgtgaccgccgctccacctgcacagcctttagctaagaagaaaggggtcaagagaaaagccgacacaaccacacctacccctactgctatcctggcaccagggtctcccgcaagtcccccaggcagcttagagccaaaggccgcaagactgccaccaatgagacgggaatccggcagacccataaaaccaccaagaaaggatctcccagattcccagcagcaacaccagtcctctaagaaaggcaaactctcagagcagctgaagcactgtaatggtattcttaaagaactcctgtctaaaaagcatgctgcatacgcgtggcccttctacaagccagtggatgccagcgccctgggactgcacgactatcatgacattatcaagcatccgatggacctttcaactgtgaagaggaaaatggagaaccgcgattaccgcgacgcccaagagtttgcagccgacgtgaggctgatgttttccaactgctacaagtacaatcccccagatcacgacgttgtggcaatggcgcgtaagctccaggacgttttcgaatttaggtacgccaagatgcctgacgagcctctcgaacctggtccgctgccggttagcacggccatgcctcctggactggctaagtcttcctcagagagttcatccgaggagtcttcaagcgaaagttcttccgaagaggaagaagaagaggacgaggaagacgaggaggaggaggagtcagagtcgagcgatagcgaagaagagcgggctcaccgactcgccgaattacaagagcaactgcgcgcagtgcacgaacaacttgctgcgctttcccagggcccaatttccaaacccaagcgaaagagggagaaaaaggagaagaaaaaaaaaaggaaggccgagaaacatcgagggcgagctggcgcagacgaggatgacaaaggaccacgggctcctcggcctccacagcccaagaagtcaaagaaagcctctggctccggcggaggatctgccgctctggggccaagtggattcggaccttccggtggaagcggcacgaaactgcctaaaaaggcaactaagactgcgcctccagctcttccgactgggtatgattctgaagaagaagaggagagtaggccaatgtcctacgacgaaaagagacagctgagtctcgacattaataaactccctggcgaaaagctaggaagggtggttcacattatacaagccagggagccctcactgcgtgactcaaaccctgaggaaatagaaattgacttcgagactctgaagccttccaccctccgagaattggaaagatacgtgctcagctgcctcagaaagaaaccaagaaaaccatataccatcaagaaacccgtcggcaagacgaaggaggagctcgccctagagaaaaaacgagaattggagaaacggctgcaggacgtgtcagggcagctgaattccacaaagaagccgcctaagaaagccaatgagaaaacagaatcatcttctgcacaacaagtcgctgtatcccggttgtctgctagcagctcatcctccgactcctcctcctccagtagcagtagcagcagcagcgatacctccgattcagattccggttag

SEQ ID NO: 216190 - DNA, 2406 bp, Artificial Sequence
  Description of Artificial Sequence: Synthetic coding sequence
atgctgcaaaacgtcacgccccataataagctccccggtgaagggaatgccggacttctgggacttggcccagaagctgctgctccaggcaaaaggataaggaaaccttccctactctatgaaggattcgagagcccaactatggccagtgttcctgctctacaactcactcccgctaatccacctccgcctgaagtgtcaaaccccaaaaaaccgggaagggttactaaccaactccagtacctgcacaaagtggtaatgaaggctctgtggaaacatcagttcgcttggccgtttcgacagccagtggacgcggtcaaactggggctgcccgactaccataaaataattaagcaacctatggacatgggaacaattaagaggaggctagaaaacaattattactgggccgcatccgagtgcatgcaggattttaatacaatgttcacaaactgttatatttacaacaaaccaaccgacgacattgtgttgatggcccagacactagagaaaattttcctccagaaagtagctagcatgccacaggaggaacaggagctggtagtcactataccgaaaaatagtcataagaaaggtgccaaattagctgcactccagggttccgtaacatccgcacatcaagtgccagctgtgtcctccgtctctcataccgccctgtacaccccacctccagaaataccaactacagtccttaacatcccacacccgtcagtgatctcctcacctctcctgaagtctctccactccgctggacctcctttgttggctgtgaccgctgcccctcccgctcaacctctggcaaagaagaaaggcgtgaaacgcaaagcggatacaactacgcccacaccgaccgccatactggccccagggtctccggcttctcccccaggatcattggagccgaaggctgccagattaccacctatgaggagggagtctggccgacccatcaagccaccaagaaaggacctgcccgattcacagcagcagcaccaatcctctaagaaggggaagcttagcgaacaacttaagcactgtaacggcatcttgaaagagttactttccaaaaagcacgccgcatacgcatggcctttttacaagcccgtcgatgcatctgctctcggactccacgattatcacgatattatcaaacacccaatggacttatcaacagtgaagaggaaaatggaaaatagggattacagagacgctcaggaattcgccgctgacgtgcggctcatgttttccaactgctataaatataacccgcctgaccatgatgtcgtggcaatggcacgcaagctgcaggatgtattcgaatttcgttatgccaagatgcctgacgagcccctcgaacctggtcctctccccgtgtccaccgctatgccacccggtttggcaaaatcctcctctgagtccagttcagaggagtcctctagtgagtcaagcagtgaggaggaagaggaagaagacgaggaggacgaggaggaggaggaaagcgaaagtagcgactctgaagaagaacgtgcacaccggctggccgaactgcaggaacagctcagggcagttcatgagcagttagccgctctgtctcagggccctatctccaagccgaagcggaagagagaaaagaaggaaaaaaagaagaaacggaaggccgaaaagcacaggggacgcgctggggctgatgaagacgataagggtcctcgtgcccctcggcctccacagcccaaaaagagtaaaaaagcttccggctccggaggaggcagcgcagccttggggccttcagggtttggtccctccggcggatctggcaccaaattacctaagaaggccacgaaaaccgcgccaccagccctgcccactggatacgacagcgaagaagaagaagaaagtaggcccatgtcttacgacgagaaaagacaactgagcctggatataaacaaactgccaggggaaaaactggggcgtgtcgtacatataatacaagccagagaaccatccctccgcgactccaacccagaggaaattgagatcgactttgaaactctgaaacctagcacactgagagaactggagcgctatgtgctcagctgcctgcggaaaaagccaaggaagccttacaccatcaagaaacccgttggcaaaaccaaagaggagttggcgctcgagaagaaaagagagctagagaaaagacttcaggatgtgtctggccagttgaacagtaccaagaagccccctaaaaaggcaaatgaaaagactgaatcaagtagtgctcaacaggtagccgtgagcaggctgagcgcctcttcttcatcctctgactcttccagttccagcagctcttcttcaagttctgatacatcagattccgactccggatag

SEQ ID NO: 216191 - DNA, 2511 bp, Artificial Sequence
  Description of Artificial Sequence: Synthetic coding sequence
atgctccagaacgtgacacctcataataagctgccaggagaaggaaatgccggtctactgggcctgggccctgaagccgctgctcctggaaagcggattcggaaacctagcttgctgtatgagggctttgagtctccaaccatggcctcggtacccgctcttcagctaactcctgccaatccccctccccctgaagtcagcaaccctaagaagccgggacgcgtgacaaaccagctgcagtacctgcacaaagtagttatgaaggccctgtggaagcaccagtttgcgtggccctttcgtcaacccgtggatgcagtgaagctcggtttgcctgactatcataaaatcataaaacagcctatggatatgggtaccataaagagaagactggagaacaattattattgggctgcgtccgaatgcatgcaggattttaatactatgttcactaactgctacatctacaacaaacctactgatgacattgtgcttatggcacagactttagaaaagatttttttacaaaaggttgcaagcatgccccaggaggagcaggaattagtggtgaccattcccaaaaactcccataaaaagggagcaaaactggccgcactacagggaagtgttacaagtgcgcaccaggtgccagctgtgagcagcgtaagtcacaccgcactttacacaccacccccagagatacctacaaccgtgttgaacatcccacacccgagtgtgatctctagtccgctacttaagtccctgcactcagctggcccacccctgttggctgtgaccgcagccccaccagcccaaccattggcaaaaaagaaaggtgttaaacgcaaagcggacacaactacacctacccctactgctatccttgccccaggttccccggcaagcccaccaggctccttggaacccaaagcagctagattgccacccatgaggagagagtctggtcgcccaattaagcctccaagaaaggacttacctgactctcagcagcagcatcagagtagcaagaagggaaagctgtcagaacagctcaagcactgcaatggcatcttgaaggagctattgagcaaaaagcatgctgcatacgcctggcccttctacaaaccagttgacgccagtgctctgggcctccacgactaccatgatattatcaagcatccaatggacctcagcacagttaagaggaaaatggaaaatcgagactatagggatgcccaggaatttgccgcagatgtccgcttaatgttcagcaattgttacaaatataatccaccagatcacgatgttgtggctatggcacgaaaactgcaggatgtatttgagttccgctacgctaagatgcccgatgagcctttggaaccaggtcccttgcccgtttctaccgctatgccccctggcttagctaaatcctcaagtgaatcctcgtcagaagaatcatcatctgaatcctccagcgaagaggaagaagaagaggatgaggaagacgaggaagaggaagaatccgaatcatctgactccgaggaggagagagcccacaggctggccgaactccaggaacagctcagagcggtccacgaacaactcgctgccctgagtcagggccctatctccaaacctaagcggaaaagagagaaaaaggaaaagaaaaaaaagagaaaagccgaaaagcaccgtggcagagcaggagccgatgaggatgacaagggccctagagcccctcgccctcctcagccaaaaaagtcaaagaaggcttcaggatctggcggtggaagcgccgctttgggaccaagcggctttggacccagcggcggatcagggactaagcttcaggcaggcgtgcaatggcgggatttgggattactgcaacctcccctgctgggattcaagagattttcgtgcctatctctgcctagctcccaggactatcggcttcccaaaaaagccaccaagaccgcaccccctgccctccccactggttatgactctgaggaggaagaggagtctcggcctatgtcatacgacgagaagcgacagttgtcgctggacatcaataagctgcctggtgaaaagttgggtagagtggtgcatatcatccaagcccgagagcctagcctgagggacagcaatcccgaagagattgagatcgatttcgagaccctcaagccatccacgttacgggagcttgaacgttatgtcctcagctgtctaaggaagaagccacgtaagccctacacaatcaaaaagcccgtgggtaaaactaaggaagagctagccctcgaaaaaaagcgagagctagagaaacgcctgcaggatgtgtccgggcagctaaattcaactaaaaagcccccaaagaaagccaatgagaagaccgaatctagcagtgcccagcaggttgccgtaagtcgcttaagcgcttcctcttcctcatctgatagctcttcctccagttcttctagttcctcctctgatacaagtgactccgattcaggatag

SEQ ID NO: 216192 - DNA, 2511 bp, Artificial Sequence
  Description of Artificial Sequence: Synthetic coding sequence
atgttacaaaacgtaaccccgcacaataaattgccaggcgaaggcaacgccggattgctgggacttggtccggaagccgctgcccctggaaaacgaatccggaaaccttcgttactgtacgaagggtttgaaagcccaacaatggcgtctgtgcctgctctgcagctcacccccgctaaccctcccccaccggaggtgtctaaccccaagaaacctggcagagtgactaaccagcttcagtacttgcataaggttgtgatgaaggccctttggaagcaccagttcgcctggccttttcgacagccagtggatgctgttaaactaggtctcccagattaccataagatcataaaacagcccatggatatggggaccatcaagcgtaggttggagaataactattattgggccgcaagtgagtgcatgcaggattttaacactatgtttacaaactgctacatatacaacaagcctactgatgatattgtactgatggcccaaaccctggagaagatttttcttcaaaaggtagcctcaatgcctcaagaggagcaggaattagtggtaacaatcccaaagaactcgcacaagaagggtgctaagctggccgctctgcaaggttctgtgacttcggctcaccaggtcccagccgtgagttcggtatcacacaccgcgctctacacccccccaccagaaatccccactactgttcttaacatcccccatccatcagtgatctcgagtccgctccttaaaagtctgcattcagccggtcctcccctgctcgccgtgacggccgctcccccagcgcagccattagctaaaaagaaaggtgttaagagaaaagccgacacaactacgccgacccccacagccatcctggctcccggtagccctgcctcaccacccggaagtcttgagccaaaagccgctagactccctccgatgcggagggagagcggtcgccctatcaagccgccacgaaaagacctcccggactctcagcagcagcatcagtcatctaagaaagggaagttgagtgaacagctgaagcactgcaatggcattctcaaagagctgctgagcaaaaaacatgcagcttatgcctggccattttacaaacctgtggacgccagtgccctgggactgcacgattaccatgacatcatcaagcaccccatggacctatctacggtaaagcgaaagatggaaaaccgagattatagagacgcacaagagtttgctgccgatgtgcgactcatgttctcgaattgttacaagtacaatccgccagatcacgacgtagtggcgatggctcggaagctgcaggatgtttttgagttccgatatgccaagatgccagacgaacccctggagccaggcccactgcccgtaagcactgccatgcctcctggcctggctaaaagcagcagcgagagttcatcagaagagtcctccagcgagtcttcttccgaggaagaagaagaagaagatgaggaagacgaggaagaagaagagtcagagtctagtgattcagaagaagaacgggcacataggctcgcagagctccaagagcagctgagggccgtgcacgaacagctggccgcactgtcccaagggcctatctcaaagccaaagagaaagcgcgaaaaaaaagagaagaaaaaaaaacggaaagcggaaaaacacaggggcagagcgggtgcggacgaggatgataaagggcctcgcgcacccagaccaccccagcccaagaagtctaagaaagcttccggaagcggcggtggcagcgccgctttaggtccttccgggttcggcccatcaggaggcagcggaacaaaacttcaggccggagtgcagtggcgggacctgggactgttacagccgccactactagggttcaagaggttcagctgcttgtcactcccatcctctcaggactatcgcctcccaaagaaggctaccaagacggccccacccgctctgcctaccggttacgacagtgaggaagaggaggagtccagacccatgtcttacgacgagaaacggcagctgagcctggatatcaataagcttcccggtgagaaactaggcagggtggttcacattatccaggcgagggagccatccctgagagacagcaatccggaagagattgagatagatttcgaaacactgaaaccttcaacattgcgcgaactggagagatatgtgcttagctgccttcgtaagaagccgcgaaaaccatacacaattaaaaagcctgtaggaaagacaaaggaggagctggccctcgagaagaagagggaattggagaagcgcctacaggacgtgtctgggcagttgaatagtaccaagaaacctcccaagaaagctaatgagaagaccgaatcctctagcgcccaacaggtggctgttagccggttatcagcttcgagttcttcctccgactccagcagcagctcttcaagcagtagttcgtcggatacaagcgattccgattccgggtag

SEQ ID NO: 216193 - DNA, 2511 bp, Artificial Sequence
  Description of Artificial Sequence: Synthetic coding sequence
atgctccagaatgtgaccccgcataacaagctgcctggagagggtaatgccggactgctcggcctggggccagaagctgctgcgccaggaaagaggatccggaagccatcgttactgtacgaaggcttcgagagtcccaccatggcctcagtgcccgctctgcagttgacccccgctaaccccccacccccagaggtcagtaaccccaagaagcctggcagagtgacgaatcaactgcagtatcttcacaaggttgtcatgaaagcgctgtggaagcatcagtttgcctggcccttccgccagccagtggatgcagtcaagttggggctgcccgattaccacaaaatcatcaagcaacccatggacatgggcacaatcaagagacgcctggaaaataattactactgggccgcatcagaatgcatgcaagacttcaacacaatgttcactaattgctacatctacaataagccaactgacgacatcgtcctgatggctcagaccctcgagaagattttcctccaaaaggtggcttcaatgcctcaggaagaacaggaactcgtagtgaccattcccaaaaattcccacaaaaaaggcgcaaaattggccgcattgcaaggcagcgtgacaagtgctcatcaggtcccagcagtcagtagcgtgagccacacagccctatacacccctccacccgaaatccctacgaccgtgcttaatattccacatccatcagttataagcagtccgctcttaaagtctctgcacagtgccggacccccactgcttgccgtgacggcagccccacctgctcagcccctggccaagaaaaaaggggtgaagcggaaggcagacacaaccacgccaacccctactgccattctcgcaccgggtagtcccgcatccccacccggaagcttagagccaaaagcagctcgcctccctccaatgcgtagggagagtgggcgaccaatcaagcctcctcgcaaagatctgccagatagccagcagcaacaccagtcctccaagaagggtaagctctctgagcagttgaaacactgcaacggcattctgaaggagttgctgagcaagaaacatgcagcctacgcatggccattctataagcctgtcgacgcgtctgctctaggcctgcacgattatcacgatattatcaaacaccccatggatttaagcacggtgaagagaaagatggaaaatcgtgactatagagatgcccaagagtttgctgccgacgtgcggctgatgttcagcaactgttacaaatacaaccccccagaccatgatgtggtggcgatggcacgcaagctccaagacgtgttcgagttccggtatgccaagatgcctgatgaacctctcgagcccggtcctcttcccgttagtacagccatgccacctggcctcgctaagagcagttcggagtcttcctctgaggaatcatctagcgagagttcctctgaggaggaggaagaagaagacgaagaggacgaggaagaagaggagagcgaaagctccgactcagaagaagagagggcacaccgtcttgctgaattacaggaacagctgcgggcagtgcatgagcaattagctgctctgtcacagggccctatctcaaagccaaagcgcaagagggaaaaaaaagagaagaaaaagaagaggaaagcggagaaacatcgcggtcgggcaggcgctgatgaagatgataagggcccaagagctccaagaccaccacagcccaagaagagcaaaaaagcctccgggtccggagggggttcagccgctcttggccctagcgggtttggcccaagcgggggttcgggcactaagcttcaggccggagtgcagtggcgggatctcgggctgctgcagcccccacttctgggattcaagaggtttagctgcttatccttaccgtcctcacaggattacaggctgccaaaaaaggccacaaaaaccgcacctccagcgctcccaaccggctacgactccgaggaggaggaggaaagcagacctatgagttacgacgaaaaaaggcagctgtccctggatatcaataagctgcctggggaaaagttgggtcgggtggtgcatattatccaagccagagagccgtctctgcgcgactccaatccagaggagatcgagattgattttgaaactttaaagcctagcacactgcgcgagctggaacggtatgtgctgtcttgcttacgaaaaaagccgcgtaagccatacacaataaagaagcctgtcggcaaaacaaaagaagagttagcccttgagaaaaagcgagaactcgaaaaaagattgcaggatgtgtcaggacaactgaactctaccaagaaaccacccaagaaagctaatgagaaaacagaatcctcctcagcccagcaagttgcggtgagcaggctgtctgcaagcagcagttccagcgacagcagcagctcatcgtcctcgagctcctcctccgatacaagcgacagcgactccggttag

SEQ ID NO: 216194 - DNA, 2406 bp, Artificial Sequence
  Description of Artificial Sequence: Synthetic coding sequence
atgctgcagaacgttacaccacataacaaactgcccggagagggcaatgccggtctgctcggtctaggccctgaggccgctgctcctgggaagcgcattcgcaaaccttccctgttgtacgagggtttcgaaagtcctaccatggccagtgttcctgcgttacagctgactccagccaatccgccaccaccagaagtatccaatcccaaaaaacctggccgtgttaccaaccaactccagtatttgcataaagtggtgatgaaggcactctggaagcaccaatttgcctggcccttccggcagcccgttgatgccgttaagctgggcttacctgactatcacaaaatcatcaagcagcctatggacatgggcactattaaaagacgactggagaataattactactgggccgcaagtgagtgcatgcaagactttaatactatgttcaccaactgctatatttacaacaaacccaccgacgatatagttctaatggcgcagaccctggagaaaattttccttcagaaggtggcatcaatgcctcaagaggagcaagagcttgtggtaacgattccgaagaacagtcataagaagggcgctaagctagcggctcttcagggctcggttacatctgcacatcaggtcccagcggtgagcagcgtgtctcacaccgcactgtacaccccaccccctgaaattccaactacagttctgaacataccacacccgtcagtcatcagcagtcccctcctgaagagccttcactctgcgggtcctcccctcctggccgttacagcagcaccacccgcacaacctctggccaagaagaagggcgtgaaaaggaaggcagacactacaaccccaaccccaactgccattcttgctccgggtagccctgcctcccctcccggtagcctagagcccaaggccgctaggctgccccctatgaggagagagagtggcaggcctatcaagcccccaagaaaggatttaccggactctcaacagcagcaccagtctagcaagaaaggcaaattgtctgaacagcttaagcattgcaatggaatcctgaaggagttgttgagcaagaagcacgcggcatatgcctggcctttctacaaacccgtggacgccagcgcactagggttacatgactatcatgacattatcaagcatcccatggatcttagtactgtgaaaaggaaaatggagaaccgcgattacagagacgcacaggagtttgccgcagatgtcaggctgatgttctctaattgttacaagtacaacccccctgaccacgatgtcgtcgcaatggcccgaaagttgcaagacgtgttcgagtttcgctatgcaaagatgccggatgagccgctagagcccggtcctctgccagtctccaccgcaatgcccccaggcctggctaagagcagctccgagtctagttccgaggaatcttcatcagagtcctcttccgaagaggaggaggaggaggatgaagaggacgaggaggaagaggagtccgagtccagcgactccgaagaggaacgtgcacaccgtctggcggaactccaggaacaactgagggccgttcacgagcagctggcagcgttatctcagggacctatcagtaagcccaagaggaaacgggagaaaaaggaaaagaagaaaaagaggaaggcagaaaagcaccgagggagagctggcgcagatgaggacgataaaggaccaagggcccctcggcctcctcagcctaagaaatccaaaaaagcgtcgggctccggaggcggaagcgcagcgcttggcccaagtggattcggtcccagcggcggttccgggaccaagttacctaagaaagcaacaaagacagcacccccagctctgcctacggggtacgactcggaggaggaggaggaatccagacccatgagctatgacgagaagagacaactgagtctggatattaataagctgcccggagagaagctgggcagggtcgtgcacataatccaggcccgtgagccatcccttagagacagcaatccggaggaaatagagatagacttcgagactttaaaaccaagcaccctccgggagttagagagatacgtgctgagctgcctgagaaagaagccccgaaagccgtataccatcaagaaaccagtgggcaagaccaaagaagagctggccctggaaaaaaagagggagctggagaaacgccttcaggatgtgagcggacagctcaactctacgaagaagcctcctaaaaaagcgaatgaaaagactgaaagctcctcagcccaacaggttgctgtgtcacgcttgtctgcctcgtcctcctcttccgactccagctcaagtagctcttcctccagttcctccgatacttccgattccgactcaggatag

SEQ ID NO: 216195 - DNA, 2406 bp, Artificial Sequence
  Description of Artificial Sequence: Synthetic coding sequence
atgctgcaaaacgtgacgccccataataaactgcccggtgaggggaacgctggccttttagggcttgggccagaggccgcagctcccggtaagcgcataaggaagccctctcttctctatgaaggtttcgagtcacccaccatggcttcagtgcctgcgttgcagctgactcccgctaacccgccaccaccagaagtttccaatccaaagaagcctggccgagtcaccaatcagttgcagtatctccacaaggtggtgatgaaggccctctggaaacatcagtttgcctggccatttagacagcctgtcgatgccgtgaaattaggattgcccgactaccataagatcattaaacaacctatggacatgggaacaattaagcggaggctcgagaacaattactattgggccgcttccgagtgcatgcaggactttaatactatgtttaccaactgttatatttataacaagcccacagatgacattgtcttaatggctcagacattagagaaaatcttcctacagaaggtggcctccatgcctcaggaagaacaggagctggtcgtcactatcccaaaaaactctcacaagaagggcgctaaattggccgctttacaaggctcagtgactagtgcccatcaggtaccagccgtgtcctccgtcagccacacagctctgtataccccaccccctgagatcccgacaactgtgctgaatatcccccatccctctgtaatctcttctccgctgctgaagtctctgcattcagccggaccacctctcctggccgtgacggccgcaccccctgcacagccattagcgaagaagaagggcgtcaagagaaaagctgacacgactacacctacaccaaccgctattctggcaccaggaagtccagctagccctccaggatctctagagcccaaggccgcacggctgcctccaatgcggagggagagcggccgacctatcaaacctccacgcaaagacttaccggactctcagcagcagcatcaatcctcgaagaaaggcaagctgtccgaacaactcaagcactgtaacggtattctgaaagagctcctttctaaaaagcacgcagcctacgcctggcccttctataaaccagtcgatgcatctgcactcgggcttcacgattatcacgatattataaaacacccaatggatttgtccactgtaaaacgcaaaatggagaacagagactaccgggacgcgcaggagttcgcagccgacgttcgcctgatgttttccaactgttacaaatacaacccccctgatcacgacgtggtggctatggctaggaagttgcaagatgttttcgagttccggtatgccaaaatgccagacgaaccccttgagcctggcccactgccggtaagcaccgccatgccgcctggcctagccaagagcagcagtgagagttcttcggaggagtcatccagcgagtctagtagcgaggaggaggaagaggaagacgaggaggatgaggaggaagaggagtccgagtcctcggattcagaagaggagcgggctcaccggctggccgaacttcaagaacagctcagagctgttcatgaacaactcgccgcactgtctcaggggccaatctccaagcccaaaaggaagcgggagaagaaagagaaaaagaagaaacgcaaagccgagaagcatagaggacgcgcaggagcggacgaggatgataaggggccacgcgctccacgtcctccccagcctaaaaagtctaaaaaggcgtcaggaagcggcggtgggtctgcagccctggggccaagtggctttggtcccagtggagggtccggcacaaaacttcctaagaaggccacaaaaaccgctcctcccgcacttcccacagggtacgactccgaggaagaggaggaaagtcgtccaatgtcatatgatgagaagagacaactgtcgctggatattaataagttgccaggcgaaaaactggggagggtcgtgcacatcattcaggccagggagccgagtctgcgagactccaatccggaggagatcgaaattgactttgagaccttgaaaccgtctaccctgagggagcttgagaggtacgtcctgtcttgtttacgcaaaaagccgagaaagccatacaccatcaaaaaaccagtggggaaaactaaggaagaactagctctagagaagaagagagagctagaaaagcgcctacaagatgtgtccggacaacttaacagcactaaaaaacctccaaagaaagctaacgaaaagaccgagagctcaagtgctcaacaagtcgccgtaagtcggttatccgcctcgtcctcttcgtccgacagctccagctcttcgtctagttcatcctcaagcgataccagtgattcagattcggggtag

SEQ ID NO: 216196 - DNA, 891 bp, Artificial Sequence
  Description of Artificial Sequence: Synthetic coding sequence
tagcgacccctgggagtgcagcagcccggtgccagacttcccggagaagggaatgcagggctgcttggtcttgggcctgaagctgcagcacccggaaagcgcataagaaagccaagcctgctatacgagggctttgaaagccctactatggcaagtgtgcccgctcttcagttgaccccagcaaatccaccccctcccgaagtatctaaccccaagaagccagggagggtgaccaatcagttgcaatacttacataaagtagtgatgaaagcattatggaagcaccagtttgcgtggcccttccgccagcccgtcgatgcagtcaagctgggtttgcccgactaccataaaatcattaagcaacccatggacatgggtactatcaaacgaagactagagaacaactattactgggctgcaagcgagtgcatgcaagacttcaacacaatgttcaccaactgttacatttataataaacctaccgacgatatcgtgctgatggcacagaccctagagaagatttttctacagaaggtggcctcaatgcctcaggaggagcaggaattggtggttactatcccaaaaaatagccacaaaaagggagcaaaactagccgcactacagggtagcgttactagcgctcaccaagtgcccgctgtttcatctgtgtcacatacggcgttatatacccctccacctgagatccctactaccgtgctcaatatccctcacccatccgtgatctcctcccccctattgaagtccctgcactctgctggaccaccactgctagcggtgacagccgctcccccagcccagcccttggccaaaaaaaagggcgtgaagcgtaaagcagacacaacaaccccaacacccactgccatactttag

SEQ ID NO: 216197 - DNA, 2406 bp, Artificial Sequence
  Description of Artificial Sequence: Synthetic coding sequence
atgttgcagaacgtcacaccccacaacaaactgccgggagaagggaacgctggcctgctggggctgggcccagaggctgctgctcccggaaagagaattcgtaagcccagtctactgtacgaaggtttcgagtctccaaccatggcctccgtaccggcactgcaacttacaccagcaaaccctcctccccctgaagtctcaaaccctaagaagcctggtcgagtaactaaccagctccagtacctccacaaagtggtaatgaaagcgctgtggaagcaccagttcgcctggccttttcggcagccggttgacgctgttaagctggggctccccgattaccataagatcatcaaacagcccatggacatgggtacaatcaagaggagactggaaaataactattactgggccgcatctgaatgtatgcaggacttcaacacaatgtttacgaattgctacatttataacaaacccaccgacgacatagtcctgatggcgcagaccttagagaagattttcttacaaaaagttgccagcatgcctcaggaggaacaggaactcgtcgtgactatccctaaaaacagccataagaaaggagccaagttggccgcactccaggggagtgttacatctgcccaccaggtccctgccgtttcatctgtaagccacaccgccttgtacacccctccacccgagattcctaccactgtattcaacattcctcatccttcagtgatttcctctcccctcctgaagtcgctacacagtgctggacctccactgttggcggtcaccgcagccccaccggcacaaccgttggctaagaaaaaaggtgtaaagcgaaaggcagacacgacgacccccacccccactgccatcctggctcccggaagccccgctagtccgcctgggagtctcgagcccaaagctgctcgcttgccaccaatgcggagagaatccgggcgaccaatcaaaccacccagaaaggatcttcctgattctcaacaacagcaccaaagctcgaaaaagggcaagctgtctgagcagctgaagcactgcaatggcatattaaaagagctactgagcaagaagcacgcagcctatgcctggcctttttataaaccggttgacgcctccgccctcggtctgcacgattatcatgatatcattaagcaccctatggacctttctactgtgaaacgcaagatggagaatagagattatcgtgacgcacaggagtttgcagccgatgttcggctaatgtttagtaactgctataagtataaccctcccgaccacgacgttgtcgccatggccagaaagctacaagacgttttcgaatttcgatatgccaaaatgccagatgaacccctggaacccggtcccctgccagtgagcactgctatgcccccagggctcgccaagtcctcctctgagtcaagtagcgaggagtcttcgtcagagagtagctccgaggaagaagaggaggaggatgaggaggatgaagaggaggaggagagcgaaagctccgacagcgaggaggagcgggctcacagactagcggagttacaggaacagctaagggcagtgcacgagcagttggcagctttgagccaggggcctatcagcaagcccaagaggaagagagagaagaaggaaaagaaaaaaaaaaggaaggccgagaaacatcgcggacgtgccggtgccgatgaggacgacaaaggcccaagggcacccaggccgccacaacccaaaaaatcaaaaaaggccagcggttccgggggaggctcagcagctctgggaccatccggcttcggccctagcgggggtagtggaacgaaattaccaaagaaggccactaaaacagccccaccagccttgccgacaggctacgacagcgaggaagaggaagagtcacggccaatgagctacgacgaaaagcggcagctctccttggacatcaataagttacctggggaaaaactcggccgagtagtccacattatccaagcaagagagccatccctgagagactccaatcctgaggagattgagattgacttcgaaactttaaagccatccacgctcagggaactggaacggtacgtgctttcatgcctcaggaagaagccccgaaagccttataccatcaaaaagccagtgggcaaaaccaaggaagagctcgcactcgaaaaaaagcgggaactcgagaagaggctgcaggatgtgagtggccagctgaattcaacgaaaaagccccctaagaaggccaatgagaaaacagagagctcatctgcgcagcaggtggctgtatcgcggctctctgctagctccagcagttccgatagtagttcctctagttcctctagttctagcagcgacacgagcgatagtgattcaggttag

SEQ ID NO: 216198 - DNA, 1842 bp, Artificial Sequence
  Description of Artificial Sequence: Synthetic coding sequence
atgctgcagaacgtcaccccgcacaacaaattacccggagagggcaatgccggattactgggtctgggacccgaggccgctgcaccgggtaaaaggattagaaagccaagcctgctgtatgaggggttcgagtcacccactatggcttccgttcctgcattgcagctgaccccagcaaacccgccacctccggaggttagcaatccgaagaagccaggaagagtcaccaatcagttgcagtacctgcacaaggtcgtcatgaaggccctgtggaagcatcagttcgcatggcccttccggcaacctgtcgatgccgtgaagctcggcctgcccgactaccacaagataattaagcagccaatggacatgggcaccattaaacgtcggttggaaaataattattactgggcagccagcgagtgcatgcaggacttcaataccatgttcaccaactgttatatctataataaacctacagatgatattgtgttgatggcccaaacactggaaaagatcttcctgcaaaaggtagctagcatgcctcaggaagaacaggagctggtggttaccatccccaagaatagtcacaaaaagggagccaagctcgcagccttgcaggggtcagttacttcagcccatcaggtgcccgctgtttcctctgtaagccacacggccctatacaccccaccacccgagatccctaccaccgtcctgaatatacctcatccctctgtcatttcttctcccttattgaaatcactgcactcagctggacccccactcttggccgtaaccgccgcaccacccgctcagccactggcgaaaaaaaagggcgtgaagcggaaggctgatacaaccacccctaccccaaccgcgatactcgctcctgggtccccagcttctccacctggatctctggagccgaaagccgctcggctgccgcctatgagacgtgaaagtggccgtccaattaagccccctcggaaggaccttcccgattcccagcagcagcatcagtcctccaagaagggcaaactgagtgaacagttgaaacattgcaatgggattcttaaagaactactgtccaaaaaacatgcagcttacgcgtggccattctacaagcccgtggacgcttctgccctgggccttcatgactatcacgatatcataaagcatccgatggatctgtccactgtcaaacgcaagatggagaatcgggattacagggacgctcaggaatttgccgcagacgtcaggttgatgttctccaactgttacaagtacaatcctcctgatcatgacgtggtcgctatggcacgaaaacttcaagatgtgtttgagttccgatacgcaaaaatgccagacgagcccctggaacctggccctctacccgtttctacagctatgccacctggccttgcaaagagtagctccgaatcttcatccgaagaaagctcgtcggagtcctctagtgaagaagaggaggaggaagatgaggaggacgaagaagaagaggagtctgaaagctccgacagcgaagaggagcgcgctcaccgccttgcggagcttcaagagcagctgcgtgccgtgcatgagcagctggctgctctctctcagggcccaataagcaagccgaagaggaagcgggaaaagaaagagaaaaagaagaagcgcaaggccgagaaacaccgcggacgcgcaggcgctgacgaagatgataaaggtcctcgcgctcctcggcctccacagcccaagaaaagtaaaaaggcctcgggatcaggaggcggttcggcagcattgggtccttccggattcgggccatccggcggaagcggcacctag

SEQ ID NO: 216199 - DNA, 1842 bp, Artificial Sequence
  Description of Artificial Sequence: Synthetic coding sequence
atgctgcagaatgttaccccgcacaataagctgccaggcgaagggaacgctggcctactgggcctggggccagaagccgctgcacccggtaaaagaataagaaaaccatctctgctttatgaagggtttgaatctcccacaatggcttccgtgcctgcactacagttgactcccgctaatcccccaccaccagaggtctctaaccctaagaagcccggacgcgttacaaatcagctacagtatctgcacaaggtggttatgaaggctctgtggaaacatcagtttgcctggccttttcgtcagcctgtggacgccgttaaactcggtttgcctgattaccacaagattattaaacagcccatggacatggggacaataaagcggagacttgaaaacaactattactgggccgcaagtgagtgcatgcaagattttaataccatgtttaccaattgttatatttacaacaaaccaacagacgacatagtcctgatggctcaaacccttgagaaaatcttcctgcagaaggtagcaagcatgccccaagaagaacaggaactggtggtgacaattccaaaaaacagccacaaaaagggcgctaagttagctgccttgcaaggatccgtgacaagtgcccatcaggtgcccgcagtttcatcagtctcccacactgcactttacactccacctcccgagattcccaccacagtgctgaatatcccacatcccagcgtgatctcctccccattgcttaagtcacttcactctgcaggacctcccctgctggccgttactgccgctccccctgctcagccacttgcaaaaaagaagggcgtaaaacgaaaggccgacacaactaccccaacccctaccgccatccttgcacccggttcccctgcaagcccaccagggtcactcgagcccaaggccgcaagactaccccctatgcgcagggaaagcggtaggcctattaaacccccacggaaggacctgcctgattcccagcaacagcaccagtcaagtaagaagggaaaattgagtgaacagctgaagcattgtaatggcatcctgaaggaattgctctccaagaaacacgcggcatatgcatggccattttataaaccggtggatgcatccgccctgggcctccacgactatcatgacataatcaagcaccccatggatttgagcacggtcaagaggaagatggagaaccgtgattatcgggatgcccaggaatttgctgccgatgtgcggcttatgttttcgaactgctacaaatacaatccacctgatcacgatgtggtcgcaatggcacgcaagctgcaggacgtgttcgagtttcggtatgcaaaaatgccagacgagcctcttgaacctggccctctcccagtgtcaacagcaatgccccctggcctcgccaagagctcctcagaatctagctccgaggaatcatccagtgagagcagttctgaagaagaagaagaggaggatgaggaagacgaagaagaggaggagagcgagagctctgattctgaggaggaacgcgctcataggcttgctgaactccaggagcagttgcgggcagtacatgaacaactggccgcattgagccagggaccgatttccaagcccaaaagaaaacgcgaaaaaaaggagaagaagaagaagcgcaaagccgaaaagcaccgagggagagctggggcagatgaggacgacaaaggtcctagggcgcctcgtcctcctcagcccaagaaatcaaagaaggcttcagggtccggcggtggatcagcagctctcggcccaagtgggttcggccctagcgggggtagtggcacttag

SEQ ID NO: 216200 - DNA, 987 bp, Artificial Sequence
  Description of Artificial Sequence: Synthetic coding sequence
tgagccaagagcagttcagagtcatcctcagaggagagctcctccgaaagttcctctgaagaggaagaagaagaggatgaagacgaagaagaagaggaaagcgagagctcagattctgaagaggagagagctcatagactcgcagagctgcaggaacagctgcgggctgtgcatgagcagctcgccgctctgtctcagggccctatcagtaaacccaagagaaagagggagaaaaaagagaagaagaagaagagaaaggcagagaaacaccggggaagagccggtgccgatgaggatgacaaaggtccacgagcccctcggccaccacagccaaagaagtccaagaaggccagtggctccggaggtggcagcgccgcactggggcctagtggcttcggtccatctggagggagtggtacaaagttaccgaagaaagccactaagaccgctccacccgcacttcccacaggatacgattccgaagaggaggaggagtccagacccatgtcttacgatgaaaagagacagctttccctcgatataaacaaattgccaggcgagaagctgggaagagtggtacatatcattcaggctcgggagccctcattgcgtgatagcaaccccgaggagatcgagatcgacttcgagaccctgaagccctctaccctcagagaattggaacgctacgtgctcagctgccttcgcaagaagcctcggaaaccctataccatcaagaagccagtaggaaaaactaaggaggaattggctctggagaagaagagggagctcgaaaagcggctgcaggacgtgagcggccagctcaatagtaccaagaagccacctaagaaggctaatgagaagactgaatctagctcagcccagcaggttgctgtcagtcgactttctgcaagctcaagctccagtgacagctcgtcctcgtcctcaagcagctcatccagtgacaccagtgatagcgatagcggatag

SEQ ID NO: 216201 - DNA, 1947 bp, Artificial Sequence
  Description of Artificial Sequence: Synthetic coding sequence
atgctgcagaacgtgacaccacacaataagctgcctggcgaggggaacgccggacttctcggccttggtccagaggccgcagctccaggtaaacggattcgcaaaccctcactgctgtatgagggctttgaatcgccgacaatggcctccgtgccagccctgcagctgacacccgctaatccacctcctcccgaggtgtccaaccctaaaaaaccaggaagagtgactaaccaactgcagtacctgcataaggtcgttatgaaagctctgtggaaacatcaattcgcctggccattccgtcagccagtggatgccgtgaagcttgggctgccagactaccataaaataatcaagcaacccatggatatgggtacgataaagaggcggttagagaataattactactgggcagcttccgagtgcatgcaggattttaacaccatgttcaccaattgctatatctacaacaagcccaccgatgatattgtccttatggcacagacactcgagaaaatatttctccagaaggtggcctctatgccacaggaggagcaagaattggtggtgactatccccaagaacagccacaagaaaggcgcaaagcttgcagcactgcagggatccgtaacgagcgcacaccaggtacccgctgtcagcagtgtttcccataccgcactctacactccacctcctgaaattcccacaacagtgttgaacattccccacccctccgtcatatcgtcccccctgctgaagtctctccattcagctggccctccactgctggcagttactgccgctccccctgcgcagccgctcgctaagaaaaaaggggtcaaaagaaaagctgatacaaccacccctactccaaccgcgattctcgcaccgggatcccctgcttccccacctggatcattagaacccaaggccgctaggctgccacctatgcggagagagtcaggaaggccaatcaaaccccctcggaaggacctcccagattcacagcaacagcatcaatcgagcaaaaagggaaaattgtctgagcagctgaagcactgtaatggcatactgaaggagctgctgagtaaaaaacatgctgcgtacgcctggccattttacaaacccgtcgacgccagcgctctaggccttcacgattaccatgatatcatcaagcatccaatggacctaagtacagtcaaaagaaagatggagaatagagactaccgggacgcccaggaattcgccgcagatgtgcgacttatgtttagcaactgttataagtacaaccctccagatcatgacgtggtggccatggctagaaaactccaggacgtctttgagttccggtacgccaagatgccggatgaacctcttgagcccggacctttgcccgtctcaactgccatgcctccaggactagctaagtcctcatctgaaagcagttcagaggaatcatcaagcgagtcaagttccgaagaagaagaggaggaggacgaagaggacgaggaagaggaagaatcagagtcctccgacagcgaagaggagcgcgctcaccgcttggctgagctccaggaacagctccgcgcagttcatgagcagctggctgctctgtctcaagggcctattagtaagcccaagcgaaagcgagagaagaaagagaaaaagaagaaacggaaagcagaaaagcatcggggtagagctggcgctgacgaggacgacaagggaccccgtgctcccagacctcctcaacctaaaaagtccaagaaagcttcagggtctggcggaggaagtgcggctctgggaccttccgggttcggtccttccggaggatccggaacaaaactccaggccggtgttcagtggcgcgatctgggcctccttcaaccacctttactcggatttaaaaggtttagctgtctgtcccttccgtctagccaggattactag

SEQ ID NO: 216202 - DNA, 2424 bp, Artificial Sequence
  Description of Artificial Sequence: Synthetic coding sequence
taaaacggaggtgggggatcagccaccgcgaggggcggagagtacagactccccggtgaggggaatgctggcctgctgggcctcggtcccgaagccgctgcccctgggaaaaggatccgcaaaccttcgctgctttacgagggcttcgagtcaccaaccatggcctctgtgcccgcactgcagttgacaccagccaatccaccgccacctgaggtgtctaatcccaagaaacccggtcgtgtgacaaatcaacttcagtacttgcacaaagtcgtaatgaaggctctgtggaagcatcagtttgcctggccatttcggcagcccgtggatgcagtgaagctggggcttcctgattaccataaaattattaaacagccaatggatatgggtaccataaaaagacgcctggagaataattattactgggccgctagtgagtgcatgcaggactttaacaccatgttcaccaattgctatatatacaacaaacctacagacgatattgtactaatggcacagaccctcgagaaaatcttcctgcagaaagtggccagtatgccacaggaagaacaggagttagtcgttactattccaaaaaattcacacaaaaaaggagccaagctggccgcattgcagggctctgttactagcgcccatcaggtgcccgctgtatcttctgtcagtcatacagccctctacactccccctccggaaatcccaaccaccgtctttaacattccacatccgagcgtgataagcagccccttgctgaaatctctccactctgcgggacctcccttgttagctgttactgcggcaccccctgcccagcctctcgccaaaaagaaaggggttaaaagaaaggccgacaccaccactccgacacccactgctattctcgcccctggctcaccggcaagcccccctggaagtctagagccgaaggcagccagactgccccctatgaggagagaaagcggcagacccattaagcctccacggaaagacctgcctgacagccagcaacagcaccaatccagcaaaaaagggaagttatccgagcagctgaaacactgtaacgggatcctcaaagagctcctttctaaaaaacacgctgcgtatgcttggcctttctacaaaccagtggacgctagcgccctaggcctacacgattaccacgacattatcaagcaccctatggacctgtcaacagtgaaaagaaaaatggaaaaccgcgactacagggacgcccaggaatttgcggctgacgttcgtctcatgttcagcaattgttataagtacaatccccctgaccacgacgtggtggcaatggctcgcaaactgcaggacgtgttcgagttccgatacgctaagatgccagacgagcccctggagcctgggccattgcctgtgagcacagccatgccccctgggctcgcgaagtctagttccgagtcatcctctgaggagagcagcagcgagagctcatccgaggaagaggaagaggaggacgaggaggacgaggaggaagaggaatcagagagttcagactcggaagaggagcgagctcaccggctcgctgagttgcaggagcaactgagggccgtgcacgagcagctcgccgcactgagtcagggccctatttcgaagccaaagcgtaagagggagaaaaaggagaagaagaaaaaacggaaggccgagaaacaccgcggaagggctggcgctgacgaagacgataaaggcccaagagccccacgccctcctcagccaaagaaaagcaagaaggccagcggtagtggcggtggctcagccgctctggggccaagcgggtttggcccatccggagggtccgggactaaactccctaagaaggccactaagacagctccgccagcactgcctacaggatacgatagtgaggaggaggaagaatccaggccgatgagttacgatgagaagcgccaactgagcctcgatattaataagcttcccggagaaaagctggggcgagtggttcacatcatccaagccagagagccatctctgcgggactccaatcctgaggaaattgaaattgactttgagaccctcaagccaagcacactgagggaacttgagcggtatgtgctctcttgcctgagaaaaaagccacgcaagccctataccatcaaaaaaccagtcgggaagacgaaagaggaactggcgctagagaagaagcgcgaactcgaaaaacggctccaggatgtgtccggccagttgaatagcactaaaaaacctcctaagaaggccaacgaaaaaacagagagctccagtgcccagcaggtcgctgtcagcaggctgtctgcatccagcagttcttctgactcatcaagtagttccagttcttcatcgtcatccgacactagcgactcagatagtggatag

SEQ ID NO: 216203 - DNA, 891 bp, Artificial Sequence
  Description of Artificial Sequence: Synthetic coding sequence
tagcgccctttgggcgtccaacaacccggagcaaggctgcccggagaaggaaacgcaggcctcttggggctaggtcctgaggctgccgctccaggcaagcgcattcggaagccttccctgctctacgaagggttcgaaagccctactatggcctcagttcccgcactgcagctgacccccgcaaatccaccaccccctgaggtttctaatcccaaaaaaccaggcagagtcacgaaccagctccaatatttgcataaggtggtgatgaaggctctgtggaaacaccagttcgcatggcctttccggcagcccgttgacgctgtgaagctaggcttgcctgattaccataagatcataaaacagcctatggatatggggacaataaagagacggttagagaataactactactgggccgcaagtgaatgcatgcaggactttaacactatgttcacgaattgctacatttataacaaaccaaccgatgatatcgtactcatggcccagaccctagagaaaattttcctgcaaaaagtggccagcatgccgcaggaagaacaggagctcgtggtgactatccctaagaattcgcacaagaagggcgctaaactcgccgcactgcaagggagcgtgacctccgcgcaccaggtcccggctgtttcttcggtgagccacaccgccctgtacaccccaccaccagagatccctaccacagttttcaacatcccgcacccttctgtgatttcgagtcctttgttaaaaagcctgcacagcgcaggcccaccacttcttgccgtcacagccgcaccccctgctcagcccctcgcgaaaaaaaaaggcgttaagcggaaggcagataccaccactccaacacccaccgccatcctgtag

SEQ ID NO: 216204 - DNA, 2265 bp, Artificial Sequence
  Description of Artificial Sequence: Synthetic coding sequence
atggcttcagtccccgcacttcagttaacgccagctaatcccccacccccagaggtgtccaatccgaaaaaaccgggacgcgttaccaaccagcttcaatacttacacaaggtggtcatgaaggctttatggaaacaccagtttgcttggccattcagacaacctgtggatgcggttaagttgggcctgccagattatcataaaatcatcaagcaaccaatggacatgggcactatcaaacgacgccttgagaacaactactattgggccgcaagcgaatgtatgcaggattttaataccatgttcactaattgttatatttataataagcctactgacgatatcgtcctaatggctcagacactagagaaaatatttctccagaaagtggcctccatgccacaggaagagcaagagctggtagttaccatccctaagaacagtcacaagaagggagccaagttggccgcactgcaaggctcagtgacctccgctcaccaggtgcccgcagtgagttcagtctcacacaccgcgctctatacgccccctcccgaaatcccaaccaccgtgctgaacatcccccacccctccgtcataagtagtcccttactcaaatccttacattctgccggtccgccactgctggccgtcacagctgcccctccagcacaacctttagcaaaaaaaaaaggagttaagaggaaggcggacacaaccacccccacacccaccgcgattctggcccctggatcacctgcctcaccgcctggatcactcgagccgaaggcagccagactcccaccaatgaggagggaatcaggcaggcccattaagcctccccgtaaggacttacctgactcacaacagcagcatcaatcatccaagaagggaaagctgtcagagcaactgaaacattgcaatgggatccttaaagagctactgtctaaaaaacacgccgcttacgcctggcccttctacaaacccgtggatgccagcgccctcgggttgcacgattaccacgatataattaaacatccaatggacctgtctacagtgaagcgcaaaatggaaaatcgagattatagggacgcacaggagttcgcagccgacgtcagactgatgttttcaaattgttacaaatataaccctccagatcacgatgtagtggccatggcccgaaagctccaggatgtgttcgaatttagatacgccaaaatgcctgatgaacctctggagcctggaccactgccggtgtctacggccatgccccctggtcttgcaaagagttcctctgagagcagctccgaggagagcagcagtgaatcctcttctgaggaagaggaggaggaagacgaggaagatgaggaggaggaggaatctgaatcgagtgacagcgaagaggagagagcccatagactggccgagctgcaggagcagttgcgcgcagtgcacgaacagctggcagcgctttcccagggcccaataagcaagcccaagcggaaacgcgagaaaaaagagaagaaaaaaaagcggaaggcagaaaaacatcggggaagggcaggagctgacgaggacgacaaaggcccaagggcacccaggcccccacaaccaaaaaagagcaaaaaggctagtggaagtgggggaggctctgctgcacttgggccttctggtttcggtccatccggtggcagcggcactaagctccccaaaaaagccactaagacagcgccacccgctctccctaccgggtacgacagcgaagaagaggaagaaagtcgccctatgtcctatgacgaaaaacgtcagctttccctggacattaacaaactgcctggcgaaaaacttggcagagtcgtccacattatccaggccagggagccatcattgagagattccaaccccgaagaaattgagattgactttgaaaccttgaagcctagcactttgcgcgaactggagagatacgtactgtcttgcctcagaaagaagccaaggaagccatacacaattaagaagcccgtgggtaagactaaagaagagcttgccttggagaaaaagcgggaactggagaagcgcttacaggacgtgtccggacaattgaatagcacaaagaaacccccaaaaaaagctaacgaaaagacggagagttctagcgcccaacaggtagccgtgagccgtctctctgccagttcgtccagctccgactcatccagcagttcttcctcctcgagtagctctgacacctcagatagtgattccggatag

SEQ ID NO: 216205 - DNA, 2406 bp, Artificial Sequence
  Description of Artificial Sequence: Synthetic coding sequence
atgctgcagaacgtgacgcctcacaataagcttcccggtgagggtaacgctggactgttaggtttgggacccgaggctgctgcgcctggcaaacgcattagaaaaccctccctgctgtacgagggattcgaatcgcccaccatggccagtgtgcccgctctgcaactgacacctgccaaccccccacctccagaagtttccaatcctaagaaacccggacgggtgactaatcagctgcagtacctgcataaggtggtaatgaaggccctctggaagcaccagttcgcatggccattcagacagcctgtggacgctgtcaaattgggcctgcccgactaccacaaaataatcaaacagcctatggacatggggaccataaaaaggcgcctggaaaataattattattgggctgccagcgaatgtatgcaggacttcaacaccatgtttaccaactgctacatttataacaagcctacagatgacattgtcctgatggcgcagacgttagaaaagatttttctgcagaaggtcgcatccatgccccaggaggaacaagaattggtggttacaatcccgaaaaatagccacaagaagggggcaaaactggctgcactgcagggtagcgtcacgagtgctcatcaagtcccagccgtgtctagcgtgagccacaccgctctgtacacccctccacctgaaattccaactaccgtcctgaacattccacacccgagcgtcatctcttccccactcctcaaatccttacacagcgcgggtccaccactccttgctgtcacagcagctccaccagcccaaccactggccaaaaaaaaaggcgtgaaacgaaaggccgataccaccacaccaactccgactgctatcctggcaccgggaagtcctgctagccctcccggaagcctggagcccaaggcagcccgtctgcctccaatgagaagagagtccggccgaccaattaagcctcctcgaaaagatcttccagacagccaacagcaacaccagagtagtaagaaagggaaactgagcgagcagctgaagcattgcaacggaatactaaaggaactgttgtcgaagaagcacgccgcttatgcctggcctttctataagccggtagacgccagcgccctgggcctgcacgattaccacgatattataaaacaccccatggatctctccaccgtgaagcgtaaaatggagaatcgtgactaccgggacgctcaggaattcgccgcagatgtacggcttatgttctccaactgctataaatacaatccaccggatcacgacgtcgtggccatggccagaaagctgcaggacgtcttcgagtttcgctatgctaagatgccagacgagccgttggagcctggcccattgcctgtctcaacagccatgcctcccggactggctaagagttcctcggaatcatcgtctgaagagtcttcgtccgaaagcagctcagaggaagaagaggaagaggacgaagaagatgaggaagaagaagaatcggagagcagtgacagtgaggaggagcgggcacatcgcctggccgagctgcaagagcaactccgggctgtgcacgagcagctcgctgccctttcccaggggccaatctccaaacctaaaagaaagcgcgagaaaaaagaaaaaaaaaaaaagaggaaggctgagaaacaccggggacgggctggagctgatgaggatgacaaaggacctagggcacccagacctccacaacctaagaagagcaaaaaggccagtggctctggcggtggctctgccgcactaggtcctagcgggttcgggccaagcgggggttctggaactaagcttccgaaaaaggctaccaagaccgcaccacccgctttgccgaccgggtacgatagcgaagaagaagaagaaagccggcctatgtcttatgacgagaaaaggcagctgagcctagatataaataagctccccggtgaaaagctgggcagggtggtgcacatcatccaggctcgggagccctccctccgcgacagcaaccccgaggagattgagattgactttgagactctcaaaccaagcacgctgcgcgaactggaacggtacgttctgagttgcctgcggaagaaacctcgcaagccttataccatcaaaaaacctgtcggcaagacaaaggaagagctggccctagagaagaagcgtgagttggagaaaaggctccaggacgtgagcggtcagctcaactctaccaagaagcctcctaagaaagctaacgaaaaaaccgagagcagctctgcacagcaggtggcagtgagtaggctgtccgccagctcttcctctagcgatagctccagttcctcctcatcatcatcctcgtctgatacatctgattctgactccggctag

SEQ ID NO: 216206 - DNA, 2424 bp, Artificial Sequence
  Description of Artificial Sequence: Synthetic coding sequence
tgaaatggagggggtggctcggcaactgctcggggaggtgagtaccggctccctggtgaaggtaatgccggattgctgggactcggtccagaggccgcagctcccggaaaacgcatcaggaagccaagtctcctgtatgagggattcgaatccccaaccatggctagcgtgcctgcactccagctgaccccagccaaccccccaccacctgaagtctcaaaccctaagaagcccggaagggtgaccaatcagctccagtatttacataaggttgttatgaaagcactctggaagcatcagtttgcctggcctttcaggcagcccgtagacgcggtgaagctaggtctcccagattatcacaaaattattaaacagccaatggatatgggcaccatcaaacgtaggctagaaaacaactattactgggccgcttccgaatgtatgcaagactttaacactatgttcacaaattgctacatctacaataagcctactgacgacattgttttgatggcccagaccctcgagaaaatcttcctgcagaaggttgcttctatgccacaagaggagcaagagctcgtggtgactataccaaaaaatagtcataaaaaaggcgctaagcttgcagccctgcaggggtcagtgacttcagcccaccaggtgcccgctgtgtcctctgtcagtcacactgctctctacacccctcctccagaaatacccaccacagttttaaacataccacacccgtcagttatatctagtccgttgctgaaatccttacatagtgccggtcctcccttactagcagtgactgccgctccccctgcccagcctcttgcaaaaaaaaagggtgtgaagaggaaggcggatacaacaacccctacacccaccgcaattctcgcgccagggtcacctgcctctccgcctggttctcttgagcctaaggccgcacgccttccacccatgcgtcgcgaatccggcagaccaatcaagccccctaggaaggatctgcctgatagtcagcagcagcatcagagcagcaaaaaagggaaactgtcagagcaactgaagcactgtaacgggatactgaaggaattgctaagcaaaaaacacgccgcttacgcctggcctttttataagcctgttgatgcctctgccctcggcctccatgactaccacgacattattaaacatcctatggatcttagcacggtcaagcgtaagatggagaatcgggactatcgagacgctcaggaatttgctgctgacgtgagactgatgttcagtaactgctataagtataacccccctgaccacgatgtggtcgccatggcacgaaaattgcaggatgtctttgagtttagatatgctaaaatgcctgatgagcccctggaacctggccctttgccagtgtccaccgccatgcctccaggcctggccaagtcatcgtctgaaagcagttccgaagagagctctagcgagagctcctccgaagaggaagaagaagaagacgaggaggatgaagaagaagaggagtctgagtcctccgacagtgaggaggaacgcgcacaccgccttgccgaactgcaggagcagctcagggccgtgcacgagcaacttgcagcccttagccagggacctatcagtaaaccaaaacggaagagagaaaagaaagagaaaaagaaaaaacggaaggctgaaaaacatagggggagagccggagccgacgaagacgataaagggcctcgagccccacgaccacctcagccaaaaaaatctaagaaggccagcgggtcgggtggcggaagcgctgccctgggaccaagcgggttcgggccttcaggtgggtccggcacaaaactgccgaagaaggctaccaaaacagcaccacccgctctgccaactgggtacgatagtgaggaggaggaagagagtcgccctatgagctatgatgagaagcgacaactgtcattagacattaacaagttaccaggcgaaaagttaggaagagtcgtacacattatccaggcacgtgaacccagtttgagggattcgaaccctgaagagatcgagatcgactttgagaccctgaagccatccactttgagggagctcgaaagatacgttttatcttgtctgcgcaaaaagccgaggaagccatacacaataaagaagcccgtggggaagacaaaggaggagcttgccctcgagaagaagagagagctcgaaaagaggcttcaggacgtttctggccagctcaactctactaaaaagccgcctaaaaaagctaatgagaagactgaatcatcctccgctcagcaggtggctgtcagcagattaagtgctagttcctcttcgtcagacagctccagctcctcttctagttcatcatcctcagacacaagcgacagcgattcagggtag

SEQ ID NO: 216207 - DNA, 1092 bp, Artificial Sequence
  Description of Artificial Sequence: Synthetic coding sequence
tgagcaaagtcctcctcagaaagcagttccgaagaaagcagctctgagagctcgtccgaggaggaagaagaagaagatgaggacgaagaggaagaggagtccgagtcaagcgattccgaagaagaaagagcccatagactcgctgaacttcaggagcaactgagagccgtgcacgagcagctggccgcactttcccaagggccaatctccaagccgaaacggaagagggaaaaaaaggaaaagaagaaaaagcggaaagccgaaaagcaccgagggagagctggtgccgatgaggatgacaagggccctcgggctccaaggccgcctcagcctaaaaagtcaaagaaggctagcggttctggtggcggaagcgcagccttaggcccatctggctttggcccatctggcggaagtgggaccaagctgcaagctggggtccagtggcgagatctgggtcttcttcagcccccactgctggggttcaagcggttttcctgccttagtttaccatcctctcaggactatcggctaccgaagaaggcaacaaagaccgctccacccgcactgccaactggctatgactctgaggaggaggaagaaagtcggccaatgagttatgacgaaaaacggcagctttcactcgacattaataagctgcccggagaaaaactggggagggtcgtacatatcatccaggccagggagcctagtctgagggatagcaatccagaggaaatcgagatcgatttcgagacactcaaacctagcactctccgggagctggagaggtatgtgttgtcctgtcttcgcaagaagccgcgtaagccctacactattaaaaagcccgtcggaaaaacaaaagaagagttggcactagagaaaaagcgagagctggagaaacgcttgcaagacgtgtcaggccagttgaactccaccaaaaagccaccaaagaaggctaacgaaaaaaccgagtcaagctccgcgcagcaggtggcggtgtctcgcctcagcgcaagctcatctagcagtgattcatcttctagctcctcgtcgtcaagtagttccgacacgagcgatagcgattccggctag

SEQ ID NO: 216208 - DNA, 2511 bp, Artificial Sequence
  Description of Artificial Sequence: Synthetic coding sequence
atgttacagaacgtaacaccgcataataaactgcccggagaagggaatgcagggcttctagggctggggccagaggctgccgctccaggtaaacgcatccggaaaccttccttattgtacgagggattcgagagccccacaatggcaagtgtgccagccctccagctgactccagcgaatccccctcctccagaggtttcaaatcccaaaaagcctggacgggtgactaatcagctgcagtacctgcacaaggtagttatgaaggccctttggaagcaccaatttgcttggccctttcggcaacctgtggacgctgtaaagttgggcctgccagattaccataaaatcattaaacagccaatggacatgggcactatcaagcggaggctcgaaaacaattattattgggcagcctctgaatgtatgcaggactttaataccatgttcaccaactgctatatctataataaaccaaccgacgacatcgtcctgatggcccagaccttggaaaaaatttttcttcagaaagtcgcctcgatgcctcaagaggagcaggagttagtagtaaccatacccaagaatagtcacaaaaagggcgcaaagctggcagccttgcagggttccgtcaccagcgcccaccaggtgcccgctgtgagcagcgtctcgcatacagctctatacacacctcctcccgaaattccgactacagttctgaatatcccccacccatctgtgatttcatcaccgctcctgaagtcattgcatagcgccggaccaccactgttggctgtgaccgccgctccccctgctcagcctctggcaaaaaagaaaggagtcaagcgcaaggcagatacgaccacccctaccccgaccgccattctagcacccggaagtccggcttctccgcctggtagtctcgaaccaaaagccgcacgcctgcctcctatgaggagagagagtgggcgacctatcaaacccccacgtaaagaccttcccgactctcagcagcagcatcagtcctccaagaaaggaaaactcagcgagcagcttaagcactgtaacggaatcttaaaggaactgctgtccaaaaagcatgccgcatatgcctggcctttttacaaaccagtcgatgcatctgcactcggactccatgattaccacgacatcatcaagcacccaatggacctctcgactgtcaaacgcaagatggaaaacagggactatcgggatgcgcaggagttcgctgcagacgtccggctgatgttcagcaattgctataaatacaatcccccagaccacgacgtggtggccatggctagaaagttgcaagatgtgtttgaattccggtacgcaaagatgccagatgagcctctggagcctggcccactcccagtttccacggccatgccccctggcttagcaaagtcgtcatcagagtcctcatccgaagaaagctcgtctgaatcgagcagtgaggaggaagaggaagaggatgaagaggacgaagaagaggaggaatcagaatcatctgactctgaagaggagcgcgctcatcgtcttgcggaacttcaagaacagctccgtgcagtacacgagcagctagctgcactgtcacaaggaccgattagtaagccgaagcgcaagagagagaagaaggagaaaaaaaaaaaacgtaaagccgagaagcataggggaagggccggagctgatgaggacgacaaaggacccagagctcccagaccacctcagcccaaaaagtctaaaaaggcatccggaagcggcggtggctcagcagccctgggcccaagtggatttggacccagcggaggcagtggaaccaaactccaggctggtgtgcagtggagagacctcggcctcttgcagcccccactcctgggattcaagaggttcagctgtctgtctcttccgagctctcaagactatcggctcccaaagaaggccactaagaccgcccctccggctctgcctactgggtacgacagcgaggaagaggaggagtccagacctatgtcatacgacgagaagcgacagctctcccttgacatcaacaaacttccaggggagaaactgggtagggtcgtccacatcattcaagctagggagccgtcattgagagatagtaatcccgaagagatcgaaatagacttcgagactctgaagccctctacacttagagagttggaaaggtatgtactgtcttgcttgcggaaaaaaccccgtaagccctacaccatcaaaaagccagtggggaaaacaaaagaggaactggccctggagaagaaacgggagcttgagaaacgactccaggacgtctctggacagctgaattctaccaaaaagccccctaaaaaggctaatgaaaaaaccgagagttcgtctgcccaacaagtggctgtgtccaggctgagcgcatcttcctccagtagcgactcatccagctccagctcaagtagctcatccagcgacacatcagactccgacagcggatag

SEQ ID NO: 216209 - DNA, 2046 bp, Artificial Sequence
  Description of Artificial Sequence: Synthetic coding sequence
atggacatgggaactatcaagcgtaggctggaaaacaactactattgggccgcttccgagtgcatgcaggacttcaatactatgttcactaattgttacatctataataagcctacggatgatatagttttaatggcccagactctagagaagatttttcttcagaaggttgcctccatgccccaggaagagcaagagctggtggtcactataccgaagaactcacacaagaagggggctaaattagctgctcttcaggggtctgtcacatctgctcatcaagtcccagcggtgagcagtgtctcccacacagcactgtacacccccccacctgaaatccctactactgtcctgaacatccctcatccttctgttatttccagtccactcctcaagtcccttcactcggccggacctccactcttggctgtgactgctgcccctcccgcacagccgttagccaaaaaaaagggcgtgaaaaggaaggcagacactaccacccccactcccactgctatcttagccccaggatctccagcaagccccccaggctcgctcgaaccaaaggccgctaggcttcctccaatgagaagggagtccggtcgccctattaaacccccacggaaagacctcccagattcccagcagcaacaccagtctagtaaaaaaggaaaactttcagaacaacttaaacattgtaatggtatactgaaggaactactcagcaaaaagcatgccgcttacgcgtggcccttttacaagcctgtggacgcaagtgccctgggtctgcatgactaccacgacataattaaacatcctatggacctgagcacagtgaagagaaagatggagaaccgggattacagagacgcacaagagttcgctgcagacgtgcggctgatgttctcgaattgctacaagtataatcccccagaccacgatgtagtggccatggcccgaaaacttcaggacgttttcgaatttaggtatgctaagatgcccgacgagcccctggagcccggacccctgcctgtgtcaacagcaatgcctcctggcctagccaaatcatccagtgagtcttcttctgaagagtcttcatcggaatctagctccgaggaagaggaggaagaggacgaggaggatgaggaggaggaggagtcagagtcctccgattccgaagaagagagagcccaccgcttagccgaactgcaggaacagctgcgggcagtacatgagcagctggctgcactgtcccagggacctatctcgaagcctaagcgcaagagggagaagaaagaaaagaaaaagaagcgtaaggctgagaagcatcggggtagggccggagctgacgaagacgataaaggtcctagggccccacggcctccacaacctaagaagtccaagaaagctagcgggtcgggaggagggagtgcagctctgggaccctctgggtttggaccctccggaggttcggggaccaaacttccaaaaaaagcgacaaaaacagctcccccagcactgcccactggctacgattcagaagaagaagaagagtcacgtcccatgtcctacgatgaaaaacggcagttaagtctggatattaataaactgccaggagaaaaactaggtcgggttgttcacatcattcaggccagggagccttcccttcgggattcaaatcctgaggaaatagagatcgatttcgagacactgaagccctccacattacgtgagctggagaggtacgtgctgtcatgtctgcggaaaaaacccaggaagccttatactattaaaaaaccggtgggtaaaacgaaagaggagctggctctggagaagaagcgtgagctcgaaaagagactgcaggacgtttccggacaactaaatagcactaagaagcccccaaaaaaggccaacgaaaagacagagtcttcatcggcccagcaagtggctgtcagtagactatctgcttcctctagttcatcagactcctccagttctagctctagtagcagcagcagtgacacaagcgactcggactcagggtag

SEQ ID NO: 216210 - DNA, 2424 bp, Artificial Sequence
  Description of Artificial Sequence: Synthetic coding sequence
taaaatggaggagggggaagcgccacggcccgaggcggagaatatcggctgccgggagaaggtaatgcgggacttctgggtctggggccagaagctgccgctcctgggaaacgaattagaaagccatccctcttatatgaaggttttgaaagtcccacaatggcctccgtgcctgccttgcagctcaccccagccaacccccctccccctgaggtctctaatcctaaaaagcctggcagggtcaccaatcagctgcagtacctgcataaggtggttatgaaagccctctggaagcaccagttcgcatggccatttagacaaccggtggatgcagtcaagcttggtctgcctgattaccataagataatcaagcaaccaatggatatgggtaccattaagagacggctggaaaacaattattattgggcggcatcagaatgcatgcaggattttaacaccatgtttacaaattgttacatttataacaagcccacagatgatatagttctcatggcacagaccctggagaaaattttcctgcaaaaggtggcgtccatgccccaggaggagcaggaactggtagtaacaatacccaagaatagccacaaaaagggggctaaacttgcggcactgcagggctctgtgacatccgctcatcaggtgccagccgtgagctctgtctcacacactgccttgtatactccaccccctgaaattccgacaactgtgctgaacatcccacatccctccgtgatctcatccccccttctgaaatccctgcattccgccggtcctccgctcctagccgtcaccgctgcccctcctgcgcagccactggccaagaaaaagggcgtgaaacgtaaggccgacacaacaacacctacccccacggcgattctggcgcctggatcaccagcttctcctccgggatccctggaaccaaaggccgctagattgccaccaatgcgaagggaaagcggcagacctatcaagccgccacgcaaagacctccccgacagtcagcaacagcaccagtcaagtaaaaaagggaagcttagtgaacagctgaaacactgtaatggcatactaaaagagttgctatccaagaaacacgcagcctacgcatggcctttttacaagcctgtggacgcaagtgctctcggtctacacgattaccacgacataatcaagcaccctatggatctgtcaaccgttaagcggaagatggagaatcgcgactatagggatgcacaagaattcgccgctgatgtaaggctgatgttctcaaattgctacaagtacaaccctcctgatcacgacgtagtcgccatggcccgtaagttacaggacgtattcgagtttcggtacgccaaaatgcctgacgagcctctggaaccagggcctctgccagtgtccacagcgatgccacctggtctggcaaagtccagctccgagagttcctcggaggagtcctcttctgaatcctcctccgaggaggaggaggaagaggacgaggaggacgaggaggaggaggagtcagagtcctccgactctgaagaagaaagagcacaccgcctggctgagttgcaggaacagctacgcgctgtgcatgagcagttagccgcacttagccagggacctatcagcaagcctaagcgcaagagggagaagaaggaaaaaaagaagaaacgaaaggctgaaaagcaccgtggacgagcaggggctgatgaggatgataaagggcctagagcaccccgtccaccacagcctaagaagagtaagaaggcgagtgggtctggaggcggatccgccgcactcggaccgtctgggtttggaccgagtgggggaagcggtacaaagttacctaagaaggccaccaaaaccgcccctcctgccctgcctacggggtatgatagcgaagaggaggaggagagtaggcctatgagctacgacgagaagcgacagctgtcccttgacatcaataagctcccgggtgaaaagctggggagagtggtgcacataattcaggctagagagccatcgcttagagacagcaatcccgaagagatcgagatcgatttcgaaacccttaaaccctcgacactacgagaactggagcggtacgttctgtcatgtcttcgcaagaaaccacggaagccatacaccatcaaaaaacctgtaggcaaaacaaaagaggagctggctcttgaaaagaagcgggaactggaaaagagactgcaggatgtttcgggccagttaaattccacaaagaaaccgccaaaaaaggccaacgaaaaaacagaatctagttcagcacagcaagtcgctgtctctcggttaagcgctagctcctcgtcctcagactcttccagcagcagcagctcgtccagttcctccgacactagcgatagcgattcaggttag

SEQ ID NO: 216211 - DNA, 987 bp, Artificial Sequence
  Description of Artificial Sequence: Synthetic coding sequence
taagccaaatcatcaagtgagtccagtagcgaggagagctcaagcgagtcatcctctgaagaggaagaggaagaagatgaagatgaagaggaggaggagtccgagtcttcagactcggaagaggaaagggctcataggcttgcggagttgcaggagcaactgcgggcagttcatgagcagctcgccgctctgtcacaaggacccattagtaagccaaaacgcaaaagggaaaagaaagaaaagaaaaagaagcgcaaggcagaaaagcatcgcggaagggccggtgccgacgaggatgacaaaggaccacgggcaccgaggcctccccagcctaaaaagagcaagaaagcgagcgggagtggaggcggtagcgccgcactggggcctagcgggttcggtccatccggcggttccggcactaagctccctaagaaggcaacaaagactgcccctcccgctttgcccacaggatatgactcagaggaggaagaagagtcccgccctatgtcttatgacgagaagagacagttgagtctggacatcaataagttgcccggagaaaagcttgggcgagtggttcacattatccaagctcgggagccctccttacgcgactctaatcctgaggaaattgaaatcgactttgaaacattgaagccgtcaacgctgcgagaactggagagatacgtgctgtcttgcttgcgtaagaagccaaggaaaccctatactatcaagaagcccgtggggaaaactaaggaagagctggctctcgaaaaaaagcgcgagctcgaaaaaagactgcaggatgtcagcgggcagctcaacagcacgaaaaagcctcctaagaaggctaatgagaaaaccgagagctcatctgcccagcaggttgccgtgtcaaggttgagtgcaagtagtagctccagcgattctagttcttcctctagctcatcttctagctctgatacctctgactctgattcaggctag

SEQ ID NO: 216212 - DNA, 2511 bp, Artificial Sequence
  Description of Artificial Sequence: Synthetic coding sequence
atgcttcagaatgtgacgccgcacaacaagctgcctggtgagggaaatgcaggtcttctgggattaggcccagaggcagcagctcctggaaagagaatcaggaagccttcactgctgtacgaaggattcgagagtcccacaatggcaagtgtacctgctcttcaactgactcctgcaaatccaccccctcccgaggtgagcaaccctaaaaaacctggccgagtgaccaaccagctccaatatttgcacaaagtggtgatgaaggcgctctggaagcatcagtttgcctggccgtttcggcagcctgtggatgctgtcaaactcggcctgcccgactaccataaaatcatcaaacaacccatggacatgggaactatcaaacgacgcctagagaataattactactgggccgcatcggagtgcatgcaggactttaacaccatgttcacaaactgctacatctataataagccaaccgacgatattgtgttgatggctcagacgctggagaaaatctttcttcagaaagtggcctcaatgcctcaagaagagcaggagctcgtggtaacaatacccaagaacagccacaaaaagggagctaagttggcagctcttcagggctctgtgacctcagcacatcaggttcctgccgtatcttccgtgtctcacaccgcgctgtatacaccccctcccgagatccctactaccgtgttgaacatcccccatccatctgtcatcagctccccacttctgaaatcactccacagcgccggaccacccctcttagccgttactgctgcccctcccgcacagcccctcgcaaagaagaagggagtaaagaggaaggccgacaccacaacacctactccgacagcgatcctggctcctggcagcccagcatctccccctgggagcttggagcccaaggccgcacgccttcccccaatgaggcgcgaaagcggtcggcctatcaagccgccaagaaaggacctgccggactcacagcaacagcaccagtctagcaagaagggaaaattatctgagcaattgaagcactgcaacggcatcttgaaggagttgctgtcaaaaaagcacgctgcctacgcttggcctttctataaacccgtagacgcgagtgctctcggcctgcacgattaccacgatattataaaacacccaatggacctttctacagtcaaacgaaagatggagaaccgagattatcgcgacgctcaggagttcgcggctgacgtacgactgatgttctctaattgctataagtacaatccccctgaccacgatgtggtggctatggcacggaagcttcaggatgtcttcgaattccgatacgccaagatgcctgacgaaccccttgagccagggcctttacccgtgtctacagcgatgcctccaggcctggccaaaagctctagcgaatcctcatctgaggagtcttccagcgagtcctcttcagaggaggaggaagaagaagacgaggaggacgaggaagaagaagagtctgagagctccgatagtgaggaagaacgggcacacaggttggctgaactgcaggaacagctgagagctgtccatgaacagctcgccgcactgtcacagggacccattagcaaaccaaaacggaaaagggaaaaaaaggagaagaagaagaaacgtaaggcggaaaaacaccggggacgggctggagcagacgaggatgataagggaccacgcgctcctcgacctccccagccaaaaaagagtaagaaagcctccgggagcgggggtggaagtgctgcgttgggtccgagcgggtttggtccaagtggtggctcaggaaccaaactgcaggcaggcgtgcagtggcgggatctcgggcttttacagccgcctctgctggggttcaagcgcttctcttgtctatccttgccctcttctcaggactatcgtctgcccaagaaagctaccaaaacagcccctccagccctgcccacggggtatgatagcgaggaggaggaagaatctaggcctatgagctacgacgagaagaggcagctgtccctggacatcaataaactgcctggggagaagctcggacgcgtcgtgcacatcatccaggcgagagagccatctctgagggatagcaatcctgaagagattgaaattgattttgagacactgaaaccaagcacactccgagaactcgagaggtacgtgctgagctgcttgagaaagaaaccaaggaagccttacacaataaagaagcctgtgggcaagaccaaggaagaattggctctggaaaaaaaaagggagctggagaaacgactgcaagatgtatccggtcagctgaattcaaccaaaaaaccacccaaaaaagccaatgagaagactgaatccagttcagcgcagcaggtcgctgttagtaggctctctgcatccagctctagttctgactcctcgtccagctcgtcctctagctcttcttccgacacaagcgactccgactcaggatag

SEQ ID NO: 216213 - DNA, 2424 bp, Artificial Sequence
  Description of Artificial Sequence: Synthetic coding sequence
taaaacgggggaggtggaagcgctaccgcccgaggcggtgagtaccgattgcccggagagggcaatgcgggacttctgggcctcgggccagaagctgctgcccctggtaagagaattagaaagccatcccttctctatgagggtttcgaatcgcccaccatggcctcagtgcctgctcttcagcttacgcctgccaatccaccaccacctgaggtttcaaacccaaaaaagcctggcagagtgaccaaccagctgcaatatcttcacaaggttgttatgaaagcgctctggaaacaccaattcgcttggccttttcgccagcctgttgatgccgtcaagctcggtctgcctgattatcacaaaatcataaaacagccaatggatatgggaacaattaaacggagattggaaaacaactattactgggcagcctcggagtgcatgcaggatttcaatacgatgttcacaaattgttatatctataacaagcccacggacgacatagttttaatggcccagacacttgaaaagatctttctgcagaaagtggctagcatgccgcaggaggaacaggaactggtggtgacaatccccaaaaattcacacaagaaaggggctaaattggctgctctccagggatccgtaacctcagcccaccaagtgcctgccgtttcgagcgtatcccacaccgcactatataccccaccaccagagattccaacaacagtgctgaatatcccacacccgagcgtcataagctcgcccttgcttaaatctctacattccgctggaccaccactgctcgccgtcacagctgctccccctgcacagccactcgccaaaaaaaagggggtcaaacggaaggccgacacgaccaccccaaccccgactgccatacttgcacctggaagcccagcaagtccgcctggatctctggagccaaaggccgctcgcctacctccaatgcgaagagagagtgggcgacccataaaaccccctcggaaggatttacctgatagccagcaacagcatcaaagctctaagaaaggcaagctctctgaacagttgaagcactgtaatgggatactcaaggaactgctgtctaaaaagcacgccgcttatgcttggcccttctacaagcccgttgacgcctcagcgctgggacttcatgactaccatgacattattaagcatccaatggacctgtctaccgtgaagagaaaaatggagaacagagactatagggacgcacaggagtttgcggcagatgtgaggctgatgtttagcaactgttataaatacaacccgcctgatcacgacgtggtagccatggcacgcaaattgcaagatgtcttcgagtttcgctacgccaagatgcctgatgaaccacttgaaccaggacctcttccagtgagcaccgcgatgcctcccggactagcaaagtctagcagtgaatccagtagcgaggagtcaagctcagaatcctcctctgaggaggaagaggaagaagatgaggaggatgaggaggaggaggagtcagaaagcagtgatagtgaagaggagagagcacaccgcttggctgagctccaggagcaactgagagctgtgcacgagcaactggcagcactgagccagggaccaatttcgaagcccaagcggaagcgagaaaagaaagagaaaaagaagaagcggaaggctgagaagcatcgcggacgggctggtgccgacgaggacgacaagggccctcgggcacctaggcctcctcagcctaagaaatcaaagaaagcttctgggtctgggggaggatctgccgctctagggccatccgggttcggcccatccgggggtagcggaaccaagctccccaagaaagccaccaaaacagccccaccagctctgcccaccggctacgatagcgaagaggaggaggaaagccgacctatgagttatgacgagaagaggcagctcagcctggacattaacaagcttcctggagagaagttgggtagggttgttcacattattcaggctagagagccttccttgcgcgacagtaacccagaggaaatcgagattgattttgaaacactgaaaccctccactctgagggagctagagagatatgtgttgtcatgcttgcgcaagaagccgaggaaaccttacacaattaaaaagcctgtcggaaaaacaaaggaagaacttgcgctcgagaagaaaagagagctggaaaaaaggctgcaggacgtgtctggtcaattgaacagcacaaagaaaccacctaagaaagctaacgagaaaacggagtcttccagcgctcaacaggtcgctgtgagtcgcctcagtgcctcttcgtctagttcagacagcagctcgtctagcagctcatcttcttcttccgatacgagcgactccgactctggctag

SEQ ID NO: 216214 - DNA, 2265 bp, Artificial Sequence
  Description of Artificial Sequence: Synthetic coding sequence
atggcctcagtccccgctctccagcttacccctgccaatccgccaccacctgaagttagtaatcccaagaagccgggtcgggtgactaatcagttgcagtaccttcataaggtggtcatgaaggcactctggaagcaccaatttgcctggccattccggcagcccgtggacgctgtgaagttgggcctccctgactatcacaaaatcatcaaacaacccatggacatgggaacgattaagaggcggctggagaacaattactattgggctgcttcggagtgtatgcaagatttcaacactatgtttactaactgttacatttacaacaagccaaccgatgacatcgttctcatggcgcaaaccctggagaagattttcttacaaaaggtcgcgagcatgccacaagaggaacaggaactcgtggtgaccatcccaaagaacagccataagaagggcgctaaactcgcagccttgcagggctcagttacctcagcacatcaggtgcctgctgtaagttctgtgtcccataccgccctatatacgccaccccctgaaatcccaacaaccgtgttgaacatacctcacccatctgtgatctcatctccactactcaagtcgctccactctgccggaccaccgcttcttgctgttacagcagctcctccggctcagcctctggcaaaaaaaaaaggtgtgaagaggaaggcggacactacaaccccaacccctactgctattcttgcgccagggtcacctgcatctcctcctggatccttagagccaaaagccgctcgtttgcccccaatgcggcgagagagcggtcgccctattaagccaccaagaaaggaccttccagattcgcagcagcagcaccaatctagtaagaaaggaaaattgtctgaacagctaaagcactgtaatggaatcttaaaggagttactgagtaagaagcatgctgcctacgcatggccattttacaaacccgtggatgcaagcgcactcggtctgcacgactatcatgatataataaagcaccctatggacctcagtactgttaagcgtaagatggaaaaccgagattacagggatgcacaggaatttgcggcagatgtgcgcctgatgttcagtaattgctacaagtacaaccctcccgatcacgacgtggtggctatggccagaaaattacaggacgtctttgaattcaggtatgcaaagatgcctgacgaacccttagagccagggccattgccagtatcgacagcaatgccacccggtctagccaagtcctctagtgagtcttcaagcgaggagtcatcttctgagagcagttcagaggaggaagaagaggaggatgaagaagatgaagaagaagaggagtctgagtcgagtgactcagaggaggagagggcacaccgcctggcggagctgcaggaacagctcagagccgtccatgagcaactggctgcacttagtcagggtccgatttccaagcccaaaaggaagcgcgagaagaaagagaaaaaaaaaaaacgcaaggccgagaaacacaggggacgcgcaggggcagatgaggatgacaaggggccacgggctccacgccctccccaacccaagaagtccaaaaaagcatccggcagtggagggggaagcgcagccctcggcccaagcgggtttggtccttctggaggaagtggaaccaaactcccaaaaaaagcgacaaaaactgcacccccagccctcccaactggctacgacagcgaagaagaagaggagtcgagacccatgtcgtacgacgaaaaacgccagctatctttagacatcaacaaactgcctggtgagaaactgggacgtgtggtccacatcattcaagcgagagaaccttccctccgcgacagcaatcctgaagagattgagattgattttgagacacttaagccctccaccctgcgggaactggaacgctatgttttgagttgcctgcggaaaaagccaaggaagccgtataccatcaaaaagccagtcggaaaaactaaggaggagctggccctggagaaaaagagggaactcgagaagaggctgcaggacgtgtctggacaattaaattcaacgaagaaaccaccaaagaaggccaatgagaagactgagtctagcagcgctcagcaggtagccgtatcacgattgtccgccagctcttccagcagcgacagtagttccagttctagctcttcctcaagttcagacacgtctgacagcgatagcggctag

SEQ ID NO: 216215 - DNA, 2406 bp, Artificial Sequence
  Description of Artificial Sequence: Synthetic coding sequence
atgttgcagaacgtcacccctcacaacaaactgcccggagaagggaacgcgggactgctcggactgggtcccgaggctgcagctcctgggaaacggattcgtaagccttcactgctgtatgaggggttcgagtctccgaccatggcatctgtgccagccctgcaactgacccccgcaaatcccccaccacccgaggtgtcgaacccgaaaaagcctggacgcgtaacgaatcagcttcaatacctgcataaggtggtgatgaaggcactgtggaagcaccagtttgcctggccgttccggcagccagtcgatgctgtaaagttagggctccctgactaccacaagataataaaacagcctatggacatgggcacgattaagagaagactcgaaaacaattattactgggccgcttccgagtgcatgcaggacttcaacactatgttcaccaactgttatatttataataaaccgactgatgacattgtgttgatggcccagaccctggagaagatctttctgcagaaagtcgcctcaatgcctcaggaagagcaggaactggtggtgactattcctaagaactcacacaaaaagggagctaaattggccgctctacagggctcagtgactagcgcccatcaggtgccagctgtgtcgtcagtgagccacaccgcactctacactccgcctcccgagattcctaccaccgtgtttaacattcctcacccttctgttatcagcagtcctttactcaagtctttgcacagcgcaggacccccactgctggctgtcacagcagctccccctgcacagccgctggctaagaagaagggcgtgaaacgcaaagctgacacaaccacgccaactccaactgcgatcctggctcctggatctcccgctagcccgcctggctcgctggaacccaaagcagccaggttgccaccaatgcgtcgcgagagtggtaggccaattaaaccccctagaaaggatcttccggactcccagcagcaacatcagtcctctaagaaaggtaaactgtctgagcagctgaagcattgcaatgggattctcaaggagctgctgtcaaaaaaacacgcagcgtacgcgtggcctttttacaagcccgtggatgcaagcgctctcggcttgcacgattaccatgacatcattaaacacccaatggatctatctacggtaaagcgtaagatggagaatagagactacagggacgcacaggagtttgccgctgacgtgcgcttgatgttcagtaattgttataaatacaacccgccagaccatgacgtcgttgctatggcccgtaagttgcaggacgtgttcgagtttcgatatgcgaagatgccagatgagccgctggaaccaggtcccctgcccgtatcaactgccatgccacccggactagccaaatcctcctcagaatcatccagcgaggagagttcatccgaatcctcatccgaggaggaagaggaagaagacgaagaagacgaggaagaagaggaaagcgagtcttctgactccgaggaagaaagggcccacagactggctgaactgcaagaacaactgcgcgctgttcacgaacagctcgctgccctgtcccagggacctatctctaaacctaagcgtaaaagggaaaagaaggagaagaagaaaaaacgaaaggcagaaaagcatagaggacgcgctggcgctgatgaggacgacaaagggccacgcgcaccgaggcctccccagcctaaaaaaagtaagaaagctagtggttcaggtgggggatctgcagcgttaggcccttccggctttgggccttcggggggtagtggtacaaaactgcctaaaaaggcaaccaagaccgctcccccagcactgcctacaggatatgacagtgaagaggaggaagagagccgccctatgagctatgatgagaaacggcaactcagtctagacattaacaagctgccaggggagaaacttgggagagtagtgcacatcatccaggccagagaaccttctctgagggactccaaccctgaagagatcgaaatcgatttcgaaaccctgaagcccagcactcttcgcgagcttgagaggtacgtgctgagctgcctccgcaaaaaacccaggaaaccctatactatcaaaaagcccgtgggaaagaccaaggaagagttggcacttgaaaaaaagagggaactcgagaaacgattacaggatgtgtctgggcagttaaactccacaaagaagccaccaaaaaaagcaaacgagaagaccgaatcttcttctgcacagcaggtagcagtctcccgcctaagcgcgtcctcttcctcgtctgacagttccagtagttccagcagttcttcatcaagcgacacatcggattctgattcaggatag

SEQ ID NO: 216216 - DNA, 891 bp, Artificial Sequence
  Description of Artificial Sequence: Synthetic coding sequence
tagcggcctcttggcgtgcagcagccaggcgcacggctcccgggagagggtaacgctggtttgctgggtctgggacccgaggcagccgctccaggcaaaagaatccgaaaaccgtcgcttctttacgagggatttgaatccccaacgatggcctctgtgccagctctgcagttgactcctgccaaccccccacctccggaggtgtctaaccccaagaaaccgggtcgtgtgacgaaccagcttcaatacctgcataaggtcgtgatgaaggccttgtggaagcatcagttcgcatggccttttcggcagcccgtagacgccgttaagctgggcttaccagactaccataagattattaaacagccaatggatatgggaaccattaagaggcggctggaaaataactactattgggccgctagcgagtgcatgcaggatttcaacacgatgtttacgaactgttatatctataataagcccacagatgatattgtcctcatggcgcagactctcgagaagatatttctacagaaggtggcgagcatgcctcaggaagaacaagaacttgtggtgacgatcccaaagaactctcataagaagggagccaaattggcagccctccagggcagtgtaacttccgctcaccaggtgcccgcagtctcatccgttagccatacggcgctttatactcctcccccagagattcccacgactgtgctgaacatcccgcatcccagcgtcatatctagccctcttcttaagtcactacacagcgccggtcctccactcctcgcggtcactgctgctccacccgctcaaccactggctaagaaaaaaggcgtgaagcggaaagctgacaccacaaccccgactccaacggccattctctag

SEQ ID NO: 216217 - DNA, 2511 bp, Artificial Sequence
  Description of Artificial Sequence: Synthetic coding sequence
atgctccagaacgtgactccccacaataaactgcctggagagggaaacgccggactgttgggcttaggtccagaagccgcagcaccaggcaaaaggattcgaaaacccagcctgttgtatgaagggttcgaatcacctaccatggccagcgttcccgcactgcagttaacccccgctaaccccccacctccggaagtgtctaaccctaaaaagcctggccgagtgaccaatcaactgcagtacctccataaagttgtcatgaaagctctgtggaaacaccagttcgcgtggccgtttcgtcagccagtggacgccgtcaagctgggactgcctgactatcataagatcattaagcaacccatggacatgggcacaataaagcgaaggcttgagaataactattactgggccgcaagcgaatgcatgcaggactttaatacaatgtttacgaactgctacatttataacaagcccaccgatgacattgtgctgatggcccagactttagagaagatctttcttcagaaggtagcttctatgcctcaagaggagcaggaacttgtcgtcaccattcccaagaattcccacaagaagggcgcaaaacttgctgccttacagggttctgtaacctccgcccaccaagtgcccgctgtgagctcagtgtcccacaccgcgctctacactccaccaccggaaatccctaccaccgtcttcaatatcccccacccaagcgtaatttctagtcctctcttgaagtctctccatagcgccggaccacctctgctcgctgtgacagctgcgccacctgcgcagccactggcaaagaaaaaaggcgtgaagagaaaggcggacactaccacacccacccctactgccattctggctccaggaagtcccgctagtcctccaggcagtctggagcctaaagccgctagattgcctccaatgaggagagaaagcggcagacctataaagccacccagaaaggacctgcccgacagccagcagcagcaccagtcttctaagaaaggcaagctcagcgagcaactgaagcactgcaacggtatcctgaaggagcttctaagcaaaaagcatgccgcttacgcttggccattttacaaacccgtggacgcctcagcacttggcctacacgactaccacgatatcatcaagcatcccatggacctgagcacagtgaagcgcaagatggaaaaccgggattaccgcgacgctcaggagttcgctgctgacgttagactgatgttcagtaattgttacaagtataacccccctgatcatgatgtcgtcgccatggctcggaaactacaggacgtgttcgagtttcgctacgctaaaatgccagatgagcccttagaaccgggaccacttccggtttcaaccgctatgccacctgggctcgccaaatctagctctgagagcagtagcgaagaatcatcctcggaatcctcaagcgaagaggaggaggaggaggacgaagaggatgaagaagaagaagagagcgaaagctcagactctgaggaggagcgagcccatagactggccgagctgcaagagcaattgcgcgcagtgcacgagcagttggcggcattgtcccaggggcctatcagcaagcctaagcggaagcgggaaaaaaaagagaaaaaaaaaaaaagaaaggccgaaaagcacagggggcgtgcaggtgccgacgaggatgataaaggccctcgggcaccccgtcctccccagcctaaaaagtctaaaaaggcatctgggtcaggcggagggtcggcagccttgggaccaagtggatttggacccagtggaggatcgggaaccaaactgcaagctggggtccaatggcgtgacttgggtctgcttcagcccccactgttgggattcaagcgcttttcctgtctctcgctgccatcaagccaaaattatagactcccaaaaaaggcgaccaaaactgcgcctcctgcactgccgaccgggtatgacagcgaggaagaggaggaaagccgccctatgtcttacgacgaaaagagacaactgagcctggatatcaataaattgcctggagaaaagctcgggcgtgtggtgcatatcatccaggccagggagccatctctgagagactcaaacccggaggagatcgagatcgactttgaaactctcaagccatcaacgttaagggagctggagagatacgtgctctcctgcctgcggaaaaagccccgaaagccctatactatcaaaaagcctgtcggcaaaactaaggaggagttggcacttgaaaagaaacgtgaattagaaaagcggctacaggacgtgagcggccaactgaatagcacgaaaaagcccccaaagaaagcaaacgaaaagacagagtcgtccagtgcacagcaagtggctgtgagtagactgtcagcaagcagtagttcctccgatagcagcagttctagttcttcaagctcttcgagcgatacctccgattcggactccggatag

SEQ ID NO: 216218 - DNA, 987 bp, Artificial Sequence
  Description of Artificial Sequence: Synthetic coding sequence
taggccaagtcttcaagcgaatcttcgagtgaagagtctagtagcgagtccagttctgaagaagaggaagaggaagacgaagacgaggaggaggaggaaagtgaaagctcagattccgaggaggagcgcgcacatcggctagccgagctgcaggagcaactgagggcagtccatgaacagctagccgcactgtcccaggggccaataagtaagcccaagaggaagagggagaagaaggagaagaagaagaagaggaaagccgaaaagcaccgcggtcgagctggagccgacgaagacgacaaagggcctagagctcctaggccaccccagcccaaaaagtccaagaaggcgagtggctccggtggaggcagtgcagctctgggcccaagcgggttcggacctagtggcggaagcggcactaagttaccaaagaaggcaactaagactgcaccgccagccttaccgaccggttacgattctgaagaggaggaagaaagccgcccaatgagttacgacgagaaaagacagctctctctggacataaataagctgccaggcgagaagctcgggagagtcgtgcatattatacaggcgagggagccctcactccgagatagcaatcctgaagagatcgaaatcgactttgaaacactcaagccctcaacgctgagagaactggaacgatacgtactgtcatgcctgagaaaaaaacccaggaagccatataccatcaagaagcctgtgggtaaaactaaagaagaactagccttggagaaaaaacgcgagcttgaaaaacgattgcaggacgttagtgggcagctaaattccacgaaaaagcctcccaagaaggcaaacgaaaagacagaaagctcatccgcacagcaggtagcagtctctcgattgagcgcatcatcctcttcttctgactctagctcctcctcgtcaagcagttcctcttccgacacatccgatagtgattcagggtag

SEQ ID NO: 216219 - DNA, 891 bp, Artificial Sequence
  Description of Artificial Sequence: Synthetic coding sequence
tgacgaccactcggagtgcaacaacctggggcacgcctgccaggcgaggggaacgccggtctgttaggtctgggccctgaggcggcagcccctggcaagagaattcgtaagccatctctgttgtacgaaggctttgagtctcctacaatggcaagtgtgccagccctccagttaactcccgcaaacccaccccctcctgaggtttctaacccaaagaagcccggtcgggtgaccaaccagttacagtacctgcacaaggtcgtaatgaaagcattatggaaacaccaattcgcttggcccttcaggcagccagtggacgccgtcaagctgggactccccgactatcataaaatcatcaaacaaccaatggatatggggactattaaacgtcgtctcgagaataattactattgggctgcatccgagtgtatgcaggattttaacactatgttcacgaactgctacatttataataaacccactgacgacatagtcttgatggcacagaccttagagaaaatcttcttgcaaaaggtcgcatcaatgcctcaggaggaacaggaactggtggttacaattccaaagaattctcacaagaaaggcgcaaagctggccgcactgcaaggctccgtcaccagcgcccatcaagtccccgcagtgagctcggtatcccatactgccctgtataccccgcctcccgagatccccacaacagtgctaaacatccctcacccatctgtcatcagctcgcctctgctcaagtctcttcacagcgctggcccacctttgctggctgtcacggctgcgcctccagcgcagccattagcaaaaaagaaaggagtgaaaaggaaagcagatacaactacacccacacccacagccattttatag

SEQ ID NO: 216220 - DNA, 891 bp, Artificial Sequence
  Description of Artificial Sequence: Synthetic coding sequence
tgaaggccgcttggggtccaacagcccggtgccagacttcctggggagggcaatgcgggactgctagggctgggcccagaagcagccgctccagggaagcgtatccggaagccctcactgctctacgagggttttgaaagccctactatggcaagcgtgcccgcacttcaactaacgccagcaaatcctccacctcctgaggtaagcaaccctaagaagcccggacgggtgacaaatcagttacagtacttacataaggttgttatgaaggcattatggaagcatcagtttgcttggccatttcggcagccagtcgacgctgtgaaactggggctacccgattatcacaagatcatcaagcagccaatggacatgggcaccatcaaacgcaggttggagaacaactactactgggcagcttccgagtgtatgcaggattttaacaccatgtttactaattgttacatctataacaagcctacggatgatatcgtactgatggcgcagactcttgaaaagatcttcttgcagaaggttgcgagcatgcctcaggaagagcaggaactggttgtgactattccgaagaacagtcataagaagggagctaagctggctgctcttcagggttccgtcacatctgcccaccaagtccccgctgtctcatctgtgtcccacacagcgctgtataccccacccccagagatccccacaactgtacttaacattccccatccttctgtgatatcgtctccactgctcaaatctttacatagtgcaggacctcccttgctcgccgtgacagcggcacccccagcccagccactggccaaaaagaagggcgtgaagcggaaggcagatacgactacgcccacaccgacggccattctctag

SEQ ID NO: 216221 - DNA, 1860 bp, Artificial Sequence
  Description of Artificial Sequence: Synthetic coding sequence
tagaacgggggtggcggaagtgcaacggctcgcggaggtgagtacagacttcccggtgaagggaatgctggtttgctagggctgggcccagaggcagccgctccgggtaagcggattagaaaaccctccttattgtacgagggtttcgaaagcccaacaatggcaagtgtgcccgcactgcagctcacacccgctaatccaccccctccagaggtcagcaatcccaagaaaccgggacgcgttaccaaccagctgcagtaccttcataaggtggtgatgaaggctctgtggaagcatcagttcgcttggccatttaggcagcctgtggatgccgtgaaattgggactcccagactatcacaagattataaaacaacccatggatatgggtactatcaagcggcgattagaaaacaattactactgggcggcttccgagtgcatgcaagattttaacaccatgttcaccaactgttacatctataacaagccaacagatgacatcgtcctgatggcacagacccttgaaaagatctttctgcagaaagtcgctagcatgccacaggaggaacaggaactcgtggttaccatccccaagaacagccacaaaaagggcgcaaaattggctgcactgcaggggtcagtcacatccgcacaccaggtcccagctgtctcctcagtgtcccatactgctttgtacacccctcctcctgagattccaacgaccgtcctcaacataccccatccatcagtgatcagtagtccactcttgaagtctttgcattctgctggtccacccctgttggcggttacggccgcaccccctgcccagcctctcgccaagaagaagggcgtgaaaagaaaagcagatacgaccacgcctaccccaaccgcgattctggctccaggtagtcccgcatcaccacccggtagcctggaaccaaaggcggctcgactccccccaatgcggagagaatcaggcaggccgataaaaccacccaggaaggacctgcccgacagccaacagcagcatcagtcttctaaaaagggcaagctctcagaacagcttaagcattgtaatggaatattaaaggagctgctgtccaagaaacatgccgcttacgcctggcctttttacaaacccgtcgatgccagcgccctgggtctgcacgactatcacgatatcataaagcatccaatggatctgtccaccgtgaaaaggaaaatggagaatcgggactaccgggatgcacaagagtttgctgcagatgtcagactaatgttcagtaattgttacaaatacaatccgcctgatcatgatgttgtcgccatggccaggaaactccaggatgttttcgaatttcgctatgccaagatgccagatgagccactcgagccagggccactgcccgtgtcaacagccatgcccccaggcctcgccaaaagcagttccgagtcgtcatcagaggagagcagttctgaatcctcatccgaagaggaggaagaagaggatgaagaagatgaagaagaggaagaatctgagtctagtgactccgaagaggagagggcccatcggttggcggagcttcaagagcagctacgagcggttcacgaacaacttgccgcactgtcccagggtccaatcagcaaaccaaaacgcaagcgagagaaaaaggaaaaaaaaaagaaacggaaggctgagaaacaccgcggacgcgctggcgctgacgaggacgataaaggacctcgggctcccagaccgcctcaacctaagaagtccaagaaagccagcggatcagggggaggctccgctgctctagggcctagtggattcgggcctagtgggggatccggtacttag

SEQ ID NO: 216222 - DNA, 987 bp, Artificial Sequence
  Description of Artificial Sequence: Synthetic coding sequence
tgagcgaagtcttcatccgagtctagctctgaggagtcatcatccgagtcctcctccgaagaggaggaggaagaagatgaagatgaggaagaggaggagagtgagtccagcgacagcgaagaggagagagcacacagactcgcagagttacaggaacagttgagagccgtgcatgagcaactggcggcattaagccagggtccaatctccaagcctaagagaaaacgtgaaaagaaagaaaaaaaaaaaaaaaggaaggccgagaagcataggggtcgggcaggtgctgacgaggacgataagggtcctagagcacccagacctccccagccaaaaaaatccaaaaaggccagcggcagcgggggagggtccgcggcactgggcccttccggctttggaccgtcaggtggtagcgggaccaaactgccgaagaaggcgaccaagactgcaccacctgcactccctacgggatacgattccgaagaagaggaggagtctaggcctatgtcctatgacgagaaaagacagctgtccctggacataaataagcttcccggtgaaaagctggggcgtgtcgttcacattatacaggctagagagccttctctgagagactcaaaccccgaggagattgagattgactttgagacgctcaagccgagcacccttcgcgaattagaacgctacgttttgtcctgcctcaggaagaagcctagaaaaccttacactataaaaaaacctgtcgggaagactaaggaagaactggccctggaaaaaaaacgcgagctcgagaagagactgcaggacgtaagtggtcagctaaatagcaccaagaagccgcctaagaaggccaacgagaagaccgagagctcttcagcacaacaggtagccgtgtccagactgtccgcttcctccagctcatcagacagctccagcagcagttcttcatcctctagtagcgacacaagcgacagcgacagcgggtag

SEQ ID NO: 216223 - DNA, 2046 bp, Artificial Sequence
  Description of Artificial Sequence: Synthetic coding sequence
atggatatgggcaccatcaaacgcagactcgaaaacaattactactgggccgcaagtgaatgcatgcaggatttcaacacaatgttcaccaattgctacatctataacaagcctaccgatgacatcgtgctgatggcacagacactggagaagattttcctgcaaaaggtggcatccatgccccaggaagagcaagagctggtggtgactattccaaaaaacagtcataagaaaggcgctaaactagcagccctgcagggcagcgtgaccagcgcacatcaggtgccggcagtgtcaagcgtgtcacacactgcactgtatacaccaccacctgaaatccctaccactgttttcaacattccacacccgagcgtgatcagttctcccttgctcaagtcccttcactctgcgggacctccactgttagcggtgacggccgcacctccagcacagcccttggctaagaaaaagggcgtcaaacgtaaggctgatactactacacccacacccactgctatactcgcccctggctctcccgcttcccctcccggttcacttgagccaaaagcagcacggctccccccaatgcggagggaatcaggtcgaccgattaaacctccccgtaaagatctccctgattcgcaacaacaacaccagtccagtaagaaaggcaaactctccgagcagctgaaacactgtaacggtattctaaaggaactcctatctaagaagcacgctgcatatgcttggcctttctacaagcctgtcgacgcaagcgcactaggactgcatgactaccacgatataattaaacacccgatggatctgtctacagtgaaacgtaagatggagaatcgggattatagagacgcacaggagtttgcggctgatgtgcgattgatgttcagcaattgttacaaatacaacccacctgatcacgatgtagtcgcgatggctagaaaattgcaagacgtgtttgagttccgctatgctaagatgccagacgaacctctggagcccggtccacttcctgtgagcacggctatgcccccaggtcttgccaaaagttcaagcgagagcagctctgaggagagctcctctgagagctcaagcgaggaagaggaagaggaggatgaagaagacgaggaggaggaagagtctgagtcgagcgactcggaagaggaacgggctcatagattagccgagctccaagagcaactacgcgcagttcatgagcagttggccgcactgtcccaagggcctatctctaaaccaaagcgaaagcgagaaaaaaaagaaaaaaagaaaaaaaggaaggcagagaagcacaggggcagggccggagccgatgaggacgacaaaggccctcgagcgccacggcctccgcagcctaagaagtccaagaaggcgtcaggttcagggggagggtcggccgctctagggccaagcggattcggcccttctggcggatccggaacgaaactgcccaaaaaggccacaaagacggcaccccctgcactgccgacaggatacgactccgaggaggaagaagagtcccgaccgatgtcatatgatgagaagaggcagctctccctggatatcaacaaacttccaggagaaaagcttggacgggtggtccacattatacaggcaagagagccatcgttacgcgattccaacccagaagaaattgaaattgacttcgagacactgaagccttcgaccctgcgggagctggagaggtacgtcctgagctgtctccggaaaaagcctaggaaaccctacacaataaaaaagccagtcggaaagaccaaggaggagctcgctctggaaaaaaagcgcgagctcgaaaaaaggctgcaggacgtgtccggacagttaaatagtaccaagaaaccgccaaagaaggcaaatgaaaagacagagagcagttcagcacagcaagtagcagtaagtcgactgtccgcttcgtcatcaagcagcgattcatcaagtagcagcagttcatcaagttcttcagacacctccgactccgactccggatag

SEQ ID NO: 216224 - DNA, 2265 bp, Artificial Sequence
  Description of Artificial Sequence: Synthetic coding sequence
atggcaagcgtgcctgctttacagctcaccccagccaaccccccaccgcctgaagtgtccaatcccaaaaagccagggcgtgtgaccaatcaactgcaatacctgcacaaagttgtaatgaaagccttgtggaaacaccagttcgcgtggcccttccgacaaccagtggacgcggtgaagcttggattgcccgattatcataagatcatcaagcaaccaatggacatgggcaccattaagcgaaggttagagaacaactattattgggcggcatctgagtgcatgcaagactttaacactatgttcactaattgctacatttataataaacctactgatgatattgtcctgatggcccagactctcgagaagatctttcttcagaaagttgcctctatgcctcaggaagagcaagagctcgtggtgactattcctaagaactcccacaagaagggtgccaagctggctgctcttcagggttctgtaacctcagcacaccaggttccagctgtgtcttccgtgtctcacacagctctttatactccccctccggagatacccactacagtgttcaatatccctcaccctagtgtgataagtagtccccttctgaagtcactccacagtgccggtccacctctgctcgcagtgacagcggctcccccagctcagccgctagcgaaaaaaaagggcgtgaagcgcaaagctgacacaaccacacccactcctacagctattctcgcaccaggcagcccggctagcccacctggctccctggagcctaaggcggctcggctgccgccaatgaggagggagtcaggaagaccaatcaaaccccctcggaaagatcttcccgactctcaacagcaacaccagagtagcaagaaggggaagctgtctgaacagctgaagcactgcaatggaattctgaaagaactgctatctaaaaagcatgcagcatacgcgtggcctttttataaaccggtcgatgcatccgccttagggctgcatgactaccacgacataatcaaacatccgatggacttatcaaccgtcaagcgcaagatggaaaatcgcgactacagggacgcccaggagtttgccgctgacgtgcggctcatgttctcaaattgttacaaatataaccctccagatcatgacgtggtagcaatggcgaggaaattacaggacgtcttcgagtttcgctacgcaaagatgcctgatgagcccctggagccaggcccactgcccgtttcaactgccatgcctccgggactcgccaaaagcagcagcgagtcatcgagcgaagaatcctctagtgagtcctccagtgaagaggaggaggaagaggatgaggaagacgaagaggaagaggaatccgagtcatccgacagtgaggaagagagagcccatcgactcgctgaactgcaggaacaattgagggctgtccatgaacagctagcggcactctcacaagggcctattagcaaacctaaacgcaaaagagagaagaaagaaaaaaaaaagaaaagaaaggccgaaaaacatcggggaagggccggagccgatgaagacgataaggggcctagggcccctcgacctcctcagcccaagaaatccaagaaagccagcgggagcggcggaggatccgctgcactgggacctagcggtttcggcccatctggagggagcggtaccaaacttcccaagaaggctacaaagactgccccacccgctcttcctacaggatatgatagcgaggaggaagaggagagtcgtccgatgtcgtacgatgaaaaacggcagctgtccctggacattaacaagttgcccggtgaaaaactcggacgagtggtgcacatcattcaagcgcgtgaaccatcactcagggactcaaaccctgaagagatcgagatagatttcgaaactctgaaacccagtacattgcgggaactggagcgatacgtcctctcctgtctacggaagaaaccccgtaaaccatataccatcaaaaagcctgtgggaaagacaaaggaagagctggccctggagaaaaagagagaattggagaagcggcttcaagatgtctccgggcagttgaatagtacaaagaagccccctaagaaagctaacgaaaaaacagaatcttcgagtgcccagcaagttgctgtgagcaggctgtccgcgtcctccagctcatcagattcgagttcaagctcctccagcagttccagctccgataccagcgattccgacagcggttag

SEQ ID NO: 216225 - DNA, 2511 bp, Artificial Sequence
  Description of Artificial Sequence: Synthetic coding sequence
atgctacagaatgttaccccacacaacaagctgcctggagaggggaacgcgggactcctagggcttggacccgaggcggctgcccctggtaagaggattcggaagccctcgctgctttacgaaggcttcgaaagccctacaatggcgtctgtgccagccctacagctcacacctgccaaccccccacccccagaagtctccaatccgaagaaacctggtcgcgttactaaccagctccagtacctgcataaggtagtgatgaaggcgctgtggaagcaccaattcgcctggcccttcaggcagccggtggacgccgtaaaattggggttgccggactaccacaagattatcaagcagccgatggacatgggcacgattaaacggagattagaaaacaattattactgggctgcctccgagtgcatgcaggatttcaacacgatgtttaccaactgttacatatacaacaagccaaccgacgacattgtcctgatggctcagacgttggaaaagatttttttacagaaggtggcatccatgccacaggaagaacaagaactcgttgttaccatccctaaaaacagccacaaaaaaggagccaagctggctgctctccagggcagcgtgacctccgcacaccaggtccccgctgtgtctagcgttagtcacactgctctatacacgcctcccccagagatcccaaccacagtcctgaatatcccccatcccagtgttatctccagtcctttactgaaatctcttcactccgccggacctccactgctcgccgtgactgcggctccacccgctcaacccctggcaaagaagaagggggttaagcgaaaggccgatactaccaccccaacacctaccgctattctggcccctggaagtccagcttcccctcctggaagcctcgagccgaaggccgctaggctgcctcctatgcggagggaaagtgggcgacccatcaagccccctagaaaggacctccctgatagtcaacaacagcatcagtcttcgaagaaaggtaagctaagtgagcagttgaaacactgcaatggcatccttaaggaattgctcagcaagaagcacgcagcatatgcttggcctttttacaaaccagttgatgcttccgcccttggattgcatgactaccacgatattattaaacatcccatggatctctcaactgttaagaggaagatggagaaccgcgactatagagatgctcaagagttcgcagccgacgtgagactgatgttctctaattgctataagtataaccctccagatcatgacgtcgtggctatggccagaaagttacaggatgttttcgagttccgctacgcaaagatgccagatgaacctctagagcctggaccactacccgtaagcacagccatgccacctggattggcaaaaagtagttccgagtcatcaagcgaagagtcctcaagcgagtcttcctctgaggaggaagaggaagaggatgaggaggacgaggaagaagaagagagcgaatcatcagatagcgaggaggaacgtgctcatcgcctggctgaactccaggagcagcttagggccgtccacgagcaattagcggctctgtcacagggccctatcagcaaaccaaagcgcaaacgtgagaagaaggagaagaaaaagaaaaggaaggccgaaaaacaccggggtcgggctggcgctgatgaagatgataaaggtccgagagctccacgaccccctcagccaaaaaagtcaaagaaagcctcaggcagtggtggaggttcagctgccctcgggccttcaggctttgggccatccggcggtagcggcactaaactgcaggcaggagtccagtggagagacttgggtctacttcaaccccctttactaggctttaagcggttctcctgtctgtcactcccatctagtcaggattatcgactgccaaagaaagccaccaaaactgcccctcctgcactgcctacaggatacgattcagaggaagaggaggagtcgcggccaatgtcatatgatgagaagcgccagctgtcactggacatcaacaagctgcctggagagaagctcggtagagttgtacatattatccaggctagagaaccttctctccgtgacagcaatccggaggagatcgagatcgacttcgagacacttaagccgtccactttgcgcgaactcgaaaggtacgtactcagttgcttgcgcaaaaagcccagaaaaccttataccatcaagaagcccgtcgggaaaactaaggaggaattagcacttgaaaaaaagcgggaactggaaaagcggcttcaggatgtctcggggcagctgaacagcacgaagaagcctccaaaaaaagcaaacgagaaaaccgagtcctcgtcagctcaacaggtcgccgtttcacggctttctgcctcaagttccagttctgattcatccagctcctcctcgtctagtagcagtagcgatacgagtgacagcgacagtggttag

SEQ ID NO: 216226 - DNA, 2046 bp, Artificial Sequence
  Description of Artificial Sequence: Synthetic coding sequence
atggacatgggtaccatcaagcgccgactagagaacaactactattgggccgcttccgaatgtatgcaagactttaatactatgttcacgaattgttacatctacaataaacccactgatgatatcgtgctcatggcgcagacgttagagaaaattttcctgcagaaggtagcatccatgccgcaagaggagcaggagcttgttgttactatccctaagaatagtcacaagaaaggggcaaaactcgcagccctacaaggatctgtcacctctgcccatcaggtcccagccgtgtccagtgtgtcccatactgcgctatacacaccaccgccagaaattccaaccactgtattaaacatcccacatcccagcgtgattagttctccactgctaaagagtctgcacagtgctggcccacccctgctagcagtgacggctgcacctcctgctcaaccgctggccaagaagaaaggcgtcaaacgaaaggctgatactaccacacccacgcccactgccatactggcccctggtagcccagctagcccgcctggctcactcgagccaaaagccgctaggctgccacccatgagaagagaaagcggaaggccgataaaaccccctaggaaagatcttcccgactcacagcaacagcatcagagcagtaagaaagggaaactgtctgaacagctgaaacattgtaacgggattcttaaagaactgctgagcaagaaacatgccgcttatgcttggcccttctacaaacccgtcgacgcatccgccttgggcctgcacgactatcatgatattattaaacaccctatggatctgtcaacggtcaaaaggaaaatggagaatagggattatagagacgcccaggagtttgctgctgacgtcaggttaatgttcagtaattgctataagtataatccacctgatcatgacgtagtcgcgatggccagaaagttgcaggacgtcttcgagttccgctacgcgaaaatgccagatgaaccgttggaacccggtcccctccccgtgagtaccgctatgccgccaggcctggctaaaagcagctctgaatccagctcggaggagagtagctccgagtcatctagtgaagaggaggaagaggaggacgaagaagacgaagaagaagaggagtcagagtcctccgatagcgaggaggaacgcgctcaccgcctggcggaactccaagagcaactgcgcgctgttcatgagcagctggccgcattgtcccagggtccaatcagcaagccaaagcggaagagagagaaaaaggagaagaaaaagaagaggaaagccgaaaagcatcggggaagagctggagcggatgaagatgataaaggtcctagagccccacgccctcctcagccgaagaagtctaagaaggccagcgggtcagggggaggttcagcagccttaggtcccagcggctttggcccttctgggggaagcggaaccaaactgcctaagaaggccacgaaaaccgcacccccagcactgcccaccggctacgatagcgaggaggaggaggaatcccggcctatgagttacgacgagaagcggcaactctccctggatatcaacaagctgccgggagaaaaacttgggagggtcgttcacattatacaggctagagagccttcgttacgagactcgaatcctgaggagatcgagatcgattttgagacattaaagcccagtacactaagggagttggagagatacgtcttgtcttgcctcagaaagaaacccaggaaaccttacacaattaagaaacccgtgggaaaaacgaaagaggaactggcgctcgaaaagaaacgggagctggaaaagagacttcaggatgtttcgggccaactgaactccaccaagaagcccccaaagaaagccaatgagaagacggagagtagtagtgcgcagcaggttgccgtatctaggctatctgcgtcttcctcatcctcagacagctcttcttcatctagtagctcctcttcctcagacacatcagattccgatagtgggtag

SEQ ID NO: 216227 - DNA, 2511 bp, Artificial Sequence
  Description of Artificial Sequence: Synthetic coding sequence
atgctccagaatgtcactcctcataacaagttgcctggggaaggcaacgccggtctgctgggattggggccagaagcagctgcgcctgggaaacggatccgcaaaccatcactgctttacgaaggcttcgaaagccctactatggcttcagtgccggctttgcagttgactccagccaaccctcctccaccagaagtttctaatcctaaaaaacctggcagagtaactaatcagttacagtatctgcacaaggtcgtaatgaaggccttgtggaagcaccaattcgcttggccattccgccagcctgttgacgccgtgaagttaggccttcccgattaccacaagattatcaagcagccgatggatatgggaactattaagcgacgattggagaataactattactgggccgcttcagagtgcatgcaggactttaacactatgtttaccaattgttacatatacaataagcccaccgatgatattgttttgatggctcagaccttggagaagatcttcctacagaaagtggctagtatgcctcaggaggagcaagagttagttgtgacaattccaaagaactcccacaaaaagggcgctaaactggctgcattacagggcagcgtgacctccgctcaccaggtgcccgctgtctcatccgtgagccatacagccctctacacgcccccacccgaaatccctaccaccgtccttaacattccccatccaagcgtgatcagtagtcctctcttgaagagcttacactccgccggaccccctcttctggctgtcactgcagccccaccggctcaaccgctcgctaagaaaaaaggcgtgaagcgtaaggccgatacaaccacccctactcctaccgccattcttgctcctggcagtcctgcgtccccacccggatccctggaacctaaagcagcccgactgcccccaatgaggagggaaagcggcaggcctatcaagccccctaggaaggacctacccgatagccagcagcagcaccagagtagtaagaaaggaaagctttccgagcaactgaaacactgtaacggcatccttaaggagctgctctcgaaaaagcatgccgcatatgcgtggcctttctataagccagtggacgctagcgccctgggtctgcatgactaccacgatatcatcaaacaccctatggacctgtcaaccgtgaagcgcaaaatggaaaacagagattatcgcgatgcacaggagtttgccgctgatgtgaggttaatgttctcaaattgttacaagtataaccccccagaccacgacgtggtcgctatggctaggaaacttcaagacgtcttcgaatttcgatacgccaagatgccggacgagcccctggagccaggccctctgcctgtgtctacggccatgcccccaggtctggcaaagtcaagctcagagtcaagctccgaggagtcaagtagtgagtcatcatctgaggaggaggaagaagaggacgaagaagatgaggaagaagaagagagtgaatcttcagattccgaggaagaacgggcacacaggctcgcagagttgcaggagcagcttagagcagtccacgaacaactagccgctttgagccagggccctatctccaagcccaagcgaaagcgagaaaaaaaagagaagaagaaaaaacgcaaagctgagaagcatagggggagggccggagcggacgaagacgacaagggtcccagagctccacggcctccccagcccaaaaaaagcaagaaagcctctgggtccgggggaggatccgcagctttaggaccttctggatttgggccatctggagggagcggcacaaagctacaggcaggagtacaatggagagacctgggtctcttgcagcctcccctgttaggcttcaaaagattcagctgtttgagcctgcctagctctcaagattacagacttccgaaaaaggccaccaaaacggcgcctccagcactgccaaccggctacgactccgaagaagaagaggaatcaagacccatgagctatgatgaaaagcgtcagctttctttggatattaataagcttcctggggagaagctcggaagagtggtacacataatccaggccagggagcctagtctgcgtgatagcaatcccgaggaaatcgaaatagactttgaaactttgaagcctagcacactgagggagctcgaaaggtatgtcctgtcctgtcttcggaagaagcccagaaagccatacacgattaagaagcctgtcggcaaaactaaggaggagctggccctggagaagaagcgggaactggagaagcgtctgcaggatgtctctggccaactcaactccacaaaaaaaccacccaaaaaggccaatgagaagaccgagagcagttctgcacaacaagtggcagtgtctcgattgtctgcatcttcaagctcgtccgacagctcaagcagctcatcgagctcttcctcttccgatactagcgattcagactctggttag

SEQ ID NO: 216228 - DNA, 2265 bp, Artificial Sequence
  Description of Artificial Sequence: Synthetic coding sequence
atggcatcagttcccgctctgcagctcacccccgcaaacccgccacctcctgaagtatctaatcccaagaaaccaggccgagtaaccaaccagctgcaatatctgcacaaagtcgtcatgaaagcactgtggaagcatcagttcgcatggccttttcggcagccagtcgatgccgtgaagttgggccttccagactatcataagattattaagcagccaatggacatgggcacaatcaagaggagactggagaataactactactgggcagccagtgaatgtatgcaggatttcaacactatgttcacgaactgttacatctacaataagcccacagatgacatcgttttgatggctcaaactctcgagaagatttttcttcagaaagtcgcatctatgcctcaagaggagcaagagctggtggttaccattcctaagaacagtcacaagaaaggcgctaaattagctgccctgcaaggcagcgtgacttctgcccatcaggtgccagccgtgtccagcgtgagtcacacagcactgtatacacctcctccagagatccctacaaccgttcttaatatcccccacccatcagttattagttcccctctgctgaagagtcttcatagcgccggacctcctctgctggccgtgaccgcagcaccacccgctcaaccactggcgaaaaagaagggagtaaaaagaaaggcggataccacaacgcccacccccacagcgatcctggccccagggtcccccgcttccccgcctggatccttggagccgaaagctgcgagactaccgcctatgcgaagagagagtgggaggcccatcaaacccccacgcaaggatctacctgactcccagcaacaacaccaatcttctaagaagggcaaactgtccgaacagctaaaacactgcaacggcatcctgaaggagttgctttccaagaaacatgcagcctacgcatggcccttttataagcctgtggacgcctcagctctggggctgcatgattaccatgacatcattaagcacccgatggaccttagcacagtgaagaggaagatggagaaccgtgattatagagacgcccaggagtttgccgctgatgtacgcctgatgttcagtaattgctacaaatacaaccctcctgaccacgacgtggtggccatggccagaaagctccaagacgtgttcgaattccgatacgccaagatgcctgatgaaccactggagcccggacctctgcctgtctcaacggcgatgccccctggactcgctaaatccagctctgaatcaagcagcgaggagtcgtcctccgagtcctccagcgaggaggaagaagaagaagatgaagaagacgaagaggaggaagagtccgagtcttccgactccgaggaggaacgcgcacaccggctggccgagcttcaagaacaactgcgggcagtgcacgagcagcttgctgccctctcgcagggacctataagcaagccaaagcgcaaacgcgagaagaaagaaaaaaagaagaaacgtaaggctgaaaagcacagggggagagcaggtgccgacgaggacgacaaagggccaagagccccacgtccaccacagcccaagaagtctaaaaaagccagcggaagcggtgggggtagcgcagctttgggcccaagtggctttgggccaagcggaggaagcggtacaaaactgcccaagaaagccactaagaccgctccccctgctctgccaaccggatatgattcggaggaggaggaggaaagtcggccaatgtcatatgacgaaaagaggcagctgtctctagacattaacaaactccctggtgaaaagttaggaagagttgtccacattatccaagcgagggagccttcattgcgggactccaatcccgaagagattgagatcgactttgaaacgctgaagccatctacactacgcgaacttgagcgctacgtgttaagctgtcttcgaaaaaaacctcggaaaccttatacaattaaaaaacccgttggaaaaaccaaagaagaattggctctggaaaaaaagcgggagcttgaaaagagactacaggacgtaagcggacaactcaattcaaccaaaaaaccgcctaagaaggccaacgagaaaacggagtcaagctctgcgcagcaggtggcagtctcccgcctaagcgcttcaagttctagctccgacagtagttcctctagttcctcttcctcatcttctgacacttctgatagcgacagtgggtag

SEQ ID NO: 216229 - DNA, 2046 bp, Artificial Sequence
  Description of Artificial Sequence: Synthetic coding sequence
atggacatgggaacaattaagcggcgactggagaacaactattactgggccgcaagcgaatgtatgcaagatttcaacacaatgtttacgaactgctacatctataataaaccaactgatgatatagtgctgatggcccagacgttggaaaagattttcctgcagaaggtggcttccatgcctcaggaagagcaggagctggtggtgactatccctaagaactcacataaaaaaggggcaaaactggcggctcttcaaggcagcgttacaagtgcacaccaggtgcccgcagtgtcatcagtgtctcacacggcgctgtacacaccaccaccagaaattcctactacggtgttgaacattcctcaccccagtgtcatctcctcacccctgctaaagtctttgcattctgccggtcctcccctcctggccgtgacggcggcaccaccggcacagcccctagcaaaaaagaaaggtgtgaagaggaaggctgataccactacccctacccctaccgccattctggctcccggtagcccagcctccccaccaggcagtttggagccaaaagctgccaggctgccaccgatgcgcagggagtcagggcgtcctattaagccccctagaaaggatcttcctgactcccagcagcagcatcaatcatccaagaaaggaaaattaagcgagcaactgaagcattgcaatggtatcctgaaggaactgttaagcaaaaagcacgccgcatacgcctggcccttttacaagcccgtggatgcctcagcactcgggttacatgactaccacgacattatcaagcaccccatggacctgtcaacagtgaagcgcaaaatggagaaccgggattatcgcgacgctcaggaatttgctgccgatgtaaggctgatgttctccaactgttataaatacaatcctcccgatcatgacgttgttgccatggcaagaaagctgcaagacgtcttcgaattccggtacgcaaagatgccagacgaacctctagagcctggaccccttccagtctctaccgcgatgccacccggactggcgaagtcgagttccgagagttcatccgaggagtcatccagtgaaagctccagcgaggaagaggaagaggaggacgaggaggatgaagaggaggaggaatcggagtcctccgatagtgaagaagagcgggcacatcgcttggccgaactgcaggagcaactgcgcgctgtacatgagcaactggccgctctaagccaaggtcccatcagcaagcctaaacggaaaagagagaaaaaagagaaaaaaaagaagcgcaaggccgagaaacacagagggagagctggggctgatgaagacgacaaaggtccaagggcaccaagacctcctcaacctaagaaatccaagaaagccagcggaagcgggggtgggtcagcagctctgggaccctctggatttgggcctagtgggggttctggtaccaaattgcccaagaaagccactaagactgcccctccagctcttccgaccgggtacgacagcgaagaggaggaggagagtcgtcccatgtcgtatgacgagaaacggcagctctctctcgacattaacaagttgcctggcgaaaagctggggagggtcgtgcacatcattcaggctagagagccgtctctgcgcgatagtaaccctgaggaaatagagattgattttgaaactctgaagccttcaactctccgggagctggaaagatacgtgcttagctgcttacgtaaaaaaccacgcaaaccatatacaatcaagaagccagtcgggaaaacaaaagaggaactggctttggagaagaagcgagagttagaaaagcgcctgcaggacgtgtccggccagctgaactctaccaaaaagcctcccaaaaaggctaacgaaaagaccgagtcatccagcgctcaacaggtagccgtcagccggctgtccgcttctagcagtagttcggactcttctagtagttcttcctcctcttcatcatctgacacgtctgattctgacagcggctag

SEQ ID NO: 216230 - DNA, 2511 bp, Artificial Sequence
  Description of Artificial Sequence: Synthetic coding sequence
atgctccagaatgtgactccccacaataagctcccgggagagggaaacgccggtctactgggtctgggtccagaggcagccgctcctgggaaacggatcaggaagccatctctgctgtacgaaggctttgagtctccaacgatggcttctgtgcctgctctgcaattaacacctgccaatccaccacctccggaggtatcaaatcctaaaaaaccaggccgagtgaccaatcaactccagtacctccacaaagttgtcatgaaagcactgtggaagcaccagtttgcctggccctttcgccagcctgtcgatgcggtgaaactcgggctgcccgactatcacaagatcatcaagcagcctatggacatgggtacgatcaaacgcagactggagaataattattattgggccgcatccgaatgtatgcaggacttcaatactatgtttacaaactgttacatctacaataagcccaccgacgacatcgttttgatggcccagacgttagaaaagatctttctccaaaaagtggcaagcatgcctcaggaagaacaggagttggtggtcactattccgaaaaattcgcacaagaaaggtgcgaagctggcagccctgcaaggatccgtcaccagcgcacaccaggtgcccgcagtgtcttcagtttcgcatacggcgctttatacaccccctccagagattcctacaactgttttgaatatcccacacccttccgttataagcagtccattgctgaaaagtttacactctgctggacctcccctgcttgctgtgactgccgcacccccagcgcagccgttagcaaagaagaagggggtgaagcgaaaagccgataccacgacccctacgcctaccgctatcctagctcccggttcccccgctagcccgcctggcagtttagagcccaaagcggcaagactgcccccaatgaggcgcgaatctggccgacccataaagccaccccgaaaagacttgcctgatagtcaacaacagcatcagtcttcaaagaaaggtaaactaagtgagcagctcaaacattgtaacggcatcctgaaggagctgctgagcaagaagcacgctgcttacgcctggccgttctataaaccagtcgatgcctcagcactgggtctacatgactaccatgacatcatcaagcatcccatggatctatccactgtgaaacggaaaatggaaaaccgggattatcgagacgcgcaggaattcgcagctgacgtcaggcttatgttctctaattgttacaagtacaacccacctgatcatgacgttgttgccatggctcgtaaactgcaggacgtttttgaattccggtatgctaagatgcctgatgagccactggaaccaggtccactgccagtctctaccgccatgcctccaggcctagccaagtcctccagcgaaagctcatccgaggagtcatcaagtgagtcttctagtgaggaggaagaagaagaagacgaggaagatgaagaagaggaagagtctgagtctagcgactctgaagaagaacgcgcacataggctcgccgagctgcaggagcagctcagagcggtgcacgagcagctcgctgcattgagtcagggccctatatccaagcctaaacgcaagcgagaaaaaaaagaaaagaaaaagaagagaaaggccgagaagcataggggtcgcgctggggctgatgaagatgataaaggacccagggctccacgcccaccacagcctaaaaagtcgaaaaaggcctctggatccggcggtggctccgccgctctgggacccagtgggttcggacctagcgggggttccggcaccaagctgcaggccggtgtacagtggcgggatctggggcttcttcagccccctttgctgggctttaagcggttttcttgcctcagcctgccctccagccaggattacaggctgcccaagaaagctactaaaaccgctccacccgcactgcctacaggctatgacagtgaggaagaagaagaatcgcgccctatgtcatacgatgagaagaggcagttgagcctggatatcaataaattgcccggtgaaaagctcggccgagtcgtccatatcattcaggccagggagccttctctcagagacagcaatccagaagagatcgagattgattttgagacacttaaaccaagtacattgagagaactggagaggtatgtcctcagctgtttgagaaaaaagccacgtaaaccttacaccataaaaaagcctgtgggcaagactaaagaggagctggccttggaaaaaaaacgtgaattagagaagagactccaagatgtgtcaggacaattaaacagcacaaaaaagccccctaaaaaggccaatgaaaagaccgagtcctcctctgcccagcaggtggccgtgagcaggcttagtgcctcctcctcttcctcggatagctccagttcaagcagctcctcctcttcatctgacacatccgatagcgattctggatag

SEQ ID NO: 216231 - DNA, 2511 bp, Artificial Sequence
  Description of Artificial Sequence: Synthetic coding sequence
atgttgcaaaacgtaacaccccacaataaactgcccggagagggtaacgcgggattgctaggactggggcctgaagcggctgcccctggaaaacgaatccgcaagccatcccttttatatgaaggtttcgagtctccaacaatggcttccgtaccggctcttcagcttacgccggctaatccgccaccacctgaagtaagtaatccaaaaaagcctggccgagtcacaaatcaacttcagtacttacacaaggtggtaatgaaggccctctggaagcaccaattcgcctggcctttcagacagcctgtagacgccgtgaaactcgggctccccgattaccataaaataattaaacagccaatggatatgggcacaatcaaaaggcggttggagaacaattactactgggcggcatctgaatgtatgcaggactttaacaccatgtttaccaattgctacatatacaataaaccgactgacgatatcgtattaatggcacaaactctcgagaagatctttttgcagaaagtggcttccatgcctcaggaggagcaggaattagtcgtgactatccccaaaaacagtcataaaaaaggggcaaaactagccgcattgcaaggctcagtgaccagcgcccaccaggtgcctgcggtttccagcgtctcccacactgctctttatactcctcccccagaaatcccaacaacagtttttaatatcccccacccttctgttatctctagtccactattgaaatctctccactccgctggcccacctttactggccgtgacagccgctcctcctgcccagcccctggccaaaaagaaaggggtaaaaagaaaagccgacacgacaacacccacccccaccgcaatcctcgcacctgggagtcccgcaagccctccgggttcactggagccaaaagcagctcgcctgccgccaatgcgaagggaatccgggagaccgatcaagccacctaggaaggatctccccgacagtcagcagcagcatcagtcaagtaagaagggcaagctctctgaacagctcaaacattgtaacgggattctcaaagagctgctctcaaaaaaacatgcagcctacgcatggcccttttataagcccgtcgatgcgtctgcccttggactccacgattaccacgacatcattaagcaccctatggatctgagtacggtaaaacgtaagatggaaaatcgagactaccgcgatgcccaggaattcgctgctgatgtgcgcttgatgtttagcaattgttataaatataaccctcctgaccacgatgttgtagccatggcccgaaaactacaggacgtgtttgagttcagatacgccaaaatgccggacgagcccttggagcccggtcccctgcccgtgtcaaccgctatgccaccaggtctggctaaatcgtcatcagaaagcagctctgaagaatcctcctctgaatcctcttccgaggaggaagaagaggaagatgaggaagacgaggaggaggaagagagcgagagtagcgacagtgaggaggagcgagcccacagacttgctgagctgcaagagcagcttagagcagtacacgagcagctggctgcactgagccagggccctataagcaaaccgaaaagaaaacgtgagaaaaaggagaaaaagaaaaagcggaaggcggaaaaacaccggggtagggccggagctgatgaagatgacaagggccctcgggcaccaaggccaccccaaccgaaaaaaagcaagaaggcttctggaagcggtggtggctctgctgctttgggcccatcagggtttgggccatctgggggaagcggcacaaagctgcaggctggagtgcagtggcgagacctcggtttgctgcagccaccactgctgggtttcaagagatttagctgcctgtcactcccttccagtcagaactatcgtctgcccaaaaaagctactaagactgctcccccagcgcttccaactggctatgatagtgaagaagaggaagagagcagacctatgtcttacgacgaaaagcggcaactttcccttgatatcaataaactgccaggagaaaagctgggccgagtggtccacatcattcaggctagagagccttcactcagagactctaaccctgaagagatcgaaatagatttcgagacactgaaaccgagcactctgagagagttagagcggtacgtgctgtcctgcctgagaaagaagccgaggaaaccctacacgattaagaagcccgtggggaagaccaaggaggagctggctctggaaaagaaaagggagctcgaaaaacggctccaagacgtgagcggccagcttaactctacgaagaagcctcctaagaaagctaacgaaaagacagaaagctcaagcgctcaacaggtggccgtgtcaaggctgagcgccagttcaagttcatcggactcatctagcagcagtagctcaagcagtagctctgatactagtgattcggatagtggatag

SEQ ID NO: 216232 - DNA, 2265 bp, Artificial Sequence
  Description of Artificial Sequence: Synthetic coding sequence
atggcgtccgtgcccgctctgcagctgaccccggctaatccaccaccacctgaggtgtccaatcctaagaagccgggtcgggtcacaaaccaactccagtatttgcacaaggtggtgatgaaggcattatggaagcaccagtttgcctggcctttcagacagccagtggacgccgtcaaactgggactgccagattaccataaaatcatcaagcagcccatggacatgggaaccattaaacgcagattggaaaataactattattgggcggcaagtgagtgtatgcaggactttaacaccatgttcacaaactgctatatctataataagccaaccgatgacatcgtgctcatggcccaaactctggaaaaaatctttctgcaaaaggtcgcttcaatgccacaggaagagcaggagctcgtcgtgacaatccctaagaacagtcacaaaaaaggggcaaagcttgctgccctgcagggatccgtaactagtgcacaccaggtacctgccgtgagctcggtatctcacaccgcactgtacactccccctcctgaaataccgacgaccgtcttgaatatcccacatcccagtgttatctctagccctctgcttaagtctttgcactccgccggacctccactgctggccgtcactgcggcaccccctgcccagcccttggcgaagaagaaaggcgtaaagagaaaggccgataccacaactccaacacctaccgccatcctggcgccaggtagccccgcttcccctcctggtagcctggagccaaaagcagccaggctgcctcctatgagacgagaaagcggaaggcctataaagccaccgcgaaaggatctgccagacagccaacagcagcatcagtccagtaagaaaggcaaactgagtgaacaactgaaacattgtaatggaattctcaaagagctactatctaagaaacacgcggcttacgcctggccattttataagcctgtggatgcctctgctctagggctgcatgactaccatgacattataaaacacccaatggacctgtcgactgtcaagcgcaagatggagaatcgcgactacagggacgcccaggaatttgccgcagacgtgcgattaatgttcagcaattgctacaagtataacccgcctgatcacgacgtggtcgccatggcacgaaagctgcaggatgtctttgagttcagatacgcaaaaatgccagacgagcctttagaaccgggaccactccccgtttcaacggcgatgccacccggattagcgaagtccagttcggagtcctctagcgaagagtccagtagtgaaagctcctcagaagaggaagaggaggaggatgaagaggatgaagaggaggaagagtccgagtcttccgattccgaagaggagcgggcacatcggctcgccgagctacaggagcaacttagggcagtgcacgagcaactcgcggcactttctcagggaccaatctccaaacccaagcgaaaaagggagaagaaggagaagaaaaaaaagcgtaaggccgagaagcatagaggacgcgctggagcggacgaagatgacaaaggccctcgggctcctcgacccccacagcccaaaaagtccaagaaggcttcaggctctggagggggaagtgcagcccttggaccaagcggcttcggcccttctgggggatcaggaacgaaactgcccaaaaaggcgactaagacagcccctcctgcactccctacagggtatgacagcgaggaagaggaggaatctcgccctatgtcttacgacgagaagcggcagctctccctagatattaacaaactgccaggagagaaactgggacgcgtggtgcacatcatacaggcacgagaaccgtcactccgggactcgaaccccgaggagatcgagatcgactttgagactctcaaaccatccactctacgagagttggaacggtacgttcttagttgtctgaggaaaaaaccccgtaaaccctatacaattaaaaaacctgtaggcaagacaaaggaggagctggcactggaaaaaaaacgtgaactcgagaagaggctacaagatgtgtctggacagcttaacagcaccaagaaacccccaaaaaaagcaaatgaaaagaccgagagctcttccgcacagcaggtcgccgtttctaggctgtcagcatctagctcctctagcgactcatccagctcaagcagtagcagttcttcttccgacacatccgacagcgacagtggatag

SEQ ID NO: 216233 - DNA, 2406 bp, Artificial Sequence
  Description of Artificial Sequence: Synthetic coding sequence
atgttgcaaaatgtcacaccccacaataaactgcctggtgagggcaatgcaggcctcctgggcctggggcctgaggctgccgctcctggtaaaaggatcagaaaaccctccctgctctacgaaggtttcgaaagcccaactatggcctctgtccccgctctacagctcactcccgctaacccacctccaccagaggtctcaaatccaaagaaacctgggcgtgtcacgaaccaacttcaatatctacacaaggtggtcatgaaagccctgtggaagcaccagttcgcctggcccttccgacaacctgtggacgcagtcaaattaggactgcccgattaccacaagatcatcaaacagccaatggatatgggcactatcaagagacgactggagaacaattactattgggcagccagcgaatgtatgcaggattttaacacaatgtttaccaactgctacatctacaacaaacccaccgacgatatcgtcctgatggctcagactctcgagaaaatctttctgcagaaggtggccagcatgcctcaagaggaacaggaacttgtcgtgacgatcccaaaaaatagtcacaagaaaggagcaaaactggccgctttgcagggaagcgtcacatctgcccaccaggtgccagcagtgtcatcggtatctcacacagctttgtacacgccacccccagaaatccctaccaccgttctgaatatcccacaccccagtgtcatctctagtccactccttaagtctcttcattccgccggtccaccacttctggctgtgactgccgctccccctgcacagcccttagccaaaaagaagggtgtgaagcggaaggccgataccacaacacccactcctacagcaatcctcgcccctggcagcccagcgtccccccctggcagcctcgagcccaaggccgctcggctacctcctatgaggcgggaatctggaagaccgatcaaaccgcctcggaaggacctgccagacagccagcagcagcatcagagctccaagaaaggaaaactgtcagagcagttgaaacattgcaatggaatcctcaaagagctcctcagtaaaaaacatgccgcttacgcttggcccttctataaacccgtagacgcttcagcactgggcttgcacgactaccatgacatcatcaagcacccaatggatctctccaccgtaaaacgcaagatggagaatcgggattaccgcgacgcacaggagtttgctgccgacgtcaggcttatgttctcgaattgctataagtacaatcctccagatcatgacgtggtggcaatggccaggaagctgcaagatgtgttcgagttcagatacgctaagatgcctgatgagccactggaacctgggccactgccagtgtctaccgccatgccccctggactcgccaagagttcctccgagtcaagttccgaagaatctagcagcgaaagcagttccgaggaggaggaggaggaagacgaggaagatgaggaagaggaggaatccgaatcctccgatagtgaggaggaacgtgcccaccgattggccgaattgcaggagcagctgcgggcagtgcacgaacagcttgcagccctctctcagggcccaataagtaagcctaagcgaaagcgggagaagaaggagaaaaagaagaagcgcaaagctgaaaagcaccggggacgcgctggcgctgatgaggatgacaaggggccaagggcacctaggcccccacaaccaaagaaatcaaaaaaggccagcggctccggcggaggtagcgccgctctcgggccaagcggattcggaccaagcgggggatctgggaccaagctccctaagaaagccaccaaaacagcccctcctgcgcttcccaccggctacgactccgaagaagaagaggagagcagacccatgagttacgacgagaagagacaattaagcctagacatcaataagcttcccggagaaaaactgggtagggtcgtgcacataatccaagcaagggaacccagcttacgagatagcaaccctgaggagattgagatcgattttgagacattgaaaccgtccactctccgggagttggagcgctatgtcctgtcctgcctgcggaaaaagccacgaaagccatacaccatcaaaaagcccgttggaaagacaaaggaggagctcgccttagaaaagaagcgagagttggagaaaagactacaggatgtcagcgggcagctcaattctaccaaaaaaccgccaaaaaaagcgaacgaaaagactgaaagctcatctgctcagcaagtggctgttagtaggctgtcagcttcaagtagctcatctgactctagttcctccagctcctcaagcagcagctccgataccagcgacagcgattctggttag

SEQ ID NO: 216234 - DNA, 2046 bp, Artificial Sequence
  Description of Artificial Sequence: Synthetic coding sequence
atggacatggggactataaaacgacgtctggagaataattactattgggccgcttctgaatgcatgcaggacttcaatactatgtttactaactgctacatctacaataaacccactgatgatatcgtgctgatggcacagactctggagaagatcttccttcagaaagtagcctcaatgccgcaagaggaacaagagctcgtggtgacaatcccaaagaattcacacaagaaaggagctaagctcgctgcccttcaggggtccgtcaccagcgcgcatcaggtgcctgctgtttcaagcgtctcccacactgcgctgtatacgccacctccggaaatcccgactacggtactaaatatcccacatccctcagtgatttctagtcctctactgaaatctttgcactctgccggacccccacttctggcagtcaccgccgctccaccagcacagccactggctaagaaaaaaggcgtgaaacgcaaggccgacactacaacaccaaccccaacggcaatcttagcccctggcagccctgcttccccacctggaagcctggagcccaaggccgctcggctacctccaatgcgccgtgaaagtgggaggccaataaagcccccacggaaggatcttccagactcccaacagcagcatcagagctcaaaaaagggcaagcttagcgaacagttgaagcattgcaacggcatcctcaaggagttgttaagcaagaaacatgccgcttatgcctggcctttttataaaccagtggacgcgagcgccttgggcctccacgactaccacgacattataaaacatcctatggacctctctacggtgaagcggaagatggagaatcgagactaccgcgatgctcaagaatttgccgcagacgtccggctaatgttttcaaactgctacaagtataatccccctgaccacgacgtcgtggcaatggcaagaaaactgcaggacgtatttgagtttcgatacgctaaaatgccagacgaaccactggaaccagggccactgcccgtcagcacagccatgcctcctggcctcgctaagtcttccagcgagtctagctctgaggaatcgtcatccgagagttcaagcgaagaggaggaggaggaagatgaggaggatgaggaggaggaggagagtgaatcatctgattccgaggaggagagggcccaccggctggcagagctgcaggagcagctgcgagccgtgcacgagcagctagcagccctgagccaaggaccaatatctaagcccaaaagaaagagagagaagaaagagaaaaagaaaaaaaggaaggccgagaagcatcgtggacgggcaggcgctgacgaagatgataagggtcctcgggctcccagaccgccacaacccaaaaaaagtaagaaagctagcgggagcggtggagggtccgccgctctaggccctagcggcttcggtcctagtggcggatccggaactaaacttcctaaaaaagccaccaaaacagccccacctgccctccccacgggctacgacagcgaggaagaagaggagagccggcctatgtcgtatgatgagaaacggcaactgtcactggatatcaacaagctgccgggtgagaagctgggaagagtggtccatattatccaggcacgtgaaccgtctttgagagattcaaacccagaggaaatagaaatcgatttcgagactctcaaacccagcacccttagagaactcgagcggtacgttctgagttgcctgaggaagaaacccaggaagccttacactattaagaagcccgtgggcaagactaaggaggagctagccctggagaagaaaagagaactggagaagaggctgcaggatgtttcgggccagttaaatagcaccaagaaaccgccaaagaaagctaatgaaaagacggagtcctcttccgcacaacaggtcgccgtaagccgactgtctgcatcctcctcctcttccgactcctcatctagctcctcaagctcatccagctcagacactagcgattcggacagtgggtag

SEQ ID NO: 216235 - DNA, 4089 bp, Artificial Sequence
  Description of Artificial Sequence: Synthetic coding sequence
atgtccgccgagtcggggcctgggacccgtctacgaaatctccccgttatgggggatgggctggagacaagccaaatgagtactacccaggcccaggcacagccacagccagctaatgcggcatccactaaccctcctccaccagaaacatctaacccgaataaacctaaacgccagactaatcagcttcagtacctcctgagggtggtgctgaagactctgtggaaacaccaatttgcgtggccatttcaacagcccgtggacgccgtgaaactgaacctacccgactactacaaaattataaaaactcctatggacatgggaaccataaagaagcgattggaaaacaattattactggaatgcgcaggaatgtatccaagacttcaacaccatgtttacaaattgttatatctataacaaaccaggagacgacattgtgctgatggccgaggctttggagaaactattcttgcagaagattaatgagttaccaacagaggagaccgagattatgatcgtccaggcgaaagggaggggaaggggaaggaaggagacagggacggcaaagccgggtgtgtccactgtgccgaatacaacacaagcgtcaaccccacctcagacacagacaccccagcctaatccacctccggtgcaggccacgcctcatccctttccagccgtcaccccagacctgattgtacagaccccggtgatgacagttgtgcccccacagcctctccaaactcctcctcctgtgcctccacagccacagccgccacctgcccctgcacctcaaccagtgcagtctcatccacccattattgcagccactcctcagcctgtgaagaccaaaaaaggcgtcaaaagaaaagccgacaccacaacccctaccaccattgatcctatccatgagcctccatcgttacccccagagccaaagaccaccaagttgggacagcgccgagaatcttcacgacccgtaaaacctccgaaaaaggacgtgcccgacagtcagcagcaccctgcgcctgagaagagctcgaaagtgtcagagcagctcaaatgctgctctggcatcctgaaggaaatgttcgcgaaaaagcacgcggcttacgcctggcccttttataaacccgtggacgtggaagcattggggttgcatgattactgcgatatcatcaaacaccccatggatatgagtacaataaagtctaagctcgaggcaagggaataccgcgatgcccaggagttcggcgctgatgtaaggttgatgttttcaaattgctataaatataacccccctgatcacgaggtcgtggcaatggccaggaagcttcaggatgtgttcgaaatgagatttgcaaagatgccagatgagcccgaagagccagtggttgcggtctcatcccctgcagtgcctcccccaaccaaggtcgttgcacccccttccagtagcgacagctcttctgactcctcctccgatagcgattcatcgacggatgacagtgaagaagaaagagctcagcggctggccgagctacaagagcagctgaaggctgtgcacgagcagctcgcagctctgtcccagccccagcagaataaaccaaagaaaaaggagaaagataagaaggaaaagaaaaaggaaaaacacaagcgaaaagaggaagtggaggagaacaaaaagtccaaagccaaggagccacctcccaagaaaacaaaaaagaacaattcatcaaattccaacgtttccaagaaggaacccgctcccatgaagtctaaacccccacccacctatgaaagtgaggaagaggacaaatgtaaaccgatgtcctacgaagagaagaggcagctatccctggacattaacaagctacccggtgaaaagcttggccgtgtggtacatatcatacagtccagggaaccttctcttaaaaattctaatcctgacgagattgaaatcgacttcgagactctcaaaccgagcacactcagggagctggagcgctatgtgacaagctgtctgaggaagaagcggaaaccccaggctgaaaaggtagacgtgatcgccggttcaagtaagatgaagggtttttcatcatcagaatccgaatcttcctccgaaagctcatcctcagactcagaggattccgagacggagatggcgcctaaatctaaaaaaaaagggcacccaggccgtgagcagaagaagcatcaccaccatcaccatcagcaaatgcagcaggcaccagcccctgtgccccagcagcctccgcctccccctcagcagccgccacctcctcctccccctcagcagcaacagcagccaccccctccacctccccctccatccatgcctcagcaagcagcccctgcaatgaagtcaagcccccctccgtttatcgccacccaggtacctgttctcgagcctcagctgccaggctctgtgtttgatccaatcggtcactttacccagcccattttacacctcccgcagcccgagttgcctccacatctgcctcagcctccagagcactcaactccgccacatctcaatcagcacgctgtcgtatctcccccagccctccataacgcattacctcagcaacctagcaggccgagcaaccgcgctgctgcactacctcccaaacctgcccgaccgcctgcagtcagcccagctctaacgcaaacgccccttctcccgcagccccctatggcacagccgccacaagtattattagaggacgaagagccacccgctcccccactcacctcaatgcagatgcagttgtacctgcagcagttgcaaaaagtccagcccccaactccccttctgccctctgtcaaagtccagtcacagccccctccgcctctcccaccccctccacaccccagtgtacaacagcagctccagcagcaacctcccccaccaccgccaccccagcctcagccgcctcctcagcaacaacatcagccacctccgagacccgttcacctacagcccatgcagttcagtactcacattcaacagcctcccccacctcaagggcagcagccacctcacccacccccaggccagcaaccaccacctccacagcccgctaaaccccagcaagtgatacaacatcatcacagccccagacatcacaagtccgatccatacagtacgggccatttacgtgaagccccttctcctctgatgatccactctccccagatgtcacaatttcaatcactcacccatcagtccccacctcagcagaatgtgcagccgaaaaagcaggaactacgggctgccagcgttgtccagccacagccactggttgtcgtgaaagaggagaaaatccactctcccattattagatcagaaccctttagccctagtctcaggccggagcctcctaagcacccagaatctataaaagcaccagtgcatcttccccagcgccctgagatgaaacctgttgatgtggggagacccgtgattaggccacccgagcaaaacgccccaccacctggagcccctgacaaggacaaacagaaacaggaaccaaagacaccggttgccccaaagaaagaccttaagatcaaaaatatggggagttgggcatctctcgtgcagaagcacccgacaactccatcttctaccgccaagtcatcgagtgactcatttgaacagtttcggagggccgcacgggaaaaggaagagagggagaaggcattgaaggcacaggccgaacacgctgaaaaagagaaggagcgcctgaggcaggagcggatgaggtctagggaagatgaagatgccctcgagcaggccaggcgtgctcacgaagaggctagacgaagacaggagcagcaacagcagcagcggcaggagcagcagcagcagcagcaacagcaggctgctgccgtggccgcagccgcaaccccccaggcgcaaagcagccagccgcagagtatgctggatcaacaacgcgagcttgcgaggaagcgagaacaagaaaggcgtcgacgggaggctatggctgccacaattgacatgaattttcaatctgatctgctcagcattttcgaagagaatttgttctag

SEQ ID NO: 216236 - DNA, 2385 bp, Artificial Sequence
  Description of Artificial Sequence: Synthetic coding sequence
atgagtgctgagtctgggccaggtacaaggctgagaaaccttcctgtcatgggtgacggtttagagacttcccagatgtcgaccactcaggcccaagctcaaccacaacccgcaaatgctgcaagcactaatccgccacccccagaaacaagcaacccaaacaagcccaagcgtcagacgaatcaacttcaatatcttctgcgcgtggtgctgaagacgctgtggaagcatcaattcgcttggccattccagcagcctgttgatgcagtgaaactgaaccttccggattactacaaaatcatcaagaccccaatggacatgggtacgattaaaaaacgtcttgaaaataactattattggaacgcccaggaatgcatccaggactttaatacaatgttcacaaactgctacatatacaataaaccgggagatgacatagtattgatggccgaggcccttgagaagctttttctccaaaagatcaatgagctacctactgaggagaccgaaattatgatagtgcaggccaagggacgtggaaggggtaggaaagaaaccggcaccgctaagcctggagtgagcactgtgcctaacactacacaggcctctacccctccccagacccagacgccccagcccaatccccctccagtccaggctactccccatccattccccgcagtgacgcccgatttgattgttcaaactcctgttatgacagtagtgcccccacagccgttgcagacaccaccgcctgtgcccccacagccgcagccccctcccgctcctgcacctcagcccgtgcagagtcatccacctatcattgcggcaaccccacagcccgttaaaaccaagaagggagtgaagcgcaaggctgacacaacaacacccaccacaattgaccccatccatgagcccccatccctaccgccagaacccaagaccactaagctggggcagaggcgcgagtcttcaaggccagtgaaaccccctaagaaggacgtgcctgattcacagcagcatccggctcctgaaaagtctagcaaggtctccgagcagttgaagtgctgctctggcatcctgaaagagatgtttgcgaagaagcacgctgcttacgcctggccgttctataaacctgtcgacgtggaggccctcgggctccacgattattgtgacatcataaagcaccccatggacatgagcaccatcaagtccaagcttgaggccagggaataccgcgatgcccaggagttcggggcagacgttaggcttatgttttctaactgctacaaatacaaccccccagatcacgaggtggtcgccatggcccgaaaacttcaggacgtatttgagatgcgcttcgccaaaatgccagacgagcctgaggaaccagtcgtagccgtgagctcgcccgctgtacccccaccaaccaaagtggtcgcgccaccatccagctctgattctagcagtgactcttccagcgactccgatagcagtaccgacgattcagaggaggaaagagcacagcgcctggccgagctccaggagcagctgaaagctgtccatgaacagttggctgcgctctcccagcctcagcagaacaaacccaagaaaaaggagaaagataaaaaagagaagaagaaggagaagcataagcgcaaggaggaggtggaggaaaacaaaaaaagcaaagctaaagagccccctccgaaaaagacgaagaagaataacagtagtaatagtaacgtgtccaaaaaagaacccgcaccaatgaaatccaagcccccaccaacctatgagagtgaagaagaagacaaatgtaaacccatgtcttacgaggagaagaggcagttaagcctggacattaataaactaccaggggagaagctcggacgtgtggtgcatataattcagtctcgcgagccaagcctgaagaatagtaatcccgacgagattgaaatcgactttgaaaccttgaagccctccaccctaagagaactcgaacgctacgtcacctcctgtctgcgcaaaaaacgaaagccccaggctgaaaaggtggacgtaatcgccggaagctcaaaaatgaaaggattttctagttccgaaagtgaatcatccagtgagagttcctcctcagactcggaagactccgagacggctttttgcactagcggagacttcgtgtcacctggaccttcaccctaccacagccacgtgcagtgtgggagattccgggagatgctgcggtggttcctggtcgacgtcgaacagaccgccgcagggcagccccaccgacagtccgctgctggaccagcaatcacctgggcaccagccatcgcctatccctctcctgagtgcgcgaggtgttgtgtcggatgcagttag

SEQ ID NO: 216237 - DNA, 2169 bp, Artificial Sequence
  Description of Artificial Sequence: Synthetic coding sequence
atgtccgcagaaagtgggcctggcactcggttaaggaatttgcccgttatgggcgacggattggagacctcacagatgagcacaacgcaggcacaggcccagcctcagccggctaatgctgcatccacaaaccctcctccccctgaaacgtcaaaccccaataagccaaaaaggcagacaaatcagttgcagtacctgctgagggtcgtccttaagaccctctggaaacatcaattcgcgtggccctttcaacagccagtggacgcagtcaagttaaatcttcctgactactataagatcataaaaacccctatggacatgggcacaatcaagaaacggttggagaacaattactattggaacgcacaggaatgcattcaggattttaacacgatgtttacaaattgctacatttataataaaccgggagatgatattgtgctaatggccgaagctctggagaagctctttctgcagaaaattaatgaactgcccaccgaggaaacagagattatgatcgtccaggccaaggggcgaggtagaggaaggaaggagactggaactgctaagccgggtgtctctaccgtgccaaatactacgcaggccagtactccacctcaaactcagaccccccaaccaaatccacctcccgtccaggcgactccacacccatttcctgcggtgacccctgacctcatcgtccagactcccgtcatgaccgtggttccgccacagcccttgcagacacctccaccggtgccccctcagccacagccacctcctgcccctgcgcctcagcctgttcagtcacatcccccaatcattgccgctaccccccaacccgttaaaaccaaaaagggggtgaagagaaaagctgacaccacaacacccacaactatcgaccccatccacgagcctccttcactgccacctgaacccaagaccacaaaactaggccagagacgcgagagttctcgacccgttaaacccccaaagaaggatgtgcccgatagccagcaacatccagccccagaaaagagctcaaaagtgagtgaacagctcaaatgctgcagcggaatcctgaaggagatgtttgcaaaaaaacacgcagcctacgcctggcctttttacaagccagtggatgtggaagcacttgggctgcatgattattgtgatattatcaagcatcccatggacatgtccaccatcaaatccaaactggaagcaagagaataccgcgacgcacaggaatttggagccgatgtgaggttgatgttctctaattgctataaatacaatcctccagaccacgaagtggttgctatggcaagaaaactgcaggatgtgttcgagatgcgttttgcaaaaatgcccgacgagccagaagagccagtggtggccgtatcttctcccgctgtaccaccgcctacaaaagtggtagcacccccaagctcttccgactccagctctgactcctcttcagactcggatagcagtacggacgacagcgaagaagagcgtgcccagcggttggccgagctgcaggaacagctgaaagctgtccacgagcaactagctgccctgtcccagcctcagcagaataagccaaagaaaaaggagaaagataaaaaggagaagaaaaaagaaaagcacaagcgaaaagaagaggtcgaggagaacaagaagtctaaagccaaagaaccaccaccaaagaaaactaagaagaataactcatccaactccaatgtgtcaaagaaagaacctgctcctatgaagagtaaacctccgcctacctatgagtcagaggaggaggataagtgtaaaccaatgagctatgaagagaagcgccagctttctctcgacattaacaagcttccgggagagaagctgggccgtgtcgtgcatatcatccaaagcagagaaccttcccttaagaattctaatcccgatgagatagagatcgactttgagacactgaaaccttcaactttgcgagaactagagagatacgttacaagctgtcttcgcaagaaacggaagccacaggccgagaaagttgatgttatcgctggctcctccaaaatgaagggcttcagcagctccgaatctgagagcagctcagagagcagctcctccgactccgaagatagcgagaccggacctgcgtag

SEQ ID NO: 216238 - DNA, 2625 bp, Artificial Sequence
  Description of Artificial Sequence: Synthetic coding sequence
atggacttgaacacgatcaagaagcgtttagagaacaagtactacgctaaggccagcgaatgcattgaggattttaatacaatgttttccaactgctacctgtacaacaaacctggggacgatattgtgctgatggcccaggcactagaaaagctattcatgcagaaattaagccaaatgcctcaggaagaacaagtggtgggtgtcaaggaacgcatcaagaaaggcacgcagcaaaatatagctgtcagttcagccaaagagaagagctccccctccgccaccgagaaagtctttaaacaacaggaaatcccctccgtttttcctaagacctcgatctcccccctgaatgtagtgcagggagcgtccgttaactcatcctcccagacagccgctcaggtgaccaaaggcgtgaagagaaaggctgataccaccaccccagcaaccagtgccgtgaaagcttctagcgaatttagcccaacgttcactgaaaaatcagtcgctctgccgcctatcaaagaaaacatgcccaagaacgtgcttcctgattctcagcagcagtacaatgtagtgaagaccgtgaaagtgactgaacagcttaggcactgttcagaaatcctgaaggaaatgctcgcaaaaaaacatttctcttatgcgtggccgttctacaaccctgtggacgtgaatgcgttaggcctgcataactactacgatgtcgtgaagaatccaatggacctcggtacaatcaaagagaagatggataatcaagagtacaaagacgcgtataagttcgcagccgatgttcgcttgatgtttatgaattgttataaatataatccccctgaccatgaagtggtcactatggcaaggatgcttcaggatgtctttgaaactcacttcagcaagataccaatcgagccggtcgaatccatgcctctctgctacattaagactgatatcacggagaccaccggtagagaaaataccaatgaagcaagcagcgaaggaaactcctcagatgacagcgaggacgaacgggtgaagcgtctcgccaagctgcaagaacagctgaaagcagtgcaccaacagttacaggtgttaagtcaggtgcccttcaggaaactgaataaaaagaaagagaaaagcaaaaaggagaaaaagaaggagaaggttaataactcaaacgaaaaccctcggaagatgtgcgaacagatgcggctcaaggaaaaatccaaacgaaaccagccgaagaagaggaagcagcaatttattggtctcaagtctgaggacgaagataacgctaagccaatgaattacgacgaaaagcgtcagctgtccttaaacatcaacaagttgccaggagacaagttaggtagagtggtgcatattatacagagccgggagccctctctgtctaactcaaacccagatgagattgagatcgactttgagacactgaaagcctctacattaagggagctggaaaagtacgtttctgcttgtctccggaagaggccactgaagccccctgccaagaaaattatgatgagcaaggaagaactccacagtcagaagaaacaggagctggaaaagaggttacttgacgtgaacaaccaactgaacagcagaaaaaggcagaccaaatccgataagacgcagcctagcaaggctgttgaaaacgtcagccggctgagtgaaagctctagttcgtcgagcagctcttccgagtccgaaagttcttcatctgaccttagctcatccgactccagcgatagcgagagcgaaatgttccctaagttcaccgaggttaagcccaatgattcccctagcaaggagaatgtcaaaaaaatgaagaatgagtgcatccctccggagggaagaacaggtgtgacacagatcggctactgcgtgcaggacacaacgtctgccaataccaccctcgtgcatcagactacgccatcgcatgtaatgcccccaaaccatcaccagctggcttttaattatcaagagttagaacacctccaaacagtaaagaatatctctccactgcagattctgcccccttctggcgattctgagcagctttctaacggtatcaccgtgatgcaccctagcggagactccgacactaccatgctcgagagtgagtgtcaagcccctgtgcaaaaggacatcaagattaaaaacgctgactcttggaagtccctcgggaaacctgtcaagcctagcggggtgatgaagagcagtgatgaattgtttaaccagtttcgcaaggcggctatcgagaaagaagtcaaggcccgaacgcaagaactgatacggaaacacttagagcaaaatactaaggagctgaaggcatctcaggaaaatcagagggatttgggtaacgggctcacagtggaatcattctcgaacaagatccaaaataagtgttcaggggaggaacagaaagagcatcagcaatcaagcgaagcccaggacaagagcaagctttggcttttaaaggacagggatctcgccaggcagaaagaacaagagcggagaagaagagaggcgatggtggggaccatcgacatgacattacagagcgacatcatgactatgtttgaaaacaactttgattag

SEQ ID NO: 216239 - DNA, 45 bp, Artificial Sequence
  Description of Artificial Sequence: Synthetic coding sequence
atgtcgctgccctctaggcagacagctatcatagtaaatccatag

SEQ ID NO: 216240 - DNA, 2844 bp, Artificial Sequence
  Description of Artificial Sequence: Synthetic coding sequence
atgagtctgccctctcgccagacagccatcattgtgaatccgcctccacctgagtacatcaataccaagaaaaacggtagattgaccaaccagcttcagtacctgcagaaagtagtgctgaaggatctgtggaagcatagtttcagctggcctttccagaggccggtggatgcagttaagctccagttgcctgattactataccatcatcaagaacccaatggacctcaacaccataaagaagcgtctggagaacaaatattatgccaaagccagtgaatgcattgaagactttaataccatgttttctaattgctacctatacaataaacccggagacgatatcgtacttatggctcaggcactggaaaaacttttcatgcagaaactatcccagatgccacaagaggagcaagtagtgggagtaaaagaacgaatcaagaaaggaacgcagcagaatatcgctgtctcttcggccaaagaaaagtcgagcccctccgcaacggagaaggtgtttaagcaacaggaaatcccctcggttttccctaagacaagcatttcccccctgaacgtggtccagggtgccagcgtcaatagctcgtcccaaactgccgcacaagttaccaaaggcgtaaaaagaaaagccgacaccacgacacccgctaccagcgcagtgaaagctagcagcgaattctctcctaccttcaccgaaaaatcggttgcactcccgcctatcaaagagaacatgccaaaaaacgtgctgcctgattcacagcagcaatataacgttgttaagaccgttaaagtcacggaacagctgcgccactgtagtgagatactgaaagaaatgctggctaaaaagcacttcagttacgcctggccattctacaatccagtggacgtaaacgcgctgggtttgcacaactactatgacgtggttaaaaacccgatggacttgggcacaatcaaagaaaagatggacaatcaggagtataaagatgcatacaagttcgcagctgacgtgaggctcatgtttatgaattgctataagtataacccaccagaccacgaggtggtaacaatggcacgtatgctccaagacgtgtttgagacgcacttctcaaagattccaatcgaacccgtagagtctatgcctctgtgctatataaaaaccgacatcactgaaacaactggccgagaaaacactaatgaggcctcttccgagggtaacagctctgacgacagcgaggatgaacgggttaagcgcttggccaagctgcaggaacagcttaaagcagtccaccagcagctccaggtcctgagccaagtcccattccgtaaactgaacaaaaagaaagaaaaatctaagaaggagaaaaaaaaggagaaggtgaataatagcaatgaaaatcccaggaaaatgtgcgagcagatgagattaaaagagaaatccaagaggaatcagccaaagaaacggaaacagcagtttatcggcctcaagagcgaggacgaggataatgccaaaccaatgaactacgatgaaaagcgccagctgtcactcaatattaataagttgcccggtgacaagctgggtcgtgtggtgcacattattcagtcgcgggagccttccctgagcaactccaatccagatgaaatagagattgatttcgaaaccctcaaggcatcaactctgagagaactggaaaaatacgtttcagcgtgtctgaggaagcggccacttaagcccccagccaagaagattatgatgagtaaggaagagttacacagtcagaaaaagcaggaactggagaagcgcctgttggatgtgaacaatcagctgaactctaggaagcggcagaccaagtcagacaagacacagccttcgaaggctgtggagaatgtctcccgtctaagcgaatcctcgagttctagcagctctagcagcgaatcagagagcagttcttctgacctgtcatccagcgatagttccgattcagaaagtgaaatgttcccaaagttcactgaagtgaagcccaatgatagcccatccaaggaaaacgtgaagaaaatgaagaatgagtgtatacccccagaagggagaacaggggttacacaaatcggatattgtgtccaggataccaccagtgctaacacaacgttagttcaccagactacccccagtcatgtgatgccacctaaccaccatcagttggccttcaactaccaagagttggagcatctccaaaccgtgaagaatattagccccctgcagatcttgcccccaagtggtgattccgaacagctgtctaacggcataaccgttatgcatccatcaggtgactccgatactacaatgctggaaagtgagtgtcaggctcctgttcaaaaggacattaagatcaaaaatgccgattcatggaagtctcttggcaagcccgttaagccctcaggagtaatgaaatcttccgatgaactgtttaatcagttcaggaaagcagcgattgagaaagaggtgaaggctcgcacacaagagctgataaggaagcatttggaacagaacaccaaagagttaaaagctagtcaagaaaatcaacgagacctgggaaacggcctgaccgtcgagtctttctcaaacaagatacagaacaaatgttccggcgaagaacaaaaggaacaccagcagagctccgaagctcaggataagtccaaactgtggcttttgaaggatcgggacctggccaggcagaaggaacaggagcggagaaggagggaagcaatggtcggtaccatagatatgaccctgcagtccgatattatgaccatgtttgagaacaacttcgactag

SEQ ID NO: 216241 - DNA, 2706 bp, Artificial Sequence
  Description of Artificial Sequence: Synthetic coding sequence
atgtcattgccctctcggcagactgctatcattgtgaaccctccccctccggaatacatcaatacaaaaaaaaatggtagactgaccaaccagttgcagtacctccagaaggtagtgctaaaggatctgtggaagcacagcttttcatggccatttcaaaggccagttgatgcagtcaagttgcaattgcccccaggggatgacatcgtgctcatggctcaagcactggagaagttattcatgcaaaaattatctcaaatgccccaggaggagcaggttgtaggcgtcaaagaacgcatcaagaaggggacccagcagaatatcgctgtcagttcagcaaaggaaaaatcctcaccatctgctactgagaaggtgtttaagcagcaagaaatcccgtcagtgttccctaaaaccagcatatctccgttaaacgttgtgcaaggggcttcagttaattcaagcagccagacagcagcacaagttacgaagggagtaaagagaaaggcagataccaccacccctgcaaccagtgcagtgaaagcaagtagtgagttctctcccacctttacggagaagagcgtagccctgccccctatcaaggagaatatgcccaagaatgtactccctgactcacaacaacaatacaatgtcgtgaagaccgttaaggtcactgagcagttaaggcactgcagtgagatcctaaaggagatgctggctaagaaacacttcagttacgcctggcctttttataacccggtggatgtcaacgccctgggactgcataactattacgacgttgttaagaatcctatggacctgggcactatcaaagaaaaaatggacaatcaggaatacaaggatgcgtataaatttgctgccgatgtcagattgatgtttatgaattgttataagtacaaccctccagaccacgaggtagtcacaatggcccgaatgctccaggacgtgttcgaaactcatttttctaagattcccatcgaacctgtggagtctatgccactctgctacataaaaacggacattaccgagacaactggcagggaaaatactaacgaggcatcctcagaaggaaactcctccgacgactcagaagatgaaagagtgaagcggctggccaagctgcaggagcagcttaaggctgtccaccagcagctgcaggtcctcagccaggttcccttccggaagctgaacaaaaaaaaagagaagtctaaaaaggagaaaaaaaaggaaaaggtgaataacagcaatgagaacccgcgtaaaatgtgcgagcagatgaggttaaaggaaaagtcaaaacggaaccagcctaaaaagcgtaaacagcagttcattggcttaaagtccgaggatgaggacaacgccaagcccatgaactacgatgaaaagcgccagctgagcttgaacattaataagctgcccggtgacaagctgggccgagtggtgcatatcatccagtcccgcgagccctccctgtcaaactccaatccggatgagatcgaaatcgattttgagaccctcaaagcctccacccttagagaacttgagaagtatgtgagcgcctgcctcaggaagagacctctgaagccaccagcaaagaaaatcatgatgagcaaagaagagctgcactcacagaagaaacaggaactggaaaaaaggctcctcgacgtaaacaaccagctcaatagcagaaagcgtcagaccaaaagtgacaagacccagccaagcaaagccgttgagaacgtgtctcggctgagcgagtcatcaagctcttcttcctccagcagtgaaagcgaatcaagttccagcgacctttctagtagcgacagctccgactccgagtccgagatgtttccaaagttcacggaggtcaaacctaacgactcaccttctaaggaaaatgttaagaaaatgaagaatgaatgtatccctcccgagggacgcacaggggtcacccagattggttactgcgtacaggacaccacatccgcaaacactaccctcgtgcatcagactactccctcgcacgtgatgccccctaaccaccatcagttggccttcaactaccaagaactcgagcaccttcaaaccgtcaaaaatatttccccattgcagatactgcctcctagtggcgactctgagcaactgtccaatggaattacagtcatgcatccctctggagactccgacacgactatgttggagagtgagtgccaagcccctgttcagaaagatatcaagattaagaatgccgattcctggaagtctctcggcaagcccgtgaaacccagtggagttatgaagtcatctgacgagctatttaaccagttcagaaaagcagcgatcgagaaggaagtcaaagcgaggactcaggaactgatccgaaaacatctcgagcagaacactaaggagctaaaagctagtcaagagaaccagcgcgacctcggcaacgggcttacggttgaaagtttctcaaataagattcagaataagtgcagcggtgaagagcagaaagagcatcagcaatcttcagaagcacaggacaaatccaagctgtggcttctgaaagatcgcgatctggccaggcagaaagagcaggaacgccgtaggagagaagccatggtcggaacaattgatatgaccctgcagtccgacataatgaccatgttcgagaacaacttcgattag

SEQ ID NO: 216242 - DNA, 2844 bp, Artificial Sequence
  Description of Artificial Sequence: Synthetic coding sequence
atgtccctcccatctcgacagactgcgattatcgtgaacccccctcccccagaatacattaacaccaagaagaacggcaggctgaccaaccaactgcaatacctgcagaaggtcgtgctgaaggatctatggaaacattccttctcgtggcccttccagcggccagttgatgccgttaagctgcagttaccggattactacactataatcaagaaccccatggacctgaacacgattaaaaaacgactcgaaaacaagtattacgcaaaagcctccgaatgtatcgaagattttaatactatgtttagtaattgttacctgtacaataagccaggcgatgacattgtcttaatggcccaagccctcgaaaaactgtttatgcagaagttatcacaaatgccacaggaggagcaggttgtgggggtcaaggaacggatcaagaagggcacccagcaaaatatcgccgtaagctctgcaaaggagaagtcttctccctccgccaccgagaaggtgttcaaacaacaggaaattccctcagttttcccaaaaacttctatatctcctttgaatgtcgtgcaaggggcttctgtgaacagctcatcacagactgccgcacaggtgacaaaaggggtgaagcgcaaggccgataccactactccagccacgtcagccgtcaaggcttcttcagaattcagccccactttcaccgaaaagagcgtggccctccctccaatcaaggagaatatgccgaaaaacgtcctgcccgacagtcagcagcaatacaatgtggtgaagactgttaaggtgactgagcaactgaggcattgcagtgaaatcttgaaagagatgctggctaagaaacatttttcatatgcttggccattctacaatcccgtggatgtgaatgcccttggtttgcacaactattacgacgtggtgaagaaccctatggatctgggaacgataaaagagaagatggacaaccaagaatataaagacgcatataaatttgctgccgacgtgcgcctgatgttcatgaattgctataaatataaccctcccgatcatgaggtcgtaacaatggctagaatgcttcaggatgtgtttgagacacacttcagtaagattccaatcgaaccagtcgagagcatgcctttgtgttacattaaaactgatattacagagactacaggtcgggaaaacaccaacgaggcaagctctgaaggtaatagcagcgacgactcagaggacgagagggtcaaacgccttgcgaaactgcaggaacagctcaaagccgtgcaccagcagttgcaagtgctgagtcaggtaccctttaggaaactgaacaagaaaaaggagaaaagcaagaaagaaaaaaagaaggaaaaagtaaataactcaaatgaaaatcctcggaaaatgtgtgagcagatgagattgaaagaaaaatctaagagaaatcaacccaaaaagaggaagcagcagttcattggcctgaaatccgaggatgaagataatgctaaaccaatgaattacgacgaaaagaggcagctgtccttaaatatcaacaaactgccaggtgacaaactgggaagagtggtgcatattatacaatcgagagagccaagcctttcgaacagcaatcctgacgaaatagaaatcgatttcgaaacactcaaagcctctacactccgtgagctggagaagtacgtatcagcctgcttgcgtaagcgcccactcaaaccacctgcaaagaaaatcatgatgagcaaggaagagctgcactcccagaaaaagcaggagctcgaaaaacgtctgctggatgtgaacaaccagctcaactcacggaaaaggcagactaaatctgataagacacaacctagcaaagcagtcgagaacgtctctcggctatcggagtcatcaagcagttcctcctcctcttcagaaagcgaatccagctctagcgacctgtcgagcagcgactcatctgactccgagagtgaaatgttccccaaattcaccgaggtgaaaccgaacgacagccccagcaaggagaacgtcaaaaagatgaagaacgagtgcatacccccagaaggaagaaccggggtgactcaaatcggctactgtgtgcaagataccacatcagccaataccaccttggtgcaccagaccacaccgtcacatgtgatgcccccaaatcatcatcagctcgcattcaactaccaggaacttgaacacctccaaacggttaagaatatctcgccactgcagatactaccaccgtccggcgacagcgagcagctctccaacggaatcaccgtcatgcatccttctggcgattcagatacaacaatgctggagagcgagtgccaagcgccagtgcagaaggacatcaaaatcaagaacgccgattcttggaaaagcctggggaagccggtgaagccctccggggtcatgaagtcctcagacgagctgtttaaccagttcagaaaagccgcaatcgaaaaggaggtaaaggccagaacgcaggagctcattcgcaagcacctcgagcagaacactaaggagttgaaggccagccaggagaaccagagggaccttgggaatgggctgactgtggagtcttttagcaacaaaatccaaaataagtgtagtggcgaggaacagaaggagcatcagcagagctcagaagcccaagacaagtctaaactgtggcttctgaaagaccgggacctggccagacagaaagaacaggaaaggaggcgccgtgaagccatggttgggacaattgatatgacactgcaatcagacatcatgaccatgtttgagaacaacttcgattag

SEQ ID NO: 216243 - DNA, 2844 bp, Artificial Sequence
  Description of Artificial Sequence: Synthetic coding sequence
atgagcctgccctctcgacagactgcgatcatcgtaaacccaccacccccagagtatatcaacacaaagaagaatggcaggctcaccaatcagcttcaatatctgcagaaggtggtgttaaaggacctctggaaacatagtttctcatggccatttcagaggccggtggacgccgtgaagttacagctgcccgattactacactattatcaaaaatcccatggatttgaacactattaaaaagcgactggagaataaatattacgctaaagccagtgaatgtattgaggacttcaatactatgttctctaattgctatctgtataacaagcctggcgatgatatcgtgctgatggcgcaggccctggaaaaactctttatgcagaaattgagccagatgccgcaggaggagcaggttgtgggggtgaaggaacgcataaaaaaggggacgcagcagaatatcgcggtcagctcagccaaggaaaaaagtagcccaagtgcaacagaaaaggtgtttaagcagcaggagatccccagcgtctttccaaagaccagtatatccccactaaatgtcgtgcagggagcctccgtgaattcctccagccagacggccgctcaggtgacaaagggagtgaaacgtaaagctgacaccaccacaccggcaacaagtgcagtaaaagcctctagtgagttctcccccacattcacagagaagagcgttgcgctgcctcccatcaaggaaaatatgcccaagaacgtgctgcccgacagccagcaacagtacaatgttgtgaagaccgtgaaagtcaccgaacaacttcggcattgcagcgaaattttaaaagagatgctggcaaagaagcatttttcatatgcctggcccttttacaatccagttgacgtgaacgctcttggattacataactactatgacgtcgtgaaaaaccctatggacctcggcaccattaaagaaaaaatggacaaccaggaatacaaggatgcttataagttcgctgccgacgtcagactgatgttcatgaattgttataagtataatccacctgatcatgaagtggtgacaatggcgaggatgcttcaagatgtttttgaaactcactttagcaagatcccgatcgagcctgtcgaaagtatgcctttgtgttacattaaaacagatatcaccgaaaccaccggaagagaaaacactaatgaggccagcagcgaagggaactcaagcgacgacagcgaagacgagagagtgaagaggctggccaaattacaggaacagctgaaggccgtgcatcaacagctccaagttctctctcaagtcccctttcgaaaacttaacaaaaaaaaggagaagtcgaaaaaggagaagaaaaaagagaaggtgaataacagcaatgaaaacccaagaaaaatgtgtgaacagatgcggctgaaggaaaaaagcaagagaaaccaaccaaaaaaaagaaaacagcaattcattggcctcaagagtgaggacgaggataacgcaaagcccatgaattacgacgagaaaagacaactctctctgaatatcaacaagctgccgggtgataagttaggccgtgtagttcatatcattcagagccgtgagccgagcttatcaaatagcaaccctgatgagattgagattgatttcgagacattgaaagcgtctactttgagggagctcgaaaaatatgtgagcgcctgccttagaaaacggccactgaagcctccagctaagaagatcatgatgagcaaggaggaactgcacagtcaaaagaaacaggagctggaaaaacgactcctcgatgtaaataaccagttaaatagtcgcaagcggcagacaaagtccgacaagacacagccctctaaagccgtcgaaaacgttagtaggctgagcgaatcttcttctagtagctcttccagcagcgagtcagaaagcagtagcagtgacctgtcatcgtctgatagctccgattccgagtccgaaatgttccccaaattcaccgaggtcaaaccaaatgacagtccttcaaaagagaatgtcaagaagatgaaaaatgaatgcattccccctgaaggaagaaccggtgtcacacagattggctactgtgtgcaggatactacctcggccaacacgactctggtgcatcagacaacgccttcacatgtcatgcccccaaaccatcatcagctcgcctttaactatcaggagctggaacatctccaaacagtgaagaacatatccccactgcagatccttcctccctccggagatagcgagcagttgtccaatggcataaccgtaatgcatccaagtggagattccgatacaaccatgctcgaaagcgagtgccaggcccctgtgcagaaggacatcaagattaaaaatgccgactcctggaagagcctgggtaagccagtgaagccgagcggggttatgaagagttcagacgaactgtttaatcagtttagaaaggctgccatcgaaaaggaggtgaaagctcgtacacaggaactgatcagaaaacatctggaacagaataccaaagaattgaaagccagccaggagaatcagcgcgacttgggaaatgggctgactgtggagagcttctccaataaaattcagaacaagtgcagtggcgaggaacagaaggagcaccagcaaagctccgaggcccaggataaaagtaaactgtggctccttaaggatcgcgacctcgcacgtcagaaggaacaggagagacgccgaagagaagctatggtcggcaccatcgacatgactttacagtctgacatcatgaccatgttcgaaaataacttcgactag

SEQ ID NO: 216244 - DNA, 531 bp, Artificial Sequence
  Description of Artificial Sequence: Synthetic coding sequence
atgtccctacccagccggcaaacagcaattatagtaaatccacctccccctgaatacatcaacactaagaagaacggccgactcaccaaccaacttcagtatctgcagaaggtggtgctgaaggacttgtggaagcatagctttagttggccgttccagaggccggtggacgcagttaagctacaactgcccgactattacaccatcatcaagaacccaatggacctgaatacaatcaagaagcgcctggagaataagtattatgccaaagcttccgaatgcattgaagactttaatactatgttcagtaactgttacctgtataacaagcctggcgacgacatcgtcctgatggcacaggccttggagaagcttttcatgcagaaactcagtcagatgcctcaagaggagcaggtagtcggtgtcaaagaacgaatcaagaaaggtacccagcaaaacatcgcggtgtctagtgcgaaggaaaagagttcaccgagtgctaccgaaaaagttttcaagcagcaagagtag

SEQ ID NO: 216245 - DNA, 1389 bp, Artificial Sequence
  Description of Artificial Sequence: Synthetic coding sequence
atgagcctgccatccaggcaaaccgccattatcgtcaaccctccacccccagagtatattaacacaaaaaagaatggcagactcacaaatcagctccagtatctgcagaaagtggtgttgaaggatctgtggaagcacagcttcagttggccctttcaacgaccagttgatgccgttaagttgcagctgcctgactattataccattatcaaaaaccctatggatctgaatactatcaagaaaagactggaaaacaaatattacgccaaggcttcggagtgcatcgaggattttaacacaatgttctcaaattgctacttatacaataaacccggtgatgatatcgtgctcatggcccaggccttggagaagctttttatgcagaaattatcacagatgccccaggaagaacaggtggttggggttaaggagaggatcaagaagggtacacaacagaacatcgcagtttctagcgccaaggaaaaaagcagcccttctgccacagagaaagtcttcaaacagcaggagataccgtccgtatttcccaagacatctattagcccgctgaatgtggtccagggcgcatctgtgaattcttcttcacaaaccgcagctcaggtgactaagggggtcaagagaaaggctgacactaccacgccagcaacctcggctgtgaaagccagtagcgagttcagtcccacatttacagagaagtctgtggccctacccccaatcaaggaaaatatgccaaaaaacgtgctcccagatagccagcagcaatataatgtagtgaagactgtaaaggtgaccgagcagttacggcactgtagcgaaatcctgaaggagatgctggcgaagaagcacttttcgtacgcatggcctttctataatcctgttgatgtgaatgcattagggctccataattactatgatgtggtgaaaaatccgatggatcttggtaccataaaggagaaaatggataaccaggagtataaggatgcttacaaatttgcagccgacgttcgccttatgtttatgaactgttataaatacaatccgcctgatcatgaagttgtgactatggcgaggatgcttcaggatgtctttgagacacacttctccaagattcccatagaaccggtcgagtccatgccgctctgttacatcaagacggatattactgagaccaccggcagggagaacaccaatgaagcgtcgtctgaaggaaattcttccgatgattccgaggatgagcgcgtcaaacggttggcaaagttacaggaacaacttaaagccgtgcaccagcagctgcaggttttgtctcaggtacccttccggaaactcaataagaagaaggagaagtctaaaaaggagaagaaaaaagagtag

SEQ ID NO: 216246 - DNA, 468 bp, Artificial Sequence
  Description of Artificial Sequence: Synthetic coding sequence
atgagcctgccatccagacaaacagccatcatcgtgaaccccccaccacccgagtacataaacaccaaaaaaaacggtcgtcttacaaatcagctccagtacctgcagaaagtggtgcttaaggacttgtggaaacactctttctcctggcccttccagcgaccggtggatgctgtaaagctgcagctgcccgattactataccatcatcaagaacccaatggatcttaatacgattaagaagagactggagaacaaatattatgccaaggcgtctgaatgcattgaagactttaatactatgttctctaactgctacctatataataaacctggggacgatatcgtattgatggcccaggcactggagaagctcttcatgcagaagttgtcacaaatgccacaagaagagcaagtcgtgggggtaaaggaaaggataaaaaaggggacccagcagaatatcgcctag

SEQ ID NO: 216247 - DNA, 603 bp, Artificial Sequence
  Description of Artificial Sequence: Synthetic coding sequence
atgtcgctgccatctagacaaacagccattatcgtgaatcctcccccaccggaatacattaatacgaaaaagaacggtcgattgactaatcagctgcagtacctgcagaaggtggtgttaaaggatctgtggaaacattcttttagctggcccttccagcgcccagtggacgcggtgaagctccaactgccagattattatacaatcatcaagaaccctatggatttgaacactattaagaaacgtctggaaaacaagtactacgctaaagcctcagaatgtatcgaggacttcaacacgatgttctcaaattgctatctgtacaacaaacccggagatgatatcgttcttatggcccaagcattagagaagctctttatgcaaaaactgtcgcagatgcctcaggaggagcaggtcgtcggtgtgaaagagcggataaaaaaggggacacagcagaacatcgccgtcagtagcgctaaggagaaaagcagtccctcggcaaccgaaaaggtgttcaaacaacaggaaatcccgagtgtattcccgaagacatctatcagtccactcaatgtagtacagggggcaagtgtgaactcttcatag

SEQ ID NO: 216248 - DNA, 468 bp, Artificial Sequence
  Description of Artificial Sequence: Synthetic coding sequence
atgagcttaccctctcgccaaactgctattatcgtgaaccctccccctcccgagtacatcaataccaagaagaacggcaggctgaccaatcaattacagtatctacagaaggtggtactcaaagacttatggaagcactcgtttagctggccattccaacgaccagtcgacgcggtgaaactccaattacctgactattacacaattataaagaaccctatggacctgaacaccattaagaagcgactggaaaacaaatactatgcaaaggcgtcggaatgcatcgaggacttcaacactatgttttccaattgttacctatataacaaacctggcgatgatatcgtgctgatggcccaggcactggaaaaactgttcatgcaaaagctgtcacagatgccccaggaagagcaagtcgttggcgtgaaggagagaattaagaaggggacgcagcaaaacatcgcctag

SEQ ID NO: 216249 - DNA, 159 bp, Artificial Sequence
  Description of Artificial Sequence: Synthetic coding sequence
atgagcctgcctagcagacaaactgctattattgtgaatccgccaccccctgaatacatcaataccaaaaaaaatggacggttgacgaaccagctccagtacctccaaaaagtcgtactcaaggacctttggaagcactccttcagttggcctttctag

SEQ ID NO: 216250 - DNA, 291 bp, Artificial Sequence
  Description of Artificial Sequence: Synthetic coding sequence
atgagcctgcccagtcgccagacagctatcatagtaaatcctccccctccggaatacataaataccaaaaagaatggaaggttgactaaccagcttcagtacctccagaaggtggttctgaaggatctctggaagcacagctttagctggccgtttcagcggccagtggatgcagtcaaactgcagcttcccgattactacaccatcatcaaaaacccaatggacctcaatactatcaagaagcgactcgagaacaaatattacgcgaaggccagcgaatgtattgaatag

SEQ ID NO: 216251 - DNA, 99 bp, Artificial Sequence
  Description of Artificial Sequence: Synthetic coding sequence
atgagtctgccctcccgccaaactgccatcatagtcaaccccccaccacctgaatatatcaataccaaaaagaatggcaggctcaccaatcagctctag

SEQ ID NO: 216252 - DNA, 1398 bp, Artificial Sequence
  Description of Artificial Sequence: Synthetic coding sequence
atgtcacttccatccaggcagaccgcaattattgtgaatccaccccctccggagtacataaatactaaaaagaatggccgactgacaaaccagttgcagtacctgcagaaggttgtgctaaaggatttatggaagcactcattcagctggccgttccagcgccctgtggacgctgtcaagctccagctcccggattattacaccataatcaagaatccgatggacttgaataccatcaagaagcgccttgagaataagtattacgcgaaggcctccgagtgcattgaggatttcaataccatgttttctaactgctatctgtacaataaaccaggggatgacattgttttgatggcgcaggcattggagaagctgtttatgcagaaactcagtcagatgccacaggaggaacaagtcgtaggcgtgaaggagagaattaagaaaggcacacagcaaaacatcgcggtttccagcgcaaaggagaaaagcagccccagcgcaaccgagaaagtgtttaagcaacaggagataccttccgtattcccaaaaacatccatctccccattgaatgtagtccagggcgcaagcgtgaattctagctctcaaactgcagcccaggtcacaaagggcgtcaagagaaaggcagatacaacaacaccggctactagtgccgtaaaggcttcctctgagttttcacccacttttaccgagaaatctgttgcccttccacctattaaagagaatatgcccaaaaacgtgcttcctgactcgcagcagcaatacaacgtggtgaaaacagtgaaagttactgaacagttaagacactgctccgaaatattgaaggaaatgctggctaagaagcacttctcatacgcttggccattctataatccagttgacgtgaacgcattgggcttgcataactattacgatgtggtgaaaaacccaatggaccttgggacaattaaagagaagatggacaatcaagagtacaaagatgcttacaagtttgctgccgacgttagacttatgttcatgaattgttataagtacaaccctccagaccacgaagtggtgacgatggctcgcatgctccaggacgtgttcgagactcatttctcaaaaatcccgattgaacctgttgaaagcatgcctctgtgctacattaagactgatattacagaaaccaccggtagagagaacacaaatgaagcctcatcagagggcaattccagtgacgactccgaggacgaacgagtgaagcgattggctaagctgcaggagcagctgaaggctgtgcatcaacagttacaggtcctgtcacaagtgccatttcggaagcttaacaagaagaaggaaaagtcaaagaaggaaaaaaaaaaagagaaaaaaaaatag

SEQ ID NO: 216253 - DNA, 303 bp, Artificial Sequence
  Description of Artificial Sequence: Synthetic coding sequence
atgtctctgccttcccggcagaccgctatcatcgttaatccaccacccccagagtatatcaataccaagaaaaatggcaggcttacaaatcagctgcaatatctacagaaagtcgttttgaaagacctgtggaaacactcattttcctggccttttcagaggccagtcgatgccgtaaaattgcaactccctgactactacacaattattaaaaaccccatggatctcaacacaattaaaaagcgactggaaaacaaatactatgctaaggcctctgagtgcattgaggatttcaatacatag

SEQ ID NO: 216254 - DNA, 5550 bp, Artificial Sequence
  Description of Artificial Sequence: Synthetic coding sequence
atggcagtgtctaggttggacaggcttttcattctcctagacactgggaccacacctgtgaccagaaaagctgccgctcagcaactgggggaagtggtgaaacttcacccacatgaactcaacaacctgctgagtaaggtattgatataccttcggtcggctaactgggatacgcgcatcgctgccggacaagcggtcgaggccatcgtgaagaatgtgcccgagtggaacccagtgccacgcactaggcaggagcctacctctgaaagttcaatggaagacagcccaacaactgaaaggttgaatttcgatcggttcgatatctgcaggctcctccagcatggcgcatcgttgcttggaagcgctggagcagagtttgaggtgcaagatgagaagtccggggaggtggatcccaaagaaagaatagcacgccagagaaaattgctccagaaaaagctgggcctcaacatgggggaagctatcggcatgagcactgaggaattattcaatgacgaggacctggactacacccccactagtgccagcttcgtgaacaaacaacccaccctgcaggctgcagagctaatcgactccgagttcagagcaggaatgtccaataggcaaaagaacaaagctaaacgcatggcgaagctgtttgctaaacaaaggagcagggatgccgtcgaaacaaacgagaaatctaacgattccactgacggggaacccgaggaaaagcggagaaaaattgccaatgtcgtgatcaaccagtcagctaacgactcaaaggtgttgatcgacaacatcccagattctagttctttaattgaggaaaccaacgagtggcccctggaatcattttgtgaagaattgtgtaatgacttatttaacccttcatgggaggtgcgccacggggcaggcaccggtttgcgggagattctcaaagcacatggtaagtctgggggaaaaatgggggactctacgcttgaagaaatgatccagcagcaccaggagtggctcgaagatctcgtcatacgactgttatgcgtgttcgcgctcgataggttcggcgactttgtgtcggatgaggtcgtcgctcctgtccgtgagacatgcgctcagaccctgggagtcgtgttaaaacacatgaatgagacaggcgtgcataagaccgtggacgtgctcttgaaactgcttactcaggagcagtgggaagttcgacacgggggattactgggcatcaagtacgccctcgcggtgcggcaagacgtcataaataccctgctgcccaaggtcttgacacgtataatcgaaggcctgcaggacctggatgatgatgtgagagcagtggccgctgccagcctcgtgcctgttgtggagtctttggtctacctgcagacgcaaaaggtgcctttcatcatcaataccctctgggacgctctactcgaactggatgatcttacggcctctactaactctattatgacactgctcagctccctccttacttacccacaagttcagcagtgttctatccagcaatccctgaccgttctggtgccacgggtgtggcctttcctccaccacaccattagcagtgtgaggagggccgctctggaaactcttttcaccctacttagcacacaggatcagaacagcagttcttggctcattcccatcctgccggacatgcttcgacatatttttcagttctgtgttttagaatctagtcaggagattctggatctgatccacaaagtttggatggagctgctcagtaaggcttccgtccagtatgttgtggccgctgcctgcccttggatgggggcatggttatgtctgatgatgcagccctcccatttgcccatcgatctgaacatgctgctggaagtgaaggcccgagccaaagagaagacagggggtaaggtgcgccagggccagagtcagaacaaagaagtattacaggagtatatcgctggtgccgacaccatcatggaagaccctgccaccagggattttgttgtaatgcgggcacggatgatggctgcaaagcttcttggagccctatgctgctgtatttgcgacccaggcgttaacgttgtcacacaggagattaaacccgcagagtctctgggccaactcctgctgttccatctaaacagtaaaagtgccctccagagaattagtgtcgccctggtgatttgtgaatgggcagctcttcagaaagagtgtaaggctgtgactttggcagtgcagccaagactactggatatcctgtctgaacatctgtattacgacgaaatagccgtcccctttaccaggatgcagaacgagtgtaagcagcttatttcttctctcgcagacgtgcatattgaagtgggcaatagagtgaacaacaatgtccttaccattgatcaggcatccgatcttgtaaccacagtctttaacgaagccacaagttccttcgatctgaatcctcaagtgcttcagcagcttgattctaagcgtcagcaggtgcaaatgactgtgacagaaaccaaccaggaatggcaggtcctccagctgcgcgtgcacacattcgccgcatgcgcagtggtgtccctccagcagcttccagagaagctgaaccccatcataaaacccttgatggaaacgattaagaaggaagagaacacccttgtgcagaattacgccgctcagtgtatcgccaaactactgcagcagtgcactacccggacaccctgcccaaacagtaagattataaaaaatctgtgttcaagcttgtgcgtcgacccctacctaaccccatgtgttacttgtcccgttcctacgcagagtggtcaggagaactccaaaggaagcactagtgagaaggatggaatgcaccatacagtgacaaagcatcgtggcataattaccttatatagacaccagaaggccgcatttgccatcaccagtaggagaggcccaacacccaaggccgtaaaagcccagattgcagaccttcctgcgggatctagcgggaacatcctggttgagttagacgaagcccaaaaaccctatttggtgcagaggaggggggcagagtttgcattgactacaatagtgaaacactttgggggagaaatggctgtcaaactcccccatctctgggacgccatggtgggccctttgcggaatactatagatatcaacaattttgatgggaaatctcttctggacaagggcgatagtcctgcgcaggagcttgtaaatagtctgcaggtgtttgagacggcagccgcttccatggattcggaattacacccattgctcgttcagcacctacctcacctctatatgtgcctgcaatacccatctactgccgtgagacacatggccgcaaggtgcgtaggagtgatgagcaagatagcgactatggagaccatgaacatttttctagagaaggttttgccttggctgggcgcaatcgatgacagcgttaagcaagagggggcaatcgaggcccttgcctgcgtgatggagcagcttgatgtgggtatcgtcccttacatcgtgctgctggttgtaccagtgctcgggaggatgagtgaccaaactgatagcgtacgttttatggctacacagtgctttgcaactctgattcgcctgatgccactcgaagccggaatacctgacccccctaatatgtcagctgaactgatccagctgaaggccaaggagagacatttcctcgagcagctgctggacggaaagaaactggaaaattacaaaataccagtgcctattaacgcagagttacgtaaataccaacaggacggagtgaactggctggcattccttaacaagtacaagctccacggcatcctatgtgacgatatgggtttgggcaagacgttgcagtccatctgcatcctagcgggagaccattgtcatcgcgcacaggagtacgctagaagcaaactggctgagtgcatgccgctgccaagcttagttgtctgccctccgaccctcacaggccactgggtcgatgaggttggaaagttctgcagcagggaatatctcaaccctttgcactacactggccctcccactgaacgaatccgcctccaacatcaggttaaaaggcataatttgatagtcgcctcttacgacgtggtccggaacgacatcgactttttccgaaacattaaattcaattactgcattctggatgaaggtcacgttattaagaacggcaaaaccaaactgtcaaaggcggtgaagcagctcactgctaactacaggatcattttatctggcacacccatacagaataatgtgttggaattgtggagtttattcgatttccttatgcccggatttcttggcactgagcggcagtttgccgctcgatatggtaagccaatcctcgcgagtagggacgcacgatcaagctcccgcgaacaggaggccggtgtgctggccatggatgccctgcatagacaagtgttgcccttccttctcagacgaatgaaggaggacgtgctccaagacctaccccctaaaatcattcaggactactattgtaccttgagccctctgcaggtacaattgtatgaggacttcgccaagagccgcgcaaaatgcgacgtcgatgaaactgttagtagcgccaccctttcagaggaaacagaaaagccaaagttgaaagctactgggcatgtcttccaggcactgcagtacttacgaaagctgtgcaatcatcctgccttggtcctcacacctcaacatcctgagttcaaaaccacagctgaaaagctggctgtccaaaacagctcactgcacgacattcagcacgccccaaagttgagcgctcttaaacagctgttgctagactgtggcctaggaaacggctctacatctgaatctggtaccgaatccgtggtggcacagcacaggattttaatcttctgccagttgaagtcgatgttggacatcgtagagcatgacctcttgaaaccccatcttccttcagtgacttacctgagactcgatggtagcattccgcctgggcagaggcattctattgtgtcccgctttaataatgatccttctatcgacgtgctcctattaacgacacacgtgggcggtttgggattaaacctgaccggtgcagataccgtagtctttgtggaacatgactggaatccaatgcgcgacctccaggcaatggatagagcccatcgaatcgggcagaagagggtggttaatgtctatcgactcattaccaggggtaccttggaagaaaaaatcatgggcttgcagaagttcaaaatgaacattgcaaacacggtcatttcccaggaaaattcctctttgcaatcaatgggcacggaccagctgctggacctgtttacattggataaagacggcaaggcagagaaggcagatacttccacatccggcaaggcctctatgaaaagcattctcgagaacctgtccgacctctgggatcaggaacagtacgattcagagtattcactggagaacttcatgcattccctgaagtat

SEQ ID NO: 216255 - DNA, 2100 bp, Artificial Sequence
  Description of Artificial Sequence: Synthetic coding sequence
aagctgtggttcaaaaataccgaggactacaggcgcacagcgcttacccggctgacaagtggggtgatggagcagctcgacgtgggtattgtcccctacatagtgttgctagtggttccggttctgggcaggatgtctgaccagacagattccgtacgctttatggcgacacagtgctttgcaaccctcatacgcctgatgccacttgaggctgggatccctgatcctcctaacatgtccgcagaactcatccaactgaaggctaaagagcgacatttccttgagcaactgctcgatgggaaaaagctggaaaactataagatccccgttcccatcaacgcggaactcagaaagtaccagcaggacggggtaaactggctggcatttctcaacaaatacaagctgcatgggattttgtgtgatgatatggggcttggaaagaccctgcagagcatatgtattcttgctggcgatcactgccaccgggctcaggaatacgctcgttccaaacttgccgaatgcatgcctctcccaagtcttgttgtgtgtccacccacactgaccggccattgggtcgatgaggttgggaagttctgcagccgcgagtatcttaatccactgcactacaccggtcccccaacggagcgcatccggttgcagcatcaggtgaagaggcataatctcatcgttgccagttacgacgtagttcggaacgatatcgattttttccgaaatataaagttcaattattgtatcctggacgaaggacacgtgattaagaacggaaaaacaaagctgtccaaagccgtaaagcagctcactgcaaattataggatcatcctgagcggcacgccgatccagaacaacgtcctggaactctggtctctgtttgacttcttaatgcccggattcttgggcacggagaggcaattcgctgcccgttatgggaagcccatcctggcgtctagggatgctagaagttccagcagggagcaggaagccggagtgctggcaatggacgctctgcaccgccaggtgctccccttcctgttaagaaggatgaaggaagacgtactgcaagacctgcccccaaaaataatccaggactattactgtacactaagcccactgcaagttcaactgtatgaagacttcgcaaagtcacgagcaaagtgcgacgttgacgaaaccgtctcgtccgccacgctctcagaggagacagaaaaaccgaaactgaaggctaccggccacgtgttccaggccctccagtatctgcgtaagctgtgcaatcacccagcactcgtcctcacaccccagcatccagagttcaaaaccaccgcagagaagctggcagtccagaactcaagcttgcatgacatccagcacgcccctaagctgtcagcgctgaagcagctgctgctggattgtggcctcggtaatggatccacctccgaatcagggactgaaagcgtggttgcacagcatcgcatcctgattttctgccagctgaagtctatgctggatattgtcgaacacgacctgctaaagccccacctcccgagcgtgacatacctacgcctggatgggtcaataccgcctggacaaaggcattccattgtcagcagattcaacaatgatccctctattgatgtattactgctgactacccatgtcgggggacttggactgaaccttaccggagctgacaccgtggtgttcgttgaacacgattggaaccccatgcgcgacctccaggccatggatcgggctcacaggataggacagaaaagggtggtcaatgtttaccgcctgatcacacggggtactctggaagagaaaatcatggggctccagaagtttaagatgaacattgcaaacacagtcatttctcaggaaaactctagcctgcagagcatggggacagatcagctcctcgacctgttcaccctggataaggacggtaaagccgagaaggcggacacctccacgtccggcaaggcgagcatgaaatccatcttagaaaacctaagcgacctgtgggaccaggagcaatacgattccgagtactcactggagaacttcatgcattctctgaagtag

SEQ ID NO: 216256 - DNA, 2034 bp, Artificial Sequence
  Description of Artificial Sequence: Synthetic coding sequence
atggaacaacttgatgtgggcatcgtgccgtatattgtcctactcgtcgtccctgtcttggggagaatgtccgatcaaaccgactccgtgcgtttcatggccacccagtgtttcgccacactgattcgcctgatgccccttgaagctggaatcccagacccgcctaatatgtcggctgagctaattcaacttaaagcaaaggagcgccatttcttagaacaactgctggacggtaagaagttggaaaattacaagattccggtcccgatcaacgccgagctaaggaagtaccagcaggatggcgtgaattggctggcttttctcaacaaatataaattgcatggaattctttgcgacgacatgggcctggggaagaccctgcagtccatctgtatcctggccggtgatcactgccaccgggcacaggagtatgccagaagcaaactcgctgaatgtatgcccctcccttcacttgtggtctgtcctcctactctgaccggacattgggttgatgaagttggcaaattctgctctcgcgaatacctgaatccccttcattatacgggccctcctactgaacgcataagactccagcaccaggtgaaacgccacaatttgatcgtcgcaagttatgatgtggtacggaacgatatcgatttttttagaaacatcaagttcaattactgtatcctagatgaggggcatgtaatcaaaaacggcaaaaccaaattgtcaaaggccgtgaagcagctgacagcgaactatcgcattatcctgtccggcacgcccatacagaataatgtcctggaattgtggagcctgttcgacttcttgatgcccggttttctgggaaccgaacggcagttcgctgctagatatgggaagcctatccttgcatccagagatgctcgatcctcctctcgggagcaggaagccggagtccttgccatggacgctttgcaccgccaggtcctgccttttctcctccgcaggatgaaggaggacgtcctgcaggatctccctccaaaaattatacaggattactattgcaccttgtccccgttacaagtccagctgtacgaggacttcgcaaaaagccgcgcaaagtgcgacgtggacgagactgtgtcctctgccacactgagtgaggagacagaaaagcccaagctcaaagccacagggcatgtgttccaggccctgcagtatctgcggaaactctgcaatcacccagcacttgttttgactcctcagcacccagagttcaaaactaccgccgagaaattagcggtccagaatagtagcctgcatgatattcagcacgctcctaagctgtccgccttgaagcagcttctcctggactgcggcctgggaaacggctccacaagtgaatctggcacagagtctgttgtcgcgcagcatagaattctgatcttttgtcagttaaaaagtatgctcgatatagtggaacacgatctcctgaaaccacacctgccctctgtgacctatttgagactcgacggatctattccacctggtcagcgccattccatcgtgtcccgatttaataacgacccttccatcgacgtcctgctgctcacgacacacgtgggtggcttgggcctaaaccttaccggagctgataccgtggtctttgtggaacatgactggaatccaatgcgggacctccaggccatggacagagcacataggattggccagaaaagggtggtgaacgtttaccgtttgatcacgaggggaacactcgaggaaaagataatggggctccagaagttcaaaatgaacattgcaaataccgtgatttcacaagagaattctagcctacagagcatggggactgaccaacttttggatcttttcactctggacaaggacggcaaggcagaaaaggcagacacaagcacttctggtaaggcaagcatgaagtctattctcgagaacttatctgatttgtgggatcaggagcagtatgacagtgaatacagtcttgagaatttcatgcactccctgaagtag

SEQ ID NO: 216257 - DNA, 1233 bp, Artificial Sequence
  Description of Artificial Sequence: Synthetic coding sequence
atgggggcaaacgcctccaactacccccactcttgctcacccagagtcggcggtaattcacaggcccagcaaacgttcattggaacttccagttacagtcaacaggggtatggctgtgaaagtaagctgtatagcttggaccatggtcacgagaagcctcaggacaagaaaaagcgaacctctgggctggcgacacttaaaaagaaatttatcaagcgccgaaagagcaaccgctccgccgatcacgcgaagcagatgagggaactgctgtccggatgggacgtgagagacgtgaatgctctcgtcgaggagtacgaaggaaccagcgcgcttaaagaactgagtttacaggctagcttggccaggcctgaagccaggaccttgcaaaaagatatggctgatctctatgaatacaagtattgtaccgacgtcgacctgatttttcaggagacctgctttccggtgcatagggcaatattggctgctaggtgtccattttttaagacccttctgtctagctcgcctgagtatggcgctgaaattataatggatattaacactgccggaattgatatgccgatgttctccgctctgttacattacctctacacgggtgagtttggcatggaagattcgcgcttccagaatgtcgacatcctggtgcagttaagcgaagagtttggcacaccaaattccctggatgtggatatgagaggactcttcgattacatgtgttactatgatgttgtactctccttttcgtcggattctgaactcgtggaggcatttggtggcaatcagaattgtctggacgaggagcttaaggctcacaaagctgtcatttccgccagaagcccatttttcaggaatctgctccagcggagaatcaggaccggagaagaaattaccgaccgcactctgagaacacctactagaattatcctggatgaatctatcattcccaaaaagtatgccaccgtcattcttcactgcatgtacacagatgtggtagacttgagcgtgttgcattgctctcccagcgtgggctcattaagtgaagtgcaggctttggtcgccggaaaacctaatatgaccagggctgaggaggcgatggagttgtaccacattgctctcttcttggagttcaacatgctcgcccaggaggaaactaccgtgattcgccctgcttgcgccgcagaactctccaattcttgcttattgcctcagtcctag

SEQ ID NO: 216258 - DNA, 3399 bp, Artificial Sequence
  Description of Artificial Sequence: Synthetic coding sequence
atgggagcgaatgccagcaactatcctcacagctgcagccctcgcgtcgggggtaacagccaggctcagcagacgttcataggaacctcttcatatagccaacagggctatggttgtgaatcaaaactgtacagcctggaccacggccacgagaaaccacaggataagaaaaaaagaacttctgggctggcgactctcaaaaagaaattcatcaaaaggaggaaaagtaatcgcagcgccgaccacgccaaacagatgagagaactgttgtctgggtgggatgtacgagacgttaatgcgctggttgaagaatatgaaggaacctccgccctgaaggaactgtccctgcaggcaagcctggcgagacctgaggcacgtacgctccagaaagatatggcagacctctacgaatacaaatattgtaccgacgttgatctgatcttccaagagacctgctttcccgtacacagagcaatactggctgcacgatgtcctttcttcaagactctcctgagttcttcacctgaatacggagccgaaataattatggacattaacactgcagggattgatatgccaatgttttccgccttgctacattacctgtataccggggaattcggaatggaggatagccggttccagaacgtggatatcctggttcagctttctgaggaatttggtacacccaatagcttagacgtagatatgcgcggactgttcgattatatgtgttactacgacgttgtgctgtcattctcgtctgactctgaactggttgaagccttcggtggcaatcaaaactgtctggacgaagaactgaaggcccacaaagcagtgatctcagccagatctccgttcttcaggaacctcctgcagaggcgcattagaactggagaggaaattaccgataggactttacgcacacccacccgaattatcctggacgaaagtattatccctaagaaatatgccacggtcatcttgcattgcatgtatacagacgttgttgatttgtctgtgctccactgttctccatcagtgggaagcctcagtgaggtgcaggccctagtagcaggtaagccaaacatgacacgggcagaggaagccatggaactctatcatatagcgctgtttctggagttcaatatgctcgctcagggctgcgaggatatcatagcagagtcgattagcctggacacactaattgcgatcctgaagtggagttctcacccctatgggtctaagtgggtccaccgccaggctttacacttcttgtgtgaggagttttcccaggtgatgacatcagacgtgttctacgagctcagcaaggatcacctactgacagctattcaaagcgattatttgcaggcatccgaacaggacattctgaaatacttgatcaaatggggcgagcaccagctgatgaaaaggattgccgacagagagcctaacttgctcagcggtacagcccactcagttaataaaagaggagtcaagagacgtgatctggacatggaggagctcagagaaattttgtcatccctgcttccgttcgtccggatcgagcatatactgcctatcaacagtgaggtgttgtccgatgcaatgaaacgagggttgatatcaacgccaccatccgatatgctgcctacgaccgagggaggaaagagtaacgcctggttgcgacagaagaatgcaggtatctacgttaggccaagactatttagtccctatgtggaggaggccaaatcagtgctcgacgaaatgatggtcgagcagacggacctggtgaggctaagaatggtgcggatgtcaaatgtaccagacacattatatatggtgaataacgcggtcccccaatgttgccatatgatttcccatcaacaaatttcctcaaaccagtcctcaccaccctccgttgttgccaacgagatccccgttcctagattacttataatgaaggacatggtgagacgactccaagagttgaggcacacagagcaggtccagagggcgtacgccctcaactgtggagaaggcgcaacagtgtcatatgaaattcagatacgtgttctgcgggaattcggactcgcagatgctgcagcagagctcctccaaaacccgcacaaatttttccctgacgagaggttcggggatgaatcaccactcctgaccatgcgtcagccaggtcgttgccgcgtgaacagcactccccctgctgaaactatgttcacagatctggactcatttgtcgcattccacccacccctcccccctccgccacccccataccacccgcctgccacccctattcataaccagttgaaagcagggtggaagcagcgccctcccagtcaacacccatccaggagcttttcctatccatgtaaccacagtctattccacagccgcaccgccccaaaggctgggcctccacccgtctatctgcccagcgtcaaagctgctccaccagactgcaccagcactgcgggattggggcgtcagacagtcgccgctgccgcagcaaccaccacctcaacagcaaccgccgcagccgcagccgcatctgaaaaacaagtacgcacccagccagtcctaaacgacttgatgcccgatattgccgtgggcgtcagcactctaagcctcaaagaccggcgtctgcctgaacttgccgtagataccgaacttagccagtccgtgtccgaagcaggccctggacccccacaacacctgtcttgtataccccagcggcacacacatacctcacgtaaaaagcatactttggagcaaaaaacagacactcgggagaatccacaggagtatcctgatttctacgattttagcaacgccgcttgtcggccttcaacgcccgcactgagccgaagaactcctagcccctcacagggaggatattttggacccgatctttactcccacaataaggcgtctcccagtgggctaaaatccgcatacctcccaggacagacttcaccaaagaaacaggaggaggctagacgggagtatcctctgtcacctgatggccacctccatcgccagaagaacgagccaattcaccttgacgtggtggaacagcctcctcaaaggtctgatttccccctggccgcaccagagaacgctagcaccgggccagctcacgtacggggtagaaccgcagtagagaccgatcttaccttcgggctaaccccaaacaggccgtcactctccgcctgtagctcagaggctcccgaggagaggtcggggcgaagactcgcagactccgagagcctgggacatggcgctcaacgcaacacagacctcgaaagagaggactcgatcagtcgcggaaggaggtctcccagtaagccagatttcctttacaagaagagcgccttatag

SEQ ID NO: 216259 - DNA, 2121 bp, Artificial Sequence
  Description of Artificial Sequence: Synthetic coding sequence
atgtataccgacgtggttgacctgtccgtattgcattgttcaccatccgttggttctctgtcggaagttcaggccttagtcgccggtaaacccaacatgaccagagccgaggaggccatggaattgtaccacatcgctctgtttttggagttcaacatgttggcccaggaaccaaatctcctcagcggtactgcacactccgtgaacaagcgtggagttaagcgacgggacttggatatggaggaactgagagaaatcctcagctctctgttgccctttgtccggatagaacatatcctccccatcaattcagaggtgttatcagacgctatgaagcgtggtttgatttcaaccccaccaagcgacatgttgcctaccacagagggtggcaagtccaatgcctggcttagacagaagaacgcaggaatttacgtaaggcccagactgttcagtccttatgtagaagaggcaaaaagtgttttggatgaaatgatggtggagcagactgacctggtacgtctgcggatggtgaggatgtctaatgtccctgatactctttatatggtgaacaatgccgtgcctcagtgttgtcacatgatctcacaccaacagatctcttcaaatcagtctagccctccgtctgtcgtggctaatgaaatccccgtgcctaggctcctgattatgaaggacatggtgcgcaggcttcaggaattgcgacacactgagcaggtgcaacgtgcctatgctttgaactgtggagaaggcgctacggtgagctacgagatccaaataagagtcctccgggaatttggtttagcagacgctgctgccgaactactgcaaaatccccataaattcttccctgacgaaagattcggcgatgaatctccgcttctcaccatgaggcaaccaggcaggtgcagagtgaattccacccctcccgctgaaaccatgtttaccgacctggactctttcgtggccttccaccccccacttcctcctcctcccccaccctatcatccgccagccacccctattcataaccagctcaaagctgggtggaagcagcggcctccttcccaacacccgagcaggagctttagctatccctgtaaccatagcctgttccactccaggacagcccctaaggctggtcctcctccagtgtatctgccaagcgtcaaggcagccccacctgactgtacttccacagccggtctggggcgacagacagtcgccgctgcagcggctacgactacctccacggcgacagccgcagccgctgccgcttcagagaaacaagttcgtacccagcccgttctaaacgacctcatgcctgacatcgccgtgggggtgagcaccctttctttgaaggataggaggctgccagagctggctgtggataccgagctgtcccagtccgtgtccgaggccggaccgggacctccacagcatctctcctgcatcccacagaggcatactcacacatcccgcaagaaacacaccctggagcaaaaaaccgacaccagggaaaacccccaggagtacccagacttttacgatttctccaatgccgcttgccgcccatccacaccagctcttagccgaaggacccccagtccaagccagggcggatactttggcccagatctttacagccataacaaggcatcaccgtctgggctcaagagtgcctatctgccaggccagactagccctaaaaaacaggaggaagccaggcgtgagtatcctctatcccccgacgggcatcttcacaggcaaaagaacgaaccaatccacctggacgttgtggaacagccacctcagagatcagatttcccgctggcagcacccgagaacgccagcaccggccctgctcacgtaagagggagaacagctgtggaaacagatctgacatttgggctgacccctaaccggccttcactcagcgcatgttctagcgaggctcccgaagagagaagtggtcggcgtctcgcagactccgagagcttgggacatggcgctcagaggaatactgacctcgaaagagaggactcaataagccggggacggcgaagcccaagtaaacccgattttctttacaagaagtcggccctctag

SEQ ID NO: 216260 - DNA, 2346 bp, Artificial Sequence
  Description of Artificial Sequence: Synthetic coding sequence
atggccggtggcgctggcgcaggcgcagatggtggcgctggcggagggggtggcggtggcgatggatcagggccatctggctccagcagcggtggcagaagccttaggggatgcgaagatatcatcgccgaatctatctcgctggatactctgatcgcaatcctgaagtggtcttcccatccatacggctcaaagtgggtgcatagacaagccttgcactttttatgtgaggaattttcacaggttatgacctcagacgtgttctacgagctttccaaggatcacctgctgaccgccatacagagcgactatctccaggctagtgagcaggacattcttaagtatcttattaagtggggcgagcatcaactgatgaagcgcatagcggatagggagccaaaccttctgtctggcacagcacactctgtgaacaagcgcggtgtgaagaggcgagatctggacatggaggagctgcgcgaaatcctttctagtcttctcccatttgtccggattgaacacatcctgcctattaacagtgaggtccttagtgatgctatgaagcggggtctgattagcactcctccctcggatatgctgcctaccactgaggggggtaagtccaacgcatggctgaggcaaaagaatgccggaatttatgttcggcctcgtctcttctcgccctatgtagaagaggccaaaagcgtgctcgacgagatgatggtggagcagactgacctggtcaggttgcgtatggtgcggatgtccaacgtacctgacacgctgtatatggtgaataatgctgtgccacaatgctgtcacatgatcagccaccaacagattagcagtaatcaatcatcaccgccttccgtagttgcaaatgaaatccccgtacccaggctcctcattatgaaagacatggtgagacgacttcaagagcttcgtcacacagaacaggtgcagcgcgcttatgctctgaactgcggagagggagctactgtatcctatgagatccagatcagagtgcttcgtgaatttggcctggcagacgccgcagctgagttgctccagaacccccataagttttttccagatgagaggtttggggatgagtcacccttgctgaccatgcgccaaccagggagatgccgggtgaactccacccctcctgctgagacgatgtttaccgacttggatagctttgttgcctttcatccaccgctcccgccaccgccacctccataccaccctcccgcaacccctatccacaatcagttgaaagccggttggaagcaaaggcccccatcccagcaccccagtcggtcattctcttatccatgtaatcactcccttttccactctcgaacggcacccaaggcaggaccaccccctgtgtacttaccctccgtcaaggcggcaccgccagattgtacgagcactgctgggctgggccgtcagaccgtggcggcagcggcagcaactactacttccacggctactgccgctgctgctgccgcttctgagaaacaggtccgaacccagccagtccttaacgatctcatgcccgacattgctgtcggcgtgtcaactctgtccctgaaggaccgacgtctgcccgaacttgcggtggacactgaactgtcacaatccgtgtcagaggctgggccaggccctccgcagcatctatcttgcattcctcaaaggcacacccacaccagtaggaagaagcacacacttgaacaaaagacggacacacgcgaaaacccccaggagtatccggatttctatgatttcagtaatgcggcatgccggccttccacaccagccttatcacgcagaaccccctcccctagccagggaggctatttcggtcctgatctgtacagccacaataaggcatctccttccggactaaagagtgcctatttgcctggccaaactagcccaaaaaagcaagaggaggcgaggcgcgagtatccattaagtccagacggacacttgcacaggcaaaagaatgagcccatccatttggacgtcgttgaacagccaccacagcgtagcgatttccctctggcagcgcctgaaaacgcctccacaggacctgcccatgtccgcggacgaactgccgtggaaaccgacctgacatttggcctgactcctaatcgtccctccctttcagcttgttcgtccgaggctcctgaagagagaagcggcagacgccttgcggatagcgaatccctcggtcacggggctcagaggaacactgatctggagcgcgaagactctatctcccggggtcgtcgctccccatctaagccagatttcctgtataagaagtctgctttatag

SEQ ID NO: 216261 - DNA, 168 bp, Artificial Sequence
  Description of Artificial Sequence: Synthetic coding sequence
atgggagctaatgcgagcaattatcctcactcatgcagcccaagagtggggggtaactcacaagcccagcagaccttcatcggcacctcaagctacagccagcagggctacggctgtgagtctaagctatactccctggaccacgggcacgagaagccccaggactag

SEQ ID NO: 216262 - DNA, 1635 bp, Artificial Sequence
  Description of Artificial Sequence: Synthetic coding sequence
atgagggaatcccaacccgaagctgagattcctctccaagatacaactgctgaggcctttacgatgctgcttaagtatatatatacagggcgagctactctgacagatgaaaaggaggaggtgctgctggacttcctatcactggcgcacaaatatggcttccctgaactcgaggattcgaccagtgagtacctgtgcactatccttaatatccagaacgtgtgcatgactttcgatgtggcttctctctacagtctgcctaagctgacctgtatgtgctgtatgttcatggatcgcaatgcacaggaggtcctgtcatccgagggattcctgtccctcagcaagaccgccttgcttaatattgttctccgggactccttcgccgcacccgaaaaagacatcttccttgctctgctcaactggtgcaagcacaacagtaaggaaaaccacgctgaaataatgcaggcagtccggctgcctttgatgagcctgacagaactgctcaatgtagtcagaccctcagggcttctttcccctgatgccattctggacgctattaaagtccgttccgaaagcagggatatggatttgaactatcggggaatgctcattccagaggaaaacatagcaacaatgaagtacggcgcacaagtggtcaaaggtgagttaaaaagtgcgctcctggacggagatacacagaactacgatcttgaccatggattcagccggcaccctatcgacgacgattgccgatccggaatcgagatcaagctagggcagccgtcaattatcaaccacatcaggatcttattatgggatagagacagccgatcctacagctatttcatagaggtgtcaatggacgaactcgactgggtgcgtgtcatcgaccatagtcaatacctttgccgctcatggcagaagctttacttccctgctagagtgtgccgctatatccgcatcgtgggaacccataataccgtgaacaaaatttttcacatagtggctttcgagtgcatgttcactaacaaaacctttaccttagagaagggccttatcgtgcctatggaaaatgtggccactattgcagattgtgccagtgtgatagagggtgtgtcgaggtcccgtaacgccttgctgaacggcgacactaagaattacgactgggacagcgggtacacgtgtcaccagctagggagcggggctattgtcgtgcagctggcccagccttacatgatcggcagcattcgcttattgctctgggattgcgatgaccggagctattcttattatgtcgaggtctcaaccaatcagcaacagtggactatggtggccgacagaacgaaagtttcctgtaaatcctggcaatccgtgacttttgaacggcagccggctagtttcatcaggatcgtgggaactcacaacaccgccaacgaagtgttccattgtgttcatttcgaatgcccggagcaacaatccagccagaaagaggagaacagtgaggaaagcggaaccggggatacctctctggccggtcagcagctggattcccacgcacttcgcgctcctagcggaagctcactgcccagctcgccaggcagcaatagcagatcacctaaccgccagcatcaatag

SEQ ID NO: 216263 - DNA, 1839 bp, Artificial Sequence
  Description of Artificial Sequence: Synthetic coding sequence
atgagcaactcacacccactgaggccattcacggccgttggggagattgatcatgttcacatactgtctgaacacataggtgcgctcttgatcggagaggagtacggcgacgtgaccttcgtggtcgagaagaagcgcttcccggcacatagagttattttagccgctagatgtcaatactttcgcgctctcctctatggtgggatgcgggagtcccagccagaagcggaaataccattacaggataccactgccgaagcttttaccatgctcttgaagtatatctacacaggcagagccactctcacagacgaaaaggaggaggtgctcttagattttctgagcctggcgcataagtacggctttcctgagttagaggactcgacatcagaatatctctgcaccatattgaacatccagaacgtgtgtatgacattcgacgtcgcctcactttattcactgccgaagctgacgtgtatgtgctgcatgttcatggacaggaacgcacaggaagtgctttcatccgagggcttcctgtccctgagcaagaccgctctcctgaatatcgtgctaagggattccttcgcagcccctgagaaggacatcttcctggctctgttgaactggtgcaaacataattctaaagaaaatcacgcagagatcatgcaggcagtgagactgcccctaatgtccttaacagaactcctgaacgtcgtgagaccaagtggacttcttagcccggatgccattctggacgccattaaggtccgctctgagtcacgcgatatggacctgaactatagggggatgctgatcccagaggagaatatcgccaccatgaagtatggagcccaggtggtgaagggggagctgaagagcgccctgctagacggggacactcagaattacgacctggatcatggcttctcacggcaccccatagacgacgactgcaggtccggcatcgaaatcaaattggggcagccctccatcatcaaccatatcagaattttgctctgggaccgcgactcaagaagctattcttactttatagaggtgtcaatggacgaattggactgggtcagagttattgatcatagccagtatctgtgccggagctggcagaagctgtattttcccgcaagagtctgtagatatatacgcatcgttggaacccataacacagtaaacaagatcttccacatcgtggcattcgagtgtatgtttaccaataagacgtttactctagagaaaggactcattgtgcccatggagaatgtagctactatcgccgactgcgcttccgtcatcgaaggagtttcccgtagccgaaacgcgctgctcaacggggacactaaaaattacgattgggacagcggctacacttgccaccagttgggtagtggagccattgtggtccagcttgcacagccatatatgattggcagtataaggttactgctatgggactgtgatgataggtcttactcctattacgtcgaagttagtactaaccagcagcaatggaccatggtcgccgaccggactaaggtctcttgtaagagctggcagtccgtgacttttgagcgccagccggcatcatttattaggatcgtcggtactcacaacacagccaacgaggtgttccattgcgttcactttgaatgtcccgagcagcagagctcccaaaaggaggaaaattcagaggagagcggcacaggcgacacttcgttggctggacagcagctggactcccacgccctccgtgccccttccggctcatccctcccgtcctcacctgggagcaacagtagatccccgaatcggcagcaccaatag

SEQ ID NO: 216264 - DNA, 1635 bp, Artificial Sequence
  Description of Artificial Sequence: Synthetic coding sequence
atgcgggagagtcagccagaggcagagatcccactgcaggacactacagctgaggcttttacgatgctgctgaagtacatctacactgggagggccactttaacagacgagaaggaagaggtgctcttggatttcctttccctggcgcacaagtatggcttccctgagcttgaggatagtacatcagaatacctgtgcacaatcctcaatattcagaacgtgtgcatgacattcgatgtggcctctctgtatagtctaccaaagctcacctgtatgtgctgcatgtttatggacaggaacgctcaggaagtgctgagttctgaggggttcctctccttaagcaagacagctctgttaaacattgtgctccgcgactcattcgccgcaccagagaaagacatcttcctagcccttctcaattggtgcaaacacaactctaaggagaaccacgccgaaatcatgcaggccgtccgcttgcctctgatgtctctcactgagttgctgaacgtagtgcgcccttctggactcttatcacctgacgccattctggacgcgatcaaggtaagatctgaaagccgggacatggacctcaactaccgaggtatgttaatcccagaggaaaatattgctacgatgaagtatggggctcaggtcgtaaagggagaactgaaatccgcgctcctggatggagacacccagaattacgatctcgaccatggctttagtcggcacccaattgacgatgactgccggtccggcatcgagattaagctgggccagcctagcataattaatcacatcaggattctgctctgggatagagacagccgcagttactcctattttatcgaggtgtctatggatgagcttgactgggtaagagtcatcgatcatagccagtacctgtgcagatcgtggcagaagctttactttcctgcgcgagtctgtcgttacatcaggattgtcggaacacataataccgttaataaaatcttccacatcgtggccttcgagtgcatgttcactaacaaaactttcacactcgaaaaaggactgatagttccaatggagaatgttgcaaccatagctgactgtgcgagcgtcattgaaggcgttagcaggtcaaggaacgctttacttaacggcgataccaagaattatgactgggatagcggatatacctgccaccaactgggaagtggcgctatcgtagttcagctggcccagccatacatgatcggctctatcagacttctgctgtgggactgcgacgaccggtcttattcatactatgttgaagtctctactaatcagcagcagtggactatggtggccgatcgtacaaaggtgtcgtgcaaatcatggcagtccgtcacttttgaaagacagccagccagctttatccgcattgttgggacacataacaccgctaatgaggtctttcactgtgtgcacttcgaatgcccagagcagcagtcttctcagaaagaggaaaattccgaggaaagcggtacaggcgacacctcacttgccggacagcagctagactctcacgcactaagggcaccaagcggctcaagcttaccaagttccccaggatccaatagcagaagccccaatcgccaacaccagtag

SEQ ID NO: 216265 - DNA, 1839 bp, Artificial Sequence
  Description of Artificial Sequence: Synthetic coding sequence
atgtctaattctcatccactccgacccttcaccgcagtgggagagatcgatcacgtgcatattctgtcagagcacatcggagcactcttgatcggggaggagtatggcgacgtcacatttgtggtggagaagaaacgctttcctgcccatcgcgtgattcttgctgccagatgccagtacttccgggctctgctgtatggcggtatgcgggagtcgcagcctgaggcagaaatccctcttcaggatacgacagctgaagcttttacaatgctgctgaaatacatctacacgggccgtgcaactctcactgatgagaaagaagaggtgttgctggacttccttagcctggctcacaagtatggattcccagagttggaggattctacatctgaatatttatgcaccatactgaatatacagaatgtttgtatgaccttcgacgtggcttctctgtattccctaccaaagctaacctgcatgtgctgcatgtttatggataggaacgctcaggaggtgctctcctccgagggcttccttagcctgtcaaaaacggccctgctgaatatcgttcttagagattcattcgccgcaccagaaaaggacatctttcttgctctgctgaattggtgcaagcataactctaaggaaaaccatgcagagattatgcaggccgtgcgcctgcctctgatgtcactcaccgaacttttaaatgtggttcggccatctggcctcctgtctccagacgctatactggacgcgattaaagtccgaagcgagtcccgcgatatggacttgaactacagaggtatgttaatcccagaggaaaacattgctacaatgaaatacggagcacaggtggtcaaaggggagctcaagtcagccctgctggacggagatacccagaattacgacctggatcatggcttcagccgacaccccatcgacgacgactgccggtctgggatcgagattaaactgggccaaccgagcataataaaccacatccgtattctgctctgggatcgagactctaggtcctattcctattttatcgaagtgtcaatggacgagctggattgggtcagggttattgatcatagtcagtacttatgccggagctggcagaagctgtactttccggctcgtgtgtgcaggtacattcgaatcgttggtacccataataccgttaataaaatattccatatcgtcgcctttgagtgcatgtttacaaataagactttcaccctggaaaaagggctgattgtgccaatggagaacgtcgccaccattgccgattgcgctagcgtcatcgaaggggtgtcaaggtcacgcaatgcactccttaatggggatacaaagaactatgactgggacagcggctacacctgtcaccagctgggctcgggggctatcgtggtgcagctggcccagccctacatgattggctccatacgactgctcctgtgggactgcgacgataggtcgtattcctattacgtggaggtgtcgaccaaccaacaacaatggacaatggtggctgaccggacgaaggtgtcatgcaaaagctggcaatccgtgacattcgagagacagcctgccagttttatccgcattgtggggacacataacaccgccaacgaagtctttcattgtgtacacttcgagtgcccagagcagcagtcgtcccagaaagaagagaacagcgaggagagcgggacaggggacacctctctggcagggcagcagttagatagccacgccctcagagcaccgagcggaagctctctccccagtagcccaggcagtaacagtcggagtccaaatagacagcaccagtag

SEQ ID NO: 216266 - DNA, 279 bp, Artificial Sequence
  Description of Artificial Sequence: Synthetic coding sequence
atgtccaacagccaccctcttcggccattcacagccgttggagaaattgatcacgtgcatatcctatcagaacatattggagcactgctcattggagaggagtatggcgacgtcacatttgtggtcgaaaaaaagcgctttcccgctcacagggtgatcctcgccgctaggtgccagtattttagggccctgctgtacggcggaatgcgggagtcccaacctgaggcagagattcccttgcaagataccacagctgaagcttttacaatgctcctgtag

SEQ ID NO: 216267 - DNA, 1749 bp, Artificial Sequence
  Description of Artificial Sequence: Synthetic coding sequence
atgtgccgagctctactttacggtgggatgagggagagccaaccagaggctgaaataccactccaggacaccaccgccgaagcattcaccatgttgttgaagtacatttatacgggtagagccaccttaacggatgagaaggaagaagtcctcttagactttctttctctggcacacaaatacggctttcccgagctcgaggatagcactagcgaatatctttgtaccattctcaacatccagaacgtgtgtatgacgttcgatgttgccagcctgtattccttaccaaagctcacatgtatgtgctgcatgttcatggatcggaatgcccaggaggtgctgtccagtgaggggtttctgtccctgtccaaaacagccctgcttaacatcgtactccgcgatagcttcgccgctcccgagaaagacatctttctagccctactgaactggtgtaagcataactcaaaggagaaccatgctgaaattatgcaggccgtcagattgccactgatgtctctcaccgaactcctgaatgttgttaggccatcagggcttctcagccctgatgcaatcctggacgctatcaaagtcaggtccgagagtcgcgacatggatctgaactaccggggaatgctgattcctgaagaaaatattgccactatgaagtacggtgctcaggttgtaaagggcgagctgaagtcagccttactggatggcgacacccagaattatgaccttgaccacggcttttcccggcatccaatagatgacgactgtaggagcggcattgagatcaagctgggccagccctcaattatcaatcacattcgcatcctgctatgggaccgagatagtcgtagctattcttattttattgaggtgtccatggatgaactcgactgggtgagggtgatcgatcactcacagtacctctgtcgctcttggcagaaattgtattttccagcgagggtgtgctctggcgacggggtgagcctttggtgtccgctctggtcgcggacacccgagcttaagcaatcctccctgttaggtttgcctaaatgtaggtatattcgaattgtgggcacacataacaccgttaataagatttttcatattgtggcatttgagtgcatgttcaccaacaagacgtttactctcgagaagggtctgatcgtgcccatggagaatgtcgcaaccatagctgactgtgcctcggtcattgaaggcgtgtctcgctctcgcaatgccctgctgaatggagacaccaaaaactacgactgggactccggatacacatgccatcaactggggagcggagctatcgtggtccagctcgcccagccttatatgatcggaagcattaggctgctgttgtgggattgcgatgaccgatcatactcatactatgttgaggtgtcaactaaccagcagcagtggacgatggtcgctgataggactaaggtgagttgcaagagttggcagagcgtgaccttcgagcggcagcctgcatcgtttatcagaatagtggggactcacaatacagccaacgaagtgtttcactgcgtccattttgagtgtccggagcagcagagtagccagaaagaggaaaactctgaggagtccgggacaggggacactagcctggccggacagcagctcgactctcatgcgttgcgggcaccttctggctcatctctgccttccagtcccggaagcaactctagatcaccaaacagacagcatcaatag

SEQ ID NO: 216268 - DNA, 2211 bp, Artificial Sequence
  Description of Artificial Sequence: Synthetic coding sequence
atgagtctgagcgaaaatagtgtattcgcctatgaatcaagcgtccattctacgaacgttttgctgtctcttaatgatcagcgcaagaaggacgttctgtgcgatgtaaccatcttcgtagaggggcagagattcagggctcataggtccgtactggccgcttgctcgagttacttccactcccggatagtgggacaggccgacggcgagctgaatattactctgcccgaggaggtgacagtcaaaggcttcgagccccttatacagttcgcttacacggccaagctcattcttagcaaggaaaatgtcgacgaggtctgcaagtgcgttgaattcctctcagtgcacaacatagaggagtcatgctttcagtttctcaaattcaagttccttgacagcactgccgaccagcaagaatgcccaagaaaaaaatgcttttcctcacattgtcagaagactgatctcaaattgtccctcctggaccagagggatttggaaacggatgaggtggaggagtttctagagaacaaaaatgttcagacaccgcagtgcaaacttaggagataccagggaaacgctaaagccagtcctcctttacaagactcagcctctcagacctacgaaagcatgtgtttagaaaaggatgccgcactggcattgccaagcctctgccccaagtacagaaaattccaaaaagccttcggtactgatcgggtgagaactggcgagagctctgtaaaggatattcatgccagcgtgcagcccaacgaaaggtctgagaacgagtgtcttggcggagtgcccgagtgcagggatctacaggtgatgctgaagtgcgacgagtccaagctagccatggagcccgaggaaacgaagaaggaccccgctagccagtgcccgacagagaagtctgaagtcacccccttcccacacaactcctccatcgatccccacggactgtattcgttgagccttttacatacctacgatcagtacggagacctgaactttgcaggcatgcagaacaccacagtactcacagagaagcccctttctggcacggatgtgcaggagaaaacatttggagagtctcaggacctccctttgaagtctgatctgggcacccgtgaagatagctccgttgcgtcctctgatagatcctcagttgagcgcgaggttgctgagcatttagcaaaaggcttttggagcgatatctgctcaacggacacaccatgtcagatgcagctgtcccctgctgtcgctaaggacgggtcggaacagattagccagaagcgcagcgagtgtccttggctgggaatacgaattagcgaaagtcctgaacccggtcagcggacattcacgacactgtcaagcgtgaactgccccttcatcagtactttgagcacagagggctgcagctctaacttggaaatagggaacgatgattatgtgtcagagccacagcaggagccgtgtccctatgcctgcgtaatttcgcttggtgacgacagtgagacggatactgaaggcgacagtgaaagttgctccgctcgcgaacaagagtgcgaagttaaactgccattcaacgctcagagaataatctctctttctagaaatgactttcaaagcctgctgaagatgcataaattgacccccgagcagttggattgcatacacgatatccgaaggcgctctaaaaacagaatagcagcccaacggtgtagaaagcgcaagctcgattgcattcaaaacctggaaagtgagatcgagaaactgcagtctgagaaagaaagcttgctcaaggagagagatcacatcttgtctacacttggcgagaccaagcagaacctgacggggctatgccagaaggtctgcaaagaagctgccctcagtcaggagcagatacagatcctggctaagtattctgctgccgactgccctctgagttttcttatcagcgagaaagataaaagcacacccgatggagagctggcgttaccatccatcttcagcctgtcagacaggccaccggctgtcctgcccccatgcgctagagggaactcggagccaggatatgcccgaggtcaggaatcacaacaaatgtcaaccgcgacaagtgagcaagctggacctgccgagcagtgccgtcagtccggcggaattagtgacttctgccagcaaatgactgacaagtgtaccacagacgagtag

SEQ ID NO: 216269 - DNA, 2211 bp, Artificial Sequence
  Description of Artificial Sequence: Synthetic coding sequence
atgagcctctcagagaacagcgtcttcgcatacgagtctagtgtgcacagtactaacgtgttgctctctctgaatgaccaaagaaagaaggatgtcctctgcgatgtgactatatttgtggagggtcagagatttagggcacatagatcggtactggcagcctgcagcagctactttcattctcgcatagtgggtcaggcggacggggaactaaacatcacgctcccggaggaggtcacagtcaagggtttcgaacccttaatccaatttgcgtacactgccaagctgatcctgtccaaggaaaacgttgatgaggtttgtaagtgtgtggagttcttgtcggtgcacaatatcgaggaaagctgttttcagttcctaaagttcaagttcttggactctacagctgatcagcaggaatgcccacggaagaagtgcttctcgagtcattgtcagaaaaccgacctgaaactctctcttttggatcagcgcgatctggagaccgacgaagtggaggagttcttagagaacaaaaacgtacagactccacagtgcaaactgcgcagataccaagggaatgctaaagctagcccccctctccaagattctgcatctcagacatacgagtccatgtgtctcgaaaaggatgccgctcttgctttgccttccctatgcccaaaatataggaaattccagaaggcttttgggacagacagggtgcgcaccggtgagtcgtctgtcaaagatattcacgcttctgtgcagcccaacgagcggtctgagaatgagtgtctcgggggagttcctgaatgtcgggacttacaagtgatgctaaaatgcgatgagtccaagctggccatggagccagaggagacaaaaaaagatccagcctcccagtgtccaacagagaaatcagaagtcacaccattcccacataacagctcaatcgacccacatggcttgtattccctgtccttgctgcacacctacgatcagtatggagatctcaacttcgcagggatgcagaacacgactgtgctgacagagaagcccctgtcagggaccgatgtgcaggaaaaaacttttggcgagtcccaggacttacctctgaaatcggatcttggtacccgggaggatagttccgtagcctcttccgaccgatcttccgtagaacgggaggtcgcagagcatctcgcaaagggcttttggtccgacatttgttccaccgacactccttgtcagatgcagctatcccccgctgtggccaaggacggtagtgagcagatctctcagaagcggagcgaatgtccctggctgggcattcgaatcagcgagtcccccgaacccggacagcgcactttcactaccctcagtagtgtcaactgtcctttcataagtacactgtctaccgaaggttgcagcagtaatctagaaataggcaacgacgattacgtgagtgagccacagcaagaaccctgtccatacgcatgcgtgatcagtctgggcgacgacagcgagactgacactgagggagattccgaaagttgttcagcccgagaacaagagtgcgaggtcaaactgccctttaatgctcagcgcatcatcagcttatcccggaatgacttccagagtctgctcaagatgcacaaactgacgccggagcagctggattgtatccacgacatacgccgtcgcagcaaaaataggatcgccgcacaacgctgccggaagagaaaactggattgtattcaaaatctggaaagtgagatcgaaaagctgcaatccgagaaggagagcctgttgaaggaacgcgaccatattctatcgaccctcggggagacaaagcagaatttaacagggctctgtcagaaagtctgtaaagaggcagcccttagtcaggagcagatacaaatcctggctaaatacagtgcagccgattgtcccctaagctttcttatttccgagaaagataaaagcacccccgatggggagctggctctgccatcaatcttctctctatcagatcgtccccctgctgtgctgcccccttgtgccagggggaattccgagccgggatacgctagaggccaagagtcacagcaaatgtcaaccgccaccagcgaacaagctggcccagccgagcagtgccggcaatctggcggtattagcgacttctgccagcagatgaccgacaaatgcactacagacgagtag

SEQ ID NO: 216270 - DNA, 513 bp, Artificial Sequence
  Description of Artificial Sequence: Synthetic coding sequence
atgagtctaagtgaaaactcagtgttcgcctacgagtctagcgtccacagcaccaatgtactgctctcgctcaacgaccagagaaagaaagatgtcctctgcgatgtgaccatcttcgtggaaggccaacgattccgagcccaccgctccgtgctcgctgcctgctcaagttactttcattcccggatcgttggccaggcagacggggaactcaacatcaccttgccagaagaagtgacagtcaaggggtttgaacctctgatccagttcgcttacacggcaaagctgatcctgtccaaagagaacgtggacgaggtgtgtaaatgtgtcgagttcctgtccgtgcacaatatcgaagaaagttgttttcaattcttgaagttcaagtttctggactctacagccgaccagcaggagtgtccaagaaagaaatgtttttcttcccactgtcagaaaaccgatctaaaactgtcgcttctggaccagcgggacctcgagactgacgaggtgtag

SEQ ID NO: 216271 - DNA, 663 bp, Artificial Sequence
  Description of Artificial Sequence: Synthetic coding sequence
atgagcctttccgaaaactccgtttttgcttatgaatcctccgtgcacagcacaaatgtcctgctttctctcaatgaccagcgcaagaaagacgtgctgtgcgacgtgactatttttgtcgaaggacagaggttcagagcacacagatccgtgctggctgcctgtagctcctactttcactctcgcatagtgggccaggcagatggagagcttaacatcactctgcccgaagaagttactgtaaagggatttgaacccttaatacagtttgcctacacggctaaacttattctgtctaaagaaaatgtggacgaggtgtgcaagtgcgtggagtttctgtcggtacacaacattgaagagtcatgtttccaatttctcaagttcaagttcctagactctacagcagatcagcaagagtgtccgagaaaaaagtgtttctcatcccactgccaaaagaccgacctgaagctctctctcttagaccaacgcgacctggaaactgatgaagtggaggagttcctcgaaaacaagaacgtacaaacaccacaatgcaaacttaggcggtatcagggaaacgctaaggcatccccacccctccaggattcagcctcacagacttacgaatccatgtgtctggaaaaggatgctgctctggccctgtag

SEQ ID NO: 216272 - DNA, 678 bp, Artificial Sequence
  Description of Artificial Sequence: Synthetic coding sequence
atgtccttgagtgagaattccgtgtttgcctacgaatcttccgtgcactccacaaacgtccttctctcgctgaatgatcaaagaaaaaaagacgtgctctgcgacgtgacaatcttcgtggaggggcagcgcttcagggctcatcgctctgtcttagcggcttgcagcagctatttccactcacggatagtgggccaggcagacggcgagcttaacatcacactcccggaagaggtgactgtcaagggttttgagccattaattcagtttgcttacactgccaagctgattctctcgaaggagaacgtggacgaagtgtgtaaatgcgtcgagttcctctcagttcacaacatcgaggaaagctgttttcaatttctgaagttcaaatttctggattccacagccgaccaacaagagtgccctcggaagaaatgtttctcctcccactgtcagaagacagatctaaagctatctctgctcgaccaaagggatctggagactgatgaggttgaggagttcttggaaaacaagaacgtgcaaacacctcagtgtaaactgcgtaggtaccagggaaacgccaaagcgtctcctcccctccaagactctgcatcccagacatacgaatccatgtgtcttgagaaagacgcagccctagccctgcctagcttatgcccttag

SEQ ID NO: 216273 - DNA, 78 bp, Artificial Sequence
  Description of Artificial Sequence: Synthetic coding sequence
atgagcctgagcgagaactcggtatttgcctacgagagttccgtgcattctactaacgtgcttctcagtttaaactag

SEQ ID NO: 216274 - DNA, 78 bp, Artificial Sequence
  Description of Artificial Sequence: Synthetic coding sequence
atgtcgctatccgagaactcggtgtttgcctacgagtctagcgttcattccactaacgttttactgtccctgaattag

SEQ ID NO: 216275 - DNA, 78 bp, Artificial Sequence
  Description of Artificial Sequence: Synthetic coding sequence
atgtcgctgtctgagaatagcgtgttcgcttacgaatcaagcgtgcattccactaacgtgttgcttagtcttaattag

SEQ ID NO: 216276 - DNA, 78 bp, Artificial Sequence
  Description of Artificial Sequence: Synthetic coding sequence
atgagcctctcagaaaattcggtcttcgcgtacgagagcagcgtgcactcaaccaacgtactcctgtctttaaactag

SEQ ID NO: 216277 - DNA, 78 bp, Artificial Sequence
  Description of Artificial Sequence: Synthetic coding sequence
atgagcttatccgaaaattccgtcttcgcctacgaatcctccgtgcactctactaatgtgcttctgtctttgaactag

SEQ ID NO: 216278 - DNA, 2526 bp, Artificial Sequence
  Description of Artificial Sequence: Synthetic coding sequence
atgagcgtcgacgagaagccagatagtcctatgtatgtctacgagagcaccgttcattgcactaatatcctgttgggcttgaacgatcagcgcaaaaaagatattctgtgtgatgtcacgttgatcgtggagaggaaggagttcagggcacatcgggctgtcctggctgcttgctcagaatatttttggcaggccctggtaggacaaaccaagaatgatctcgttgtatctctgccagaggaagttacggctcgtggatttggaccgctgcttcagttcgcttacacagccaagctgcttcttagcagagagaacatcagagaggtcatcagatgtgcagaatttttgagaatgcacaatctggaagattcctgtttctctttcctgcagacccagttgctaaactcagaagatggtcttttcgtctgtagaaaggacgcggcatgtcagcgaccccacgaagattgcgagaattccgccggtgaggaggaagacgaggaggaagaaactatggactccgagactgcgaagatggcatgcccacgagaccagatgctgcctgaaccaatttccttcgaggcagctgctatccctgtcgccgagaaagaagaggcccttttgccagaacctgatgtgcctacggacactaaggagagctcggagaaggatgcgctcacgcaatatccccgttacaaaaagtatcaactcgcctgcaccaagaatgtttacaacgcctccagtcatagtacatctgggttcgcaagtacattcagagaggataatagcagcaactcccttaagcccggactggccagaggacagattaaatccgagccaccgtccgaggaaaacgaagaggaaagtatcactctgtgcctgtctggagacgagcccgacgcaaaggatcgcgcaggcgacgttgaaatggaccgaaagcagccgtcgccagctcccacccctactgccccagcaggcgcagcttgcctggaaagaagtaggagcgtagccagccctagctgcctgcgatccctgttcagcatcaccaagagtgttgagttgtctgggttgcctagcacatcccagcaacactttgcccgaagtcccgcttgcccctttgataagggaatcacccaaggcgatttgaagacagactacacccccttcacaggcaactatgggcagcctcacgttggacaaaaagaagtctcgaacttcaccatgggctctcccttgaggggccctggcctggaagccctgtgcaagcaggagggcgagttggaccggaggagtgtaatcttttcatccagtgcttgcgaccaagtgtcaacttccgttcatagctattccggtgtgtcctctctcgataaggatctgtccgagcctgtacccaaaggactctgggtgggggctgggcagagcctgcccagctctcaggcatatagccacggcggtctgatggccgatcatctgccgggtcgcatgcgtcccaacacctcttgccccgtgcccataaaagtgtgccccagatccccccctctggaaaccagaacacgtacatccagttcttgctcatcctacagctatgctgaagatggcagtggaggatccccttgcagtcttccgctttgtgaattcagtagctccccgtgttcgcagggcgctcggttcctggccacggaacaccaggagcccggactgatgggggacgggatgtacaatcaagtaagaccccagattaaatgtgaacaaagctatggtacaaatagttctgacgagtccggcagtttcagcgaagcagatagtgaatcctgccccgtgcaggatagaggccaggaagtgaagctgccctttcccgtggaccagatcacagatttgcccagaaatgactttcaaatgatgatcaagatgcacaaacttacatcggagcagttggaattcattcatgacgtccgccgtaggagcaagaatcggatcgcggcacaaaggtgccggaaacgaaaactcgattgtattcagaatctagagtgcgagatcaggaagttagtgtgcgagaaagagaagctgctgagcgagcgtaaccagctcaaggcctgcatgggggagctgctcgacaactttagttgcctgagccaggaggtttgtcgggacattcagtctcctgagcaaatccaggcattgcacaggtattgccccgtgctgcggccaatggatctcccaaccgcttcaagtatcaatcccgctccgctgggagcggagcagaatatcgcggcttcgcaatgtgccgtcggcgaaaatgtgccctgctgtctcgaacccggagctgccccaccaggaccaccatgggcaccgagtaatacatcagagaactgcacaagtggcaggcgcctggagggcactgacccaggaacttttagcgagaggggtccaccccttgagccaagatcccagaccgtaaccgtcgacttctgccaggagatgactgacaaatgcaccaccgatgagcaacctcgaaaggactatacctag

SEQ ID NO: 216279 - DNA, 2526 bp, Artificial Sequence
  Description of Artificial Sequence: Synthetic coding sequence
atgtctgtagatgaaaaaccggatagtcccatgtacgtgtatgaatctacagtgcattgtacaaacatactgctggggctgaacgatcaacggaagaaggatatactttgcgacgtcactctaatcgtggaacgcaaagaatttcgcgctcaccgagccgtgttggccgcttgcagcgaatacttctggcaagcgctggtggggcagaccaagaacgacttggtggtgagtctcccagaggaagtaaccgccagagggttcggcccattgcttcagtttgcatatacagcaaagctgcttttaagccgcgagaatataagagaggtgattaggtgcgcagaattcctgcgcatgcacaatttagaggacagctgtttctcatttctgcagactcaactgctcaacagcgaagacggactgttcgtctgtcgcaaggacgcagcctgtcaacgccctcacgaagattgcgagaatagtgctggtgaagaggaggatgaagaagaggagaccatggattctgagaccgccaaaatggcatgtcctcgggaccaaatgctgcccgaaccaattagttttgaagcagctgcgatcccagtcgctgaaaaggaagaggcactgctgccagagccggatgtacctacggacacaaaggagagttctgagaaagacgcactgacacagtatcctcgctataagaagtaccagcttgcgtgtaccaagaacgtttataatgccagctctcatagcacgtccggatttgcgtcgacatttagagaagataattcgtctaactcgcttaagccgggtcttgcacgcggtcaaatcaagtccgaacccccttccgaggagaatgaggaggagagcattaccctatgcctgagtggagacgaacccgatgcgaaagatagggctggggacgttgaaatggataggaagcaacctagtcccgcacctacccctaccgctcccgctggcgctgcttgtctcgagcgtagtagatccgtggcctctccctcctgtctccgctccctgttctctattactaagtccgtggaactatccgggctgccaagtacctctcagcagcactttgcgagaagtccggcatgcccatttgataaaggaatcacccaaggggatctgaaaacagattatacccctttcacaggcaactacggccagcctcacgtgggacaaaaggaagtaagcaatttcactatggggtccccactgcgtggaccaggcctggaagccttatgtaaacaggaaggtgagctcgatcgcaggtcagtgattttttcaagcagcgcttgtgatcaggtcagcaccagtgtccacagctactctggggtcagcagcctggacaaagacctaagtgaaccagtgcctaagggcctgtgggtcggtgcaggacagtcgctaccatcatcccaggcctactcccacggaggcctgatggccgatcatctgcccggtcgtatgagaccaaatacctcttgcccggtacccatcaaagtatgtccaaggtctcctcccttggagacacggacccggaccagttcatcttgttcatcctacagttacgctgaagacggctctggcggttccccatgcagcctcccgctgtgtgaattctcatcaagtccctgcagccaaggagcacgattcctggccactgagcatcaagaaccaggcctcatgggggatggcatgtacaaccaggtccgtcctcagatcaagtgcgaacaatcatatggcacgaattcctccgacgagtctggaagctttagtgaagcggattccgagtcctgtcctgtgcaggaccgtggccaagaggtgaagctgccattccctgtggaccagatcacagatctgccacgcaacgacttccagatgatgatcaaaatgcacaaactgaccagtgaacagttagagtttatccacgatgtgaggcgcagatccaagaaccgcatcgcggctcagcgttgtagaaaacgtaaactggactgcatacagaacctggaatgcgagattcggaaattagtatgtgagaaggaaaagttactaagtgaacgcaatcaactgaaggcctgcatgggcgagttgctggacaacttcagctgtctcagccaggaagtttgcagagatattcagtcccctgagcagatccaagctttgcacagatactgcccagtactgaggccaatggatctgcccaccgcctcctcaattaatcccgcacccctgggcgctgaacagaacatagcagcctcccaatgtgccgtcggagaaaacgtgccctgttgtctcgaacctggcgctgccccacctggcccaccgtgggccccttctaacacgagcgaaaactgtacctctggcaggagactcgaggggactgaccccggaactttctcagagagaggtcctccactggagccacgtagccagaccgtcaccgtggacttttgccaggaaatgactgataaatgcaccaccgatgagcagcccagaaaggactatacctag

SEQ ID NO: 216280 - DNA, 246 bp, Artificial Sequence
  Description of Artificial Sequence: Synthetic coding sequence
atgagcgtggacgagaaacctgattctcccatgtacgtttacgagtccacggtgcactgtaccaatattctcttgggacttaacgatcagcggaagaaagacatactctgtgatgtgacactgatagtggaacggaaagagttccgcgcacaccgcgctgtcttggcggcatgctcagagtacttttggcaggcattggtcgggcagacgaaaaatgatctcgtcgtgtctttgccggaggagtag

SEQ ID NO: 216281 - DNA, 246 bp, Artificial Sequence
  Description of Artificial Sequence: Synthetic coding sequence
atgtcagtcgatgagaagcccgacagccctatgtatgtgtacgaatccactgtccactgtactaacatcttgctagggctgaacgatcagaggaagaaagatatcctgtgtgacgtgacattgattgttgagagaaaggaattcagagcacatagagccgtgctggccgcatgttcagagtatttttggcaggcactggtcggtcagactaaaaacgatctcgttgtctctctgcccgaggaatag

SEQ ID NO: 216282 - DNA, 2526 bp, Artificial Sequence
  Description of Artificial Sequence: Synthetic coding sequence
atgagtgtggacgaaaagcccgactcccccatgtacgtgtatgagtccacagtccactgcactaatattcttctcggtctgaacgaccagcgaaagaaggacattttgtgtgatgtaaccctgattgtcgagcggaaggaattccgcgctcatcgagcagtgctggccgcttgcagcgaatacttttggcaggcactggtgggccagacaaaaaatgatctggtggtgtctcttcctgaagaggtaactgccaggggattcggtcctcttctccagtttgcctacaccgcaaagttgctcctgagccgggagaatatacgcgaggtcatccgctgcgccgaatttctgcgcatgcacaacttagaagattcgtgcttcagcttcttgcagacccaactgctgaatagcgaggatggacttttcgtgtgtcgaaaagacgccgcatgtcagaggccacatgaagactgcgaaaattccgctggggaggaggaggatgaggaagaagaaactatggactccgagacagcaaaaatggcttgccctcgggatcagatgctgccagagccaatcagcttcgaggctgccgctatccccgtcgccgaaaaagaggaggccctcctacccgagcccgatgtccctaccgacacaaaagaatcaagcgagaaggacgctctgacccagtaccctagatataaaaagtaccagctggcttgtacaaaaaacgtatacaatgcaagttcccactccaccagcgggtttgcttctaccttcagagaggacaactcttcaaactcactgaaacctggcctcgccagagggcaaatcaaatcagaaccgccttctgaggagaacgaagaggagagcatcaccctttgtttgtccggagatgagccagatgctaaggatcgcgcaggagacgtcgagatggacaggaaacaaccgtctcctgccccaactcctactgccccagccggtgctgcctgcctagagcggtcccgctctgtggcttctccgtcttgtctgcgtagccttttctccataactaagtccgtggagcttagtggactgccatcaacatcgcagcagcattttgctcgctcaccggcttgtccatttgacaaaggaattacacagggcgaccttaaaaccgattacacaccctttacggggaattacggacagccgcatgtcggccagaaagaagtctcaaatttcaccatggggtcaccattgcgtggtccagggcttgaggccctttgcaaacaggagggcgagttagatcggagatccgtgattttctcttctagtgcgtgcgaccaagtctcaacaagcgtccactcctacagcggagtctcctccctggacaaggatttgtccgagcctgtgcccaaaggcctgtgggtaggtgcaggtcagagcctccccagttcccaggcctatagccacggcggtctgatggccgaccaccttccagggaggatgaggccaaatacctcctgtcccgtgcccataaaggtttgtccgagatccccaccccttgagactcgaactcgaactagctcctcttgcagttcgtacagctatgctgaggatggcagtggagggagtccttgtagtctccccctgtgcgaatttagcagttctccctgttcccagggtgccaggttcctggctactgagcaccaagaaccgggactcatgggggatggtatgtacaaccaagtgcgtccgcagatcaagtgcgagcagtcttacggcaccaattcttccgacgaatccggttcattcagtgaagctgatagcgagtcatgcccagtccaggaccgcggtcaggaggtgaagctgccctttcccgtggaccagatcaccgatctccctcgtaatgatttccagatgatgatcaaaatgcacaagcttacctcagaacagcttgagttcattcatgatgttcggcgtcgctcaaagaatcggatagcggctcagcggtgtaggaagcggaagctggactgcatccagaatctcgagtgcgagattagaaagttggtctgtgaaaaagagaaattgctgagcgagcggaatcagttaaaagcttgcatgggtgagctcctggataattttagttgtctcagtcaggaagtttgcagggacattcagtcccccgaacagatccaggcactgcatcgctattgcccagttctccggccaatggatctaccaacggcatcatctatcaatccagccccacttggggctgagcagaacattgctgcatcccaatgcgcagtgggggagaatgtgccttgctgtttggagccaggcgcagctcctcctggacccccatgggccccttctaacacatcagaaaattgcacttccggcagacggttggagggcacagacccaggcacgttcagcgaacgcggacccccattagagccacgctcccaaacagtcaccgttgatttctgccaggagatgacagacaagtgtacaacagatgagcaacctcggaaagattacacatag

SEQ ID NO: 216283 - DNA, 477 bp, Artificial Sequence
  Description of Artificial Sequence: Synthetic coding sequence
atgagtcacggcaaagggaccgacatgctccctgagatagccgcagctgtgggattcctgagctcactgctgcgtactcgcggatgcgtatccgaacagagacttaaggtgttttctggagctctacaagaagccctgaccgaacattataaacaccattggtttcccgaaaagccgtccaaaggatccggctatcgctgtatccggatcaaccataagatggatcccataattagccgggtggctagccagatcggtctgagtcagccccagctgcaccagctcctgccatctgaactgaccttgtgggtggacccctacgaggtgtcctaccgcataggggaggatggcagcatttgtgtattatacgaggaggcgccacttgcagccagctgcggcttactgacgtgcaaaaaccaggtacttctgggccgatcctccccgagtaaaaactatgtcatggctgtgtcgagctag

SEQ ID NO: 216284 - DNA, 3258 bp, Artificial Sequence
  Description of Artificial Sequence: Synthetic coding sequence
atggatacacccgagaacgtactgcagatgttggaggctcacatgcagtcctataagggaaacgatccgttaggcgagtgggagagatatatccaatgggtggaggaaaactttccggaaaacaaagagtatctgattactctgctggaacacctgatgaaagagtttctggacaagaaaaaataccacaatgaccccagatttatctcttactgcttgaagtttgccgaatataacagtgacctgcaccaattctttgagtttctctacaaccatggtatcggtaccctttcaagtcctttgtacatagcctgggcaggacatctggaggcccaaggcgagttgcagcacgcgtcagctgtgttgcagagggggatacaaaaccaggcggagcctcgagagttcctccaacagcagtaccgcttatttcaaacacgcctgacggaaacgcatctgcccgctcaggctagaacttctgaacccttgcacaatgtgcaggtacttaatcagatgataacatcaaagtccaatccagggaataacatggcctgcatatccaagaaccagggcagtgaactgagtggggttatctcctctgcttgcgacaaagaaagtaatatggagcggagagttataacaatcagtaaatctgagtattctgttcatagtagccttgcaagcaaagttgacgtggaacaagtcgttatgtactgcaaggagaagctgattcgaggtgaatctgagttttcatttgaggagcttagagcccagaagtacaaccagaggcgaaagcatgagcagtgggtgaatgaggaccgccactacatgaaaaggaaggaagctaatgccttcgaagagcaacttttaaagcagaagatggacgaactccataagaaactgcaccaagtggtagaaacaagccatgaggacctgccagcttctcaggagcgcagcgaggtgaaccctgccagaatggggccttccgtgggatcccagcaggagcttagagcaccatgtttacccgtgacttaccaacagactccggtaaatatggaaaagaatcccagagaggcccctcccgtcgttcccccacttgcaaacgccatttccgccgctctcgtcagtcctgcaacctctcagtccatcgctccccctgtgcccctcaaagcccaaacagttaccgattcgatgtttgccgtcgcttcaaaagatgccggttgtgtgaacaaaagcacccacgaatttaaacctcaatcgggcgcagagatcaaagaaggatgtgaaactcataaggtggctaacacaagttcatttcatacaaccccgaacaccagcctcggtatggtgcaggccactccatccaaggtccagccatcgcccactgtccataccaaagaggcattaggttttattatgaacatgtttcaagcaccaacgctcccagacatttcagacgataaggatgagtggcagagcttggatcaaaacgaagacgcattcgaggctcagttccagaagaatgtgcggagctctggagcctggggagtgaataaaattatctcttccctcagtagtgcttttcacgtgtttgaggacgggaataaagagaattacggcctcccgcaaccaaagaataagccaacaggggcaaggaccttcggagagcggagcgtctctagactcccttcaaaacctaaggaagaggtgcctcacgcagaagaatttctggatgattctaccgtttggggaatccggtgcaataagactcttgctcctagccctaaatctcccggtgactttacctcggccgcacaactcgcctctacccccttccacaaactgcccgtggagtctgttcacatcttagaagataaagaaaacgtggttgctaaacagtgcacacaggctaccctcgattcgtgtgaagaaaacatggttgtgccaagtcgtgatggcaagttttctccaatccaagagaagagtcccaagcaggccctgtctagtcacatgtattccgctagccttctgagattgtcacagcccgcagccggaggagtgctaacatgtgaggccgaactgggagtggaagcttgccgactcacagacactgatgcagccatcgccgaagatcctccagacgccatcgctggtctacaggctgaatggatgcagatgtcctccctcggcacagtcgatgcgcctaatttcatcgtcgggaatccctgggacgataaactaatatttaagcttttgtcagggttgtctaagcctgtttctagttacccaaacaccttcgagtggcaatgtaaactccccgctatcaaacccaagacagagttccagttggggtcaaaacttgtgtatgttcatcaccttctcggagagggtgctttcgcccaggtttatgaagccacccagggtgacctcaacgatgccaagaacaagcagaaattcgttcttaaagtgcaaaaaccagctaatccctgggaattttacatcggcacccagctcatggaaagacttaaacctagtatgcagcacatgttcatgaaattctacagtgcccacctgttccagaacggtagcgttcttgtgggagagctgtactcttacggcaccctgttaaatgccatcaatttgtataagaacacccccgagaaagttatgccgcagggtctggttatctcttttgccatgcggatgttatacatgatcgagcaggtccacgactgcgaaataatccatggcgacattaaacccgataattttatactgggcaatggctttttagagcaggatgacgaggatgatttaagcgccggtctggccttaattgatcttggacagtcaatcgatatgaaactcttcccaaaggggacaatctttaccgctaaatgtgagacaagtggtttccaatgtgtggagatgttgagcaacaaaccttggaactatcagattgattactttggagtagccgcaacagtgtattgtatgctgttcgggacctatatgaaggtcaaaaatgaggggggagaatgtaaacccgagggccttttccgacgactgcctcatctggacatgtggaacgagttctttcacgtcatgctcaatattcccgattgccatcacttgccaagcctcgatctactgaggcagaagctcaaaaaggtgttccagcagcattacacaaacaaaataagagccctgaggaatcgcttgatcgtgcttttgttagaatgtaagcggagcagaaagtag

SEQ ID NO: 216285 - DNA, 3087 bp, Artificial Sequence
  Description of Artificial Sequence: Synthetic coding sequence
atggacacgcctgagaatgtcctgcagatgttagaggctcatatgcagtcctataaggggaatgaccctctgggggaatgggaacgctacatccagtgggtggaggagaattttccggagaacaaagagtatctgatcacgcttctcgaacatttgatgaaggaattcctggacaagaagaagtatcacaacgatcccaggtttataagttactgtctcaagtttgccgaatacaatagcgacttgcatcagttctttgagtttctctataatcacgggatagggactctcagttctcctttatacatagcttgggcgggtcacctggaggcccaaggagagctacaacacgcctccgctgtgctgcagcgagggatacagaaccaagctgagccccgtgagttccttcagcaacagtaccggctgttccaaaccaggctaactgagacccatcttcctgcccaggcccgtactagcgaacccctgcataacgtccaagtgttgaatcagatgatcactagtaagagcaatccaggtaacaacatggcttgcatctccaagaatcaaggcagcgagctgtcaggagttatctcaagtgcatgcgacaaggagtctaacatggaaagaagagtgatcactatttccaagagcgagtattctgtgcattcctctctggcctctaaagttgatgtggagcaggtggtgatgtattgtaaggagaaactgattcgtggggagtccgaattcagtttcgaggagttacgggcacagaaatataatcagcggagaaaacatgaacagtgggtgaacgaagatcggcactatatgaagcggaaggaagccaacgcattcgaagaacaactgctgaagcaaaagatggacgagcttcacaaaaagctccaccaggtcgtagagacatcccacgaggacttgcccgcatcccaggaaagaagcgaagttaaccccgcacggatggggccttctgtaggatctcagcaggaattgagagccccttgtttgcccgtaacctatcagcagactccagtgaacatggagaagaaccctcgggaagcccctccagtagtgcctccactagcgaatgccataagtgctgctctcgtatcccctgccacctcccagtcgatcgcaccccctgtcccactcaaggcccagacagtaacggatagcatgtttgctgtggccagtaaggatgcaggttgcgtgaataaatccacacacgagttcaaaccccagagtggagccgagatcaaggagggctgcgaaacacataaggtggcaaatacctcctcatttcatacaacaccaaatacaagtttgggcatggtccaagctactccgtccaaagttcagccgtcgcccacagtacataccaaggaagctcttggctttatcatgaatatgtttcaggcccctaccctccccgatattagcgacgacaaggatgagtggcagagcctcgatcagaatgaggacgcctttgaagcacagttccaaaagaacgtgcgaagctctggggcttggggggtgaataaaatcatcagtagccttagcagcgcctttcacgtattcgaggatggcaacaaggagaattacggactcccacagccaaagaacaagcctacgggcgctcgaacgttcggggaaagatcggtgtcaaggctgcctagtaaacctaaggaagaggtaccacatgcagaggaattcctcgacgattctacggtatggggcatcagatgcaacaagaccctggccccttcacccaagtctcccggtgacttcaccagcgcagcgcagctcgcgagtacaccttttcacaagttgcctgttgagagtgtgcatattctcgaggacaaagaaaacgttgtggctaagcagtgcacacaggctactctggattcatgcgaggagaatatggtggtgccgagccgggatggcaagttttctccgattcaggagaagtctcctaaacaggctctgtcctcgcatatgtattcagcgagtctgttaaggctgtcccagccagcggctggtggggtgcttacttgcgaagcagagctgggcgtagaggcatgtcggctaactgacaccgatgctgcaatcgctgaggacccacccgacgccattgccggtctacaggctgagtggatgcaaatgtccagtctgggtacggttgatgcccctaacttcatcgtcggcaatccatgggatgacaagttgattttcaaactgctgtcgggactgtcaaagcccgtgtcatcttatcctaatacgttcgagtggcagtgtaaactgcccgcaatcaaaccaaaaacggaattccagcttggcagcaagcttgtctacgtgcatcatttactgggcgagggtgctttcgcccaggtgtacgaggcaacacagggggatctgaacgacgcaaaaaataagcagaaattcgtccttaaggttcagaagcccgctaatccatgggagttttatatcggaacccagcttatggagaggctcaagccttctatgcaacacatgttcatgaagttttacagcgcacacctcttccaaaatggcagcgtgttggtgggagaactttacagctacgggaccctcctcgacgacgaggatgacctgtccgcaggcctggcactgattgatcttggccaatcaatcgatatgaagctattccccaaaggaactatattcacggcaaaatgcgaaaccagcggcttccaatgcgttgagatgctgtccaacaagccttggaactaccagattgactactttggcgtagcagcaaccgtgtattgcatgctattcgggacatatatgaaggtgaagaatgagggaggagagtgcaaacctgaaggactatttcggcgtctaccccacctcgatatgtggaacgagttctttcatgtgatgctgaacatccctgactgccaccacttaccctccctcgacctgttgcgacaaaagctgaagaaggtatttcaacaacactatacgaataaaattagggccttgaggaaccgactgattgtcctcctgctggagtgcaagaggtcaagaaaatag

SEQ ID NO: 216286 - DNA, 3198 bp, Artificial Sequence
  Description of Artificial Sequence: Synthetic coding sequence
atggatacaccagagaatgtcctgcagtacatccaatgggtcgaggaaaatttcccagaaaataaggaatatctaataactctcttagagcacctaatgaaggagtttcttgacaagaagaaataccataatgatcctaggtttattagctattgcctcaagttcgcagaatacaattccgatctgcatcagttcttcgaatttctgtacaaccacggtataggaacgctctcatccccactgtacatcgcctgggcgggtcatctcgaagcccagggggaactgcagcacgcctcagcggtcctccagagaggaatacagaaccaggccgagccgcgagagttcctccagcagcaatacagattattccagactaggctgaccgagacacatctgcccgctcaggcgcgaacatcagaaccactgcacaacgtccaggtactaaatcagatgatcacttcaaaatccaaccccggtaacaatatggcatgcatctccaaaaatcaaggatctgagctttccggagttataagttccgcctgcgacaaggagtcaaatatggagcggcgagtgattactatctctaagtctgagtatagtgtacactcctcactcgcgtctaaagtggacgtcgaacaggtggtcatgtactgcaaagagaagcttatcaggggggaatcagagttcagtttcgaggagctgcgcgctcaaaaatataatcagaggcgaaaacatgagcagtgggtaaacgaagaccggcactatatgaaaagaaaagaggccaacgcctttgaagagcagctgttgaaacagaagatggatgaactacataaaaaactgcatcaggtggtggagacgtctcacgaggaccttcccgcatctcaagagcgtagcgaggtgaaccccgcacggatgggaccctccgtgggttcacagcaagaattgagggcgccatgtctgcctgtaacttatcagcaaactccagtcaacatggaaaagaatccgagagaggccccacctgtagtgccccctctggctaacgccatatcagcagcccttgtgtccccagccacgagccagtctatcgcacccccagtgccattgaaagcccaaaccgtcaccgattccatgttcgccgttgcatcgaaagacgcaggatgcgtgaataaaagcacgcacgaatttaaaccacagagcggcgctgaaatcaaggaggggtgtgagacacacaaagtggccaacacctcaagcttccacaccacgccgaatacttctctgggtatggtgcaagctacccctagcaaggtgcagcccagccctactgttcataccaaagaggccttaggattcatcatgaacatgttccaagccccaaccttgcccgacatatctgacgataaggatgaatggcagagcctcgaccagaacgaagatgcattcgaggcacagtttcagaagaacgtgcggtcatccggagcctggggggttaacaaaattatcagcagcctctccagcgcctttcacgttttcgaggatggtaataaggagaactatgggcttccccagcctaagaacaaaccaaccggggctaggacattcggggaaaggagcgtgtcacgcctccccagcaaacccaaggaggaggtcccacacgcagaggaattcctcgacgattccacggtgtggggcatccgctgtaataagactctcgccccatcacctaagtctccaggcgattttacctccgccgctcagctcgccagcacgcctttccacaaattacccgtagaatcagttcacatcttggaggacaaggaaaatgtggtcgcaaagcagtgcacccaggctaccctcgatagttgcgaagagaatatggtcgtgccatcacgtgatgggaagttttctcctatccaggagaagagtccaaagcaggctctttctagtcacatgtacagtgcgtcactgttgcgactgtcccagcctgccgcaggcggagtgctgacatgcgaggctgagctgggcgttgaagcctgcaggctgacggatactgatgccgcaattgccgaggacccacccgacgctattgcgggactccaggccgagtggatgcaaatgagttcgctgggaacagttgacgcccctaactttatagtgggaaacccgtgggatgataagttgatcttcaaattactgtccggactttccaaaccagtctcatcatacccgaatacgttcgaatggcagtgcaaattgccagcaattaagccgaagacagaattccagttaggatccaagttagtatacgtgcaccatctgctgggtgaaggtgccttcgcacaggtgtatgaagcaacacagggggatctgaatgacgcgaagaataagcagaagtttgttctgaaggtgcagaaaccagcgaacccctgggagttttacattggaacccaactgatggagaggctcaagccaagtatgcagcatatgttcatgaaattctacagcgctcacctgttccagaacgggagcgtacttgtcggagagctatatagctacgggacactgttaaatgccatcaatctctataagaacacccccgaaaaggttatgccgcagggtcttgtcatctccttcgctatgagaatgctatacatgatcgagcaggtccacgactgtgagattatacacggcgatatcaaaccggataatttcattctcggcaacgggtttctggagcaagatgatgaggatgatctgagcgctgggctggccctgattgacctgggtcagtctatcgatatgaaactgtttcctaagggcacaatcttcacagccaagtgcgagacatctggctttcaatgtgttgagatgttatcaaacaagccctggaattaccagatcgattactttggcgttgccgctacagtctattgtatgctgttcgggacgtacatgaaggtaaaaaatgagggcggagagtgcaagcccgagggactgtttcggaggctgccccaccttgacatgtggaatgaattctttcacgttatgctgaacatacctgactgccatcatctgccttctctggacctgctgcggcagaagctgaagaaggtcttccagcagcattacacgaacaagattagggccctgcgcaaccggctaattgtgcttctcttggaatgcaaacgtagccggaagtag

SEQ ID NO: 216287 - DNA, 2475 bp, Artificial Sequence
  Description of Artificial Sequence: Synthetic coding sequence
atggatactccagagaacgttctgcagatgctagaggctcacatgcagtcatacaaaggaaatgaccccctgggagagtgggaaagatacatacagtgggtagaggaaaatttccctgagaacaaggaatatctgattactctcctggaacacctcatgaaagagttcctcgacaagaaaaagtaccataatgatcctaggtttatttcgtactgtctcaaatttgccgaatataattccgacctgcatcagttttttgagtttctctacaaccacgggatcggaacactgagtagccccttatatatcgcatgggcgggtcacctggaagcacagggggagctccagcacgcatccgccgtgctgcagcgaggaatacagaaccaagcggagcccagagagtttttgcaacagcaataccgactgtttcagacgcgccttacggagacgcatcttcccgctcaggcaaggactagtgagccacttcacaacgtccaggtactgaaccaaatgatcacctccaagtctaaccctggaaacaatatggcctgcatttccaagaaccaggggagcgagctgagtggcgtcataagctctgcgtgcgataaggaatctaatatggaacggagagtgatcacaatctcgaaatcagagtattcagtacatagtagtttagcttctaaagtggacgtcgagcaagtagtgatgtactgtaaagaaaagctcataaggggagaatctgaattctctttcgaggagcttagagcccagaagtataaccaacggagaaagcacgaacaatgggttaacgaggaccggcactacatgaaacggaaggaggcaaatgccttcgaagagcagctcctcaagcagaaaatggacgagcttcacaagaaactgcaccaggtggtagagacttcacatgaagacctgcctgccagtcaggagcgatctgaagtcaacccggcaaggatgggtccgtcagtgggcagccagcaggaattaagagccccatgcttacccgtgacctaccagcaaactccagtcaacatggaaaaaaatcccagagaagcacctccagtagtacctccgctagctaatgctatcagcgctgctctcgtgtcccctgcaaccagtcagagcatcgccccacctgtgcctcttaaagcgcagacggtaaccgactctatgtttgcagtggcgtcaaaggatgctgggtgcgtgaataagtctacccacgagtttaagccccagagtggagcagaaatcaaagagggctgtgaaactcacaaggtcgctaataccagctcttttcatactacccctaacacatcactgggcatggtgcaggccacaccaagtaaggttcaaccttcccctactgtgcatacaaaggaagctcttgggtttatcatgaacatgttccaggcccctactctgcctgacatttctgatgacaaggacgaatggcagagtctcgaccaaaacgaggacgcctttgaagcccagtttcagaagaatgtgcgcagctccggagcgtggggggtgaacaagatcatcagctctctgagcagcgccttccacgtgtttgaagatggcaataaagaaaactacggcctgcctcagcccaagaataagccgactggggctcgaacttttggtgagcgctcagtgtctcgccttcccagtaagccaaaagaagaggtgccccatgccgaggaattcttggacgactcaacagtgtggggcattcgttgcaacaagaccttggcccctagcccgaagtcacccggagacttcactagtgctgcccaactagcatctaccccattccacaagctccctgtcgagtcagtgcacatcctggaggacaaggagaatgttgtcgctaaacagtgtacccaagctactttagactcttgtgaggaaaacatggtcgttccatcccgcgacgggaagttctctccaatacaggagaagtctcctaaacaggccctcagttcacatatgtactccgcctcactactgcggctgtctcagcccgctgccggaggcgtgctaacttgcgaagctgaactgggcgtcgaggcgtgtcggctcaccgacaccgatgccgctatcgcggaagatcctccagatgcgattgcagggctgcaggccgagtggatgcagatgtcatccctcggtacagtggacgctcccaacttcattgtgggaaacccatgggatgacaaactgatttttaaattgttatcaggtctgtccaaaccggtgagtagttatcctaacacctttgaatggcagtgcaaattacccgcaatcaagcccaagacagagttccagctcgggtccaaactcgtttacgttcaccacctgctgggcgaaggcgcatttgctcaagtgtacgaagccacccagggtgacctgaacgatgccaagaataagcaaaaatttgtcctcaaagtgaagtcttag

SEQ ID NO: 216288 - DNA, 981 bp, Artificial Sequence
  Description of Artificial Sequence: Synthetic coding sequence
atgaccgggtccaacgagtttaagctaaatcagcccccagaagacggcatttcatcagttaaattttccccaaatacaagccagttccttctggtgagcagctgggacacaagcgttcggctgtatgatgttcctgccaactccatgcgcctaaagtatcagcataccggcgcagtgttggactgcgcattctacgatccaacccacgcttggtccggcggactggatcaccagctgaagatgcacgacctgaacactgatcaagaaaacctggtaggaacacatgacgcacctattaggtgtgtcgagtattgtcctgaggttaacgttatggtgactggaagttgggatcagactgtgaagctttgggatccacgcactccatgtaatgccggtacatttagccagccagagaaggtttacaccctgagcgttagcggcgatcgcctcatcgttgggaccgccggacgcagggtacttgtttgggatctgcggaatatggggtatgtccagcaacggcgtgaatcatcccttaagtatcagacgaggtgcatccgcgcattcccaaataagcagggttacgtgctttcctctatagagggacgggtcgcagtggagtatctcgatccatcaccagaggttcagaagaagaaatatgccttcaaatgccaccgcctcaaggagaacaacatagaacagatctaccctgtaaacgccatcagtttccacaatatacataacaccttcgcaactggaggcagcgatggttttgtgaatatatgggacccttttaacaaaaaacgactctgccagttccacaggtaccctaccagcattgcgtccctggcattctccaatgatggcacaacactcgccatagctagctcttacatgtacgagatggacgatactgaacacccggaggacggcatctttatccgccaagtcacagacgccgagaccaaacccaagtctacctag

SEQ ID NO: 216289 - DNA, 987 bp, Artificial Sequence
  Description of Artificial Sequence: Synthetic coding sequence
atgacagggagcaatgaattcaaactgaatcaacctccagaggacggaatcagctccgttaagtttagccccaacacatcacagtttctgctcgttagtagctgggacacgagtgtgagactgtatgatgtccctgctaatagcatgcggttaaagtatcagcatacaggcgctgtactggactgtgcattttacgatcccactcatgcatggagcggaggcctggaccaccagctgaaaatgcacgacctgaacacagaccaagaaaatctggtgggaacccacgatgctcctattcgatgtgtcgaatattgtccagaggtaaacgttatggtcactggcagctgggaccagacagttaagttgtgggaccccaggactccttgcaacgctggtaccttttctcagcccgaaaaggtctacactctgtccgtatcaggtgatagactaatcgtgggcactgccggacgcagagttctggtttgggatctgagaaatatgggctatgtgcagcagcgccgtgaatcgagcctgaaataccagacaagatgcattagggctttccccaataagcaggggtatgtgctctccagtatcgagggcagagtggccgtcgaatacctggatccttctcctgaggtccaaaagaaaaagtacgcattcaaatgtcaccgactgaaagagaacaacatcgagcaaatatatcccgtaaacgccatttcattccacaacatccataacacctttgccaccgggggatcagacggctttgtcaacatttgggacccattcaataaaaagcgcctgtgccagtttcacagatatccaacctcaatcgcgtcactggctttttctaatgatggaactactctggcaatcgcttcatcttacatgtacgagatggacgatacagagcatcccgaagatgggatctttataagacaggtgacagatgctgagaccaaaccaaaatctccgtgcacctag

SEQ ID NO: 216290 - DNA, 747 bp, Artificial Sequence
  Description of Artificial Sequence: Synthetic coding sequence
atgcatgatcttaatacggaccaagagaatctggtgggcacccatgatgctcccattagatgcgtggaatattgtcccgaagtcaatgtgatggtaaccgggagctgggatcagaccgtcaagctctgggatccacggacgccttgcaacgccggaaccttctcacagcccgagaaagtatacacactgagcgtcagcggcgataggctgatagtcggcactgcgggacggagggtcctcgtttgggacctcaggaatatgggttacgtacagcagagacgggaatccagcctcaaatatcagacccggtgcattagagcttttccaaacaagcagggctacgttttgtcctcgatcgaaggcagagtagccgtggagtatctcgatccatcccctgaagtccagaagaagaagtacgccttcaaatgtcaccgtttaaaggagaataatattgagcagatttatcctgtgaatgccattagttttcacaacatccataacactttcgctaccggagggtcggacgggtttgttaatatttgggatccctttaacaagaagcggctgtgccagttccataggtaccctacatctatcgcttccctagccttctcaaatgatggcacaacattggccatagcttcatcctatatgtacgagatggatgacacagagcatccagaagacgggatatttattcgccaggtcacggacgctgaaaccaagccgaagtccccgtgcacatag

SEQ ID NO: 216291 - DNA, 1164 bp, Artificial Sequence
  Description of Artificial Sequence: Synthetic coding sequence
atggcctgtaccatccagaaggccgaggcattggacggcgcacaccttatgcagattctgtggtatgatgaagaagaatctctgtatccggcagtttggttaagagacaattgtccctgcagcgactgttatcttgactctgcaaaagctcggaagttgttagtcgaggcgctggacgttaacatcggaattaaaggactgatttttgaccggaagaaagtctatattacttggccagatgagcattactcagagtttcaggcagactggcttaaaaagcgctgtttttcaaagcaagcaagagccaagcttcagagagaactgttttttccggaatgccagtactgggggtcggagctccagctgccaacactcgatttcgaggacgtgctgcggtatgacgaacatgcttataagtggctctccactctcaaaaaggtgggcattgttaggttgacaggagcgtcggacaagccaggcgaagtttcaaagttagggaagcgcatgggttttctgtacctcactttttatggacatacatggcaagttcaagataagattgacgccaacaatgtcgcatacacaactggaaaactatcctttcacacagactatcccgcactccaccatccaccaggagtgcaactactgcattgcattaaacagaccgtgactggcggtgattcagagatcgtcgatggattcaacgtttgtcagaaactgaaaaaaaacaatccacaggcctttcagattctctcttccacatttgtggacttcaccgatatcggagtagattattgcgacttctccgtccagtccaaacataagattatcgagctggatgataaaggacaagttgtccggatcaatttcaacaacgctacaagggacacgatcttcgacgtaccagttgaaagggtgcagcctttttatgcagccttgaaagagtttgtcgacctcatgaactccaaagagtcaaagttcacatttaaaatgaaccccggagacgtgataaccttcgacaactggagacttctccacggacgacggtcgtacgaggccggaacagaaatcagccgacacttggaaggcgcatacgcggattgggatgttgtgatgagcaggctccggattttgaggcaacgggttgagaacggcaattag

SEQ ID NO: 216292 - DNA, 1164 bp, Artificial Sequence
  Description of Artificial Sequence: Synthetic coding sequence
atggcttgcaccatccagaaggctgaggccttggatggtgcccacctgatgcagatcctctggtacgatgaagaagaaagtctgtaccctgccgtatggttgcgcgataactgcccatgttctgactgctacctggattctgctaaggccaggaagcttctagtcgaggctctcgatgtgaacatcggcattaagggcctaatcttcgaccgcaaaaaggtctatatcacttggcccgatgagcactacagcgagttccaagctgattggttgaaaaaacgatgtttttctaaacaagctcgtgcaaagctgcagagagaactctttttcccagaatgccaatattggggatctgaactacagttgccaacacttgactttgaggacgttctgagatacgacgaacatgcatacaagtggctgtcaacactgaaaaaagtcggcatcgttagattgacaggagcttctgacaaacccggagaggtttctaagctgggtaaaagaatgggcttcctgtatctcacattctacgggcacacatggcaggtgcaagacaaaatcgacgccaacaatgtagcctacacaacaggcaaactgagtttccataccgattaccctgcactgcatcacccacctggggtccaacttcttcattgcatcaaacagaccgtgaccggcggtgattccgagatagtagacgggtttaatgtgtgccagaagctgaagaagaacaaccctcaagccttccaaatcctcagctctacatttgtggatttcaccgacatcggcgtggattactgtgatttttcagtgcagtcgaagcacaagattatagagctggacgacaagggacaggtggttaggattaacttcaacaatgccactcgtgacaccatcttcgacgtcccagtggagcgcgttcagcccttttatgctgccctgaaggaattcgtggacctgatgaacagtaaagagagcaagtttacgtttaagatgaaccccggagacgtcatcacctttgacaattggcgacttcttcatgggaggcgtagctacgaagctggtaccgagatcagccgacatcttgaaggggcatacgcagactgggacgttgttatgtcccgattgagaatcttacgacagagggtcgaaaatggaaactag

SEQ ID NO: 216293 - DNA, 1164 bp, Artificial Sequence
  Description of Artificial Sequence: Synthetic coding sequence
atggcctgcaccatccagaaagcggaggccctggatggagcccacctaatgcagatactttggtacgatgaagaggaaagcctctaccccgctgtgtggctccgagataactgcccctgctcagattgctatctagactcagcaaaagcgcgaaagctactggtggaggctcttgatgtgaatatcggaatcaaagggttgatttttgaccgtaaaaaggtatatattacctggccagatgagcattactctgagtttcaggccgactggctgaagaagagatgtttttcaaagcaagctagggctaagctgcagcgcgaattatttttcccagaatgccagtattggggtagcgagctgcagctgcccacccttgactttgaagacgtactccggtacgacgagcacgcctacaaatggctttcaacgctgaagaaggttggaatcgtgaggctcactggtgccagtgacaagcctggcgaggtcagtaagttgggaaagcgcatgggctttctttacctgaccttttacggccacacctggcaggtacaggacaagatcgatgctaacaatgtggcgtatacgaccggcaagctgagtttccatacagactacccggctctccaccatccccctggagttcagctgctgcattgcataaagcaaacagtgactgggggagacagcgaaatcgttgatgggttcaatgtgtgtcagaagctgaagaaaaataacccgcaggcctttcagatcctgtcctctacatttgtcgatttcaccgacatcggggtcgactattgcgatttttctgtgcaatctaaacacaagataatcgagctggacgacaagggccaggttgttagaatcaacttcaataatgctacgcgggacacaatattcgacgtccctgtagaacgtgtccagcccttctatgctgctctaaaggagtttgtggaccttatgaactcaaaggagagcaaatttacatttaaaatgaatcccggagacgtaattacatttgacaactggaggttgctacacggcaggcggtcgtacgaagcaggtaccgaaatttcacgccacctggaaggcgcttacgccgactgggatgtcgtgatgagtaggctgcggattttacgccaaagggtggagaacggcaactag

SEQ ID NO: 216294 - DNA, 1164 bp, Artificial Sequence
  Description of Artificial Sequence: Synthetic coding sequence
atggcttgcactattcagaaggcggaagctctggacggcgctcacttaatgcagatcttatggtatgatgaagaagagagtctgtaccctgccgtatggctgcgcgacaattgtccctgcagtgactgctatttagatagtgccaaagcgagaaagctgctggttgaagcgttggatgtcaatattggcattaaggggttgattttcgaccgcaaaaaggtgtacatcacctggcccgacgaacattacagcgagtttcaggctgactggctgaagaagcgatgcttctcaaaacaggccagggccaaactacagcgagaactgttcttcccggagtgccagtactggggatcagaactacaattacctaccctggactttgaagacgtgctccggtatgacgagcatgcttacaaatggttgagtacactcaagaaagttggtattgtgcggctgacgggcgcttccgataaacccggagaggttagcaaattaggcaaacgtatgggtttcctgtacctgaccttttatggacacacctggcaagtgcaagataagatcgatgctaataatgtggcttacacaaccggtaagttatcctttcacaccgactatcctgccttgcatcatcccccaggagtgcagcttctgcattgcatcaaacaaaccgtgaccggcggtgatagcgaaatcgtggacggcttcaacgtttgccagaagctcaaaaaaaataaccctcaggcctttcagatactcagtagcacattcgtggacttcacagatatcggggtcgattattgcgactttagcgttcagtctaaacacaagattattgagctggatgacaagggccaggttgttaggatcaactttaacaacgctaccagggatactattttcgatgtgccagtcgaaagggtgcagccgttctatgcggctcttaaggagttcgtagatctcatgaacagcaaagagtcaaaattcactttcaaaatgaatcccggtgacgtgataaccttcgataactggaggctcctgcacggcagacggagctacgaggctggcacagaaattagccgccatcttgaaggggcttacgctgattgggatgtggtgatgtcccgactacggatactgcggcaaagagtggaaaacgggaattag

SEQ ID NO: 216295 - DNA, 207 bp, Artificial Sequence
  Description of Artificial Sequence: Synthetic coding sequence
atggcatgcactattcagaaagctgaagcactagatggtgcgcatctgatgcagatcttgtggtacgatgaagaagagagcctttatccggctgtttggctgcgggacaattgcccctgctcagactgttacctggactccgcaaaggctaggaaactgctggtcgaagctctggatgttaacattggaattaagggtctaatttag

SEQ ID NO: 216296 - DNA, 771 bp, Artificial Sequence
  Description of Artificial Sequence: Synthetic coding sequence
atggagcctgctgccgctctgcatttctccttacccgcaagcctgctgctcctgctgttattattgctcctatctctttgtgcgttggtctcagctcagttcacggttgtcggacctgcaaaccccatcctggccatggtaggggagaataccacactgaggtgtcacctgagtccggagaaaaatgctgaggacatggaagtccgctggtttagaagccagttttcacctgcagtatttgtgtacaaggggggacgagagcggaccgaagaacagatggaagagtatagaggcagaatcacctttgtgtccaaagatatcaaccgaggctctgtggcacttgtaattcacaatgttactgcacaggagaacggtatctaccgttgctattttcaagaaggcagaagttacgacgaagccatactgcggttagtagtcgctgagtcttttatgccctcagcatctccatggatggtagccctggctgtgatcctaacagcaagcccctggatggtcagtatgaccgtcattttggcggtgtttattatctttatggcagttagtatttgctgtattaagaagttgcagagggaaaagaagattttaagcggagagaagaaggtcgaacaggaggaaaaagagattgctcaacagctgcaggaagaattacgctggcgacgtacattcctgcatgctggttacgagttgcccggtatccgtggcccttcatggaagaggccactacatggggaaccgccttctgctttctag

SEQ ID NO: 216297 - DNA, 942 bp, Artificial Sequence
  Description of Artificial Sequence: Synthetic coding sequence
atggagcccgctgcggcactgcatttctcgctgcctgcatcccttctgctgctcttattgctcctgctgctgagtttgtgtgccctggtcagcgaaagctttatgccatcagcatcaccctggatggtggcgcttgccgtgatcttaaccgcgtctccttggatggtatctatgactgttatactggcagtgttcataatctttatggccgtctcaatctgctgcatcaagaagcttcagagggagaagaagatactctccggagaaaagaaggtggaacaggaggaaaaggagatagcgcaacaactgcaagaagaactgcggtggcggagaacattcctgcacgccgcagatgttgtactagaccccgatacagcccacccggaactgttcctgtcagaggacaggcggtcagttcgaagaggaccttatcgccagcgggttcccgataatccagagcggttcgactcgcaaccctgcgtactcggctgggagtccttcgcatcaggtaagcattactgggaggtagaagttgagaacgtcatggtgtggaccgtgggggtctgtagacactctgtcgaaaggaagggtgaagttctactgattcctcaaaatggcttctggacactggaaatgttcggaaaccaataccgcgctctgagctcaccggagagaatcctaccacttaaggagtccctctgccgcgtgggagtctttctggattacgaagctggagacgtctccttctataacatgcgggacaggtcccacatctacacatgcccaagaagtgccttcactgtccctgtgcggcctttctttcgcctgggctccgacgattctccaatctttatctgcccagccctaactggcgcttcaggggtgatggtccccgaagaaggactcaagctgcacagggttggcactcatcagtccctatag

SEQ ID NO: 216298 - DNA, 1608 bp, Artificial Sequence
  Description of Artificial Sequence: Synthetic coding sequence
atggtcggcgaggatgccgacctgccctgccacctcttcccaacgatgagcgctgagactatggaactgcgctgggtgtcgtcatcgctgcgacaagtcgtgaacgtgtatgctgatggtaaggaagtggaggaccgtcagagcgcaccctatcggggaaggacttcaattcttagagatggcatcacggccggaaaggccgcactgcgcattcacaacgttacagcctctgatagcggaaagtatctgtgttattttcaggatggcgatttttacgaaaaagcactggtggaacttaaagtggctgcactcggttccgatttacatatcgaggtcaaagggtatgaggatgggggtatccacctggagtgcagatccaccgggtggtatccccaacctcagatcaaatggtccgacacgaaaggagagaacatccccgctgtggaggctccagtcgtggccgatggggttggactgtatgcagtggccgcttcggtcatcatgagaggttctagcggcggaggcgtaagctgtattatccgcaactcccttctgggccttgaaaagacggccagcatttcaatcgcagacccattcttcagaagcgctcagccctggattgcggcacttgccggtacgcttcctataagcttacttctgttggcaggagcctcttactttctctggaggcagcagaaagagaagattgccttaagccgggagaccgagagggagagagagatgaaagaaatgggctacgcagccaccgaacaggaaatctctctccgggagtggaggaaaatacagtacatggccaggggtgagaaatcccttgcatatcacgaatggaaaatggccctgtttaagcctgctgacgtgatactggaccctgataccgctaacgccatattgctcgtctccgaagaccaacggtcagtccaaagagccgaagagccacgcgacctgcccgacaacccggagagattcgagtggcgatactgtgtcctcgggtgtgaaaatttcacaagcggccgacattattgggaggttgaggttggggacaggaaagaatggcacatcggcgtttgtagcaaaaatgtcgaacgaaaaaaagggtgggtgaagatgacgcccgagaatgggtattggaccatggggctgaccgacggaaacaagtacagagcccttacggaacccagaacgaacttaaagttgcctgaacctcccaggaaagtgggaatttttcttgattacgagactggagaaatttctttttataacgctacagatggttctcacatttatacattccctcacgcaagcttctcggaaccattgtaccccgtgtttcggatcctcactctggaaccgacggccctaacaatttgtcctatacccaaggaggtcgaatcaagccccgatccagatcttgtgcctgaccactccctggaaactcccctcacaccaggactagctaacgagagtggcgaaccacaagcagaggtgacgtccctgctcctcccagctcatcccggagccgaagttagcccaagtgccaccactaatcaaaatcacaagctccaggcacggacagaagctctgtactag

SEQ ID NO: 216299 - DNA, 1581 bp, Artificial Sequence
  Description of Artificial Sequence: Synthetic coding sequence
atggccgtgtttcccagctcagggctaccaaggtgcctgttgaccctgatcctgctacaacttccaaagctcgactccgcacctttcgacgtgatcggccctcctgaacctattctggccgtggtgggcgaagacgcagagctcccatgtagattgtccccaaacgcttcagccgagcacttagaactccgctggtttcgaaaaaaggtttccccagcagttcttgtgcaccgggatggtcgtgagcaagaagctgagcagatgcctgaataccggggacgtgctactctagtgcaagacggaatagcaaaggggagggtggcacttaggataagaggggtcagggtcagcgacgatggagagtatacctgctttttccgcgaagatggcagctacgaagaggccttagtccatcttaaggtggccgctttaggttctgatccgcacattagcatgcaggttcaggagaacggcgaaatttgcctagaatgcacaagcgtgggttggtatcctgaacctcaggtgcagtggcgcacctcaaaaggagagaaattcccatcaacgtccgagtcccgcaatccagacgaagagggcttgtttactgtagcagcctcagtgatcatcagagacacatcagccaagaatgtgagttgctatatccagaacctcctgctcggacaagagaagaaagtggaaatcagtattcccgcatcgagcctcccaagactaacgccttggatagtggcggttgctgttatattaatggttctgggcctcctgactatcggatccatcttctttacttggaggctttataatgaacggcctcgggagcgccgtaacgaattttcttctaaagagcgcttgctcgaggagcttaaatggaaaaaggccaccctacacgccgttgacgtgaccctcgacccggacacagcccacccgcatctatttctttacgaagattcaaaaagtgttaggcttgaagattccagacaaaagctgcccgaaaagacagagcggttcgacagctggccttgtgttctgggccgtgagactttcacatcaggccgtcactattgggaggttgaggtcggcgataggacggactgggctatcggggtttgcagagagaacgtgatgaaaaaagggtttgacccaatgactcctgagaatgggttctgggctgtggaactttatgggaacggatactgggcattaaccccactccggacaccattgccgttggccggacccccacgcagagttggtatttttctggattatgagtctggcgatatcagtttttacaacatgaacgatggatccgacatctacactttctccaacgtgactttttccggccctcttcgaccttttttctgcctatggagttctggcaaaaagcccctcaccatatgcccaatcgccgacgggcctgagagagtgaccgttatcgcaaacgctcaggacctgtctaaagaaattcccctgagtccaatgggggaagatagtgcccctagggacgctgataccctacactctaaactcatccctacccagccttcccagggagccccttag

SEQ ID NO: 216300 - DNA, 1485 bp, Artificial Sequence
  Description of Artificial Sequence: Synthetic coding sequence
atggcagtgttccctagtagcgggttgcctaggtgcctgttaaccctgatcctactccagttgccgaagctggactcagctccgtttgacgtcattgggcctcctgagccaattctggctgtagtgggagaggatgccgaactgccctgccgtcttagcccaaacgcaagtgccgagcatttggagctaagatggtttcggaagaaggtgtcaccagctgttctggtgcaccgggacggtagagagcaggaagccgaacaaatgccagaataccggggaagggcaacattagtgcaggatggcatcgcaaagggccgagtagcgctccggatcaggggtgtcagggtttccgatgatggcgaatatacatgtttctttagggaggatgggagttatgaggaagcgctggtgcatttgaaggttgcagccctggggtcagatcctcacatatccatgcaggtacaggagaatggggaaatctgcctcgaatgcacttctgtcggctggtaccctgaacctcaggtgcagtggcggacgtctaagggcgagaagttccccagcacaagcgagagcaggaacccagacgaagaggggctcttcactgtggcagcatctgtcatcatccgggatacttccgctaagaacgtgagttgttacattcagaatttgctgttagggcaagaaaagaaagtagagattagcattccagcttccagcctccccagactcaccccgtggattgtggcagtggccgtgattctgatggtgctgggtctgctgaccatcgggtcgattttctttacttggcgtctctataacgaacgccctcgagagcggcgtaacgagtttagtagtaaagaaaggttgctggaggaactaaaatggaaaaaggcaaccctccatgcagtcgatgttacccttgatcctgatactgctcacccacacttgtttctctatgaagattctaagtcagtaaggctggaagactctcggcagaaattgccggagaagaccgagagattcgattcatggccatgtgtactcggacgggagacattcacaagcggtaggcactactgggaggttgaggtcggagatcgcaccgattgggcaatcggcgtgtgtcgggagaatgtgatgaagaaggggttcgacccaatgacaccagagaatggattctgggccgtagagctatatggcaacggatattgggcgctgacacccctgaggacccccctacccttggctggacccccacgtcgagtggggattttccttgattacgagtcaggcgacatttcattttacaacatgaatgacggctccgacatatatacgtttagcaacgtgaccgtgatcgccaacgcgcaagacctgtccaaagaaattccgttatccccgatgggggaagacagtgccccacgggacgcggacaccctgcattccaagctgataccgacccagccgagccagggcgcaccctag

SEQ ID NO: 216301 - DNA, 1590 bp, Artificial Sequence
  Description of Artificial Sequence: Synthetic coding sequence
atggagagcgccgcagcactccatttctcccggcctgccagcttgctgttactgctgctttcgttgtgcgctcttgtcagtgctcagtttatagttgtaggccctactgatcctattctggcaaccgtcggggagaatacgaccttaaggtgtcatctgtcacccgagaagaatgctgaagacatggaggtgaggtggtttaggtcgcagttctcacctgccgtgttcgtatataaaggcggacgagaacgaacagaggagcaaatggaggagtaccggggaagaacaacctttgtgagcaaagatatctcgcgtggatcagtcgccttagtgatccacaacatcaccgcccaggagaacggcacgtaccggtgttatttccaggagggcagaagttatgacgaagctattctccatctggtggtggccggtctgggcagcaaaccattaatctcgatgagaggccacgaggatggagggatccgactggaatgtatctctcgcggatggtaccctaagcctttaaccgtatggcgcgatccttatggaggagtggctcctgccctgaaagaggtaagcatgccagacgcggacgggttattcatggtgacaactgccgtcatcatccgtgacaaatccgttaggaacatgtcctgtagcatcaacaacaccttattgggccaaaagaaagagagcgtaatctttatcccggagtcatttatgccttctgtttcaccgcctattgccgtctgtatctattggataaacaaactgcagaaagaaaaaaaaatcctgagtggcgaaaaggaatttgagagggagacacgcgagattgccctcaaagagctcgaaaaagagagggtgcaaaaggaagaggaactgcaggtgaaagaaaagctgcaagaggaactgaggtggcggaggacttttctgcatgcagtggacgtagtccttgacccggacaccgcgcatccagacttgtttctctcagaagacaggcgctctgtgaggaggtgccctttccgacatttgggtgagtccgtcccagataaccctgagcggttcgattctcagccttgtgtcctgggcagagaaagcttcgcatctggcaagcactattgggaagtggaggtagaaaatgtcatcgagtggacggtgggggtgtgtagggactcagtcgaaaggaagggtgaagtcctactgatcccccaaaacggcttttggacgttggaaatgcacaaaggccagtatagagccgtctcttccccagataggattctccctctgaaagaatccttgtgtagggtgggtgtgttcttggattacgaagccggagatgtctctttctacaacatgcgggatcgcagccacatctatacctgcccacggtcagctttttctggaccagatacgagccaatctggggaccccccagagccaatagagtccatcccctggtcccatagccatgtggacaaaccttggtccagtcagcaaccacctcacaatacccacctgccagcagcttcattcaccccaacaaccgatttgtcccctagtttcttgctcctcacccgcctctgtttctag

SEQ ID NO: 216302 - DNA, 1584 bp, Artificial Sequence
  Description of Artificial Sequence: Synthetic coding sequence
atggagtcagctgccgctcttcacttctcgagacctgccagcctgcttctcctgctcttgagtctttgtgccctagtctccgcgcaattcattgtggtgggcccaactgacccaatcctggccaccgtaggagaaaacacaacacttaggtgccatctgagtcctgaaaaaaacgccgaggatatggaggtgagatggttcagatcacaattctcccctgctgtgttcgtatataaggggggacgcgagcggactgaggaacagatggaagagtacaggggaaggacaacattcgtgtccaaggatatcagtcgcggaagcgtggcactcgttatacacaacattactgcccaggagaatgggacctaccgttgctacttccaggagggcaggtcctacgacgaggccattctgcacctggtggtagcgggattgggatcaaagcccttgatctctatgagggggcatgaggacggcggaattcgactagaatgcataagcaggggatggtacccaaagcctttgacagtgtggcgagacccttacggcggtgtggcacctgctctcaaagaagtcagtatgcccgatgcagatggcctcttcatggtgaccactgcagtgataattcgagataaatctgttagaaacatgtcatgttcaattaacaatacactgctcggacagaagaaagagagtgtgatctttatccctgagtcctttatgccaagcgtcagcccttgtgccgtggctttacctatcattgtcgttattctgatgatccctatagcggtgtgcatatactggatcaataagttgcagaaagagaagaagatcttgagcggggagaaggagtttgaacgggagacacgtgaaattgctctgaaggagctggaaaaggaaagagtccagaaggaagaagaactgcaggttaaagaaaaactgcaggaagaactcagatggcggaggacgttcctccacgcggtggacgtggtattggaccccgataccgcccatccagatctcttcttatctgaggataggaggagcgttcggaggtgcccatttaggcacctaggtgagtcggtgcccgataatccagaacggttcgactcgcagccgtgtgtgctcgggcgagagtctttcgcatctgggaagcactattgggaggtggaggtggaaaatgttatcgagtggaccgtgggggtttgcagggatagtgtcgagaggaagggagaggtgctgcttatcccgcagaacggcttctggactctcgaaatgcacaagggtcaatatcgggctgtgtctagtccggacagaatcctgcctctcaaagagtcgttgtgccgcgtgggtgtgttcctggattatgaagccggagacgttagtttttataatatgagagaccgaagtcatatatatacctgccctcggagtgcattctctgttccagtgcgcccttttttcagactcggatgtgaagactcacctatttttatctgtccagctttgactggtgccaacggggtcacggtgccagaagagggtctgaccctgcatcgggttgggacccaccagagcctctag

SEQ ID NO: 216303 - DNA, 1005 bp, Artificial Sequence
  Description of Artificial Sequence: Synthetic coding sequence
atggagagcgcagctgcccttcactttagcaggcccgcatcgctgctgcttctgctcctgtcactctgcgcccttgtgtcagcacagttcattgtcgttggtccgacagatccaattctcgctactgtcggagaaaatactaccttgcgctgtcatctgtcccctgagaagaacgctgaggatatggaggtccgctggtttcgcagccagttcagccccgcagtatttgtgtacaaagggggaagggaacgcacggaggagcagatggaggagtatcgcggacgcacgactttcgtttctaaagacatctcaagagggagtgtcgccctggtgattcacaacatcaccgcacaagaaaatggcacttatagatgttactttcaagaggggcgttcttatgacgaagccatcctgcacctagtcgtcgccggtttagggagtaagcccttgatttctatgaggggacacgaagacggaggtattcggctggagtgtatctcacgcggatggtatcccaagccccttacagtgtggagagacccttatggcggagtggccccagccctgaaggaggtaagcatgcctgacgccgacgggctgttcatggtgactacagccgtcatcatcagggataagtctgtacgcaatatgagctgcagcatcaataatacacttttgggccaaaagaaagagtcagtcatctttatacccgagtcattcatgccctccgtttccccctgcgccgtggccctgcccataatcgtggtcatactcatgatccctatcgccgtgtgcatctactggattaacaagctgcagaaggaaaaaaagattctctctggggagaaggaatttgaacgtgagacacgtgaaattgcactgaaagagctggagaaggagagggttcagaaggaggaggagctgcaggtgaaggagaagcttcaggaagagctgaggtggcggaggacctttctacacgccgaacttcagtttttttccaactag

SEQ ID NO: 216304 - DNA, 993 bp, Artificial Sequence
  Description of Artificial Sequence: Synthetic coding sequence
atggaaagcgccgctgcactacacttctctcggccagccagcctcttgcttttactgctatccctgtgcgctctagtcagcgctcaattcatcgtcgtaggtcccacagatcccatcctggctaccgttggtgaaaacacaactctgaggtgccatttgtcacctgaaaagaacgccgaggacatggaagtccgctggttcaggtcccagttcagtcctgcggtctttgtgtacaaaggaggcagagagagaacggaagaacagatggaagagtacagaggccgaacaactttcgtgagcaaagacatttctcgcggttcagtggcgttagtaatccataatataacagcccaggagaacggcacatataggtgttactttcaggaggggcgatcctacgatgaggcaatcctgcacctcgtagtagccggtttgggttccaagcccctgatcagtatgcggggacatgaagatggtggcatcaggctcgaatgtatttcccggggatggtacccaaaaccactcacggtatggcgcgacccctacggaggtgtcgccccagctctgaaggaggtctccatgcctgatgccgacgggctgtttatggtaacgactgcagtaatcataagagataaatccgtacgtaacatgagctgtagcatcaacaataccttgcttggacagaaaaaggagagcgtcatttttatcccagaatccttcatgcccagcgtcagcccctgcgcagtggctctaccaatcattgtcgtcattctgatgatccctatcgccgtctgtatttactggataaataagctgcagaaggagaagaagattctgtctggggaaaaggagttcgaacgggagacacgtgagattgccctgaaggaactggaaaaggagagagtccaaaaggaagaggaactgcaagtgaaggagaaactccaagaggaactgaggtggcgcaggaccttcttacacgccggtcccgtgtag

SEQ ID NO: 216305 - DNA, 1401 bp, Artificial Sequence
  Description of Artificial Sequence: Synthetic coding sequence
atggaagtgaggtggtttagatcacagttctcccctgccgtttttgtctacaagggtggcagggaacgtactgaagagcaaatggaggagtaccgcggacggacaacatttgtgagtaaggatatttccagaggatcggtggccttagtgatacacaatatcactgcccaggagaacggaacctataggtgctactttcaagaaggcagaagctatgatgaggccattctgcatctggtagtggccggtttggggagcaaacctctgattagcatgagagggcacgaggatgggggaatccggctggaatgcatttccagaggctggtatcccaagcctctgaccgtgtggcgagatccatacggaggagtagcacctgctctgaaggaggtgtcaatgccagatgcggacgggctatttatggtgactactgcagtgatcatccgagacaaatccgtgcgcaacatgtcctgtagcatcaacaatacccttctgggtcagaagaaagagtcagtaattttcattcccgagtcttttatgccgtccgtgagcccttgcgcagttgctcttcctattatcgtcgtcatactgatgattccgattgccgtgtgcatttactggattaataagcttcagaaggaaaagaaaatccttagcggggaaaaagaatttgaaagggaaaccagagaaattgctctgaaggaattggagaaggaacgcgtgcagaaagaagaggagttgcaggtgaaagaaaagctgcaagaggaactgcgatggcgacggaccttcctgcatgccgttgacgtggtcctcgaccctgataccgcacacccagacctctttctgtctgaagatcgaagatctgtgcgccgatgtcctttccggcacttgggtgaatccgttccagataatcctgagcggtttgacagtcagccctgtgtcctcggcagggaatcgttcgcttcaggtaagcattattgggaggtcgaggtggagaacgtgatcgaatggaccgtcggagtctgtcgagatagtgtggagcgaaagggtgaagtcctgcttataccgcagaacggcttctggactctggaaatgcacaagggtcagtatcgggctgtatcatcacccgaccgcattttgccactcaaggaatccctgtgtcgggtgggcgtgttcttggactacgaagccggtgatgtgtcattttataacatgagagaccgatctcatatctacacttgccctaggtccgccttttcggtacccgtaaggccattctttcgactcggatgcgaggattctcctattttcatctgtcccgctctgacaggcgctaacggagttacggtacctgaggaagggctcacactgcatcgcgtgggtacacaccagagcctttag

SEQ ID NO: 216306 - DNA, 1224 bp, Artificial Sequence
  Description of Artificial Sequence: Synthetic coding sequence
atggaaccagcagcagctctgcatttctctctccccgcaagcctgctgctcctgctgcttttacttcttctgtctctgtgtgccctggtttccggcttaggctccaagccccttattgagattaaggcacaggaggatggatccatttggctcgaatgtatctcaggcggatggtatcctgaaccgttgacagtctggagagacccctatggcgaggttgtgccagccttgaaagaggtttctatcgccgatgccgacggcctgttcatggttactacggccgtaataatccgggacaagtatgtgaggaacgtgagctgctcggtcaataacacactcctcgggcaggaaaaagagaccgtgatctttatccctgagtcattcatgccaagtgcctccccatggatggtggccctagccgtcattctaacggccagcccatggatggtgtcaatgacagtaatcttggcagtgtttataattttcatggcagtgtccatctgctgtatcaagaagctccaaagagaaaagaagattctaagtggcgaaaaaaaagtggagcaagaggaaaaggagattgcccagcagctccaggaggaacttcgttggagaagaactttcctccatgccgcagacgtcgtcttggatccagataccgcccatccagaactatttctgagtgaggatcgaaggtctgtgcggagaggcccttatcgccaacgggtgccagacaatcccgagcgcttcgactctcagccgtgtgtattgggctgggaaagcttcgcctcaggcaagcactattgggaagtggaagtggaaaacgtgatggtatggactgtgggcgtttgtcgtcacagcgtagagagaaaaggagaggtcctactcatcccccagaacgggttttggaccctcgagatgttcggaaatcaatatagggctttaagctccccggaacggattctccccttgaaagagtctctctgtagagtgggcgtgttccttgactatgaggccggagacgtcagtttctataacatgcgggaccggtctcacatctatacgtgtcctagatcggcttttactgtgcccgtacgcccattctttcgattggggtccgacgactctcccatttttatttgtcccgcattgacaggcgctagtggtgtgatggtgcctgaggagggactgaagctgcaccgggtgggtacccatcagtcactgtag

SEQ ID NO: 216307 - DNA, 1572 bp, Artificial Sequence
  Description of Artificial Sequence: Synthetic coding sequence
atggagccagctgccgctctgcatttctcacttccagcgagcctcttgctcctgctcttactgctgttgctctccttgtgtgccctcgtgagcgctcagttcactgtagttggcccagccaaccctatcctggccatggtgggcgagaacaccaccctgcggtgccacctgagccccgaaaaaaatgcggaggacatggaggtgagatggttccgcagtcagttctcacctgcagtcttcgtgtacaagggcggtcgagaaaggaccgaggaacagatggaggaatatagaggtagaattaccttcgtgtcaaaagacatcaatagggggagcgtcgccctcgtgatacataatgtaacagcccaggagaatggcatctacagatgttattttcaggaggggagatcttatgacgaggcaatcctgcgtcttgtcgtcgccggacttggatcaaagcctctcatcgaaataaaggctcaggaggacggatcaatctggcttgaatgtatctcaggagggtggtatccagagccccttaccgtgtggcgggacccctatggagaagtcgtgcccgctctgaaggaggtgagcatcgccgacgccgacggcctgtttatggtcaccacagcagtcattataagggacaagtacgtcaggaacgtgagttgcagcgtcaacaacacactccttggccaggaaaaagagactgtcattttcatccctgaatccttcatgccctcagcgagcccatggatggtagcgctggccgtgatccttaccgcgtctccatggatggtgagtatgacggtgatattagccgtgttcatcatttttatggccgtatctatctgctgcatcaagaaactgcaaagagagaagaagatactgtccggtgaaaaaaaggtagagcaggaggaaaaggagatcgcacagcagctccaggaggagcttcgatggcgacgtacctttctccacgctgctgatgttgttctggatcccgatacagcacatcctgagctcttccttagcgaggatcgcaggtcagtccgtaggggcccttaccggcaacgtgtgccagacaatcccgaacgtttcgactctcaaccctgcgttttgggttgggagtcttttgcctctggaaagcactattgggaggttgaagttgagaacgtgatggtgtggactgtgggcgtatgtcggcacagcgtcgaacgcaaaggggaagtccttttaattccgcaaaatggcttctggaccctggagatgttcggcaatcagtaccgggcactttcttctccagaacggattctgcctctgaaggagtccttatgtcgggtcggggtgtttctcgattacgaggcaggcgatgtgagtttctacaatatgagagatcgaagtcatatctatacgtgcccgcgttctgcttttaccgtgccagtcagaccttttttcaggttgggttccgacgatagtccaatctttatttgtccagcgttgactggcgcttccggagtgatggttccggaggagggccttaagctgcaccgtgtagggacgcaccagagcttatag

SEQ ID NO: 216308 - DNA, 1572 bp, Artificial Sequence
  Description of Artificial Sequence: Synthetic coding sequence
atggagcccgctgccgctctacacttttctctcccagcttccctcctcctcctgctgctactgctgctcttgtcactgtgcgctcttgtttcagcgcagttcaccgtagtgggccctgccaaccctattctggctatggttggggaaaacaccacactgagatgccacctcagcccagaaaaaaatgccgaagatatggaggtgagatggttccggagccagtttagcccggcagtgttcgtttacaaaggcggtcgggaaaggacagaagaacaaatggaggaatatcggggtcgaatcaccttcgtgtccaaggacataaatcggggaagtgtagcattagtgatccataacgttactgctcaggagaacggtatttacaggtgttacttccaggagggcaggagttatgatgaagcaattttgaggcttgtggtcgccggtctgggatccaagcctctcattgagatcaaagcccaagaagacgggagcatctggctcgagtgcatatcaggtggctggtatccagaaccactgacagtctggagagacccttacggggaggttgtcccagccctcaaggaggtgagtatcgctgatgcagacggattatttatggtgactacagcagtaataatccgagataagtatgtgcgcaatgtgagttgctcagttaataacactctgctgggccaggagaaagagaccgtcatcttcatcccggaaagctttatgccatcagcgtctccttggatggtggcactggccgttatccttactgcatcaccgtggatggtgagcatgaccgttatcctcgcggtgtttattatctttatggccgtcagcatatgctgtatcaaaaagctccagagggagaaaaaaattttgagcggagagaaaaaagttgagcaagaggaaaaggaaatagcacagcaactgcaggaggagctccgatggaggaggacattcctccacgcagcggacgtcgtacttgatcccgacaccgcccaccccgaactctttctttccgaggaccgaaggagcgttagacgcggtccatatagacagcgggtgcccgacaacccagagcgttttgactctcagccgtgcgtgttaggatgggagtcattcgcatccggcaaacattattgggaagtggaggtggagaatgtaatggtatggacagttggagtctgccggcactcggtggaaaggaaaggggaggtgctcctgataccccagaacggtttctggacattagaaatgtttggaaaccagtaccgtgctcttagctcacctgaacgcatcctgccactgaaagagtctctgtgcagggtgggggtctttttagattacgaggctggtgatgtgtctttctataatatgagggatcggtctcacatctatacatgcccgagatcagcgttcaccgtgcctgtaaggccattcttcagattgggcagcgatgactctcccatctttatctgccctgccctcaccggcgctagtggggtgatggtgcccgaggagggcctgaaactgcaccgggtagggactcaccagtctctctag

SEQ ID NO: 216309 - DNA, 1011 bp, Artificial Sequence
  Description of Artificial Sequence: Synthetic coding sequence
atggagcccgctgcagccctccatttcagtctcccagcatccttgctgctccttctcctgctgctgctgctttctctttgtgcactggtatccgcacaattcaccgtcgttggacccgcaaatccgattctggctatggtgggtgagaacacgaccctgagatgtcacttgagcccagaaaagaacgccgaggacatggaagtacgctggttccgctcacagttcagtccagccgtgttcgtttataaggggggaagagagaggacggaagagcagatggaagagtatcgaggtaggattactttcgtttctaaggacattaaccgcggaagtgttgccctcgtcattcataatgtcacagctcaggagaatgggatttacaggtgctattttcaggagggtagatcctatgatgaggctattctgagattggtggttgcaggactaggcagcaaacctttgatagagatcaaggctcaggaggacggctcgatttggctcgaatgcatctctggtgggtggtacccagaaccacttacggtatggcgcgacccatatggtgaggtcgtaccagctctgaaggaggtgtctatcgcagatgcagacggacttttcatggtgaccacagctgttatcatacgtgataaatatgtgcgaaatgtctcctgcagcgtgaacaacactctgctgggccaggagaaagagacagtgatctttataccggagtctttcatgccgtctgcatccccgtggatggtggcattagcggtgattctcactgcctcaccttggatggtgtctatgacagtaatcctcgccgtgttcatcatcttcatggccgtatctatctgctgtattaagaaacttcaaagggagaaaaaaattctgtccggcgagaagaaggtggagcaggaagaaaaggaaatcgctcagcaactccaagaggaactccggtggaggcggaccttcctgcacgctgatgttaatctgaccggcctgcgcaacacctag

SEQ ID NO: 216310 - DNA, 333 bp, Artificial Sequence
  Description of Artificial Sequence: Synthetic coding sequence
atggagcctgcagcggcactgcacttctcgctcccagcctcactgctgctgctgctgcttttgctgttgctctccctgtgtgctctggtctcaggccttgggtccaagcccctcatcgagattaaggcgcaggaagatggcagtatctggctggagtgcatatccgggggatggtaccccgagcctctgacagtttggcgcgacccttatggggaggtcgtgcccgctctgaaggaggtgtctatcgccgatgctgacgggctgttcatggttactaccgcagtgattataagagataagtacgttcgaaatgtctcttgcagcgttaattag

SEQ ID NO: 216311 - DNA, 555 bp, Artificial Sequence
  Description of Artificial Sequence: Synthetic coding sequence
atggagccagccgctgccctgcatttttccctgccggcttccctcctgctacttctgttgctcttactgctgtcactctgtgccctcgtttcgggtctaggctcaaagcctctgattgaaattaaagcccaggaggatgggtccatctggctcgaatgtatctctggaggctggtaccccgagccactgacagtctggcgtgacccatacggagaagtggtgccggcattaaaagaggttagtatagcggatgccgacggactgtttatggtgaccacggccgtgatcatcagagacaaatatgtgaggaacgtgagctgttcagtaaataacacactcttagggcaggagaaagagacggtcatttttatcccagaaagctttatgcccagtgcctctccctggatggtggccctggccgttatccttacggcgagcccctggatggtgtcaatgaccgtgatccttgcagtatttatcatattcatggcggtgagcatctgttgtatcaagaaactgcagagggaaaaaaagatactgagtggagagaaatag

SEQ ID NO: 216312 - DNA, 720 bp, Artificial Sequence
  Description of Artificial Sequence: Synthetic coding sequence
atggagcccgcagctgcattgcactttagccttcctgcaagccttctcctccttttgcttcttctactcttgtccctgtgcgccctggtaagcgctcaatttaccgtcgtaggcccagctaacccaatactcgcgatggtcggcgaaaacaccacactgaggtgccacctgtccccagagaaaaatgcggaagacatggaagttaggtggtttcggagccaattctctcccgcagtctttgtctacaagggaggaagggagcgtacagaagaacaaatggaagagtacaggggaaggatcacctttgtatccaaggacatcaaccggggtagcgttgccctcgtgatccacaatgtcaccgctcaggagaatggcatttacagatgttattttcaggaaggcagaagctatgatgaagctatcctccgcctcgtggtggccggactgggatccaagccactaattgagatcaaggcccaggaggatggctccatttggctcgagtgtatctccggcggttggtatccagaacctctgacggtctggcgtgacccatacggcgaagttgtgcccgcattgaaagaagtatcaatcgccgacgccgacggccttttcatggtaaccaccgccgtaataattcgcgataagtacgttcgcaatgttagttgttctgtgaataataccctgctgggacaggaaaaggagaccgttattttttag

SEQ ID NO: 216313 - DNA, 291 bp, Artificial Sequence
  Description of Artificial Sequence: Synthetic coding sequence
atggagccagctgccgctctccatttctccctaccggcttctctgctgctgctgcttcttctgctgctactcagcctttgtgcccttgtaagcgcccagtttacggtggttgggcctgccaatcctattctggccatggttggcgagaacaccaccctccggtgccacctgtcccctgaaaaaaatgccgaggacatggaggtgaggtggtttcgcagtcagttttctcccgcagtattcgtctataaaggagggcgagagagaaccgaagagcagatggaggagtactag

SEQ ID NO: 216314 - DNA, 1542 bp, Artificial Sequence
  Description of Artificial Sequence: Synthetic coding sequence
atgaaaatggcctcatttctggcattcctcctgcttaattttcgtgtgtgccttctgcttctacaattgctgatgcctcattctgcacaatttagcgtcctgggaccgagtgggcctatactggcaatggtgggagaggacgcagacttgccttgtcacctgttcccaactatgtccgccgagactatggagctgaagtgggttagctcctccctgagacaggtggtaaacgtttacgctgacggcaaggaggtggaagaccgacagagtgccccatataggggacgcaccagcattcttagagacggaatcactgccggtaaagccgcactcaggattcacaacgtaacagccagcgacagcggcaagtatctgtgttactttcaagatggcgatttttatgagaaagctctggtagagttaaaagtcgctgctcttgggtctgatttgcacgtcgatgtaaagggctacaaagacggcggtattcacctggaatgtaggagtaccgggtggtatcctcagccgcagatacaatggtccaataataaaggggagaatattccaactgtggaggcaccagtggttgccgacggtgtgggtctgtacgccgtcgccgctagtgttattatgcggggttcctccggagagggagtttcttgtaccattaggtcctctctgctgggcctggagaagacggcatctatctctatagccgatcctttcttcaggagtgcccagcgatggattgcagcactggctggaacgctgcctgtgctcctgctcctgttggggggagcagggtatttcttgtggcagcagcaggaagagaagaagacccagtttagaaaaaaaaagagagagcaggagcttcgcgaaatggcatggtcgacaatgaaacaggagcagagtacacgcgtaaaacttttggaagaactgcggtggagatctatccaatatgcttcccgcggagagcggcactcggcttacaacgaatggaaaaaagcacttttcaaacctgccgacgtgattctggatcctaaaacagcaaatccgatccttctcgtgtcagaggaccagaggagcgtgcagcgggctaaggagccccaagacctgcctgataatccggagcgtttcaattggcattattgtgttcttggctgtgaaagcttcatatccggcaggcattactgggaagttgaggtcggagatcgtaaggaatggcatattggcgtctgcagcaaaaacgtacagcggaagggatgggtgaaaatgacacctgagaacggcttttggacaatgggactcaccgacggcaacaagtaccggacactgactgagcccaggaccaacctgaagcttcctaaacccccaaagaaggtgggcgtttttcttgactacgaaacaggggacatttccttttataacgcagtggatggtagccatatccacactttcttggatgtgagcttttccgaagcactttatccagtgtttcgtatccttacactggagcctacagctctgaccatttgccctgcttag

SEQ ID NO: 216315 - DNA, 1386 bp, Artificial Sequence
  Description of Artificial Sequence: Synthetic coding sequence
atgaaaatggcatcattcctcgctttcctactgctgaactttagggtatgcctgctgttgctgcagctgcttatgccccactccgcccagttttctgtcctggggccatcgggacctattctggccatggtgggagaggatgcagacctcccctgtcacttatttcctacaatgagcgcagagaccatggaactgaaatgggtatcaagtagtctgcggcaggtcgttaacgtgtacgccgacggaaaggaagtggaggacaggcagtccgccccataccggggaagaacctcaatcctgagagatggtattacagctggtaaggccgcattacgaatccataatgtgaccgcctccgactctggtaagtacctgtgctatttccaggacggagatttttatgagaaggcccttgtggaacttaaagtagccgatggggtgggactctacgctgtggctgctagtgtcatcatgcggggatcttccggcgagggagtgagttgcacaattagaagctctttgctcggtctggagaaaacagcgtccattagcatcgcagatcccttcttcaggagcgctcaacgctggattgctgctttggccggaactctgccggtgctgctgttgctacttgggggtgctggctacttcctgtggcagcagcaggaggaaaagaaaacacagtttagaaagaagaagcgggaacaggaactgcgggagatggcatggagtactatgaagcaagagcaatccactcgcgttaagcttctcgaagaactgaggtggaggagcatccaatatgctagcagaggggaaaggcatagtgcatataacgagtggaagaaggccctattcaagcccgctgacgtgatcttagaccctaagactgccaacccaatcctcctggtttctgaagatcagaggtccgttcagagggccaaagagccgcaagatctccctgacaacccagagcgatttaactggcactactgtgtccttggatgtgaatcttttatctccggcaggcattactgggaggtggaagtgggggatcggaaagaatggcatattggcgtatgtagtaaaaacgtgcagaggaaaggatgggtaaagatgacaccagagaacggtttttggaccatgggattaacagatggcaacaagtaccgaactctgacagaacctaggacaaatctgaagctacctaaaccacctaagaaggtcggggtgtttttggactatgagaccggggacatttcattctacaacgcagtcgacggatcgcacattcatacctttctggatgtttccttttcagaggctctttaccccgtcttccgcatactaacacttgagccaacagcactgactatttgtcccgcttag

SEQ ID NO: 216316 - DNA, 1137 bp, Artificial Sequence
  Description of Artificial Sequence: Synthetic coding sequence
atgaagatggcctctttcttggcgtttctcttgctgaacttcagagtatgtctgttgctgctccagctgctgatgccgcactccgcccaattcagcgtgctggggccatcaggaccaatcttggccatggttggcgaggacgctgatctcccatgtcacctgttcccaactatgtccgctgagactatggaactgaagtgggtaagttccagcttgcgccaggttgtcaatgtgtacgccgatggcaaggaggtggaggatcggcagagtgcaccttatcgagggagaacctccatcttgcgggatggaatcactgccggaaaggcagcattgcggatccataatgtgacagcaagcgattccggcaaatatctgtgctatttccaggacggcgacttctacgagaaagcgctagttgagcttaaggtcgcggctttagggtcggacctgcatgtcgatgtgaagggctacaaagatgggggtatccatcttgagtgcaggagtacaggttggtacccccaaccccagattcaatggtctaacaacaaaggcgaaaacataccaactgtggaggctcctgtagtagccgacggtgttggactgtacgcggttgcagcttccgtgattatgcgcggttccagcggtgagggagttagctgcacaatcaggtcctcccttctaggtcttgagaaaaccgctagcattagcatcgccgaccctttctttcggagcgctcaaaggtggatcgcagcactggctgggacccttcccgtgttactgctcctcctgggcggtgctggttatttcctctggcagcaacaggaggagaaaaagacacagttcagaaagaaaaagcgcgagcaggagctgcgcgagatggcttggagcactatgaaacaggagcaaagtactcgggtgaagctgctcgaagagcttagatggcggagcatccaatacgctagtcgcggagaacggcactcagcctacaatgaatggaaaaaggccctctttaaaccgggtcccccaataggtcagacacagcagcagacccgtggccagggatctcctgttgccctttctcaggagtccgctcagcggaccgactcatggggaccagaggagggcggagaaagctag

SEQ ID NO: 216317 - DNA, 132 bp, Artificial Sequence
  Description of Artificial Sequence: Synthetic coding sequence
atgaaaatggcctctttcctggcctttctgctgttgaacttccgggtatgcttgcttctgctgcagttacttatgccacattcagctcagttctcagtgctcgggccatccggccctatactggccatgtag

SEQ ID NO: 216318 - DNA, 360 bp, Artificial Sequence
  Description of Artificial Sequence: Synthetic coding sequence
atgaagatggccagtttcctggcctttttacttttgaactttcgggtgtgcttgctcctgctgcagcttcttatgccccattcagcccaattcagtgtgcttggtccatccggaccaatcctcgcgatggttggggaagacgcagacttgccctgccacttgttccctaccatgtctgcagagactatggaacttaagtgggtatcttcctccctgcgtcaggttgtgaacgtctatgctgatgggaaagaagtcgaggatcgccagtccgctccgtatagaggtcgtacttccattctgcgagatggcattacggctggcaaagcagccctccgaatccataacgtcaccgcctcctag

SEQ ID NO: 216319 - DNA, 1059 bp, Artificial Sequence
  Description of Artificial Sequence: Synthetic coding sequence
atgaagatggcttcattcctggcttttctgcttctgaattttagagtgtgtctgttgctgttgcagcttctgatgccccactctgcccagtttagcgtactagggcctagcgggccaatccttgcaatggttggggaggacgcagatctgccatgtcatctatttcctactatgagtgccgaaactatggagctgaagtgggtgagtagctcactccgacaagttgtaaacgtctatgccgacgggaaagaggtggaggatcggcagagcgcaccctaccgcggacgcacctccatcctccgagatggcatcactgctgggaaggctgccctgagaatccataacgtaaccgcttccgattcgggaaaatatttatgctatttccaggacggggacttttacgaaaaggccctggttgaactgaaagtggcggcattgggttcagacttgcacgtagacgtgaagggatacaaagacggaggcatccacctggaatgccgcagcacaggatggtatccccaacctcagatccagtggagcaataataagggggaaaatattccgacggtcgaggctccagtcgttgccgacggagtaggactgtatgccgtggctgctagtgtgataatgcgaggctcttccggagagggggtgagctgtaccattagaagctccttactggggctggaaaaaaccgcttctatcagtatagcagatccgttttttcgatctgcccagagatggattgcagctctggcgggtacattacccgtcttactgctgctactcggcggagctggttactttctgtggcagcagcaggaggagaagaagacccagtttcgaaagaagaaacgggagcaggagctgcgcgagatggcgtggagtacgatgaaacaggagcagtctacaagggtgaaactactagaagagctgcggtggagatccatacagtatgcctctcgtggagagcgccattcggcctataatgagtggaagaaggccctgtttaaacctggagaagaaatgttgcagatgagattgcattttgtgaaatag

SEQ ID NO: 216320 - DNA, 279 bp, Artificial Sequence
  Description of Artificial Sequence: Synthetic coding sequence
atgaagatggcatctttcttggcctttctcctgcttaacttccgggtgtgcctgcttttgctgcaattgttaatgccacactccgcacaattctccgtgcttggtccttcggggcctatcctagcaatggtgggagaagatgcagacttaccctgtcatctgttcccaaccatgagtgcagaaacaatggagttaaagtgggtgtcatctagcctacgtcaggtggtgaatgtttatgctgacggcaaggaagtggaggatagacaatccgccccatag

SEQ ID NO: 216321 - DNA, 1005 bp, Artificial Sequence
  Description of Artificial Sequence: Synthetic coding sequence
atgaaaatggccagctcactggctttcttactgctgaacttccacgtgagcctgctattggttcagctcttgaccccatgctcggcacagttttccgtgttgggtccatctgggcctatactggccatggtgggagaagacgcggatttaccgtgtcaccttttccctacaatgtccgccgagaccatggagttgaagtgggtctcgtcctccttacggcaagtggtcaacgtgtatgctgatgggaaggaagtcgaggacagacagtccgctccataccgcggaagaaccagcattctccgggatggcatcacggccggaaaggctgccttaaggatccacaatgtaacagccagcgacagcgggaagtacttgtgttacttccaggatggagatttttatgaaaaagccctggtagaactgaaagtggctgccctgggatcgaatcttcacgtggaggttaaaggctatgaggacggaggcattcatttggagtgccggtccaccggctggtatccacagccacagatccagtggtccaatgcgaagggagagaatattcccgcagtggaagcacccgtggtggccgatggagtgggcttatacgaagtggcagcctctgtgatcatgcgcggaggcagcggagagggcgtttcctgtattatccggaatagtctcctgggcctcgagaagaccgcctctatatccattgctgacccattcttccggagcgcgcagccctggattgctgctctcgctgggaccctccccatcctgctcttactgctggcgggagcttcttattttctatggcgccagcagaaggagatcaccgcactcagttcagagattgaatctgaacaggaaatgaaggaaatgggctacgcagccaccgagagggagatttcactccgagagagcttacaggaggaattgaaaaggaagaaaatccagtacctgactcgaggggaagagtcctccagcgatacaaacaaaagcgcatag

SEQ ID NO: 216322 - DNA, 1005 bp, Artificial Sequence
  Description of Artificial Sequence: Synthetic coding sequence
atgaaaatggccagcagtctggcattcttgttactgaatttccacgtatctctattgctggttcaactcttgacaccttgcagcgcacagttttccgtcttaggccctagtggccctatattagcgatggtgggagaggacgcggacctcccatgccacctgttccccaccatgagtgccgagactatggagctgaagtgggtctcaagcagccttagacaggtggttaacgtttatgcagatggtaaggaggttgaggataggcagtcagccccatacaggggccgtacttctatcctgagggacggtatcacagcagggaaggccgcacttcggatacacaatgtgaccgcttcagactctgggaagtatctgtgttattttcaggacggggatttctacgaaaaggccctcgtggaactgaaagtggccgctctagggagtaacctccacgtggaggtgaagggatatgaagacggaggcattcacctcgagtgcaggtcaactgggtggtatccacagcctcagattcaatggtcaaacgccaaaggcgaaaacatacccgctgtggaagccccagtagtggcagacggcgtcggactgtacgaagttgccgctagtgtcattatgcggggtggttctggggagggggtgtcatgtattatacggaactcgttgctgggtctcgagaagaccgctagcatttccattgcggacccattctttagatcagcccagccctggatcgcagcactggcgggtacgcttcccattctgttgttgctgcttgcgggagcctcgtatttcctgtggcgccagcagaaggaaatcacagccctcagcagcgaaatagaatccgagcaggagatgaaagaaatgggatatgccgcaacagagcgagagatctctctccgggagtcacttcaggaggagcttaagcgtaaaaaaatccagtacctgactagaggtgaagagtctagtagtgatacaaacaaatcagcttag

SEQ ID NO: 216323 - DNA, 936 bp, Artificial Sequence
  Description of Artificial Sequence: Synthetic coding sequence
atgggtattccacgcgctcagttctccgtgttgggacctagcggccctatcttggcaatggtgggcgaggatgcagacttaccttgccacttgttccccaccatgtcagcggagaccatggaactgaaatgggtctccagctctctgcgccaggttgtgaatgtctacgccgatggcaaagaagtggaggacagacagtcagctccatatagaggtagaacaagcatcttgagagacggaattacggccggtaaagcggcactgagaatccacaatgtgaccgcctcagacagtgggaaatacctctgctatttccaggacggggacttttacgagaaggctcttgtagagctcaaagtggccgcactgggctcaaatctccacgtggaggtgaagggatatgaagacggcggtatccatctcgagtgcagatcaaccggatggtacccccagccacagatccagtggagcaatgccaaaggggagaacattcccgcagtggaagcacctgtcgtggcggatggggtgggactgtatgaagtcgctgcttccgtaattatgcgcggtggatcaggagagggcgtcagctgcattattcgaaattccttattgggcctcgagaaaacagcatcaattagtattgcggaccctttcttcaggtccgctcagccttggatcgcagcattggccggaacacttcctatcctgttactacttctggcaggcgctagctatttcctgtggcggcagcagaaggagatcacagccctctcatctgaaattgagtcagaacaagaaatgaaagagatgggatacgcagctacggagcgagagatctctctgcgcgaatccctccaagaagaactgaagagaaagaaaatccagtacctgacgaggggcgaggaaagtagttccgataccaacaaaagcgcttag

SEQ ID NO: 216324 - DNA, 1005 bp, Artificial Sequence
  Description of Artificial Sequence: Synthetic coding sequence
atgaaaatggcaagttctctggcattcctgctgctcaactttcatgtgtctttgctcctggtgcagctactgacaccatgcagtgctcagttcagcgtgcttggaccatccggccctattcttgcaatggtgggtgaagatgctgacctcccatgtcacttgtttcctactatgtcggcggagacaatggaacttaagtgggtgtcttccagtctcagacaggtggtgaatgtgtatgctgacgggaaagaagtggaggacaggcagagcgccccataccgcggacgcaccagcatcttgagggacgggatcactgcgggtaaggccgcactgcgcattcataacgtaaccgccagtgattccggtaagtatctatgttatttccaggacggagacttctatgagaaggctttggtggagctgaaggtcgcggcactggggtcaaacctacacgtcgaggttaaagggtacgaggatgggggaatccatctcgagtgtaggtccacaggttggtacccacagccacagattcagtggagtaacgccaaaggagaaaacatccctgcagtagaggccccagtggttgctgatggggtgggcctatacgaagtggcagccagtgtgattatgagaggcggttcaggcgagggtgtttcctgcatcataaggaactctctgctggggctggagaagacagcctctatttctatcgctgaccctttttttaggtccgctcagccgtggattgctgcactagcaggcactttacctatcctcctgctgcttctggccggagcaagctatttcctctggcggcagcaaaaagaaatcaccgccctctcttccgagatcgagagcgaacaggaaatgaaggagatgggatacgccgcaactgagcgcgagatctccctccgcgagtccctccaggaggagctcaagcgtaagaaaattcagtacctcacccggggtgaagaaagcagcagtgatacgaataaaagcgcttag

SEQ ID NO: 216325 - DNA, 879 bp, Artificial Sequence
  Description of Artificial Sequence: Synthetic coding sequence
atggtgggcgaggatgctgatcttccctgtcatctgtttcctacaatgtcagctgagacaatggaactgaagtgggtctcctcttccctgaggcaggtggtgaatgtctacgccgatgggaaggaggtggaagacagacaaagcgctccttatagaggtagaacttccattctgagggatggcattaccgctgggaaagccgctctgcgcatacataatgtgacggcttccgactctggcaagtacttatgctactttcaggacggagacttttacgagaaggctctagtggagctgaaggtcgccgctctcggctctaaccttcacgtggaggtgaagggctacgaagacgggggaatccacttagagtgcagatcaaccggttggtatcctcagccccagatccaatggagcaatgctaagggcgaaaacatcccagcagttgaggcaccagtcgttgcggatggggtggggctgtacgaggtcgcagcatctgtcattatgagagggggttctggagaaggcgtgtcatgcatcatcaggaattccttgttgggcctcgagaagacagcctccatttctatagccgatcctttcttcaggtctgcacaaccctggattgcagccttagctggaacactacccatacttcttctgctcctggctggagcttcctactttctgtggcggcagcagaaggaaataactgccctgagcagtgagatcgaatccgaacaggagatgaaagagatggggtacgcagccacagaaagggaaatcagtttgcgggagagcttgcaagaggaactcaaaaggaagaaaatccagtacttaactcgaggagaagaatcttctagcgacaccaataagagcgcctag

SEQ ID NO: 216326 - DNA, 1005 bp, Artificial Sequence
  Description of Artificial Sequence: Synthetic coding sequence
atgaagatggcctcctcactggcatttctccttctgaactttcacgtgtctttgttgctggtgcagctcctgacgccctgctccgcccagtttagcgttctaggaccgagtggcccaattctggccatggtgggggaagatgcggatctcccgtgtcatctcttcccaacaatgtccgcagaaaccatggaactgaaatgggtctcttcttcattacgacaggtggttaatgtgtacgctgatggtaaggaggtggaggatcgacaaagcgccccatatagaggacggacgagcatcctgcgcgacggcatcactgccggaaaggccgctctccgaatccataacgtgacggccagcgattcgggcaagtatctgtgttacttccaagacggcgacttctatgaaaaagctttggtcgagttgaaagtcgccgctttaggatctaacctacacgtggaggttaagggatatgaggatggcggtatacacctggagtgccggtccaccgggtggtacccacagccgcaaatacagtggagcaacgctaagggagaaaatatccccgcagtggaggcccctgtggtggcagacggtgtgggcctgtacgaggtcgccgctagtgtgattatgagaggtggttcgggggaaggtgtgagctgtatcattagaaattccctgcttgggctggagaagacagcttcaatctcaattgctgatccatttttccgtagcgcacagccctggatcgcagccttggcgggtacgctccccatcctattgctgctactcgctggggcaagttacttcctgtggcggcagcaaaaggagatcaccgcattgagctccgagatcgaaagcgagcaagagatgaaggaaatgggttacgctgctaccgagagagagatatctttgcgcgagagtctccaggaagagctaaaacggaagaaaatccagtacctgactcgcggtgaagaatcatcgtctgacacaaacaagtctgcgtag

SEQ ID NO: 216327 - DNA, 960 bp, Artificial Sequence
  Description of Artificial Sequence: Synthetic coding sequence
atgaagatggcatcatcattagctttcttgctcttgaacttccatgtcagcctattgctggtccaactgctcactccctgctcagcccagttttctgtgcttggtccatcaggacctatcttggccatggtgggcgaggacgccgatcttccctgccacctgttccctaccatgagcgctgagactatggagttaaagtgggtttcctctagcctgaggcaggttgtcaacgtgtacgccgatggcaaagaagtggaggatcgccagtcggctccatacagaggccgtacatccatcttgagagatggcatcaccgctggcaaagccgcattgagaatccataacgtcaccgcgtccgattccggaaaatacctgtgctacttccaagacggagacttttacgaaaaggctctggtcgagcttaaagtcgctgccctggggtctaatctccacgtggaggtgaagggctatgaggacgggggaatccacctggaatgtagatcaaccggctggtatccacagcctcagatccagtggagtaatgccaagggcgaaaacattcccgcagtcgaagcaccggtggtcgccgatggggtaggactgtacgaggttgcagcctctgtcattatgcggggaggctcgggggagggcgtgtcatgcatcatccgaaatagccttctggggcttgaaaaaaccgctagcattagcattgccgaccctttcttccgctcggcccagccatggattgccgctctagctggaaccctgcctattttgcttctcctgctcgccggagcctcctactttttgtggaggcagcagaaagaaatcactgcactatcatcggagattgagagcgagcaggaaatgaaggagatgggatacgccgctacggagagagaaattagcctccgggagagcctgcaggaggagctcaagagaaagaaatcatccacgtag

SEQ ID NO: 216328 - DNA, 1755 bp, Artificial Sequence
  Description of Artificial Sequence: Synthetic coding sequence
atgaagatggctagctcactggcctttcttctgctgaattttcacgtctcattattcctggtgcagctgctgacgccgtgcagtgcccagttcagcgttctgggcccttcagggccaattctagccatggttggagaagatgcggacctcccttgccacctgttcccaaccatgagtgccgagactatggaactgcgctgggtctcttcctcgctccggcaagttgttaacgtctacgcagatggcaaagaagtggaggatcgccaaagcgccccatatagaggacggacttctatcctgcgagacgggattacagccggtaaagcggctcttagaatacacaacgtgactgccagcgactcagggaaatatctgtgctatttccaggacggagacttttatgaaaaggcgctcgtcgagttaaaagtcgcagctctgggttctgacctgcacatcgaggtcaagggatacgaagacgggggaatacatctggagtgtcgctcaaccggctggtatccccaaccacagattaaatggagcgacactaagggcgagaacattccggcagttgaagccccagtggtggccgatggcgtcgggttgtatgccgtggccgcaagcgttattatgagggggtcttccggcggtggcgtgtcctgtatcattagaaactctctgctcggactggagaaaactgcctcaatttcaattgcagaccctttctttcgttccgcccaaccttggatcgcggctttagccggtaccctccctatttctctgcttctgcttgcgggagcctcttacttcttatggcgtcagcagaaagagaagattgccttatctcgcgagactgaacgtgaacgcgagatgaaggagatgggctatgctgcgaccgagcaggaaattagcctgcgagaaaagctccaggaagaactaaagtggcgtaagattcagtatatggccaggggagagaagagtctggcctaccacgagtggaagatggcactgtttaagccagccgatgtcattttagatccagatactgccaacgccatccttctagtaagtgaggatcagcgatctgtccaaagggcagaggaacctagagacctgcctgacaaccccgagcggtttgagtggcggtattgtgtactaggttgtgaaaatttcacaagtggacggcactattgggaggtggaggtcggcgatcgcaaggaatggcatattggcgtttgctccaagaacgtggaacgcaagaaagggtgggtcaagatgactcccgagaatggttactggactatgggcctgacggatggcaataaataccgagccctgactgagcccaggactaatctgaagctcccggagccccctagaaaagtcgggattttcctggattatgagaccggagagatctcattctacaatgcaactgatggaagccatatctatactttcccacacgcctcctttagcgagccgctgtaccccgtcttccggattctcacgctggaacctacagcactcaccatctgccccatcccaaaagaagtggaatcctctccagatcctgatctggtgcctgaccatagcctggagacgccgctcacccctgggctagccaacgagtccggggaaccgcaggctgaagtcacgtcacttttgctgccggcacatcctggagccgaggttagccccagcgcaaccactaatcaaaaccacaagctacaggctagaaccgaggccctttattag

SEQ ID NO: 216329 - DNA, 1629 bp, Artificial Sequence
  Description of Artificial Sequence: Synthetic coding sequence
atggttggagaggatgccgatctcccatgccacctgtttcctactatgtctgcagagacaatggagctgaggtgggtgtccagcagtctgagacaggtggttaatgtgtatgctgacggcaaggaggtggaggaccggcagtctgcaccttaccgcggacgaaccagcattttacgtgacggaatcaccgccggaaaggcagcactcaggattcacaatgtgacagcctctgacagtggcaagtacttgtgctattttcaggacggcgatttctacgaaaaggcactggtggaacttaaggtcgcagctctggggagtgacctgcacattgaggtcaagggctacgaggacggtggtatccacctcgagtgtcgctccactggctggtacccgcagccccaaatcaagtggtccgacacgaaaggagaaaacatccccgctgtagaagctcctgtggtcgccgatggtgtggggctgtatgctgtcgcggcttctgtgattatgcgcggatcgtcaggaggcggagttagctgcataatcagaaacagtcttctgggcctagaaaaaaccgctagcatctctatcgcggatccattcttccgcagtgcacagccgtggatcgccgctctggccggaaccttaccaatcagcctcctgctgctggccggagcaagctactttttgtggcgacagcagaaggagaagatcgccctctcacgcgaaactgaaagggagcgcgagatgaaggaaatgggctacgcagccaccgagcaagagattagcctgcgcgaaaaattgcaggaggaactgaagtggcgcaagatccaatacatggccagaggcgagaagagtctggcgtatcacgaatggaagatggccctgtttaagcccgctgatgtgatccttgaccctgacaccgctaatgcaatcctcctggttagcgaggatcagcggagcgtccagagggctgaagaacctcgtgacctcccagacaaccccgaaaggtttgaatggcgctattgcgtgctcggttgcgagaatttcactagtggccgacactattgggaggtggaagtgggagaccgcaaggaatggcacataggtgtgtgcagtaaaaacgtcgagagaaagaaggggtgggtcaaaatgacgccagagaacggctattggacgatgggcctcaccgatggcaacaaataccgggctctgacggaacccagaactaatctgaaactaccagaacccccacggaaggttggcattttcctggactacgaaaccggagagatctctttctacaatgcaacggacggctcacacatctacacctttccacacgccagtttctccgaacccctttatcctgtttttcggattctaaccctggagccaacagcactcacaatttgccccatcccaaaagaggtggaaagctcccccgatcccgatctggtgcccgatcacagcctggagacccctttaacaccgggtctcgcaaatgaaagcggagagccgcaggccgaagtaacctcccttcttctacctgctcaccctggcgctgaggtgtcgcccagcgcgaccaccaaccaaaatcataagctgcaggcgagaaccgaagccctgtactag

SEQ ID NO: 216330 - DNA, 417 bp, Artificial Sequence
  Description of Artificial Sequence: Synthetic coding sequence
atgaagatggccagtagtcttgccttccttttgcttaactttcacgtttcactgtttctggtacagctattaacaccatgtagtgcacagttcagcgttttgggaccttctggcccaattctggccatggtcggggaagatgcagatctcccctgtcacctgtttcccactatgagcgccgaaacaatggaacttcgttgggtctctagtagtctgagacaggtagttaacgtttacgccgatggaaaggaagttgaagatcgacagagcgccccttatagggggcgaacctctatcctacgagatggcattaccgccggaaaagcagctctgaggattcacaatgtgacggcaagcgattctggcaagtacctatgctactttcaggatggcgacttctacgagaaggcactttag

SEQ ID NO: 216331 - DNA, 717 bp, Artificial Sequence
  Description of Artificial Sequence: Synthetic coding sequence
atgaagatggccagttcccttgccttcctcttgctgaattttcatgtgtctctttttctggtccagctgctgaccccatgctctgcacaattctctgtgcttgggccttctggtcccatcctcgccatggtgggggaggatgcggatttgccatgtcatttatttccaaccatgtccgccgagacgatggaactgagatgggtttcctcctccttgagacaggtcgttaacgtctacgctgacggcaaggaggtcgaggacaggcagagcgctccgtatcgcggacggacctctattctgagagacggcatcacagcgggtaaagccgcactacgaatacacaatgttaccgccagtgattcaggcaagtacctgtgctactttcaggatggagacttctacgagaaggctcttgtggagctcaaagtcgcagccctgggaagcgatttacacattgaagtgaagggttacgaagacggcggaattcatttagagtgtcgcagcacaggctggtatccacagccacagatcaagtggtctgacaccaaaggcgaaaacattcctgccgtggaagcaccggtggtggcagacggggttggcctgtacgcagtggccgcttccgtaattatgcggggatcttccggcggtggagtgagctgcatcataagaaattccctcttaggcctggagaagacagcctccatctctattgcttag

SEQ ID NO: 216332 - DNA, 1368 bp, Artificial Sequence
  Description of Artificial Sequence: Synthetic coding sequence
atggtggactttcccggttacaatctgtcgggcgcagtggcttcttttctattcatcctgctgacaatgaaacagagcgaggactttagagttattggcccagctcatcctatactggccggagtgggcgaggatgcgctcctgacgtgccagctgctgcctaagagaaccaccatgcacgtcgaggttcgctggtatcgctctgagcctagtactcccgtgttcgtgcatcgggacggcgtggaggtgacagaaatgcagatggaggaataccggggatgggtggagtggatagagaacggaatcgctaaaggaaacgtcgccttaaagattcataacattcaaccttcagataatggacagtactggtgtcactttcaagacgggaactactgtggcgaaactagcctcttgctgaaagtcgccggtttaggaagcgccccttccatacacatggaagggcctggcgagtcaggtgtacaattagtgtgcactgccaggggttggttcccagagccccaggtgtactgggaggacatccgcggtgagaagttacttgcagtgtcagagcatcgcatccaggacaaagatgggctgttctacgcggaagcaactttggtggtgagaaatgcatcagcagagtcagtcagctgcctcgttcataatcccgtgctaactgaagagaaaggctctgtcatcagccttcccgagaaactgcagaccgaattagccagcttgaaagttaacgggccaagccaaccgattctggtaagagtgggcgaggacattcagcttacgtgctacttgagcccaaaggcgaatgcccagtccatggaggttcgatgggacaggtcacatcgctaccctgccgtgcacgtgtacatggatggtgaccatgtggctggggagcaaatggctgaataccgtggcaggacagttcttgtgagcgacgcaattgacgaagggcgacttacactgcagattctgagcgccaggcccagcgacgacggacagtaccgatgcctcttcgaaaaagatgacgtatatcaggaggcctctctcgatcttaaagtggtgtctctaggtagttcccccctgattaccgtggaaggccaggaggacggcgagatgcagccaatgtgtagttccgacggctggtttcctcagccacatgttccgtggcgcgacatggaggggaaaaccatcccttcctccagccaggctctgacccaggggtcacacgggctgtttcacgtgcagaccttgctgagagtgactaatatctccgcagtagacgtgacctgttcaatctcaatcccatttttgggggaagagaaaattgccacgttctcactgagtggttggtag

SEQ ID NO: 216333 - DNA, 1167 bp, Artificial Sequence
  Description of Artificial Sequence: Synthetic coding sequence
atggtcgacttcccaggctacaatctgagtggagctgtggcgtccttcttgtttattctattgactatgaagcaaagcgaagatttcagggtcatcggccctgcccatcccattctggccggtgtgggggaggacgccttactgacctgccagctcctgcccaaacggaccactatgcacgttgaggtgagatggtaccggtctgaacccagcactcctgtctttgtccatcgcgacggggtagaagttaccgagatgcagatggaagaataccggggttgggtcgagtggattgagaatgggattgctaaaggaaatgtagcgctgaaaattcataacatacagccatccgataacggacagtactggtgtcactttcaggatgggaattattgtggagaaactagccttctgctcaaagtggctgaaaagttgctggcggtgctgtcatctctgaaagtaaatggcccttcacagcctattctggtgagggtgggagaagacatccagctgacatgttacctcagcccaaaagcaaacgcccagtctatggaagtgaggtgggatcggtcccaccggtaccccgcagtacacgtttatatggacggcgatcacgtggctggcgagcaaatggcagagtatcgaggcagaaccgtccttgtgagcgacgctatcgatgaggggcgacttacattacagatattaagcgccaggccctcggatgacggccagtaccgttgcctgtttgaaaaagatgatgtgtaccaggaggctagtctggacctgaaagtagtgtctttgggctccagccccctgatcaccgtggagggccaggaggatggcgaaatgcagccaatgtgtagttctgatggttggtttccccagccccatgttccctggcgggacatggagggaaagaccatcccctcaagcagccaggctctcacacaagggtcacacgggctctttcacgtgcagaccctgttacgggtgaccaatatctctgccgtcgacgtcacctgtagcatttctattccctttttgggagaggagaagattgccactttctcactgtcagaaagccgcatgacgttcctgtggaaaactttactggtgtggggactgctgctcgctgtcgccgtgggcttgccaaggaagcgttcttag

SEQ ID NO: 216334 - DNA, 738 bp, Artificial Sequence
  Description of Artificial Sequence: Synthetic coding sequence
atggtggattttccagggtacaacctgagcggggcagtggccagcttcttatttatcctgcttactatgaaacagagcgaaaaactgcagacagagttagcaagccttaaggtgaacgggccatctcagcccatactggtcagggtgggcgaagacatccagctgacttgttacctgagtccaaaggcgaacgcccagagtatggaagttaggtgggacaggtcccaccgttatcccgctgtgcacgtttacatggacggcgatcacgtggcgggtgaacagatggcagagtacaggggcagaacagttctggtctctgatgcaatcgatgagggcagattgactctgcagatcctcagcgcccgtccaagcgatgacggccagtatcggtgcctattcgagaaagatgacgtctaccaagaagcttccttagacctcaaggttgtctcattggggtctagcccccttatcacagtcgaggggcaggaggacggcgagatgcaacctatgtgttccagtgacggctggttcccccagccgcacgtaccctggcgagatatggaaggaaagactattcctagtagcagccaggcattgacccaagggtcacatggtctgttccatgtgcagaccctcctacgggtgacaaacattagcgctgtggatgttacttgtagcatatccatacccttcctgggggaagagaaaattgcaacattttctctgtccggatggtag

SEQ ID NO: 216335 - DNA, 327 bp, Artificial Sequence
  Description of Artificial Sequence: Synthetic coding sequence
atggtggattttccagggtacaatctgtccggtgccgtggcttcgtttctttttatcttgctgacaatgaaacagtctgatttcagggtcattggacctgcacaccccattctagccggtgtcggcgaggacgctctcctcacctgtcaacttctgcccaaacggacaaccatgcacgtggaagtccggtggtaccgctccgagccatctacccctgtttttgtgcaccgcgatggcgtcgaagtcactgaaatgcaaatggaggaatataggggctgggtggagtggatcgagaatggtatagccaaaggtaacgtggccctgtag

SEQ ID NO: 216336 - DNA, 780 bp, Artificial Sequence
  Description of Artificial Sequence: Synthetic coding sequence
atggttgactttccagggtataatctgtcaggtgcggtggcatcctttcttttcattttacttactatgaaacagtccgaggatttccgagtcatcggcccagctcacccaattctggcaggcgtgggggaggacgccctcttaacctgtcagcttctaccaaaacggacaaccatgcacgtcgaggttagatggtatcggagcgagccatctacacccgtctttgttcatagggacggagtggaagtaacagagatgcagatggaagagtaccggggatgggtggagtggatagagaacggcatcgccaagggcaacgttgctctaaagattcacaatatacagccatcggacaacgggcagtattggtgtcacttccaggacggcaactattgcggggagaccagcctcctgctgaaggtggctgggctaggtagcgcccctagtatccacatggagggacctggcgaaagcggggttcagctagtgtgtaccgccaggggttggtttccagagccacaagtgtactgggaggacatcaggggagaaaagctgctggcggttagcgagcacagaattcaggatgaggacggcctgttttatgcagaggctactctggtagtgaggaatgcctccgccgagagtgtttcttgtctggtccataaccccgtgctgaccgaggagaagggtagcgtgatttcactgcctgaaaaactgcagacagagctgggcaagtatgaagtcctagcccacacatgtggtggttccctttgcccctag

SEQ ID NO: 216337 - DNA, 780 bp, Artificial Sequence
  Description of Artificial Sequence: Synthetic coding sequence
atggtagattttcctggctacaacctttccggagccgtggcttcatttctgtttattctcctcacaatgaagcagagtgaggatttccgcgtgataggccctgcccaccctattctggcgggtgtgggagaggatgcgttactcacctgccagctcctgcctaagcgcacaacaatgcacgtcgaggttagatggtaccggtctgaaccatccactcctgttttcgttcacagggacggcgtggaggttacagaaatgcagatggaagagtatagaggctgggtagagtggatagagaatggaatcgccaagggaaatgtagccttgaaaatccacaatattcagccctctgataatggtcagtactggtgccatttccaggacggcaactactgtggtgagacgagcctgctactaaaggtggctgggctgggttccgcccctagtatccacatggagggccctggagagtctggcgtgcagcttgtgtgtacagctaggggctggttcccagagccccaagtttactgggaggacatcagaggggaaaagctcctggctgtgtccgagcatcgaatacaggataaggacggtcttttctatgcagaggctaccctggtggtgaggaatgcctcggcagagtccgtctcatgcctggtccataaccccgtcctcactgaagaaaagggatctgttatttcactgccagaaaagctccaaaccgaacttgggaagtacgaagtgctggctcacacttgtggcggatctctgtgcccatag

SEQ ID NO: 216338 - DNA, 636 bp, Artificial Sequence
  Description of Artificial Sequence: Synthetic coding sequence
aaagcaaatgcccagagcatggaggttcggtgggatagatcacatcgatacccagcggtgcatgtctatatggatggggatcacgtggctggcgagcagatggccgagtaccgagggcgtacagtgcttgtgtcggacgctatagatgaaggacgcttgacgctccagattctgagcgccaggcctagtgacgatgggcagtatcggtgcctctttgagaaggacgacgtttatcaggaggcctcattagatcttaaagtcgtgtctttgggttcatccccgctgattactgtggagggtcaagaagacggtgagatgcagccgatgtgttcttccgatggctggttcccccaacctcatgtgccctggcgggacatggaggggaaaaccatccccagctcaagtcaggccctaacgcaagggagtcatggcctgtttcatgtacagactttactgcgcgtgaccaatatttccgctgtggatgtcacatgctccatctctattccatttctaggggaggaaaaaatcgctacattctccctgtccgagtcacgaatgacttttttatggaaaactctactggtgtggggcctgttgttggctgtggctgtgggcctccctcgaaagaggtcttag

SEQ ID NO: 216339 - DNA, 780 bp, Artificial Sequence
  Description of Artificial Sequence: Synthetic coding sequence
atggtggattttcctggctataacctgtccggggctgtggcttctttcctctttatcctgttgactatgaagcagtctgaagacttccgggtcattggccctgcacatcccatactggccggagtgggcgaagacgccctgttgacttgccagctgctgccaaagaggacaacgatgcatgtggaagtcaggtggtatcggagtgaaccttccaccccagtgttcgttcaccgagatggagtcgaagttactgaaatgcaaatggaggagtacaggggatgggtagaatggatagagaacgggattgccaagggaaacgtcgcactcaagatccataacatccagccaagcgacaacggccagtattggtgtcactttcaggacggaaactactgtggagaaacctccttgctcctcaaagtggcaggtcttggttcagccccaagtattcacatggagggcccaggggagagcggagtacagctcgtgtgtacggcgagagggtggttccccgaaccgcaggtatactgggaggacattaggggcgagaaattgttagctgtctccgaacatcggattcaggataaagatggcctcttttacgcagaggccacattagtggtgcgcaatgctagtgctgagagtgtttcatgtctcgtgcacaacccagttttgaccgaagagaaggggtctgtaatatcactccctgaaaaactgcagactgagctgggcaaatacgaggttctggctcacacatgcggaggatcattatgcccttag

SEQ ID NO: 216340 - DNA, 327 bp, Artificial Sequence
  Description of Artificial Sequence: Synthetic coding sequence
atggttgatttccccggatacaatctcagcggcgctgttgcaagtttcctcttcatcctactgacaatgaaacagagcgacttccgggtgattggacccgcacaccctatcttagcgggagtgggggaagatgccttattgacttgccagcttcttcccaagcggaccactatgcacgtggaggtgcgctggtatcggtctgaaccctctactcctgtcttcgtgcaccgggacggcgtggaagtgaccgaaatgcagatggaggaatacaggggatgggttgaatggatcgaaaatggcattgcgaaaggtaacgtcgcgttatag

SEQ ID NO: 216341 - DNA, 327 bp, Artificial Sequence
  Description of Artificial Sequence: Synthetic coding sequence
atggtggatttcccgggatataacctatccggagccgtggccagttttctctttatcctcctgacaatgaaacaatcagatttcagggtcataggacctgcccaccctatccttgccggagtcggcgaggacgcgcttttgacctgccagttgctgcccaaacgaacgacgatgcatgttgaagtgcggtggtaccgatccgaacctagtactccagtgttcgtgcacagagacggtgtggaggtgactgaaatgcagatggaggaataccgcggatgggtggaatggattgagaatggcatcgctaaaggcaatgtggcactatag

SEQ ID NO: 216342 - DNA, 636 bp, Artificial Sequence
  Description of Artificial Sequence: Synthetic coding sequence
aaagccaacgcccagagtatggaggttcggtgggataggtcccatcgctaccctgccgtgcacgtttacatggatggggatcacgtggccggagagcaaatggccgagtatcgcggaaggaccgtgctcgtgagtgatgccatcgacgaagggagactcacactgcagatactctccgctcggccatcagacgatggtcagtacagatgcctcttcgagaaagacgatgtctaccaggaagcttctttagacttgaaagtggtcgggctgggctcttcacctctgattacagtcgaagggcaggaagatggggaaatgcagccaatgtgttcatcagacggatggtttccgcagccacacgtaccttggcgagacatggaaggcaagactatcccctcttcttcacaggccttgacgcaaggatctcatggattgttccatgtgcagactctgctgcgcgtcacaaatatttccgcggtggatgtgacttgcagcatctccatacccttcctgggggaggaaaagatcgctaccttttccctgtctgaaagccgaatgaccttcctgtggaaaaccctgctggtgtgggggctgctgctggctgttgcagttggacttccccgaaagagaagctag

SEQ ID NO: 216343 - DNA, 816 bp, Artificial Sequence
  Description of Artificial Sequence: Synthetic coding sequence
atggtcgattttccgggatacaacctcagtggcgcagtggcctctttccttttcatcctgttaactatgaaacagagtgaagacttccgagtgattgggccagcccatcccattctggccggtgtgggcgaggacgctcttctgacctgccagctgctccccaagcgcactactatgcacgttgaggtgcgctggtacaggagcgagcccagtacaccagtctttgttcaccgggacggtgtggaggttacagagatgcagatggaggagtatcggggatgggtggaatggatcgagaacgggattgctaagggcaatgtagctctgaagatccacaatattcagccctctgacaacgggcagtactggtgtcacttccaagacggcaattattgtggggagacatccctcctgttgaaggtagcagctgtgctgcgagacgacatcattgcctctctcaaagtgaatggtccaagtcagcccatcctcgtgagggtgggggaggacatccaactcacatgctacttgtctcctaaggctaatgcccagtccatggaggtacggtgggacagaagccaccgatatcctgcggtgcacgtatacatggatggtgatcatgttgcaggggagcagatggctgagtaccgcggaaggactgtactggtcagtgatgccatcgatgaaggcagactaacacttcagatactctctgccaggccatccgatgacgggcagtacaggtgcttatttgaaaaagacgatgtttatcaggaagcaagcctggatctgaaagtggtgtgggtgctcccccattag

SEQ ID NO: 216344 - DNA, 327 bp, Artificial Sequence
  Description of Artificial Sequence: Synthetic coding sequence
atggtagactttcccggatacaatctctcaggtgccgttgccagttttctcttcatcttgctaactatgaaacagtcagacttcagggtcataggtccggcacatccaatcctggctggggtcggtgaagacgccctcctgacctgccaactgctgcctaaaaggaccactatgcacgtcgaagtgcgctggtataggtcggaaccctccacacccgtcttcgttcacagagatggcgtggaagttaccgagatgcagatggaagaatacagaggttgggttgaatggattgagaatggaatcgccaagggtaacgtggccctttag

SEQ ID NO: 216345 - DNA, 780 bp, Artificial Sequence
  Description of Artificial Sequence: Synthetic coding sequence
atggtggactttcctggatacaatctgtcaggcgcagtggcttccttcctattcatccttctcactatgaagcagtctgaagacttccgcgtcatcggcccagcgcaccccatcctcgctggggtcggcgaagacgccttgttaacatgccagttgctacccaaaagaaccactatgcacgttgaggtccggtggtaccgctcagagccttcaacacccgtcttcgtgcaccgcgatggggtggaggtgacggagatgcagatggaagagtacagaggatgggtagaatggattgaaaatggcattgcaaaaggaaacgtggcgctgaagattcataacattcaacccagcgataatggacaatactggtgccattttcaagacggtaattactgtggggagacctctctcttgctcaaggtcgccggacttggctccgcgcctagtatccatatggagggtcctggagagtccggtgtgcagctggtgtgtactgccaggggctggtttcctgagccacaggtctactgggaagacatccggggtgagaagctcttagcagtgagcgaacatcgtatacaggacgaggatggtttattttacgccgaagcgactctggttgtacgcaatgcttcagctgagagcgtgtcttgtctggtgcataaccccgtgctgacggaggagaaaggatcagttatttctctccccgaaaaactacagactgaactcggaaaatacgaggtgctagctcatacctgcggcggaagtctgtgtccctag

SEQ ID NO: 216346 - DNA, 327 bp, Artificial Sequence
  Description of Artificial Sequence: Synthetic coding sequence
atggttgactttcctggctacaatctgtcaggggcagtggcaagcttcctctttattttgcttaccatgaaacagagtgattttcgggtcatagggcctgctcaccctattctcgccggagtcggagaggatgctctgctgacatgtcagcttctgccaaagcgaactaccatgcacgttgaagtgaggtggtataggtcagagccgtctacccccgtgtttgttcacagagatggtgtagaggtgaccgagatgcagatggaggagtatcgcggttgggtggaatggatcgagaacggtatcgcgaaggggaacgtggcgctgtag

SEQ ID NO: 216347 - DNA, 636 bp, Artificial Sequence
  Description of Artificial Sequence: Synthetic coding sequence
aaggcaaatgcacaaagcatggaagtgcgatgggatcggtcccatcgataccccgcagtgcacgtctacatggacggtgaccatgtagcgggagagcagatggccgagtacagaggtcggactgttctggttagcgacgccattgatgagggaagattgacactccagatcctgagcgcacggcctagcgatgatggtcaataccggtgcctgttcgaaaaggacgatgtgtatcaggaagccagcctagatctcaaagtggtcggattgggttcctcccccctaattacagtcgagggacaggaggacggtgaaatgcaaccgatgtgctcttccgatgggtggtttccacagccccacgtgccatggcgcgacatggaggggaagaccataccttccagcagtcaagccttaactcaaggttctcatggactctttcatgtgcaaacattgctgcgcgttactaacatatctgcagtagatgtcacctgttcaatttctatcccatttcttggcgaggaaaagatagcaaccttctctctctctgagagccgcatgaccttcctgtggaaaaccttgcttgtatggggcctcctcttggcagtagctgtgggcttgccgagaaagaggtcttag

SEQ ID NO: 216348 - DNA, 780 bp, Artificial Sequence
  Description of Artificial Sequence: Synthetic coding sequence
atggttgacttccccggttacaacctctcaggagcggttgcgtctttcttgtttatactgctaacaatgaaacagagcgaagatttcagggtgatagggcctgcccatcccatccttgccggagtaggagaggatgcactgctgacgtgccagctcctgccaaagagaaccaccatgcacgtagaggtgcggtggtaccgttctgagccctctactcctgtgttcgtccaccgggacggcgtggaagtgaccgagatgcagatggaagaataccggggatgggttgaatggattgagaatggcattgcaaaaggcaacgtggcattaaaaattcacaacatccagccttcagataacggacagtactggtgtcattttcaagacggcaattattgtggagaaacttctttgctgctgaaggtcgccggactgggatccgctcccagtatccatatggaaggcccaggagagagcggtgtccagcttgtctgcaccgcacggggatggtttccagaacctcaagtatactgggaggatattaggggcgagaagctgctggccgtgagcgagcacagaatccaggacgaggatggactgttctacgctgaagctaccttggttgtgcgcaatgcttctgccgagtcagtcagctgcctggttcacaatccggtgcttacggaggaaaagggctctgtcatctccctccccgaaaaactgcaaactgagctcggcaagtacgaggttctggctcatacctgcgggggatccctgtgcccatag

SEQ ID NO: 216349 - DNA, 780 bp, Artificial Sequence
  Description of Artificial Sequence: Synthetic coding sequence
atggtggattttcccggatataatttgagtggcgctgtcgcgagcttcctatttatactgcttactatgaagcagtcagaggacttcagagtgattgggcctgcccaccctatcctggccggagttggggaagatgctttactcacatgtcagctcctccccaaacgcaccaccatgcatgtggaagtgcgatggtatcgcagcgaaccatcaacccctgtctttgtgcacagggatggcgtggaagttacagagatgcagatggaggagtaccgcggatgggtggaatggatcgaaaatggtatcgctaaaggtaatgttgcccttaagatccataacattcagccatccgataacggacagtattggtgtcatttccaggacgggaattactgtggggaaacctctctgctgcttaaggtggccggattgggtagtgcaccttccattcacatggaaggaccaggggaaagcggagttcagctcgtatgcacagcacgtggctggttcccagaaccccaggtgtactgggaagatattaggggggaaaagctgctggccgtctctgagcacaggattcaagataaagatggccttttttatgctgaggccacacttgtggtccgcaatgcctcagccgagtccgtatcgtgcttagttcataatccagtcctgactgaggaaaagggcagcgtgatttccctgcccgagaaacttcagacagagctcggaaaatatgaggttcttgctcatacgtgcggcggaagcctatgtccctag

SEQ ID NO: 216350 - DNA, 327 bp, Artificial Sequence
  Description of Artificial Sequence: Synthetic coding sequence
atggtggactttcctgggtacaacctatcaggggcagtggcctcttttttgttcatccttttgacaatgaagcagtctgatttcagagttattggacccgcacaccccatcttagcaggagtcggagaggatgcacttttgacatgccagctcctgcccaagcgcacaacaatgcacgtggaagtgcgttggtatagaagtgagccctctacacctgtgttcgtgcatcgcgatggtgtggaggttacagaaatgcagatggaagagtacaggggttgggtggaatggatagaaaacggaatcgcaaagggaaatgtagctctgtag

SEQ ID NO: 216351 - DNA, 780 bp, Artificial Sequence
  Description of Artificial Sequence: Synthetic coding sequence
atggtcgactttcctgggtacaatctttctggtgccgtggccagtttcctcttcatcttgttgacgatgaagcagagcgaggactttcgtgtaatcggacctgcccacccgatcctagcgggagttggcgaggatgctctcctaacatgtcaattgctgccgaagcgcactaccatgcatgtagaggtcaggtggtaccgctcagaaccgagcaccccagtgtttgtacacagagacggagtcgaggttacagagatgcagatggaagagtacaggggttgggtggagtggatcgagaatgggatcgcaaagggcaatgtggctctcaagattcacaatattcagccctcggacaacggtcagtactggtgtcattttcaggacggcaactattgcggtgagaccagtctgttgctaaaggtggccggtctcggttctgccccttcaattcacatggaaggacctggggagagcggggtgcagctggtgtgtaccgccagaggctggttccccgaaccacaggtttactgggaggatattcgcggagaaaaattgctggcagtttccgagcaccgcatacaggacaaggacggtcttttttacgcagaggccacccttgtggtgcgcaatgcctccgccgagagcgtgagctgtctcgtacataaccctgtgctgacagaggagaaggggtcggtgatctcgctgcctgagaaacttcaaacagagctgggtaagtacgaggtcctcgcccacacctgtgggggatcactgtgtccctag

SEQ ID NO: 216352 - DNA, 636 bp, Artificial Sequence
  Description of Artificial Sequence: Synthetic coding sequence
aaggccaacgctcagagtatggaagttcgatgggatcgctcccaccgctatccggctgttcacgtgtacatggacggtgatcatgtggctggagagcaaatggcagagtacaggggaaggaccgtgttggtgtctgacgcaattgacgaaggtaggctcactttgcaaattctttctgcaagacccagtgacgacggacagtaccgctgtctgttcgaaaaagacgacgtgtatcaagaagcttctttggacctgaaagtggtcggcttgggtagctcccccctgatcaccgtggagggacaggaagatggcgagatgcagccgatgtgctctagcgacggttggttcccgcagccacacgtgccttggagagatatggaaggcaaaactattccttcatcctctcaggccctaacgcaagggagtcacgggcttttccatgtgcagaccctgcttcgtgtgacaaatatcagcgccgttgacgttacatgttctatctcaattccattcttgggggaggaaaaaatcgctacttttagcttgtctgagagtcgaatgacatttttgtggaagactctgctagtatggggtctgctgctggcggtcgcagtcgggctcccgcgaaagcgaagttag

SEQ ID NO: 216353 - DNA, 636 bp, Artificial Sequence
  Description of Artificial Sequence: Synthetic coding sequence
aaagccaatgcacagagtatggaagttcgttgggaccgtagccaccggtatccggcagtacacgtttatatggatggagaccacgtagccggagagcagatggcggaatacagaggtaggacggtcttggtcagcgacgctattgatgagggcaggttgaccttgcaaattctgtcagcacgtcccagtgacgacgggcagtaccgctgtctcttcgagaaggatgacgtgtaccaagaagctagtctggacctcaaggtggtgtccctgggatccagtcccctgatcactgtagagggtcaagaagacggtgagatgcagcccatgtgttcgtccgatggttggtttccacaaccccatgtgccttggcgtgacatggaaggcaagaccattccttccagcagccaggcacttacacagggctcgcacggtctgttccacgttcagacactgctcagggtgaccaacatttcagccgtggacgttacatgctccatttccattccatttctcggggaagaaaagatcgccaccttcagcctatcagaaagccgaatgacattcctctggaagaccctgctcgtgtgggggcttttattagcagttgccgtgggactgcctaggaagaggtcatag

SEQ ID NO: 216354 - DNA, 636 bp, Artificial Sequence
  Description of Artificial Sequence: Synthetic coding sequence
aaggcaaacgcgcagtccatggaggtgcgatgggacagaagtcacaggtatccagcagttcatgtgtacatggacggagatcatgtagctggcgagcagatggccgagtacagggggagaacggttctggtgagcgacgccatcgatgaggggcgattaacactccagatcctttcagctcggcctagcgacgacggccagtaccgctgcttgtttgagaaggatgatgtgtaccaggaggcttcactcgatctgaaggttgtgagcctgggcagctctcccctgattactgtcgaggggcaggaagacggcgaaatgcaacccatgtgctccagtgatggttggtttccgcagccccacgtcccctggagagacatggagggtaagaccattccaagctcaagccaagcacttactcagggctcccatgggctgtttcacgttcagacactactccgggttactaacatttctgccgtcgacgtcacttgctctatcagcatcccttttctgggggaagagaaaatcgctaccttcagcctatcagaaagtcggatgacgttcctgtggaagactctgttggtatggggcctcctccttgcagtggcagttggcctgccacgcaaaaggtcttag

SEQ ID NO: 216355 - DNA, 327 bp, Artificial Sequence
  Description of Artificial Sequence: Synthetic coding sequence
atggtagacttcccaggatacaacctgagtggcgcagtagcttctttcctgtttatactgctgacaatgaagcaatctgacttccgtgtgatcggacccgcacaccccatcctcgcaggggtcggggaagatgctctgcttacatgccagttgctgccaaaacgcactacaatgcatgtggaggtgagatggtataggtcagagccatcgacgcctgttttcgtccatagggacggcgtggaggttactgagatgcaaatggaagaataccggggttgggtcgagtggattgaaaatgggatcgccaaaggtaatgtggccctatag

SEQ ID NO: 216356 - DNA, 636 bp, Artificial Sequence
  Description of Artificial Sequence: Synthetic coding sequence
aaggctaacgcacagagcatggaagtacgctgggacaggtctcaccggtacccggcagttcacgtttacatggatggcgatcacgtggccggtgagcagatggctgaataccgcggaagaacagttcttgtaagcgacgcgattgatgagggacggctcactttgcaaattttgagcgcgcgaccgagcgatgatggccagtataggtgcctgttcgaaaaggacgacgtctaccaggaagccagtctggatctcaaggtcgtgtcactgggcagctctccattaattactgtggaggggcaagaggacggagagatgcagcccatgtgctcctcagatgggtggttcccacaaccacatgtgccctggcgggatatggaaggcaagaccatcccatcctcttcgcaggccctgacgcaggggtctcatggactcttccatgtgcagacacttctgcgggtgactaacattagtgcagttgatgtcacatgttcaatcagcattccattcctgggggaggaaaaaatcgcaacatttagtcttagcgagtctcgaatgactttcttgtggaaaacccttctcgtctggggtctccttctggccgtcgctgttggcctgcccagaaagcggagctag

SEQ ID NO: 216357 - DNA, 1449 bp, Artificial Sequence
  Description of Artificial Sequence: Synthetic coding sequence
atggtggacttccctggatacaacctgtcaggagccgtagcgagtttcctcttcatactgctcacgatgaagcagagcgaagactttagagtgatcggcccagcccatccaatcctcgccggagtcggggaagacgccttgttgacctgtcagctgctgcctaagaggaccaccatgcatgttgaagtgcgctggtacagaagcgagcctagtacacccgtgttcgtgcaccgtgacggtgtcgaagtgaccgagatgcagatggaggagtaccggggttgggtcgagtggatcgagaacggcatcgctaaggggaacgtggctctaaaaattcacaatatacagccatccgataacgggcagtactggtgtcactttcaggacggcaactattgcggggaaacatctttactgctgaaggttgccggactcggcagcgcaccaagtatacacatggaagggcctggggaatcaggagtccagttggtgtgtacagccagaggatggttcccagagcctcaggtctactgggaggatatccggggagagaagctcctggctgtgtcagaacaccgtattcaagataaggacgggttattctatgcagaagctacattagtggtgagaaacgccagcgccgaatccgtatcctgcttggtccacaacccagtcctgactgaagagaaaggatcagtgatctccctgccggagaagctgcagaccgaactggcgagcctgaaggtgaatggtcctagtcagcctatattagtacgagtgggggaggatatccagctgacttgttatctgtccccaaaggcaaacgcacagtccatggaagtgagatgggacagaagtcatcgatacccggcagttcacgtgtatatggacggggaccacgtggcgggagagcaaatggctgagtaccgaggccgtacagtgctggttagcgatgcgattgacgaggggagactgacacttcagatcctgagcgcgaggccatcagatgatggtcagtatagatgtcttttcgagaaggacgacgtttatcaggaggcttcactggacctgaaagtggtgagtcttgggtccagtcctctgattaccgtggagggtcaggaagatggggaaatgcaacctatgtgttccagtgacggttggttccctcagcctcacgtcccttggcgcgacatggaaggcaaaaccattccatcttcaagtcaggccctgacacagggatcccacggcctcttccatgtgcagacactcctgagggtaactaatatctcagcagtcgacgtcacatgcagcatctctattccattcctgggtgaggagaagattgctaccttttctttaagcgagtcacgtatgacatttctatggaaaaccttgctggtttggggcctcctgctcgctgtagccgtcgggctgcctcgcaagcggagttag

SEQ ID NO: 216358 - DNA, 738 bp, Artificial Sequence
  Description of Artificial Sequence: Synthetic coding sequence
atggtggatttccctggatacaatttgagcggggcagtggccagttttctttttatcttgctgacaatgaaacagagcgaccggctggatacccctaaggcttctcttaaagttaacggaccctcgcaaccaattttggtcagggtcggtgaagacatacaacttacctgttacctgtcaccaaaggctaacgcccagtcaatggaggtacggtgggatcggagccacagatacccggcagtccacgtgtatatggatggcgatcatgtggcgggagagcagatggctgaatatcgaggtaggaccgtcctcgtgtcagacgcaattgatgaaggtcgattaacccttcaaatcctttcggctagaccgagcgatgacggacagtatagatgtcttttcgaaaaagatgatgtgtaccaggaagcgagtttggatctgaaagttgttagccttggaagcagtcccctgattaccgttgagggccaggaggatggtgaaatgcaacccatgtgctcctcggacggatggttcccccagccacatgtcccttggcgggatatggaggggaaaactataccgtcaagttcacaggctctcacccagggaagccacggcctattccacgttcagacactgcttcgtgtgactaacatatctgccgtggacgttacctgttcaatcagcatcccttttttaggtgaggaaaagattgccactttctctctgagcgggtggtag

SEQ ID NO: 216359 - DNA, 537 bp, Artificial Sequence
  Description of Artificial Sequence: Synthetic coding sequence
atggaagtcagatgggatagatctcaccggtacccggctgtgcacgtgtacatggatggggaccatgtagctggcgagcagatggccgagtacagagggcgtacagtgctcgtgtcagatgccattgacgaaggtcgccttaccctgcagattctctcagccaggcccagcgacgacgggcagtatagatgcctttttgaaaaagacgatgtttaccaggaagcatcattggacctgaaagtggtctctctgggctctagtccactcattaccgtcgaagggcaggaagatggtgagatgcagcctatgtgcagcagtgacgggtggtttccacagccacacgttccatggcgggatatggaagggaagaccataccgagttctagccaggcactgacccaaggaagccacgggctttttcacgtccagacccttctccgtgtgacaaatatatcggcagttgacgtgacttgtagcatctcgatcccattcctcggtgaggagaaaatcgcaactttctctttatcagggtggtag

SEQ ID NO: 216360 - DNA, 1167 bp, Artificial Sequence
  Description of Artificial Sequence: Synthetic coding sequence
atggtggatttccccggatacaacctcagtggcgctgtggcatccttcctattcattctgctgacaatgaaacagagcgaggatttccgtgtaataggccctgcacatcctatcttagcaggtgtgggggaggacgccctgttaacctgccagcttcttcctaagcgcaccacaatgcacgtggaggttcggtggtaccggagcgaaccatcgactccagtgttcgtccaccgggacggcgtcgaagtgaccgagatgcaaatggaagagtatcgaggttgggtagagtggattgagaatggtatcgcaaaaggaaatgtggccctgaagattcacaatatccagccttccgataatggacagtactggtgtcatttccaggacggcaattattgtggggagacatccctgctgcttaaagtggcagaaaaattacttgccgtgctgtccagtctgaaagtgaacggcccttcgcagccaatccttgtgagggtcggtgaagacattcaattgacgtgttatctcagtcctaaagcgaacgcccagtcaatggaggtacgatgggaccggtcccataggtatcccgcagtgcacgtgtacatggatggggaccatgttgccggagaacagatggcagaataccggggtcgtactgtcttggtgtccgacgccattgatgaaggccgacttactttgcaaatcctgtcggctagaccatccgatgacggtcagtatcggtgcctgttcgagaaagacgacgtatatcaagaggccagcctggacctcaaagtagtgagtctcggatcaagtcccctgattactgtggaaggccaggaagatggggagatgcagcccatgtgctcaagcgatggatggttcccgcagcctcacgtcccttggcgagacatggagggtaagacaattcctagttcctcccaggctcttacccagggatctcacggattgtttcatgtgcagacgctgctgagagtgactaatattagcgccgtagatgtcacctgcagcatcagcatcccgttcctaggcgaagagaagatcgccaccttcagtctatcggagagccgcatgacgttcctttggaagaccctcctggtgtggggcctcttgttagccgtagccgtgggccttcctcggaagaggagttag

SEQ ID NO: 216361 - DNA, 1167 bp, Artificial Sequence
  Description of Artificial Sequence: Synthetic coding sequence
atggtcgactttcctgggtataatctgagcggcgcagtcgcctctttcctctttattcttctgaccatgaagcaatcagaggactttcgggttatcgggcctgcccacccaatactggctggggtgggcgaagatgcactgctcacctgtcaactgctacccaagaggaccactatgcacgtagaagtccgctggtaccggagtgaacccagcacccctgtgttcgtacaccgcgatggcgttgaggtgaccgagatgcagatggaagagtaccgtggctgggtggaatggatagaaaacgggatcgcaaagggcaacgtcgccttaaagattcataatatccagccttcggacaatgggcaatactggtgtcacttccaggacggcaattactgcggcgaaacaagtctcctcctgaaggtggctgagaaactcttagctgttctctcttccttaaaagtgaatggcccatcccagcctatcctggttagagtgggagaagatatccagctaacgtgctatctctcacccaaggcgaatgcccaatcaatggaagttcgttgggatagatctcatagataccccgctgtgcatgtgtacatggatggagaccatgtggcgggagagcagatggccgagtacagagggagaacggtcttggtgtctgacgccatcgacgaaggcaggcttaccctccagatcctaagcgcccgaccctcagatgatggacagtaccgttgtctgtttgaaaaagatgatgtgtaccaggaggcttcgttggaccttaaagttgtgggtctgggatcttcaccattgattaccgtggaaggccaggaggatggggaaatgcagccaatgtgctccagtgacggttggttcccccaaccacatgtgccctggcgcgacatggagggaaagacaattccaagctcctctcaggccctcacacaagggagtcacggactctttcatgtgcaaaccctgttaagggtaaccaatataagcgcggtggacgtgacttgttccatctccatcccgtttctcggtgaggaaaagatcgccactttctctttatctgagtcccgcatgaccttcctctggaaaaccctcctggtatggggcctgcttttagctgtggcggtcggccttcctcggaagcgatcatag

SEQ ID NO: 216362 - DNA, 1167 bp, Artificial Sequence
  Description of Artificial Sequence: Synthetic coding sequence
atggtagactttcctggatataatctctccggagccgtcgcgtcctttctgtttatcctcctgacaatgaagcagagcgaagactttcgcgtcattggcccagcacatcctattttggcaggcgtaggcgaagacgccctgctgacatgtcagcttctgccaaaaaggaccactatgcacgttgaggtcaggtggtatagaagcgagccctccacccctgtgtttgtgcacagggatggggtagaggtcaccgaaatgcagatggaggaataccggggatgggtagagtggattgaaaacgggattgccaagggaaatgttgcgctgaagattcacaacattcagccatcagacaacggccagtactggtgccattttcaggacgggaattattgcggcgaaacctctctgctgcttaaagtagcagagaaattactcgccgtcctgtcttcactaaaggtgaacggcccttcccaaccaatcctcgtacgagttggagaagacatccagctgacatgctacctgtctccaaaggctaacgcccaaagcatggaagtgcgatgggaccgctcacatcgttatcccgcagtgcatgtgtatatggacggtgaccacgtggccggagagcagatggctgagtataggggcaggaccgtgctggtaagcgacgccatcgatgaagggagacttaccctgcaaattcttagcgcgaggccaagcgatgatggtcagtatcggtgtctgtttgaaaaggacgatgtgtaccaggaggcttcactagatctgaaggtggtatccctgggttcttcacctctgattacagtggaaggccaggaagatggcgaaatgcagcctatgtgctcgagcgatggttggttccctcaaccacatgttccttggagggatatggaggggaaaaccatacctagctcatctcaggcattgacccaaggcagccacggactgttccacgtccagacactcctgcgcgtgacaaacatctcagccgtggacgtgacatgtagtatctctattccatttttaggggaagaaaaaatcgcaacattctccctgtctgagtccaggatgacttttttgtggaagacactgttggtgtggggactgctcctcgcagtggctgtcggtctgcctaggaaaagaagctag

SEQ ID NO: 216363 - DNA, 738 bp, Artificial Sequence
  Description of Artificial Sequence: Synthetic coding sequence
atggtggattttcccggatacaatctatcaggcgctgtagccagctttctctttatcctgctgacaatgaagcagtccgaccgattagacacacccaaagcctcgttgaaggtgaatgggccttcccaacccattcttgttagggtgggcgaggacatccaacttacatgctatttgagcccgaaagcaaacgcacagagtatggaggttcgctgggaccgcagccacaggtacccggctgttcatgtgtacatggacggggatcacgtggccggagagcagatggccgagtacagaggcaggaccgtgctggtctctgacgccattgacgagggacgactcactctacaaattctctccgcccgaccctcggatgacggacagtaccgatgtctgtttgaaaaggatgatgtgtaccaagaggctagcctggatcttaaggtcgtgggcctcggctctagccctctgataactgtggagggccaagaagacggcgaaatgcaacctatgtgctcttctgatggttggtttccacagccacacgttccctggagagacatggaggggaaaacaattccgagttctagccaggctttaacacaaggtagccatggtttatttcacgttcagactctgttgagggtaaccaatatttccgctgtggatgtcacctgttccatctctattccattcctgggcgaggaaaaaatcgctacctttagcctgtctggatggtag

SEQ ID NO: 216364 - DNA, 738 bp, Artificial Sequence
  Description of Artificial Sequence: Synthetic coding sequence
atggtagactttccaggatataacctgtcaggagcggtcgccagctttctattcatcttattgacaatgaagcagtctgatcggctcgacacgcccaaggcctcattgaaagtaaatgggccttcacaacctatcctagttcgcgtgggggaggatatacagctgacatgttatctgtctccaaaggccaatgctcaaagtatggaagtgcgctgggacaggtcgcatagatatccagcagtgcacgtgtacatggacggtgaccatgtggctggagagcagatggcggagtaccgcggaaggaccgtgttggtttcagacgccatcgatgagggtagactgactttgcagatcttgtcggcaagacccagcgatgacgggcagtaccgctgcctgttcgaaaaggacgatgtataccaggaagcctcactcgatttaaaagtggtgagcctgggcagcagtcctctgattaccgtagaagggcaagaggatggcgagatgcaaccaatgtgctcctccgacggatggtttcctcagccccacgttccatggagagacatggagggtaagaccattccatcctccagtcaggctctaacccagggctcacatggtctcttccatgtgcagaccctgctcagagtcaccaatatatcagcagtggatgtaacctgctctatatctataccgttcttgggcgaggaaaagatcgcaaccttctcgctgagtggctggtag

SEQ ID NO: 216365 - DNA, 1167 bp, Artificial Sequence
  Description of Artificial Sequence: Synthetic coding sequence
atggtggacttccccggatataacctgtcaggcgcagtcgcatccttcttattcatattactgactatgaaacagtctgaagactttagagtgatcggccctgcccatcctattcttgctggggtaggagaagacgcactgctgacatgtcagttgctacctaagcgtactaccatgcacgtggaggtgaggtggtaccggtccgaaccatccacacccgttttcgtgcacagggatggtgtggaagttacagagatgcagatggaagagtaccggggatgggtagagtggatcgagaatgggattgctaagggtaatgtcgcactaaaaattcacaatatccagcccagcgacaatggccagtactggtgccacttccaagatggcaactattgtggtgagactagtctcttactgaaagtggctgagaagctgctcgcggtgctctccagcctaaaagttaatggcccttcccagccaattctggtccgcgtcggagaggacatccagctcacctgctacctaagccccaaagctaatgcacagagcatggaggtgcgttgggatcggtcccatcgatatccggctgtgcacgtctacatggacggggaccacgtggccggagagcagatggcagaatacagggggaggacagttctcgtgtcagacgcaattgacgagggcagactgacgttgcaaattctgtcggctcggcctagcgatgacggccagtatcgatgcctgtttgagaaagatgatgtttaccaggaggcgtctctagacttgaaagttgtttcattgggaagctcccctttgatcactgttgaggggcaagaagatggtgaaatgcagcccatgtgttcctctgacggctggtttccccagccacacgtgccctggagagacatggaagggaaaacaattccgagttcctcgcaggctcttacgcagggcagccacggattgttccatgtacagacactcctgcgtgttactaatatttccgccgtggacgtgacctgcagcatatctatcccatttttgggtgaagaaaagatagcgacgtttagtctgagtgagtctagaatgacatttctttggaaaactctgctagtgtgggggctactgctcgctgtggcagtcggacttccgcgaaagcggagctag

SEQ ID NO: 216366 - DNA, 816 bp, Artificial Sequence
  Description of Artificial Sequence: Synthetic coding sequence
atggttgactttcccggttataacctgagtggcgctgtagcaagctttctctttattctgttgactatgaagcaatcagaagactttagagtgatcggacccgctcatccgatcctggctggggtgggcgaggatgccctgctaacctgccaactcctgcctaagaggacgaccatgcatgtcgaggtccgttggtacagaagtgaacctagcactcctgtgttcgttcatagggacggcgtggaagtgacggaaatgcagatggaggagtacagggggtgggttgagtggatcgagaacgggattgctaaggggaacgttgcattgaagatccataacattcagccttccgataacggacagtactggtgccacttccaggatggcaattattgtggggaaaccagcctgctcttaaaggtcgcagctgtgctccgggacgatatcatagcatctctcaaggtgaatggcccttcacagcctatccttgttagagttggtgaggatatccagctgacttgttacttgagtcccaaggcaaatgcccagtctatggaggtccggtgggaccgaagtcacagatatccagctgtgcacgtttatatggatggggatcatgtggcgggagagcagatggccgagtacaggggccgaacggtgctagttagcgatgctattgatgaaggtcgcctcacattgcagattctgagcgcgcgaccttctgatgatggtcagtaccggtgtctctttgagaaagacgatgtgtaccaggaggccagcctggatctgaaagtagtgtgggttttgccacactag

SEQ ID NO: 216367 - DNA, 738 bp, Artificial Sequence
  Description of Artificial Sequence: Synthetic coding sequence
atggtggatttccccggttataacttatcgggcgctgttgccagcttcttgttcattctcctcactatgaaacagtccgagaagctccagacggagctggcttccttgaaagtgaatggcccttcccaaccaattctcgtccgggtgggggaagatattcagttgacatgttacctttccccaaaagccaatgcccagagtatggaggtccgatgggacaggtctcaccgttacccagcagtccacgtttatatggatggggaccatgtagcgggtgagcagatggccgaatatcgcggtagaaccgttctggtatctgacgccattgacgagggcaggctcaccctgcagatcctgagtgctcgtccatcggacgacgggcaatatcggtgcctattcgagaaagatgatgtctaccaggaggccagcctagacctgaaagtcgtcggccttggctccagcccactgatcactgtggaaggacaggaggatggggaaatgcagcctatgtgcagctctgatggatggtttccacagcctcatgtgccttggcgggacatggaggggaaaaccatcccctcatccagccaagccctaacccagggttctcacggcttgtttcatgtgcaaactctactgcgtgtaacaaatattagtgctgtcgatgtgacttgttctattagtataccttttctgggcgaggagaagattgcaaccttttccttgagcgggtggtag

SEQ ID NO: 216368 - DNA, 537 bp, Artificial Sequence
  Description of Artificial Sequence: Synthetic coding sequence
atggaggtacgatgggataggtcccaccggtatcctgcggtccatgtgtatatggacggcgaccatgtggcgggagagcagatggccgagtaccgaggtaggactgtactggtcagcgatgcgatcgacgaagggcgactgacactgcagattctgtccgcacggccatccgatgacggacagtacagatgtctgtttgagaaggacgacgtatatcaggaagcttctcttgatctaaaagtagttggtcttggatcgagcccactcatcaccgttgaaggccaagaggacggcgaaatgcaacccatgtgcagtagtgacggctggtttcctcagccacatgtcccctggagggacatggagggaaagacaatcccgtcctcctctcaggctctgacccaggggtcacatggactcttccatgttcagacactgctccgcgtcacgaacatctccgccgtggatgtgacgtgtagcatctccattccttttctcggggaagaaaaaatcgctaccttttcgctgtccggatggtag

SEQ ID NO: 216369 - DNA, 738 bp, Artificial Sequence
  Description of Artificial Sequence: Synthetic coding sequence
atggtggacttcccaggctataatctgtccggcgctgtggctagctttctgttcatcctgctgactatgaaacagtcggacagattagacacacccaaggcttccctaaaagttaatgggccatcacagccgatcctggttcgcgtgggcgaggatatacagttaacctgctatttatctcctaaggctaatgcccagtcaatggaagtgcggtgggaccgcagccacaggtatcccgcagtacatgtgtacatggatggagaccatgtcgccggagaacagatggccgagtaccgaggccgaactgttttggtctcagacgctatagacgaagggagactgacactccaaattctgtccgccaggccttcagacgatgggcagtatagatgtctttttgagaaggatgatgtttatcaggaggcctctcttgacctaaaggtagtctctttaggctcatctcctctgatcacagtcgagggccaagaagatggagagatgcaaccaatgtgtagcagcgatggatggtttccgcagccgcatgtgccttggcgggatatggaggggaagaccattccgtcgtcctcacaggccctgacccagggctcacatggcctgtttcacgtacaaactctgttgcgtgttacaaatatctcagcggtggacgtgacttgttctatctctataccctttttgggcgaggaaaagatcgctaccttctcattgagtggctggtag

SEQ ID NO: 216370 - DNA, 1368 bp, Artificial Sequence
  Description of Artificial Sequence: Synthetic coding sequence
atggttgattttcctggctacaatctgagcggcgctgtcgcttcgttcctgtttatactgctgacaatgaagcagagcgaggacttcagagtgatcgggccagcccacccaatactggcaggcgtgggcgaagatgccctccttacttgccagctgctaccaaagcgaacaaccatgcacgtagaagttagatggtatagaagtgagccgtcgaccccagtctttgtacaccgcgatggcgtggaagttacggaaatgcaaatggaggaatacagaggttgggtggagtggattgaaaacggcatcgcaaaaggaaatgtggccttaaaaatccataacatccagccctcagataacggacagtactggtgtcactttcaggatgggaattattgtggtgaaactagtctcctattgaaagttgcaggcctaggctcggcacctagtattcatatggagggcccaggggaatccggcgttcagctggtgtgcaccgcccgtggatggtttcccgaacctcaggtatactgggaggatatcaggggagagaagttactggcggtaagcgagcatcggattcaagatgaagatggcctgttctacgctgaggccactctggttgtgcgcaatgccagcgccgagtccgtgtcatgcctcgtgcacaatccggtcttaactgaagaaaagggatccgtcatctcgctgcccgagaagctccagacagagctggcttcattgaaggttaacggcccaagccagccaatattggtgcgggtgggagaagatatacagctgacctgctatctgagccctaaggccaacgcgcagagcatggaagtaaggtgggatagatcacatcgctatcccgcagtccatgtctacatggacggcgatcatgtggccggagaacagatggccgagtatcggggtagaaccgttctggtgtcagacgctatcgatgagggacgcttaacattacagatcctgtccgccagaccttcagatgacggccaatacaggtgcttgtttgagaaggacgatgtctatcaggaagcgtctctagatctaaaggtcgtgggtctgggatcaagtcctttgataaccgtggagggacaagaggatggggagatgcagcctatgtgtagtagcgatggctggttcccccagccccatgtgccttggagggatatggaggggaagacaatcccctctagttcacaggccctgacccagggcagtcatggtctgttccacgttcagactttactgcgcgtcaccaacatcagcgccgtagacgtaacgtgtagcatttccatacccttcctcggcgaggaaaaaatcgccactttcagcctaagtggatggtag

SEQ ID NO: 216371 - DNA, 816 bp, Artificial Sequence
  Description of Artificial Sequence: Synthetic coding sequence
atggtcgacttccccggatacaacctttcaggggcagtggcttcctttctgtttatcctgctcaccatgaagcaatccgaagacttcagggtaattggccctgcccaccccatcttagctggcgttggagaagacgccctgctgacctgtcagctgttacctaagaggacaacaatgcatgtggaagtgaggtggtaccggtctgagccctctacccctgtgttcgttcaccgcgacggtgtcgaggtcacagaaatgcagatggaggaatacaggggctgggtggaatggattgagaacggaattgccaaaggaaatgttgcgcttaaaatccacaacattcagccaagcgacaacggacagtactggtgccacttccaggacggtaattattgtggggagaccagcttattactgaaggtagccgctgtgcttcgggacgatattatcgcttctctaaaggtcaatggtccttctcaacctattctggtccgcgttggtgaggatatccaactcacctgttacctgagccccaaggcaaatgctcagtcaatggaggtgcggtgggacaggagtcaccggtaccctgctgtacatgtctatatggacggggaccatgtggccggtgaacagatggccgagtatcggggtaggaccgtactggtctccgacgccattgacgaggggagactaactctccaaatcctgagcgctcgaccaagcgacgatgggcagtaccgatgcttattcgagaaggatgacgtatatcaagaagcctcactggacctcaaagtcgtctgggttctgccgcactag

SEQ ID NO: 216372 - DNA, 816 bp, Artificial Sequence
  Description of Artificial Sequence: Synthetic coding sequence
atggtggattttcctggatataacctgtcaggggcagtggccagtttcctgtttattctactcacaatgaagcagtccgaggacttccgtgttataggccctgcccatccaattcttgctggtgtgggggaggacgcactcctgacctgtcagcttttacctaaacgcaccacaatgcacgtagaagtgcgctggtaccgttccgaacctagcacaccggttttcgtccacagggacggagtagaagttacagaaatgcaaatggaagagtatcgcggttgggtggaatggatcgaaaacggcatcgctaaaggtaatgtcgcccttaagattcacaacatccagcctagtgacaatggccagtactggtgccactttcaggacggcaattattgtggcgaaacatccctcttgttaaaggtggcagctgttttgcgggatgatattatcgcatcattgaaggttaatggtccgtcccaacccatcttggtgagggtgggtgaggacatacagctgacctgctacctaagccctaaagccaacgctcagagtatggaagtgcgctgggatcgctcacatcgataccccgcagtccatgtctatatggatggagaccacgtagccggagagcagatggccgagtataggggacgcaccgtgctggtcagtgatgccatcgatgagggaaggttaaccttgcagattctgagtgccagaccctcagatgacggccagtaccgatgcctcttcgaaaaggacgacgtgtaccaggaggcaagcctggatcttaaggtcgtgtgggtcctacctcattag

SEQ ID NO: 216373 - DNA, 738 bp, Artificial Sequence
  Description of Artificial Sequence: Synthetic coding sequence
atggtggatttcccagggtacaatctctctggtgccgtggcttcctttctcttcattctactgaccatgaagcaaagcgatagactggatacaccaaaagcatcactgaaagtcaacggccctagccagcccatcctggtgcgcgttggggaggatattcagctgacctgctatctctcccccaaggcaaatgctcagagtatggaggtgagatgggataggtcccacaggtaccccgcagttcacgtgtatatggacggggaccatgttgcaggtgagcagatggctgagtacagaggaagaaccgtgctggtgagcgacgctatcgatgagggccgactgacactccagatactgtcagctcgcccttcagacgatggccagtatagatgcttgttcgaaaaggatgatgtgtatcaggaggcgagcctggatctcaaggtcgtctccctaggatcaagccctttgattaccgtcgagggacaggaggacggggagatgcagccgatgtgctcttctgacggatggtttccccagccccacgtgccatggagggacatggaaggcaagacaattccctcatcttcccaggcgctgacgcaaggatcgcatggcctgttccatgtgcagacactgttaagagttaccaacatttctgcagtggatgtcacttgctcgatttctatcccattcttgggcgaggaaaagatcgcaacattctcccttagcggctggtag

SEQ ID NO: 216374 - DNA, 816 bp, Artificial Sequence
  Description of Artificial Sequence: Synthetic coding sequence
atggttgactttccaggctataacttgtcaggggcagttgctagctttctgttcatactgttaacgatgaaacagtcggaagacttccgagttatcggccctgcccatcctattttggcaggggtcggcgaggatgcattgcttacgtgccagttactacccaagcgcacaactatgcatgtggaagtgcgttggtatagaagcgaaccatctacaccagtcttcgtccacagggatggcgtggaggttaccgaaatgcagatggaggagtacagggggtgggtggagtggatcgaaaacggtatcgccaaaggcaacgtggcactcaaaatccataacatccaaccctctgacaacgggcaatattggtgtcatttccaggatggcaattattgcggagagacatcattgttgttgaaagtggcagccgtcctgcgggacgatataattgctagtcttaaagtcaacggcccttctcagccgattctcgtaagagtaggagaggacattcagctgacatgttacctttcccctaaagccaatgcacagagtatggaggtgcgctgggataggagccatcgttatcctgccgtgcatgtgtacatggacggggatcacgtggccggtgaacagatggctgagtataggggcaggaccgtgttggtgagcgacgcaattgatgaagggcgattgacattacagattctgtccgctagaccttccgatgacgggcaatatcggtgcctcttcgagaaggatgacgtttaccaggaagcgagcttagatcttaaagtcgtgtgggtcttaccccactag

SEQ ID NO: 216375 - DNA, 738 bp, Artificial Sequence
  Description of Artificial Sequence: Synthetic coding sequence
atggtggattttccagggtacaatctgtctggggctgttgcttcatttttgtttatccttctcaccatgaaacaaagcgaccggctggatacaccaaaggcctccttgaaagtgaatgggccatctcagcccattcttgtgcgcgtaggggaagatattcagctgacgtgttatctaagtccaaaagcaaatgcccagtccatggaggtacgctgggaccgctcacacaggtaccccgcagtgcatgtgtatatggatggcgatcacgttgcaggggagcagatggccgagtatcgcggaaggacagtgttggttagcgatgccatcgatgaggggagattgactctgcagatcttgtcagctcgaccctcagacgatggacagtaccgttgtctttttgagaaagacgacgtgtatcaagaggctagtctggaccttaaagttgtggggttaggttcctccccactgataactgtggaaggacaggaagacggagagatgcagccaatgtgtagctccgatgggtggttcccccaacctcacgtcccatggagggacatggaaggcaaaacgatccccagtagttcccaggccttgacccagggtagccatggactgtttcatgtgcaaacactcttgcgggtcacaaatatctcagccgtagacgtgacctgttctatatctattcctttccttggggaggagaagatcgccacattttcactgtcagggtggtag

SEQ ID NO: 216376 - DNA, 738 bp, Artificial Sequence
  Description of Artificial Sequence: Synthetic coding sequence
atggttgacttccccggatacaacctgtctggcgctgtggctagcttcctgtttatcctcctgaccatgaaacagtcagacaggttagataccccaaaagcgtccctgaaagttaatggtccttctcagccaattttagtccgagtaggggaggatatacaactaacgtgttatctgtctccaaaggctaatgcgcagagcatggaggtgcgctgggatcgtagccaccggtacccagctgttcacgtctacatggatggcgaccacgtggccggagagcagatggccgaatatcggggtaggacggtgcttgtgagcgacgcaattgacgaggggaggctgacgttgcaaatactgtctgccaggccctccgacgacgggcagtaccggtgtctgttcgaaaaggatgacgtataccaggaggcaagcctggatcttaaagttgtgagtttggggtcatccccactcattaccgtcgagggccaggaagatggagagatgcagcctatgtgttctagcgacggatggttcccccaacctcatgtgccatggagggacatggaaggaaagacaattcctagctcttcccaggccctgacccagggctcccacggtctgtttcatgtccaaacgctgctgagggtgactaacatatctgcagtggatgttacttgtagcatctctatccccttcctaggcgaggaaaagatcgccacgttcagcctgtcaggatggtag

SEQ ID NO: 216377 - DNA, 1368 bp, Artificial Sequence
  Description of Artificial Sequence: Synthetic coding sequence
atggtcgattttcctggatacaatctgtccggagcggtagcatcattcttattcattttgctcactatgaagcaatcagaagattttcgggttatcggacccgcacacccaatactggcaggcgttggagaggatgccttgctcacctgccagctgctgccaaagagaactacaatgcatgtagaagtccggtggtaccgatcagaaccctcaacccccgtttttgtgcatagggacggggtggaggtcaccgagatgcagatggaagaatacagagggtgggtggagtggatcgagaatgggattgccaaaggcaatgtagccttgaaaatccataacatccagccttccgataacggtcagtactggtgtcactttcaagacgggaactactgcggggaaacatcgctactgctgaaagtggcagggctaggcagcgccccatccattcatatggaggggcctggcgaatcaggtgtccagcttgtctgcacagcgcgtggctggttccccgaacctcaagtttattgggaggacatccggggagagaagttgcttgctgtcagtgagcaccggatccaggataaggacggattgttctatgcggaagcgaccttggttgtcaggaacgcctccgctgagagtgtcagctgccttgttcacaatcctgtgctcacagaagaaaagggtagcgttataagtctgcccgagaagctgcaaactgagctcgcatctttgaaggtcaatgggccttcacagccaatcctcgtgcgtgttggcgaggacatccaactgacttgttacctttcccctaaggctaatgctcagagcatggaggtccgctgggatagaagtcaccgctatccagccgtccacgtttatatggacggggaccacgtggctggcgaacaaatggctgagtaccgcggacggactgtgctggtgagcgatgccattgatgaaggaagactcaccctccagatactgtcagccaggccaagcgacgacggccaataccggtgcctgtttgagaaggacgatgtgtaccaggaagccagtctcgacctaaaggtggtgtccctggggagttcacctctgattactgtggaagggcaggaggacggtgaaatgcagccaatgtgctcaagtgacggctggttcccacaaccccacgttccgtggcgtgacatggaaggcaaaactattccaagctcatcgcaggccctcacgcagggcagccacgggctgttccacgttcagacacttctaagggtcaccaacattagcgccgtagacgtgacatgcagcatctctataccattcctgggagaggagaagatcgccaccttttcgttgtccggttggtag

SEQ ID NO: 216378 - DNA, 1368 bp, Artificial Sequence
  Description of Artificial Sequence: Synthetic coding sequence
atggtggacttccccggttacaatctgtctggagcagtcgctagtttcttgttcattcttctcaccatgaagcagtccgaagactttcgcgtgattggaccggcacacccaattctggctggcgtgggtgaggatgcgctgctgacctgccaactgctccctaaacgtactaccatgcatgtggaagtccgctggtatcgctctgagcctagcactcctgttttcgtgcatcgtgatggagtggaggtgacggagatgcagatggaggagtacaggggctgggtggaatggatcgagaatggtattgcaaaggggaatgtggccctaaagatccataacatccagcccagcgataatggtcagtactggtgtcattttcaagacggcaactactgtggggagacttccttgttgctgaaagtagctggtctaggatctgctccctctatccacatggaggggcctggagagtcaggcgtgcagctggtgtgcactgcacgtggatggttccccgagccacaggtctactgggaagacattaggggagaaaagctgctcgcagtgtctgaacatcggatacaagataaggatggcttgttttatgccgaggccacgttagtggtgagaaacgcctctgccgagtcggtgtcatgtctggtacacaacccggtcttaacagaggaaaagggtagcgtgatctcacttcccgagaaactccagacggaactcgcatctctgaaagtgaacgggcctagccagcccatcttagtgcgagttggagaagacattcagcttacgtgctatctgtcacctaaggctaatgcgcagtcgatggaagtaagatgggatcgtagccaccgctaccccgctgtgcatgtgtatatggacggggatcatgtggccggtgagcaaatggccgagtacaggggcagaacagtcctggtatctgacgccattgacgaaggcagacttacccttcagatcctatcggcacgcccaagcgatgatggacagtacaggtgtttgtttgagaaggatgacgtttaccaggaagccagtctcgacctgaaggttgtctcactgggctccagccctctgatcacggtcgagggccaggaggatggagagatgcagcctatgtgcagttccgacgggtggttcccccagccacatgtgccatggcgagacatggagggtaagactattcccagtagcagccaggccttaactcaggggagtcacggactgtttcacgttcagacgctcttgcgggttactaacatctctgccgtggatgtgacttgttcaatctctattcctttcttgggggaagagaaaatagccacgttcagcctctccggctggtag

SEQ ID NO: 216379 - DNA, 537 bp, Artificial Sequence
  Description of Artificial Sequence: Synthetic coding sequence
atggaagtccgctgggaccggagccaccggtaccccgcagtgcacgtgtatatggacggcgatcacgtcgctggcgaacagatggccgagtacaggggcagaaccgtgctggtgagcgacgcaattgatgagggcaggctcactctgcaaatacttagcgccagaccaagtgatgatgggcaatatcggtgcctttttgaaaaagatgacgtttaccaggaggcttcactagacctgaaggttgtctcccttggatcatcacctctgattaccgttgaaggacaagaggacggagagatgcaacctatgtgctcatctgacgggtggtttccgcagcctcatgtaccttggcgagacatggagggtaaaacgatacctagttcctcccaggctctgacccagggtagtcatggcctttttcacgtgcagaccctcctgcgggtcaccaacatctccgctgtggacgtgacctgtagcatctccattccattcctaggtgaagaaaagattgctacgttcagtctgtcaggatggtag

SEQ ID NO: 216380 - DNA, 1368 bp, Artificial Sequence
  Description of Artificial Sequence: Synthetic coding sequence
atggtcgatttccctggatataaccttagcggggctgtggcatcgttccttttcatcctgcttacaatgaaacagtctgaggacttcagagtaattggtccagcacatcccattctcgccggagttggcgaagatgccctgctgacatgccaacttttgcctaaacggaccaccatgcacgtggaagtcagatggtatcgctcagaaccatccacccctgtctttgtacatcgggatggggtagaggtgacagagatgcagatggaggagtaccgtggatgggtggaatggatcgagaacggcattgcaaagggaaatgtcgccttaaaaatccacaacatccaaccttccgataatgggcagtactggtgccactttcaggacggtaattattgtggggagacctcccttctactgaaggtggcgggtttgggctcggctcctagtatacacatggagggaccaggggaatccggcgtgcagcttgtatgcaccgctcgaggatggttccctgaaccacaagtatactgggaggacatccgaggcgagaaactcctggctgtgtctgaacaccgcattcaggacaaggacggactcttttacgctgaagctacccttgtagtgcgaaatgcctcagcggaatcggtgtcatgcctggtgcataatccagttctgaccgaggagaagggcagtgtaatcagcttgcctgagaaacttcagactgaactcgcctcactaaaggttaacggcccatcccaaccaattttggtgagggttggggaggacattcagttaacgtgctatctttcacccaaagccaatgcgcagtctatggaagtcagatgggacaggtcgcatcggtaccccgcagtccacgtttacatggacggcgatcacgtcgccggtgaacaaatggccgagtatcgtggacgtacagtgctcgtcagcgacgctattgatgaaggacggctgacgttacaaattctgtccgcacggccttctgacgacggacagtatcggtgtttgttcgagaaggatgacgtctaccaggaggcgagccttgacttgaaggtggtttctttgggatcgagtccgctgataacagtcgagggccaggaagacggcgaaatgcagccaatgtgcagcagcgacggctggttccctcaaccccatgtcccatggagggacatggaggggaaaaccatccctagttccagccaggcgttgactcagggtagtcacgggctgtttcatgttcagaccctgttacgcgtaacgaacataagtgctgttgatgtgacctgttcaatcagcataccctttttgggtgaggaaaagatcgctacattcagtttgtccgggtggtag

SEQ ID NO: 216381 - DNA, 816 bp, Artificial Sequence
  Description of Artificial Sequence: Synthetic coding sequence
atggtcgactttcccggttacaacctgtccggcgctgttgcctcatttttgttcatactgctcaccatgaagcagtctgaagactttcgcgtaatcggccctgcccaccctatactagcaggcgtaggagaagatgccctgttaacgtgtcaattactccccaaaaggaccacaatgcatgtagaagtgagatggtatcgcagtgagccatccaccccagtcttcgtacacagggatggagtggaagtcacggaaatgcagatggaagagtacaggggctgggtagagtggattgagaacggaatcgccaagggcaatgtggcactaaagatccacaatatacagccttcggacaacggccagtattggtgtcactttcaggacggcaattattgcggcgaaacttctcttctgctgaaggtggccgctgtcctgcgtgacgatattattgcttccctgaaggtgaacggcccatcccagcctattcttgtgcgggtaggcgaagacattcagctaacctgctatcttagcccaaaggccaatgcccagtctatggaagtcagatgggatcgctcgcacaggtacccggctgtgcatgtgtatatggatggcgaccacgttgcgggagagcaaatggccgagtatcgaggaagaacagtgctagtgagcgacgccatcgacgaggggcgactgaccctgcagatcctgtcagcgagacccagcgatgatggacagtataggtgcttgtttgagaaggatgatgtgtaccaggaagcttcactggacttaaaagtggtctgggtcctcccccactag

SEQ ID NO: 216382 - DNA, 1368 bp, Artificial Sequence
  Description of Artificial Sequence: Synthetic coding sequence
atggtcgactttcccggatacaacctgtccggggcagtagcgtcctttctgttcatacttctgactatgaagcaatcagaagacttcagggtgataggcccagcgcacccgatcctcgcaggcgtgggcgaagacgctctcttgacctgtcagctgctacccaagcggacaaccatgcacgtggaagtccggtggtatcgctcggagccttcaaccccggtgttcgtgcaccgtgatggagtggaggtgacagagatgcagatggaggaataccggggatgggtggagtggatcgaaaatggaatagccaaagggaacgtcgccttaaagatacataatattcagccgtctgacaatgggcagtactggtgtcactttcaggatggtaactactgtggcgagaccagcttgctgttgaaggtggctggcttagggtccgctccctctatacacatggagggaccaggagagagtggagtccagttggtatgtaccgctagaggatggtttcctgaacctcaggtttattgggaggacatccgaggggagaagctccttgctgtgtccgagcatcgaatccaggatgaggacggcttattttacgccgaggccacactggttgtccgcaacgcctctgccgaatctgtttcatgcctggtgcacaaccctgtcctcacagaagaaaaaggttccgtcatctccttacctgagaaactgcagacagaactggcgtcactaaaagtaaacggtccgtcacagcctatcctggtgcgtgtgggcgaagacattcagctcacttgctatctctcccctaaagccaatgcccagtcaatggaggtacgctgggatcgaagccatagatatccagctgttcacgtgtatatggacggagaccatgttgccggagagcagatggcagaatatcggggtaggactgtgcttgtctcagatgccattgacgaaggtaggttgacactccagattttgagcgctcggccatccgatgacggccagtaccgctgtctctttgagaaagatgatgtgtatcaggaagccagcttagaccttaaggtagtgggccttggatctagcccacttatcacggtcgaagggcaggaagatggggagatgcaaccaatgtgcagcagcgatggatggtttccacagccccatgttccctggagagacatggagggcaagacaatcccatcaagctcccaggccctgacacagggctctcatggcctctttcatgttcaaactctattacgcgtgacaaacatcagtgcagtggacgtgacatgtagtatttcgattccatttcttggcgaagagaaaattgctacctttagcctcagcgggtggtag

SEQ ID NO: 216383 - DNA, 1368 bp, Artificial Sequence
  Description of Artificial Sequence: Synthetic coding sequence
atggtagactttcctgggtacaatctctctggggcagtcgccagttttcttttcatactactgaccatgaaacaatctgaagatttcagggtgatcggcccagcccaccctattctggcaggtgttggagaggacgccctgctgacctgccagctgctgcccaaacgtaccactatgcacgtagaagtgcgctggtatcgatctgaacctagtacaccagtgtttgtacaccgtgatggggtggaggttaccgaaatgcagatggaggagtatcggggatgggtggaatggattgagaatgggattgccaaagggaacgtggctctgaagatccataacattcagccgtctgacaacggacagtactggtgccacttccaggacggcaactattgcggagaaacaagcctcttgctaaaggtggctggcttaggttctgcacccagtatccacatggaaggcccaggggaatcaggtgtccaattagtatgcaccgctcggggatggtttcccgaacctcaagtctattgggaggacatccgcggtgagaaactgctggcagtgtccgaacaccggatccaggacgaggatggactattctacgcagaagcaacattagtcgttcgtaatgcttctgccgagtctgtgtcatgcctggtccataatccagtgctgaccgaagagaaaggctccgttataagtttgcccgagaagctccagactgaacttgccagccttaaggtgaatggcccttcacagcctatcctggtcagggttggtgaggacatccagctcacttgttatctcagccccaaggctaacgcccagtccatggaggtccgctgggacaggagtcatcgctaccctgcagtgcacgtgtacatggacggcgaccacgtggccggtgaacaaatggccgaatacagaggcaggaccgttctggtgtctgacgctatcgacgagggccgactgaccttacagatcctgtctgctcgaccttccgatgatgggcagtatcgttgtctctttgagaaggacgatgtatatcaagaggccagtcttgacctaaaagtggtcgggctgggctcttcccccttgataaccgtcgagggtcaagaggatggggaaatgcaacccatgtgctcttctgatggctggttccctcagccgcacgtgccatggagggacatggagggcaaaaccatcccatcttcctcacaggcccttacccaaggctctcacggactattccacgtccagaccctgctgcgcgtgacaaacatcagcgctgtggatgttacctgtagcatctccatacccttcttgggtgaagaaaagatagccaccttcagtttgagcggctggtag

SEQ ID NO: 216384 - DNA, 816 bp, Artificial Sequence
  Description of Artificial Sequence: Synthetic coding sequence
atggtggattttcctggctataatctgtctggcgcagtggcatcttttctctttatcttgctaactatgaaacagtccgaggacttcagggtgatcggcccagctcatcctattttagcaggtgtaggggaggacgctcttctgacctgtcagctgctgcctaaaagaaccactatgcatgtcgaagttaggtggtatcgatctgaaccatccactccagtgttcgtccaccgagatggggtagaggttactgaaatgcagatggaagaatacagaggatgggttgaatggattgagaatggtatagccaagggaaacgtcgccctcaagatccacaatatccagcccagcgacaatgggcagtactggtgtcatttccaggacggcaactattgcggggagaccagcttactcctgaaggtggcagccgtcctacgcgacgatatcatcgctagcctcaaagtgaacggaccttctcagccaatcctggtcagggttggtgaggatattcagctgacctgctatctcagtcccaaagctaacgcccagagcatggaagtgcgttgggataggtcccaccgataccctgcagtacacgtatatatggatggcgatcacgtagccggtgaacagatggcagaatacagaggccgtacagtgctcgtgtctgatgcaattgatgaaggtagattgaccctgcagattctctctgcccgacctagcgacgacggccaatacagatgtctgtttgagaaagacgacgtatatcaagaggcaagcctggatctgaaagtggtctgggtgctgccacactag

SEQ ID NO: 216385 - DNA, 537 bp, Artificial Sequence
  Description of Artificial Sequence: Synthetic coding sequence
atggaggtgcggtgggatcggtctcacaggtaccccgctgtgcacgtgtatatggacggtgaccatgtggctggcgagcagatggctgagtatcgcggtagaactgtgctggtttcagacgccattgacgagggcagactcacactgcagatcctgtccgccaggcctagcgatgacggtcaatatcggtgcctctttgagaaggatgacgtgtatcaagaggcgtccctggacttgaaggtggtaggactgggaagttcccctctgatcacggtagagggccaagaagatggcgaaatgcagccaatgtgttcctcggacggctggttccctcagccccacgtgccctggcgggacatggagggtaagacaatcccatccagcagtcaagcactgactcaggggagccacggcttattccatgttcagacactgctgagggtcacaaacatttcagcggtcgacgtgacatgcagcatctccatcccctttctcggagaggaaaaaatcgccacattcagtctgtctggatggtag

SEQ ID NO: 216386 - DNA, 738 bp, Artificial Sequence
  Description of Artificial Sequence: Synthetic coding sequence
atggtcgacttccccggttataacttgtccggggctgtggcaagctttctatttatcctgctcaccatgaagcaatctgaaaagctgcagacagagctcgctagccttaaggtgaatggcccaagtcagccaatcctggtgagagtgggtgaggacattcagctgacctgttacctgagccctaaagcgaacgctcagagcatggaagtgaggtgggatcgaagtcacagataccctgctgtccatgtttatatggatggcgatcacgtagctggcgagcagatggctgaataccgagggagaacagtccttgtgagcgatgccatcgacgaaggcagactcactctccagattcttagtgcgaggccctctgacgacggacaataccgttgcctctttgaaaaggacgatgtgtaccaagaggcttcactcgacctcaaagtggtcggactcggctcttcccccctaatcactgtggaaggccaggaggacggagagatgcagcccatgtgtagctccgatgggtggtttccccagccacatgtgccgtggcgcgacatggaggggaagaccataccctctagcagccaggctctgactcagggttcacatggactgtttcatgtgcagactcttctgagggtgaccaacatatcagccgtggatgtcacctgttccatttctataccattccttggcgaggaaaaaattgccaccttctctctgtctgggtggtag

SEQ ID NO: 216387 - DNA, 738 bp, Artificial Sequence
  Description of Artificial Sequence: Synthetic coding sequence
atggttgatttccctggatacaacctgagtggagccgttgcaagtttcctgttcatcttactgactatgaaacaatccgagaaactgcagacagaactcgcttctctgaaagttaacgggcctagccagcctatcctggtgagagtcggtgaggacattcagcttacctgctatctgtcccccaaagcaaacgcacagtccatggaagtgcgttgggaccggtcccacaggtacccagccgtccacgtgtacatggacggtgaccatgtagcgggagaacagatggcagagtatcgcggtaggaccgtactggtatcagacgccatcgatgagggccgtcttacactgcagatcctgtcagcaagaccttctgatgatggtcagtaccgctgcctgttcgaaaaagatgacgtgtaccaggaggcctctcttgacctcaaagtggtctctctggggtcttccccgctaataactgtggaggggcaggaggacggcgagatgcagcccatgtgctcttcggatggctggtttccgcaaccacacgttccgtggcgtgatatggagggtaagactattccaagcagtagtcaggctctcacacaaggttctcacggattgtttcatgtgcagacactgcttagggtgacgaacattagcgcagttgacgtcacgtgcagtatctcgattccgttcctgggtgaggagaaaatcgcaactttctcacttagcgggtggtag

SEQ ID NO: 216388 - DNA, 1167 bp, Artificial Sequence
  Description of Artificial Sequence: Synthetic coding sequence
atggtggacttcccgggttataacttatctggggctgtggcatcattcttattcattttacttaccatgaagcagagcgaagactttagagtcatcggacccgcacaccctattctggctggcgtgggcgaggacgccttgctcacgtgccagcttttgcccaagcgaacgaccatgcatgtcgaggttaggtggtaccgctctgaaccgagtacaccggtgttcgtgcatagagatggagtcgaggtaaccgaaatgcaaatggaagagtaccgtgggtgggtagagtggatcgaaaacggcattgccaagggaaacgtggcccttaaaatacacaacatccagcccagtgataacggtcaatattggtgtcacttccaggacggcaactactgtggtgaaacctctcttctcctgaaagtcgctgaaaaattgttggcagtactgagttcactcaaagtgaacgggccaagtcagcctattctggtgcgagtgggtgaggacatccagctaacatgctatctgtcgccaaaggccaatgcccaatcgatggaggtgcgatgggaccggtcacaccgataccctgccgtgcatgtgtacatggacggcgaccatgtggctggcgagcagatggctgagtacagggggcgtactgtgttggtcagtgatgcaatcgatgagggccgactcacattgcaaatactgtctgcccgaccttccgacgacggccagtataggtgtctgttcgaaaaagatgatgtttaccaggaggcgtccctggatttgaaggttgtgagtttaggcagtagcccgctcatcacagtggaaggacaagaggacggcgaaatgcagcctatgtgctcaagcgacgggtggttcccacagcctcacgtaccatggcgcgacatggagggaaagactatccccagctcctcacaagcactgacacaaggcagccatggactgtttcatgtccagaccctcttacgtgtgactaacatctctgccgtcgatgtaacttgttcgatatctataccctttcttggagaggagaagatcgccaccttttcccttagcgaaagtaggatgactttcctgtggaaaactctacttgtgtggggacttcttctggccgtagctgtaggccttcccaggaaacgaagttag

SEQ ID NO: 216389 - DNA, 1368 bp, Artificial Sequence
  Description of Artificial Sequence: Synthetic coding sequence
atggtggactttcccggatataatttgtccggagccgtagcctcctttctgtttatactacttactatgaagcaatcggaggatttccgcgtaattggcccagcccaccccattcttgccggtgtgggtgaggatgccctgctgacatgtcaacttcttcccaaaaggacaaccatgcacgtggaggttagatggtatcgcagcgagccttcgaccccagtcttcgtacaccgtgatggtgtagaggtcacggaaatgcagatggaggagtatagaggctgggtggaatggatcgagaacgggattgccaaagggaatgtggcgctgaagatccacaacatccagccgtccgataacgggcaatactggtgtcatttccaggacggcaactattgtggggaaacttcgctccttctgaaggtggccggtttgggcagcgcccctagtatccacatggagggacccggagaaagcggcgttcagctggtatgcaccgctcgcggatggttcccggagccacaggtgtattgggaggatatcaggggcgagaaactgctcgccgttagcgagcatcgcattcaggacaaagacggcctgttctacgcagaggccactcttgtggtgcgcaatgcttctgccgaatcggtatcctgtttggttcataatcctgttctgacagaagagaagggtagcgtcattagtctgccagagaagttacaaaccgagctcgctagtttaaaagttaacggccctagtcaaccaatcctggtacgtgtcggcgaggatatacaactgacctgctatctgagccccaaagctaatgcacaatccatggaggtgcgctgggataggtcacacaggtatccagccgtgcacgtgtatatggatggcgatcatgttgccggagaacagatggccgagtatcgaggcagaacggtgctcgtatcagacgccattgacgaaggtcgactcactttgcagattctaagcgcgcgtcctagcgatgatggacagtaccgctgcttgtttgagaaggatgacgtttaccaggaggcttccctggatctgaaggtcgtgtcactcggttcatcacccctaataacagtggagggacaggaagacggcgagatgcagccaatgtgtagctccgatggatggttcccccagccccatgtgccatggcgcgacatggagggcaagacaatcccctcttctagtcaggcactgacccagggcagccatggactgttccatgtacagacgttgctgcgagtcactaacattagcgccgtcgacgtgacatgcagcatctccatccctttcctaggtgaagaaaaaattgcgactttcagcctgtctggatggtag

SEQ ID NO: 216390 - DNA, 1167 bp, Artificial Sequence
  Description of Artificial Sequence: Synthetic coding sequence
atggtggacttccctggctataatctgagtggtgccgtcgcatcgttcctgtttatactcctgaccatgaagcagagcgaagacttccgcgtcatagggcctgcccatccaatccttgccggagtgggagaggatgccttgttgacatgccagctgctgccaaagaggacaactatgcatgtggaagtccggtggtaccgctccgagcccagtacgcccgtattcgtacaccgcgacggcgtggaggtgactgagatgcagatggaagagtaccggggatgggtagagtggatagagaatggaatcgctaaggggaacgtcgcgctgaagatccacaatatccagccatccgataacggccagtattggtgccactttcaagacggcaactactgtggagagacatcgctgctcctcaaggttgcagaaaaactgctagcggtactgtctagcttgaaagttaatgggccttcacaacctattttggttagggtaggggaggatatccaactgacctgctacctaagtcctaaagccaacgctcagagcatggaagtgcgctgggatagatctcaccggtacccagctgtacatgtgtacatggatggggaccacgtcgccggagagcaaatggccgagtacagaggtcggaccgttttggtgtctgatgccatagacgaagggagactgacgctgcaaatcctcagcgctcgcccatctgacgacgggcagtatcgatgtttgtttgagaaggacgacgtgtatcaggaagcatccctggacttaaaggtagtgggtctgggttcctcccctttaatcacggtggaaggccaggaggatggagagatgcagccaatgtgctcctcagatggttggttccctcaacctcatgtgccatggcgcgatatggagggaaagaccatcccctcctcctctcaggctctgacccaggggagccacggcctgtttcatgttcagaccctcttacgagtgaccaatatatctgcagtcgacgtgacatgttccatctcgatcccgttcctgggagaggagaagatcgctacattctccctaagtgagagccgcatgacattcctgtggaagacactcttagtgtggggcttgctcctggccgtggcagtgggactgccacggaagcgcagctag

SEQ ID NO: 216391 - DNA, 738 bp, Artificial Sequence
  Description of Artificial Sequence: Synthetic coding sequence
atggtggatttccccggatacaacctcagtggagcggttgcgtcatttcttttcattctgctcactatgaaacaaagtgatcgcctggacacacccaaggcttccttaaaggttaatggcccatcacagcctattctcgtgcgtgttggtgaggacatccagctcacgtgctacctgagcccaaaggccaatgcccagtcgatggaggtaaggtgggacaggagccacagatatccggctgtccatgtgtatatggatggggaccatgtcgcaggggaacagatggcagagtaccgcggacgcaccgtgttagtctcagatgccattgatgagggtagattaactctgcagatcctgagcgcccgaccctcagatgacggacagtaccggtgcctttttgagaaagatgacgtctatcaagaggccagccttgaccttaaggtcgtcggcctcggaagcagcccccttatcacggtggaggggcaagaggatggcgagatgcaacctatgtgcagctctgacgggtggtttccccagcctcatgtcccatggagagacatggaaggaaagacaatcccaagttccagccaggcccttacacagggatcgcacggtttgtttcacgtgcaaactttgctgcgtgtcacaaatataagtgccgtcgatgtcacatgctccatctcaatacctttcctgggagaggagaaaattgctacattctcattgagcggctggtag

SEQ ID NO: 216392 - DNA, 816 bp, Artificial Sequence
  Description of Artificial Sequence: Synthetic coding sequence
atggtggatttccctggctacaatcttagtggtgctgtcgctagctttctgtttatccttttaacgatgaagcagtctgaggacttccgcgtaattggtccagcacatcctatcctcgcaggtgttggcgaagatgccctcttgacctgtcagttactgccaaaacgaactacaatgcacgtggaggtccggtggtaccgtagtgagccctcgactcctgtgttcgtgcatcgagacggcgttgaagttactgaaatgcagatggaggagtatcgcggatgggtggaatggatcgagaatggaatagcaaagggcaacgtcgcactgaagatccacaacattcagcccagtgataacggtcaatattggtgccacttccaggacggaaattattgcggagagacatccctcctgttgaaagtggccgcagtcctgagagacgacattattgcctcccttaaggtgaatgggccaagtcagcctatcttggtgagagtcggcgaggacattcaattaacttgctatctcagcccaaaggcaaatgcgcagagcatggaggtgcgctgggatcggagccacaggtaccctgcagtgcacgtctacatggatggggatcatgtggctggcgaacagatggccgaataccgcggacgcaccgtcctggtaagcgacgcgatagacgaggggaggcttaccctgcagattttgtcagctcggccaagcgatgacgggcagtacaggtgcttatttgagaaagatgacgtttatcaggaagcctctctggatctcaaagttgtgtgggtccttcctcattag

SEQ ID NO: 216393 - DNA, 1167 bp, Artificial Sequence
  Description of Artificial Sequence: Synthetic coding sequence
atggtcgactttccagggtacaacctgagtggtgccgtggccagcttcctctttatactgctgactatgaagcagtccgaagatttcagagtgattggccctgcccaccccattctggccggagtaggagaagacgcactcttaacatgtcagctgctccctaaaagaaccactatgcacgttgaggtacgttggtacagatctgagccctctacacccgttttcgtccaccgtgacggtgtagaagtaacagagatgcagatggaagagtatcgcggttgggtcgagtggatcgagaacggaattgccaaaggaaacgtggcactgaagatacacaacatccaaccttctgacaacggtcagtattggtgtcatttccaggacggaaactactgcggcgagacatctttgctgctcaaggtcgccgaaaaattattggccgttctgtcctcactcaaggtgaacggccctagtcaacccatactcgtacgagttggcgaggatatccagctcacttgctatctgagtcccaaggccaatgcccagagcatggaggttcgttgggataggagccacaggtatcctgccgtgcacgtttatatggacggcgaccacgtcgccggtgagcaaatggccgagtaccggggtcgcacggtcttagtgtcagacgcaatcgacgaggggagactgacattgcagatcctgtccgcaagaccctctgacgacggacagtatagatgtctgtttgagaaagatgacgtgtatcaggaggcgagtcttgatctcaaagtcgtcggcctcgggtccagccctttgatcaccgttgaaggccaggaggatggcgagatgcagccaatgtgcagttcggacggctggtttccgcagcctcatgtgccatggcgggatatggagggcaagactatccctagcagttctcaggccctgacgcagggaagccacgggttatttcacgtgcagacgctgctccgtgtgactaatatctctgctgttgacgtcacttgttctatctctatcccgtttcttggcgaggaaaagatcgccaccttctccctgagcgagtcaaggatgacatttctatggaagaccctgttggtctggggcctgctcctggccgtggccgtgggcctgcctaggaagagaagttag

SEQ ID NO: 216394 - DNA, 1401 bp, Artificial Sequence
  Description of Artificial Sequence: Synthetic coding sequence
atggctttcgtactcatcctcgtgctgagtttctatgaattggtctccggacagtggcaagtgaccgggcctggcaaattcgtccaggctctcgtgggtgaggacgctgtgttttcatgttcactgttccccgaaacctccgctgaagcaatggaagtgcgattcttccggaaccagttccacgccgtcgttcatctgtaccgcgacggtgaggactgggaaagcaagcagatgccgcagtacaggggccgaacagagttcgtgaaggattcaattgcaggcggtcgtgtcagcctgaggttaaagaatattaccccttccgatatcgggctctatggatgctggttttccagccaaatttatgacgaggaggccacctgggaactccgcgtggctgccctggggtccctcccgttgatttccatcgtaggctacgtcgacggtgggatacagctcctgtgccttagctccggctggttccctcagccgacggccaaatggaaagggccacaggggcaggatctcagcagtgatagcagagccaacgcagatggctattctctctatgatgtagaaataagcatcattgtgcaggaaaacgctggctctatcctgtgcagcattcacctggccgagcaatcacatgaagtggagagcaaagtacttattggagagacatttttccaacccagcccatggaggttagcctccattttgctggggttgctctgcggggcactgtgtggtgttgtgatgggtatgataattgtcttcttcaagagcaaaggaaagatacaagcagagctcgattggaggcggaagcatgggcaggccgagttgcgtgacgcgagaaaacatgcagtggaggttacacttgaccctgagaccgcccatcccaagctctgcgtgtccgaccttaaaacggttacacacaggaaagcccctcaggaagtcccgcacagtgaaaaacggtttacccggaaatcggtggtggcgagccaggggtttcaagctggaaagcattactgggaggtggatgttggccagaatgtcgggtggtatgtaggtgtctgtcgcgacgacgttgacagaggaaaaaacaatgtgactctgagtcctaacaatggttactgggtgctgcgcctgaccactgagcatttatacttcacctttaatccacattttatttccctgcccccatctacaccccctacacgggtgggcgtgtttttggactacgaaggtggtacgatctccttttttaacacaaatgaccaatctttgatctataccctcttaacctgccagtttgaggggctgctgagaccatatattcaacatgccatgtacgacgaagagaaaggcacgcctatttttatttgtcctgtaagttggggctag

SEQ ID NO: 216395 - DNA, 1299 bp, Artificial Sequence
  Description of Artificial Sequence: Synthetic coding sequence
atggccttcgtgttaatcttagtgctctcattctatgaattagtctccggccagtggcaggtcacaggcccaggcaagtttgtacaggcccttgtaggggaagatgccgtgtttagctgcagcctgtttccagaaacctctgcagaggcaatggaggtgcggtttttccgcaatcaattccatgctgtggttcacttgtatcgagacggcgaggattgggagagtaaacagatgccacaatataggggacgaacagagttcgtgaaggattccattgccggaggcagagtttcactcaggctgaagaacattacaccatctgacatcggactctatggttgctggttctcctcccagatatacgatgaggaggccacatgggaattgcgcgtggccgctttgggttccctgcctttaatctctattgtgggttacgttgacggcggaattcaactgttgtgcttgtcctccgttcagccatctccctggcgccttgcttcaatcttgctgggattgctatgcggcgctctatgtggagttgtgatgggcatgatcatcgtgttttttaaatctaagggaaaaatccaggccgaactggggatgtgccacgtcctaagcctgccccatatggtcttaccaggcccttccctgattcattcgctgtccctttggacaactctggccgctggatggaccgggtctactgactggaggaggaagcatggtcaggctgaactgagagatgccagaaagcacgccgtggaagtgacacttgatccggagacagctcaccctaaactgtgtgtctccgatctcaaaacagtaacccacaggaaggcccctcaagaggttccacactcagagaaaagatttaccagaaagagtgttgtggcatcacagggttttcaggcaggaaaacattactgggaagttgacgtaggccagaacgtaggctggtacgtcggcgtttgccgggatgatgtggatcgcggaaagaacaacgtcacgcttagtcctaacaacgggtattgggtgttgcgactcactaccgagcacttgtactttacgtttaatcctcacttcattagcctgccaccttctacccccccaacccgggttggagtctttctggactatgagggagggaccatatctttctttaacactaacgatcagtccctgatctatacgctcctgacatgccagtttgagggcctgctgagaccatacatccagcacgcaatgtacgacgaagaaaagggtaccccgattttcatttgtccagtcagctggggttag

SEQ ID NO: 216396 - DNA, 1809 bp, Artificial Sequence
  Description of Artificial Sequence: Synthetic coding sequence
atgcattccaaggtgacaattatttgtatacggttcctgttttggtttctgttgctctgcatgttgataggcaaaagccataccgaagatgacataattattgccacaaagaacggcaaggttagggggatgaatttaactgtgtttggaggaaccgtcaccgcgtttcttggcattccatatgcccagcccccactggggcgactacggttcaaaaagccccagagtctcacgaaatggagcgatatttggaatgccactaagtacgccaacagttgttgccagaacattgaccaaagcttcccaggctttcacggctccgagatgtggaaccctaataccgacctcagcgaggattgcttgtatttgaatgtctggatccccgctccaaagccaaaaaatgccaccgtgcttatctggatctacggaggcggttttcagacaggaacgtcaagcctgcatgtgtatgacggtaaattcctggcacgtgtcgaaagggttattgtagtctccatgaactacagggtcggtgcactgggtttcctcgctctgccagggaatcctgaagccccaggtaatatggggctatttgaccagcaactcgccttgcagtgggtccagaaaaatatcgcggcatttgggggaaatcccaagtctgtgacattgtttggggaatctgccggtgcagcgtcggtctcattacacctgttgtctcccggttctcattcacttttcaccagggcaatactacaaagtgggtcctttaatgcaccctgggccgtgacatccctttatgaagctagaaaccggacgcttaatttggctaagttgacaggctgtagtcgcgagaacgaaacggaaataattaaatgtttgcgaaataaagacccccaggaaattctgctaaacgaggcgtttgtcgtcccttacggcacacccctttctgtgaactttggccctaccgtggacggcgatttcctaactgacatgcctgacatcctgttggaactgggccagttcaaaaaaacccagattctcgtcggagtaaataaggacgaaggcaccgcctttttggtctacggtgcccctggattttccaaggataataattccatcattactagaaaggagtttcaagaggggctgaaaattttcttcccaggggtgagcgaattcgggaaggaatcgatcctgttccattacactgattgggtcgatgatcagcggccagaaaactaccgcgaagcgttgggggacgtagtaggagattataattttatatgtccagctttggagttcaccaaaaaattttcagagtggggtaacaatgccttcttttactattttgaacatagatcatccaaattgccctggcctgagtggatgggcgttatgcatggatacgagatagaatttgttttcgggctaccgctggagagaagggataactacaccaaagcggaggagatcttgtctcgatctattgtgaaaaggtgggccaatttcgcaaaatacggcaaccctaacgagactcagaataatagcacttcttggcctgtctttaagtctacagaacagaaatatttgactttgaatacagagtctacgcggattatgacaaagctgcgcgctcagcagtgtcgtttctggacctcgttcttccctaaggtactggaaatgacagggaacatcgatgaggccgagtgggagtggaaagcgggatttcaccggtggaataactacatgatggactggaaaaatcaattcaatgactatacctctaaaaaagagtcctgcgtcggcctgtag

SEQ ID NO: 216397 - DNA, 399 bp, Artificial Sequence
  Description of Artificial Sequence: Synthetic coding sequence
gcagtgcagttcaccggctggtcgtcatcctgcatcttgcattttcctgaagtgttgcacgatttccacagcctgcagacactgccatcgctgctacagcggattgggaacccaaatgagacacagaataatagcacatcttggccagtcttcaagagtacggagcagaaatacctgaccttaaacacagaatctacaaggatcatgaccaaactgcgggcacagcagtgtcgcttttggactagcttttttccaaaagtattggaaatgaccggaaatatcgacgaggctgaatgggagtggaaggccggattccatcgctggaacaactacatgatggactggaagaatcagttcaacgattacactagcaaaaaggaaagctgtgtagggctgtag

SEQ ID NO: 216398 - DNA, 195 bp, Artificial Sequence
  Description of Artificial Sequence: Synthetic coding sequence
atgaccaagctccgcgctcagcagtgccggttctggactagcttttttccaaaagttctggaaatgaccggtaacatcgacgaagctgaatgggaatggaaagctggattccatcgatggaataactacatgatggattggaagaatcagttcaacgactatacgtccaagaaggaatcttgcgtagggctctag

SEQ ID NO: 216399 - DNA, 1431 bp, Artificial Sequence
  Description of Artificial Sequence: Synthetic coding sequence
atggcaagcagaataggactacgcatgcagttaatgcgggaacaggcccaacaggaggagcagagggaacgtatgcagcagcaggcggtaatgcactacatgcagcagcagcagcagcagcagcagcaacagttgggagggccacctactcctgctattaacaccccagtccatttccagagtccacctccagtgcccggagaggtgctaaaggtgcaatcctacctggagaacccaaccagttatcatttgcagcagtctcaacatcagaaagtgcgggagtatttaagcgagacttatgggaataagttcgctgcccacattagtccggcacaagggtcacctaagcctccgccagctgcctccccaggtgtgcgcgctgggcacgttttaagcagctccgcgggtaattctgccccaaatagcccaatggccatgctgcatatcgggagtaaccccgagcgcgaactggacgacgtcattgacaacatcatgagactggacgacgtcttgggctacattaaccccgaaatgcagatgccaaacacacttcctttatcaagcagccacttgaatgtttattcgtctgatccccaagtcactgccagcttggtgggggttacgtcgagctcgtgtccagctgatctcacccagaaacgggagctgacagatgccgagtcccgcgctctggctaaagaaaggcaaaaaaaggataatcacaacctaatcgagcgtcggaggaggtttaacattaacgatcggattaaagaactgggcatgttgatccccaaagctaacgatctcgatgtgaggtggaataagggcaccattctcaaagcttctgtggactatattaggagaatgcagaaggacctccagaaaagccgtgaactcgagaaccatagcaggcggttggagatgaccaataagcagctgtggctgcgtattcaagagctcgagatgcaagctagggtgcacggcttacctacgacgtccccttcagggatgaacatggctgaactggctcagcaggtggtgaaacaggagctccctagcgaggaggggcctggggaagccttaatgcttggagcagaggttcccgacccagaacctctcccagctctccccccacaggctcctctccccctgccaacccagccacctagcccattccaccatctagacttttcccattctctgagctttggcggtagagaggatgagggtccacctgggtacccagagccactggctcctggacacggatcaccattcccctccctgtcaaagaaagatctcgatctcatgctgctggacgactcactcctgccattggcatccgatccgctgctgtcaacaatgagtccggaggctagcaaagcttccagtaggaggagttctttcagcatggaggagggagatgtattgtag

SEQ ID NO: 216400 - DNA, 426 bp, Artificial Sequence
  Description of Artificial Sequence: Synthetic coding sequence
atggccggtgaagagattaacgaggattatcccgttgagattcatgagtacttgagtgcctttgagaactctatcggtgccgtcgacgagatgctgaaaacaatgatgtccgtgtccagaaacgagttgctccaaaaactagatcccctggaacaagccaaggttgacctggtcagcgcctatacactgaatagcatgttttgggtgtacctggcaacacagggcgtaaatccgaaggaacaccccgtgaaacaagaactcgagcgcattcgcgtgtacatgaatcgcgtaaaggagatcactgataagaaaaaagctggcaagcttgacagaggcgctgcctcccgcttcgtgaagaacgctctgtgggaaccgaaatcaaaaaatgcaagtaaagtcgccaacaagggcaaaagtaagagttag

SEQ ID NO: 216401 - DNA, 543 bp, Artificial Sequence
  Description of Artificial Sequence: Synthetic coding sequence
atgcccagtccttctgtgtcaaccagcgcagccagtgtgctggagggtgtttgcggcagagcccgttctacataccgtactccagaagagggagaagagcagtcgtggagcgccataatggctggcgaggagatcaatgaagattaccccgtggaaattcacgagtacctgtccgcattcgaaaattcgatcggagcagtggacgagatgctgaaaaccatgatgagtgtgtctcgcaatgagcttctgcaaaagctggaccctctggaacaggccaaggtggatctggtgtctgcctacacattaaactctatgttctgggtgtacctcgccacccagggggtaaatccaaaagaacaccctgtcaaacaggaactggagagaatcagggtatatatgaaccgagtcaaagagatcaccgataaaaagaaggcaggcaaactggatcggggtgcagcctcgcgatttgtgaagaacgcattgtgggaacctaagagcaaaaatgcctcaaaagtagcaaataagggaaaaagtaaaagttag

SEQ ID NO: 216402 - DNA, 426 bp, Artificial Sequence
  Description of Artificial Sequence: Synthetic coding sequence
atggccggagaggagatcaacgaagactaccccgtggagatccacgagtatcttagtgcctttgaaaattctattggcgctgtggacgaaatgctgaagacaatgatgtccgtgagcagaaatgaactccttcagaaattagacccactcgaacaagcaaaagtcgatctggtgtcagcctacactcttaattccatgttctgggtttatttagcgactcagggcgtaaaccctaaagaacacccagtcaagcaggagttagagcgaattcgcgtgtacatgaatcgggtgaaggagattacagataagaagaaggctggaaaactggacagaggcgctgcctcccggtttgtgaagaatgctttgtgggagccaaaatccaaaaatgctagcaaagtcgccaataaggggaagtcaaagtcgtag

SEQ ID NO: 216403 - DNA, 426 bp, Artificial Sequence
  Description of Artificial Sequence: Synthetic coding sequence
atggccggagaggagattaacgaggattacccagtggaaatccatgagtatctgagtgcctttgagaacagtattggcgcagtggacgagatgctgaagacgatgatgtcagtgtctcggaacgagttgcttcagaaactcgaccctttggagcaggccaaggtggaccttgtgagcgcatacaccctgaactccatgttctgggtctacctagcaacccagggagttaaccccaaggagcatccagtcaagcaggaacttgagcgaatcagagtctacatgaatagagtcaaagaaattacagataaaaagaaagccggaaagctggacagaggagcagcctctcgatttgtgaagaacgcattatgggagccaaagagcaaaaacgcgtccaaggtcgctaataagggcaagtccaagagctag

SEQ ID NO: 216404 - DNA, 957 bp, Artificial Sequence
  Description of Artificial Sequence: Synthetic coding sequence
atgctgtccgaaagtagctccttccttaaaggtgtcatgctggggtcaattttctgcgcattgatcactatgcttgggcacatacgtatcggccatgggaatcgcatgcaccatcacgagcaccaccatctgcaggccccaaataaggaggacatcttgaaaatctctgaggacgagaggatggagctttcaaagagcttcagagtctattgcataattctggtgaagccaaaggatgtttcgctgtgggcagctgtcaaggagacatggacaaagcactgtgacaaggccgagttcttttcctcagagaacgtcaaggtgttcgagtcgatcaacatggacaccaacgatatgtggctcatgatgcgcaaagcttataagtacgcctttgacaagtatcgagaccagtataactggttcttcctggctcgaccaactacatttgcaattatcgaaaacttaaaatacttcctgctgaaaaaagatccaagccagcctttctacctgggccatacgataaaatccggcgatctggaatacgtgggcatggaagggggaattgtgctgtccgtggaatctatgaaaaggttaaattccctgctaaatattcccgagaagtgcccagagcaaggagggatgatctggaagattagcgaggataaacagcttgccgtgtgtctgaagtatgcgggtgtgtttgctgaaaatgctgaggatgccgacgggaaagacgtgttcaataccaagtctgttggtcttagcattaaggaagctatgacttaccaccctaatcaagtggtggagggatgctgctccgacatggcagtgacgtttaatggcctgactcctaatcagatgcacgtgatgatgtatggggtctatagactgcgggcatttggccacatttttaacgatgcgctcgtattcttgcctcctaacggcagcgataatgactag

SEQ ID NO: 216405 - DNA, 957 bp, Artificial Sequence
  Description of Artificial Sequence: Synthetic coding sequence
atgctgagtgaatcatcctcatttttaaaaggggtaatgctcggatcaatattttgtgccctcataaccatgctaggacacattagaattggtcatggtaaccgcatgcaccatcatgagcaccaccaccttcaggcaccaaataaggaagatatcctaaaaatatctgaggacgagcgcatggagctgtctaagagtttccgcgtttattgcattatactagttaagcccaaagacgtttccctttgggcggctgtcaaagaaacctggacaaagcattgtgataaagctgagttcttttcctcagaaaatgtaaaagtctttgagagcatcaatatggataccaacgatatgtggctgatgatgcgaaaggcctacaaatacgcatttgataagtacagggatcagtataattggtttttcctggcgagacccacaactttcgccataatcgagaatctgaaatactttctgctaaagaaagatccctcccagcccttttacctgggccataccatcaagtccggggatctcgaatacgtaggcatggaaggcggtatcgtcctgtcggtggaatcaatgaaacgcctgaacagtctactcaacatcccagaaaagtgcccggagcaaggaggcatgatctggaagatttccgaagataagcagctggcagtctgcctcaaatatgccggagtctttgcggaaaatgccgaggatgcagatggcaaagatgtgtttaacactaaaagcgtcggcctgtcaattaaagaggccatgacttatcacccgaaccaggttgtcgagggatgctgtagtgacatggccgtgacatttaatggcctgacgccaaatcagatgcatgtaatgatgtacggcgtgtatcgcttgagggccttcggacacatatttaatgacgccctggtgttcctcccccctaacggaagtgacaacgactag

SEQ ID NO: 216406 - DNA, 732 bp, Artificial Sequence
  Description of Artificial Sequence: Synthetic coding sequence
atgcgtccactcttagtgctgcttctgctggggcttgcagctggatcccctccactagacgacaacaaaattccaagcttatgtccaggtcatcccggactacccggaactcctggacaccacgggagtcagggactccccggtagggatggtagagacgggagggacggcgctcctggagctccaggcgagaaaggggaagggggacgccctgggctaccaggacctcgcggtgaccctgggcctagaggggaggccggacccgctgggcctacgggacccgcaggtgaatgctcagttccaccacggtcagccttctccgccaagaggagcgagtcaagagtgccaccaccatcagacgctccactcccctttgatcgagtgctggtgaatgaacaaggccattacgatgccgtcacaggtaaattcacatgtcaggtgccaggggtgtactacttcgcggtgcacgcgactgtgtaccgtgctagcctacaattcgacctggtgaagaacggggaatctattgcctcctttttccaattctttgggggatggccaaagcctgcctctttgtccggcggagcaatggtgaggcttgaacctgaagaccaggtttgggtccaggtcggcgtgggtgattacattggaatttacgcctcgattaagaccgactctacatttagtggctttctcgtgtattccgattggcattcctcgcctgtatttgcctag

SEQ ID NO: 216407 - DNA, 732 bp, Artificial Sequence
  Description of Artificial Sequence: Synthetic coding sequence
atgcggccattgctagttctcctgctgcttggtcttgccgctgggagtccgcctctggatgacaacaaaataccctccctttgtccgggtcacccaggactccccggaactcctggccatcatggctctcaaggtttgcctggcagagacggccgagacgggagggatggggcacctggagcacccggtgaaaaaggtgaaggagggagaccaggcttgcccggtcctaggggcgacccgggaccgaggggggaggcaggaccggctgggccaaccggcccagcaggagagtgttccgtccccccaaggtctgcttttagcgccaagcgctctgagtcacgcgtacctcctccatccgacgctcctctccctttcgatcgcgtgctggtcaatgaacagggacattacgatgccgtgacgggaaagtttacttgccaggtgcctggggtttattactttgcagtccatgcaacggtctacagagcctctcttcagtttgatcttgttaaaaacggagaaagtattgcctccttcttccaattctttgggggttggccgaagcctgccagtctttcaggtggcgctatggtgcggttggaacccgaggatcaagtttgggtgcaggtgggggtgggggattacatcggcatttacgcaagcattaaaacagactctacttttagtgggttcctggtgtacagcgactggcatagtagccctgtctttgcctag

SEQ ID NO: 216408 - DNA, 759 bp, Artificial Sequence
  Description of Artificial Sequence: Synthetic coding sequence
atggctgcccctgccctgctgctattagcactgctcttgccagtgggtgcgtggccagggctgcccagacggccttgtgtacactgttgtcgcccagcttggccacccggaccttatgccagggtctcagatcgggacctctggcgcggagacctgtggcgaggactgccaagagttagacccactattgatattgagattctgaaaggcgaaaaaggcgaggcaggcgtgaggggcagagctgggaggagcgggaaagagggccctccgggtgccagaggtctacagggtaggcggggtcagaaggggcaggtcgggcctccgggagctgcttgcagacgtgcttatgccgctttttctgtgggcaggcgtgaagggctccactcatcagatcacttccaggcagtcccctttgatacagagttggtcaatctggatggggctttcgacctggcagccggtaggttcttgtgcaccgtcccgggagtgtattttctgtctctaaacgtgcacacctggaattacaaggagacatatctgcacatcatgctgaatcggcgacctgccgcagtgctgtacgcccagcctagtgagagaagcgtgatgcaggcacagtctctgatgctgctcctcgctgctggagatgccgtttgggtacgcatgtttcagcgggatcgggacaacgccatttacggcgaacatggagacctatatatcacttttagtggtcacctcgtgaagcctgctgccgagctctag

SEQ ID NO: 216409 - DNA, 1002 bp, Artificial Sequence
  Description of Artificial Sequence: Synthetic coding sequence
atgcggatttggtggttgctcctagcgattgagatctgcactggcaacatcaactcacaggacacgtgtagacaaggccaccctggaatccccggaaatccgggacacaacggattgccgggtcgcgacggccgtgatggtgcgaagggagataaaggagacgccggagaaccgggacggcctgggagcccaggcaaggatggaacgtccggcgaaaaaggagagcgtggtgccgatgggaaggtggaagctaaaggcataaagggggaccagggaagccgtggtagccccggaaaacatggaccgaaaggacttgcaggcccaatgggagaaaagggccttcgaggggagactggaccacagggccaaaaaggcaataagggtgacgtcggacctaccgggcctgaggggcctagaggcaacattggtcccctcgggccaactggcctgcccggaccaatgggaccgattggaaagccaggaccgaagggggaggccggacctactggaccccaaggcgagcccggagtgagaggtatccggggatggaaaggcgaccgcggtgagaaaggcaaaatcggagagaccttagtgctcccaaagtccgcttttacagttgggctaacagttctgtctaagttcccatccagcgacatgccgatcaaatttgataaaatcctctacaatgaatttaatcattacgacactgctgccggaaagttcacttgtcacatcgcaggggtgtactacttcacctatcatattaccgtgttttcgcggaatgtgcaggtgtcgctcgtgaaaaacggggtcaaaatcctccacacaaaggatgcttatatgtcctccgaagaccaggcaagtgggggaatcgtgctgcagcttaagctgggtgatgaggtctggctccaggtaactggcggtgaacgttttaacggcttattcgcagatgaggatgacgacaccactttcacggggtttcttttattctccagcccatag

SEQ ID NO: 216410 - DNA, 1002 bp, Artificial Sequence
  Description of Artificial Sequence: Synthetic coding sequence
atgcgtatctggtggctgctcctcgctatagagatctgcaccggtaacatcaactctcaagatacctgcaggcagggacaccccggtatcccagggaaccctggtcataacggattacccggacgcgatggaagagacggcgcaaagggcgataaaggagatgccggtgagcctggccgaccaggctctcccggtaaggacgggacctcaggagaaaagggggagcggggagccgacggcaaggttgaggcgaaggggatcaaaggtgatcagggctccagaggaagccctggcaagcacgggcctaaaggactcgccggtcccatgggcgagaagggcctgcggggagaaaccggccctcaggggcagaaggggaataagggcgatgtggggccaaccggccctgagggacccagggggaacatcggcccactgggccctactgggttgcctgggcctatgggcccaataggtaaaccaggtcccaagggcgaggcgggtccaaccgggccacagggagagcctggagtacgcggaatcaggggatggaaaggggaccggggtgaaaagggcaaaattggcgagacgttggtgctgccgaagagtgcctttactgtggggctcactgtgttaagcaaatttcccagctccgacatgcctattaagtttgataagatactctataacgagttcaatcactatgacaccgccgctggaaagtttacctgccacattgccggtgtgtattattttacttatcacattacagtctttagcagaaatgtgcaggtgagcctggtgaaaaatggggtgaagatacttcacacaaaggacgcttatatgtcttccgaggatcaggcaagcggcggaatcgtgctccagctgaagctgggggacgaggtctggctccaggttacaggcggagagcgattcaatggactgttcgccgatgaggacgacgataccacctttacaggttttctgctgttttccagcccatag

SEQ ID NO: 216411 - DNA, 300 bp, Artificial Sequence
  Description of Artificial Sequence: Synthetic coding sequence
atgaggatctggtggctgcttctggctatagaaatttgtactggcaacataaatagtcaggatacttgtcggcagggccacccgggtatcccaggcaatccagggcacaatgggctgcctgggagagatggtagggacggagcaaaaggagataaaggggacgcaggcgaacccggatgccctggcagccccggaaaggacggcaccagcggggagaagggcgaacgtggcgcagacggtaaagtcgaagctaaagggatcaagggcatgttccgttgtctctggtcaaagaccgaatag

SEQ ID NO: 216412 - DNA, 1002 bp, Artificial Sequence
  Description of Artificial Sequence: Synthetic coding sequence
atgagaatctggtggctgctcctggcgattgagatatgtaccggaaatatcaattctcaggatacttgccgtcagggccaccccggaattccaggaaatcccggacataacgggctgcctgggagagatgggcgtgatggcgcaaaaggtgataagggcgacgctggtgaacctggctgccccggatctcccggtaaagatggtacttcaggggaaaagggtgagaggggggctgacggaaaagttgaggcaaagggcattaaaggcgatcaggggagcagagggtctccaggaaagcacgggcctaaaggactggcgggaccaatgggagaaaagggcctgcgtggtgaaacaggtcctcaagggcagaagggcaacaaaggagatgtgggcccaacagggccagaagggcctcggggtaacattgggccactcggccctacagggctgccgggacccatgggccctatcgggaaacctggacctaagggcgaggcgggacctaccgggcctcagggcgagccaggcgtgagaggaatcagagggtggaaaggcgatagaggagagaaaggaaaaatcggagagactctagtactgccaaagagcgcctttacagtcgggctaacagtgctcagcaagtttccatccagcgacgtcccaatcaaattcgacaagatcctgtacaacgaatttaatcactatgacacagctgtcggaaagttcacttgccatattgcaggggtatattatttcacatatcatataaccgtctttagcaggaatgttcaggtcagtctggttaaaaacggcgtgaagattctgcacacaagggatgcttacgttagctctgaggaccaggcatccggttcaatcgtccttcagttaaagttgggggatgagatgtggttacaggtgaccgggggagaaaggtttaatggattgttcgcagacgaagatgacgacactacattcaccggattccttctgttctcaagtcaatag

SEQ ID NO: 216413 - DNA, 1002 bp, Artificial Sequence
  Description of Artificial Sequence: Synthetic coding sequence
atgcgaatatggtggcttctccttgcaattgagatctgcaccggaaatattaatagtcaggatacctgcagacaggggcaccctgggatacccggtaaccccggtcacaacgggcttcccggacgggatggtcgtgatggggcaaaaggcgataagggggatgccggtgaacctggctgcccaggatcaccaggcaaggacgggacttcaggcgaaaagggcgaacggggtgcagatggcaaggtggaagccaagggaataaagggggatcaaggcagccggggatcacccggaaaacatggtccaaaaggactggccggacctatgggggagaaaggcttgagaggagagactggaccacaagggcaaaaaggcaacaaaggggatgttgggcctacagggccagaggggccaaggggaaatattggcccattgggtcctactggcttgcctggccctatgggccctatcgggaaaccaggtcccaaaggtgaagcaggacctactggtcctcagggggagccaggcgtcaggggcattcgtgggtggaaaggcgaccgtggagagaagggaaaaataggcgaaaccctcgttcttccaaagtcagcctttaccgtgggcttaacggtgttgtctaaatttcccagtagcgatgtgccaatcaaatttgataaaatcctgtacaatgaattcaaccattatgacaccgctgtcgggaaattcacatgtcacatcgctggcgtctattattttacataccatattaccgtgttctctcgaaatgtgcaagtgagcctcgtcaaaaacggagtgaagattttgcacactcgcgacgcctatgtcagctcagaggatcaagcttccggcagcattgtgctccagctcaagttgggtgacgagatgtggctacaagtgacgggaggagagcgctttaatggcttgttcgctgatgaggacgatgataccactttcaccggttttctcctattctcgtcacagtag

SEQ ID NO: 216414 - DNA, 150 bp, Artificial Sequence
  Description of Artificial Sequence: Synthetic coding sequence
gtaggccctacaggcccagaaggccctcgaggcaatatcggcccactggggcctactgggctgcccggacctatggggcctattgggaagcctggccctaaaggagaagctggtcctaccggacctcaggtgttccccttctgcatctag

SEQ ID NO: 216415 - DNA, 1110 bp, Artificial Sequence
  Description of Artificial Sequence: Synthetic coding sequence
atgtggtgtctggaacggttaagactgggccctgaatgtctgagacgctctggtgattggttattacccggacgagccaggggcgctaaatcccgcacaacagccgcttgcgccaacgtgctgacacccgatcgcatcccagagttttgcatcccgccaagacttatgccccgactggccctggctgccctacgaaacagctgggtagaggaggctggaatggacgaaggggcaggcagaacggattgggaccctagatcccaggcagccctttctctgccacacctgccacgcgtgagaaccgcctatggattctgtgcccttctggagagcccccatacacgccgaaaagaaagcctgctgctcgggggtcctccagctcctcgaccacgggcacacacttatgggggtggcggtggacctgatgcacttctaggtacactgcgcgtgcccagggctcctggtcctgccacacccgctgccccaggctgccctcggccaccccaagatgccctggctaggcgccctcggggttgtaggctgctccgtgtgccagatggtctgctaagtcgcgctctgagggcaggtcgctcccgcaggctgacacgggtgaggtcggtatcttcaggcaacgaggacaaggaacggagggctggaagtcagagtcctgccagagcaccctctaccagccccccttcctcccgagtgccatttcctgagcgtctggaggctgagggcaccgtggccctgggacgagccggtgatgcactacggctagccgctgaatattgccccggtaccggacgtctgcgtttaagactgcttcgggctgagtccccagccggaggcgcaccaggtcctagggccgtgtcctgcaggttgtccctggtgttgcgacccccaggtacggctcttagacagtgctcaaccgtcgtcggaagatctcggaaggcctccttcgatcaagatttttgttttgatggactctccgaggatgaagtccgccgactggcggtgagagttaaggcacgggatgagggcaggggaagggaaaggggtcgcctgctcggccagggggagttatcactaggagcccttcttttactgtag

SEQ ID NO: 216416 - DNA, 1095 bp, Artificial Sequence
  Description of Artificial Sequence: Synthetic coding sequence
atgcgacttctggaaaaactttgtagttcagcagcgggttccagcgcaccaaaacccgctttcgcaaaggtgttgactccaaaccgcattccggaattctgcatccctcccaggctgcctgccccatgcacccttgaaagccccattagggcggctgccgtacctaggcgatgcgcagccgaatcagatttgtggcctagagccgcagacgaggacgcaggcagaactgactgggatcctagatcacaagccgcactgagcctacctcacctgcctagggtgagaacaacctatgggttttgcgccctgctggagtccccccacacccgcaggaaagaatcacttttactgggcggacccccagctcctagacctcgggctcacagctgcgggggtggtgggggacctgacgccccactgggaactttatgcggaccacggggtccaggacccgctacaccagccgcaccaggaggaccccgactgccccaggatgcactggcagctgggcctagacgctgcagactattgagagtgccagatgggctcctgtccagagcactcagggctggacgtagccgacggctcgctcgcgtcagatccgtgtcttccggcaatgaagacgaggaaagaagggctgggagcgagtctccagccagagcgccatcaagttctcccttgagtagcagagccccacttccagaacgattggaagctaaggggactgtggccctcggcagggctggcgacgcgttacgactggctgcagagtactgcccgggaacgcgcaggctgaggcttagactgctgagggccgagtcattgttcggaggcgcacccggacctcgggcagtgcggtgccgactttctctggtcctgcgcccaccaggtacagcccgatggcagtgcagcgccgtcgtagggcgtagtcgcaaagcctccttcgaccaagacttttgttttgacggactgagcgaagacgaggtgaggcgactggccgtgagagtgaaggccagggatgagggaagggggagggaccggggtagactgctgggccaaggagagctcagcttaggcgctcttctcttgctttag

SEQ ID NO: 216417 - DNA, 1266 bp, Artificial Sequence
  Description of Artificial Sequence: Synthetic coding sequence
atgagaaaaaccaacatgtggttcttggagagactgagaggatccggcgaaaatggcgcagcaaggggcgtgggctccgaagccggagataaggctagcaaggggccactgtatagcaacgtgttaactcccgataagatccctgacttttttatcccacccaaactacctagcggaccggctgagggcgagggacaagcagctctcgggccaagcacctccgaacagaacctcgctagtgccgcaccacggcaaacacctagatctcctcgattgcctgctaagcttgccgcagagtctaagagcctacttaaagccgcaacgagacatgtaattcagattgagtccgccgaggactggctgtcagaggaggctaccgacgcagatcctcaagctcagggcgcaatgtccctgccatccgtgccgaaagcccaaacgtcatatggatttgccatgctggccgaatctcctcatactagaaggaaggagtctttatttcactctgaacatggagcactggctcaagtggggtcccccggtgctggaagaagaagggctgcagcaaaggccaacggcggtgacgggggaccccgagaagcgggtggtgctctgatgagtcctggccgttatttttcagggggtgagtctgacactgggtccagcgctgaaagcagcccctttgggtctcccctcctgtcaagaagtgtgagtttgctcaaaggatttgcccaggattctcaagcaaaggtgtcacagctaagacattccgtgggcaggcacgggagcctcagcgcggacgatagcactcccgatgcctcccctggatcacgccgacggctcacccgcagagcccctccagagccaggacccgagagtgggcaggctcgtggtgaacataccgtccacgtcggcccaaggggttccgtgagactgctggcggaatatgaagccggtcaggcccgactcagagtccatttgctggcggctgaaggcttatacgacagactgtgtgacgctcggtccattaactgctgtgttgggctgtgtctcgttcctggcaagttacaaaagcagcgcagcaccatcgtgaaaaattcccggagacccgtgtttaacgaggatttcttctttgatggcctcggccctgcctccgtgaggaaattagctctgcgcattaaggttgtgaataagggcagttctctgaaaagagataccctcttaggagaaaaggagttgccattaacatccctgctcccatttctgtag

SEQ ID NO: 216418 - DNA, 3945 bp, Artificial Sequence
  Description of Artificial Sequence: Synthetic coding sequence
atgttggacccgagttcaagtgaggaagagtcagacgagatagtagaggaggagtcagggaaggaagtgctagggtcagccccttctggggcacgattaagcccgagtaggaccagcgaagggtccgctggctctgctgggctgggcggtggcggtgccggagcaggtgccggagtcggggctggaggtggagggggatccggagcctcttccgggggtggggctggaggactgcaaccctcgtcccgggcaggcggagggaggccatcttccccttccccgagcgtggtgtccgagaaggagaaggaggagttggagcgtctccagaaagaggaggaagaaaggaagaagcgacttcaactgtatgtatttgtcatgagatgtattgcatatcctttcaatgcaaagcagcccaccgatatggcccgtcgacagcaaaagatttccaagcagcagctccagaccgtgaaggacagatttcaagccttcctgaatggtgagacccagattatggccgacgaagccttcatgaacgcagtacaatcctactatgaggtgtttctcaagtcagatagagtcgcgcgtatggtgcagtcaggaggctgctccgccaacgacagtagggaggtgttcaaaaaacacattgagaagagagtcagatcactgcctgagatcgacggcttgtcaaaggagacagtgttgtcttcatggatggccaaatttgacgccatctatcggggtgaagaggatccaaggaagcaacaggcaagaatgaccgctagtgcagccagcgagttgatcctgtctaaggagcagctctatgagatgttccagaacatcctggggattaaaaaatttgagcaccagttactgtacaatgcctgtcaactcgacaaccccgacgaacaggccgctcagatcaggcgtgagctggacggcagactgcagatggccgaccaaatcgcgagagagcgtaaatttcctaaattcgtaagcaaagagatggagaatatgtatatcgaggagcttaaaagtagcgtgaacctgctgatggcaaacctcgagagtatgcctgtcagtaagggaggggagtttaagttgcagaagctgaaaaggagtcacaacgcttctataattgacatgggcgaggaatcagaaaaccagctttcaaagtccgacgtcgtcttatcattttcacttgaggtagtgatcatggaagtacagggactcaagtcactggcacccaacagaatcgtatactgtaccatggaagtagaaggcggagaaaaactgcagactgatcaggcagaggcatctaaaccaacttggggaactcagggtgacttttctacgactcatgccctaccggctgtcaaagtgaaacttttcacggagagcacaggcgtgctggctctggaagataaagaactgggtcgcgtgatcctgcatccaactcctaatagtccgaagcagtctgagtggcacaaaatgacagtaagtaagaattgcccagaccaggacttgaaaataaaactagccgtacgtatggacaaaccacagaacatgaaacacagcgggtacctctgggccatcgggaaaaacgtgtggaagcgctggaaaaaacgttttttcgttctcgtgcaggtgtcccaatacacgtttgccatgtgctcctaccgcgagaagaaggccgagcctcaggagctactacagctagacggctataccgtcgattacactgacccccagcccggactcgaagggggaagagctttctttaatgccgttaaggaaggagacaccgtcatctttgcctccgacgacgaacaggatcgtattctgtgggtgcaggctatgtaccgggcaaccggacagtcccacaagcccgtgcctccaactcaggtgcagaaactcaatgccaagggaggaaatgtgccccagctggacgccccaatctcacagttctacgcggaccgggcacagaagcatggtatggatgaatttatctcttccaacccttgcaattttgaccacgcctcacttttcgagatggttcagcggctcacacttgaccatcgactgaacgattcttatagctgtttaggatggttttctccagggcaggtgttcgtccttgacgaatactgtgcaaggaacggggtgcggggatgtcacagacacctgtgttaccttcgggacctgttggagagagcagagaacggagctatgatcgatcccacactcctgcactattctttcgccttctgtgccagccacgtgcatggaaataggcccgatggcatcggcacagtcactgtggaagaaaaggaaaggttcgaagaaattaaggagcggctgcgggtcctgctggagaaccagataacgcatttccgctactgtttcccgttcgggaggcccgaaggggctcttaaagcgacactttcactcctggaaagagtcctcatgaaggacattgtcacacccgtccctcaggaggaagtaaaaacagtaattcggaaatgccttgagcaagctgctttggtcaattatagtcgcctgagcgagtatgccaaaatcgaagggaaaaagagggagatgtacgagcatccagtattctgcttagcttctcaggtcatggacctgacaatacagaatgtgggcaggcttatcactccagcgaaaaagctggaagataccatccgattggctgagttagtgatcgaagtgctgcagcagaatgaggagcatcatgctgaagcctttgcctggtggagcgacttgatggtggaacatgccgagacatttcttagtttgttcgctgtggatatggatgcggctctagaagttcagcccccagatacttgggattcctttccactattccagctgctgaatgactttctgcgcactgattataacctctgtaatggaaaattccacaagcatttgcaggatctttttgctccattagtggtgagatatgtcgacctgatggagtctagcatcgcccagtctattcatagaggttttgagcgagaaagctgggaaccagtgaacaacggtagcgggacctccgaagatcttttctggaaattagatgctctgcagacttttataagagaccttcactggcccgaagaagaattcggtaaacatctagaacaacgactcaaactgatggccagtgatatgatcgaatcttgcgttaagcgcacccgcatcgcttttgaggtgaaactgcagaagacgtcccgctctaccgatttccgggtcccccaatctatctgcacaatgttcaacgttatggttgatgctaaagcccagagcacaaagctttgcagcatggagatgggccaggagcaccagtaccattcaaaaatcgacgaactgatagaggagaccgtgaaagaaatgataaccctgttggtagccaagttcgtgacaattctggagggagtcctggctaaactctcgcggtatgatgaggggacgctcttttctagctttctctctttcactgtgaaagccgctagtaaatacgtcgacgtccccaagcctggaatggatgtggccgatgcgtatgtgacattcgtgcggcacagccaggacgtactaagagacaaggtcaatgaggaaatgtacatcgaacgcctgttcgatcagtggtacaattcctcaatgaacgttatctgtacgtggttaacagacaggatggacttgcagctgcacatctaccaacttaagacgttaatcaggatggttaaaaaaacctatcgggacttccgcctacagggggtgcttgatagtaccttgaacagtaaaacatatgagacgatccgcaatcggctgaccgtggaagaggccactgcctcagtaagcgagggcggaggactgcagggcatcagtatgaaggattcagacgaggaagacgaggaggacgactag

SEQ ID NO: 216419 - DNA, 3825 bp, Artificial Sequence
  Description of Artificial Sequence: Synthetic coding sequence
atgctggatcccagtagctcggaggaggaaagcgacgagatcgttgaagaagagtccgggaaagaggtcctggggtccgccccttctggcgcacgactgagcccgagtcgtactagcgagggcagcgctggttctgccggattaggagggggtggcgcaggggcaggtgcgggtgtaggcgctggtggaggcggagggagtggtgccagttccggaggaggtgccggtgggctgcaaccaagctcccgggcaggcggtgggagaccctcaagccccagtccttcggtggtcagcgaaaaggaaaaagaggagcttgaacgactgcaaaaagaggaggaggaacggaaaaaaagattgcaactgtacgtgtttgtgatgagatgtattgcttaccccttcaacgcaaagcaacctaccgacatggcacgcagacagcagaaaatctcaaagcagcagctacaaactgtgaaggacaggtttcaggcttttctgaatggagaaacgcaaataatggccgatgaggccttcatgaatgccgtgcagtcctattacgaggtgtttctgaaatccgacagagttgcacgtatggttcaatcaggcggatgctctgccaacgactcccgcgaggtatttaaaaagcacattgaaaaacgggtgcggagccttcctgagattgacggtctgtctaaagagactgttctctcctcctggatggccaagttcgacgcgatctatcggggtgaagaggacccaagaaagcagcaggccaggatgactgcctctgcagcaagcgagctgatccttagcaaagagcagctctacgagatgtttcagaacattctgggcattaaaaagttcgagcaccagctgttatacaatgcctgtcaactggacaacccagatgagcaggccgctcagatcagaagggagctggacggacggctccagatggcggaccagatcgcgcgagagcgtaagtttcctaagttcgtttcaaaggagatggaaaatatgtacattgaggagctgaaatcttcagttaacctactgatggccaatctggagtcaatgcctgtaagcaagggcggagagtttaaactccagaaattgaagaggagccacaacgcgtcaattattgacatgggcgaagagtcagagaatcagctatccaagtcagatgtggttctcagtttctccctggaggtcgtcattatggaggtacaaggcctcaagtccctcgcccctaaccggatcgtttattgtaccatggaagttgagggcggagagaaactccagaccgaccaggccgaggcaagcaagcctacctgggggacacagggggattttagcaccacccacgcgcttcccgcagtgaaagtgaaactcttcacggagagcactggtgtgctcgccctggaggacaaggagctcggtcgagtaattttacatcccacccctaactcacctaagcagtctgagtggcacaagatgactgtgtccaaaaattgtccagaccaggacttgaaaataaagctcgcggtccgcatggacaagccacagaatatgaagcattctgggtacctatgggctattggaaaaaatgtgtggaagcgttggaagaagaggttttttgtgcttgtccaagtttcacagtacacctttgccatgtgctcttacagagagaagaaagccgagccccaggagctgttgcaacttgacgggtacaccgtcgattacactgacccacagcctggcttggagggagggagggcattcttcaatgccgtgaaagagggtgataccgtaatttttgcatccgatgacgagcaagacaggatcctgtgggttcaagctatgtaccgggctacgggtcagtcccataagcccgttcccccaacacaagtccagaagctgaatgccaaagggggtaacgtcccacagctagacgctccgatttctcagttctacgccgatcgggctcagaaacacgggatggatgaattcattagttcaaacccctgtaattttgaccatgctagtctgttcgagatgggctggttttccccaggtcaggttttcgtactggatgagtactgtgctaggaatggtgtgcgcggatgtcatcgccacttgtgttacctgcgggatctcctggaacgtgcagagaatggtgccatgatcgatcctacacttttgcattattcttttgccttctgtgcaagccacgtccacggtaatcggccagacggcatcggtacggttaccgtggaagagaaagaacgttttgaagagatcaaggaaaggttacgggtcttactcgaaaatcagattacacactttcgctactgtttcccctttggtagacctgagggcgcacttaaggccactttgtctttgcttgaaagagtgttgatgaaagacatcgtcactcccgtcccccaggaggaagtaaagacagtgattcgcaagtgcctggaacaagctgctctggtgaactattccaggttgagtgaatacgccaagatcgaggaaaacgtaggcagattgatcacacctgctaagaaattagaggacaccattagactggcagagttggtgattgaggttctccagcagaatgaagagcaccatgctgaagccttcgcctggtggtctgacctcatggtagagcatgccgaaactttcctgtcactgttcgctgtggatatggatgccgcactcgaagtacagccccctgacacttgggatagttttcctctctttcagcttcttaacgattttctacgcaccgactacaacctgtgcaatggcaagtttcacaagcatctacaggacctctttgcccctcttgtggtgcgttacgtagaccttatggaatcaagtattgcgcaatctattcacagaggattcgagcgggagtcatgggaacctgtcaataacggatccgggacctctgaggacctgttctggaaactcgacgccctgcagaccttcataagagatctacactggccggaggaggagttcgggaagcatctcgaacaaagattaaagctgatggcatccgatatgatagaaagctgcgttaagcggacgagaatagcgtttgaggtcaaactccagaagacatcccgaagcaccgattttagagtccctcaaagcatttgtactatgtttaatgttatggtggacgccaaagcccagtctacaaaattgtgtagcatggagatgggccaggaacatcagtatcattctaagatcgacgagctcatcgaggagactgtgaaggagatgataaccctgcttgtggccaaatttgtaacaattctcgaaggagttctcgcgaaactcagccgatacgacgagggaaccctcttctcaagcttcctctcatttacggtaaaggctgcttctaagtacgtggacgtcccgaagcctggcatggatgtcgccgatgcttatgtaactttcgtgcgacactcccaggatgtattgcgggacaaggtgaatgaggagatgtatatagagaggctctttgatcagtggtacaatagttctatgaacgttatctgcacgtggctcaccgatcggatggaccttcagctgcacatataccagctgaaaacgcttatcagaatggtcaagaagacttaccgggatttcagactccagggtgtgctggactcgactctcaacagtaagacttacgagactatcaggaatcggttaacggtggaggaggctaccgcctctgtttctgagggcggtggccttcagggcatttctatgaaggatagcgacgaagaggatgaggaggacgattag

SEQ ID NO: 216420 - DNA, 4080 bp, Artificial Sequence
  Description of Artificial Sequence: Synthetic coding sequence
atgctggacccctcctcgtccgaggaggaatcagatgaaatcgtggaagaggaaagcggcaaggaggtgctggggtctgcaccatctggagcacggctgagcccatcccgtacctctgagggatctgccggaagcgccggtcttggcggagggggagcaggcgctggagctggcgtgggtgcaggcggaggaggcggttccggtgccagcagcgggggtggcgctggagggctgcagccttcctcccgcgctggcggagggaggccgagttcgccatccccttcagttgtttcagaaaaggagaaggaggaacttgaaagattgcagaaggaggaagaggagcgtaagaagcgcctgcaactgtacgtgttcgtcatgaggtgtattgcttacccattcaacgccaaacagcccacagacatggccagaaggcagcagaagattagcaagcagcagctgcagaccgtgaaggatcgattccaggcgttcctcaatggcgaaacccagatcatggcggatgaggctttcatgaatgctgtccaatcgtactacgaggtattcttgaaatccgatagagtggctcggatggtgcagagtggcggatgttcagcgaacgattctagggaggtattcaaaaaacatatcgagaaaagggtacggagcctcccagagatcgacggactcagtaaagaaactgttttgtcaagctggatggcaaagtttgatgccatatataggggagaagaggaccccagaaagcagcaggctcgtatgacagcctccgcagccagcgagctgatcctgagcaaagaacagctgtatgagatgttccagaatattttaggaattaaaaagttcgaacatcagctgctctacaacgcttgccagttggacaaccctgacgaacaggctgcccaaattagaagggagcttgacggcagactgcaaatggcagatcagatcgcacgcgaaaggaagttcccgaagtttgtgtccaaagaaatggagaatatgtacatcgaggaacttaagagcagcgtaaacttactgatggccaatctggagtctatgccagtgagcaagggcggagagtttaaactgcaaaaacttaagcggagccataatgcgtctatcatcgatatgggcgaggagtctgagaaccaactgagtaaaagcgatgtggtactgtctttctccctagaagtggtcattatggaagtgcaggggctgaagagcctggccccaaatcggattgtctactgtactatggaagttgagggcggagaaaaactgcaaaccgaccaggccgaggcgtccaaaccgacatgggggacccagggcgatttctctacaactcatgcattgccggctgtcaaagttaagttgttcacagaatcaactggagtcttggctctagaagataaagagttagggagagtcatcctgcaccctacgcctaatagccccaagcagtcggagtggcataagatgactgtctccaagaactgccctgatcaggatctgaagatcaagttggccgtcagaatggataaaccgcagaacatgaagcacagcggctatctttgggcgattggcaagaacgtttggaaacggtggaagaagcggtttttcgtgctcgtgcaagtcagccagtacactttcgctatgtgttcttatcgggagaaaaaagcagagcctcaggagctgctccagcttgacggatacaccgttgattacacagatcctcaaccgggacttgaagggggtcgtgctttttttaacgcggtcaaagagggcgataccgtcattttcgccagcgacgatgagcaggataggattctgtgggtgcaggccatgtacagggcgaccggccagtctcataagcccgtcccacctacgcaggtgcaaaaactgaatgcgaaaggaggaaacgttcctcagctggatgcaccgatcagtcaattttatgccgaccgggcacagaagcacggcatggacgagtttatcagcagcaacccatgtaatttcgatcacgcttctctcttcgaaatggtgcaaaggctgaccctggatcataggctaaacgactcttactcgtgtcttggttggttcagtcctggccaggtgtttgttctagacgagtactgtgcaagaaatggagtccgaggctgtcatcggcacctgtgctaccttcgcgatcttctagagagggcagaaaacggggcaatgattgatcccacccttcttcactacagttttgccttttgcgcctctcatgtgcatggcaaccgacccgatggcattgggactgtcaccgtcgaagagaaggagagattcgaagagatcaaagagaggctgcgcgtattgttggagaatcagattactcacttccggtactgttttccattcgggcgtcccgaaggagctctcaaagccacactgtcactgctggaacgtgttctgatgaaagatattgtgacaccagttccccaagaagaggtgaaaactgttatccgaaaatgccttgagcaggccgcattggttaattactccaggctatccgaatacgccaaaattgaggcaaactcttgcactacagaaaatgtcggtaggctgatcactcccgctaagaaactggaggacactattagactcgccgagctagtgatcgaggtgctccagcaaaacgaggagcaccatgcagagcctcatgtcgacaaaggagaagcatttgcttggtggagtgacctgatggtcgaacacgccgagacctttctctcactcttcgccgtggatatggacgctgcactggaagtgcaaccacccgatacatgggacagttttcccctgtttcagctacttaatgatttccttcggacagattataatctgtgcaacggcaaatttcataaacacttacaggacttgtttgccccactggttgtgcgctacgtcgatctgatggagagctccatcgcacaatcaattcaccggggattcgagcgcgagtcttgggagccagttaagagtttgacatccaacctgccgaatgttaacttacctaatgtcaatctgccaaaagtgcctaacttacccgtcaacattcccctaggtattccacaaatgccaacattttcagcccctagctggatggctgccatttatgatgcagacaatggtagtggtacctctgaggacttattctggaagttagatgctttgcagacgttcatccgagaccttcattggcctgaggaggagtttggaaagcatctcgaacagcggctaaaacttatggcatccgatatgatcgagtcctgcgtaaaacgcactcgtatcgcattcgaagtgaaactgcagaaaacatcgcggtccactgattttcgggtgcctcagtccatttgcacgatgttcaacgtgatggttgacgcaaaggcccaatctaccaagctttgttctatggagatggggcaggaaaagtacaagaaaatgaggcatcagtaccatagcaagattgacgagctcatcgaggagactgtgaaagagatgatcacattactggttgctaaatttgtaactatattagagggagttttagcaaaactctcaagatatgacgaaggaaccctattctcctccttcctgtcatttactgtgaaggcagccagcaaatatgtggacgtgcctaagccaggcatggatgtggccgacgcttacgttacgttcgttaggcacagccaggatgttctccgggataaagtgaacgaggaaatgtatattgagcggttgttcgaccaatggtacaacagcagtatgaatgtcatctgcacatggctcaccgaccgtatggaccttcaactccacatttatcagttgaagacactaattcggatggtcaagaaaacttaccgcgactttaggctgcagggtgtattagactctacactgaactcaaaaacttacgaaaccattcgtaacaggttgaccgtagaggaagccaccgcttccgtctcggagggcggtggcctccagggcatttcgatgaaagactcagacgaggaggatgaggaagatgactag

SEQ ID NO: 216421 - DNA, 4062 bp, Artificial Sequence
  Description of Artificial Sequence: Synthetic coding sequence
atgttggacccatcatcttcagaagaagaaagcgacgagattgtggaggaagaaagcgggaaggaggttttgggaagtgctccttccggagcaaggttaagtccttcccgcacctccgaaggcagtgcagggtctgctggactgggcggaggaggagcgggtgcgggtgccggtgtgggtgccggtgggggtggaggcagtggtgcaagttcaggaggtggagctggcggtctgcagccttctagtcgggcaggcggtggcagaccgtcatcaccgagtcctagcgtcgtaagcgagaaggagaaggaggaattagagagattacagaaagaagaggaggaaagaaaaaaaaggctgcagctttacgtatttgttatgcgttgtatcgcatatccgttcaacgccaaacagccaacggatatggcacgaaggcagcagaaaatcagtaaacagcagctgcaaaccgttaaagacagattccaggcttttctaaatggagaaacacaaatcatggccgacgaagcttttatgaacgcagttcagagctactacgaagtgtttctgaagtccgaccgagtggctcgcatggtacaatccggcggatgctccgctaatgatagccgggaggtcttcaagaagcacatcgagaagcgtgtgagaagtttaccagagattgacggtctctcgaaagagactgtgcttagctcctggatggccaagtttgatgcaatttacagaggtgaggaagatccccgaaagcagcaggccagaatgacagcttctgctgctagtgagcttatactgtcaaaggaacagctttacgagatgtttcagaacatcctgggcattaaaaagtttgagcatcagttactgtacaacgcttgccagctggacaaccctgacgagcaggccgctcagatccgacgagagctcgacgggaggctccagatggctgatcagattgcccgtgagaggaagtttcctaaatttgttagtaaagagatggaaaacatgtacatcgaggagctgaagagttccgtcaatttactcatggctaatttggaatctatgccagtgtctaaaggtggagaatttaaactccaaaaacttaagcgctcccacaacgcttcaatcattgatatgggggaagaaagcgagaatcagttgagcaagagcgacgtggttctgtcgttttccctggaagtggtgataatggaggtgcagggcctcaagtccttggcaccaaacaggatcgtatactgtacaatggaggtcgaaggtggagagaagctgcagaccgaccaggccgaggcctcaaagcccacctggggtacccaaggtgacttctcaactacccacgctctcccggctgtgaaggttaagttatttactgaatcaacgggagtcctggctctggaagacaaggaactaggcagagtgatcttacaccctaccccaaactctcctaaacaatccgagtggcacaaaatgactgtctcaaaaaactgccctgaccaggatctgaaaatcaagctggctgtgaggatggacaaacctcagaatatgaagcactccggctatctgtgggccatcggaaaaaacgtgtggaaacgatggaagaaacgattcttcgttctcgtccaggtctcccagtatacatttgctatgtgcagttaccgagagaagaaagcagaaccacaggagctgttgcagctggatggatacaccgttgactacacggatcctcagcccggactggagggtggacgtgctttcttcaacgcagtaaaagaaggcgacacagttattttcgcgtcagatgatgagcaggataggatcctatgggtccaagctatgtaccgagccaccgggcagtcccacaaacccgtgcccccaacacaagtccagaagctgaatgctaaaggagggaatgtgccccagctggatgcccctattagtcagttttacgccgaccgtgcccagaagcatggcatggatgaattcatcagtagtaacccttgtaatttcgaccatgcctcactatttgaaatggtccagaggctgaccctcgatcataggctgaatgatagctatagctgccttggatggttcagccctggtcaggtttttgtgctcgatgaatattgcgccaggaacggtgtgcgagggtgccatagacatctgtgttacctccgggatctgttagagcgagcagagaacggggctatgatagatccaactctgctgcattactcattcgctttttgtgcttctcacgtacatgggaatcgcccagacggaatcggaacagtgactgtcgaggagaaagagaggttcgaagagataaaggagcgtctgcgagtgctgttagagaatcagattacccacttccgctactgcttccccttcgggaggccggaaggagctttaaaggctaccctcagtctcctggaacgagttctcatgaaagatatagtgaccccagtgccccaggaggaggtgaaaacggtgatccggaaatgtctggaacaagcagctctcgtgaattattcgcggctgtccgagtacgcaaagatcgaggaaaaccaaaaggatgccgagaatgttggaagactcatcactcctgctaagaaactcgaagatacgatccgactcgctgaactggtaatcgaagtcctgcaacagaacgaagagcaccatgccgaaccacacgtggataagggagaagcattcgcttggtggtccgatctgatggtggagcatgctgagacatttctctccctgttcgccgtggatatggacgccgcactggaggtccaaccccctgatacatgggattcttttcctctgttccagcttctgaatgactttctgaggaccgactacaacctttgtaatggaaaatttcacaagcacctgcaggacctttttgctcctctggttgtgaggtacgtggatctgatggagtcatctatcgcccagagcattcatagggggtttgaacgagaatcctgggagccagtgaaatcacttacctcaaatttgcctaacgtgaatcttcccaatgtgaatctgccgaaggtacccaatcttccagttaacataccgctcggcatcccccagatgccgaccttcagtgccccatcctggatggcagcaatctatgatgccgataatggcagcgggacttccgaagatctcttttggaaactggatgcgctgcagaccttcattcgggacctgcactggccagaagaagaattcggcaagcatctcgagcagcgcctgaaactcatggcatcagacatgatagaatcatgcgtgaagcgaacacgcatcgcatttgaggtgaaattacagaagacaagccggtctaccgactttcgcgtgcctcagtctatctgcactatgtttaatgtgatggttgacgcaaaggcccagtccaccaagttatgcagtatggagatgggacaggaacatcagtaccattcaaaaattgacgagttgattgaggagacagttaaggaaatgattacactgctggtcgcaaaatttgtgacgattttagagggagtgctggctaaactgtctagatatgacgagggaaccttattctcgagttttctgagtttcaccgtcaaggccgcatccaaatatgtggatgtacctaagcccggtatggacgtggctgacgcttatgtaacctttgtgaggcattctcaggacgtcctacgggataaggtcaatgaagagatgtatatcgaacgccttttcgaccaatggtataacagctccatgaacgtcatttgcacttggctgaccgacagaatggacctacagcttcatatctaccaattaaagacgttgatccgcatggtgaaaaaaacttacagggatttcaggcttcagggagtgttggattcaacgttgaattccaaaacctatgagaccatccgaaataggttgaccgtggaagaagctacggcaagcgtgtccgaaggaggcggtctgcagggtatcagcatgaaggacagcgacgaggaagatgaggaagatgactag

SEQ ID NO: 216422 - DNA, 1038 bp, Artificial Sequence
  Description of Artificial Sequence: Synthetic coding sequence
taactgccgaacgttaatcttccaaacgtgaatctccccaaggtgcccaacctccctgtgaacatccctctcgggatccctcagatgcccacattttcagccccttcctggatggcagccatctacgatgcagacaacggttcagggacaagcgaggacctgttctggaaactagacgcactgcagactttcatccgcgatctccactggccagaggaggagtttggcaaacacctggaacaacgcctgaagctcatggcttccgatatgatcgaaagctgcgttaagcggacgagaattgcattcgaagtgaagctacaaaagacctccagatccacagatttcagagtgccgcagtccatctgcactatgtttaatgtcatggtggatgcaaaggctcaatctactaagctctgttctatggaaatgggccaggagtttgctaaaatgtggcatcagtaccacagcaagatcgacgagcttatcgaggagaccgttaaggaaatgatcaccctgctggtcgctaagttcgtgaccatacttgaaggcgtgctggcaaagctgtcccgatacgacgagggtacgctgttttctagctttctcagtttcaccgttaaggctgcctcgaagtacgttgacgttccaaagcccggaatggacgtagctgatgcctacgttacattcgtccgacatagccaggacgtcttgcgagataaggtaaatgaagaaatgtatattgagcgcttattcgaccagtggtacaatagctcaatgaatgtgatctgcacatggctaactgacagaatggacctgcagttgcatatttatcaactaaaaaccctgatccgtatggtcaaaaaaacttacagagattttcgcctgcaaggcgtgttggacagcaccctgaactccaaaacatatgaaaccatccgtaatcgacttaccgtggaggaggccacggccagcgtgagcgagggtgggggacttcagggcatcagcatgaaggactcggacgaggaagatgaggaagacgactag

SEQ ID NO: 216423 - DNA, 3768 bp, Artificial Sequence
  Description of Artificial Sequence: Synthetic coding sequence
atgctagacccttccagctcagaggaagagtccgacgaaggactagaggaagaaagcagggatgtgctggttgccgctggttcctcccagagggcacctcctgcacctacacgagaaggtcgaagggacgccccaggaagagcaggtggtggcggagccgctaggtcggtcagcccttctccatccgtcttgagtgaaggccgagatgaaccgcaacgccagttggacgatgagcaggagcggaggatacgtctgcagctgtacgtcttcgtagttcggtgcattgcctatccttttaatgccaagcagcccaccgacatggctaggcgacagcagaagctgaataagcagcagctgcagcttctgaaggaacgattccaggccttcctgaatggtgaaactcagatcgtggctgacgaagcattctgcaacgcagtgagatcatactatgaagtctttctcaaatctgatagagtggcacggatggtgcagtcaggtggatgttcagcaaatgatttccgtgaggtctttaagaagaatatcgagaagagagtccggtccctgcccgagatagatggcttaagcaaggagacagtgctctcttcttggatcgccaagtatgatgccatttatagaggagaggaggacttgtgcaagcaaccgaatcggatggccctgagtgccgtttccgagcttatactgtcaaaagagcagttatacgagatgttccagcaaatccttggcataaagaagttggagcaccagctgctctacaatgcctgccagctggataacgccgacgagcaggctgctcagataagaagggaactcgatggaaggttgcagttagctgataaaatggcaaaagagaggaaattcccaaagttcatcgccaaggatatggagaatatgtatatcgaagaactgaggtccagcgttaacctgctcatggccaacttggaatccctgcccgtttccaagggcggtccagagttcaaactgcaaaagttgaagaggtcccagaatagtgcatttctggacataggagacgagaacgaaatacagctttcgaagtcggatgtcgtgttatccttcaccttggagattgtaataatggaagtgcagggactgaagtctgtggctcccaacaggatcgtctattgtacaatggaggtggagggggagaagctccaaacagatcaggccgaggctagtaggccccagtggggaacccagggggacttcaccacgacgcaccccagacccgtggtcaaggtaaagctatttacagagagcaccggagtgctggcgcttgaggacaaggaactcggtcgagtgatactttatcctacatcgaattcaagcaaaagtgctgaactccaccgcatggtggtccctaaaaattcccaggattccgatctgaaaatcaagttagctgtgaggatggataagccagcccacatgaagcattcgggctacctatacgccctcggccaaaaagtgtggaagagatggaaaaaaaggtatttcgtcctggtccaggtgtcccagtacacgttcgcgatgtgtagttacagggagaaaaagagcgagccccaagagcttatgcagctcgagggctatactgtggattacaccgaccctcaccccggactccagggagggtgcatgttcttcaacgctgtgaaagagggtgacacagtgatttttgccagtgacgacgagcaggaccgtattctgtgggtgcaggctatgtatcgcgctactggtcagtcatacaaacccgtgccagccatccaaactcaaaagctcaatcctaagggaggtactctgcacgcagatgctcaactctacgctgatagatttcagaaacacggtatggatgaattcatatctgcaaatccctgcaaactcgatcacgcatttctcttccgcatactgcagaggcagactctggaccaccgtttaaacgacagttattcctgcttgggctggttctcccctggacaggttttcgtactggacgagtattgcgctagatatggggtgcggggatgccaccggcacctgtgctacctggccgagctgatggagcattccgagaacggcgctgtgatagacccaactctgttgcactactcctttgccttttgtgctagccacgtccacgggaacagaccggatggcatcggcaccgtatccgtagaggaaaaagaacggttcgaagagatcaaggagcggttgagctcattactcgagaaccaaatttcacattttcggtactgttttccctttggcagaccagaaggcgctttaaaggcgactctctccctgcttgagagggtgctcatgaaagatatcgccacacccatccccgcagaggaagtgaagaaggttgttcgtaagtgtctggagaaagctgcgctcataaattacaccagattgacggagtatgcaaaaatcgaggaaaccatgaaccaggcgtcgccagcccgaaaactcgaagaaatccttcatttggcagaactctgcatcgaggtgttgcaacaaaatgaagagcatcatgccgaggccttcgcgtggtggccagacttgctggccgagcacgccgaaaagttttgggccctgtttactgtggacatggatacggcgttagaagcccagccccaggatagttgggattcatttccgctatttcagcttctgaataactttttacgtaacgacaccctcttgtgtaatggaaaattccacaagcacttacaggagattttcgtgcccctcgttgtgagatacgtggatcttatggagagctctattgcacagagcattcatcggggatttgagcaagaaacctggcagcctgtgaataatggttctgcgacatcggaagatctgttctggaaacttgacgccctccagatgtttgttttcgatcttcactggcctgagcaagaattcgcgcatcatctggaacagagattaaagctgatggccagcgatatgctcgaggcttgcgtgaagcggactagaacggccttcgagctaaagttgcagaaagcttcgaagacaaccgacctcaggatcccagcttcagtatgtaccatgttcaatgtcctagtggacgcaaaaaaacagagtaccaagctgtgtgcactcgatggcggacaggaggtatgtcgcatcttccagcagtatcatagtaaaatagatgacttaattgataattctgtcaaggaaattatttcactgctggtcagcaagtttgtctcagttctcgagggagtactgtcaaagctcagccgctatgatgagggcacatttttctcaagcatcctgagcttcacagttaaggcagccgctaaatacgtagacgtgccaaagcctggtatggacttagctgatacctatatcatgttcgtgcgccaaaaccaggacattttacgggagaaggtaaacgaggaaatgtacatcgagaagcttttcgatcagtggtactcttcttcaatgaaagtgatctgcgtatggttaaccgacaggcttgacctccaactccacatttaccagctcaagaccctgatcaaaatagtgaaaaagacctatagggacttccgcctacagggggtacttgagggcacacttaattcaaagacatacgataccgttcatagacggcttactgtagaggaggccactgcctcagtatcagaaggagggggtctccagggcataacaatgaaggactcagacgaagaggaggagggatag

SEQ ID NO: 216424 - DNA, 3885 bp, Artificial Sequence
  Description of Artificial Sequence: Synthetic coding sequence
atgttagatccctcctctagtgaggaggagtctgacgaaggcttggaggaggaaagtagagacgtgctcgttgctgcaggctcttcccagagagccccacctgctcccacccgagaggggcgtcgcgatgctccaggacgcgctggaggaggtggcgctgcgcgatcggtatctcctagtccttccgtgctatcagaaggacgcgacgaacctcagaggcagctggatgacgaacaggagcgaagaattagacttcagctctacgtgttcgtagtacggtgtattgcctatccttttaacgccaagcagccaactgacatggcaagaaggcagcagaagcttaataagcaacagctgcagctcctcaaagagcgctttcaagccttcttgaacggagagacgcagattgtagcagacgaggccttttgtaatgctgtgcgctcttattatgaggttttcctcaagagtgaccgcgtggcaaggatggtccagagtggtggttgttccgccaatgactttcgagaagtgttcaagaaaaatattgaaaaacgcgtaaggtccctgccagagatagacggtctgagcaaagagacagtgttgtcttcatggatagcaaaatacgatgctatataccgtggtgaggaagatctgtgcaagcagcccaatagaatggctctatcggccgttagcgagctcattctgagcaaagaacagttatatgagatgtttcagcagatcctgggaatcaagaaattggagcatcagttgctgtacaacgcttgccagctggacaacgcggacgagcaagccgcacagatccgtcgggagctcgatggacgtctgcagctcgccgataagatggccaaagaacgaaaatttccgaagtttattgcaaaggatatggagaacatgtacatcgaggagctgcgatcttcagtgaatctgctcatggccaacctggaatctctgcctgtgtctaaagggggacctgaatttaagctgcaaaagctgaagcgatctcaaaattcggcttttttggatatcggtgatgagaatgagatccagcttagcaagtccgacgtggtgttgagttttaccttagagattgtgatcatggaagtgcagggcctgaagtctgttgccccaaaccgaattgtatactgtaccatggaggtcgagggcgagaaactgcaaacagaccaagcggaagctagcagaccccagtggggtacccagggtgatttcacaaccacccatcctcggccagtcgttaaggtcaagttgttcaccgaatctacaggcgtgctggcattggaggacaaggagttgggaagggtgatcctttatcctactagtaacagctctaaatctgctgaattgcaccgaatggtggtgcccaaaaatagtcaggattctgacttaaagataaaattggctgtgaggatggataagcccgctcacatgaagcattccggctatttatatgccctcggtcaaaaggtatggaagcgctggaaaaagcgctacttcgtgctggttcaggtcagccagtacacatttgctatgtgctcatatcgagaaaagaaatccgagccccaggagctgatgcaactagagggctacacagtcgattacactgaccctcacccaggccttcaggggggatgcatgttttttaacgctgtgaaagaaggagacacagttatctttgctagcgacgatgaacaggatcgcattctttgggtgcaggccatgtatcgtgccacggggcagagttataagccagtccccgcaattcagactcaaaaactgaatccaaagggtggcacacttcatgcagacgctcagctttctgagttcactgacgccgacagattccaaaagcatggcatggacgagttcatctcagccaacccatgcaagctggaccacgcgtttctatttaggatcctgcagcggcagaccttggaccacagactgaatgactcatattcttgccttggatggttctcaccaggacaggtctttgtgcttgacgagtactgtgcacgatacggagtaaggggttgccaccggcacctctgctatcttgcggagctaatggagcacagcgagaatggcgctgttattgatcccacacttctccactatagctttgctttctgtgccagtcacgttcacggcaaccgccctgatggtattggaactgtgtcagttgaggagaaagaacggtttgaagagatcaaagagaggctgtcttcactgctggagaaccagatcagccactttcggtattgcttccccttcgggcgaccagaaggagccttaaaggctacactctctctgctggagcgggtgctgatgaaggatatcgccactcccatccccgctgaagaggtcaagaaggttgtccggaagtgcctggaaaaggctgctctaatcaactacactcgcctgaccgaatacgccaagattgaagagacaatgaaccaggctagccccgctcggaagctggaagagatactgcacctggctgagctgtgcatcgaagtgctgcagcagaatgaagaacatcatgctgaagcatttgcgtggtggccagaccttctcgccgaacacgcagagaaattctgggctctgttcacagtggacatggacacagccctagaggctcagccgcaggatagctgggactcctttccactcttccagctgctgaataatttcttgcgaaatgatactcttttgtgcaatggcaaattccataagcatctgcaggaaatctttgtgccgttagtagtgagatatgtggacttaatggagtcttctatcgcgcaatctatccataggggcttcgagcaggagacctggcagccagttaagaatattgccaacagcctgccaaacgtggcattgcccaaggtcccatctctgcccctcaatctgccccagatccccaatatttcaaccgcttcttggatgcccagcctttacgaatccacaaacggatcagctacaagcgaggacctcttttggaagctcgacgcattgcagatgttcgtgttcgacctgcactggcctgagcaggaattcgcccaccaccttgagcagcggctaaagttgatggcctctgacatgctggaggcttgtgtgaagaggactcgtacagcatttgagctgaagttgcaaaaggcgagcaagaccactgatctgagaatccctgcttccgtgtgtacaatgttcaacgtgctcgtagatgctaagaagcagtctactaagctttgtgctctcgatggtggccaggagcaacagtaccactccaagattgacgacctgattgacaatagcgtgaaggagatcattagcctcctggtcagcaagttcgttagtgtcctcgagggcgtacttagcaaactctctaggtacgacgagggcaccttcttcagctctattctgagcttcaccgtgaaggccgcagctaagtatgtggatgtgcctaagcccggaatggacttggcagacacctacattatgttcgttagacagaaccaggatattctacgcgaaaaagtcaacgaggaaatgtacatcgaaaagctgtttgaccagtggtatagctcctccatgaaggtaatttgtgtctggctaaccgacaggctcgacttgcaattgcatatttatcaactgaaaactctgattaagatcgtaaaaaagacttaccgcgatttccgcctgcagggggtgctggaaggcaccctaaactctaaaacatacgacactgtgcataggaggctcaccgtcgaggaggccacagccagcgtcagcgaaggcggaggcctccagggcattaccatgaaagactcggatgaggaggaggagggctag

SEQ ID NO: 216425 - DNA, 1410 bp, Artificial Sequence
  Description of Artificial Sequence: Synthetic coding sequence
atgaatcaggcatcacccgcaaggaaattggaagaaatcttacatctcgcagaactctgtatagaagtgctgcagcaaaatgaggaacaccacgcagagcttaggcatgctttcgcatggtggccagatctactggcggaacatgcagaaaagttctgggccctattcacagttgatatggacacggcgttagaagcccagccacaggactcctgggactcattccctttgtttcaactcttaaacaatttccttagaaatgacaccctactttgcaatggcaagtttcacaaacacctgcaggagatatttgtgccactagtggtgcgctacgtggacttgatggaatcaagcatagcacaatccatccaccgtgggtttgaacaagaaacctggcagcccgttaaaaacattgctaacagtctccctaatgttgccttgccgaaggttcctagtttaccgcttaacctcccgcagattccaaacatatcaacggctagttggatgccctccctgtatgaaagtaccaatggtagcgcaacgagcgaggatttattttggaaactcgacgctctgcagatgtttgttttcgacctgcactggcctgagcaggagttcgcgcatcacctggaacagaggctgaagttgatggcctcagacatgttagaagcttgcgttaagagaaccaggactgcattcgaacttaagttgcagaaggcttctaagaccactgacctgcgtattccagcctcagtatgtacaatgtttaacgtgctcgtggatgccaagaagcaaagcactaagttatgcgcgctcgacggaggtcaggaacagcagtaccattccaagatcgatgacctgatagacaactccgtgaaagaaattatctccctgttggtgtctaaatttgtctcagtgctggaaggagtcctctctaagctctccagatacgacgagggcactttcttctcttcaattctgtcatttacagtgaaggcggctgcaaagtacgtggatgtgccaaaaccgggtatggaccttgccgacacctatattatgttcgttcgccagaatcaggacatcctgcgcgagaaagtcaacgaggagatgtacatagagaagctcttcgaccagtggtactcaagcagcatgaaggtgatttgtgtttggctcactgatagactcgacctccaattgcacatctaccaactcaagacacttataaagatagtaaaaaaaacctatagagactttcgcctccagggggttttagaagggaccctgaacagtaagacctatgacaccgtacatcgcagattgactgtggaggaggctactgccagtgtctccgaaggagggggtctgcagggcatcactatgaaagattccgatgaggaggaagagggatag

SEQ ID NO: 216426 - DNA, 2700 bp, Artificial Sequence
  Description of Artificial Sequence: Synthetic coding sequence
tgagaaatccagctgtctaaatctgacgttgtgctgtcgttcaccctggaaattgtgattatggaggtgcagggccttaaaagcgtggctcctaatcgcatcgtatattgtaccatggaggtcgaaggcgagaagctccagactgaccaagctgaggcgagccggccacagtggggtacacagggcgactttacaacaacccacccaaggccagtagttaaagtcaaactatttacagagagcaccggtgtgctggcactcgaagataaagagctaggtagggtgattctctaccccacatctaacagcagcaagtcagccgaactgcacaggatggtagtccctaagaactcccaggatagtgatctcaagataaaattagcagtccggatggacaagcccgctcacatgaagcactcaggatacctgtacgcactgggtcagaaggtgtggaaacggtggaagaagagatactttgtgttagtgcaagtgtctcagtatacttttgccatgtgtagctacagagagaagaagtccgagccacaggaactgatgcagcttgaagggtacaccgtagattatacagatcctcatcccggactacaaggcggttgcatgttctttaatgctgttaaggagggagacactgttatttttgcctcagatgatgagcaagatagaatcctgtgggtccaggctatgtaccgtgcgaccggacagtcctataagccagtgcctgcaattcagactcagaagctcaatccgaagggcggaacgctccatgctgatgcgcagttatatgccgaccgctttcagaagcacggtatggatgagttcatatcggctaacccttgcaaattagatcatgccttcctcttccggatcctgcaaaggcagactcttgatcatcgcctgaatgacagctacagttgcctcgggtggttcagtcctggccaggtgtttgtgctggatgagtactgtgctcgctacggagtgaggggctgccaccgacacttgtgctacctggcggaactgatggaacattccgaaaacggggctgttatcgaccccacgctgctgcactattctttcgctttctgcgcatcccacgttcacgggaatcggccagacgggataggcactgtcagcgtcgaagagaaggagcgcttcgaggagataaaagagaggctgagttctcttcttgagaatcagatatcccactttaggtactgtttcccattcgggagacctgaaggggctctcaaggctaccctgtctctgctggagagagttctaatgaaggacattgccacccccattccagccgaagaagtgaagaaggtggttcgaaaatgcctcgagaaggccgctctgatcaattacaccaggctcaccgagtatgcaaaaatcgaggagacgatgaatcaggctagtccagcaaggaagcttgaggaaattttacacctggcagaactgtgtattgaagtccttcaacaaaacgaagagcatcatgccgaagccttcgcatggtggccagatctcctggctgagcacgcagaaaaattctgggctttattcactgtggatatggacacagcactagaggcacaaccgcaggactcctgggactccttccccttatttcaactgctgaataattttctaagaaatgacactttgctctgcaatggaaaatttcacaaacatctccaggagattttcgtcccgctggtcgttcgctacgtggatctgatggagtcctcaatagcacagtccattcaccggggtttcgagcaggagacctggcaaccggtcaataacggctccgccacctccgaggacctgttttggaagctcgacgctttgcagatgtttgtgtttgatctacattggccagagcaagaattcgcccaccatctggagcagagactgaaactcatggccagcgacatgctggaggcctgcgtaaagcgcacccgcacagccttcgagctgaaactccagaaggcgtctaagacaacagatttgagaatccctgcttccgtgtgcacaatgtttaatgtgttggtagatgccaagaaacaaagtactaagctctgcgccctggatggtgggcaagaacagcagtaccatagcaaaatagatgatctgatcgataattcggtcaaagaaataatctcactgctcgtatcaaaatttgtgagtgtgctggaaggagtgctgagtaaattgagccgatacgatgagggaacattctttagctccatcctgtccttcacagtcaaggccgcagcaaagtacgtggatgtgcccaaacctggtatggacctggccgatacctacatcatgttcgtgcggcaaaaccaggacatcctaagggaaaaggtgaacgaagaaatgtacattgagaaactgttcgaccagtggtactcctccagtatgaaggtgatttgcgtgtggctgacggatcggcttgatctgcagctgcacatctaccaattgaagactttgattaagatcgttaagaagacctatcgggattttcgcttgcagggggtgctggagggaactttgaacagcaaaacttacgacaccgtgcaccggaggcttactgtggaggaggccacagccagtgtgtccgaaggaggtggattacaaggaataactatgaaggattctgatgaggaagaggaagggtag

SEQ ID NO: 216427 - DNA, 3768 bp, Artificial Sequence
  Description of Artificial Sequence: Synthetic coding sequence
atgctggatccatcatcaagtgaggaagagagcgacgaaggcctggaggaggagtcacgagatgtcctggtggctgccggaagctcccagcgagcgcctccagcccctacccgggagggacggcgtgacgcccctggccgtgccggagggggaggcgcagctagatccgtgtcacccagccccagcgtgctgagtgagggcagagatgaacctcagcgccagctggacgacgaacaggagcgcaggattcgcctgcagctatacgtcttcgtcgtgcggtgtattgcataccccttcaatgcaaagcagccaacagatatggcaagaagacagcagaagctgaacaaacagcagctgcagctgctgaaagagagatttcaggcatttctgaacggggagacccaaatcgtagcggatgaagctttttgcaacgccgtgcgctcctactacgaggtattcctgaaaagcgaccgagtggctcggatggtacaatctggagggtgctcagcaaatgattttcgtgaggtattcaagaagaatattgagaagagagtgcgcagtttaccggaaatcgatgggctgagcaaagaaactgttctgtcatcttggattgcgaagtatgatgctatataccggggagaagaagacctatgtaaacagcccaacaggatggccctgagtgctgtgtccgaactgatccttagtaaagagcagctctacgaaatgtttcagcagatactggggattaagaaacttgagcatcagctcctctacaacgcttgccaactcgataacgccgatgaacaggcagcccagattcggcgtgagttagatggaagactacaactcgcggataagatggctaaagagcgcaagttccccaagtttatagcgaaggatatggagaatatgtacatcgaggaactcaggtccagcgtgaatttgctgatggcaaacctggaatctttacccgtgagtaaagggggtcctgagtttaagctgcagaagttaaagcgttcccaaaacagcgctttcctggatatcggggatgaaaacgaaatacagctgtctaaaagcgatgttgttttgagctttacgctggaaatcgtcattatggaggtgcagggtttgaagagtgtggccccaaatcggattgtttattgcactatggaagtggagggcgagaagctccaaaccgaccaagctgaggccagccggccacagtggggcacccaaggggatttcacaactacacaccccaggcccgtcgtgaaggtgaagctattcaccgaatccacaggagtgcttgccctggaggataaggagcttggacgagtgattttataccccacaagcaactccagcaagagcgcagaacttcatcgcatggttgtacctaaaaacagccaggattctgaccttaagattaagctggccgtgcgtatggataagccagcgcacatgaaacatagcggttatttgtacgcacttggtcagaaagtgtggaaaaggtggaagaaacggtacttcgttttggtgcaggtttcacagtacacgtttgctatgtgcagctacagagaaaaaaagtctgaaccacaggaacttatgcagctggagggttatacagtcgattacactgaccctcacccaggactgcagggtggctgcatgttcttcaacgccgtcaaagaaggcgacactgtgatattcgcttccgacgacgaacaggacagaatcctgtgggtgcaggctatgtatagagccaccggccagtcctataaacctgtgcctgcgatccagacacagaagttgaatcccaaggggggtaccttacatgcagatgcgcagctctacgctgaccgtttccagaagcacgggatggacgaattcattagtgctaacccttgcaagctcgatcacgcattccttttcaggattctccaaaggcagaccctggaccaccgactgaacgactcttatagttgcctgggctggttcagtcctggacaggtgtttgtgctggacgaatactgtgcccgatacggggtgagaggatgtcacagacacttatgctacctggccgagctgatggagcactctgagaatggggcagtgatcgatcccaccctcctacattattcgttcgcattttgcgcatctcatgtgcacggaaaccggccagacggcattggaacagtctccgttgaagaaaaagaacgctttgaggagattaaggaacgactttcctcattgctggagaaccagatcagccattttcggtattgctttccattcggcagaccagaaggcgcactgaaggcaaccctgtctcttcttgaacgggtgctaatgaaggatatcgctactcccatacccgcagaggaagtgaagaaggtggtcagaaaatgcctggaaaaggctgcacttatcaactatacccgcctgacagagtacgcgaagattgaggagacaatgaaccaggccagtcctgccaggaaacttgaagagatccttcatctggcagagttatgcatcgaggtcttacagcagaacgaagagcatcatgccgaagcattcgcctggtggcctgacttgctggcagaacatgccgagaaattctgggcattgttcactgtcgatatggacactgctctcgaggctcagccccaggatagttgggactcatttcccctgttccagctgctaaataatttcctgcgaaacgatactctgctgtgcaatgggaagttccacaaacacctgcaggaaattttcgttcccctggtcgtcaggtacgtcgacctcatggaaagctctatcgcacaaagtatacatcgcggattcgagcaagagacttggcagccagttaataatggcagcgccacatctgaggacctgttttggaagctggacgctctgcagatgttcgtttttgatctccattggccggagcaggagttcgcccaccacctggagcagcgtctgaaactcatggcctcagacatgttggaggcgtgcgtgaaaagaactaggactgctttcgaactcaagctgcagaaggcctccaagactaccgatctgcgcatcccggcttccgtctgcaccatgttcaacgtcctggtggatgcaaagaagcagagcaccaagctttgtgcgcttgacggcggacaggagtttggttcccaatggcagcagtaccattccaaaattgacgacctgattgacaactcggtcaaagagatcatttccctgcttgtgtccaagtttgtttctgtgctcgaaggcgtcttaagcaagctctcgagatatgacgagggcaccttttttagctccattctgtcatttactgttaaagctgctgcaaaatacgtcgacgtccctaagccaggaatggacttagcagatacttacataatgtttgttcgacagaatcaagatatcttgcgcgaaaaggttaacgaagaaatgtacattgagaagctctttgaccaatggtactcaagcagtatgaaggtcatctgtgtgtggttgactgatagactcgacctgcaattacacatataccaactgaagaccctgattaaaatagtgaagaaaacctatcgggactttcgcctgcagggggtactcgaaggaacactgaacagcaagacctacgacaccgtgcaccgaaggttgacagttgaagaagctacagccagcgtaagcgaggggggtggcctacaaggcataacaatgaaagacagcgatgaagaagaggaggggtag

SEQ ID NO: 216428 - DNA, 3906 bp, Artificial Sequence
  Description of Artificial Sequence: Synthetic coding sequence
atgctcgacccatcctcaagtgaagaggagagcgacgaaggcctcgaagaagaatcccgcgacgtcctggtggctgccggaagcagccagcgcgctcccccagccccaacccgcgaaggcagaagagatgctccaggacgggcaggaggcggtggggctgctagatcggttagccccagcccatctgtgctgtctgagggtcgtgatgaaccccagagacagcttgatgatgagcaggagcgcaggatcagactccagctgtacgtgtttgtggtcaggtgcatagcttaccctttcaatgctaagcagccgactgatatggccagaagacaacagaaactgaacaaacagcaacttcagctgctgaaagagagattccaggccttccttaatggcgagacccagattgtagccgacgaagccttctgcaacgcagtgaggtcgtactatgaagtctttctcaaatcagacagagtggccaggatggtccagtcaggcggatgttcggctaacgattttcgggaggtttttaaaaagaacatcgagaagcgggtccgtagcctcccagagattgacggattaagtaaggaaacggtgctgtcaagttggatcgctaaatatgacgcaatctaccgcggtgaggaggacttgtgcaaacagcccaatcggatggccttgtctgcagtgtccgaacttatcctatcgaaagagcaactctacgagatgttccagcaaattctcggtattaaaaagctcgagcaccagcttctgtataacgcgtgccagctggacaacgccgacgagcaggccgcacagattaggcgtgaactggacggccgtctgcagttggccgacaaaatggcgaaggagcgcaaattcccaaagttcattgctaaggatatggaaaatatgtatatcgaggaactgcgtagctcagtgaatttattaatggcaaacctggaatccttacccgtgtccaaaggcggtccagaattcaaactgcaaaaattgaaacgctcgcagaatagcgcttttctagacattggtgatgagaatgagatccagctctccaaaagcgatgtagttctaagcttcacattggaaatcgtgataatggaagtgcaggggctgaagagtgtcgcgccaaaccggatcgtctactgtacgatggaagtcgagggagagaaactccaaacggaccaagctgaggcgagccggccacagtggggcactcaaggcgactttactacgacccatcctagaccggtggtaaaagtcaagctgttcactgagagtacgggggtgttggctttggaggacaaggagctcgggagggttattctctacccaacatctaattcttctaaaagcgcagagcttcaccgcatggtcgttcccaaaaactcacaggacagtgatctgaagattaagttggccgtgcggatggacaagcccgcacatatgaaacactccggctatttatatgccttgggccagaaggtgtggaagcggtggaaaaagcggtacttcgttctagtacaggtgagtcagtatacttttgctatgtgcagttacagggagaaaaaatctgagcctcaagagctgatgcagcttgaagggtacacagtggattatacagacccacatcctggcctccagggaggatgtatgttttttaacgcggtcaaggagggtgatactgttatatttgcatctgacgatgagcaggatcggattttgtgggtgcaagctatgtaccgcgctactggccagagctataagccagtgccagccattcagacccagaaattgaaccctaagggaggcacactccacgccgacgcccagctcagcgagtttaccgacgccgacaggtttcagaagcatggcatggatgaattcatttccgccaacccatgcaagctcgaccacgccttcctattccggatattacagaggcaaaccctggaccaccgcttgaatgatagctatagctgtttaggctggttttctcctggccaagtgttcgtgcttgacgaatactgcgctcggtacggtgtaagaggctgccaccgtcatttgtgctaccttgccgaactcatggaacactctgagaatggcgctgttatcgatcccacactgctacactactccttcgctttttgtgccagccatgtgcatggcaaccggccagatggaatcggcaccgtttccgtggaggagaaagaaaggttcgaggagattaaagagaggctgtcttccctgctggaaaaccagatatcccactttaggtattgtttccctttcgggagacccgaaggagctctgaaagccacactgtcgctcctggagagggtgctaatgaaggacattgcaacaccaatccctgctgaggaggtgaaaaaggttgttagaaagtgtctcgaaaaggccgcactgataaattacacccgcttaaccgagtatgccaagatagaggggcctgccgaaaaagagaccgaaacaatgaatcaggcctctcctgccagaaagctggaggagatcttacatctcgccgagctgtgcatagaggtgctgcagcaaaacgaggagcatcatgccgaggcctttgcttggtggcccgacctgctggctgaacatgctgaaaagttttgggctctgtttacagtggacatggacacggctcttgaagcacagccccaagacagttgggattcttttcccttgttccagctgctgaacaactttctgagaaacgatacccttttgtgtaacggcaagtttcacaaacacttgcaggagattttcgtgccactggtcgtaaggtatgttgacttaatggagtcatctatcgctcagagtattcaccggggattcgaacaggaaacttggcagcccgtgaagaatatcgccaattcgctgccaaatgtcgccttgcccaaagtgcctagtctgccgctgaatctgccgcagattcctaatattagcaccgcttcatggatgccatccctgtacgaatccacaaacgggagcgcaacgtccgaagatctcttttggaagttggacgcgctgcagatgtttgtcttcgatctacactggcctgaacaggaattcgctcaccacctagagcagagactcaaactgatggcctcagatatgctagaggcatgtgttaagaggaccagaaccgcgttcgagctgaagttacagaaggcatcaaagactactgacctgaggatcccagcatcagtctgcaccatgtttaacgtgttagtcgatgccaaaaagcaatccactaaactgtgtgcattggacggtgggcaggagcaacagtaccacagcaagattgatgatttgatcgacaacagcgttaaggagatcatatctctcttagtgtctaagtttgtgtcagtgttagaaggggtcctgtcaaagttatcccgctatgatgaggggacatttttctcatccattttgtcttttaccgtcaaggctgccgctaaatacgtagacgttcctaagccagggatggacctggccgacacttacatcatgtttgtcagacagaaccaggacatcctgcgcgaaaaggtcaatgaggaaatgtatatcgaaaaactcttcgaccagtggtactcttctagcatgaaggtcatctgcgtctggctcacagatcgcctggacctgcaactgcacatctaccagcttaaaaccctgattaaaatcgtcaagaaaacctaccgagattttcggctgcaaggagtgctggagggcacactgaatagcaaaacatatgatactgtccacagacggctaaccgtggaggaggcgaccgctagcgtctcagaagggggtggactacagggcatcaccatgaaagactcagacgaagaggaagaaggctag

SEQ ID NO: 216429 - DNA, 3891 bp, Artificial Sequence
  Description of Artificial Sequence: Synthetic coding sequence
atgctcgacccctcttcctctgaggaggaatcggacgagggtctcgaggaggaaagccgggatgtgttggtggccgctggcagcagccaacgtgccccaccggctccgaccagagagggccgaagggacgcccctggccgagcaggtggaggcggagccgctagaagtgtttccccatccccatcagtgctgtcagagggcagagatgagcctcagagacaactggacgacgaacaggagcgtaggatccggctgcagctgtacgtatttgtggtccgatgcattgcgtatccctttaacgcgaaacagccaactgatatggcacggcgtcaacagaagttgaataagcagcaactgcagctacttaaagaacgctttcaggcgtttttgaacggcgagactcagattgtggctgatgaggccttttgcaatgccgtgcgctcctattacgaagtgttcttgaagagcgatagggttgccagaatggtccagtctggaggatgtagtgctaatgactttagagaggtgttcaaaaagaacatcgagaagcgggtccgcagtctgccggaaatcgatgggctctcgaaggagactgtgctgagttcttggattgctaaatatgacgctatctatcgtggagaagaggacttatgcaaacaacctaatcggatggctctgtccgcggtgtcagaattgatcctcagtaaagaacagctatatgaaatgtttcagcagatactgggtattaaaaaactagaacaccagctgctgtacaatgcctgccagctggataacgctgatgagcaggctgcccaaatcagacgggagcttgacgggaggctccagctcgcggataagatggctaaggagcggaaatttccgaagtttatagctaaggatatggagaatatgtacatcgaagaattaaggagctctgtcaatctcttgatggctaacctcgagtcactccccgtgtcgaagggagggccagaatttaaactgcaaaagctgaagcgcagtcaaaacagcgcatttttagacataggagacgagaacgagattcagctcagcaaatcagacgttgtgctttccttcactcttgaaatcgttatcatggaagttcagggcctgaagtctgtggcccctaacaggattgtatactgcaccatggaagttgagggagaaaagctgcagaccgaccaagccgaggctagccggccacaatggggcacccagggtgatttcaccactacccaccctcgcccagtggtgaaagttaaactgttcaccgagtctacgggcgtcctagccttagaggacaaggagctggggagggtgatcctttatcccacttccaacagctccaaaagcgcggaattgcaccggatggtggtccccaagaattcccaagatagcgacttgaaaataaagctggctgtgagaatggataagcctgctcacatgaagcattccgggtatttgtatgccctaggccagaaggtgtggaaacggtggaagaaaagatatttcgtgctggttcaagtctcccagtacaccttcgcgatgtgttcttatcgcgagaagaagtctgagccacaagaactgatgcagctcgaaggttacaccgtagactacactgatccacaccccggtctgcagggaggttgcatgttcttcaacgctgtgaaagagggggacactgtgatttttgcctccgatgacgagcaggatagaatcctttgggtacaggccatgtacagagctactgggcagtcctataagccagtgcccgcaatccaaacacagaagctcaatcctaaaggcggtaccctgcacgctgacgcgcagctcagtggcaaagatgcagatcggtttcagaaacatggcatggacgaattcatttccgctaatccttgtaagctggaccatgccttccttttccgaatactgcagcgccagaccttagatcacaggctcaatgacagctactcatgtttggggtggttttctccgggtcaagtcttcgtgctggatgaatattgcgcacggtacggcgtgcgcggttgccaccgacacctttgctatcttgcagaactcatggaacacagtgaaaatggcgcagtcatcgacccaaccctgctccactattcgtttgccttttgcgcgagccatgtccacggaaataggccagatggtataggtactgtgagcgtcgaggagaaggaaagatttgaagagataaaggagcggttgtcttctctgctagaaaaccagattagtcatttccggtactgttttccattcggcaggcccgagggagccttgaaggccactctcagcctcctggaacgcgtgttgatgaaggacatagctacacccattcccgcagaagaggtcaaaaaggttgtaaggaagtgtctggaaaaggctgcactgatcaattatactagactcacagaatatgctaaaattgaggagacaatgaatcaagcttcccctgcaagaaagctggaagaaattctgcaccttgctgaattgtgtatcgaagttctacagcaaaacgaggagcatcacgccgaagggagggaggcctttgcatggtggcctgacctgttggccgaacatgccgaaaagttttgggcgttgtttaccgtggacatggacaccgctttggaggctcaaccccaagattcttgggacagtttcccgctgttccagctgctcaacaatttcctgcgcaatgatactttactgtgtaatggcaagtttcacaagcatctccaagagatctttgtgcctctggtcgtgagatacgttgatttgatggagagctccatcgcacagagtattcacaggggtttcgaacaggagacatggcaacccgtgaagaatatcgccaactccttacctaacgtagcccttcccaaggttccttcattgcctctcaacttacctcagataccaaacatttccaccgcatcctggatgccaagcctatacgagtccacaaatggctcagcgacctccgaggacctgttctggaagctggacgcactgcagatgtttgttttcgacctgcattggcccgagcaggaatttgcgcaccacctcgaacagaggttgaagctcatggcctcagacatgctcgaggcttgcgtgaagcgaaccagaacagcttttgaactgaagttgcaaaaagccagcaaaacgaccgacttgagaatcccagcatctgtttgtactatgtttaacgtcctggtcgacgccaagaaacagtctactaaactgtgtgccttagatggcggtcaagagcagcagtatcacagcaagatcgacgaccttatcgacaattccgtcaaagagattatctcactgctcgtctccaaattcgtcagcgtgctggaaggagtgctcagtaagctgtccaggtacgatgagggtacattcttttcttccatcctcagcttcacggtcaaggcggcagcaaagtacgtggatgtgcccaaacccggaatggatctggcagacacttacatcatgtttgtgcgccagaatcaggacatactgcgagagaaggttaacgaggaaatgtatatcgagaagttgttcgatcagtggtattcaagttccatgaaagtaatttgtgtatggttgactgacaggttggatctgcagctgcacatctatcagcttaagaccctgattaagatcgtgaaaaagacataccgagattttagacttcagggtgttctggagggtacactcaactctaaaacctacgacaccgtgcatcggagacttaccgtcgaagaagccacggcaagcgtaagtgaggggggtggactgcaggggatcacaatgaaggacagcgatgaagaagaggaggggtag

SEQ ID NO: 216430 - DNA, 1473 bp, Artificial Sequence
  Description of Artificial Sequence: Synthetic coding sequence
tgatacacccggcttaccgagtacgctaagattgagggaccggctgagaaagagacggagactatgaaccaagcctcccccgcacgcaagttagaggaaattctccacctcgctgagctttgtatcgaggtactgcagcagaatgaggagcaccacgctgagggaagagaagcttttgcctggtggccagatctgctggctgaacacgccgagaaattttgggccttgttcaccgtggatatggatacagctctagaggctcagcctcaggattcttgggactcattccctctttttcaactgttaaataactttctgcgcaacgatactctcctgtgtaacggcaaattccataagcatttgcaggaaatttttgtccctcttgtggttcggtatgtggatcttatggaatctagtattgcccaaagcatccaccgtggcttcgaacaggaaacatggcagcccgtgaaaaacattgctaactctctcccaaacgtggccctaccaaaagtaccctctctacccctgaatctgcctcaaattcccaatataagcacggcaagctggatgccaagcctttatgagagcacgaatggtagtgctaccagcgaagatctcttttggaagttggatgccctgcagatgttcgtgttcgacttgcactggcctgaacaagagtttgcacatcacctggaacaaagacttaaattaatggcctcggatatgttggaggcctgcgttaagagaactcgaacagccttcgagcttaagcttcagaaggctagcaagacgacggacctgcggatccccgcatccgtatgcaccatgtttaatgttcttgtcgacgctaaaaagcagtctaccaagctgtgcgccctcgatgggggacaggagcagcaataccacagtaagattgacgacttaattgataactccgtcaaagagatcatcagtctgttagtgagcaagttcgtgtcagttctggagggtgtgctctctaagctcagtcgatatgacgaaggcactttcttttccagtattctaagtttcacggtgaaggctgccgctaaatacgtggacgtgccgaagccagggatggatctagcagatacttacatcatgtttgtgagacagaaccaagacatcctgcgcgagaaagtcaatgaggaaatgtacatagagaagctttttgaccaatggtatagcagctcaatgaaggtcatctgcgtgtggctgactgataggctcgatctgcagctgcacatctatcagctcaagactcttattaagattgtcaagaagacttatagagatttccgccttcagggtgtactggagggaaccctgaacagcaagacttacgataccgtccatagaaggctgacagtggaagaggcaaccgcgagtgtctcagagggtgggggtcttcaaggcattaccatgaaagattcggatgaagaagaagaaggctag

SEQ ID NO: 216431 - DNA, 3669 bp, Artificial Sequence
  Description of Artificial Sequence: Synthetic coding sequence
atgctagatcctagttctagtgaggaagaatctgacgagggtcttgaagaggagtcccgcgatgtgctggtggctgccggatcgtcccagcgcgctccgccagcacctactagagagggccagctcgacgatgaacaggagcggcgaatccgcctgcaactgtatgtgtttgtggtacggtgtatcgcctatccgtttaacgccaagcagcctacagatatggctagacgccaacagaagcttaataaacagcagctgcagcttctcaaggagcgatttcaggcctttttaaacggcgaaacccaaatcgtggccgacgaggctttttgcaatgcggtgcgttcctattatgaggtgtttctgaaatccgaccgtgttgctcgcatggtgcagtccggtgggtgcagcgcaaatgacttccgggaagtcttcaagaaaaatattgaaaagagagtcaggtccctccctgagatcgacggactaagcaaggaaacggtcctctctagttggatcgccaagtacgacgctatctaccgcggtgaagaggatctctgtaagcagcctaacaggatggctctgtccgccgtgagtgaactcatcctgtccaaagagcagctctatgaaatgttccagcaaattctcggaatcaaaaagctggagcatcagctgttgtacaatgcatgccagttggacaacgccgacgaacaggcggctcagataagacgggagctggatgggaggttacagctggctgacaaaatggccaaggaacgtaaatttcccaagtttattgcaaaagatatggagaacatgtacattgaggaactccgctcttcggtgaatttattgatggcgaatctggaatccctcccagtttcgaagggaggcccagagtttaagttgcagaagctgaagcggagtcaaaactcagcatttttagacattggcgacgaaaatgaaatacagttgtccaaaagtgacgtggtgctatctttcaccctggagattgtgatcatggaagtgcaggggctaaagagtgttgctccgaacagaatcgtctactgcactatggaagtcgagggcgagaagctgcagactgatcaggccgaagccagcagaccacaatggggaacccagggagatttcacaaccacccatcccagacctgtggtcaaggtaaaactgttcactgaaagcaccggggtgctggccctggaagataaagagctcgggagagtgatcctgtaccctactagcaattcttcaaaatccgctgagctacatagaatggtggtgcccaaaaatagccaggacagcgacctgaagatcaaattggccgtccgtatggataaacccgctcacatgaagcactcaggctatctttatgcccttggacaaaaggtgtggaaaagatggaagaaaagatattttgttctggtccaggtgtcccagtatacctttgctatgtgctcttatcgagagaaaaagagtgagccacaagagctgatgcagctcgaagggtatacagtggactacacggatccacatccaggactccagggtggctgcatgtttttcaatgcggtgaaagaaggggatactgtgatcttcgcctcagacgacgaacaagatagaattctctgggttcaggcaatgtatagagcaacgggccagtcctacaagcctgtgcctgcaatccagacccagaagctcaatcctaagggtggcaccctccacgcggatgcacagctttacgcagatagatttcagaagcatggcatggatgagtttatttcagcgaacccttgcaagctggaccatgctttcctctttcggatattacagcggcagacactcgatcacagattaaatgactcctattcttgcctcggatggttttcgccaggccaagtctttgtcctagacgaatactgtgccagatacggagtgcgaggttgtcaccgccacctctgctacctcgctgagttgatggagcatagcgagaacggggcagtcatcgatcctactctgcttcattactcttttgcattttgcgcgtcccatgtgcacggaaacagaccggatgggattggaactgtctcagtcgaagagaaagagcggttcgaggaaattaaggaacggctatcatccttgttggaaaatcaaatctctcacttcagatactgcttcccctttggacgcccagagggcgctctgaaagccaccctcagccttctggaacgagtactgatgaaggatatcgccacgccaatccctgctgaggaggtaaagaaagtggtgcggaagtgtttagagaaagccgcactgattaactatactaggctcactgagtacgcaaagatcgaggagactatgaatcaggcctcccccgcacgaaagttggaggaaattctgcacttagccgaactgtgcattgaagtgctgcagcagaatgaagaacatcacgcagaggcctttgcgtggtggcctgacttgctggcagagcacgccgagaagttctgggcgctcttcacagtcgacatggacacagctcttgaggcccagcctcaagatagttgggatagcttccctctgttccaactgttaaataatttcctcaggaatgacacgcttctgtgcaacggcaaatttcacaagcatttgcaggaaattttcgtgcccctagtcgtacgttacgtggatctgatggaaagctctatcgcacagagtattcatcgcggtttcgaacaggagacctggcagccagtaaacaatggcagcgccacttctgaagacttgttctggaaactggatgccctgcagatgtttgtgtttgacctgcattggcctgaacaggaatttgcacatcatctggagcagcgtctaaagctgatggcctcagacatgctagaagcatgtgtaaaacgaacgaggaccgcttttgagctcaagctgcagaaagcctccaaaacaacagatttacgcatcccagcctccgtgtgcacaatgtttaacgtgttggttgacgccaagaagcaatcaacaaagttatgcgctcttgacggtggccaagaattcggatctcaatggcagcagtaccatagcaagattgatgatctgatagacaatagcgttaaagaaattatttcactcctcgtgtccaaatttgtctcggtgctggagggagtgctctcgaaactgtcacgttatgacgagggcacattcttcagcagtatcctcagcttcaccgtgaaagctgccgctaagtacgtcgacgtgcccaagcccggaatggacctagcagacacgtacatcatgttcgtgaggcagaaccaggatatccttagagagaaagttaacgaggagatgtacatagagaaactctttgaccagtggtacagcagtagcatgaaggtgatatgtgtgtggctgactgacagactggacctacagctgcacatttaccaactcaaaacactgatcaagatagttaaaaagacctacagagacttcaggctgcaaggcgtgttagaaggcaccctcaattctaagacctacgacacagtgcaccggaggttgactgtggaagaagccaccgctagcgtgtccgagggaggtgggctgcagggcataactatgaaagactcagatgaggaagaggagggttag

SEQ ID NO: 216432 - DNA, 2367 bp, Artificial Sequence
  Description of Artificial Sequence: Synthetic coding sequence
atgactattcaccagttcttgttgctgttcctgttctgggtttgcctacctcacttttgttcccctgagatcatgtttcgccgtactcccgtgcctcagcaacggatcctgagctccagggtccctagaagtgacggaaaaatactgcatagacagaagcggggttggatgtggaaccagttttttctgttagaggagtacacagggtctgactaccaatatgtgggcaagctccactcggaccaggataagggagatgggtcgctaaagtatatactgagcggcgatggcgctggaaccctcttcattatcgatgagaaaacaggcgatattcacgccacgagacgcattgaccgcgaagaaaaagccttttacaccctgcgcgctcaagcaatcaaccggaggactctccggccagtggagccagaatccgaattcgtgatcaagattcacgacatcaatgacaatgagccaacatttcccgaggaaatttacactgcctcagtccccgaaatgagcgtggtgggcacttcagtagtgcaggtgacagctactgatgccgacgatccatcatacggcaatagcgccagggttatatattccatcctgcagggccagccgtactttagcgtcgaacctgaaaccgggatcatcaggactgcgttacccaacatgaaccgggaaaaccgagagcagtatcaggtcgtgatccaagcgaaggatatggggggacagatgggaggtcttagtgggactaccaccgtaaacattaccctcacggacgtcaacgataatcctcctcgttttccacagaatactattcacctgcgcgtgctagaatcaagcccagtgggaacagccattggatctgtgaaagcaaccgatgcggatacgggcaaaaacgctgaggtggaatacaggatcatcgatggcgacggaaccgacatgtttgacatcgtaactgaaaaagatacgcaggagggcatcataacagtgaaaaaacctcttgactatgagtcaagaaggctgtatacgttgaaggttgaggccgagaacactcacgtggacccacggttttattatttggggccatttaaggataccaccatcgttaagataagcatcgaggacgtggacgaaccacctgtgttcagtaggtctagctacctattcgaggtgcacgaggacatcgaagtgggaactatcatcgggacagtgatggccagggacccagacagcatttcatctcccatccggttttcacttgacaggcatacagatctggatcggatctttaacatccacagtggcaacgggtccctatacacctctaaaccgctggaccgtgagctgtcacagtggcataacctgaccgtgatcgctgcggagattaacaatccgaaagagaccacgagggtagctgtgtttgtgcggatactcgatgtaaacgacaacgcacctcagttcgccgttttttatgacaccttcgtatgcgaaaatgcgcgaccaggacaactgatccagacaatcagtgccgtggacaaagatgaccctctgggcggtcagaagtttttcttctctttggcagccgtaaatccaaacttcaccgtccaggacaatgaggacaatacggcgcgtatcttgacaagaaagaacggattcaataggcatgaaatcagcacctacctcctgcctgtggtcatctctgataatgattaccctattcagtcttccacagggacactaactattcgagtgtgcgcttgtgacagtcagggaaatatgcagtcatgttcagcagaagcattgctgctcccagctggcctttccacgggtgcactgattgcaatcctattgtgcatcataatcctgctggtgatcgtggtgctcttcgctgccctcaagaggcaacgaaaaaaggagccgctcatactgagcaaggaagatatcagagacaacattgtaagttataacgatgagggaggtggagaagaggacacccaagcattcgacatcgggaccctacggaatcccgcagccatcgaagagaagaaactgcgcagggacatcattcccgaaacgttatttattcccagacgcacccctacagctccagacaacacagatgtacgcgacttcattaacgagcgcctgaaggagcacgacctggatcccaccgctccgccatacgattcgctggccacctatgcatacgaggggaatgactctatcgctgaatctctctctagtctcgagagtggaactacagaaggcgatcagaattacgactatcttagagagtggggtcctcgctttaacaaactcgctgaaatgtacggcggaggcgagtccgataaagacagctag

SEQ ID NO: 216433 - DNA, 2385 bp, Artificial Sequence
  Description of Artificial Sequence: Synthetic coding sequence
atgcttactcggaactgcctgagcctactgctgtgggttcttttcgacggagggctccttacgccgctccagccccagccccagcaaacccttgctacagagccacgggaaaacgtgattcaccttccgggtcagcgatcgcacttccaaagagttaaaaggggttgggtttggaatcagttctttgttcttgaagaatatgtgggaagtgagccacaatacgttggtaaacttcactcagatctggataagggggaaggtaccgtgaaatataccctgtccggggatggcgctgggaccgtgttcactatagacgaaacaacaggcgacatccacgcgattcggtccctcgatagggaggaaaagcctttctacacattgcgcgctcaggctgtcgacattgaaacacgcaagccactggaaccggaatctgagtttatcataaaagttcaggatatcaacgataacgaaccgaagttcctcgacggtccttatgtcgcaacggtgcccgagatgtccccagtcggcgcatacgtgctacaagttaaggcaaccgacgccgatgatcctacatatgggaacagcgccagggtagtatacagtatccttcagggacagccatatttttcaatcgatccaaagacaggagtgatacgcactgcgctgccgaacatggatagagaagttaaggagcagtaccaggtgctgatccaggctaaagatatgggaggtcagctcggcggacttgccggaacaacaatcgttaatatcacactcactgacgttaatgacaatcccccacgattcccgaaatccatcttccacctgaaggttcccgagtcaagtccgattggctcagccatcggccgtatccgggctgtggatcctgacttcgggcaaaacgcggagatcgaatacaatatcgtccctggcgacggcggaaatctgtttgatatcgtgacggacgaggacactcaggagggggtgattaaacttaagaaacctctcgactttgagaccaagaaggcatacactttcaaggttgaagcatcaaacctgcacctggatcatcgctttcattcagctggtccatttaaagatacagccaccgtgaagatctcagtgcttgacgtcgatgagccccctgttttttccaagcccttatacaccatggaggtttacgaggataccccagtggggactatcattggcgctgttacagcccaggaccttgacgttgggtcctctgccgtgcgctactttattgactggaaaagtgatggagattcctattttacaattgacggcaacgaggggacaattgcaactaatgagctgctggacagagagagcacagcccagtataattttagcatcatcgccagcaaagtcagtaaccctctgctgacctcaaaagtgaatattctcatcaacgtgctcgacgttaatgagtttcctcccgaaatcagcgtcccgtatgagaccgcggtttgcgaaaacgccaagcccggtcaaatcatccagatcgtcagtgccgcagacagggatctttccccagccggtcagcagtttagctttcgccttagtccggaagccgcaattaaaccaaacttcactgtcagagacttccgcaacaatactgcaggcatcgagacaaggcgtaacgggtactccagacgccagcaagaactgtattttctccccgtggtcatcgaggacagttcataccctgttcagtcatcaacaaatactatgactattcgggtgtgtaggtgcgactctgacggcactatcctctcttgcaatgtggaagccatcttcctaccagtgggtctgagcacaggggcactcatcgcaatcctactgtgcatcgtcatccttctcgcaattgtggtcttgtacgttgcattgagaagacagaaaaagaaggatactctgatgacctcaaaagaagacatcagagacaatgtgatccactacgacgatgaaggaggaggtgaggaagacacacaggcctttgatatcggcgcactcaggaacccaaaggtcatcgaggaaaacaagatacgcagggacataaagcccgatagcctgtgtctgcccaggcagcggcctccaatggaggataacacagatattcgggattttattcaccagcgactgcaggaaaacgatgttgatccaaccgctcccccttatgattcattggcaacctacgcttacgaaggatctgggtctgttgccgaatcactgtcctccattgatagtttgaccactgaggcagaccaggattatgactacttaactgattggggccctcgattcaaagttctagccgacatgttcggcgaggaggaaagttacaaccccgacaaagtgacctag

SEQ ID NO: 216434 - DNA, 2385 bp, Artificial Sequence
  Description of Artificial Sequence: Synthetic coding sequence
atgttgaccagaaattgtttatctctcctgctctgggtcctgtttgacggcggactcctgactccactacaaccccaacctcaacagaccttggcaacagagcctcgggaaaacgtgatccacctacctgggcagcgttcgcattttcagcgagtgaagcggggatgggtgtggaatcagttctttgtgctcgaagagtatgtaggctccgaaccacagtacgtcggcaagctgcactccgacctggacaaaggggaaggcacggtcaagtacacattgtctggcgatggagcaggcactgtctttactattgacgagacgaccggtgacatacacgccatcaggtctctggacagggaagagaagcctttttacactctccgcgcacaggcagtggacatagaaaccaggaaaccgctggagcctgaatccgagtttataataaaggtgcaagatattaatgataacgagcccaagttcctcgacggcccatacgtagctactgtgcctgaaatgtctccggtgggggcatacgtcctccaggtgaaggcgacagacgccgatgatccaacatacgggaattctgctagggttgtatattcaatcctccagggtcaaccttacttcagcatcgacccgaagacaggggttatccggaccgcgctccctaacatggaccgcgaggtgaaagaacagtaccaagtgttaatccaagccaaggatatgggagggcagctggggggactggccggaactacgatagtgaatatcacgctgactgatgttaatgataatccccctaggttccctaagtctatatttcacctgaaagttccggaatcttcccccatcgggtctgccattggccgaatccgagcggtcgacccagacttcgggcaaaatgccgagatagaatataatattgtgcctggagacggaggcaacctgtttgatattgtcacagatgaagacacgcaggagggcgtaatcaagctaaagaaaccgctggactttgaaacgaaaaaagcttatacttttaaggtggaagcaagcaatttacacctggaccatagatttcacagcgccggaccattcaaggacacagctacagtgaaaatctcagtgcttgatgtggatgagccacccgtattcagtaagcccctctatacaatggaagtgtacgaagataccccagtcggcacgatcatcggggctgttactgcccaagatctggatgtcggcagctccgctgttagatacttcattgattggaaaagtgacggcgactcctatttcacaatcgatggtaatgaaggaaccattgccaccaacgaacttttagatcgggaaagtaccgcacagtacaacttttcgatcatagccagtaaagtgtccaatccactgttgacctccaaagtgaatatcctcatcaatgtgttggatgtgaacgagtttcctccagagatctccgtgccctatgaaaccgctgtgtgcgaaaacgccaaacccggacagataattcagattgtgtcagccgctgatagagatcttagtccagctggacaacaattttccttcagattgtcccccgaggccgcaatcaagcctaactttactgtgagggactttcggaacaacacagccggtatcgagacccggagaaatggctatagtaggcggcagcaggaactatactttctgcccgtcgtgatagaagattcctcctaccccgttcagtccagcacgaacaccatgaccattagggtgtgcagatgcgattccgatggaactattctgagctgcaacgtagaagccatcttcctccccgtggggctctcaacaggagccctcatcgcaatcctgctttgcattgtaatcttactggccattgtcgtactgtatgtggcgctccgccgtcagaagaaaaaagatactctgatgacctctaaagaagacatccgagataacgtgatacattatgatgatgagggagggggagaagaggacacgcaggcctttgacataggagcattgagaaatcccaaagtcatcgaagagaataagatcaggcgggacatcaagccagattctttatgtcttccaagacagcggcctcccatggaggacaacactgacataagagattttattcaccagaggctccaagaaaatgatgtagaccccaccgcacctccatatgactctcttgctacctacgcttatgaaggatccggctctgtcgctgagtcactgtcctctatcgattcactgaccaccgaggcagatcaggactatgactatttgactgactggggtccaaggtttaaagtgctggcggatatgtttggggaggaggagtcatacaatcctgacaaggtgacgtag

SEQ ID NO: 216435 - DNA, 2265 bp, Artificial Sequence
  Description of Artificial Sequence: Synthetic coding sequence
atgctgacaaggaactgcttgagcttgctgttgtgggtattattcgatggcggactattgacccccctgcagcctcagcctcagcagacacttgccacagaaccccgagagaatgtaattcacttaccaggacagagatcccatttccagcgcgtaaagcggggttgggtttggaaccaatttttcgttctggaagaatacgttggaagcgagccccagtacgtggggaagcttcatagcgacctagataagggtgaggggacagtcaagtacacgcttagtggggatggagcaggaactgtgttcacaatcgacgaaacgaccggtgacatccatgccatcagatccctagacagagaagagaagcctttctatacgctgagagctcaggcagtggatatcgaaacccgaaagccgctagaacctgaatccgaattcattatcaaggtgcaagacatcaacgataacgagccgaaatttcttgatgggccatatgtggccaccgtgcccgaaatgagccccgtgggagtgattcgcacagcactccctaatatggaccgggaagtcaaagaacagtatcaggtgcttatacaggcaaaggatatgggcggacagttaggtggtctcgcaggcactaccatcgtgaatatcaccctcacagatgtgaatgataatccacccaggttccccaaatccatcttccacctcaaggtgccagaaagctctccaataggaagtgctatcggtcggatacgtgctgtggaccccgactttggacaaaacgcagaaattgaatataatattgtgcctggggacggcggtaatctgtttgatatcgtgacagacgaggatacgcaggaaggggtgatcaaactgaagaagccccttgacttcgaaaccaaaaaagcatacacattcaaagttgaggctagtaacctgcacctcgaccatcggtttcattcagccggtccatttaaagacacggccactgtgaagatttccgtcctcgatgtggatgagccaccagtgtttagcaagccactgtacaccatggaggtgtatgaagatacacctgtggggaccataattggagccgtgacggcacaggatttagacgtcggaagttccgcagtgcgctacttcatcgactggaaaagcgatggcgacagttatttcaccatcgacggaaatgagggaactatcgctacaaatgaactgctcgaccgggagagtaccgcgcagtacaatttctctatcatcgcaagcaaggtgagcaatcccctcctgacatccaaggtgaatatccttatcaatgttctggacgtcaatgagtttccgcctgaaatctccgtcccctatgagactgctgtgtgtgaaaatgccaaacccggtcagatcattcagatcgtgagcgcggctgacagggatctctcaccggctggccagcaattctccttcaggctgagccctgaagccgcaattaaacctaatttcactgtcagggacttcaggaataataccgcgggaattgagacaagacgtaacggatactcacgcagacagcaagagctctattttcttccagtcgtcattgaggatagctcttatccagtacagtcaagcacaaatactatgactatccgcgtgtgcagatgcgactcggatggtaccattttaagctgcaacgtcgaagccatattcctgcccgtgggactttcgacaggtgccctcatcgcaattctcctgtgcatcgtgatcctgttggctattgtcgttctctacgtcgctctgagacgtcagaaaaaaaaagacactctcatgacttcaaaagaggacatccgggataacgtgatccattatgatgatgaggggggaggcgaagaggatacccaggcctttgatatcggcgctcttaggaaccccaaggtcatcgaggaaaacaagatccgcagggatattaagcccgactctctgtgcctgccacggcaacgtccccctatggaagataataccgatattcgggatttcatccaccagaggctgcaagagaatgacgtggatcccaccgccccaccttatgattccctagccacttatgcctacgagggctcgggctccgttgccgagagcctgagctcgatcgactccttaacaacagaagctgaccaagactatgactatcttaccgactgggggcctaggttcaaggtgctcgccgacatgttcggggaggaggagagctacaaccctgataaagtcacttag

SEQ ID NO: 216436 - DNA, 2445 bp, Artificial Sequence
  Description of Artificial Sequence: Synthetic coding sequence
atggacgcagctttcctcctggtgctaggcttactggcacaatcgttatgcctgagtttgggggtgcccggatggcgcagacctactaccctatatccatggcgacgtgcaccggctttatcccgggtgagaagggcgtgggttattccacctatttccgtgagtgaaaaccacaagaggctgccgtaccccttggtccaaatcaagtccgataaacaacagctcgggtcagtaatctatagtatccaggggcctggggtggatgaggaaccacgcggtgtctttagcatagacaagtttaccggtaaggtctttctcaatgctatgctagaccgggaaaagactgatcggtttagactgcgggctttcgctctggatcttggaggcagtacccttgaggaccctacggatctggagattgtggtggttgatcaaaacgataaccgaccggctttcttgcaggaggccttcactggcagagttctcgagggggctgtgcccggaacctacgttacccgagccgaggcaaccgatgccgacgatccggagaccgacaatgcggcactgagattctccatattacagcagggctcgcctgagctgttcagcatagatgagttgacaggagagatccggactgttcaagtcggcctagaccgagaagtggtggcggtctataatctcacccttcaggttgctgatatgtcaggtgacggactaaccgcaaccgcttctgctatcatcacacttgacgatatcaatgacaatgcacccgagttcactcgagacgagtttttcatggaggcaattgaagccgtctccggggtagatgttggcagactggaagtcgaagacagagacctccctggctcccctaactgggtggccagattcaccattctggagggcgatccggacgggcaattcacgattcgaacagacccaaagactaacgagggcgtgctctccattgttaaagcgttagactatgaatcatgtgagcattacgagctgaaggttagcgtgcagaatgaggctcccctgcaggctgcagcactgcgtgccgagcggggacaagctaaagttcgggtgcacgtgcaggatacaaatgagcccccagttttccaggagaatcctttgcggacgagtttggcggaaggggcacctcccggaaccctggtggccaccttttcagcgagggatccagatacagagcaactccaacggttgtcatatagtaaggactacgaccctgaagactggctgcaggttgacgccgcaacagggaggattcagactcagcacgtactgagcccagcctcaccattcctcaaaggagggtggtacagggctatagttcttgctcaggatgatgcctcacagcccaggacggctactggaaccttgtccattgaaattcttgaggtcaacgaccatgccccagtgctagctccccctccccctggaagcttgtgctccgaaccgcaccaaggcccaggtctactgctaggggctacggacgaagatttaccacctcacggtgcgcctttccacttccagctctctcctcgcctgccagaactggggcgaaactggtctctcagccaggtaaacgtgtcccacgccaggctgaggcctcggcaccaagttccagaaggactgcacaggctttcactgctgctcagagattcaggccagcctccccaacaacgcgaacagcccctgaatgtaactgtgtgcagatgcggtaaggatggagtctgtctgcctggcgctgctgctttactggctggcggtactggcctctctcttggggcactcgtcattgtactcgctagtgccctgctgttgttggtgctcgtgcttctggtcgccctcagggccagattctggaaacagtccagggggaaggggctgttgcatggccctcaggacgacttacgagacaatgtcctgaattacgacgagcagggcggtggcgaggaggatcaggacgcctacgacatttcgcagctgcggcacccaacagctctgagcttgcccctgggccctcctccccttaggagggacgcaccccagggtcggctccaccctcagccccctcgcgtacttcccacatcgcccctagacattgccgactttataaatgacgggctagaagcagccgattctgacccatcagtgcccccatacgacaccgctttaatctatgattatgagggcgacggcagcgtcgccggaaccctgagcagtatcctttcctcccagggtgacgaggaccaggactatgattatttacgtgactgggggccacgattcgccagactcgccgacatgtacgggcacccctgtggattagagtacggcgcacgctgggaccaccaggcccgagaaggcctctcacccggagcccttttgcccagacaccgcggacgcacagcatag

SEQ ID NO: 216437 - DNA, 2373 bp, Artificial Sequence
  Description of Artificial Sequence: Synthetic coding sequence
atggtcccggcttggctctggctgctttgtgtttcggttccacaggcactgccgaaggcccagcccgcagaactctcagttgaagtgccagagaattacggtgggaacttcccactgtatctgaccaagttacctctgcccagggagggcgcagagggccagatcgttctgagtggagacagcgggaaagctaccgagggtccatttgccatggacccagacagcgggtttttgcttgttacacgcgctttggacagggaggagcaggcagagtaccagttgcaggtgacattggaaatgcaggacggtcacgtactatggggaccacagcctgttctggtccatgttaaggatgagaatgatcaagtcccacatttttcccaggccatctatagggctaggctgtccagggggacacgaccaggtatcccttttctgtttctggaagcgagtgacagggatgaacctgggacagcaaatagcgatttacgcttccacatcctcagtcaagctcccgcacagccaagtccagacatgttccagctcgaacccagacttggcgctctggcgctgtcaccaaagggaagtacttctttagaccatgcacttgaaaggacttaccagctgctggtgcaggtgaaagatatgggtgaccaagcatccggacaccaggcaacagctacagtggaggtctccattatcgagtccacctgggtctccctcgagccaatccatcttgcagagaaccttaaagtcctgtatcctcaccatatggcgcaagttcactggtcaggcggagacgtgcactaccatctggaatcccaccctcccggtccttttgaagtgaatgcagagggaaacctttacgtgactagggaattggaccgagaggctcaggcagagtaccttcttcaagtgcgggctcagaacagccacggggaagactacgctgctcctctggagctacatgtactggtgatggacgagaacgacaacgtccctatctgccccccacgagatccgacagtctctatccctgagctctccccacctggtactgaggtgacgaggttgagtgcggaagacgctgatgcccctggaagccccaattcacacgtcgtgtatcagctcttgtcccccgagcctgaggacggagttgaaggaagggccttccaggttgaccccacttccgggtccgtcacccttggagtgttgccactgagagccggacagaacattttactgctcgtcctcgccatggacctcgccggagctgagggtggattctcttctacatgtgaagtagaggtcgctgtcactgatataaacgaccatgcccctgagttcatcaccagccagattgggccaatctctctcccggaggacgttgagcctggtactctggtggcaatgctaacagccatagacgctgacctagaacctgcctttcggctgatggacttcgctattgaaagaggggacaccgaaggaacattcggactggactgggagccggattccggccatgtccgccttcgcctctgcaagaatctttcatatgaggccgctccaagtcacgaggtcgttgtagtcgttcagagtgtagcgaaattggtgggtccaggtccaggcccaggggctactgccactgttacggttcttgtggagcgtgtcatgccgccacccaagctagatcaagaaagttatgaggctagtgtgcccatctcggccccagccggttcatttttgctgacaattcaaccatccgaccccatcagtcgaacactgcggtttagcctcgttaatgactccgaagggtggctgtgcatagagaagttttccggtgaagtccataccgcgcagtccctccagggcgctcagcctggagacacctacacagtgctcgtggaggcccaagataccgaccacggccttatcgtttccggccctagtaaggaccccgatctggcttccgggcacgggccttattcctttaccctgggacccaaccccaccgtgcagcgggactggcggcttcagacccttaacgggtcacatgcctatttgacgctcgcattacattgggtcgagccacgcgagcacattatccctgtagtggtgtctcacaacgctcagatgtggcagctccttgtaagggtgatcgtgtgcagatgtaatgtggaaggtcagtgtatgcgtaaagtcgggaggatgaagggcatgcccactaaactgagtgcggtgggaatccttgtcggaactcttgtggcgataggcatcttcctgatcctgatctttacgcattggactatgtcacgcaagaaggaccctgaccagccggctgatagcgtcccactgaaagccacagtctag

SEQ ID NO: 216438 - DNA, 2199 bp, Artificial Sequence
  Description of Artificial Sequence: Synthetic coding sequence
atggttccggcttggctctggctcctgtgcgtgagtgtccctcaggcactccctaaagcccagccagccgagctcagcgtggaggtgcctgagaactacggaggtaactttcccttgtacttaaccaaactaccactgcctcgagagggagccgagggtcagatagtgctgtcaggagactccggcaaagccaccgaagggcctttcgctatggatccagactccggttttctattggtcacccgcgctcttgatagggaagagcaggctgagtaccaactgcaggtcacactcgagatgcaggacggccatgtgctctgggggccacagcctgttttggtccatgtcaaagacgagaatgaccaagcctctggccaccaggcaaccgctactgttgaggtatctatcattgagtccacctgggttagtctggagccgatccatttagccgagaatctgaaggtgttgtatccacatcacatggcccaggtgcattggtcaggaggtgatgtgcattatcatctcgagtcgcaccccccaggaccgtttgaagttaacgctgaaggcaatctgtacgttaccagagaattggaccgcgaagcgcaagctgaatatttgctgcaggttcgcgctcaaaactcacatggcgaggattacgccgctcccttggaacttcacgttttagtaatggacgaaaatgacaatgtgccaatttgtcctccgagagaccccaccgtcagcatccctgagctgtctcccccaggcacggaggtgacccggctatccgcagaagatgcggacgctcccggttccccgaacagtcacgtcgtatatcagctgctatcccctgagcccgaagatggtgtagagggtagggcctttcaggtggatcccacctccggctctgtgactctaggtgtgctgcctttacgggctggacagaatatattattgctggtactggcaatggacttagctggagcggaaggcggatttagttcaacatgtgaagtggaagtggccgtcaccgatattaatgaccacgcccctgagttcatcacaagccagattggacctatttcgctacctgaggacgtcgaacccggaacattagtggctatgctgaccgctatcgacgctgatctggagccggctttccgcctcatggatttcgctatcgagcggggagatacggaaggaacttttggactggattgggaacctgactccgggcatgtacggctccggttgtgtaaaaacctcagctacgaggcagcccctagccatgaggttgtggtggtagtgcagtctgtcgccaaactcgtgggccctggacccggacccggagccacagcaaccgtgacggtgctcgtggagcgtgtgatgcccccacctaagctcgaccaggaaagctacgaagcaagcgtgccaatttctgcacccgctggcagcttcctgctgacaatccagcctagtgacccaatctctcggactctgcggttttctctcgttaacgactcggaaggttggctctgcatcgaaaagttctccggggaagtgcacactgcgcagtctctgcagggcgctcagcccggtgatacttatacagtgctcgtcgaggcccaggacactgatgagcctaggctgtcagcgtccgctcctcttgtgattcactttctcaaggctcctccggctcctgcgctcaccctcgcccctgtgccctcgcagtacctgtgcactccgagacaggaccacgggctgatagtgtccgggccaagcaaagacccagaccttgcttcaggccacggaccttactcatttactcttggacccaacccaaccgttcagcgcgactggcgacttcagactctgaacggcagccatgcctatcttacgctggcactccattgggtggagcctcgcgaacatatcataccagtagtggtaagccacaatgcccaaatgtggcaactgcttgtccgtgttatagtgtgccggtgtaatgtggaaggacaatgcatgcggaaggtagggagaatgaagggaatgccaactaagctctcagctgtgggtattctggtgggaaccctcgtggctattgggatcttccttattctgatctttacacactggactatgtcaaggaagaaagaccccgatcagccagccgactctgtgccactaaaagcaactgtgtag

SEQ ID NO: 216439 - DNA, 2490 bp, Artificial Sequence
  Description of Artificial Sequence: Synthetic coding sequence
atggttcctgcttggttatggcttttgtgcgtctctgtcccccaggccttgccaaaggcccaacctgctgagctgagtgtggaagtccctgagaactacggcggaaactttcccctgtacttgaccaaactccccctcccgagggagggagcagagggtcagatcgtgttgtcgggagattccggtaaggcaaccgaggggcctttcgcaatggatcctgactccgggttcctgctggtaaccagggccctcgatcgggaggagcaggcagagtatcagcttcaggtgactctcgaaatgcaggatggtcacgtactgtgggggccacagcccgtgctcgtgcatgtgaaggatgagaacgatcaagtgcctcacttttctcaagcaatctatagagcacgcctgtctagagggacccgaccaggaatcccgtttttgttcctcgaggcatcggacagggacgagcctggaactgcgaacagcgatctccgcttccacatcctcagtcaggccccagctcaaccctcaccagatatgttccagttggagcccaggctgggtgcactggccctgtcccctaaaggatctacatcgttagaccacgcacttgagcgcacttaccagctcctagtgcaggttaaggatatgggagatcaggccagcgggcaccaggccaccgcaacggtcgaggtcagcatcatcgaatccacatgggtgtcgttggagccgatccatctggccgaaaatcttaaagttttgtaccctcaccatatggcccaagtacactggtcagggggagatgtgcattatcatctggaatcacacccacccggaccctttgaggtgaacgcggagggaaatctctacgtgacaagagaactcgaccgcgaggctcaggccgaatacctacttcaggtgcgcgctcagaactcgcacggagaagactacgcagcacccctggagctgcatgtgctggtgatggatgagaacgataatgtgcccatctgcccacctagggaccccaccgtgtctattcctgaattgtcacccccagggaccgaggtgaccaggctaagcgccgaggacgctgatgccccaggctcacccaacagccacgtggtataccaactcctgtctcctgaacccgaagacggcgtggaggggagagcctttcaggtggacccgacatctggcagcgtgacactgggcgttcttcctctcagagccggacaaaacatcctgctgctggtactggctatggacttggccggtgcagagggaggctttagctccacttgcgaggtcgaagttgctgtcacagacatcaatgatcacgccccagagttcatcacatcgcagatcggccctatcagcctaccggaggacgtggagcccggaacattggtcgcaatgcttactgccattgacgccgacctggagcccgcatttcgcttaatggactttgctattgagagaggcgatactgaaggcacttttggactggactgggaaccagactccgggcatgtccgcttgcgtctttgtaagaatctgagctacgaagcagccccttcacatgaagtggttgtagtggtgcagagcgtcgcaaagcttgtgggacccggtcccggtccaggggcaactgcgaccgttacagtgttagtcgagagggttatgcctccgccaaagcttgatcaggaaagctatgaggccagcgtcccaattagcgcaccggctggaagctttctgctgaccatacagccctctgacccgatcagcagaactctgcgattttccctcgtgaatgattccgaaggctggctctgcatcgaaaaattttcaggggaagtgcatacggcccagagtctgcaaggcgcacagccgggtgatacttatacagtgctggttgaggcgcaggatactgacgaacccaggctgtccgccagcgcaccgctggtaatccactttctgaaagcccctccagcaccagctctgacactggctcctgtgcctagtcagtacctgtgcacaccacggcaggaccacggtctgatcgttagcggcccatccaaggatcctgatttagcctccggacacggcccttactcctttactctaggaccaaaccctacagtccagcgggactggcgattacagaccctgaatggatctcacgcctatctcaccctcgctctccactgggtcgaaccacgtgaacatattatccccgttgtcgtgagccataacgctcagatgtggcagcttctggttagagtgatagtgtgtcgctgcaacgttgagggtcaatgtatgcggaaggtcggaaggatgaaggggatgcccaccaaactcagtgctgtgggcatcctggttgggacactcgtcgccatagggatctttctgatcctgatcttcactcactggacaatgtctcgaaaaaaagacccagatcagcccgctgattcagtgcctttgaaggccacagtctag

SEQ ID NO: 216440 - DNA, 2424 bp, Artificial Sequence
  Description of Artificial Sequence: Synthetic coding sequence
atggtgcctgcctggttatggcttctgtgtgtctcagtgcctcaggccctgcccaaggcccaaccggcagaattatccgtcgaggtgcctgagaattacgggggaaacttcccattatacctcacaaagttgccgcttccaagagaaggggcagagggccagatcgtactgtcaggtgactccggcaaggcaaccgaagggccatttgctatggatcccgacagcgggttcctgctggttacgcgcgcactggaccgggaggaacaggccgagtaccagcttcaggtgaccctcgagatgcaggatggacacgtcctctggggcccacagcccgtgctggtgcacgtgaaggacgagaatgaccaggttccacacttctcccaggccatctatcgagctaggttatcaaggggaacacgtccgggaattccgtttctgtttctggaagcctctgacagagatgagcccggtaccgccaatagcgatttgaggtttcacattttgtctcaggccccagcccagccctccccggacatgttccagctagagcctcggctgggagcgctggcactgtctcccaaggggagtacgagtctggatcatgcattggaaaggacataccagctgttagtgcaagtcaaagacatgggcgaccaggcgtctggtcaccaggccaccgctactgtggaagtgtccattatcgagtcaacgtgggtgtctcttgagcctatccatctcgccgagaacctgaaagtgctgtatccacaccatatggcacaggtgcactggagcggaggcgacgttcattatcatctggagagccaccctcctggcccttttgaagtgaacgccgagggtaacctttatgtgacaagggagctcgatcgcgaagcccaggcagagtacctactgcaggtccgtgcccaaaactcacacggggaagactacgcggctccccttgagctgcacgtgctggtcatggatgagaatgacaacgtccctatatgtccaccccgagaccctaccgtctcgatcccagagctgagcccaccaggtacagaagtgacgagattgtctgctgaggacgccgatgctcccggatctccaaatagtcatgtggtgtaccagctgctgtccccggagcctgaagatggggtggaaggtagagcctttcaggtcgatccgacttcaggttcggtcacactgggagtcttacccctcagagccggacaaaatatcctgttacttgtgctcgccatggaccttgctggagctgaggggggatttagttccacctgtgaggtcgaggttgctgtgactgacatcaacgatcacgccccagagttcattactagtcagatcgggccaattagtttgccagaggacgtagaacctgggactcttgtcgccatgcttacagcaatcgacgctgacctagaacccgcattcaggttgatggatttcgccatcgaacgaggcgatactgaaggtaccttcggactggattgggaaccagatagcggccacgtgagactcaggctgtgcaagaatctctcttacgaggcagctccctcccacgaagtagtggtggtggtgcagtccgttgcaaagttggtggggccaggcccaggcccaggcgctaccgccacggttacagttttggtggagcgtgtgatgcccccacctaagcttgatcaggaaagctatgaggcttcagtgcctatttccgcgccagcaggtagttttctgctcactatccagccttcagaccctatttcgaggacattgcggttttccctggtgaatgactccgagggctggctttgcattgagaagttttccggggaggtgcatacggcccagtccctgcagggcgctcaaccaggcgacacttacacggtgttagtcgaggcccaggatactgcactgaccttggcgccagttccgagccaatacctttgcacacctagacaggaccacggattgatcgtgtccggacccagcaaagatcctgacttggcctctggccatgggccatatagcttcaccttggggccaaacccaaccgtacagagagactggcgcctccagaccttaaatggatcccatgcctaccttactctggcactgcactgggttgagccgcgtgagcatattataccagtggtagtttcccacaacgcacaaatgtggcaactcttggtgcgggtaatagtgtgccgttgtaacgttgagggtcagtgcatgaggaaggtggggagaatgaagggcatgccaacaaagcttagcgcagttgggatactggtgggtacgctggtggctatcggaatttttctgatactgatattcacacactggacaatgtccaggaaaaaagaccccgatcagcccgctgattctgtccctctgaaggcaacagtgtag

SEQ ID NO: 216441 - DNA, 2382 bp, Artificial Sequence
  Description of Artificial Sequence: Synthetic coding sequence
atggttccagcctggctatggctgttgtgcgtatctgtgccccaagcccttccaaaggcccagccagccgaactgtcagtggaggtgcctgaaaactacggcggaaatttccccctatatctgacaaagttgccgttgcccagagaaggggctgaaggccagatcgttctctccggagaacaggccgagatgcaggacggacacgttttatggggccctcagcccgtgcttgttcatgtaaaagatgaaaacgatcaagtgccccacttttcacaagccatatatcgcgctagactctcacgcggaaccagaccgggaatacctttcctgttcctggaggctagtgatcgagatgagcctggcaccgctaactccgacctccgcttccacatcctgagtcaggctcccgctcagccttctccagacatgtttcagctggagccaaggcttggcgctttggcactgtctccgaaggggtccaccagcttagatcatgctctggagagaacgtatcaacttttagttcaggtcaaagatatgggtgatcaggcctccgggcatcaggcgacagctaccgtggaggtctcaatcatcgagagcacctgggtgagccttgagccaattcacctagccgagaacctcaaagtcctctatcctcaccacatggctcaggtccattggtctgggggtgacgtgcattatcacctcgagtcacatcctccgggtccatttgaagtgaacgcggagggaaacttgtacgtaacccgtgagctggatcgcgaagcccaggcagaatacctcttgcaggtacgagcccaaaacagccatggagaggactatgccgcacctctggagctccacgttctcgtcatggacgagaacgacaacgtcccaatctgcccgccacgggaccccactgtaagcattccagaattatcaccacctggaaccgaggtgacacggctgagtgccgaagacgccgatgcccctggatcacccaacagccacgtggtttaccagctgctatccccagaaccggaagacggtgtggaaggcagagcttttcaagtagatcccacatctgggagcgtcactctgggggtgctgccactccgtgctgggcagaacattctgctgttggtgctggccatggacctggccggtgcagaagggggattctcttccacctgtgaagtagaggtggccgtgactgatataaacgatcatgcccctgagttcattaccagccaaataggtcccatatctctgccagaagacgtggaaccgggtacgttggtggccatgctcacggctattgacgccgatcttgaacctgccttccgcctgatggactttgccatagagagaggggatactgaaggaacgttcggactcgactgggaacctgacagcggacacgtcagactccggctttgtaaaaatctctcctacgaagctgctccatcccacgaagtggtagtggtggtgcaaagcgtcgccaagctggtggggcctggccctggtcccggagccactgcaacggtaaccgttttggtggagagagtaatgccgccaccaaaactggaccaagagagttacgaagcaagcgtgcccatcagtgctcctgccggaagtttcctgctgactatccaaccaagtgatccgatttctcgtactctgaggttctccctcgtgaatgattctgagggttggctgtgcatcgagaagttttccggggaagtgcacaccgctcaatcactgcaaggcgcacagccgggtgatacttatacagtcttagtcgaagcccaggatactgacgagccaaggttgtcggcctctgcgcctctcgtgatccacttcctgaaagccccaccagccccagcgctgactctggcacccgtcccgagccaatatctgtgtacccctagacaggatcacgggctgattgtctcaggtccatctaaggaccccgatctagccagtggacacggcccatactcctttacccttggacccaaccccaccgtacagcgtgattggcggctccaaactctgaacggcagccacgcctacctaactctggccctccactgggtggaaccaagggaacacataattcccgtagtggttagccacaacgcacaaatgtggcaactgttggtgagggtgatcgtctgccggtgtaacgtagagggccagtgtatgagaaaggttgggcgaatgaaggggatgcccactaaactgtcggccgtgggcatactcgtaggcacactggtcgctattggaatcttccttatcctcatcttcacccactggacaatgtcacgtaagaaagacccagatcaacccgctgattcggttcctctgaaagctaccgtgtag

SEQ ID NO: 216442 - DNA, 2499 bp, Artificial Sequence
  Description of Artificial Sequence: Synthetic coding sequence
atgatcttgcaggctcaccttcacagcctttgcttgttgatgctgtatctagctacgggatatggtcaggaagggaagttctccgggccactgaagcctatgacgttttctatctatgaggggcaagagccgtcccagataatcttccagtttaaagctaatccccctgctgtgacattcgaacttaccggggagaccgacaatatttttgtcatcgaacgcgagggcttgttatactacaatagagcattggatagagagaccagatctacccataacctgcaggtcgccgctctggatgctaacggcattattgtggaaggccctgtgccaattaccattaaggtaaaggacattaacgataacaggcctacgttccttcagagtaaatatgagggctccgtccggcagaacagcagacctgggaagccgtttctgtacgttaacgcaaccgatctcgacgacccggcaacacccaacggacagctgtattaccagatcgtcatacagttaccaatgattaataacgtcatgtattttcagatcaataacaagactggtgctataagcctgacaagagaaggaagccaggagctcaatccggctaaaaatcccagctataatctcgtgataagcgtgaaggatatgggcggacagagtgaaaacagcttttcagatacaacgtccgttgacatcatcgtaaccgaaaatatctggaaagctcccaaacccgttgagatggtcgagaactctacggaccctcatcccatcaagatcacgcaggttagatggaacgaccccggagctcagtatagcctcgtagacaaagagaagcttcccaggttccctttcagcatagatcaggagggcgatatctatgtcactcagcctctggatagggaagagaaggatgcatacgttttctacgccgtggctaaagatgagtacggaaaacccctttcatatcccctcgaaattcatgtaaaagtcaaggatatcaatgacaatcctcccacctgtccatccccagtgacagtttttgaagttcaggagaacgaaagactgggaaactccatcgggacattgaccgcccacgaccgcgacgaggaaaataccgcaaactcgttcctcaattatagaattgtagagcagacacctaagctacctatggacggcctattcttgatacagacctacgctggtatgctgcagctcgccaagcagagtctgaagaaacaggacacgccccagtataatctgacgatcgaagtgtcagataaggactttaagaccttgtgttttgtgcagatcaacgtaatagatatcaacgaccagattcccatttttgagaaaagcgactatggaaatctgacgcttgccgaagacacaaatattggcagtaccatattaaccattcaggccactgacgccgatgaacccttcactggcagctcaaagatattgtatcacatcatcaagggagattctgaaggcaggctgggcgtcgatactgacccccataccaatactggttatgtcataattaaaaaaccgctggactttgagactgctgccgtctccaatattgtcttcaaggctgaaaacccagaacctctggtttttggtgtcaagtacaatgcgtctagcttcgccaaattcaccctaatcgtcacagatgtaaacgaggccccacagtttagtcaacacgtgtttcaggccaaggttagcgaagatgtcgccatcggcacgaaggtggggaacgtgactgccaaggacccagagggcctagacatttcgtacagtttgcgtggtgataccagaggatggctaaagatagatcatgtgaccggggaaattttctctgtggcacccctcgatcgtgaggccggatccccctacagggttcaggttgtcgcaacggaggtcggcggatcctccctttcctctgtgtccgaatttcatctgatcctcatggacgtgaacgataatccgcctaggctcgccaaagactacacgggcttattcttctgccatccactatctgccccaggatcactgattttcgaggctacagatgacgaccagcacctcttccgcggaccccacttcacattcagtctgggcagcggatccctacaaaacgattgggaggtctccaaaattaacggcacccatgctcggctgtcaacccggcataccgaatttgaggaaagagaatatgtggtgttaatcaggattaacgatggagggaggccaccactggaagggatcgtgagccttcccgttaccttctgttcctgcgttgaaggcagctgctttcgaccggcagggcaccagacgggaattccaactgtcggaatggctgtggggatactgctgaccacactacttgtgattggcataattttggccgtggtttttattcgtattaaaaaggataagggaaaggacaatgttgaaagtgcccaagcgtccgaggtgaagcctctcagatcttag

SEQ ID NO: 216443 - DNA, 2499 bp, Artificial Sequence
  Description of Artificial Sequence: Synthetic coding sequence
atgatcttacaagcccatttacactccctgtgtttattaatgctgtacctcgcaaccggttatgggcaggagggtaagtttagtgggcctttgaaacccatgacttttagcatctatgagggtcaggaaccttcccaaatcattttccagtttaaggccaacccacccgctgtgacctttgaactgactggcgagaccgacaatatcttcgtgatcgagcgcgaagggttactctactacaaccgggctctggatcgggaaaccagatccacccataatctgcaggtggctgcccttgatgcaaacgggataatcgtggaaggccctgtgcctataacgatcaaggtcaaggacatcaacgacaaccggccaacattcctccagtctaagtatgaaggttctgttcgccagaactctcgccctggaaaaccttttttatatgtgaacgcgacagatctggacgatcctgctacacctaacgggcagttgtactaccaaattgtcattcaactgcctatgatcaataatgtgatgtattttcagattaacaacaagaccggcgctatcagtcttacccgcgagggttcccaggagcttaatccagccaagaacccatcatataatcttgtgataagtgtgaaggacatgggcggacagtcagaaaatagcttttctgacaccacgtccgtggacataatcgtgaccgagaacatttggaaggcccctaaacccgtggagatggtcgaaaactctaccgacccccaccccatcaaaatcacacaggtccgctggaacgacccaggcgctcagtattccttggtggataaggaaaagctcccccgtttcccttttagtatcgatcaggaaggtgatatctatgttactcaacctctcgacagagaggagaaggacgcttacgtgttctacgctgttgctaaagatgaatacggaaaacctctttcatatccactggaaatccatgttaaagtgaaggatatcaacgacaaccccccaacttgtcctagcccggtcaccgtgttcgaagtgcaggagaacgagaggctcggaaactctattgggacgcttacggctcatgacagagacgaggagaatactgctaattcctttctcaactaccgcattgttgaacagacgccgaaattgcctatggatggcctgttcttaattcagacttacgccggaatgctgcagctggcaaagcagtcactcaagaaacaagatactccccaatataacttgaccatcgaggtttcagataaggactttaaaacactttgctttgtgcagatcaatgtaatcgacatcaatgaccagatcccaatattcgaaaaatcagattacggtaaccttacacttgccgaagacacaaatattggtagtacgatcctcactattcaggcaacggacgctgacgaaccattcacagggagtagtaaaatcctgtatcacattatcaagggggattcagagggtcgcctgggcgtcgacactgacccgcacacaaataccggctatgtgataatcaagaagcctttagatttcgagaccgcagccgtctctaacatcgttttcaaagcagagaaccctgaaccacttgttttcggggttaagtacaatgcctcgagcttcgctaagtttactctgatagttaccgatgtgaacgaggctccacaattctcacagcacgtgttccaggcaaaggtatcggaggatgtagcaatcggcacaaaagtgggaaacgtgaccgctaaagaccccgaggggttggatatctcatacagtctgagaggcgatacaagaggctggcttaaaatcgatcacgtgacgggagagatttttagcgtggcacctctcgacagagaagcagggtcaccttatagagtccaggttgtcgccaccgaggtaggcggatcctcgctgagctcggtgtccgagttccacctcattctgatggacgtgaatgataatccaccgaggttagcaaaggactacacagggttgtttttttgccaccccctgtccgcacccggtagtttaatttttgaagccaccgatgacgatcagcatctgtttagaggcccacatttcacattctccctcggctccggaagtttacagaacgactgggaggtctccaaaatcaatggaacgcacgccaggttgtcaacacgccacactgagtttgaagaaagggagtatgtggtattgataagaataaacgacggcggtaggcctccactcgaaggcatcgtttcactgccggtgactttctgttcttgcgtcgagggcagctgcttccgtcccgctggccaccaaacgggaataccaactgttggcatggcggttggcattctgctgacaaccctgctcgtcattggaatcattcttgccgtggtgtttattcgcataaaaaaagacaagggaaaggacaatgtggaatctgcccaggcgagcgaagtgaaaccactgcgctcatag

SEQ ID NO: 216444 - DNA, 444 bp, Artificial Sequence
  Description of Artificial Sequence: Synthetic coding sequence
atgatcctgcaggcgcacttacactctttgtgcctcttaatgctgtatctggcaaccggatatggtcaggagggcaagttcagcggacctctcaagccaatgacgttctcaatctacgaagggcaggagccgtctcagattatttttcaatttaaggcgaatccacccgcagtgacctttgagctgaccggtgagaccgataacatctttgttatcgagagggaaggcctgctgtattacaacagggcgttagatcgggaaactcggtcgacgcacaatttgcaggtggccgctctggatgccaacggtatcatcgtcgaaggacctgtgccaatcaccattaaagtaaaagacattaatgataatcggcctactttcctgcagtccaagtatgagggaagtgtacgtcagaacagccgacccggtaagcctttcctctattag

SEQ ID NO: 216445 - DNA, 2373 bp, Artificial Sequence
  Description of Artificial Sequence: Synthetic coding sequence
atgaagatcaccagtacctcttgtatatgccccgtactagtctgtctatgcttcgtccagcgttgttatggtaccgcgcaccacagtagtatcaaggtgatgcgaaaccagacgaaacacatcgagggagaaactgaggtccatcacagaccaaaaaggggctgggtctggaaccagtttttcgttctggaggaacacatgggccctgaccctcagtatgtgggaaaactccattctaacagcgacaagggcgacgggtctgtaaagtatatcctcacaggtgaaggcgctggtactattttcatcatcgatgatacgacgggcgatatccacagcaccaaatccttggatcgggagcagaagacccactacgtcctgcatgcccaggcaatcgaccggcgaaccaataagccgcttgaaccggagagtgaattcataattaaagtccaggatataaacgataacgcccctaagtttaccgacgggccttatatcgtgacggtgcccgaaatgtcagacatgggcacttccgtcctacaagtcacagcaactgacgctgacgatcccacctacgggaactcagctagggtcgtttatagcatccttcagggacagccttacttttcggtcgacccaaagacaggagtgattcgaacagcactgcacaacatggatcgggaggccagggagcattattctgtggtaatccaggctaaggacatggctggacaggtgggcggtctcagcggctcaaccacagttaatattaccctgacagacgtcaatgacaaccctccgagattcccacagaagcactatcaactctatgtccccgaaagcgcacaggtggggtcggctgttggcaaaattaaggcaaacgacgctgatacagggtccaacgccgacatgacttattccatcatcaatggcgatggcatggggatttttagcattagtaccgataaagagacaagagaggggattctctctttaaaaaaaccgctcaactatgaaaagaaaaagtcgtacacccttaacattgagggtgccaatacccacctggacttccgcttctcccacctaggaccctttaaagacgccacgatgcttaaaataatagtgggcgatgtggacgagcctcccctgttttctatgccaagctatctgatggaagtttatgagaacgccaaaatcgggaccgtggttgggaccgtccttgcacaggatccagacagcaccaactctctcgtacggtacttcatcaactacaatgtggaggatgatcgcttttttaatatagacgcaaatacaggtacaatccgcaccactaaggtgctcgatagagaggagacaccatggtacaatattaccgttaccgcctcagaaatcgacaatcctgatctgctctcgcatgtgaccgtggggattagagtgcttgacgtgaacgataatccacctgaactcgccagggagtatgacatcatcgtatgcgagaactcgaaacctggacaagtgattcacactatctccgccactgacaaagacgatttcgcgaacggacctcggttcaacttcttccttgacgaacgactcccagtgaaccccaactttaccctgaaagataacgaagacaataccgcttctatcttgacccgcagaagacgattctctcgcacggtgcaggacgtctattaccttcccatcatgatctccgatggcggtatacccagcctctcctcctcatccaccctgacgatccgcgtgtgcgcgtgcgagagagatgggagggtacggacttgtcacgcagaggcattcctgagctctgcaggcctcagcaccggcgctctaattgcaattctactttgcgtgctcattttgctggcaatcgtggtgttgtttattaccctgagaaggagcaaaaaagagcccttgatcatttctgaagaggacgtgcgcgaaaatgttgtgacctacgatgatgaaggaggcggagaagaagacaccgaagccttcgatattaccgccctaaggaacccctctgccgcagaagaattaaagtaccggcgtgacatacggccagaggtgaagctgactcctagacaccaaacctccagtacactggaaagcatagacgtgcaggagtttataaaacagcgcctcgctgaggctgacctggatccctctgtgccaccttacgatagccttcaaacctatgcctacgagggccaacgctcagaagccggatctatctcttccctggactccgcaactacacagagcgatcaggattaccattacctgggcgattggggtcccgaattcaaaaaacttgctgaactgtatggtgagatagagagcgaaaggaccacttag

SEQ ID NO: 216446 - DNA, 2373 bp, Artificial Sequence
  Description of Artificial Sequence: Synthetic coding sequence
atgaaaatcactagcactagctgtatctgtcctgtgctggtatgcctgtgttttgtgcaacggtgctacggaacagctcaccacagcagcataaaggtgatgagaaatcaaaccaagcatatcgagggcgaaaccgaagtccaccataggccaaagcgtggttgggtgtggaatcagttctttgtcctcgaagaacacatgggcccagatcctcagtatgtgggcaagcttcatagtaatagcgacaaaggagacgggtccgttaagtacatactgaccggagagggtgctggcaccatattcataatcgatgatacaactggcgatatccacagcacaaaatctctggacagggagcagaaaacccactacgtattgcatgcacaggccatcgaccgcaggaccaacaagcctttagaaccagagagcgagttcattatcaaggttcaggacataaacgataacgccccaaagtttaccgatgggccttacattgttacggtgccagaaatgtcagacatgggcaccagtgtcctgcaagtaactgctaccgacgcagacgacccaacctacggcaatagcgcccgagtcgtttactccattctgcaggggcagccctacttctcggtggatcctaaaactggagtgatccggacagcgttacacaacatggatagagaagcacgcgaacactattctgtggtgatccaggccaaagatatggctggtcaggtggggggtcttagcggctcgaccaccgtcaacatcaccctgactgatgtgaatgataatcctccaagatttcctcagaagcactatcaactgtatgtgccagaatctgcccaggtcggctctgccgtgggaaaaatcaaagccaatgatgccgataccggaagtaacgctgatatgacttatagcataatcaatggggacggcatggggattttctccattagcactgataaggaaacaagggaagggattttgagtctcaaaaaaccgctgaactacgaaaagaaaaaatcttacacactgaacatcgaaggtgccaacacgcacctcgactttcgctttagccatctcggtccttttaaggatgcaactatgttgaaaattattgtgggagatgtggatgaacccccactgttcagtatgccatcttatttaatggaggtttatgaaaacgcaaagatcggcacagtggtgggaaccgttctggctcaagaccctgatagtactaatagcctggtgcgctatttcattaactacaatgttgaagatgacaggttctttaatattgatgccaataccgggacaatccgcaccaccaaagtactcgatcgagaagaaaccccctggtataacatcactgtcactgcctccgaaatcgacaatcccgatctcctgtcgcacgtgacagtaggcattcgcgtgctcgacgtgaacgacaatcccccagagttggctagagagtatgacatcatagtttgcgagaatagtaaaccaggccaggtgatacacaccatcagcgcaacagacaaggacgattttgctaatggccctcgtttcaattttttcttggacgagcgcctaccggtaaaccccaactttaccttgaaagacaatgaggataacaccgcatccatcctcacccggagacggaggttcagccgcaccgtacaggacgtgtactacctcccgataatgatctcggacgggggaattccctctctctcatcttcttctacccttactatacgagtgtgcgcctgtgaaagggatggtagagtgcgaacctgtcacgcagaggccttcctgtcttccgccggactctccacaggtgcactgatcgcgatacttctctgcgtcttgatccttttagccatcgttgtactgtttataacgctccggaggtccaagaaggagccactgatcattagcgaagaagacgtgcgggaaaatgtggtgacatatgatgacgaaggcggaggagaagaggacaccgaggcttttgatatcaccgcgctgcggaatccctccgctgccgaagagcttaagtaccggcgagacattagacctgaggttaagttgactcctagacaccagactagctctacacttgaatccatagacgtccaggagttcatcaaacaacgcttggccgaagccgatttggatcctagcgtccctccctatgactctctgcaaacatacgcatacgaagggcagcgcagtgaggcaggttcaatctcctcccttgactctgctaccacccagtccgaccaggactaccactacctaggagattggggccctgagttcaagaagctggccgaattgtacggggaaattgaaagcgagcgaactacttag

SEQ ID NO: 216447 - DNA, 1725 bp, Artificial Sequence
  Description of Artificial Sequence: Synthetic coding sequence
atgaagatcacttctacgtcctgcatttgtcctgtacttgtgtgcttgtgctttgttcagaggtgctatgggaccgctcaccattcctcaatcaaagtcatgaggaaccagaccaagcatatagaaggggagacagaagtgcatcatcgacccaagcggggatgggtctggaaccagttcttcgtgctggaggagcacatgggtcccgacccacaatacgtcggaaagctccactcgaatagcgacaaaggtgatggctcagtgaaatacatcttgacaggcgaaggggcagggaccatcttcatcatcgacgatacaacaggggacatccacagtactaaatctttggatcgtgaacagaaaactcattacgtgctgcacgcacaggccatcgacaggagaaccaataagccactggagccagaaagcgaattcataattaaggtgcaggatatcaacgacaacgcccctaagttcaccgacggtccatatattgtgaccgtccccgaaatgtccgatatgggcaccagtgtgctacaagttactgccacagacgccgacgaccctacgtacgggaattcagcccgtgtcgtctatagcatattgcaggggcagccctacttctcagtggacccaaagactggagtgatacgtacagctttgcacaatatggatagggaagccagagaacactacagcgtcgtgattcaggccaaagatatggccggacaggtgggcggtctgagtggtagcactacagtgaatatcaccctgacagatgtcaacgacaacccccctagattcccacagaagcactaccagttgtacgtccccgaatctgctcaggttggatctgcagtcggaaagataaaggctaacgatgcagacactggcagcaatgcagacatgacctattcaataattaatggagacgggatgggtatctttagcatctcaaccgacaaagaaacaagagaaggcatccttagtctgaagaaacccctgaactacgagaagaaaaagtcttacactctaaacatcgagggagccaatactcatctggatttcaggttctcccatttaggaccatttaaagacgcaacaatgctgaagatcatcgtaggcgacgttgacgaacctcctctattttccatgccaagctacttgatggaggtttatgaaaacgcaaagattggaacggtcgtcggcacggtcctggcacaggaccccgacagtactaactccctcgttagatatttcataaattacaacgtcgaggacgacagattttttaacatcgatgctaacacgggaactatccggacaacaaaggtgctggatagggaggaaacaccatggtacaacattaccgtgacggcatctgaaattgataatcctgacctgctatctcatgtgacggtcggtatccgggtcctcgatgttaatgacaaccccccagagcttgcacgggaatatgacataattgtgtgtgagaactccaagcctggccaggtgatccacacaatcagcgctaccgacaaggacgacttcgcaaatggacctcgctttaatttcttcctggacgagcggctgcctgttaacccgaacttcaccctgaaggacaacgaagctgcagccccttccccatccggcttcgtgcatgctcgggagatgggggtttgcggacccgctatgcagaagccctcgtgccctagactagtttag

SEQ ID NO: 216448 - DNA, 2373 bp, Artificial Sequence
  Description of Artificial Sequence: Synthetic coding sequence
atgaaaatcacatccacctcatgtatttgccctgtgctggtgtgtctgtgttttgtacagcggtgttacgggaccgcacaccactcatccattaaggtgatgagaaaccagaccaagcatatcgagggcgaaaccgaagtgcatcatagaccaaaaagaggatgggtctggaaccaattcttcgtgctggaggaacacatgggcccagatccccagtacgttggcaagctccattctaatagcgataaaggggatggttcggtgaagtacatactgaccggggagggcgcaggcactatcttcatcatagatgatacaaccggcgatattcatagcactaagagtttggaccgcgaacagaaaacacattacgtgctccatgcccaagcaattgaccgcagaaccaacaagcctctggagccagagagtgagttcatcattaaggtccaggacattaatgataatgctccaaaatttacagatggaccatatatcgtcacggtaccagaaatgtctgacatgggcaccagcgtattgcaggtaaccgctactgacgctgacgatcctacttatggcaacagtgctagagtggtgtactctatcctgcaaggccagccatattttagcgtggaccctaagacaggcgtcatcagaaccgctctccacaacatggatcgtgaggccagagagcattattcagtggtcatacaggcaaaagacatggctggtcaggtgggaggcctcagcggctccactaccgtgaacatcacacttactgacgtgaatgataacccacctcgatttccgcagaagcactatcagctgtacgtccctgagagcgcccaggtcggaagcgccgtcggcaagattaaagccaatgatgccgacaccggcagcaacgccgacatgacgtactctataatcaacggcgatggaatgggaatcttcagtatttcaaccgacaaggagaccagagagggcatcctgtctctcaagaagccgctaaattacgagaaaaagaagtcttatacactaaacatagaaggagcgaatacgcacttggactttcgcttctcccacctcggacctttcaaagatgctaccatgctcaaaattattgtcggggacgtcgacgaacccccactcttctctatgccctcatatctgatggaagtgtacgaaaatgcaaagattgggacagtagtggggactgtcctcgcccaggatccagactctactaactcactggtcaggtacttcataaactataacgtcgaggacgaccggttcttcaacatcgacgcgaataccgggaccattcgcactaccaaggtcctcgatagggaggagactccttggtataatatcacagtgaccgcttccgaaatcgataatccggatttactttcccacgtgaccgtgggcatccgcgtcctcgatgtcaacgacaatcccccagagctcgcaagagaatatgatatcatagtctgtgaaaacagtaaacctgggcaggtcatccataccatatcggccaccgacaaggatgacttcgcaaatggacccaggttcaacttctttttagatgagaggttgccggtgaatcccaactttacactgaaagataatgaggataatactgcaagtattttgacccggaggcgcagattctctagaacagttcaggacgtgtattatttgcctattatgatctcagacggcggtattccatccctctcttcatccagcactcttacaattcgtgtgtgtgcctgtgaaagggatggccgagtacgtacgtgccacgccgaggctttcctctcttcggcaggactgagtaccggagctctaattgcgatattgctgtgcgtcttgattttgctggcaatagtcgtgctgttcatcacccttcgcaggagtaaaaaggagcccctaatcatcagtgaggaagacgtgcgggaaaacgtggtgacatacgatgacgagggcggtggtgaggaggatacggaagctttcgacatcaccgctctccgtaacccttctgccgctgaggagctgaagtatcgcagggatataaggcctgaggttaagctgactccgcgacaccagacctctagcactttagaatccatcgatgtgcaagagttcatcaagcagcgactcgccgaggcggatctcgaccctagcgtccccccttatgacagtttacaaacctacgcctatgaaggacagagatctgaggcgggaagcatctcttccttagactccgctacaacacagtctgatcaggactatcattacctcggtgattggggccctgagttcaaaaagttagctgagctgtatggcgaaattgagtctgagcgcaccacatag

SEQ ID NO: 216449 - DNA, 2373 bp, Artificial Sequence
  Description of Artificial Sequence: Synthetic coding sequence
atgaagatcacaagtactagttgcatttgtcctgtcttggtctgcctctgtttcgtccagcggtgctacggaactgcccaccatagtagtatcaaggtgatgcggaatcagaccaagcacatagaaggcgagactgaagtccaccacaggccgaagcgtgggtgggtgtggaaccagttcttcgtgctcgaagagcacatgggaccggatccccaatatgttggcaagttacatagcaactcagataagggcgacgggagcgtgaagtatattctcactggggagggagccggaacaattttcattattgatgacaccactggggatattcacagcacaaagtcactggaccgcgagcaaaagactcattacgttcttcatgctcaggccattgaccgcaggacaaacaagccattagagccggaaagcgagttcattatcaaagtccaagacatcaatgataatgccccaaaattcacagacgggccatatatcgtgacagtccctgagatgagcgacatgggcactagcgtgcttcaggtgaccgccacggatgccgacgatccaacgtacggaaatagtgctagagtggtgtactctattctgcagggccagccctacttttctgtggaccccaagactggcgtgatccgaaccgcactgcacaatatggatcgcgaggccagagaacactactccgtggtgattcaagcaaaggacatggcaggacaggtcggcggtttgtcagggtccacaaccgtgaatattaccctaaccgacgtgaacgataatcctcctagatttccacagaaacactaccagttgtatgtacctgagagcgctcaagtggggtcagccgtgggcaaaatcaaagcaaatgacgctgacactggaagtaatgccgatatgacatactctattatcaatggggatggcatgggcatcttctcgatttctacagacaaggaaactagggagggcatcctttcactaaagaagcctctgaactacgaaaagaagaagtcctacacgttgaatattgaaggtgctaatacgcatctcgattttcggttctctcatttagggccttttaaggacgcaactatgctgaagatcatagtgggcgacgttgacgagcccccattgtttagcatgccctcatatctgatggaggtctacgaaaacgcgaagattgggactgtggtgggaacagttctggcccaagatccggactcgaccaacagtctcgtcaggtatttcattaattacaacgtcgaagacgaccgcttcttcaacatcgatgccaacaccggtactattcggacgacaaaagtactcgatcgcgaagagactccttggtacaatattacggtcacagcttccgagatcgacaacccagatctgctgagtcacgtgacagttgggatcagggtgctggacgtcaacgataatccccctgaattggcacgcgagtacgacatcatcgtatgcgagaattccaagccgggacaagtgatccacacaatttccgctacggataaagacgattttgccaatggccctaggttcaacttcttcctggatgaacgtcttccagtgaaccctaattttacattaaaagacaacgaagataacacggcatctattttgaccaggagacgccgtttttctaggacagtccaggacgtctattacctgccaattatgatctccgatgggggtatcccctccctttcttcgtcaagtacgttaaccatcagagtgtgtgcctgcgagcgagacggtcgggtacggacgtgccatgcggaggctttcctctcctctgctggtctctccactggcgcactgatcgcgatcctcttatgcgtccttatcttgcttgcaattgtcgtactgtttatcacattaagacggtcgaagaaggaacctctcattatcagcgaggaggacgtgcgagaaaatgtcgtcacatacgacgacgaagggggaggcgaggaggacaccgaggcatttgatatcaccgctttgaggaacccgagtgccgctgaggaactgaagtatcggagagatattcgcccagaggtgaaactgacgcctaggcaccaaacatctagtaccctggaatccattgacgtccaggaattcatcaagcaacgcttagcagaggccgatttggatccttctgtgccaccttatgactctttgcagacctacgcatacgagggtcaacggtctgaggctggcagcatttcctcactggattcagccacaacgcagtctgaccaggattaccattacctcggggactggggtcccgagtttaagaaattggctgagctctacggcgaaatcgaatccgaaaggacaacttag

SEQ ID NO: 216450 - DNA, 2319 bp, Artificial Sequence
  Description of Artificial Sequence: Synthetic coding sequence
atgaactgctacttactgctacgattcatgctgggcatccccctcctttggccctgtcttggagcaacggaaaatagccagaccaagaaggtgaagcagccggtgagatcccacttgcgcgtgaagagaggctgggtgtggaatcaatttttcgtccctgaggagatgaataccacaagccaccacatcggccagctccggtccgatttggacaacggcaataatagcttccagtacaagcttctcggagccggagctggctccaccttcattatcgacgaacgtactggcgacatttacgctatccagaaactggatagggaggaacggtccttgtacattctgagagcgcaggtgattgatatcgctactgggcgagcagtagagcccgagtccgagttcgttattaaggtgtctgatattaacgataatgaacctaagtttctggacgagccctacgaggcgatagttccggaaatgagccctgagggaacactggtcatccaggtgacagcttcagatgccgacgatccatccagcggcaataacgctcgactgctctacagcctcctacaagggcaaccctatttttctgtcgaaccaactaccggtgttataaggatcagctctaaaatggacagggaactgcaggatgaatattgggtcataatacaggctaaggatatgatcggtcaacctggggctctctccgggactactagcgtcctgattaagcttagtgacgtcaatgacaataagcctatttttaaggaatctctctatcgtctgactgtgagtgaaagcgcccctacggggacgtctatcggcaccatcatggcctacgataatgacatcggggaaaacgcagaaatggactactcgatcgaggaggatgactcccagaccttcgacatcatcaccaatcacgaaacccaggaggggatcgtgatccttaagaagaaagtggactttgaacaccagaaccactatggaatccgcgctaaagttaagaaccaccacgtccctgagcagctcatgaaatatcacacagaagcctctactacctttattaaaatccaagtggaagacgttgatgagcctccattgtttctgctgccttactacgtgttcgaggtctttgaagagacacctcagggaagttttgtcggagtggtctccgctaccgacccagacaatcggaaatctccaattagatatagtattacccgctctaaggtcttcaacataaacgataacggcaccattacaaccagcaacagccttgacagggagatttcggcctggtacaacctgagcataaccgctactgaaaaatacaatattgaacagatatcaagtattcccttgtatgtgcaagtgctgaatattaacgaccatgccccagaatttagtcagtactatgaaacctatgtctgcgagaacgccggatcgggacaggttatccaaaccatatcagctgtcgaccgggatgaaagcatcgaggaacatcacttttatttcaatttatcagtagaggataccaacaactcctcttttacaattattgacaaccaagacaacaccgctgtgatattgacgaacagaactggtttcaatctccaggaggagccggttttttacataagcatcctgattgcagacaacggaatcccttccctgacgagcaccaacacgttgaccatccatgtttgcgactgcggtgatagcggatcaacccagacatgtcagtatcaggagttagtgctcagcatgggcttcaaaacagaggtgattatcgctattcttatctgcatcatgattatcttcggatttattttcctgacacttgggttgaaacagagaaggaagcagatcctttttcctgagaagagtgaagatttccgcgagaatattttccagtatgatgatgaagggggtggggaggaggatacggaagcgttcgacatcgctgagctgagaagttccacaatcatgcgggaacgcaagacccgcaaaaccactagcgccgagattcggagcctgtatagacaatccctgcaggtcggccctgacagcgccatattccgaaaattcatcttagagaagctggaagaggccaatactgatccttgcgcaccccctttcgactctctacagacttacgccttcgaaggcaccgggtcccttgcaggaagcctgagcagcctcgagtctgccgtcagcgatcaggatgagagctatgactatctgaatgagctaggccctcggttcaagcgtctcgcatgtatgttcggatccgctgtgcagtctaacaattag

SEQ ID NO: 216451 - DNA, 1173 bp, Artificial Sequence
  Description of Artificial Sequence: Synthetic coding sequence
atgaacaccacatcccaccatattgggcaactgaggtccgacctagacaacggcaataatagtttccagtataagctgctgggcgcaggcgcaggatcgacctttattatcgacgaacgaaccggagatatttatgctattcaaaaactggatagggaagaacgatccctatacatcctgcgggctcaggtgatcgacatcgcgaccggcagggcagtcgaacccgaatccgagtttgttataaaggtaagcgatatcaatgacaacgagcctaaattcttagatgaaccttacgaagccattgttccagagatgagccctgaaggcacgctagtaatccaagtcaccgcatcagacgccgatgacccctcatccggcaataatgccaggctcctgtactcattactccagggacagccttacttttctgtcgaaccgaccacaggagtcattaggataagtagtaaaatggaccgggagttgcaggatgaatactgggtgatcatccaagctaaggacatgatcggacagccaggtgctctaagtggcacaaccagtgtgctcattaagctctccgatgtaaacgacaataagccaatctttaaagagagcttataccgactaacagtgtccgaatctgcccctacaggaacctccattggaactattatggcctacgataatgacattggcgaaaacgcggaaatggactattctatcgaggaggacgacagccagaccttcgacatcatcactaatcatgaaacgcaggagggaatcgtaatcctcaagaaaaaagttgatttcgaacatcaaaaccactatggaattagagctaaggtgaagaatcaccacgtgcctgagcaattgatgaagtaccatacggaggcatccacaaccttcatcaaaatccaggtcgaggacgtggacgagccccctctattccttctcccttactacgtttttgaggtattcgaagagacaccgcagggatcattcgtgggggtggtgagcgccactgaccctgacaatagaaaatcacccattcgctattccattaccagatctaaggtgtttaatattaatgacaacggaaccataacaacctccaactctctagaccgggaaatttccgcttggtacaacctgagcatcactgctaccgagaagtag

SEQ ID NO: 216452 - DNA, 1473 bp, Artificial Sequence
  Description of Artificial Sequence: Synthetic coding sequence
atgaactgttacttgcttctaaggttcatgctgggtatccccctactgtggccctgtctgggcgcaaccgagaactcccagacaaaaaaggtgaagcaaccggtccgctctcatctgagagttaagcgcggttgggtgtggaaccagttcttcgtcccggaggagatgaatactacttctcaccacatcgggcagctccggagcgacctggataacggcaacaattcctttcagtacaaacttctcggcgcaggagccggatcaacctttattatagacgagcgaaccggtgatatttacgccatccaaaagctggatcgcgaggagcggtctctgtacattctccgcgcacaggtaatcgatattgcaactggtagagctgtcgaaccagaaagtgagtttgtgataaaggtcagcgatattaacgacaacgagcccaagtttctggacgaaccttatgaggccattgtgcccgagatgagccctgagggtaccctggtgattcaggtgacggctagcgatgcagatgatcccagttccggtaacaatgccaggctgctatacagtctgctgcaggggcagccttattttagtgtcgagcccacaacgggtgtgattcgcatttccagcaagatggacagagagttgcaggatgagtactgggtgatcatccaggctaaggacatgatcgggcagcccggtgctctgtcaggcactacctccgttctgatcaagctcagcgacgtgaacgacaacaaaccaattttcaaggaatccctgtataggctgaccgtgagtgaatccgccccaactggcaccagcatcgggactatcatggcctatgacaatgacattggggagaacgccgagatggattattccatcgaggaagacgactcccaaacctttgatatcatcacgaaccacgagacccaggaggggatagtgatacttaaaaagaaggtagactttgagcatcagaatcactacggcatacgggcaaaggtcaagaatcatcatgtgcctgagcagttaatgaagtaccataccgaagcctcaacgacatttatcaagatccaagtagaagacgtggacgaacctcccttgttcctgctgccatattacgtttttgaggtgtttgaagagactcctcaaggttccttcgttggtgtagtctctgcgacagatcccgacaaccgaaaatctcccatccggtactcaatcactcgctccaaggtgttcaatattaatgacaatggcaccattaccacttccaacagcttagatcgagaaattagcgcttggtataacctctccattactgccactgagaagtacaatatagaacaaatttccagcatccccctgtacgtccaagtcctcaatatcaacgatcatgcaccagaattttcccagtattatgaaacctacgtgtgtgaaaacgccggttccggacagggactgttcttttag

SEQ ID NO: 216453 - DNA, 2406 bp, Artificial Sequence
  Description of Artificial Sequence: Synthetic coding sequence
atgtggacatcgggccgaatgagcaatgctaaaaattggctcggcctggggatgtccctttatttctgggggctcatggatttgacaactactgtgctgagcgatacacccacaccacagggagaacttgaagctctgctctcggataaaccacagtcccaccagcggactaaacgatcatgggtgtggaaccagttctttgttcttgaggagtacacaggcacagatcccctctacgtaggaaaacttcatagcgacatggaccggggagacggaagtatcaagtacatcctgtcaggggagggggcaggcatcgtgtttacaatagatgacacaacaggcgatatccatgctatacagagactcgacagagaggaacgtgcgcagtatacgttgagggcgcaggctcttgatagaaggacaggcagaccgatggagcccgagtccgaattcatcattaagatacaagacattaatgacaatgagcctaaattcctggatggtccctacgtggcaacagtccccgagatgtcacctgttggcacgtcagtgattcaggtcaccgccacggacgccgatgatcctacgtatggtaacagcgcacgtgttgtgtactccatactgcagggacagccttatttctctgtggacagcaagactggagttattcggacagcgctcatgaacatggatcgggaggccaaggagtattacgaagttatcatacaagccaaagatatgggaggccagttgggagggctggccggaacaaccacagtgaatattacgctcagcgacgtcaacgacaatccgcctcgatttccacagaaacattatcagatgagcgtcctggaaagtgcgcctatttcttcaacagtggggagggtatttgcaaaagacctggacgaaggcatcaacgctgaaatgaaatataccattgtcgacggagatggagctgacgcttttgacatttccactgaccccaactttcaagttgggattatcactgtcaaaaaacctctgtcgtttgagtctaaaaaaagttacacactcaaggttgagggtgccaatccccacctggaaatgcgtttcttaaacctgggacccttccaagatactacaaccgtccacatctctgtggaggacgtggatgaacctcctgtatttgaacccggattctactttgtggaggtccccgaagatgtggctattgggacaaccattcagataattagtgctaaggatccggatgtcaccaataacagtatccggtactcaatcgatcgaagttcagaccccggtcgatttttttatgtcgatattacaacgggggctctcatgaccgcacgcccactggacagggaggaattctcttggcacaatatcacagtgcttgccatggagatgaataaccccagtcaggtgggttccgtccccgtgactattaaagtcttagacgttaacgataatgccccagagtttccccgattttacgaggctttcgtgtgcgagaatgctaaggcaggacagcttatccagacagtctctgccgtagatcaggatgaccctaggaacgggcaacacttctattattctctggccccagaggcagcaaataaccccaactttaccattcgcgacaatcaggataacactgcaagaatcttgaccaggaggtcgggctttaggcaacaggaacaaagcgtattccatctcccaatcttaattgcagacagcggccagcccgtcttgtcctctaccgggacgctgaccatccaggtttgtagttgtgacgacgacggccatgtgatgtcttgctccccagaagcgtatatgttgccagtgagcctcagcaggggagccctcatagccatactagcatgcatttttgtcctgcttgtgttagtgctgctgatactgtccatgagaagacatcgaaaacagccgtacataattgatgatgaggagaacattcatgaaaatatcgtcaggtatgatgacgagggcggaggcgaggaggacacagaagccttcgacatagccgcaatgtggaatcctcgtgaagcacaggccggagctgccccaaaaacacgtcaggacatgctgcctgagattgagtctctgtcacgctacgtaccccaaacctgtgctgttaatagcactgtgcactcttatgtcctcgccaagctatatgaggccgacatggatctgtgggctccaccttttgacagcttgcagacttacatgttcgaaggcgacggcagtgtggctggcagcctgtctagcttgcagtccgcaacttcggattccgaacaaagcttcgatttcctgaccgattgggggcctcgctttcgcaagctggcagagctctatggtgcctcagaaggcccagctcctctgtggtag

SEQ ID NO: 216454 - DNA, 2406 bp, Artificial Sequence
  Description of Artificial Sequence: Synthetic coding sequence
atgtggaccagcgggaggatgtctaatgccaaaaattggctaggcttgggtatgtccctttacttctgggggttgatggatctgaccactaccgtacttagcgatactccaacccctcaaggagagctggaagctttgctttctgacaagccccagtcccaccagagaaccaagcgatcttgggtgtggaaccaattcttcgtgctcgaagagtataccggtaccgacccactgtatgtcggtaagctgcattctgacatggaccgcggagatggcagcattaagtacatattgtctggcgaaggtgcaggaatcgtcttcaccattgatgacactactggcgacatccatgctattcaaagattagatcgtgaggagcgtgctcagtacaccttacgcgcacaggcactcgatcggcgtactgggcgaccgatggagccagaatccgaatttatcattaaaatacaggacatcaacgataacgaacccaagtttctcgacggaccttatgttgcaaccgtgccggaaatgtcccccgtgggcaccagtgttattcaggttaccgctacagatgccgatgatccgacttacggaaacagcgcccgtgtggtgtatagcatcctgcaggggcagccctacttctccgtcgatagtaagaccggggtgatacgtaccgccctgatgaatatggaccgcgaggcgaaggaatactacgaggtcatcatacaggccaaagatatgggcggacagctcggtggcttggccggaaccactactgttaatattaccttgtcagacgttaatgataatcctcccaggtttccgcagaaacactatcagatgtctgtgctggagtccgctccaattagctcaaccgtggggagggtgtttgccaaggacttagacgaaggcatcaacgcagaaatgaaatacactattgttgatggagatggcgctgacgctttcgacatatccaccgatccaaactttcaggtcggcatcataaccgtaaagaagcccctgagctttgaatccaagaaaagttatacattaaaagtggagggggcaaacccgcatctggagatgcggttcctgaacctgggcccatttcaagacaccaccaccgttcatatttccgtggaagatgtagacgagccacccgtgtttgagcccggtttctacttcgtggaagtgcctgaggacgtcgctattggaactactatccaaatcataagtgccaaagaccccgacgttaccaacaacagtatcaggtattctatcgatcgctcctctgatccaggcagattcttctacgtagatataaccaccggcgcattaatgacggccagacccttggatagagaggagttttcttggcacaacattacagtactggcaatggaaatgaacaatccctctcaggtgggttctgtccctgtgactattaaggtcctagatgttaacgacaacgccccagagtttcctagattttacgaggcctttgtgtgcgagaatgcaaaagccggtcaactcatccagactgtgtcggccgtggatcaggacgacccacgcaatggccagcatttctactacagccttgcccctgaagccgcaaataaccctaattttaccattagagacaaccaggacaatacagctcgcattcttacgcgacgtagcggcttccgacagcaagaacagagcgtgtttcatctgcccattctgatcgccgactccggccagcctgtgctgagctctactggtaccttaacaatccaggtgtgcagctgtgatgacgatggccacgttatgtcttgctctcctgaagcttacatgctgccagtgagcttatctagaggggctctgattgccatcttggcctgcatcttcgttctgcttgtgttggtgcttctgattctttcaatgcgccgacatcggaagcaaccatacattatcgatgacgaagagaacatccacgagaatatcgtgagatacgatgacgaagggggaggcgaggaggacactgaggcctttgatatcgctgctatgtggaaccctcgggaagcacaagcaggggctgctccaaagacccggcaggatatgctgccagaaatcgagtccctttccaggtacgtgcctcagacttgcgccgttaactcaacagtgcacagctatgtgctagccaaactgtacgaagccgatatggacctgtgggccccaccatttgactccctgcagacatacatgttcgagggagacggttccgttgccggaagcctctcctcactgcagtccgccacaagcgatagcgagcagagctttgatttcctcaccgattggggcccaaggtttaggaaactggccgaactgtacggagcatccgagggtcccgctccgctgtggtag

SEQ ID NO: 216455 - DNA, 2406 bp, Artificial Sequence
  Description of Artificial Sequence: Synthetic coding sequence
atgtggaccagtggtcgcatgtcaaatgctaaaaattggctgggtctgggtatgagtctgtacttttggggattgatggatcttactactaccgtgctgagtgacacccccacccctcagggagagttagaggcactgttaagcgacaagcctcaatctcatcagcgaacaaaacgatcctgggtctggaaccagtttttcgtgctcgaggagtatacagggacagatccactatacgtcggaaaactgcactcagacatggataggggagatgggtcaatcaagtacatactttcgggcgagggagccggaattgtgtttacgatcgatgataccacgggtgatattcacgccatccagagactggatcgcgaagaaagggcccaatacactcttcgggcacaggcgcttgatcgcaggacaggaagacctatggagcctgagagcgagttcattattaagattcaagacatcaacgacaatgaaccgaagtttctggacggaccatacgtcgcaaccgtgccagagatgtctcctgtgggtaccagtgtgattcaggttacagccacggacgcagacgatcccacatatgggaacagcgctcgcgtggtctactcaatcttgcaggggcagccttatttttccgtggacagcaagacaggcgttatccggaccgcactgatgaacatggacagggaggccaaagagtattatgaagttattattcaggccaaagacatgggcggtcagctgggaggcctggcagggacgacgactgtcaatatcacactgagtgatgtgaacgacaaccctcccaggttccctcagaagcactaccagatgagcgtgttggaaagcgcgcctatttcttcgactgtggggagagtctttgctaaggacttggacgaaggtataaatgcagagatgaagtatactattgtggatggcgatggtgccgacgcttttgacatcagtactgatcccaatttccaggtgggcataattacagtgaagaaacctctgagtttcgagtcgaagaaaagctatacactcaaggtggaaggcgctaacccacatctggaaatgaggtttttgaatctgggcccttttcaagacaccacaaccgtacacatctccgttgaagatgtggacgaaccacctgtgttcgagccaggattctacttcgtggaagtgccagaagatgtggccatcggaacaaccatccagataatttccgccaaagacccagatgtgactaataattctatacggtacagcattgatcggtcgtcagatcccggaaggttcttctatgtggacattaccaccggggctctgatgaccgccagaccattagatcgtgaggagtttagctggcataacatcaccgttttggccatggagatgaacaacccaagtcaggtcggctccgttccggtaacgatcaaggtccttgacgtgaacgataatgctcccgaatttccaagattctacgaggcattcgtctgtgagaacgcaaaagcaggccagcttattcagacagtaagcgcagtcgatcaggacgacccaaggaacggccagcatttttactactcactcgctcccgaggctgccaacaatcctaatttcaccattagagataatcaagataatactgcaagaatcctcactcgccgaagcggattccgtcaacaagagcaatctgtgttccacttacccatattaattgctgatagtggccagcctgtactgagctcgacaggtactttgaccatccaggtgtgctcatgcgacgatgacgggcacgtgatgagttgcagcccggaagcgtacatgctgccagtctccctgtcgcggggagctctgatcgctattctggcctgtatcttcgtgctcttggttctcgtgctgctgatcctgtccatgagaagacataggaagcagccatatatcatagatgacgaggagaatatccatgagaatatcgttcgctatgacgacgagggcggaggggaagaggatactgaagcctttgatatcgcggcaatgtggaacccacgagaggcccaagctggtgccgctccaaagacacggcaggacatgcttcccgagatagaatcattgagcaggtatgtcccgcagacttgcgcggtgaatagtaccgtgcatagctacgtgctggccaagctatacgaagctgacatggacttgtgggcccctccgtttgattcactgcagacgtacatgtttgagggtgatgggtctgtggctggatctcttagcagccttcagtccgctacatctgattcagaacagagctttgacttcttgaccgactggggacctcgcttccggaaactggccgagctgtacggggctagcgagggtcctgccccactctggtag

SEQ ID NO: 216456 - DNA, 2487 bp, Artificial Sequence
  Description of Artificial Sequence: Synthetic coding sequence
atgaggccccgacctgaaggcagaggattaagggccggagtcgccctcagcccagcgttattgttactcctgcttttgccgccacctccaacactactcgggcgactctgggccgctggcacgccatccccaagtgctccaggagcacgccaggacggggctctgggagccggaagggttaaaagagggtgggtctggaaccagttcttcgtggtcgaagagtacactggcaccgagccattatacgtgggcaaaattcactctgattcagatgagggggacggtgccattaagtacaccattagcggggagggcgctggaacgatcttcctgatcgatgagctgacaggggacatccatgctatggaaagattggaccgcgagcagaaaactttctacacgttgcgagcccaggcaagagacagagccactaatcgcttgctcgagccagaatcagagtttatcattaaagttcaggatataaacgatagcgagccccgttttctgcatgggccatacatcggttccgttgccgagctttcgcccactggaactagtgtgatgcaggttatggcttcagacgcagacgatccgacttacggaagctcagccaggttggtgtatagtgtcctagatggcgagcaccattttacagtcgatccaaaaacaggcgtgatcagaacagctgtgccagatttggaccgcgagtcccaggagcgatacgaagtcgtcatacaagctaccgacatggccggtcagctcggagggctctccggaagcactactgtcactatagtagtaactgatgtgaatgacaatcctcctagatttcctcaaaaaatgtatcagttttccatccaggagtctgcccctatcggtaccgctgtgggaagggtcaaagccgaggattctgatgtaggagagaatactgacatgacatatcaccttaaggatgagagttcctccggcggtgatgtgtttaaagtcacaactgactcggatacacaggaggcaatcattgttgttcagaagaggcttgactttgagagtcaacctgtgcataccgtgatcttggaagctctgaacaagttcgtggatccccgatttgctgacctcgggacttttagagatcaggccatcgtaagggtggcggtcaccgatgtcgatgagccacccgagtttagacccccaagcggcctgctagaggtgcaggaggacgctcaggtaggatctctggttggcgttgtgaccgccagggacccagatgcggctaatagaccagtgagatacgctatagatagagagtcagacctcgatcagatattcgatattgatgctgataccggcgcaatagtgaccggcaaagggctggatagggagacggctggctggcacaatattactgtgctggccatggaggccgataaccacgcccagctgtcgcgcgcaagcctgagaattcgtattcttgatgtgaatgataatcctcccgaactggcaacaccatacgaagcagcagtgtgcgaggatgctaagccaggacagctgatccaaactattagcgtggtagacagggatgaaccacagggcggacaccgtttctacttccggctggtgcccgaggcaccgagtaatccgcacttctctctgctggacatacaagataacacagctgcggttcacacacagcacgtgggcttcaataggcaggagcaggatgtctttttcctgccaattctggtggttgacagcgggcctccaaccttgtcgagtaccggcactctcactattcgaatatgcgggtgcgactcctctggcactattcagtcgtgcaacaccactgccttcgtgatggctgcgtctctgtcacccggtgcgctgattgccctgctagtatgcgtattgatcctggtggtcctcgtgctccttatactgacactgaggcggcatcacaaatctcacctctcttccgacgaggatgaggacatgcgcgacaacgtgattaaatacaacgacgagggaggcggagaacaggataccgaagcctatgacatgagcgccctgcggtccctctatgattttggggagcttaaaggtggcgacggcggaggcagtgccggtggtggcgctggtgggggaagtggcggaggtgcaggcagcccacctcaggcgcatttgcccagcgaaaggcatagtctccctcagggtcccccatctccagaacctgactttagtgtgttccgcgacttcatcagcagaaaggtggcacttgcagacggcgatctgtcagtgcctccatacgacgctttccaaacatacgctttcgagggggctgacagcccagctgctagcctgtcctcactccattcaggctccagtgggtccgagcaagacttcgcctacctgtcttcatggggacctcggttcagacctctcgcagcactttatgctgggcatagaggtgatgatgaggctcaggccagctag

SEQ ID NO: 216457 - DNA, 2487 bp, Artificial Sequence
  Description of Artificial Sequence: Synthetic coding sequence
atgcgcccaaggcccgaaggcagaggtctgcgagctggcgtagcgctgtccccggctcttctcctgctgcttctgctgccaccccctcccaccttgttgggaagattgtgggcagccggaactccgtcgccaagtgcccctggagcacgccaagacggagctttgggggctgggagagtcaaacggggttgggtttggaatcaattcttcgttgttgaagaatacacaggcaccgagcccctgtacgtgggcaaaatccattccgacagcgacgagggtgacggagccatcaaatataccatcagtggggaaggcgctggtaccatatttctcattgacgagttgaccggcgatatccatgccatggagagactcgaccgggaacagaaaacgttttatacactgcgggctcaagccagagacagggcaaccaaccgcctgctggagcccgagtctgagttcatcatcaaggtgcaggatataaacgattccgagccacgttttctgcacggcccttacatcggatcagttgctgagctctctccaaccggcacctccgtcatgcaagtgatggccagtgatgccgatgatcccacctacgggagctccgccaggctcgtctactctgtgctagacggtgagcaccactttacagttgaccccaagactggggtgattcgcaccgcagtgccagatttagatcgcgagtctcaggagcggtacgaagtggtgattcaggcgactgacatggccggtcagcttggcggactgagtggatcgaccaccgtcacgatagtggtgactgatgtgaatgataaccctccaaggtttcctcagaagatgtatcagttttccattcaagagtccgctccaatcggaactgctgtggggagagtgaaagcagaggattctgatgttggcgagaacaccgacatgacataccacctaaaggatgagtcctcatctgggggtgacgtctttaaagtaaccaccgatagtgatacccaagaggccataatagtcgtccagaaaaggctggacttcgaatcgcagcctgtgcacactgtgatcctggaggcactgaacaagtttgtggacccccgatttgccgatctcggaacctttagggaccaggccatcgtgagagtagcagttactgatgtggatgagcctccagagttccgtccgccaagcggcctgttagaggtgcaggaagatgcccaggttgggtcattggtgggcgtggtgacggcacgtgatccagatgcagccaatagacccgtaaggtatgcaatcgaccgtgaatcagatcttgatcaaatattcgatatagatgcagacacgggtgccatcgtgacaggaaaaggcctggaccgcgagacagccggatggcacaatataaccgtattggcgatggaggctgacaatcacgcgcaattgtcacgagcctcccttcggatcagaatcctcgacgttaatgacaacccacctgagctggccactccttatgaggcagctgtgtgcgaagatgccaaacccggacaattaatacagacgatttccgttgtggaccgggacgaacctcaaggcggacacagattttactttcgcctcgtgcctgaggcccctagcaatcctcactttagcttgctcgacattcaagataacacagccgctgttcatacacagcatgtggggtttaatcgccaggaacaagatgttttcttcttgcctattctagtggttgatagtgggcctccgaccttgtcaagcaccgggaccctgaccatccgcatctgcggctgcgacagctctggtactatccagtcctgtaacactacggcattcgtcatggctgcaagtctgtctcccggtgccctgatcgctctcctcgtctgcgtgctgattctggtggtactcgtgctgctcattctgacattgcggaggcaccataaatctcatctgtcctctgatgaggatgaagatatgagagataacgttatcaaatacaacgatgagggcggtggggagcaggacacagaggcttacgatatgagtgcccttagatcgttatatgattttggcgagttgaagggcggagatgggggtggctccgcaggcggaggtgcaggcggaggctcaggtggtggcgctggcagcccgcctcaggctcacttaccctccgagaggcattcccttccgcagggccctcccagccctgaacccgatttcagtgttttccgcgatttcatctccagaaaagtcgctctagcagacggggatctgtccgtgccaccttatgatgccttccagacatacgcgtttgagggagctgacagtccggctgccagcctgtccagtctgcactctgggtccagcggatcggaacaagattttgcctacctcagttcatggggcccaagattcaggccgctcgcagccctgtacgctggacataggggtgacgacgaggcgcaggctagttag

SEQ ID NO: 216458 - DNA, 2490 bp, Artificial Sequence
  Description of Artificial Sequence: Synthetic coding sequence
atgggcctgccacggggacctttagcgagtctgctcttacttcaggtctgttggctccagtgcgcagctagcgagccctgtagagcagtcttcagggaggcagaggttacgctggaggcaggcggagccgagcaggagccgggtcaagccttaggaaaggtattcatgggatgtccaggacaggagccagccctcttttccacggataacgatgacttcactgtcagaaatggtgaaacggttcaagaaaggagatccttaaaggaacggaacccccttaagatctttccaagcaaacggattctacgccgacataagcgggactgggtagtggcccctatctctgtcccagagaatggaaaaggaccttttcctcagaggctcaaccagttgaaatctaataaggatcgcgacacaaaaattttttattccatcaccggtccgggagcagactcacccccagaaggcgtgttcgctgtcgaaaaagaaactgggtggttgttgctgaacaagccactggatcgcgaagaaattgcaaagtatgaattgtttggccacgcagtgagtgaaaatggagctagtgttgaggatcctatgaacataagcattatcgttaccgatcagaatgaccataagccaaaatttacgcaggataccttccggggttccgtgctcgagggtgtgctccctgggactagtgtcatgcaggtcacggccactgacgaggatgatgcaatctatacgtacaacggggtggtggcctattccattcacagtcaggagccaaaagacccccacgatctgatgttcaccattcatcgcagtactggcacgatctcggtcatctcaagtggtttagacagagaaaaggtacctgaatataccctgactattcaagcgacagatatggacggcgatggctcgacgaccacggccgttgctgttgtggagatactggatgccaacgataacgccccaatgtttgatcctcagaaatatgaggcacacgtgccagaaaacgctgtgggacacgaagttcagcgcttaaccgtaaccgatctcgacgcgcctaattcaccagcctggcgcgctacttatttgatcatgggcggagacgatggggaccactttactatcactactcaccccgaatccaatcagggtatcctcactactcgcaagggtttggactttgaggctaaaaatcaacataccctgtacgtcgaagtgaccaacgaggctcccttcgttttgaaactaccaacttcgacagcaaccatcgttgtgcacgtggaggacgtcaatgaggctcctgtgttcgtacccccttccaaggtggtggaagtacaggaagggatacctacaggggaaccggtgtgtgtctacactgccgaagaccccgataaggagaaccaaaaaatatcctataggatccttagggaccctgccggatggttagcaatggatcctgactccggacaagtcacggccgtgggcaccctggaccgggaggacgagcagttcgtgcgaaataacatctatgaagttatggtgctggctatggacaacggcagcccccctaccacgggaacaggaactctccttcttacccttatcgatgtcaacgaccacggacccgtgcctgagcctcgacaaatcacaatctgcaaccaatcccctgtgaggcaggtcctcaatataaccgacaaggacctgtccccccacacatccccctttcaagctcaactgacggacgactctgatatttactggaccgccgaagtcaacgaggagggggatacagtcgtgttatccctgaaaaagttcttgaagcaggacacctacgatgtgcatctgtccctttcggaccacggcaacaaggagcagttgacggtgatccgggcaactgtatgtgattgtcacggtcatgtagagacttgtccgggaccttggaagggcggatttatcctccctgtgcttggagctgtgctagcattgctgttcctgctcctcgtgttgttgctgctggtacgcaaaaagaggaagatcaaagaacctttgctgctgccagaagacgacactagagacaacgtgttctattatggagaggaaggcggaggggaggaggatcaggactatgacattacccagctccatcggggtcttgaagcccgtccagaagttgtattgaggaacgatgttgctcctactattatacccacaccgatgtataggccaagacctgccaatcccgacgagatcggcaattttatcattgaaaacctcaaggcagcaaacactgaccctacagccccaccctacgatacgctcttggtcttcgattacgaaggcagcgggtctgacgccgctagcctgtcctcactgacctcctcagcatcagaccaggaccaggactatgactatctgaacgagtgggggtctcgatttaagaagctcgctgatatgtatggcggaggggaagacgactag

SEQ ID NO: 216459 - DNA, 2355 bp, Artificial Sequence
  Description of Artificial Sequence: Synthetic coding sequence
atgggactgcccagaggtccactggcatcactgctgctgctgcaggtctgttggctgcagtgcgcagcctccgaaccctgccgagcagtttttcgcgaggctgaagtcactctggaggcaggcggagctgaacaggaacccggacaagccctgggaaaagtattcatgggatgccccggtcaggagccggctctgttctcaactgataatgatgattttacggttagaaacggggaaactgttcaggagcggcgtagcctgaaagagagaaatcctttaaagatcttcccttcaaagaggatcctcagacgccacaagagggactgggtggtagctcctattagtgtgcctgagaacgggaagggtcccttcccccagagattgaatcagttgaagagcaacaaagacagagacaccaaaattttttactcgattaccggaccaggcgcagactccccgcctgaaggtgtgtttgcagtggagaaggagaccggatggctgctgctcaacaagcctctggatcgtgaggaaattgccaagtatgagttgtttggacatgccgtctctgaaaacggagcttccgtggaggatccaatgaatatatccatcatcgtcactgaccaaaacgaccacaagcccaaattcacgcaagacacctttaggggatcagtactcgaaggagtgcttcctggaaccagtgtcatgcaggtgactgcgacagacgaggatgacgcgatatatacatacaatggagtggtggcgtactcgatccactctcaggagcccaaggaccctcacgatctgatgttcactattcaccgcagtaccggaacaatctcagtcattagtagtggactcgacagggagaaggtgcccgagtataccttgacaattcaggcaacagacatggatggtgacggctctaccaccactgcagtagccgttgttgagatcctcgatgcaaacgacaatgcacccatgttcgatccccagaagtatgaggcacatgtccccgagaacgccgtcggccacgaagttcagaggttgaccgtgacagaccttgacgctcccaattcaccagcgtggcgcgcaacttacctgatcatgggcggtgatgatggagatcattttacaatcaccacccatcctgagagcaaccagggcattttaaccacaaggaagggcctggatttcgaggccaaaaatcagcacaccctgtacgttgaggtgactaacgaagccccattcgtactcaaattgcctaccagcacggccaccattgtggtgcatgttgaagatgttaatgaggccccagtgttcgtccctcccagcaaagtggtggaagtacaagaagggattcccaccggagagcccgtgtgcgtgtacaccgccgaggaccctgacaaggaaaaccagaaaatcagttaccgcatattaagagatcccgctgggtggctcgcgatggatccagatagtggccaggtgacagctgtggggaccttggatagagaggacgagcagtttgtgaggaataatatttatgaagtgatggtactggccatggacaacggctctccccctacaacagggacaggaacacttcttctaactttgatcgacgtcaatgatcacggccctgtccctgagccacgccagataacaatttgcaaccagtcaccagtgcgtcaagtgctaaatatcaccgacaaggacctgtctcctcacacttcaccctttcaagcccaattgaccgatgactccgatatctattggactgcagaagtaaatgaggagggcgacacggtggttctctctctgaaaaaatttctcaaacaggatacctatgatgtgcatttgtctctttcagaccatggaaacaaggaacagttaacggtcatccgtgccacggtgtgcgattgccacggacatgtggagacatgccccggtccctggaaaggcggattcatcctaccagtcctcggagcagtgttggcgttgcttttcctgttactggttttgttgctgttggtgcgaaagaagcgtaagataaaagagcctctgttacttccagaagacgatacaagagacaatgttttctactacggcgaggaaggaggcggagaagaagatcaagactatgatattactcagttgcaccgcggactggaagctaggccggaagtggtactgcggaatgacgttgcccctactattattcctactccaatgtaccggccacgtcccgctaacccggatgaaatcggcaactttattattgagggtcggggtgagcggggatcccaacgaggaaatggcggtctgcaactcgcgagaggccgaacacgtcgaagctag

SEQ ID NO: 216460 - DNA, 2325 bp, Artificial Sequence
  Description of Artificial Sequence: Synthetic coding sequence
atgggctgtcccggacaggaaccggcactgttcagcaccgataacgacgatttcacagtgcgcaatggggagaccgtccaggaacggcgatctttgaaggaacgcaatcctcttaaaattttccctagcaaacgcattctccgtagacacaaacgggattgggttgtggccccaatttctgtcccagagaacggaaaaggcccattcccacagcggcttaaccagctgaagtctaacaaggacagggatactaagatattttactccataaccgggccaggggctgacagtccacctgaaggagtcttcgcagtggaaaaagagacagggtggctcctgttgaacaagccccttgacagggaagaaattgctaagtacgagctgtttggacacgcggtctcagagaatggtgcgagcgtcgaggatcccatgaacatcagtatcatagtcaccgatcagaatgaccacaaacccaagtttacccaggatacttttcggggatccgtgctggagggggtactcccaggaacttccgtcatgcaggtgactgcaaccgacgaagacgacgcaatttatacatacaacggagtagtggcctattccattcactcgcaagagccaaaggaccctcacgatctgatgttcaccatccatcgctccaccggcacaatcagcgtgatttcctccggtcttgaccgtgagaaagtcccagagtacacgctgacgatccaggccacagatatggatggcgacggctcaacaactaccgccgtggcggtggtcgagattctggacgcaaacgataacgccccaatgttcgaccctcagaagtatgaagcccacgtgcccgaaaacgcagtgggccatgaagttcagcgccttaccgttaccgatctggatgcaccaaattctcccgcttggagggcgacatacctgattatggggggtgacgacggagaccattttactataactacgcatcccgagagcaaccagggaatccttaccacacgaaaaggtcttgactttgaagcgaagaaccagcatactctttacgtggaagtcacaaatgaagccccattcgtgttaaagcttccaacgtcgaccgcaactatagtggtccatgtcgaagatgtgaatgaagcccctgtctttgtccccccaagcaaggtggtcgaagttcaggaggggatcccaaccggggaaccagtgtgcgtctacaccgcagaggacccggataaggagaaccagaaaatttcctaccgcatacttcgagatccagctggctggttagcaatggaccccgattcaggacaggtgaccgcagtaggcacactggaccgtgaggacgagcagtttgtgcggaataatatctacgaggtgatggtcctggcaatggacaatggatctccccctaccacgggaactggcaccctgttgctgactctgattgatgtcaacgatcatgggcctgtgcctgaaccacggcagattacaatctgtaaccaaagccctgtgcgacaggtgctgaacattacagataaggacctgtcgccccacacctctcccttccaggctcaactcaccgacgattccgacatttattggacagccgaagttaacgaagagggggacacagtggttctgtcactcaaaaagtttttaaaacaggatacttacgatgttcacctgagcctgtctgatcatggcaacaaagagcagttaacggtaattcgcgctacagtgtgcgactgtcacggccacgtggaaacatgccccggtccttggaaggggggtttcatcctgcccgtcctgggagctgtgctggctcttctgtttctactgttggtgctgctgctgctggtccgcaagaagaggaaaataaaagaaccactgctgctgcccgaggatgatactagagataatgtgttttactatggagaggaaggaggaggagaggaggaccaggactatgacatcacacagcttcatcgcggattagaggcccgacccgaagttgttctgcgcaacgatgtggcccctacaatcattcccactccgatgtatcgtccccgtcccgcaaaccccgacgagattggaaatttcatcatcgaaaacttaaaagccgctaatacagatccaaccgcgccaccctatgacacgcttctggtattcgactatgaagggtcgggaagcgatgccgcaagtttaagttcactgacgtcttccgcctctgatcaggatcaggattacgactatctgaacgagtggggttcaaggtttaagaagctggcagatatgtacggcggaggcgaggatgattag

SEQ ID NO: 216461 - DNA, 2751 bp, Artificial Sequence
  Description of Artificial Sequence: Synthetic coding sequence
atgaccgcgggagccggagtgttgttactcttgctgtctttgtctggggctctcagagcccataacgaagatctgactacacgcgaaacttgcaaggccggattctccgaagacgattatactgccctgatctcccagaatatcctcgagggtgagaaactgctccaagtgaagttctcaagctgcgtcggcaccaagggtactcaatacgagacaaactccatggacttcaaggtcggcgctgatggcacagttttcgcaactcgagagctgcaggtcccctcagaacaggtcgcttttaccgtgacggcttgggattcccagaccgccgaaaagtgggacgctgtggtccgcctcctcgttgcacaaacttccagtccgcacagcggccacaagcctcaaaagggaaagaaggtcgtggcactggaccctagcccacccccaaaagacaccctgctgccgtggccacaacatcagaatgcaaacgggctccgccgaaggaagagagattgggtgatcccacctatcaatgttcctgaaaacagcagaggcccatttccacagcaactcgtgcgcattagatccgacaaggacaacgacattcccatacgatattctattacaggcgttggggcagatcagcctccgatggaagtgttctctatagactctatgagcggaaggatgtacgtgactagacctatggatagggaggaacatgcaagctaccacctgcgggcacatgccgtcgatatgaacggcaacaaggtggaaaatcccatagacctgtacatatatgtgatcgacatgaacgataatcgaccagagttcatcaaccaagtgtacaatgggagtgtggatgaaggaagcaagccaggtacttatgtaatgactgtcactgcaaacgacgccgatgattccaccactgcaaatggcatggtccgctaccgcatcgtgacccagacccctcagtcaccttcacagaacatgtttacaatcaacagcgagactggagatatcgttacggttgccgctgggttagatcgggaaaaggtgcagcagtacacagtgatcgttcaggctaccgacatggaggggaatctcaactacggcctctcaaacaccgcaactgcaattatcacagtgaccgatgtcaacgacaaccctccagagttcaccgctagtacatttgctggggaggttccagaaaaccgggttgaaactgtcgtggcaaacctcaccgtcatggatagagaccagccacacagtcccaactggaacgccgtttacaggatcatcagcggggatccaagcgggcacttttcagtgaggaccgaccctgtgacaaacgagggcatggtaacagtcgtgaaagccgttgattacgaattgaatcgggcttttatgctgacagtcatggtgagcaatcaggcccctttggcctccggcatccagatgagcttccagagtactgctggtgtcaccatatcaattatggacatcaatgaagctccatactttccttccaaccacaagctgatcagactagaggagggagtgccaccaggcactgtactcaccactttctccgctgtcgaccccgatagattcatgcagcaagctgtccgatactcaaaattaagcgacccagcctcttggctccatattaatgccactaacggacagataacaacagcagctgtcctcgaccgggagagtctctacacgaaaaataacgtatacgaggccacgtttcttgctgccgataatggaattccacctgcatcagggacagggacactgcagatatacttgattgacattaacgataacgcacccgagttgttgccaaaagaggcccaaatttgcgagaaacccaacctgaacgccattaatattacggctgcggacgccgatgtggatcccaacataggcccttacgtgttcgaattgccttttgtccctgccgctgtccggaagaattggaccatcaccaggctgaatggcgattacgctcagctttcgctcagaatcctgtacttggaggcaggcatgtatgacgttcccatcattgtcacggactctgggaaccccccactgtcaaatacgtctatcatcaaggtgaaagtttgcccttgtgatgacaatggtgactgcactacaattggggcagtggccgctgctggactgggcacaggagcgatcgttgcgatcctgatatgtatcctgatcctgctgacaatggtgctcttgttcgtcatgtggatgaaacggagggaaaaagagagacacaccaaacaactcctgatcgacccagaagacgacgtgcgagacaacatcctgaaatacgatgaggagggcggaggggaggaggaccaggactacgacttgagtcagctccagcagccggaagctatgggccacgtgccaagcaaggctccaggcgtgagacgggtggatgagaggcctgtcggggcagagcctcagtatcctatacgacctatggtgcctcaccctggcgacattggcgacttcattaacgagggacttagggctgctgataacgatcccacagcgccaccttatgattcccttctcgtgtttgattatgaaggaagcggttccacagccggatcagtttcctctctgaatagctcctcctccggggaccaggattatgactaccttaatgactggggtcccagattcaagaaactggccgacatgtatgggggaggtgaggaggactag

SEQ ID NO: 216462 - DNA, 2475 bp, Artificial Sequence
  Description of Artificial Sequence: Synthetic coding sequence
atgcccaagtctaccgggatgctacatggcggaagggagaacgctggagttaagttcagctcgtgtgtcggaaccaagggcacccagtacgaaacttcttccccacatagcgggcataaaccacaaaaaggaaaaaaggtagtggcgcttgaccctagccctccacccaaggacacgctccttccatggcctcagcaccagaatgcaaacggcctacgtagacggaaacgtgactgggtaatcccaccaattaacgttccagaaaactctaggggacccttccctcaacaactggtgcgcattaggtccgacaaggacaacgacattcccattaggtattcaataaccggtgtcggggcagatcaaccacccatggaggtcttttcaatcgactctatgagtgggaggatgtacgtgacaaggcccatggaccgggaggagcatgccagctaccatcttcgagcccacgctgtcgatatgaatggcaacaaagttgagaatcccatagatctctacatctatgtaattgacatgaacgacaaccgccctgagtttataaatcaggtatacaatgggagtgtggatgaagggtctaaacctggcacttacgtcatgaccgtcacagccaacgacgccgatgacagcacgacggccaatggaatggtgaggtacagaatcgtgactcagacacctcaaagcccaagccagaacatgttcaccattaactccgaaaccggggacatcgtgaccgtcgccgcaggcttagatcgggaaaaggtgcagcagtacactgtcattgtgcaagcaaccgacatggaaggaaacctgaactacggcctgtctaatacagccactgcgattattacagtcacagatgtgaacgacaaccccccagagttcactgccagcacatttgccggagaggtgccggagaaccgcgtggaaaccgtcgtcgctaatctcactgtgatggatagggaccagcctcacagtcctaattggaacgccgtttataggatcatctcgggggatcccagtggccacttctccgtcagaacagaccctgtcacaaacgagggcatggtcaccgtggttaaagccgtagactatgaactcaacagggcctttatgctcactgtcatggtatcaaatcaagcccctcttgcctccggaatccagatgtcatttcagagtactgccggtgtaaccataagcatcatggacatcaatgaagccccatacttcccatcaaatcataagctcattcggctggaagaaggcgtgccacccggtaccgtgctcaccactttcagcgccgtagaccctgataggtttatgcagcaggctgttcggtactccaaacttagcgatccggcaagttggttgcatatcaacgcaacaaacggccagattaccactgcagccgtgctggacagagagagcttatacaccaagaacaacgtttacgaggccaccttcctggctgcggacaacggcattcctcctgcaagcggaaccgggacgctgcaaatttatctgattgatatcaacgataacgctcccgaactgctgcccaaggaggctcagatctgtgagaagcccaatctcaatgcaatcaacattactgccgctgacgcagacgtcgaccctaatattggcccttatgtgtttgagttaccatttgtccccgcagccgtgagaaagaactggacaattacacgcttgaatggtgactacgcccaacttagcttgcgtattctctatctggaagctggcatgtacgacgtgcctatcatcgtgaccgacagtggcaacccaccactatctaacacctcaattattaaggtgaaagtttgtccctgcgatgataacggcgattgtactacaattggggcagtggccgcagcgggacttgggactggagccattgtggctatcttgatctgtatactgattctgctgacaatggtcctactttttgtgatgtggatgaaacgaagagagaaagagcgtcataccaaacagttgctgatcgaccctgaggacgacgtgcgggataatatcctaaaatacgacgaggaggggggaggggaagaggatcaggattatgacctgagccagcttcaacagcctgaggctatggggcacgtgcccagtaaggctcctggggttcgtagagttgacgaacgccctgtaggagctgagccacagtacccaattcgacctatggtgccccatcctggcgacataggggacttcatcaatgagggcttgcgcgcagccgacaacgatcccactgcaccaccgtatgactccctgttagtctttgattatgaagggtcaggctccacagcaggttccgtctcatcattgaattcgtcaagcagcggtgatcaagactatgactatcttaacgattgggggccaaggtttaagaaactggcagatatgtatgggggaggtgaggaagactag

SEQ ID NO: 216463 - DNA, 2529 bp, Artificial Sequence
  Description of Artificial Sequence: Synthetic coding sequence
atggacttcaaagtgggcgctgatggcaccgtgtttgccactagggagttgcaggtacctagcgagcaggtagccttcaccgtcaccgcctgggactcccagactgctgaaaagtgggacgcagtggttcgcttgctggtggcacagacatcctccccacactcaggccataagcctcaaaaaggaaagaaagtcgttgcattggatccatccccaccacccaaagacacactgctgccctggccccaacaccaaaacgccaacggccttcgtcggaggaaaagggactgggtgattcctcccatcaacgtccctgagaattcacgcggaccattcccgcagcagcttgtgcgcatccggagcgataaggataatgacattcccattcgctactcaatcactggcgtcggagctgaccagcctccaatggaggttttctccattgactcaatgtcgggccgaatgtacgttacccgtcctatggaccgagaggaacatgcttcgtaccatttacgtgcccacgccgtcgacatgaacggaaataaggtagagaatccaatcgacttgtacatctacgtaatcgatatgaacgacaaccggcctgagttcatcaaccaggtctataatggaagcgtggatgagggttctaaacccggaacctacgtcatgaccgtgactgccaacgatgctgacgattcgacaaccgctaatgggatggtgagataccgcattgttactcagacgccacagagcccgtcacagaacatgtttacaattaattcagaaacaggtgacattgttaccgtggctgccggactggatcgcgaaaaagtgcagcagtatacagtgatcgtccaagccacagacatggagggtaatctgaattatggactgtcaaacactgccacagctattattaccgtgactgacgtcaacgataaccctccagagttcactgccagcactttcgctggcgaggtgccagagaatcgagtggagactgtggtggccaatctaacagtgatggaccgggatcagcctcacagtcccaactggaatgccgtgtaccggattatatcaggcgatcccagcggacattttagcgttaggactgatcccgttactaacgagggcatggtgactgtagtcaaggccgtggattacgaacttaatagagcttttatgttgactgttatggtctctaaccaggccccactggcaagtggaatccaaatgtccttccagagtacagctggcgttacaataagtattatggatattaatgaagccccatatttcccttcgaaccataagctgattcgattggaggagggagtgcctcccggtacggtgttgaccacattttccgcagttgacccggatcgattcatgcagcaggctgtccgttactctaagctttcagatcccgcaagctggctgcacataaacgccactaatggtcagatcactactgccgctgtgttggaccgcgaaagcctgtatacaaagaataatgtgtatgaggccacgtttctggcagctgacaacgggattccacccgcttccgggactggaactctgcaaatctacctcattgatattaatgataatgccccagagttgctgccaaaagaggcccagatatgtgagaagccgaacctgaatgccatcaatataacagcagcggacgctgatgtggaccccaatatcggcccatatgtgtttgagctgcccttcgtccctgctgccgtgagaaagaactggacgattaccagactcaacggggattacgcccagctgagcctgagaatactgtatcttgaagcaggaatgtatgatgtcccaataattgtcacagactctgggaatcccccactctcaaacaccagcattataaaggtcaaggtatgcccgtgtgacgataacggggactgcaccaccatcggagcggttgccgctgcagggctgggcaccggagccattgtggctatactgatctgcattctgattctactgaccatggtcctgctgtttgtgatgtggatgaagcgcagagagaaggagcggcacaccaagcagcttctgattgatcccgaggatgatgtacgggataatattctgaagtacgacgaggagggcggtggtgaggaagatcaagactatgacctcagtcaactccagcagccggaggccatggggcacgtgccttcaaaggcccctggtgtgcgaagggtcgatgagcggccagtgggcgctgagccccagtaccccattagacccatggtgccccaccccggtgacatcggggactttattaatgagggtctccgggctgccgacaacgaccccacagcgccaccctacgattcattgcttgtgtttgactacgagggaagcggcagtactgctggatctgtgtcttcattaaacagttcaagctctggcgatcaagattacgactatctcaacgactggggaccgagatttaaaaaactggcggacatgtacggcggtggcgaggaagattag

SEQ ID NO: 216464 - DNA, 2358 bp, Artificial Sequence
  Description of Artificial Sequence: Synthetic coding sequence
atgaaactcggtaaagtggagttttgccactttctgcaactgatcgcgctatttctctgcttctctggtatgtcacaggctgagttgtcccgctctcgcagcaagccgtacttccagtctggtcgcagccgtactaagcgttcttgggtctggaaccaattctttgtgctggaggagtatatgggctctgaccctctctacgtcggaaaactgcactctgatgtggataaaggcgacgggagcattaagtatatcttgtctggcgagggagcttcctccatattcatcattgacgaaaacactggggatattcatgcaacgaagcgcctcgacagagaagaacaggcctactacactctgcgtgcgcaggccttggatcggctgactaacaaaccggtggagccggagtcggaattcgtaatcaaaatccaggatatcaacgacaacgagcccaaattccttgatggaccctataccgcgggtgtcccagagatgagtcctgtggggacctcggtagtccaggttaccgcaacggacgcagacgacccaacgtacgggaattcagcaagagtagtctactcaatcctgcagggtcagccgtatttctcagtggagcctaaaaccggtgtgattaagacagcgctgcccaatatggacagagaggccaaggaccagtacttactggtgattcaggctaaagacatggtggggcagaacggcggattgtcaggcacaaccagtgtgactgtgaccttaaccgatgtcaacgacaaccctccgcgattccccaggagatcctatcaatacaacgtgcctgagagtttgcctgttgcttccgtggttgctcgcataaaggccgcagatgctgacatcggcgcaaacgcggaaatggagtacaagattgtggacggcgatggcctgggtatttttaaaataagcgtggacaaagagacccaggaagggattatcaccatccagaaagagctcgacttcgaagcaaaaacctcctacacccttaggattgaagctgcgaataaagatgccgacccccgatttctgagtttgggtcccttctccgacactaccaccgtgaaaatcatagtggaagacgtagacgaacctccggttttttcctcacccctgtaccctatggaagtgagtgaggcgacgcaggtaggcaatatcatcggcaccgtagccgcacatgaccctgatagctctaactctccagtgcggtatagcatcgatcgcaacaccgatctggaacgctatttcaacattgatgccaattccggagtcataactaccgccaaaagcttggatcgcgagacaaatgcaatacacaatataaccgtgctggcaatggagtctcagaacccatcacaggtgggaaggggatacgtggccatcactatactcgatatcaatgacaatgcacccgaattcgccatggattacgagacgaccgtctgtgagaacgcccaacccggtcaggtgattcagaagatctccgctgtcgacaaagatgaaccctccaacggtcaccagttctacttctccctcactacagacgccaccaataatcacaatttctctctgaaggacaataaggataacactgcttcaatccttacaaggagaaacggcttcagaagacaggagcagagcgtctactacctcccaatcttcattgtggattcaggctcaccttcattatctagcactaacaccctcacaatcagggtgtgcgactgtgacgccgacggtgtggcccagacctgcaatgccgaggcatatgtgctacccgcaggtttatccacaggcgcactgatagctatcttagcgtgcgtactgacccttctggtccttatactcctgatagtgacgatgagacgacggaagaaggagcccctaatctttgatgaggagagagacatacgggaaaatatcgtgaggtacgacgacgaggggggaggtgaggaagacacagaggcctttgatatggcagcgctgcgaaacctgaacgtgatcagggatactaagactaggagggatgtgacgcccgaaatacagttcctcagcaggcccgctttcaagtctataccagataacgttattttccgtgagttcatatgggagaggctgaaagaagccgatgtggaccctggtgccccaccctatgacagcttgcagacctatgccttcgagggcaatggttctgtcgctgagagcctgtcttcactggacagcatttcctccaacagcgaccaaaactatgattatctgtctgactggggcccacgattcaaaaggctggctgatatgtatggcaccgggcaggaatccctttattcctag

SEQ ID NO: 216465 - DNA, 2358 bp, Artificial Sequence
  Description of Artificial Sequence: Synthetic coding sequence
atgaagctgggcaaggttgaattttgccatttcctccaactgattgcactgttcctgtgtttctccggcatgagccaggccgagctgtctaggagccgcagcaagccctatttccaatcaggccgttcgaggaccaaaaggagctgggtatggaaccagtttttcgttctcgaagagtatatggggagtgatcccctctacgtggggaagttacactcagacgtggataagggggacggttccattaagtacatcctctctggcgagggagcatcgtccatttttattatcgatgaaaataccggggatatccatgctacaaaacggcttgaccgagaggaacaagcctactacaccttgagggcccaagcactggaccgactaactaacaagccagtagaacccgagtccgaattcgttataaagatccaggacattaacgacaacgagccaaagttcctagatgggccatacaccgccggtgtcccagaaatgagtcccgtgggaacatccgtagtgcaagtcacagcaaccgacgcagacgacccaacatatggcaatagtgcgcgagtggtgtactctattctgcagggccagccctatttctccgttgaaccaaaaacaggcgttatcaagactgcactgcccaatatggatcgagaagctaaggaccaatacttactcgtcatacaggcaaaagacatggtgggccagaacggaggattatcaggaaccacgtcggtcaccgtcaccttgacggacgtgaacgacaatccaccccgattcccaagacgttcctaccagtataacgtgccagagtccctgccggtcgcctcagtagtcgctcggattaaggccgctgacgcagatattggagcgaatgccgagatggagtacaagatagtggacggtgatggtttaggaatttttaagatttccgtagacaaggaaacccaggaaggcataataactatacagaaggagttggacttcgaagccaagacatcatatacactgaggatcgaggccgctaacaaggatgctgatcccaggttcctttctctcggaccgttttccgacactaccactgtcaaaatcatcgtggaggacgtggatgagccacccgtctttagctcacccctgtatcccatggaagttagcgaggccacccaggtgggcaatatcatcggtaccgtggctgcccatgaccctgattctagcaactctcccgtgagatatagtatagataggaacaccgacctggagaggtacttcaatattgacgctaatagcggagtgattaccactgcaaagagcctagatcgcgaaacaaacgctatccacaatattacagtcctcgctatggagtctcaaaacccctcccaagttggcagaggctatgtggccatcactatcctagatataaatgacaatgcgccagaatttgccatggactatgagactaccgtgtgcgagaacgcccagcctggccaggttatccagaagatttcagctgtggacaaagacgagccatccaatgggcaccagttctatttctcactgaccactgatgcgactaataaccataatttctcgttaaaggataacaaggataacaccgcttcaatactgaccagacgaaatggatttagacgccaggagcagtcggtgtactaccttccgattttcatcgttgatagcggctctccctccctctccagtacaaacaccttaactatacgggtttgtgattgcgacgccgacggagtggcacagacgtgtaacgcagaagcctatgtgctgccggcaggtctgagcaccggcgcactgatcgcgatcctggcctgcgtgctcactcttctggtgctgatcttgttaatcgtgacaatgcgcagacggaagaaagagccgttaatcttcgacgaggagagagacatccgagaaaacatcgttagatacgatgacgagggcggtggcgaggaggacacagaagctttcgatatggcagccttgcgcaatctgaatgtgattcgggatacaaagactcgcagagatgttacaccagagattcagttcttatcacggcctgctttcaaaagtatcccagataatgttatcttcagagaatttatctgggagaggctgaaggaagcagatgtcgacccaggcgctcccccttatgacagcctacagacctacgccttcgagggaaacggctccgtcgctgagagtctctctagccttgattcaatatcgagcaacagcgatcagaactatgactacttatcagactggggcccacgttttaagcgtctggccgacatgtatggaacagggcaggaaagcctttactcatag

SEQ ID NO: 216466 - DNA, 2358 bp, Artificial Sequence
  Description of Artificial Sequence: Synthetic coding sequence
atgaagctcggcaaagtggagttctgccattttctgcaattgatagccctgtttttgtgttttagcggaatgtctcaagcagaactgtcacgctcaagaagtaaaccatatttccagtccggacggtctaggaccaagcggtcctgggtttggaaccaatttttcgtcctggaggaatatatgggatccgaccctctgtatgttggcaaacttcatagtgacgtagacaagggtgacggctctatcaaatacatcctgtctggggagggggcttcttcaatttttatcattgacgagaacacaggagacatccacgctacgaagcgattggaccgcgaggaacaggcttactacaccctgcgagcacaggccctggacaggcttacaaataagcccgtggaacctgaatccgagtttgtgattaagatccaggacatcaatgacaatgaaccaaagtttctggatggcccatatacggctggagtaccagaaatgagtccggtgggcacatccgtggtacaggttacagctactgatgccgacgatcctacttacggcaacagcgccagggtagtctacagcatactccaggggcagccttacttcagcgtggagcctaagacaggagttatcaagacagccctgcctaacatggacagggaagccaaagatcagtacttgcttgtgatccaggccaaggatatggtaggtcagaacgggggactctcaggaactactagcgtaacagtgaccctgacggatgttaatgataatccaccaagatttcctaggcgaagctatcagtacaatgtgcccgagtctctgcccgtggcgtctgtggttgccagaattaaggcagctgacgccgatattggcgcaaatgccgaaatggaatacaagatcgtggacggcgatggtctgggcatattcaagatatcagtggacaaggagactcaggaagggattattacaattcagaaggagctcgacttcgaggccaagacctcttacaccctgcggatcgaggccgctaataaagatgcagaccccaggttcctgtctttaggtccattcagtgacaccaccaccgttaaaataatcgtggaggatgtagacgagcctccagtgttcagttctccactgtacccaatggaagtgtctgaagctacccaggtgggcaatattattgggaccgtggctgctcacgatccggacagctccaatagtcccgtgaggtactccattgaccggaacaccgacttagagagatatttcaacattgatgccaactccggcgtcattacaaccgctaaatcgttagacagagaaactaacgctatccataacatcacagtgctggctatggagtcacaaaaccccagtcaagtaggtagaggttacgtagcgattactattcttgacattaacgacaacgcaccagaattcgcaatggattatgagacaactgtgtgtgaaaatgcccagccaggacaagtaatccaaaagatttctgccgttgataaggatgagccttcaaatgggcaccaattttatttcagcctgaccactgatgccaccaacaatcacaacttctcactcaaggataacaaggataacactgcctctatcctgacacgccgaaatggcttccggagacaagagcaaagtgtgtactatctccccatctttatcgttgattccggttctcctagcctcagtagtactaatacattaacgattcgagtctgcgattgcgacgctgacggggtggcgcagacatgtaacgctgaagcttacgtgctgcccgctggcctgtccactggagctctgattgcaatcctggcgtgtgtgctgactttgctggttctaatccttttgatagtgactatgcgtaggcgtaaaaaagaacccctgatctttgacgaagagcgggatatcagggagaacatcgtcaggtatgatgatgaggggggaggggaagaggacactgaggcgtttgacatggccgcactgcgcaatctgaatgttattcgcgatacaaaaactcgcagagacgtcacacctgagattcagtttctgagtcgcccagcgttcaagtccattccagacaatgtgatcttccgcgagttcatttgggagcggctgaaagaggcagatgtcgatccaggggcacccccttatgatagccttcagacctacgctttcgaaggtaacggctctgtcgcagagtccctttcgtccttggattctattagctccaactccgaccagaactatgactacttaagtgattgggggcctcgcttcaagcgcctggctgacatgtatggtacggggcaagaaagcttgtatagttag

SEQ ID NO: 216467 - DNA, 1893 bp, Artificial Sequence
  Description of Artificial Sequence: Synthetic coding sequence
atgaagttagggaaagtcgagttttgccatttcctgcaactgattgcactgttcctgtgtttttctggcatgagccaagccgaattgagccgaagccgttcaaaaccctactttcagagcggacgatctaggaccaaaagaagttgggtctggaaccagttctttgtgctggaggagtacatgggttcagatcctctctacgtaggaaaactccatagcgatgtggacaagggcgacggatcaattaaatatattttaagtggggagggcgctagcagtatctttattatcgacgaaaacacaggggacattcacgccactaagaggctagacagagaggagcaagcttattataccctcagggcacaagccctggatcggctcaccaataagcccgttgaacctgaatcagagttcgtcattaagatccaggatattaacgacaatgaacccaagttcctggatggcccttatacggccggtgtgccagagatgtctcctgtgggtacctctgtagtccaggtgactgcaacagacgctgacgaccccacctatgggaacagcgctagggtcgtgtactccattctgcagggtcagccttatttcagcgtggaacctaagacaggtgtaatcaaaactgccctgcctaatatggatcgggaagccaaggatcaatatctcttagtaattcaagctaaagatatggtgggccagaacggaggcttgtctggcacaacgagtgtgactgtcactctgaccgacgttaacgataatcccccacggtttccccgaaggtcttaccaatataacgtccccgagagcctgcccgtcgccagcgtggttgcgaggattaaggctgctgacgccgacatcggagccaacgcagagatggaatataagatagtggatggcgacggacttggtatttttaaaatatccgtggataaggaaacccaggagggcataataaccatccagaaggagctggatttcgaagccaagacgtcctacacacttcgaatcgaagccgctaacaaggacgcagaccctcggttcttgtcactgggcccttttagcgacacgaccaccgtaaaaatcatcgttgaagacgtggatgaaccccctgtgtttagtagtcctttatatcctatggaggtatctgaggctacacaagtcggaaacattattggtaccgtggcggctcacgatccagatagcagtaactcccccgtgcggtacagcatcgatcgaaacacagatttggagcgttatttcaatattgacgccaacagcggagtcattaccactgctaagtctcttgatcgagagacgaacgctatacacaacatcacagtcctggctatggaatcacagaatccatcccaggtggggagaggttatgtggctattacaatattggatataaacgataatgcacccgagtttgctatggactacgagaccacagtgtgcgaaaacgctcaacccggacaagtcatacagaaaattagtgctgtagacaaggatgagccctctaatgggcaccagttttacttcagtttgaccaccgacgctaccaacaatcacaatttcagcttgaaagacaataaggataataccgcctccattttgacccgtcgaaacggctttagacgccaggagcagtccgtgtactacctgccaatctttatcgtggatagcggcagcccgtcactgagttctaccaacacgttgaccatacgcgtctgtgattgtgatgctgacggtgtggctcagacctgcaacgccgaagcatacgtgttgccagcaggactgtccacgggggctctgatcgccattctcgcttgtgtcctgacattgctggggaggtattgttttcagggactactgtag

SEQ ID NO: 216468 - DNA, 2400 bp, Artificial Sequence
  Description of Artificial Sequence: Synthetic coding sequence
atgcccgagcgcctggctgagatgctactcgacctctggacacctctcatcatcctgtggatcacccttccaccttgcatatacatggcacctatgaatcagagtcaggtgctcatgagtggatctccactggagctaaacagcctgggagaagagcagcggatcctgaacagaagtaagagaggctgggtgtggaatcagatgttcgtactggaagagttctcagggccagaacctatccttgttgggagactccataccgatctggatccagggtcaaaaaaaatcaagtacatcctcagtggcgacggcgcaggcacaatatttcagatcaatgacgtcacaggcgacatccacgcaattaaaaggctcgatagagaggaaaaggcagagtacaccctgaccgcccaggccgtggactgggaaacaagcaagcccctggagcctccttccgaatttatcatcaaagtgcaggacatcaacgacaatgccccagaattcttgaatgggccttatcacgccaccgtgccagaaatgtcgattttggggacgtccgtaaccaacgtaactgctacagatgccgacgatccggtgtacgggaacagcgccaaactcgtgtatagcatacttgaagggcagccctatttcagcatagagcccgagactgcaattataaagaccgctttaccaaacatggatcgtgaggctaaagaggagtatctcgttgttattcaggctaaggacatgggtggccattctggtggcttaagcggaacaacaacgctgacagtcacactaaccgacgttaacgacaatcctcctaaatttgcgcagtctctgtatcacttctccgttccagaggacgttgtcctgggaacggctatcggccgagtcaaggcgaacgaccaagatataggcgaaaacgcacagtccagttatgacatcatcgatggtgacggcacagcgcttttcgagattacgtccgatgcgcaggcccaggatggaattatccgactgcggaaaccactagactttgagaccaaaaagagctacaccctgaaggttgaagccgctaatgtacatatcgatcccaggtttagcggacggggacctttcaaggataccgctaccgtaaaaatcgtggtggaggacgccgatgagccccctgtgttcagctctccaacctacctgctggaagtgcacgaaaatgcggctctgaatagcgtgattggccaggtgactgctagggaccccgacataacctcttctcctataaggttttccatcgatcgccatactgatctcgagaggcagttcaatattaacgctgacgatggcaaaataactcttgccacgcccctggatagagaactgagcgtttggcataacattacaatcatagcaacagaaatccggaatcactcccagatcagtagggttcccgttgctataaaagtgttagacgtgaatgacaacgcacctgaatttgcttccgagtacgaggccttcctctgtgagaacggcaaacctggacaggtgatccagactgtgtcagccatggacaaagatgaccctaagaacggtcattatttcttgtactctcttctgcctgagatggtgaataacccaaactttaccatcaagaagaatgaagataattcattaagcatcttagccaagcacaacgggtttaatcgtcagaagcaggaagtgtatttactcccaatcattatctccgacagcggtaaccctcctctttcatccacgagcacacttacgataagagtgtgtgggtgtagcaacgacggcgttgtccaaagttgtaatgtagaagcttatgtgctgcctatcgggttgtcgatgggagctcttatcgcaatcctcgcgtgcatcattttgcttctcgtgattgtcgttctctttgtgactttgagacgacacaaaaatgagccccttatcatcaaggacgatgaagacgttagggagaatatcataaggtatgacgatgagggcggaggagaagaagataccgaggccttcgacatcgctactttgcaaaaccccgacggaatcaacgggtttctgcctcgaaaggatattaaaccagatctgcagttcatgccccgtcaagggctagctcccgtcccaaatggcgtggatgtcgatgagttcataaatgtgagactgcacgaagcggataatgaccccacagcaccaccctacgactccatacagatttatgggtacgagggcagaggaagcgtggcaggcagtctctcaagtttggagagcactacttccgattctgatcagaacttcgattacttgtcagattggggtcccagattcaagaggctaggcgaactgtatagcgtgggagagtccgacaaggaaacttag

SEQ ID NO: 216469 - DNA, 2400 bp, Artificial Sequence
  Description of Artificial Sequence: Synthetic coding sequence
atgccagagaggctagccgagatgctgctggacttgtggaccccactaatcattctctggatcaccctccctccttgcatttatatggcacccatgaatcagagtcaggttctcatgagcggatctcccctggaattaaacagcctcggcgaagagcagcggattctcaaccgcagtaagcgagggtgggtgtggaaccagatgtttgttctcgaggaattttcagggccagagcccatcttggtgggtcgcctccatacggacttagatccaggatcaaaaaagatcaagtatatcttgagcggagatggggcaggaacgatcttccaaatcaacgatgtcacaggggacattcacgctatcaagcggctggacagagaggaaaaagcagagtacactctcacggcccaagctgtagattgggaaacgtcaaaaccactggaaccccctagcgagttcattataaaggttcaggacatcaatgacaatgcccctgagttcctgaacggaccctaccacgctacggtccccgaaatgagtatactgggcacttctgtcacaaacgttactgcaacagacgccgacgaccccgtgtacggtaactctgcaaaactggtttattctatcctggagggccaaccatactttagtattgaaccggaaaccgctattattaaaacagccctgcccaacatggatcgtgaagctaaagaagagtatcttgtagttatacaggctaaagacatggggggacacagtggcggactgagcggaacaacaaccctgacagtgacattaacggacgtgaacgacaaccctcccaagttcgcccagagcctctatcacttcagcgtgccagaggatgtggttctcggtacagcaatcgggagggtgaaagcgaacgaccaggacattggcgaaaatgcccagtcctcatatgatataattgacggcgacgggactgccttgtttgagattactagcgacgcccaagcacaggatgggatcatcaggctgagaaaacccctggacttcgaaactaagaagagctacactctgaaagtggaggccgctaatgtgcatatcgaccctagattctccgggaggggaccgtttaaagacacggccaccgtcaagattgtcgtggaggacgccgatgaacctccagttttctcatctcctacctacctgctcgaggtgcacgagaatgcggcattgaacagtgtgatcgggcaggtgacagctcgggatcccgatatcacatccagcccgatacgcttttctatcgacagacataccgatctggaacggcagttcaatatcaatgccgatgacgggaaaataactctggccacgccattggacagggagctgtccgtgtggcacaatataacgataatcgcaactgagatccgcaatcactcccagatttcaagagtgcccgtggccatcaaggtgcttgacgttaatgataatgcacccgaattcgcatccgaatacgaggctttcttgtgcgagaatggcaagcctgggcaggtaatccagaccgtctctgccatggataaggatgatccaaagaatggccactatttcttgtactctctgctgcccgagatggtgaataatcccaattttacaattaaaaagaatgaggataattcccttagtatcctcgcaaagcacaacggattcaataggcagaagcaagaggtttacttgctccctataattatctccgattctgggaaccctcccctgtccagtacctcaactttaaccattcgggtgtgcggctgttctaacgacggagttgtccagagttgtaacgtagaggcttacgtgctgccgatcggcctgagtatgggcgcactgatcgcaatactggcctgtatcatcctgctgctggttattgttgttctttttgtcactcttaggaggcacaagaatgagccactgattatcaaggatgacgaggatgttagggaaaatataatcaggtatgacgatgaggggggaggcgaggaggataccgaggcttttgatatcgctacacttcagaacccagatggcatcaacggctttttgcctcggaaagacataaaacctgacttacaattcatgcctcggcagggcctggcgcctgtgccaaatggggtggatgttgacgaattcataaatgtccgcctgcacgaggccgacaacgatcctacagctccaccctacgactcaattcagatatacggatatgagggcaggggatctgtggcgggatccctgagctctctcgagtctactacatcagatagcgaccagaattttgattacctctccgactggggaccacggtttaagagactcggggagctgtacagcgtgggcgaaagtgacaaagaaacatag

SEQ ID NO: 216470 - DNA, 795 bp, Artificial Sequence
  Description of Artificial Sequence: Synthetic coding sequence
atgacaaaattttccagctttagcctatttttcttgattgtgggcgcatacatgacacacgtgtgcttcaacatggagatcatcggaggtaaggaggtcagtccccactctcgaccttttatggcttctattcaatatgggggtcaccatgtgtgcggaggcgtgctgattgatccccagtgggtgctgactgcggctcactgtcaatatcgcttcacaaaagggcagagccctaccgtcgtcttaggggcacattccctgagcaaaaacgaagcgtccaagcaaactctcgagatcaaaaaattcatccctttctcccgggttacatccgacccgcagtccaacgacattatgctggtaaagctgcagactgccgcaaagttgaacaagcacgtgaaaatgctacacattcggtccaagacatcactgcgcagcggcaccaaatgcaaagtgacaggatggggcgctacagatcctgattccctccgcccttccgacacgttgcgcgaagtcactgtgacagtactatcgaggaagttatgcaactcccagagttattataatggggatcctttcataaccaaagatatggtgtgtgcaggcgatgccaagggacagaaggattcctgtaagggcgactcaggaggccctttgatttgcaagggggtgttccacgcgattgtctctggcggacatgaatgcggcgtcgctaccaagcctgggatctacactctcctgacaaaaaaatatcaaacctggattaagagcaacttggtgccaccccacacaaattag

SEQ ID NO: 216471 - DNA, 246 bp, Artificial Sequence
  Description of Artificial Sequence: Synthetic coding sequence
atgcgaacgtatcactatatccccctgtttatttggacttacatgtttcacaccgtagacactattcttctgcaagagaagcccaacagctacttgtcctctaagaaaattgctgggttgacaaaagacgatggcaaaatgttgagacgaacgaagagaggctggatgtggaaccaattcttcctacttgaggagtatactgggaccgatacacagtatgtcggaaagctgcacaccgaccagtag

SEQ ID NO: 216472 - DNA, 399 bp, Artificial Sequence
  Description of Artificial Sequence: Synthetic coding sequence
atgcgaacttatcattacatccccctattcatttggacgtacatgtttcacaccgtggacacgatcctcctacaggagaagccaaactcatacctttcttctaagaaaatcgccggactcactaaggatgatggcaaaatgctgcggagaacgaaacggggttggatgtggaaccagttttttctgctggaagaatacacaggaaccgacacccaatatgtagggaaactccatactgaccaggacaaaggggatggaaatctcaaatatattctaaccggcgatggcgctggctcattattcgtcatcgatgaaaatacaggcgacatccacgccgcaaagaaactcgatcgtgaagaaaaaagcttatacatcctgcgagcgaaggctatcgattag

SEQ ID NO: 216473 - DNA, 9045 bp, Artificial Sequence
  Description of Artificial Sequence: Synthetic coding sequence
atggcaccgcctccgcctcctgtgcttccagtgttgctgctgcttgctgccgctgcggcactcccggctatgggactgcgcgcagctgcttgggagccccgtgtgccagggggtactcgggctttcgcattgagacctggatgcacttatgctgttggggctgcctgtacacctagggcccctcgggagttgctcgatgttggacgcgatgggaggttggctgggcgtagaagagtctctggcgcaggaaggccattgcccttgcaggtgagactggtcgccagatcagctccaacagctttgtccagacgactgagagccagaacacacttaccaggctgtggggctagggcaagactgtgcggaactggggcacgcttgtgtggggctctgtgcttccctgtcccgggtggatgtgctgcagcacagcacagcgccctggctgcccctactactctccccgcttgcaggtgtcctcctagacctaggcctaggtgcccgggacgaccaatttgcctgccacccggaggctcggtgaggctgcggctgctatgcgcactgaggagagcagctggtgcagtgagagtaggtctggccctggaagcggctactgctggcacaccttccgcgtccccctccccatcaccccctctcccgccaaatttgccggaagccagagcgggtcctgcccgacgcgcaagaaggggcacctcaggccgtggctctctcaaattccctatgcccaactaccaggtcgccctgttcgagaatgagcctgccggtactctgatcttacagctgcatgcccactataccatcgaaggagaggaggaacgtgtcagctattacatggaaggcctgttcgacgagagatcccgcggttatttccgcattgacagcgccaccggtgctgtcagcaccgatagtgtgctggacagagaaactaaggagacccacgtgttgcgagtgaaggccgtggattattccaccccacctaggagtgcaacgacatatataaccgtgttggtgaaggacaccaatgatcatagcccagtctttgaacagtcggaataccgggagcgtgttcgggagaatctggaggtggggtatgaagtgcttaccatccgagcctctgacagggattcaccaattaacgctaatctaaggtacagggtgctggggggagcatgggacgtcttccaactgaacgaaagttccggtgtggtttccacacgcgctgtactcgaccgagaggaggctgcggaatatcagcttctcgtggaggcaaatgatcagggacgcaatcctgggcctttgtcagccacagccaccgtgtacatagaggtggaggatgaaaatgacaactacccacagtttagcgaacagaactacgttgttcaggtgcccgaagacgtcggactgaacacggccgtgcttcgcgtccaggcgaccgaccgcgatcagggccagaatgccgctatccactattcaattttatcaggcaatgttgctggacagttttatctgcatagcctctccggtattcttgacgtaatcaacccactcgacttcgaggacgtgcaaaaatactccttgtctatcaaggctcaagacgggggaagacccccactcatcaactcgtcaggagtggtcagcgtgcaggtgttggatgtcaacgataatgagccaattttcgtcagctccccctttcaggcaaccgtactggagaacgttccacttggataccccgtggtgcacatacaggccgttgatgccgactccggggaaaatgcccgactgcattatagactggtggataccgcatcgactttcctcggcggtggatctgccggtcctaaaaaccccgctccaacgccagactttcccttccagatccacaactcaagtggttggattactgtctgtgccgagctggatagggaggaggtggaacattattctttcggcgttgaagcagtggatcacggaagccctccgatgtccagcagcactagtgtcagcatcacagtcctggacgtgaacgacaatgatcccgtgtttactcagcctacctacgagctaagattaaacgaggatgcagccgtcggatcttccgttctcacacttcaagcacgtgaccgcgacgctaactctgtgatcacataccagttgacaggcggtaacaccagaaaccggtttgccctcagctcccagcgcggtgggggactgattacgctggctctgcccctggactacaaacaggagcagcaatacgtattagctgtgacggccagcgacgggactcgctcacatacagctcacgtacttatcaatgtgactgatgccaatacccatcgtcccgtctttcaatcgtctcactatacagtaagcgttagtgaagacagaccggtagggactagcatcgccacactgtcagcaaacgacgaagacactggagaaaacgctcgcattacatatgtgatccaggacccagtcccgcagttcagaatagatccagacagtggaactatgtataccatgatggagttggactatgagaaccaggtggcctacacactgactataatggctcaggacaacggcatcccccagaagagcgacaccactaccctggagatcctgatcctggatgccaatgacaatgccccacagtttctgtgggacttctaccagggctctatcttcgaggatgcccctccctccacatcaatcctgcaagtttcagctactgacagagatagcggacctaatggcaggttgctgtacacttttcaaggaggcgatgacggagatggcgacttctatatcgaacctactagtggggttattcgcacacagaggcgtctggacagggagaatgttgctgtatacaacctttgggccctggccgtggaccgcggttcaccaacacccttatcagcttcagtcgaaattcaggtgacgattctcgatattaatgacaatgcacctatgtttgagaaggacgaattggagctgttcgtggaagagaacaaccccgtcggctcagtggtagcgaaaattcgggctaacgatcccgacgaaggacctaatgcccagataatgtatcagatcgtggaaggagacatgcgtcacttcttccagctcgaccttctaaacggggatctgcgggctatggtggaactagattttgaagtgaggcgggaatatgttctggtggtacaggctaccagtgcccctctggtaagtcgcgcaactgtccatatcctattggtggaccagaacgacaacccccctgtgcttccggatttccaaatcctcttcaataactacgtaacaaacaagtctaactcctttcccacgggagtcatcggctgcatacctgcccacgacccagacgtctctgattccctgaattatacattcgtgcagggtaatgagctgcggctcctactgttggacccagccaccggcgagcttcagttatcacgggacctggacaataacagacctctggaggccttaatggaggtgtctgtgagcgacggaatccactccgtgaccgccttctgtactctgagggtgaccattataacagacgacatgctgactaacagcatcacggtgcggctggaaaacatgtctcaggagaagttcttaagtccactactggccctgttcgtcgagggggtggccgcagttctgagcacaaccaaggatgatgtgtttgtgtttaatgtgcagaacgacacagatgtgtcatcgaatatcctgaacgtgaccttcagcgctctcctacctggcggagttcgcggtcagttttttccgtcagaagacctccaagaacagatctatcttaacagaactctgctgacaactatttccactcaaagagtgttgccattcgacgataacatatgcctgcgcgaaccatgcgaaaactatatgaagtgtgtttcagtgctgaggttcgacagctcagctcctttccttagctcaacaacggtgctcttcagacctatccatcccatcaacgggttgaggtgtaggtgcccaccgggttttaccggtgattattgcgagacagagatcgatctatgttacagcgacccatgcggcgctaatgggaggtgtcggtcccgtgaaggagggtacacttgcgaatgctttgaagactttactggcgagcactgcgaagtagatgccagaagcggccgatgtgcaaatggagtgtgtaagaacggcggaacctgcgtcaacctccttatagggggatttcactgcgtgtgtccacccggagagtatgagcgcccttactgcgaggtgactacaaggtcattcccccctcaaagcttcgtcacttttcggggactccgccagcggttccactttacaatctcattgacatttgccacccaagagcgcaatggcctgctcctgtataatggcagatttaatgagaaacatgactttatagcactagagattgtggatgaacaggttcagttaaccttcagtgccggagaaaccaccaccacagttgccccaaaggttccgagcggtgttagcgacggacgctggcactcagtgcaggttcagtactacaataagcccaacattgggcacctggggttgccccatggaccgtccggggagaaaatggcagttgtgaccgttgacgactgtgacactaccatggccgttcgatttggaaaagacataggcaactacagttgcgctgcccagggcacccagaccggaagtaagaagagtctcgaccttacaggacctctcttacttgggggtgtccccaacctacccgaagacttccccgtacacaatagacaattcgtagggtgcatgaggaacctctctgtcgacggtaagaacgtcgatatggccggatttatagccaacaacgggactagggagggctgtgccgctcggaggaatttttgtgacggcaggagatgccagaatgggggaacgtgtgtaaaccggtggaacatgtatttgtgtgaatgcccactgcgcttcggcggaaaaaattgcgagcaagccatgcctcatcctcagttattttcaggcgagagcgtggtgtcttggagcgatctaaatataatcattagtgtaccttggtaccttggcctaatgtttcggacaaggaaggaagattctgtactgatggaagctaccagcggcggaccaacatcattccgcctgcagatacttaataactatctccaattcgaagttagccatggtccttccgatgtagaatcggtgatgctgtcgggcttgcgggtgaccgacggggaatggcatcatcttctaatagagttgaaaaacgttaaagaggactccgaaatgaaacaccttgttaccatgaccttagactatggaatggatcagaacaaggcggacattgggggaatgctgccagggctgacagtgcgatcagtggtggttggcggtgcctccgaagacaaggtgagcgtaagaagaggattcagaggttgcatgcagggagtgcggatgggcggtacccccactaacgtggcgaccttaaacatgaacaacgcgctcaaggtccgggtgaaagacgggtgtgacgtcgacgacccttgcacatctagtccatgcccacctaacagccgttgccacgatgcatgggaggactattcatgcgtttgtgacaaggggtacttaggcatcaactgtgtggacgcctgtcacctcaatccgtgtgagaacatgggagcttgcgtgaggtcacctggctcccctcaaggatacgtgtgtgaatgtggtccctcacattacggaccctactgtgagaacaaattggacctcccctgtcctagaggttggtggggtaatcccgtgtgcggcccatgccattgcgctgtaagtaagggctttgatccggattgcaataagacaaacggacagtgtcagtgcaaagagaattattacaagttactggcccaggatacttgcctcccatgcgattgctttccgcacgggtcacacagtcgaacgtgtgacatggctacaggccaatgtgcgtgcaaaccgggtgtgattggcagacaatgcaaccgttgtgacaacccttttgcagaggttacaacccttggctgcgaggttatatacaacgggtgcccgaaggccttcgaggccggtatatggtggccccaaacgaagtttgggcaaccagctgcagtgccgtgtcccaagggatccgtgggtaacgccgtgcgacactgtagtggcgaaaaaggctggttgcccccagagttatttaactgcactacaattagctttgtggatctgagggccatgaatgagaagttaagcaggaatgagactcaggttgatggcgctcgcgcattgcagctcgtccgcgcattgcgctccgcgacccagcatactggcacgttgtttgggaacgacgtaagaacggcctaccagctcctgggccatgtgctccagcacgagagctggcaacagggttttgatctggcagctacccaggacgccgattttcacgaggatgtgatacattctggctccgccttgctggcgcctgctacccgagccgcttgggaacagatccagcgttctgaagggggtacagcacagcttctgaggcgcttggaaggctacttttctaacgtggctaggaacgtgcgtcggacctacctcagaccattcgtaatagttaccgccaacatgatcctcgccgtcgacattttcgataagtttaattttacaggcgcacgtgttccgaggttcgataccatccacgaagaatttcctcgagaactcgagtcctctgtgagtttccccgctgacttcttccgtccccctgaagagaaggagggccctctactgcgacccgcaggcagaagaactacaccccagaccacccgccctggcccagggacagaacgggaggctcctatcagtcggagacgcaggcatcccgatgatgccggacagttcgcagtggcgctggtaatcatttatcgcaccctcggccaactattgcccgagcgctacgatcccgacaggaggtcactccggttgccacacagacctataatcaacactcccatggtctccacgcttgtatacagcgaaggtgctccactaccgcgacccctcgaacggccagtgctcgtggaattcgctcttctggaggtggaggaacggacgaagccagtctgtgtgttttggaaccactcactggcagtcggcggtaccgggggatggtctgctagaggctgcgagctgctgtcacggaataggactcacgttgcctgtcagtgtagccacaccgctagtttcgccgttctcatggatatttctagaagggaaaatggggaagtacttcctctgaaaattgtcacatacgccgctgtttctctgagcctcgcagccctcttagtcgcctttgtcctgctatccttagtacgcatgctgagatccaacctccattccatccataagcacttggccgtggcgctttttctgtcacagctggtgttcgtgattggaatcaatcagactgaaaacccttttctatgcaccgtggtggccatcttgctgcactatatttatatgtccactttcgcctggacactggtcgagagcctgcatgtgtacagaatgttaaccgaagtgcggaacatcgacaccgggccaatgcgtttttattatgtggtggggtgggggatcccggctattgttacagggctggcagtcggtctggatccccagggctatgggaacccggacttttgctggctgtccctccaagatactctgatctggagtttcgccggacctattggcgcagtgataataatcaatactgtcacatccgtgctgtcagctaaggtatcctgccagcgcaagcaccattattacggaaagaagggaatcgtgtctttgctacggaccgcttttttgttgctgctgctgattagcgccacctggttgctgggcctgttggccgtgaaccgcgacgcgttgtcctttcactacctgtttgcaatcttttccggccttcagggacctttcgtcttgctgttccactgtgtgctcaaccaggaggtgcgtaaacacctgaagggcgttctgggcggtcgcaaattgcatcttgaagactccgccactacccgcgcaacactgttgacaaggagtctcaattgtaacacaacattcggagacgggcctgatatgctacgcactgacctcggggaaagcaccgcgtcgctggattccatcgtccgagacgagggcatccagaagctgggagtgagcagtgggctcgttcggggatctcacggagagcctgatgcatccctcatgcccagatcttgtaaggatcctcctggacatgactcggactctgacagcgagcttagccttgacgagcagtcttcgtcctacgcgagttcacatagctctgactcagaagatgatggggtgggcgcagaagaaaagtgggacccagccagaggggctgtccactcgacacctaaaggtgatgctgtggccaaccacgttccagcaggctggcctgatcaaagcctggctgaatcggacagcgaagacccaagcgggaagcctagactgaaagtcgagactaaagtctctgtcgagctccatcgagaggaacaaggctcacatagaggggagtatccacccgaccaggagagtggaggagccgctagactggcctcatctcagccgccagaacagaggaaaggcatattaaagaataaagtgacatatcctcccccactcactcttaccgaacaaacgctgaaggggcgtcttcgggaaaagctggccgactgtgagcagagccctacctctagtaggacgagttctctgggatcaggaggcccagattgcgctattactgtcaaatcccccggacgggagccgggaagggaccatttgaacggtgttgctatgaatgtccggaccggcagtgcccaggccgacggcagtgactccgagaagccatag

SEQ ID NO: 216474 - DNA, 4194 bp, Artificial Sequence
  Description of Artificial Sequence: Synthetic coding sequence
atggcccctcctcctccacctgtgttgccagtcctactcctgctggcagccgctgccgcattgcccgctatgggattgcgtgctgccgcttgggaacccagggtgcctggtggtaccagggccttcgccctcagaccagggtgcacatacgccgtcggggctgcctgtacacctagagcaccccgagagctcctggacgttggaagagacggcaggcttgcaggacggagacgcgtaagtggtgcaggtcggccattgccactgcaggtccgcttggtggcgagatctgctcctacagcactcagtcgacggctcagggccagaactcacctccctgggtgtggggctcgggctcgcctctgtggcaccggtgcacgcttgtgtggtgctctctgtttccctgtccccggtggctgcgccgctgctcagcattctgcactcgccgctcctactactctcccagcctgtcgatgtcctccaagaccaagacctcgctgccctgggcgacccatttgtctgccacctggaggctctgttcgactgcgcttgctgtgcgccctgagacgcgcagctggcgctgtgcgggtgggcctcgctctggaggccgcaactgccggaaccccctccgcatccccgagtcctagccctcctctgccacccaatctccctgaagctcgagctggcccagctaggcgggcaaggcgcggaacctccggcagaggatcccttaagtttcctatgcccaattatcaggtggccctgtttgaaaatgaacccgctgggactctgatactgcagctccatgcgcactacaccattgagggagaggaggaaagggtcagttattatatggaaggtctctttgacgaaagatctcgagggtattttagaattgatagtgccacaggtgccgtttctactgactccgttctcgacagggagacgaaagagacacacgtccttagagtgaaggccgtagattatagcacccccccacggtccgctacaacgtatatcactgtgctcgtgaaggatacaaacgatcactccccggtcttcgagcagagcgaatatcgcgagcgggtacgggaaaacctggaggttggctatgaagtgttgaccatcagggcctcggatcgcgactcccctatcaatgcaaacctcaggtaccgggtcctggggggagcatgggatgtgttccagcttaatgagtccagcggggtggtctccacccgtgccgtattagatcgtgaggaagccgcagagtaccagttattggtggaggccaatgaccaaggcagaaatccaggtcctttgagcgccaccgctaccgtatatatagaagtcgaggatgagaatgataactatccgcaattttcggaacagaactacgtcgtgcaggtgcctgaagacgtcgggttgaacactgctgtccttagagtacaggcgacagatagagaccagggacagaacgcagccattcactactcgatcctgagtgggaacgtcgctgggcagttctaccttcactcactatcaggtatactcgatgtgattaatcccctggacttcgaagatgtacagaagtactcattgtctattaaggcccaggatggcggacggccaccattaataaattcctctggcgtagtttctgtgcaggtcctggatgtcaacgacaacgagccaattttcgtctctagtccgttccaagcgacggtcttggaaaacgttccattggggtaccccgtggtgcatatccaggcagtggacgccgattctggagaaaatgcaaggctccactaccggctcgtagacactgcgtcgactttcctgggaggtggctccgctggccctaaaaacccggctcccacccccgacttccccttccaaatccacaactccagtggctggatcacagtatgcgcagagctggacagagaggaagttgagcattactcatttggtgttgaggctgtcgatcacgggtcaccaccaatgtcttccagcacatccgtttccataactgttctcgacgtcaatgataacgacccagtattcacccagccgacttacgagttacgacttaacgaggacgctgccgtagggagcagcgtactgacactccaggccagagaccgagacgcgaactctgtgatcacttatcagctgaccggagggaatacaaggaataggttcgccctgtctagccaacgcggtggcggtctgattactctggctctgccactggactataaacaggagcagcagtacgtgcttgcggtgactgcctcggatgggacccgctctcatactgcccatgtgttaatcaacgtgactgacgccaacacccatcggcctgtgtttcagagctcgcactacaccgtctcggtgtctgaggatcggccagttggtactagcattgccaccttgtccgccaacgacgaagataccggtgaaaacgctagaataacgtacgtgattcaagaccctgtaccacaattcagaatagaccccgactctgggaccatgtatacgatgatggagctcgattacgaaaaccaggtggcatacactcttacaattatggcccaggacaatggaatccctcagaagtctgatacaacaacactggagattctcatcctcgacgcaaacgataatgcccctcaatttttatgggacttctatcagggctccatcttcgaggacgcccctccctctacttctatcctgcaggtctccgccactgaccgcgatagtggacccaacgggaggctcctttacacctttcagggtggggacgacggcgacggtgatttctacattgaaccaacatccggagttatccgcacccaacgcaggcttgatcgcgaaaatgtggcagtgtacaatctgtgggctctggcggtggacagaggaagtcctacccctctgagcgccagcgtcgagatccaggtcacaatattagacatcaacgacaacgcaccgatgttcgaaaaagatgagcttgagttgttcgtggaggagaacaaccctgtgggtagtgtggtggcaaaaatccgggcaaacgaccctgatgaaggccctaatgcccagataatgtatcaaatcgtagaaggcgacatgcggcatttctttcagctggatctcctgaacggggacttgagagccatggtggaactggatttcgaggttagaagagagtacgtcctggtcgtccaggcaacaagcgcccctttggtgagccgcgcaacagtgcacatcttacttgtggatcagaatgataatccacccgtgctgcccgacttccagatcttattcaataactacgtaaccaacaaaagtaatagctttccaacaggtgtgattggctgcatacctgctcacgatcctgacgtttcagattcactgaattacactttcgtacagggcaacgagctacgtctgcttcttttagatcctgctactggggaactgcaactcagtcgtgacctagataacaacaggccccttgaggcattgatggaggttagcgtcagcgatgggatacactccgtcaccgcattttgtacattacgtgttacgatcataacagatgacatgctgacaaacagcattacggtgaggctagagaacatgagtcaggagaaatttctgtcacctttgttagccctcttcgtggagggcgtggccgcagtgttgtctaccacgaaagacgacgtgtttgtgtttaatgttcaaaacgacaccgacgtttcttccaacatcttaaatgtcacgttttctgctctattgcccggtggggtgcggggacaatttttcccgagtgaggacctccaggagcagatatacctaaatcgcaccctgctgacaacaattagcacgcagagagtcttacctttcgatgacaatatctgcctgcgggaaccttgtgaaaactatatgaaatgcgtgtccgtgttacggtttgacagttctgctcctttcctgagcagcaccacagtcttgtttagacctatccaccctattaatgggctgagatgtaggtgtcctccgggttttacgggcgattattgtgagaccgagatcgacctgtgctattccgacccctgcggcgcaaatgggcgatgtcgttcccgggagggaggatatacgtgcgagtgttttgaggattttacagcggtctcatag

SEQ ID NO: 216475 - DNA, 2319 bp, Artificial Sequence
  Description of Artificial Sequence: Synthetic coding sequence
taagatttcccattccagatccacaactccagcgggtggatcacagtgtgtgcagagctggatagagaagaagtagaacactactccttcggggtcgaagcagtggaccatgggagcccacccatgagcagctccacttcggtgagcataaccgtactggatgtcaacgataacgatcccgtgttcacccaacccacatacgagctccgtctcaatgaagacgcagcagttgggagtagcgtgctcacactccaggcaagggatcgcgacgcaaactctgtgattacttatcagctgactggcggtaacacgagaaatcgtttcgcattgtcttcccagagaggcggaggcttgataacacttgcactgcctctagactataaacaggagcagcagtatgtactcgctgttacagcatctgatggcaccaggagtcacacggcccatgtcttgataaacgtcactgacgccaacactcatagaccagtattccagagcagtcactacactgtaagtgtctctgaagacaggcccgtcgggacatctatagcaacactctccgccaacgacgaggacacaggcgaaaatgccaggatcacatacgtcatacaggatccggtcccccagttcagaatcgatcctgacagtgggacaatgtatacaatgatggaactggactatgagaaccaagtagcctataccctaaccatcatggctcaggacaacggcatcccacagaagtctgatacaaccaccttggagattctgattcttgacgctaatgacaacgcacctcagttcttgtgggatttctaccaaggtagtattttcgaagatgcccctccttccacaagtatcttgcaagtgagcgcgacagacagagactcaggcccaaacggcaggttgctgtatacttttcagggcggtgacgacggagacggagatttctatattgaacctaccagcggtgtgatccgtacacaacgcaggcttgaccgggagaacgttgcagtctataacctgtgggctttggctgtcgaccggggaagccccacccctctgtccgcctccgtcgaaattcaggtgaccatcctggacatcaacgataacgctccgatgttcgagaaggacgagctggagttgtttgtagaggagaacaacccggttggttcagtggtggcaaagatacgcgctaacgatcccgacgaagggcctaacgcacagatcatgtatcagatagtcgagggcgacatgagacactttttccagttagatctgctgaatggcgatttgcgggcaatggtcgagctggatttcgaagtacgcagagagtacgttctagtggtccaggctacgtccgcaccattggtgtcgcgtgcaaccgtgcacatcctgctcgtggaccagaatgacaatcctccagtgttgccagacttccagatcctttttaacaattacgtgaccaataagagtaattctttccctaccggcgtgatcggctgtatcccagcccacgaccctgatgtttctgattctctaaattacaccttcgtgcaaggcaacgagctgaggctgctgctcttggacccagctaccggcgagctgcaattatcccgcgatctagataacaacaggcccctggaggccctgatggaagtgtctgtttcagatggtatccacagtgtgaccgcgttctgcacactcagagtgactatcattaccgatgacatgttgactaattctattacggtgcgtctggagaacatgagccaggagaagttcctgtctcctctgctggctctctttgtggagggggtggccgcagtgctcagcaccaccaaggacgatgttttcgtcttcaatgtgcagaatgataccgacgtgagcagtaacatcctcaacgtgacgttctctgccctacttcctggtggcgtgcggggtcagtttttcccaagcgaggacctacaggagcagatatacttaaaccgcacactactgacaacaatctcaacccagcgcgtgctcccatttgatgataatatctgcctgagagaaccatgcgagaattatatgaagtgcgtgagcgtactcagattcgactcgagtgccccatttcttagcagcacaaccgtgctcttcagacccatccaccccatcaacggcttaagatgccgatgtcccccagggttcacaggcgattattgcgagacagaaatcgacttgtgctatagcgatccgtgcggggcaaatgggaggtgtcgctccagagaaggcggatacacatgtgagtgtttcgaagactttaccgagatcagctag

SEQ ID NO: 216476 - DNA, 8772 bp, Artificial Sequence
  Description of Artificial Sequence: Synthetic coding sequence
atgagatctccagctactggcgtgccgctgccgacgcctccccctccgctgctacttctcctcttgctgttgctcccaccacctctcctgggagaccaggtggggccttgtaggtcactcggaagtaggggacggggatcctctggcgcttgtgccccaatgggctggctgtgcccctcatccgcctcaaatttgtggttgtacacttctcggtgccgggatgctggcacggagcttactggccatctggtgccgcaccacgatggcctcagggtctggtgccccgaaagtgaagcacacatccccctgccaccggctccagaaggatgcccctggagctgccgactcctcggtattgggggacatctcagtccacagggaaagctgaccctgcccgaagaacatccatgcctgaaggcccctcgcctgcgttgccagagctgcaagctggctcaagcacctgggctgagggctggagagcgcagtcccgaggagtccttaggtggtcgccgaaaacggaacgtaaacaccgccccacagtttcaaccaccttcataccaggctacagtgcctgagaatcagcccgctggaacgccagttgcatcattgagggcaatcgacccagacgagggagaagcgggtcggctcgagtacaccatggatgccctgtttgactcccgcagcaaccagtttttttcactcgaccctgtgactggagctgtcacaacagcggaagagctggatagagagacgaagagtacccatgtcttcagagtgaccgctcaggaccatggcatgccaagaaggagtgctctcgctactttgacaatactcgtgaccgataccaatgatcatgaccctgtcttcgagcagcaggagtataaagaaagtctgagagaaaatctggaggtagggtatgaagtgctgacagtacgcgctaccgatggagatgcgccacccaatgccaatatactgtaccgtctgctggagggcagcgggggttccccctccgaggtatttgagatcgacccccgttcaggtgtgattcggactcgagggcctgtggatcgggaagaagtggaaagttaccaattgaccgtcgaggcttcagaccagggcagggatccgggaccgcgtagtacaactgctgcagtgttcttgagtgtggaggatgacaatgacaacgcccctcaatttagtgaaaaaaggtacgtggttcaggtgcgcgaggatgttacacctggggctccagtgctgagggtgaccgcatcagatcgcgataaagggagcaacgctgttgtccactattctataatgtcagggaacgctagaggccagttctacctggacgctcaaacaggtgcccttgacgtggtgtctccgttggattatgagactaccaaggagtatacactgcgagttcgagcccaggacggaggtcgtccaccactgtcaaatgtgtccggcctggtgacagtccaggtgctcgatataaatgacaacgccccaatttttgtgtcaacgcccttccaggccaccgtgcttgagtccgttccccttggctatttagtcctgcacgttcaagcgatcgatgccgacgctggcgataatgctcgtttggagtatcgcttggctggagtggggcatgatttccccttcactataaataacggcactgggtggatatcggtcgccgcagagcttgatcgggaagaggttgatttctacagcttcggggttgaagccagggatcacggcacccccgcactcacagcaagcgcatcagtctctgttacggtactggacgtcaatgataacaaccccactttcactcagcctgagtatactgttagactgaacgaagatgctgccgtcggaacgtctgtggttaccgtgtctgcagtcgaccgcgatgcccacagcgtcatcacctaccagatcacatccggcaacactcgtaatcgattttccattacatcccagagcgggggaggcctggtgtcactcgcactccccttggactataagctcgagaggcagtacgtgctggctgtgacggcatcggacggcactcgtcaggatactgcccagattgtggtgaacgttactgatgccaacactcacagaccagtgttccagtccagtcattatactgtcaatgtgaatgaggataggcctgctgggacgacagtggtgctgatctcggccaccgacgaagacaccggcgagaatgcacgcatcacctattttatggaggatagcattccccagttccgtattgacgcagacactggagctgtgactacccaggcggagctcgactatgaagatcaggtgtcgtacacactggccatcacggctagagacaacgggattcctcaaaagagcgacactacctatttagagatcctggtgaatgacgtcaatgacaatgctccccagtttctgcgcgacagctaccaagggtccgtgtatgaagacgttcccccatttacatctgtcctgcaaatctcagccactgacagggattcgggcctgaatgggagggtgttctatacattccaaggtggggacgatggcgatggcgacttcatagtggagtccacatcaggtatcgtgaggacattgcggaggttggacagggaaaacgtagcgcagtatgtactgagagcatacgcggttgacaagggaatgccccctgcacgaacacccatggaggtaaccgtgaccgtattagacgtgaacgataatccgcctgtgttcgaacaagacgaattcgacgtctttgttgaggaaaattctcctatcggcctggcagtcgctagggtcaccgccactgacccagatgagggtactaatgctcagatcatgtaccaaattgtagaagggaacatccctgaggtgttccagttggacatcttttccggagaattgaccgccttagtagatctggactatgaggatagacccgagtacgtcctcgtgatccaggcaacctcggcccctttggtcagtcgtgcgactgtgcacgtgcggctgctggaccggaacgataacccacctgtgttagggaactttgaaatcctatttaataattatgtcactaataggagctccagtttcccagggggagcgatcgggagggtaccggctcatgaccccgacatctcagacagcctgacatacagcttcgagcgcggaaacgaactgtctctcgttttactgaatgcatccaccggcgaacttaagctcagcagagctcttgacaataatcgccctttggaggctattatgtcggtgttggttagcgatggcgttcatagtgtcaccgcacagtgcgctctgcgtgtgacaatcatcactgacgagatgcttacacattccattactctgcgcctcgaagatatgagtcccgagcggtttctgtcgccactcttggggctgtttatccaggccgtggccgctaccctagctacgcctcccgaccacgtggtcgtcttcaacgtgcagagggataccgacgctccaggtggccacatactaaacgtttctttgagcgtgggacagccgccagggcctggaggagggcctccatttttgccatccgaggacttgcaggagagactgtatctcaatagatccctattgaccgccatcagcgcgcagagagtgctcccgttcgacgataatatttgtctccgtgaaccatgcgagaactacatgagatgtgtgagtgtcttacgatttgatagttcagctcctttcatcgcgtcctcatcagtcttatttagaccaatccaccctgtcggcggactccgctgtcgctgcccaccaggttttacaggtgactattgtgaaacggaggtggacctgtgctacagtcgcccttgcggtcctcacgggaggtgccgttctcgagagggaggctatacctgcctctgccgagacggttacacaggagaacactgcgaagtctccgctcggtccggacgttgtacccctggagtctgtaaaaacgggggaacctgtgtgaacctcttggtggggggattcaaatgtgattgcccgtcaggcgattttgagaagccctattgtcaggtgactacacgatcgtttcctgcccactcctttattacatttagggggctccggcagcgtttccatttcacgctggcactgtccttcgccacaaaggagcgagacgggctgttactgtacaatggcaggttcaatgagaaacatgattttgtggccttagaggtcatccaggaacaagtgcagctgactttctcagccggtgagtcaacaacaaccgtgtccccctttgtccccggtggggtttctgacgggcagtggcacaccgtgcagttgaagtattacaacaaacctctcctcggacaaacagggctgcctcaggggccatcggagcagaaggtcgccgtagtcacggtggacggctgcgatacaggcgtcgcactccgatttgggagtgtacttggaaactatagttgcgctgcccaagggacacagggcggaagtaagaagagccttgacttgacagggcctctgctgcttggcggtgtcccggacttgcctgaaagttttcccgttcggatgagacagtttgtgggttgcatgcgtaaccttcaggttgattctaggcacattgacatggccgacttcatagcgaataacggcactgtcccgggatgtccagccaaaaaaaatgtgtgcgatagtaacacatgccacaacgggggtacctgtgtgaatcagtgggatgccttctcttgtgaatgtcccctgggattcggaggcaaatcctgcgcacaggagatggctaatccacaacactttctgggctcaagtctggtggcctggcacgggctgtctctcccaattagtcagccatggtatttgagcctgatgttcagaacacgccaggcggatggagtgcttttacaagcaattacacgcggacgcagcacgattactctgcagctgagagaaggccatgtgatgctgagcgttgagggtactgggctccaggccagctcccttcggctggagcccggaagagctaatgatggtgactggcaccacgctcagctcgcacttggggcatccggaggccctggccacgcgatacttagctttgattacggtcagcagagggcagaagggaacttgggcccaagattacacggccttcatctgtccaacataacggtgggcggaatcccagggccagctgggggagtggctagagggtttcgcggatgtttgcagggggtccgggtgagcgataccccagagggggtcaactccttagatccaagccatggggaaagcatcaacgtcgaacaaggatgttcattaccagacccgtgtgattccaatccctgcccagcaaactcttactgcagcaacgattgggattcttatagctgtagctgcgaccctggatactacggggataactgtacaaacgtgtgcgacctgaacccatgcgaacaccagtctgtgtgtacgagaaaaccttccgcgccacacggctacacttgcgaatgcccccctaactacttaggaccttattgtgagacaaggatcgatcaaccgtgtcctcgcggatggtggggacaccctacttgcgggccatgtaactgcgatgtgtctaaaggtttcgatccagactgcaataaaacctctggggaatgccactgcaaagagaatcattatagaccacctggctctccaacttgtctgctttgtgactgctaccccacaggctccttgtcacgtgtgtgtgacccagaggacgggcagtgtccctgtaaacccggagtcatcggtcgacagtgcgatcgctgcgataatccttttgccgaggtgaccactaacggatgcgaggtcaattatgatagttgtccccgtgcgattgaagctggtatatggtggcctcgaactcggtttggtctgccagccgcagccccatgtcccaagggctcatttggtactgcagtgcgtcactgtgatgaacacagggggtggttacctcccaatctgttcaattgcacgtctatcaccttttccgagctgaagggatttgcggagagactgcagcgcaatgaatctggtctagactccgggagaagccagcaactcgctttgctgctgcgcaacgccacccagcacaccgccggttacttcggttctgatgtgaaagttgcatatcagctcgctactaggcttctggctcacgagagcacgcaaagagggtttggactttccgccactcaagacgtgcattttacggaaaatttgctgagagtgggatcagctctccttgatacagcaaacaaaaggcattgggagctgatccagcagacagagggaggaacagcctggctgctccagcactacgaggcttacgcctctgccttggctcagaacatgcgccacacttacttatctccattcactatagtaactccaaatattgtcattagcgtggtccgactggataagggaaatttcgccggtgcaaaactccctcgatatgaagcccttcgaggggagcagcccccagatctcgagacaacagtgattctgcccgagagtgtctttagggagacaccgccagtcgtgcgtcccgcagggcctggtgaagcacaagaaccagaagagctggcgagacgacagaggaggcatcctgagctgtcccagggagaggcagtggcatctgtaattatatacagaacactcgcaggtctactaccccacaactacgatcccgacaaaagatccctgcgcgtgcctaagcggccaatcattaataccccggtcgtgtcgataagtgtgcacgacgatgaagaattgctccccagggcgctagacaaaccagtgaccgtccagtttcggctgctggaaaccgaagaacgcaccaagccaatttgtgtgttttggaatcacagcatccttgtgtccggtaccggcggttggtctgctcgtggatgcgaggtggtcttcaggaatgagagccatgtgtcatgtcaatgtaatcacatgaccagtttcgccgtgctcatggacgtatccaggagagagaacggcgagatcctaccacttaagacgttgacatacgtggctttaggtgtgacactggccgctttgctgctgaccttcttttttctgaccctgctgcgcatactgagatccaatcagcatgggatccggaggaacctaacagccgctctgggtctagctcagctggtcttcttgttggggattaaccaagcagatctaccattcgcctgtaccgtgatcgcgattcttctccacttcctgtatctctgtactttctcttgggcactgctcgaagcgctccacctatacagggctctcacagaagttcgggatgtcaacaccggacccatgcgattctactacatgctagggtggggcgtgcccgcttttattacagggttggctgtcggactcgaccccgagggctatggaaatcctgacttctgttggctgtccatctacgacacattgatttggagtttcgccggacccgtggcttttgcagtgagcatgtccgtgtttctttacatattagcagcaagggctagttgtgccgcacaaagacaaggcttcgaaaaaaaagggccagtctccgggctgcagccatcttttgcagtcctcctcctcctgtctgccacctggctactggccctcctgtcggtcaattccgatacactgttgttccactatttgttcgccacttgtaattgcatacagggacctttcatttttctgagctatgtggtactcagtaaggaggtgcgcaaggcactgaagctcgcttgcagccgaaagcctagccctgatcctgccctgacaacaaaatctaccctgacgagctcatataattgccccagtccctacgcagacggacggttgtaccagccctacggagactcagccggttccctgcactctacttctcggagcgggaagagccagccgagctacataccttttctgctgcgggaagaatccgcgctgaacccaggacagggtccaccagggctgggggaccctggtagcttgttcctggaaggtcaggaccagcaacatgatcccgataccgattctgactccgacctttccctcgaagatgatcaatctggcagttacgcaagcacacacagtagcgatagcgaagaggaggaagaggaagaggaggaggaggccgctttccccggtgagcagggctgggattctctcctggggccaggggcagaacgcctccccctccacagtacccccaaagatggagggcctgggcctgggaaagctccctggcccggagacttcggaaccacggctaaagaatcctctgggaacggtgcgccagaggagaggttgcgggagaatggagatgctctctcccgtgaaggatccctcggccctttacctggttcctcagcccagcctcataagggcatactgaaaaagaagtgtcttcccacgatttccgaaaaatcatcattactcaggctcccacttgagcaatgcaccgggagctcccggggatcatcagcatcagaaggtagtcgagggggacccccaccgcgaccccctcctcgacagagcctgcaggagcagctgaatggagtgatgcccattgctatgtcaatcaaggccggaacggtggacgaagattcttccggatcagagttcctgttttttaacttcctacattac

SEQ ID NO: 216477 - DNA, 9939 bp, Artificial Sequence
  Description of Artificial Sequence: Synthetic coding sequence
atgatggccaggagacctccatggagaggcctcgggggacgttcaacacctatcttgctgttgcttctcttgtcgctgttcccattaagccaggaagagctggggggaggcggacatcaggggtgggatcctgggctcgccgcaacaacaggacctagggcccacataggcggaggcgcactggccctatgcccagagagctcaggcgtacgggaggatggtggacctggcttgggcgttagagagccaatatttgtaggcttgcgtggcagaagacagagtgcccgaaactcaaggggcccacccgagcagcctaatgaggaattaggcatcgaacacggggtgcagcccctggggagccgggaaagggagaccggccagggtcccggttctgtactttactggcgcccagaggtgtctagctgtggcaggacaggacctttgcagcgaggcagcttaagtcctggagctttaagtagtggcgttcctgggagtggaaactcctccccacttcccagcgatttcctgattagacaccatggacccaaaccagtgagcagtcagcgcaacgcagggacgggatccagaaaaagggtaggtacagctagatgctgcggggaactctgggccaccgggtccaagggacagggggaacgggcaaccacaagcggcgcagagcggaccgcaccacggcgtaattgtctgcccggagcctctgggtctggccctgagctcgacagcgctcctagaactgctaggacggcacctgcctccggatctgcccctcgcgagtcgcggacagcacctgagcctgcccctaagagaatgagaagcaggggcctctttcggtgtaggtttttacctcagcggccagggcctcgccctccaggtttgcctgccaggccagaggctcggaaagtgacttccgcaaatagagcacggttcagacgggcagcgaaccgacatccacaatttccacaatataactaccagaccctggtgcctgaaaacgaggccgctgggacggccgtcttgcgagtcgtggctcaggaccccgatgctggcgaagccggtcgactggtgtactccctggccgcactaatgaactccaggtctctggaactgttcagcatagacccacagagtggtctcatcagaaccgcagcggcactcgatagggagtccatggaaagacattatcttcgggtcaccgcacaggaccacgggtcccctcgattgtccgccactacgatggtcgccgtgacagtggccgatcgcaatgatcattcacctgttttcgaacaggcccagtaccgagaaactctcagagaaaacgtggaagaaggctatcccattttacaacttcgggcaacggatggtgatgcaccacctaacgccaatttgcggtaccggtttgtaggcccacctgccgcacgcgctgccgcagccgcagcatttgagatagacccgaggtctggcctcatttccactagcggccgagtggaccgggagcacatggagtcgtatgagctcgtcgttgaagcctcggatcaggggcaggaacccggtcccaggtccgccactgttagggtgcacatcacggtgttagacgaaaacgataacgcccctcagtttagtgaaaagagatatgttgcccaggttagggaggatgtgaggcctcacacagtggtgctacgcgtaaccgccaccgatcgggacaaagatgcaaatggcctagtccactacaatattatcagtggaaacagtcgtggccactttgctatcgacagcctcactggagaaatccaggtggtggcaccactcgattttgaggctgagagagagtatgcccttcgtattagggctcaggacgcaggcagaccgccactgagcaacaatacaggccttgcgtcaattcaggtcgtggacattaatgaccatattcctatattcgtcagtacaccatttcaggtcagcgtgctcgaaaacgcaccgctcgggcattcagtgatccacatccaggccgttgatgccgatcatggcgaaaatgctcgtttggaatactcactgacgggggtggcgccagatacaccgttcgtcatcaactccgccactggctgggtgagtgtgagtggacccctggaccgcgagtcagtcgaacactacttttttggagtggaggccagagaccatggatcgccccctctgtctgccagcgcctccgtgactgtgactgtactggacgtgaacgacaatagacccgaattcaccatgaaggaataccatcttagactgaacgaggacgccgcagtgggcacttctgtcgtgtcagtcacagcggtggatagagacgcaaactccgctataagctaccagatcactggcggaaacacccggaatcgatttgctatttcgacccaaggtggcgtggggctagtcacacttgccctgccactggactacaaacaagagaggtactttaagctcgtgctcactgcctctgatcgcgcactgcatgatcattgttacgttcacatcaatattactgacgcgaacacccaccgaccagtcttccagtcagcgcactatagtgtgagcgtcaacgaagatcggcctatgggatctacaatcgttgtaatctctgcaagcgacgacgacgtgggggaaaatgccagaattacctatctgcttgaggataatttacctcagtttagaattgacgctgatagcggcgcaataactctccaggccccactcgactatgaggaccaggtgacttacacgctcgcgatcaccgccagggacaacggcataccccagaaagccgatacgacgtacgtagaagtgatggttaatgacgtgaatgacaatgcaccacaatttgtcgccagccactataccggactggtcagcgaagacgccccaccttttactagcgtgctgcagatctctgcaaccgacagagacgcccacgccaatggtagggtacagtacaccttccagaatggagaggacggggacggcgactttactattgagccgacatcagggatcgtgagaactgtgcggcgtctggacagagaagctgttagtgtgtacgagctgactgcatacgctgtggatcgaggcgtgccgccactgagaaccccagtgagtatccaggtcatggtgcaggacgtgaatgataatgcacccgtgttccccgcagaggaattcgaggtaagggtcaaggaaaacagtatcgtgggttctgtggtggcgcagatcaccgcagtggatccagacgagggtccaaacgctcacataatgtaccagatcgtagaaggaaatatacccgagctgttccagatggatattttttccggtgagctcaccgcattgatcgatctcgactatgaagccagacaggaatatgtgattgtggtccaggctacttcagcaccactggtgagccgagccaccgtccatgttagactcgtggatcagaatgacaattctccagttctgaacaattttcagatcctgtttaacaattacgtgtccaaccgttcagatacctttccatccggaataattggacgtatacctgcatatgacccagacgtttcggatcacctgttctacagcttcgaaagaggtaacgagcttcagctgctggtagtgaaccagacttctggcgagctccggttatctcggaagctggataacaatcgccctctggtggctagtatgttggtgaccgtaacagatggactgcactccgtgactgcgcaatgcgtgctgagggtcgtgattatcaccgaagagctgttagctaatagcctgaccgtccggctcgagaacatgtggcaggagcgtttccttagtcccctgcttggacgcttcctggagggcgtggcagcagtgctggccaccccggctgaggacgtgttcattttcaacatccaaaatgacactgacgtgggagggactgtgctgaacgtctccttttcagctttagctcccaggggcgctggagcaggtgctgctggcccttggttcagctccgaggaactgcaagagcagctgtatgttcgaagggccgctctcgccgcacgcagcctgttggacgtgctcccctttgacgacaatgtttgtcttcgcgagccttgtgaaaactatatgaagtgcgtgagtgtgcttcggttcgactcttcagctccttttttagcgtccgcatccaccctgttcagacctattcagcctattgcagggcttcggtgtcggtgccctcctggattcacaggtgacttctgtgaaaccgagcttgatctgtgttactccaacccttgccggaacggaggcgcatgtgcaaggcgcgagggcggatacacttgtgtgtgccgccctcgtttcacaggagaggactgtgaactcgataccgaagccggaagatgcgttcccggtgtttgtagaaatgggggaacctgtaccgatgccccaaacgggggtttcaggtgccagtgccccgctggcggtgcctttgagggtccacgttgcgaagtggcggcacgttccttccccccatcctccttcgtaatgtttaggggacttagacagcggtttcacctgaccttgtcgttatccttcgcgactgtgcaacaatcagggctgctgttctacaatgggaggttgaacgagaagcacgatttcctggccctagaactcgtcgctggtcaggttaggctgacttatagcactggcgaatcaaatacggtggtttccccaacggttccaggcggactctccgatggccagtggcataccgtgcacctgcgatactataataaacctagaacagacgctctgggaggagcccagggcccttctaaggacaaggtagcggtcctctctgttgacgattgtgatgtggccgtcgcattgcaattcggtgcggaaatcgggaactactcttgcgctgctgcgggtgtgcaaacctccagtaagaaatctctagaccttactggcccacttctcctcggtggcgttcccaacctacccgaaaactttccggtgtctcacaaggactttatcgggtgtatgagagacttgcacatcgatgggagacgcgtcgatatggccgctttcgtcgccaacaacgggaccatggctggttgtcaggcgaaactccatttttgcgatagtgggccatgtaagaactctggattctgtagtgaacgctggggctctttctcatgtgactgtcctgtgggctttggcggaaaggattgtcagttaacaatggctcacccccatcatttccgtggaaacggaaccctttcatggaattttgggagtgatatggctgtcagtgtaccctggtatctcggtctggcatttagaactcgggctacccaaggcgtgctcatgcaggtgcaggctggaccccacagtaccctgttgtgccagctcgatcgcggtctgttatcagtaacagtgacaaggggtagcggaagagccagtcatctccttctagatcaagttacagtgtccgacgggagatggcacgacctccgcttggaactccaggaagagccgggtgggaggcgcggacatcacgttcttatggtctctctggacttttccctatttcaggatacgatggcagtcggatctgaactccagggcttgaaagtgaagcagctgcacgtgggagggctgcccccagggagcgctgaggaggccccacagggcctcgtgggctgcatacagggagtttggttaggatctaccccgagtgggagcccggctctcctgccgccatcccatcgagtaaacgccgaaccaggctgtgtggtaaccaatgcctgcgcttctggaccttgtcctccacacgcggattgtagggacctgtggcagacattctcctgcacttgtcagcccggatattacgggcctggctgcgtggatgcgtgcctgctgaacccctgtcaaaaccaaggcagctgtaggcacctccccggtgccccacacggatatacctgtgactgcgttggcggatacttcggacaccattgcgaacatcggatggaccagcagtgcccccgaggctggtggggcagtcccacctgcggcccttgtaattgtgacgtacacaaagggtttgacccgaactgcaacaagacgaatggccagtgtcactgcaaggagtttcattacaggcccaggggctcagattcctgtctaccttgcgattgctaccctgtggggtctacctctagatcctgtgcacctcactcggggcagtgcccttgtaggccgggtgccttgggacgccagtgcaacagctgtgacagcccatttgcggaggtgactgcctctgggtgccgggtgctgtacgatgcctgtcctaaatccttaagaagtggagtatggtggccgcaaaccaaattcggcgttctcgctactgtcccttgtccaaggggcgcactgggggcagccgtgaggctgtgcgacgaagcccaggggtggttggagccagacttatttaattgtacctcccccgcattccgtgagttaagcctgctgctcgatggcctggagctgaacaaaaccgctctcgatacaatggaggcaaagaagttggctcagaggctgcgggaagtgactgggcacacggaccactacttcagccaggacgtgcgcgtgaccgccaggttgctcgcccacttgctggccttcgaaagccatcagcagggattcggtctgaccgcaactcaggacgcccactttaacgagaacctgctctgggctggttctgccctgctggcccctgaaaccggcgacctgtgggctgctcttggacagagggctcccggagggtcgcccggtagtgcagggttagtgagacatttagaagagtacgctgctacactcgccagaaacatggaactgacgtatctgaaccccatggggttagttacaccaaacatcatgctgagcatcgatcgcatggagcacccttccagtcctagaggtgctcgtcgctatccaaggtaccactccaatctattcagggggcaagacgcctgggaccctcatacccacgttctgctcccctcccagagccctaggccctcgccctcggaagttttgccaacttcctctagcattgagaacagcactacttccagtgttgttccaccccctgcccctccagaacctgagccgggaatctccatcatcattctactggtgtaccgtacactgggaggtctgctacctgcccagttccaagccgagcgcaggggcgcacgcctccctcaaaatcccgtgatgaattctcccgtggttagtgtggccgtattccacgggagaaactttctgcggggaatcttagagagcccaatttctttggagtttcggctgttgcagacagctaatcgctccaaggcgatttgcgttcagtgggatcctccagggctcgccgagcagcacggggtctggaccgctcgggattgtgaactcgtacacaggaacggctctcacgcaaggtgtcggtgttcacggacgggcacttttggagtcctgatggatgccagtcctcgcgagcgcctggaaggcgatcttgagctcttggcggtcttcactcatgtcgtggttgccgtatcagtggcagccttggtgctgaccgcagctatcctgctgtctctgcgctccctcaaaagtaacgtgcgcggtattcatgccaatgttgcagccgcactgggcgtcgccgagctcctatttttgctggggattcaccgaacccacaaccagctggtatgcaccgcggttgccatcttgcttcactacttttttctctccaccttcgcctggctattcgttcagggtttacacctgtatcgtatgcaagtggaacctcgtaatgtggatcggggagccatgagattttaccatgccctcggttggggagtgcccgctgtgcttctaggccttgccgtggggttggatccagaaggctacgggaaccccgacttttgttggattagcgtgcatgaacccctgatctggagctttgcagggcctgtggtgctggtgatcgttatgaatggcaccatgttcctgttggccgctaggaccagctgttccactggtcagcgcgaagcgaaaaagacttctgctctcacactccggagtagttttctattgctactgctggtctccgcctcttggttgttcggactcctcgccgtgaaccactcaatactagcattccactacttgcacgccggactgtgcgggctgcagggactggctgtgctgcttttgttttgtgtcttaaacgccgatgccagagcggcttggatgcccgcttgtcttggtcgaaaggctgcaccagaggaagcgagacccgctccgggtttaggccctggggcatataataacacagcactgtttgaggagagcgggttgatccggattactctgggtgcttcaactgtatccagcgtttcatctgcacggtcaggcagaacccaagatcaggattcacaaagaggtcgaagctatctgagggacaatgtgttagtacgccacgggtcagcagctgatcacactgatcatagcctacaggctcacgcaggccctactgatctcgacgtggccatgttccaccgtgatgccggtgccgatagtgactctgactctgatttaagcttggaggaagagcgcagtttgtcaataccgagttccgaatcggaggacaacggcagaaccagagggcgattccagagacctctttgccgagctgcacagagtgagcgactgctcacccatccaaaagatgtagacggaaacgatttactctcgtattggcccgctctcggcgagtgtgaagctgcaccctgcgccctgcagacgtggggaagcgaacgtcgcctcgggctcgacacttccaaggacgctgctaataacaatcaacctgacccggcattaacgtcaggcgacgaaacctccctgggaagggcccagcgacaacgcaaggggatcttgaagaatcgccttcagtaccctcttgtgccgcagactcgaggcgctccagagctatcctggtgccgagcagctactcttggtcatcgcgctgtgcccgcagcctcctatggcaggatctacgccggaggcggaacaggctctctgtcccagcctgccagcagatactctagccgcgagcaactggacctgctgttgcgacgccagttaagcagagagcgactggaggaggctcctgctcctgtgctgcggcctctgagccgccctggctcccaggagtgtatggacgcagcacctggacgcctcgagcctaaggatagaggctccaccctacctagacggcagccccctcgcgactatccaggagcaatggcaggcagattcgggtcgcgggacgctctggatctaggtgctccgcgtgagtggctgtccactctgccaccccctcgcagaacccgagatctggacccccagccacctcctctccctctgtcgcctcagcgtcagctctcccgggatccactgttaccaagcagacctcttgatagtttgtcccggagcagcaattccagggaacaacttgaccaggtgccgtcccggcatccctcccgcgaagcccttggccctctgcctcagctgctgcgggctcgggaagattccgtctctggcccatcacatggacccagcaccgagcagctcgacatactttcatcgatcctggcgtctttcaactcaagcgctctgtcgtccgtccagagctctagcacccccctgggcccacacacgacagcgactccaagcgcaaccgcgagcgtgttgggaccaagtacacccaggtccgctacatcacactcgatcagcgaactgtcacctgattcagaggtgcctcgctccgagggacacagctaa

SEQ ID NO: 216478 - DNA, 9954 bp, Artificial Sequence
  Description of Artificial Sequence: Synthetic coding sequence
atgatggcccgacgccctccttggcgcggacttggtggtcgttcgaccccgatcctgctgctccttctactctctttgtttccattgtctcaagaggaactggggggtggaggtcatcagggctgggatccaggactggcagcgaccaccggccctagggctcacatcgggggtggcgctctggcattatgccccgaaagctcgggcgtgagagaagacggagggcctggattgggcgtcagagagcctatatttgtcggccttcgcggaaggcggcagtccgcgagaaatagtcgaggtccacctgagcagccaaacgaagaattgggaattgaacatggggtgcagcctctgggctcacgcgagcgggagacagggcagggtccaggatccgtcttatactggcgtcctgaggtttcttcctgtggccgaactggacccctacagagaggcagtctgagccctggcgctctgtcttcaggcgtgcctggaagtggcaatagttcgcctttaccatccgacttcctgatcaggcaccacggtcctaaaccggtatctagccagagaaacgctggcaccggctcaaggaagcgggtaggcactgccaggtgttgtggtgaattgtgggcgacgggctcaaagggtcaaggcgaaagagctactacgtccggtgctgagcgcacagccccaagacgtaattgtttaccgggtgcctctggtagtggacccgagctggattccgccccacgcactgcacgcacggcccctgcgtctggcagcgcccctcgcgagtcacggacggccccagagccggcaccaaagaggatgcggagcaggggtctatttaggtgtcgttttctgcctcaaaggccaggccctcgtcctccaggcctgccggcacgtcctgaagctaggaaggtgacatcagccaatcgagcgagattcagacgtgctgctaatcgacacccgcagttcccacaatacaactaccaaaccctcgtgcccgaaaatgaggccgctggcacagccgtcctgcgtgttgtcgcgcaggatcctgatgcaggtgaagccggtcgactggtgtacagtctagctgctctgatgaactctcggtccctggagctcttcagcattgaccctcagtcgggcctgatcaggaccgccgcagccctcgatagggagtccatggagcgccactacttgcgagtaaccgcccaggatcacgggagcccaaggctgtccgccacaactatggtcgcagtcacagtcgcggaccgcaatgatcactcccctgtttttgaacaggcccagtaccgagaaacacttcgcgaaaatgtcgaggaggggtatcccatcttgcagctccgtgcgacagatggggacgcccctcccaacgccaatctaaggtaccgcttcgtgggccctccagccgcacgagccgctgccgctgctgcctttgaaatcgatcctcgtagcgggctcatctcaacctctggtagggtagatcgggagcacatggagtcatatgaactcgttgtagaggcatctgatcaggggcaggaacccggtcccagatcagcaacagtgagggtgcatattaccgtgctggatgagaatgataacgctccccagttcagcgaaaagcgatacgtggcccaagtgagggaggacgtcaggccccacaccgtggtgctgagagtgactgccaccgatagagataaggacgccaatggactcgtgcactacaacatcatatccggtaattccagaggccatttcgccattgattccctgaccggtgaaatccaggtggttgcacctctggacttcgaggccgaaagggagtatgctctgaggattcgggctcaggacgccggtagacctccactttctaacaataccggccttgcttccattcaggtggtcgacattaatgatcacatcccaatattcgtgtccaccccttttcaggtgtcagtcctggaaaatgcccctctaggccacagcgtgatccatatacaagcggtcgacgccgatcatggcgagaatgccaggcttgaatattccctgacgggggtggccccagatactccctttgtcattaattcagccactgggtgggtgagcgtaagcggcccactagaccgcgagtctgttgagcattatttttttggggtcgaggctagagatcacggttccccccctctttccgcctccgcaagcgttaccgtgaccgtactggacgtcaatgacaacaggccagagttcactatgaaagaatatcacttgaggctcaacgaagatgcagccgttggtactagcgtagtgagcgtcacagccgtggatagggacgcgaacagtgccatctcctaccaaataacagggggaaatacccgtaatcggttcgccatcagtacccaaggaggagttggactggtcaccctcgcacttcccctggattataagcaagagagatattttaagctggtgctgacagcctcggaccgtgcgctgcacgaccactgctacgtgcacatcaacatcacagacgctaacacgcacagaccagtatttcaatcagcgcattactccgtgtctgtcaatgaggacaggccgatgggaagcacaatagtggttatctcagcctctgacgacgatgtgggggagaatgcgcgaatcacatacctcttagaagataacctgccccagttccgcatagatgccgattctggagctattaccctgcaggcccctctcgattacgaggatcaggttacatacaccctcgccatcaccgctcgcgacaatgggataccacagaaggccgatacgacctacgtggaggttatggtgaacgacgtgaacgacaacgccccacagttcgttgcctctcattacaccggcctggttagcgaagatgctccgcctttcacatctgtgctgcagatcagtgctactgaccgggacgcccacgcaaacgggcgtgtgcagtatacctttcagaacggcgaggacggtgacggcgatttcacaatcgagccaaccagcgggatcgttcggacagtccggcgtctcgatagggaggccgtgagtgtttatgagttgacagcctatgccgtagaccgtggcgtgccccctttaaggaccccagtgtccatccaagtgatggttcaggacgtcaatgacaacgccccagtgttccccgcagaggagtttgaggtgcgggtgaaagaaaactctatagtggggagtgtagttgctcagattacagcggttgaccctgacgaagggccaaatgcacacatcatgtaccagatcgtggaggggaatattccagagttgttccagatggatatctttagcggcgaactcaccgccctcattgatctggattacgaagcacgccaagagtatgtaatcgtcgttcaggctactagtgctccactagtctctagagccaccgtgcacgtccggctggtcgaccaaaatgacaactcacctgtgctcaacaactttcagattctctttaacaattacgtctccaatagatctgacaccttccctagcggaatcattgggaggatccccgcatacgatcccgacgtcagcgaccacctcttctattcatttgagcgcggaaacgagctgcagctcctggtggtgaatcaaactagtggcgagctgcggttaagtcgtaaactcgacaacaatcgtccattggtagcatccatgctggtgacggtcacagatggattacattcagttaccgcccagtgtgtgcttcgcgtggtcatcattacggaagaactgctggccaattctctgaccgtccgcctggaaaacatgtggcaggagagatttctcagcccccttttgggaagatttcttgaaggagttgccgctgtactggctacccctgcagaagatgtgttcatttttaacattcaaaatgacaccgatgtcggaggcaccgtcctgaatgtgtccttcagtgcgcttgcccctagaggtgctggagccggagcagccggtccatggttcagcagtgaggagttgcaggaacagctgtatgttcgacgtgctgcacttgcggctagaagcctccttgatgtacttccatttgatgacaacgtttgcctgagggaaccctgcgagaattacatgaaatgtgtctccgtgttacggttcgactcatcagccccttttcttgctagcgccagcacactgtttcgtcctatccagccgatcgctggcctgcgttgtcgctgcccgccaggattcacgggagatttttgcgaaacggaactcgatttgtgctactctaacccttgcagaaacggtggcgcatgtgctcgcagggaaggcggatacacctgcgtctgcaggccaagatttacaggggaagactgtgaactcgataccgaggccggtaggtgcgttcccggtgtgtgccgcaatgggggtacttgcactgatgccccaaacggtggcttcagatgtcagtgccccgcagggggtgcttttgaaggccctcgctgcgaggtagctgctcgatcttttcctccgtcttcgttcgtgatgtttagggggttgcgccagcgctttcacctgactctctctctgagtttcgctacagtccagcagtcaggtctcctcttttacaatggacgcctgaatgaaaagcatgattttctggcactcgagctcgttgccggacaagttcgactcacctacagtacaggagaaagcaacactgttgtcagccctactgtgcctgggggtttaagtgatggccagtggcacacagtgcatctacgctattataacaaaccacgaactgacgcgctgggcggagctcaaggccctagtaaggataaggtcgctgtgctgtctgttgatgattgcgatgtggctgtggcccttcagttcggcgcagagattggtaattactcttgcgccgcagcaggagtgcagacaagttcaaagaagtccctcgatttaacaggccctctgctcctgggaggagtaccaaacctgcctgagaattttcccgtgtctcataaggatttcatcggatgcatgagggaccttcacattgacggtagaagagttgatatggctgctttcgtggcaaacaacggtactatggctggctgccaggccaagttgcatttttgtgactctgggccatgcaagaacagcggattctgtagcgagaggtggggaagcttttcttgtgattgccccgtcggttttgggggaaaggattgccagttgactatggcacacccccatcatttccggggaaatggaaccttatcctggaatttcgggtcagatatggccgtgtctgtcccatggtatcttggcttggcttttagaacccgtgctacacagggggtcttaatgcaagtccaagccggtcctcattccactttactatgccagctggataggggtctgctgagcgtcacagtgactcgtggttcaggacgagcatcacacttgctgctggaccaggtgactgtaagcgacggcaggtggcacgacttgaggctggaacttcaggaagagcccggtggccgtcgtggacaccacgtgcttatggttagcttagacttttccctcttccaggatactatggcggtcgggtcggagcttcagggactcaaggtcaagcagcttcacgtgggcggactgccacccggttcggctgaagaggccccacaggggttggtgggttgtatccagggtgtctggctcgggtcgacaccttcgggatctcctgccctcctacccccatcccaccgcgtaaacgcagagccaggttgtgtggtgacgaacgcgtgtgccagtgggccatgcccgccacacgctgattgccgagacctttggcagacattcagttgcacctgccagccaggatactatggcccaggttgcgtggatgcctgcttactgaacccctgccagaaccaaggatcctgcagacacctgcccggtgcaccacacggatacacttgcgactgcgtcggtggttatttcggtcaccactgcgagcatcggatggatcagcaatgccctaggggatggtgggggtctccaacatgtggcccttgtaactgtgacgtgcataagggattcgatcccaactgtaataagacgaatggtcaatgccattgtaaggaatttcactaccgtccaaggggttccgactcctgcctcccgtgtgattgttatcctgtggggtctacctccagaagctgcgcccctcactctggacagtgtccttgcagacccggagctttaggccgtcagtgcaactcatgtgactcaccctttgctgaagttaccgcatcaggatgtcgagtgctgtatgatgcctgcccaaaaagtttgaggtcgggcgtgtggtggccccagactaagtttggcgttctggctactgtcccttgtcccaggggtgccttgggtcttcgcggagctggtgctgccgtgagactatgcgatgaggcacaggggtggctggaaccagacctgttcaattgcactagccctgccttcagagagctctcccttctgttagacggtcttgaactgaacaaaacagcgctagataccatggaagctaagaaactggcacagaggctccgcgaagtgacggggcatacagatcattacttctctcaggacgtgcgcgtcaccgcgcgattgctcgcacacctcctggcctttgaatctcaccagcaagggttcggcttaacggcaactcaggacgctcacttcaacgaaaacctcttatgggctggtagcgccctcctcgcacccgagacgggggacctgtgggccgctcttggccagagagcccctggagggtcaccagggtcggcagggctagtacggcacctggaagaatacgccgcaacgctcgccagaaacatggaactgacatacttgaacccaatgggtctggttacccccaacattatgctgagcatcgacaggatggagcacccctccagccctcgcggagctagaaggtatccacgctatcactctaacctctttcgaggacaggacgcctgggatcctcatacccatgtgttactgccttcccagtcccccaggcctagcccaagcgaggtgcttcctacctcctcctctatcgagaactctaccacaagttctgtagtccctccaccggcacctcccgagccggaacctggcatcagtatcatcattctgctggtgtacagaaccctgggtggattactcccagcccagtttcaagctgaacgcagaggcgctcgactccctcagaaccccgttatgaactcccccgtagtgtctgttgccgtgtttcatggcaggaattttctgcgcggaattctggaatcaccaatttcactcgagtttagattactgcagactgccaacaggtccaaagccatatgtgttcagtgggacccccctgggctggcagagcaacacggggtgtggactgcacgggattgtgagttggtgcataggaacggctcccatgccaggtgtagatgttctcggaccggcacattcggcgtgctgatggacgccagtcccagagagagactggagggggatctcgagctcctcgccgtattcacccacgtcgtggtcgcagtgtctgtggctgccctcgtcctcaccgccgcaatcctcctctctctccgaagcctgaagagcaacgtgcgaggcatccacgccaatgtggccgcagccctgggtgtggccgagctgctttttcttctggggattcatagaactcacaatcagctcgtgtgcacagcagttgctattttgcttcactactttttcctgtcaactttcgcctggttgttcgtgcaaggcctgcacctgtaccgtatgcaggtggaacccaggaacgtggacagaggagcaatgaggttttaccacgcccttgggtggggagtgccggcagtactgttaggccttgctgtcggcttggaccctgaaggctacggaaaccctgacttctgctggatcagcgtccacgagcccctcatctggtcatttgcaggccctgtagtcttggtgatagtgatgaacgggacgatgttcctgctggctgcccgaacaagctgctcaaccggccagagagaggcgaaaaagacctccgccctgaccctccgcagctccttcttgctgctgctgttagtgagcgcgtcctggttgtttggtctactcgcagtaaaccatagcatactcgccttccactatcttcacgctggcctgtgtgggctacaagggctggctgtccttctgttattctgcgtgctgaacgctgatgctagagcggcttggatgcctgcatgcctggggagaaaggcagcccctgaggaagcaaggccagccccagggctgggaccgggtgcatacaacaacacagccctgtttgaggagtcaggcttaatacggattactctcggagcctcaactgtgtccagtgtgagtagtgccagaagtgggagaacccaggaccaggattctcagcggggaaggtcatacctccgggataatgtcctcgtacgtcacggctccgccgcagatcacacagaccactcgcttcaagcccacgcgggacccacagacttggatgtggctatgtttcatcgggatgctggagctgacagcgattctgacagtgacctgtcactcgaggaagagcgctccctgtctattcccagcagtgagagcgaagataatgggaggacccggggacggttccaaagaccgctctgtcgagcagcacaaagcgaaagactgctaacgcacccaaaagatgtggatggaaacgacctacttagctattggcccgcattaggagagtgcgaagcagccccatgcgctctgcagacctggggcagcgaacgcagactgggccttgatacgagtaaagatgccgctaacaataatcagcctgatccggcattgacatccggggacgaaaccagcttaggcagagcccaaaggcagcgtaaagggattctgaaaaatcgcctgcagtaccccttggtaccccagacaaggggcgctcccgaactcagctggtgccgcgcagcaacattgggccaccgggctgtccccgctgcctcttacggcaggatctacgctggcggtgggaccggatccttgagtcagcccgctagcaggtatagctccagggagcagttagacctattacttaggaggcagttgagtcgagagcgacttgaagaggccccagcacccgtgttgcgccctctgagccggcctggtagccaagagtgcatggatgcggctcccggtcgacttgagccaaaggaccggggaagtacactgccgaggcggcagcccccaagggattaccctggagcgatggcgggtaggttcgggtctagagacgcacttgaccttggagccccacgcgagtggctgagcactttgcctccgccacgaagaacaagggacttggacccacagccccctcctctcccgttgtcccctcagaggcagctaagtcgcgacccccttctgccaagtcgacctttggactccctctctcgtagttccaattctcgagaacaactggaccaggtgccatcacggcatccctcgagggaagcgctaggtcctcttccccagctgctaagagcgcgtgaggattccgtctctggaccctcacatggccctagtacagagcaactggacattctttccagcattctagccagcttcaacagcagtgccctgagctcagtgcagtcctctagtactccccttggccctcacactactgccacacctagtgcaacggccagtgtgctgggcccatccacacctcgttctgcgacaagccacagcatatccgagttatccccagatagcgaggtccccagatcggagggccactcataa

SEQ ID NO: 216479 - DNA, 1557 bp, Artificial Sequence
  Description of Artificial Sequence: Synthetic coding sequence
atggcgttctgggccggagggagcccttctgtggtggattactttccttcagaagacttttaccgctgtggctactgtaaaaacgagtctggctcccgttcaaatgggatgtgggctcacagtatgacggtgcaggactaccaggatttaatcgaccgagggtggcgtagatctggaaaatacgtttataagcccgtcatgaaccaaacatgctgtcctcagtatacaatacggtgcaggccccttcagtttcagccctccaagagccataagaaagttctcaaaaagatgctgaaatttctggccaagggtgaggtgcctaaaggttcctgcgaagatgaaccaatggactcgactatggacgacgcagtagcaggcgactttgcgctgattaataaattggatatacagtgtgatctcaaaactttgagtgatgatataaaggaatccctcgaatccgagggcaagaatagcaaaaaagaagagccccaggaattactgcagtcccaagattttgtgggtgagaaactggggtctggcgaaccttcgcacagcgtaaaggtccacactgtgcctaaaccgggaaagggagccgacctaagtaagccaccttgccgaaaggctaaggagatcaggaaagagcggaagagactgaagttaatgcaacagaatccggcaggcgagcttgaaggcttccaggctcagggccacccaccttccctgttccctcctaaggcaaaatctaaccagcctaagagcctcgaggatttaatctttgagagtctccccgaaaatgccagccataaactagaagtccgcgtggtgagaagctcacctccgagtagccaatttaaggcgactctgttagagtcgtatcaggtgtataagcgataccaaatggtgatacataaaaacccccctgataccccaacagaaagccagtttacacgctttctgtgttcttcaccactggaggcggagacaccacctaatggtccagattgcgggtatggatctttccatcagcaatactggctggacggtaagattatcgccgtaggcgtgatcgacattcttcctaattgcgtttcatccgtgtacctgtattacgacccggactactctttcctgtcactcggcgtttacagtgcactgagagaaattgctttcactcggcagttacacgagaagacttcacagttgagttattactatatgggattttacattcactcctgtcctaaaatgaagtacaaaggtcaataccggccttcagatctgctgtgccccgaaacctatgtatgggtcccaattgaacagtgcctgccatccctagaaaattccaaatattgccgcttcaatcaagaccctgaagccgtggacgaggatcgcagcacagagcctgatcgcctgcaggtgtttcacaaacgggctatcatgccatatggagtgtacaagaaacagcagaaagacccttctgaggaggccgcagtgctgcagtatgcgtctttggtcgggcagaaatgcagcgagagaatgttgctgttccggaattag

SEQ ID NO: 216480 - DNA, 3195 bp, Artificial Sequence
  Description of Artificial Sequence: Synthetic coding sequence
atgggacgtcacgtcgccacttcatgccacgtcgcctggctgttggtactgatcagtggctgttggggacaggtgaaccgtttgccattttttacaaaccactttttcgacacttatttactgatatccgaggacacgcctgtcggcagtagcgttacacagttacttgcccaggatatggacaacgaccccttagtttttggggtctccggcgaggaagcttcgcgcttttttgccgtagaaccagacaccggcgtggtatggttgcgccagcccttggaccgagagactaagagcgagttcaccgtggagttcagcgtgagtgaccatcagggagttatcacccgaaaagtgaacatccaggtcggggacgtgaacgacaatgcaccaaccttccataaccaaccttactctgtgcgaattcctgaagtgggcgcaactgggaacactcccgtgggcacccccatattcattgtcaacgctaccgaccctgacttaggagccggaggctctgtcctttacagtttccagccaccctcccagtttttcgccatcgattccgctcggggtatcgtgaccgtgatcagagaactggattacgaaacaacgcaggcctaccagctgacagtgaacgcaacagaccaagataaaacacgtcccctgtcaacactggctaacctcgccataatcataacagatgtgcaggatatggaccccatcttcatcaatctcccttacagcactaacatatacgagcacagtcctccaggcactacagtacgcatcatcactgctattgaccaggataaaggcagaccacgaggcatcggctatacaatcgtgtcagggaacaccaacagcattttcgcactcgactacataagcggagtgctgacattgaatgggctccttgatagagagaacccgctatattcacatgggttcatcttgaccgttaagggcacagagttgaacgacgatcgaacaccaagcgatgccacagtcacaacaacattcaacattctggtgatcgatatcaatgacaatgctccagaatttaacagcagtgagtattcagtagctataaccgaactcgcccaagtgggttttgctctccctctgtttattcaggtggtcgacaaggacgaggggctgaactcaatgttcgaagtatacttagtgggtaacaattcccaccactttatcattagtccgacttcggttcagggcaaagccgatatcaggatacgcgttgctatcccgttggactacgaaacagttgaccgctacgactttgacttatttgctaatgagagcgtgcctgaccacgtcggctacgcaaaggttaaaatcaccctgataaacgaaaacgataaccggcctattttctcgcagcctctctataacatttccctatacgaaaatgtcaccgtcggtacgtccgtgctcacagtgctcgcgacggataacgacgctggaaccttcggggaggtcagttactttttctccgatgatcctgacaggtttagtttagacaaagacacggggctcattatgttgattgccagactggattacgagttgatacagcgattcacactaacaattatagcaagggacgggggtggcgaggaaacaacagggcgtgttcggattaacgtcctcgacgtgaatgacaatgtccccactttccaaaaagatgcgtatgtaggcgcacttagggaaaacgagccttcggtcacccagcttgtgcggcttagggcgactgacgaggactctcctccaaataaccagatcacctactccattgtatctgcctcagccttcggcagttactttgatatctcactgtatgagggctatggcgtaatttctgtgtcccgacctttagattatgagcagatcagtaatgggctgatttacctcacagtcatggcgatggacgccggaaacccaccgttaaactccaccgttcctgtgaccatcgaggtttttgacgagaacgataaccccccaactttttctaagcccgcttacttcgttagcgtcgtagaaaatattatggcaggagccacagttctgttcctgaacgccaccgatttggaccgctctcgcgaatacggccaggagagcatcatttattccctagagggaagcacgcagtttcgcatcaacgcacgttccggcgagatcacgacgacgtctctcctggatcgcgaaacgaagtctgagtatattcttatcgtgagggctgtggatggaggggtgggacataaccagaaaacggggatcgctacagtaaacatcacactgctggatataaacgacaaccatccaacctggaaggatgccccatattatataaatctcgtcgagatgacacctccagacagcgacgtaactacagtggtggccgtcgaccccgacttgggcgagaacgggacgctggtttactcaatccagcctccaaacaaattctattcactgaactctaccacaggaaaaatacggacaacgcatgccatgctcgatagagaaaacccagatccgcatgaagccgaattgatgcgtaaaattgtggtgtctgtaacggactgcggccgacccccactgaaggccacgagcagcgctacggtattcgtgaatctcttagacttaaacgacaatgaccctacgttccaaaatcttccatttgtcgccgaggtgctggagggaatcccggcaggtgtgagtatataccaggtggtggccattgacttagatgaagggctgaatgggttggtcagctacaggatgccggtcggtatgccacgcatggacttcctcattaactcatcatcaggagttgtggtgaccacaactgagcttgaccgtgaacggatcgctgagtatcaactcagagtggtggcatctgacgctgggacccccactaaaagctcaacgtcaaccctcacaatccatgtgctggacgtgaatgacgaaactccgacattctttcccgctgtttataacgtctccgtgagtgaggatgtgccacgcgaatttcgggtagtgtggctaaattgtacagacaacgatgtcggactcaacgcagaactctcttatttcatcaccggcgctgcacccgctagcgcccacttatgtaggcccccaggtgcgctccccccacccctacccgatggacagcccgattag

SEQ ID NO: 216481 - DNA, 3345 bp, Artificial Sequence
  Description of Artificial Sequence: Synthetic coding sequence
atggttaagtcccccatgaaccgcgagctggttgctacttacgaggtaactctgtctgtcatcgacaatgcctctgatctacccgagcgatcagtgagcgtgcctaatgctaagctgaccgttaacgtccttgacgtgaacgacaacacgccgcagttcaaaccatttgggatcacctattatatggaacgtatcctggagggcgcaacccctggcacgaccctcatcgccgtggccgcagttgaccccgataaaggcttgaacggattagtgacttacacgctgctcgatcttgtgcccccaggctatgtacagctggaagacagttcggccggtaaggtcatcgcgaatcggaccgtcgactatgaggaggtgcactggctcaactttacggtgcgagcaagcgacaatgggtcgcctccccgagcagccgaaatcccagtttacctggaaatagtggacattaatgataacaaccccatcttcgatcaacccagctatcaagaagcggtgttcgaagatgtgccagtcggtaccatcatcctgaccgtgacagccaccgacgcagatagcggaaattttgccctgatcgagtattctctgggagacggagaaagtaagttcgccatcaatccaacaactggtgacatctatgtgttatctagcctggacagagaaaaaaaggaccactatatactgacagccctcgccaaggataaccctggcgacgtagccagtaacagacgcgaaaacagtgtgcaagttgttatacaggtgctggacgtaaacgactgtcgtcctcagttctcgaagccacagttttcaacttcggtatacgaaaatgaaccagccggaacttctgtcatcactatgatggccacagaccaggacgaaggtccaaacggggaactgacttattcgctggaagggccaggcgtggaggcattccacgtcgacatggattctgggctggtcacaactcagagacctttacagtcttacgaaaagttttccctaaccgtggtggctacggatggaggagaacctccgctctgggggacgaccatgcttctcgtggaggtcatcgatgtgaatgataatcgaccagtgtttgtcagaccacccaatggcacgatattacacatcagggaagagatcccactcagaagtaatgtctacgaggtgtatgccacggacaaggacgagggtttgaacggagccgtgcgctacagcttcctcaaaacagccggtaacagagactgggaattttttatcatcgatccaataagcgggctcatacaaacagcgcagcgcctcgatcgcgaatctcaggcagtttattctttgattttagtggcttctgatctaggccagccggtcccgtatgaaacgatgcaacccctgcaggtggccctggaggacatcgacgacaatgagcctcttttcgtgaggcctccaaaaggaagcccgcagtatcaattgcttacggtgccagaacattccccaaggggtacactggtggggaatgttacaggggctgttgatgctgatgagggcccaaacgccatcgtttattacttcatcgctgcaggaaacgaggagaagaatttccacctccagccagacggatgtctgctggtccttagggacctggatagggagcgcgaggccatctttagtttcatcgtgaaagcttcatccaatcgcagctggacgccacctaggggtcccagtcccaccctggacttggttgcggatttgactctgcaggaagtgcgagtcgtcctggaggatatcaacgatcagcctccaagatttactaaggctgagtacaccgcaggcgtagcaactgacgctaaggtgggctcagagctgatacaggtccttgcgctggacgcagacatcggaaacaacagtctggttttctattcaattctcgcaatccattacttccgggcactcgccaatgattctgaagacgttggacaagtctttacgatgggatcaatggacggtatcctcaggaccttcgaccttttcatggcttatagccctggttactttgtggtggatatcgtggctagagatctggctgggcacaacgacacagcgattatcggcatttatatcctgcgcgacgaccagcgagtcaaaatcgtgatcaacgagatcccagatcgggtccggggttttgaggaggagtttattcatctgttatctaatattaccggcgcaattgttaatacagacaatgttcagttccatgtggataagaagggacgggtcaactttgctcagacagagttgctgatacatgtggttaatcgtgatactaatagaatccttgacgtggacagagttatccagatgatcgatgaaaataaggaacagctccggaacctatttcggaattacaatgttctagacgtccagccagctatctccgttcgactccccgacgacatgtcagctctccagatggctatcatcgtgctagcaatactgctcttcttggcagcaatgctgttcgtcttaatgaactggtattatcgcacagtccataagagaaagttgaaagctattgtagctggctcagccggaaatcggggattcattgacatcatggatatgcccaacactaataagtactctttcgacggggcaaacccagtgtggttggatccattttgccgcaatttggaactggcggcacaggcagagcacgaggatgatctgcccgaaaatctaagtgagattgctgacctgtggaacagccctactagaacccacggaacattcggccgtgaacccgctgccgtcaaaccagatgacgaccgctacctgcgtgctgccattcaagaatacgataatattgccaaattgggccagataattcgggaaggacctataaagggttccttactgaaagttgtactcgaagattatcttcgcctcaagaaactttttgcccagaggatggtgcagaaggctagcagctgccattcatcaatttcagaactgattcagaccgagctcgatgaggaacctggagatcacagtcctggccaaggaagccttaggtttcggcataaaccgcctgtggagctgaaaggtcccgacggcattcacgtagtacacgggagtaccgggacactccttgcgacggacctcaactctctgcccgaggaagatcaaaaaggcctagggagatcactcgagacactgaccgctgctgaagctactgcattcgaaaggaacgcaaggacggaaagcgccaagtccaccccccttcataagctgcgcgatgtgatcatggaaactcctctggagattactgagctatag

SEQ ID NO: 216482 - DNA, 1368 bp, Artificial Sequence
  Description of Artificial Sequence: Synthetic coding sequence
atgagagcttctttgggcgtatgtggaaccgcatcatccatggtgattgtctatgttgaggatattaatgatgaagccccagtgtttactcagcagcagtatagtagactgggactacgggagaccgccggtatcgggacctccgtgatcgtagtacaggcaacggacagagattccggcgatggaggactcgttaactaccgaatcctgtcaggcgcagagggcaaatttgaaatcgatgagtctactggcctgatcattacagtgaattacctggattacgagacaaaaacgtcatatatgatgaacgtttctgcaaccgaccaggctccaccattcaatcaaggattctgcagcgtctacatcaccctcctgaacgaactggatgaggccgttcaattctctaatgctagctatgaggcagcgatactggagaatctggctctcggaacagaaattgttcgagtgcaggcctacagtattgacaacctgaaccagattacctatagattcaacgcctatacctcaacacaggcgaaagccttgttcaagattgacgctatcacaggggtaataactgtgcaaggcctggtagacagggagaaaggagacttctatactcttaccgtggtcgccgatgatggcggtccaaaagtcgatagcaccgtcgtttatataaccgtgcttgacgaaaatgataactccccaagattcgatttcacttctgattctgccgttagtatcccggaagattgtcccgtgggccagagggtggcaaccgtgaaagcgtgggaccccgacgccggtagcaatggccaggtagtgttctccttagctagtggtaatatcgcaggcgcttttgaaatcgttaccaccaacgactcaatcggggaagtattcgtagctcggccattggacagagaggagctggaccattacattttacaggtcgttgcatcagatagaggaacaccaccacgaaaaaaagatcatatcttgcaggtaactattttagacatcaatgataatccgccagtgattgaaagcccatttggatacaacgtaagcgtcaacgagaacgtcggtggcggtaccgccgtggtgcaggtccgggctacggacagggatattggcattaattctgtcttatcatactatattaccgagggaaacaaggacatggcgttcaggatggatcggatttccggagagatagctactcgaccggcaccacccgatagggagcgtcagtcattttaccacttggttgccactgttgaggatgagggcacgccaacactgtcggtgtcagatgggggaggccatagagaggagcgcgtggggcagggttcctccgcgtccgaatag

SEQ ID NO: 216483 - DNA, 1593 bp, Artificial Sequence
  Description of Artificial Sequence: Synthetic coding sequence
atggggagacacgtggcaacaagctgtcatgttgcctggttgttggtcttgatcagcggatgctggggccaggttaaccgcttaccattctttacaaatcacttctttgacacgtatctccttatttctgaagacacgccagtcggctcctctgttactcagctgctggcccaagacatggataatgacccccttgtgttcggagtcagcggagaagaagccagtaggttttttgcagtcgagcccgacactggtgtcgtgtggctgaggcagccccttgaccgggagacaaaatctgagttcaccgtggaattctcagtcagcgaccaccagggagtgattacacgaaaggtgaatatccaggttggggacgtgaatgacaacgcgcctacgttccataaccagccttacagtgttcgaattcccgaaaacacaccagttggaaccccaatcttcatcgtaaatgccacagatcccgacctgggagccggagggtcagtcctgtacagcttccagccccctagtcagtttttcgcgatagacagtgcacgaggcattgttactgtcatccgggagctggactatgaaaccactcaggcgtatcaattgacagtaaatgctactgaccaggataagactcgcccactcagtactctggccaatttagctattataattacagatgtgcaggacatggatcctatatttatcaatctcccctactccaccaacatctacgagcatagcccacctggaaccacagttaggatcatcaccgccatcgatcaggacaaggggcgacctcgtggcattggctatacaatagtgtccgggaatacaaattcaatctttgcgttggattacatttccggtgtgctgacacttaacgggttactagaccgggaaaatccactctatagtcacggatttatcttaactgtgaaggggactgaactcaacgatgaccggacgcctagtgacgcaacagttacaacaacattcaacattcttgtaattgatattaatgacaacgcaccagaatttaactcgagtgaatactccgtggccatcacagaattggctcaggtgggattcgccctgccactgtttattcaggtggtggataaagatgaaaacttaggtctcaattctatgttcgaggtttacctggtgggtaataactcacatcacttcattatttctccaacttctgtgcagggcaaagccgacattcgcataagggtggcaatcccgttagactacgagacagtcgatagatacgacttcgatctgttcgccaacgagtccgttcctgaccacgtgggttatgcgaaggtgaaaatcactctcatcaacgagaatgacaacagaccaatctttagtcagcccctgtacaacatttcattgtatgagaacgtgacagtaggcacgagtgtactgacggtcttagttagccctcgattcacagctggacctctgtcatccccgggtccaaccgtggtgaggcatcctgagggattttgccccagagacctgtctaaccaagggaggcggcaccctcagattccggagctgtgtttgcttgtgtactag

SEQ ID NO: 216484 - DNA, 3639 bp, Artificial Sequence
  Description of Artificial Sequence: Synthetic coding sequence
atggggaggcacgtcgcaacctcctgtcacgtggcttggttactcgttctgatcagcggctgctgggggcaggtgaatcgattaccattcttcaccaatcatttctttgatacctacttactgatatccgaagatacacccgtggggagcagcgtcactcagcttttggcccaggacatggataacgatcccctggtctttggggtctccggcgaggaggcttcgaggttcttcgctgtcgagcccgacacgggagttgtgtggctcaggcagccactggatagagagacaaagtctgaatttaccgttgaattctcagtgagcgaccaccagggagtgattacgcgaaaggtgaacatccaggtcggggacgtaaacgacaacgccccaacttttcacaatcagccgtacagtgtgcgcattccagaaaatacccccgtgggaacgccgattttcattgtcaacgctacagaccccgacctgggtgccggaggcagcgtattatactccttccagccaccctcccagttctttgcgatcgatagtgccaggggaatagtgaccgttatacgcgaattggactacgagaccacccaggcttaccaacttaccgtgaatgcaacagaccaagacaagacaagacctctcagcaccttggcaaatttggccatcattattactgacgtccaggacatggatccaatattcataaacctgccttactccaccaacatctacgagcattcacccccaggtacgacggtgaggataatcactgccatcgatcaggacaaggggagacccaggggaattgggtacactattgtgagtggaaacaccaacagcatctttgccctggattacatctcgggggtcctgactttgaatggccttctagaccgggagaatcctctgtactcgcacggtttcattctgacggtaaaaggaaccgagttgaacgacgacaggactccatcagatgcaacggtgactacaacttttaacattttggtgattgatattaatgataatgcccctgaattcaactcctctgaatactcagtggcaattacagaactggcgcaggtgggatttgcactcccgctctttattcaggtggttgataaagatgagacccaaggactaaactctatgtttgaagtttacttagtgggcaacaactcacaccatttcatcatttctccaacctctgttcagggcaaggcggatatccgaatccgggtggcaatccctctggattatgagaccgttgacaggtacgacttcgatttattcgctaatgagtcagtgccagaccatgttggatatgccaaagtgaagatcaccctgattaacgagaatgataatcgtccaatcttcagccagcctctttacaacatttctctgtatgaaaatgtcacagtcggtacatctgtcctgacggtacttgctacggacaacgacgctggtacctttggtgaagtgtcctacttctttagcgacgacccagataggttcagcctggacaaggatactggtctgataatgctaatcgcaaggttggactacgagcttatccaacgatttaccctcaccatcattgcccgagatggtggcggagaggagactaccggccgagtgcgcatcaacgtgctggacgttaatgacaacgtacctacctttcaaaaagacgcttacgtgggcgctttaagggaaaacgagccaagcgtgacccaactggtccgccttcgagccaccgatgaagactctcctcccaataaccagatcacttactctatcgtgagtgctagtgccttcgggtcctactttgatataagtttgtatgaaggttacggtgttatcagcgtgtcgagacccctcgattacgaacagattagtaacgggctgatttatctgactgtgatggccatggacgccggaaatcctccattgaattctacagtgcccgtcaccatcgaggtttttgacgaaaacgacaaccctccaacttttagcaaacccgcatacttcgttagcgtggtcgagaatatcatggccggtgccacagttttattcctgaatgccacagatctcgatcggtctcgagagtacgggcaggagtccatcatatacagcctggagggatctactcaatttcggattaacgcgaggagtggcgagattacgaccactagcttgctggatagggagacaaaaagtgaatatattctaatcgtgagggcggtggacggtggggtcggtcacaatcagaaaaccggcatcgcaacagtgaatatcaccctccttgacatcaacgacaatcaccctacgtggaaggatgctccatactacatcaatctggttgagatgacaccccctgacagcgatgtcaccaccgtagttgctgtggaccctgatctcggcgagaacggaacacttgtctattctatccaaccaccaaacaaattttatagcttaaatagtaccacggggaagattaggaccactcacgctatgctcgacagggagaatcctgatcctcatgaggcagaactcatgaggaagatcgttgtatccgtgactgactgcggaaggccgcctttgaaggctacgagctcagccaccgtctttgtgaacctcttggacttgaatgataacgacccaacattccaaaacctccccttcgtggctgaggtgttggagggcattccagcgggtgtatccatttatcaggtggtagccattgatctcgatgagggcctcaacggactagtgtcctatcgaatgcctgtcgggatgccgagaatggactttttaatcaactcatcgtcaggcgttgtggttaccaccacagagttagaccgcgaacgaatagccgagtatcagcttagagtggttgccagcgatgcgggtacccctacgaagagttcaacgtctacgctgacaattcatgtgctggatgtgaatgatgaaacgccaaccttcttcccagccgtttataacgtctctgttagtgaagacgtccctagggagtttcgggtggtatggttaaattgtactgataacgacgtgggtttgaatgcagagcttagctactttattactggtggtaacgttgatgggaagttctcagtcggctatcgcgatgccgtcgttcggactgtggtcggcctggatcgtgagacaactgcggcttacatgctgatcctggaagccatcgataatggaccagttggcaaacggcataccggcaccgcaacggtgtttgtcacagtgctggatgtcaatgacaataggccaatttttctacaatcttcctatgaggcttccgtgcctgaggatatcccagagggacatagcatcctgcaggaagaggacctggccagcccctgcatttctcctgccccaccaagacgggcattccagagctcaggggagaaggagaccagccagttcccgggaaaggaattgcgccgagagcctggtccatcaaaagcacagaatcgcgcagccttcacagagccactggcagaggccccattgctggggagtaaacaagctcaggaggagagagcccctctacctcgagagcaggcccaacaactacaggggtcagagggcgagaagggagggccatag

SEQ ID NO: 216485 - DNA, 1593 bp, Artificial Sequence
  Description of Artificial Sequence: Synthetic coding sequence
atgggtagacacgtcgcgacatcctgtcatgtggcttggctgctggtgctgatttcgggttgttggggccaagtgaatcgccttccattttttactaatcactttttcgatacgtacttacttatcagcgaagacacacccgtcgggtcatccgttactcaactgcttgcccaggacatggacaacgacccgctagtcttcggcgtctcgggggaagaagccagccgtttctttgctgtggagcccgacacaggggtcgtatggctgcgccagccattggatcgcgagaccaaaagcgagtttacagtggagttttctgtctcagaccaccagggggtgataacacggaaggtgaatatacaggtgggtgacgtcaatgacaacgcccctacgttccataatcagccctacagtgtaaggatacccgagaacactccagtggggacgcctatctttattgtgaatgcaactgaccccgatctgggagctgggggttccgtcctttacagcttccagccaccttcccagttcttcgcaatagactcagcacggggtatcgtgactgtaatccgggagcttgattatgagaccactcaagcctatcaacttaccgtcaatgcaactgatcaggacaagacccgcccactgtcaacactggccaatcttgccattatcatcactgatgttcaggacatggacccaatcttcatcaacttgccatactctaccaacatatacgagcatagtcctcctgggactaccgttaggattattactgccattgatcaagacaagggccgacccaggggcattggctacacaattgtgtccggcaacaccaattctatattcgcattagattatatctcaggtgttctgacgcttaacggcttgctcgaccgagagaatcctctctacagccacggattcattttgacagtgaagggcactgagttgaacgacgaccgcacaccctccgatgctacagttactaccaccttcaacattctcgtgatcgatattaatgacaacgcacctgagttcaattcctccgagtactccgtagccattaccgagttagcccaggtagggtttgcacttcccctgttcatacaagtggtcgataaggacgagacctggggattgaattcaatgtttgaggtctatctcgtcgggaataattcccaccactttataatttcccctacaagtgtgcaaggaaaagccgatattaggatccgagtggccatcccactcgattatgagacggttgaccggtacgattttgacctgttcgccaatgagtctgtccctgaccatgtgggttatgctaaggtcaaaatcaccctcataaatgagaacgacaaccggccaatcttttctcagcccctgtacaatatcagcttgtacgagaatgttacggtggggacaagtgtgcttacggtcctcgtatctccccgatttaccgctggtccattaagctccccaggcccaactgtggtgcgtcatcccgagggcttctgtccgagagatctgagcaatcaggggagaaggcaccctcaaattcccgagctttgcttacttgtgtattag

SEQ ID NO: 216486 - DNA, 9959 bp, Artificial Sequence
  Description of Artificial Sequence: Synthetic coding sequence
atgggacggcatgtggctacatcctgtcacgtcgcctggctgttggtgcttattagcggttgttggggacaggtcaatcgcttgccattttttaccaatcactttttcgacacttatctcctgatctctgaagacacgccggtcggttccagcgtaacccagctgctcgcccaggacatggataacgatcctctggtattcggggtctcaggcgaagaagctagcagatttttcgcagttgaaccagatacaggtgtggtgtggcttcgtcagccgctagatcgggaaaccaagtcggagttcaccgtcgagttttcagttagtgaccaccagggcgtgatcacccgaaaagtgaatattcaggtcggcgacgtcaacgacaacgcgcctacctttcacaaccagccatacagcgtccggatacctgaaaatacccccgtgggtactcctatttttattgtgaacgcaactgatcctgacctgggagccggtggctctgtgctctatagtttccagccgccaagccaattttttgctatcgactcagctcgcggtatcgttaccgttattagggagcttgattatgagactacccaggcttaccaactgacggtcaatgcaactgatcaggacaagacacgtccactatctacattggctaatctggcgatcatcatcactgatgtccaggatatggacccaatctttataaacctgccctattctacaaatatttacgagcactcaccacccggtaccaccgtgaggatcattacagctatcgaccaggacaaagggcgacctcgcggtataggatatacaattgtgtcgggaaataccaattctattttcgcactggactacattagcggagttttgaccctgaacggcctcctggatagagagaaccccctgtactctcacggcttcatcctcaccgttaagggcaccgaacttaatgatgacagaacaccttcggacgccacagtgacaaccacgttcaacattctcgtcattgacatcaatgacaatgcccctgagttcaactctagcgagtactcagtggccatcacagaacttgcccaagttggatttgctttgcccctgttcatccaggtggtggataaagatgagacgcagggactgaatagtatgtttgaggtatacctggttggcaataatagtcaccattttattatttctccgacgtcagtgcagggcaaagcagacatccgcattcgagtggcaatccctcttgattacgaaactgtggacagatatgattttgatttgttcgccaacgagtccgtgcccgatcatgtcggctatgctaaagtgaagattaccctgattaatgaaaacgacaatagaccaatattctcccagccgttatacaatatcagtttgtacgagaatgtaaccgtgggtacatctgttttaaccgtcctggctaccgacaacgacgccggtacctttggggaggtgtcttattttttcagcgatgatccggatcgctttagtctcgacaaggacaccgggttaattatgctgattgcccgactggattatgagttgattcaaaggtttaccctgactatcattgccagggatgggggaggcgaggaaactacaggccgtgtaagaatcaacgtgctagacgtgaacgataacgttccaacatttcagaaagatgcatatgttggagctctccgtgagaatgaaccctccgtcacccagctcgtgagactgcgggcaacggacgaggatagcccgccaaacaatcagattacatatagcattgtcagcgcatctgcttttggttcatacttcgatatatcgttatacgagggctatggggtcatttcagtgtcccgccctctcgactatgagcagatctccaatggacttatctatctcacggtgatggcaatggacgcaggtaatcccccattgaattctaccgtcccggtgaccatcgaagtattcgatgaaaacgacaatcccccaactttctccaagccagcctactttgtttcagtggtggagaacatcatggctggtgctacagtgttgttcttgaacgctaccgatctcgatcggagccgcgagtatggccaggaatctattatctacagcttagaggggagtacacaatttagaattaatgcacgctctggtgagatcactaccaccagccttctggatcgggaaaccaagtcagaatacatcctgattgtcagggctgtcgatggaggagtcggccataaccagaaaacaggaatcgcgactgtgaatattacactccttgatattaatgacaaccacccgacctggaaggatgcaccatattacataaatctggtcgaaatgaccccacccgacagtgatgtcaccactgttgtagctgtcgatcctgatctcggggaaaacggaaccctggtgtactctattcagcctccaaataagttttacagcctcaactctacgactgggaaaatccgcacaactcatgctatgctggatagggagaacccagatccacacgaggcggagctcatgcgaaaaatcgtcgtctctgttactgactgtgggaggcccccactgaaggctacctcatccgctaccgtgttcgtgaacctcctggatctgaatgataatgacccaacttttcaaaatcttccctttgttgccgaggtgcttgaggggatcccagcaggggtatctatttaccaggttgttgcaatagacttggatgaggggctgaacggtttagtgagttacaggatgccggtaggaatgccaagaatggattttctcatcaattcatccagcggagtggtcgttacaaccaccgaactagaccgggagcgcatcgcggaataccagctgagagtggtggcttccgatgccggtacaccaacaaaatcctccacatccacccttaccattcacgtcttggatgttaatgacgagacacctacttttttcccagccgtctacaacgtgtcagttagcgaggatgtgcctagagagttccgggtggtgtggctgaactgtactgacaacgacgttggactgaatgccgagttgagctattttatcactgggggtaatgtcgatgggaagttttcagttgggtacagggatgctgtcgtccgaacggtcgtgggcctggatcgtgagacaaccgccgcatacatgctgattttagaggctatcgataatggtcccgttggtaaaaggcacactggtaccgccacagtgtttgtgactgtgctggatgtgaatgacaacaggcctattttcctgcagtcgtcttacgaagcctcggtgcccgaagacattcctgagggccatagcatactccaattaaaggcaacagatgccgacgaaggcgaattcggaagggtctggtacaggatcctccatggtaatcacggtaacaattttagaattcatgtctccaacggactgctcatgaggggacctaggcctctggacagggaacgcaattcatcccacgtgctcatagtggaggcctataatcatgacctgggccctatgcggtcttcagtaagagtgatcgtgtacgtagaagatatcaacgatgaggcaccggtgtttacacagcaacagtacagccgcctcggtcttcgagaaaccgccggtataggaacctctgtgatcgttgtgcaggcgacagaccgcgatagcggtgacggaggcttggttaactatagaatccttagcggggctgagggcaaattcgagattgacgagtctacgggtttgattattacggtaaactatctcgattacgagactaagacttcttacatgatgaacgtttccgcgacggatcaagcccctccatttaatcaaggattctgcagcgtttacattactctgttaaatgagctcgatgaggccgtgcagttttccaacgctagttacgaggctgctattttagagaatctggctctgggcacagagatcgttcgagtacaggcctactcgatagataaccttaaccagatcacctacaggttcaacgcctatacatccacacaagcgaaggcactgtttaagattgacgcgatcacaggcgtaatcaccgtccagggacttgtggaccgtgagaagggggacttctataccttgacagtcgttgccgacgatggcggacctaaggtcgactccacagtccaggtttatattactgtgctggatgaaaatgacaactcccctagatttgattttacttctgactctgctgtgtcgattcctgaggactgccctgtggggcagcgtgtagcaaccgtcaaggcttgggatccagacgcgggtagcaatggccaagtggtgttcagcttggccagtgggaacatcgccggagcattcgaaattgtaacaaccaatgattccatcggcgaagtgttcgtggctagaccgctggaccgagaagagttagaccactacatcctccaagtcgtggcatctgacagagggacccccccaagaaagaaggaccacatccttcaagtaacgattctcgacatcaatgacaatccccctgttattgagtccccgtttggctacaatgtgtccgttaacgagaacgtcggcggaggaacggctgtcgtacaggtgcgcgctacagaccgagacataggtataaattctgtcctgtcctactacatcaccgaggggaacaaggatatggcgtttcggatggatcggatttccggggaaattgccacccgcccagctcccccagacagggaacggcagtctttttaccacctcgtagccaccgtcgaagacgagggcacaccgaccctgtctgcgactacacacgtttacgtcaccattgtggatgaaaacgacaacgccccaatgtttcagcaacctcactacgaagtgcttttagacgagggtccggacacactgaacacgagtcttattaccattcaagcactcgacctggacgagggtccgaacggtacagtgacgtatgcgattgtagccggaaacattgtgaacaccttccgtattgatcggcacatgggagtgatcaccgcagctaaagaactagactacgagatcagtcatgggaggtataccctcattgtgactgccacagaccagtgtcccatcttatcccaccggctgactagtaccactactgtcttagtcaacgtcaacgatatcaatgataacgttccgacatttccacgtgactacgaaggacccttcgaagtcacagaaggacagccagggccaagagtctggactttcctcgctcacgaccgggactccgggcctaacggtcaggtggagtatagcattatggacggtgatccactgggcgaattcgttatatccccggttgaaggcgttctaagagtgagaaaagatgtggagctggaccgtgagaccattgcattttataacttaaccatatgtgcaagagatcggggaatgccccctcttagctctaccatgctggtggggattcgggtcctggacatcaatgacaatgaccccgtactgctgaatttgcccatgaatattacaatctcagagaatagccctgttagctctttcgtcgcccacgtgctggctagtgatgccgattcagggtgtaacgctagactgacatttaacattaccgccggtaatcgcgaacgcgcatttttcattaacgccaccaccggaatcgttacagttaatcggcctctggatcgggagaggatcccagagtacaagctgacaatctcagtcaaggataaccctgaaaatccacgcatagccagacgcgactacgacctgctgttgatctttctgagcgatgagaatgacaatcaccctctcttcacgaaatctacctatcaggcggaggtgatggaaaattcaccagccggtacaccgctgaccgtgctcaacggacctattcttgctctggacgccgaccaggatatctacgctgtcgtcacctatcagctcctgggtgcccaatctggattgttcgacatcaacagctccaccggggtggtcaccgttaggtcaggcgtcattatagaccgcgaagcatttagccctcccatactggaactcctgctgctggccgaggatattgggttgctgaatagcactgcgcatttgctaattacgatcctggatgacaacgataaccgcccaacgttcagcccggctactttaactgtgcaccttctcgagaattgccctcctggattttccgttctccaggtcactgcaactgatgaagactctggattgaacggtgagttagtgtatcgcattgaggccggagcacaggaccgctttttaattcatctagtgacaggggtgataagagtgggtaacgctaccattgatcgggaggaacaggagtcctatcggttaacagtggtggctaccgacagagggacagtgccactctcaggtaccgccatcgtaaccatcttgattgatgatattaatgattccaggcctgaattcctgaatccaatacaaaccgtgtctgtgctcgagtcagccgaaccaggcaccgtgatcgctaacattaccgcaatcgatcacgaccttaatccaaaacttgaataccacatcgtcggtattgttgcgaaagatgatacggatagattggtccccaaccaagaggatgccttcgccgttaacataaatacggggtctgttatggtgaagagtcctatgaatagagagttggtggcaacctatgaagtgaccctgagtgtgatcgacaatgcttctgatttacccgagcggtcagtgagtgtgcccaacgccaagttaaccgtaaacgtacttgacgtgaatgacaacacgccacagtttaagcccttcgggatcacctattatatggaacggattctcgagggagcaacccctgggaccacactcatagcggtcgctgctgttgatcctgacaaggggctcaatgggttggtgacatacacacttctcgatctcgtgcccccaggctacgtccagctggaggacagttcggccggaaaggttattgctaacaggaccgtggactatgaggaggtccactggctgaactttactgtccgagcttctgataatggatctccacctcgcgcagccgagatcccagtctacctggaaattgtggacatcaatgacaacaaccctatttttgatcagccctcttaccaggaagccgtttttgaggacgtaccggtcgggacaattatcctcactgtcacagccacggacgctgatagcgggaactttgctttgatcgagtactcgctaggggacggggaaagcaagtttgccatcaatcccaccactggtgacatttatgttctgtcctcccttgatagggaaaagaaggaccattacattctgacagctcttgcaaaagataacccaggcgacgtcgcctctaatagacgcgagaactcagtccaggtggtgattcaggtgctcgatgttaacgattgccgacctcagttctccaagccccagttctccacgagcgtgtatgagaatgagcccgcagggaccagcgttatcactatgatggccactgatcaggacgaagggcctaatggcgagctgacatattcccttgaggggcctggtgtggaggcgtttcatgtggatatggactctggactggttacgacgcagaggcccctgcagtcttacgagaagttcagtttaacagtcgtggctactgacggaggggaaccacctctctggggcactactatgctactcgtggaagtcattgatgtgaatgataatagacctgttttcgttaggccccctaatggaaccattctccatatacgggaggaaataccattgcggtctaatgtatacgaggtgtacgccacggataaggacgagggactcaacggcgctgtgagatactcattcttgaaaactgctggcaatcgggactgggaattctttattattgaccctattagcggcctcatccagacagctcagcggctggatagggagagccaggcagtttattctctgattctcgtcgcttccgacctggggcagcctgtcccttatgaaaccatgcagccactacaggtggccctggaggacattgacgataatgagcccttgtttgtcaggccacctaagggcagtccccaataccagctgttgaccgtacctgaacactctcctcgaggaactttggtaggcaatgtgaccggcgcagttgatgcagatgagggacccaatgcaatcgtgtattactttatcgccgcaggaaatgaagaaaagaacttccatttgcaaccagacgggtgtcttctcgtgctgagggatcttgatcgtgagagggaagccatcttcagcttcatcgtgaaagcctctagcaataggagctggacccctcctcgcggacccagccccactctcgatctcgtggccgatctgaccctccaggaggttcgagttgtcctcgaggacatcaacgaccagcctccgagattcactaaagctgaatacacggccggagtcgctactgacgctaaagtcggatctgagctgatccaggtgctggcccttgatgctgatatcgggaacaatagcctggtgttttattccatccttgccatccactacttccgagcactggccaacgactcagaagatgtgggccaagtgtttaccatgggtagcatggacggcatcctgaggacgttcgacttgttcatggcttattcccctggctatttcgtagtggatatagtagctagggacctggcagggcacaacgatactgctatcattggcatatatatcttgcgcgacgaccagagggttaaaatagtgataaacgagatccccgatagagtgagggggttcgaagaggagttcatccacctcttgtccaacatcacgggagcgatcgtgaataccgataatgtgcagtttcatgtcgataaaaaggggagagtcaattttgcccagaccgaattactgatacacgtggttaatagagatacaaacagaattctggacgtggatcgggtgatacaaatgattgacgagaacaaagagcagcttcggaatctgtttagaaactataacgtcctcgatgttcagcccgcaatttcggttcgcctgcccgacgacatgagcgctctgcagatggctatcatcgtgttagccatactgctattccttgcagcgatgcttttcgtgctcatgaattggtattatagaaccgtacacaagagaaagttgaaagctatcgttgcaggcagcgccggaaatcgcggatttatagatataatggatatgcctaatacaaacaagtatagctttgacggcgcaaaccccgtgtggctagacccattttgtaggaatcttgaattggccgctcaggccgagcacgaagacgatctgcccgaaaacctctctgagattgcagatctctggaattctccaaccagaacccatggtacctttgggagggaacctgctgccgtgaaaccagatgacgatcggtacctcagagcagcgatacaagagtacgataatatagccaagcttggccagatcatccgcgaaggccctatcaagctcatacagaccgaactggatgaggaacctggcgaccatagtcccggtcagggctccctgcgttttagacacaaaccacccgttgaactgaagggaccagacggcatccacgtggtgcatggtagcacgggcaccctcctcgccactgatcttaattccttgcctgaagaggatcagaaaggcctgggcaggtcgttggaaacactaacggctgcggaagcaactgcgttcgagcggaacgctcgaacagagagtgctaagtccacccctcttcacaagctgagagacgtgataatggaaactcctctggaaatcaccgagctgta

SEQ ID NO: 216487 - DNA, 10079 bp, Artificial Sequence
  Description of Artificial Sequence: Synthetic coding sequence
atgggtcgacatgtggccacatcatgtcacgtggcctggctgctggttttgatttccgggtgttggggacaggtcaacagactccctttctttacaaatcacttttttgacacttatctgctcatttccgaggacacacctgttgggtcttccgtgacacaactgttggcccaggacatggacaatgatcctctcgtgtttggggtctcaggagaggaagccagtagattttttgcggttgagcccgacaccggagtagtgtggctacgacaacccctcgatagggaaacaaagtcagaattcacggtggaattctctgtaagtgaccaccagggggtgatcacacgaaaagtgaacattcaggttggagacgtgaacgataacgctccgacgtttcataaccagccttattccgtcagaattccagaggttggggcaaccggtaatactcccgtgggcactccgatcttcatcgtaaacgccactgaccccgacctgggcgcaggagggagtgtcctctatagttttcagccgcctagccaattttttgccattgacagcgccaggggcatcgtgacagtgatccgggagcttgattatgagacgactcaggcataccaactgactgtcaatgcaaccgatcaagacaaaactcggcctttatcaacccttgccaacctggcgattataatcaccgacgtgcaggatatggaccccatcttcatcaacttaccctactctaccaatatttacgagcacagtcctcctgggactaccgtcagaattatcacagccattgatcaggacaaaggcaggcctaggggtattggctacaccatcgtcagcgtggccggtaataccaattcaatcttcgctctcgactacattagcggcgtcctgaccttaaatggcctgctagatcgggaaaacccattatacagtcatggctttattctgaccgtgaaaggcacagagttaaacgatgaccggaccccatccgatgccacagtgactaccacattcaatatcttagtgatcgacataaacgataacgctccagagtttaactcctctgagtactcagtagctatcacggaactggcacaggtcggcttcgcactcccactgttcatacaggttgtagataaagacgagggcttaaattcaatgttcgaagtgtacctcgtgggcaacaactcgcaccattttattatatccccgacttctgtccagggaaaggctgacatccggatccgcgtggccatcccactagactatgagactgttgacagatatgactttgacctgtttgccaatgaatccgtccctgaccacgtcggatatgccaaggtaaaaattactttaatcaatgagaacgataatcgaccaattttttcccagccgctctacaatatatccctgtacgaaaacgtgaccgttggaaccagcgtgttgacagtgctggccacggataatgatgcgggaacattcggagaggttagctacttcttttcagacgaccccgataggttttccttggataaggataccggactgattatgctcattgcaaggctagactacgagctcatccagcgcttcacgctaaccatcatagctcgcgatggagggggtgaggagacaaccggtcgcgtccgtattaacgttctcgacgtcaatgataatgtgccgacatttcagaaagacgcctacgtgggggctctgagagaaaatgaaccatctgttacccagttggtaagacttcgcgcaaccgatgaggacagtccccctaataatcagatcacttacagcattgtgtccgcctccgctttcggcagctacttcgacattagcttgtacgaggggtacggagtgatctctgtgtccagaccgttggactacgagcagatttcaaacggtctgatttacctgactgtcatggccatggacgctgggaacccacccctgaattctaccgtgccagtgaccattgaagtcttcgacgagaatgataacccccctacattcagcaaaccagcttattttgttagtgttgtggaaaatataatggccggagccaccgtgctgtttctcaacgccactgacctcgatcgatcacgcgagtacggtcaagagtcgattatttactccctggaaggatctactcaattccggataaatgccagaagcggcgaaataaccacaacgagcttgctcgacagggaaaccaagagcgaatacattctaatcgttagggcagtggatgggggtgtggggcacaatcagaagacagggatcgcaaccgtgaatatcacgctcttggatattaacgacaatcaccccacttggaaggacgctccttattacatcaatctggtggaaatgactccacctgatagtgatgtgacgacagtcgtagccgtcgatccggatctgggagaaaatggcacgctggtgtattccatccaacctccgaataaattctattccttaaactcgactacagggaagattcggacaacccatgctatgctggatcgggagaatccagatccacacgaagccgagctgatgcgcaagattgtggtctcagtcacagattgcggcaggcccccactgaaagccactagcagcgctacagtattcgtcaacctcctggacctgaatgataacgatccgacgtttcaaaatttgccttttgtggcagaggtgttagaaggaatacccgctggcgtatccatctaccaggtggtggctatcgatttagacgagggcctcaacggactggtcagttataggatgcctgtcggcatgcccaggatggattttctaatcaactcctcctcaggcgtggtcgttactaccaccgaactggacagggaaaggattgctgaataccagcttagagtcgtcgcttctgatgcgggaacccctactaaatcttccacatcaacattgacaatccacgttcttgacgtgaatgacgagactccaaccttctttcccgctgtgtataatgtgtccgtgtccgaggacgtgcccagagaatttagggttgtgtggctcaattgtacggataatgatgtggggctgaacgctgagctatcttacttcatcactggcggaaacgtagacggcaagttctcagtgggttatcgagatgcagtggtccgcactgtagttggcctcgatagggaaactacagccgcttatatgctcatcttggaagcgattgacaacggccctgtgggcaagcgacacacgggcaccgccactgtgttcgttaccgttctcgatgtaaatgacaatagacctatctttctgcagtcaagctatgaagcatctgtgcccgaggacataccggagggacacagtattttgcagctcaaggccactgacgcagatgagggggagttcggaagggtgtggtaccgcattctacacggcaaccacggtaataacttccggattcatgtgagcaatggcctccttatgcggggaccacggccattagatagggagagaaactcatcccacgttctcatcgttgaggcatacaatcatgatttaggccctatgcgttcaagtgtccgtgtaatagtctacgtggaagatatcaacgacgaggcgccagtgtttactcagcagcaatactcaagactaggcctccgcgagacggcaggtatcggtacatcagttattgttgtacaggccaccgaccgtgactcgggcgacgggggtctggttaactataggattctttctggcgctgaagggaaatttgagatcgatgagagcacgggtctgattatcactgtgaactatctcgactacgaaactaaaacttcttacatgatgaacgtctctgctacggaccaggcgccaccattcaatcaggggttttgctctgtgtacatcactcttcttaatgaactagacgaggcagtccaattcagcaatgcgtcatacgaggctgccattctggagaacttagccctgggaactgagatcgtgcgagtccaggcctattctattgacaatcttaaccaaattacatatcgtttcaatgcctacaccagcactcaggctaaggctctattcaagatcgatgccattaccggcgttatcacggttcagggattagttgatcgcgagaagggagacttctacacattgactgtggtagccgacgatggtggtcccaaagtagattcaaccgtacaggtgtatataaccgtgctggacgaaaacgataactcacctagatttgatttcacatccgattccgccgtatccatcccagaagactgccccgtgggacaacgagtggctacagtaaaggcttgggatcctgatgccggaagcaacgggcaggtagtgttttctctcgcatccggtaatatcgctggggcttttgaaattgtgaccacaaacgattcaatcggcgaggtcttcgtggccagaccacttgatcgagaagagctcgaccattacattttacaggtggtggcgagcgaccggggtaccccgcctaggaaaaaagaccacatcctgcaagtaacaatcctggacatcaacgacaaccctccggttattgaaagcccatttggctataacgtctcggtgaatgaaaacgtgggcggaggcacagctgtggtgcaagtgagggccacggaccgggacattgggatcaactcggtgttgagctactatatcacagaggggaataaagacatggcattccggatggacagaatttcgggggaaattgcaacccgccctgctcctcctgatagagagcgacagtctttttaccacctggtggccacagtggaggatgagggcacgcccacgctttctgccaccactcacgtgtacgtgaccatcgtggatgagaacgacaatgctccaatgttccaacagcctcattatgaggtcctgttggatgagggccctgatacgctcaacacaagtcttatcacaatccaggcgctcgatcttgacgaaggcccaaacggaactgtcacgtacgcgatagttgcgggtaacattgtgaacacttttcggatcgaccgacacatgggagtcatcactgcggctaaggagctggactatgagatttcacatggcaggtacactctgatcgtgacagccaccgatcaatgcccgattttgtcacaccggctcacctccactacaaccgtgcttgttaacgtgaacgatattaatgacaatgtccctacttttcctagagattatgaaggccctttcgaagtaaccgaaggccagccgggaccacgcgtatggacatttctggcccacgacagggactctggacccaatgggcaggttgagtattccataatggatggggatcccttgggtgagttcgtgatcagtccggtcgagggcgtgcttagggtcagaaaagacgtggagttggatcgtgagacaattgccttttacaatttaaccatttgcgcccgagatcggggaatgccacccttgagttccacgatgctggtcgggattagagtccttgacataaacgataatgacccagtgctgctcaatttgcccatgaatattactatttcggagaactcccctgtgtcttctttcgtcgctcacgttctggcctccgatgctgatagcggttgcaatgccagactgactttcaacatcactgcaggcaaccgggaaagggctttttttattaacgccactactggcatcgtgacagtgaatcgaccccttgatagagagaggatccctgagtacaaattgacaatttccgttaaggataatccagaaaaccctcggattgccagaagagactacgacctgcttctgatttttctgtccgacgagaacgacaatcaccccctgttcacgaaatcgacctaccaggccgaagtcatggagaacagccctgctggcacccccctgaccgtgctcaatggtccaattctagcccttgatgcggatcaagatatctacgctgtggtgacttaccagctccttggggctcagtccggcctgtttgatattaattcatctaccggggttgtcacagtgcgaagtggcgttatcatcgaccgggaagccttctcaccaccgatattagaactgctgctgcttgcagaagacatcgggctgctgaattccacggcccatctcctcattacgatactcgatgacaatgataacagaccaacttttagtcctgctactcttactgttcatctcttagagaattgtccacccggtttctcagtgttgcaagtgacagcaacagatgaggatagcggtctcaatggtgaactagtataccggatcgaggcgggtgcacaggacaggttcctcatccacctagtgacaggcgtcatcagagtcggcaacgctacaattgacagggaggagcaggaaagctaccggctgaccgtcgttgcaaccgaccggggtacggtgcctttaagcggtactgcgattgtgactatcctgatcgacgacattaacgacagtcgtccagaatttctcaatccaattcagaccgtgagcgttcttgaaagcgcagaaccagggacggtaatcgctaatatcacggccattgaccacgatctgaatccaaaattggaataccacatagtgggtattgtggctaaagacgataccgaccggctcgtcccaaatcaggaagacgcttttgcagtcaatatcaacactggtagcgttatggtcaagagccccatgaacagagagctggttgccacctacgaggtcaccctttcagtcatcgataacgctagcgacctgcctgagcgatcagtctccgtgcccaatgctaaactgacggttaatgtgttggacgtgaacgataatacaccccagtttaaacccttcggaatcacctactatatggagcggatcctggaaggcgctacacctggcactaccctcatagccgtggctgctgtggaccctgataaaggactcaacggcctcgttacgtacacactgctcgacttggttccccctggctacgtacagctggaggacagcagcgcaggcaaggtgattgctaaccgaactgtggactacgaagaggtccactggctcaattttacggttagggccagcgacaatggctccccaccacgagcggcagaaatacccgtctacctagagatcgtcgatattaatgacaataatcccatcttcgaccagccctcttaccaggaggcagtgtttgaagatgtgccggtcgggactattattctcacagtcaccgctacggacgctgactcgggaaatttcgcgctgattgagtattccctcggcgacggagagtctaagttcgccatcaatcccaccaccggtgacatctatgtactgtcttctttagatagagagaagaaggaccattatatccttacggccctcgctaaagacaatccaggcgacgtcgcatctaacagaagagagaatagcgtgcaggtcgtgatacaagtgctcgatgtgaatgactgtcgaccccagttttccaagccacagtttagcacctccgtatatgaaaatgaacccgctggcacttcagtgatcactatgatggcgacggaccaggacgaggggcctaatggagagctcacctattctctggagggtccaggtgtggaagcctttcatgtcgacatggacagcgggttggttaccacccagcggccactccagtcctatgaaaaattttcacttaccgtagtggctacagatggcggagaacctccactgtggggaacaacaatgctgctggttgaggtgatagacgttaatgacaacagaccggttttcgttaggcccccaaatggaactatcctgcacatacgggaggaaattccacttaggtccaacgtgtatgaagtttatgctacagataaagatgaggggctgaacggcgcagttcggtattcctttctcaagactgccggaaaccgcgactgggagttttttattatagaccccatctccggtctcatccaaaccgcccagcgcttggatagggagtcccaggccgtatacagcttgatcttggtggcaagcgacctgggacagcccgtcccatacgagacaatgcaacccctgcaggttgcactggaagatatcgacgataacgagccactgttcgtacgaccaccaaaaggttctccacagtaccagcttctgacagtccccgaacatagccctagaggcacacttgtcggcaacgtgaccggtgcagttgatgcggacgagggaccaaacgccatcgtgtattacttcattgctgctggcaacgaagagaagaatttccacttgcaacccgacgggtgcctgctggtattgcgggatctggaccgcgaaagagaagcgatattctccttcatcgtgaaggcatcgtccaatcggagttggacacctcctcgcggaccaagtcctaccctggaccttgtggctgaccttacactgcaagaagtcagagttgtcctggaggacattaatgatcagccgccaagatttacaaaggccgaatatactgccggagtcgccaccgatgcaaaagttggctcagagttaattcaggtgctggctctggatgccgacatagggaacaattcgctagtattttattcaatcttagccatacactacttccgggctctagcaaacgatagcgaggatgtgggacaggtattcacgatgggttccatggacggcatcctacgaaccttcgatctcttcatggcttatagccctggctattttgttgttgatattgtggctcgcgacttggccggacacaatgacacagcaattattgggatttatatcctgcgtgatgaccagcgggttaaaatagtcatcaatgagatcccagatcgagtccgtggattcgaggaggagtttatccacctcttgtccaacattactggcgcaatcgtgaatactgataacgttcagtttcatgtggacaaaaagggtcgtgttaactttgctcagaccgagcttctcatccatgtggtgaatagagatacaaataggattctggacgtcgatagagttatccagatgattgacgagaacaaagaacaattaaggaacttgtttaggaactacaacgtgctcgatgtacaacccgcaatttctgtgaggttgccggatgatatgtccgccttgcagatggctattattgtcctcgccatcctcctctttctagctgccatgctattcgttctgatgaactggtattaccggaccgtccacaagagaaaattgaaggcaattgtagccggatccgctggtaaccggggtttcatcgacatcatggacatgccaaacaccaacaagtatagctttgatggagcaaaccctgtatggctcgacccgttctgtcgcaaccttgagttggcggctcaagccgagcatgaagatgacctccccgaaaacctttctgagatcgccgacctgtggaattccccaaccaggacccacggcacattcggtagggaacccgctgccgtaaagcccgacgatgaccgctaccttcgagcagccatccaggagtatgacaatatagccaaactgggccagattataagagaaggccctatcaagggtagtcttctgaaggtggtcctggaagactatcttcgcctgaagaaactgtttgcgcagcggatggttcagaaagcatcgtcatgtcattcctcgattagtgaattaattcagaccgagctcgacgaggaaccgggagaccatagtccaggacaggggagcctcaggtttcggcacaagcctcctgtggagttaaagggcccagatgggatacatgtggtccatgggtctactggtacactcctggccacagacctcaatagtttgcctgaagaggatcagaaggggctggggagaagccttgagaccttgactgcagcagaggccacagcgtttgagaggaatgcccgaaccgagagcgccaagagtacccccctgcataaactgcgcgatgtcattatggagacccccctggagataaccgagcttta

SEQ ID NO: 216488 - DNA, 1338 bp, Artificial Sequence
  Description of Artificial Sequence: Synthetic coding sequence
atggacaacgaccctctggttttcggtgtcagcggtgaagaagcaagtagattttttgcagtggaaccagacaccggggtcgtctggttgaggcagccactagatagagagacaaaatccgaattcacggtggagttcagcgtctcagaccaccagggggtgatcaccagaaaggtgaacatccaggtcggggacgtcaacgacaatgcgcctacatttcacaatcagccctatagtgtgcgcatccctgagaacacgcccgtgggaactcccatctttattgtgaatgcaaccgaccccgacctcggcgcagggggttcagtactgtactcatttcaaccacccagtcagttcttcgctatagatagcgccaggggaatagtgaccgttatcagggagcttgactatgaaacaacacaagcttaccagctgaccgtgaatgccctggccattatcatcaccaatctgccgtattcaacaaatatttatgagcacagccctccaggtaccactgtaaggatcattactgcaatagatcaagacaaaggccgaccaaggggcatcggatatactatcgtctcgggtaacactaactccatctttgctctcgactatatctcaggggtgctcaccttgaacgggctactcgaccgcgagaatcccctgtatagtcacggctttatcttgaccgttaaaggtacagagctcaacgacgaccgaactccgtctgatgctaccgttacaaccacatttaacatcctcgttattgacatcaatgacaacgctccagagttcaatagtagtgagtactctgttgctattaccgaactcgctcaagttgggtttgctctccccctgttcattcaggtcgtggacaaggatgaaggtctgaattccatgtttgaggtctatttggtgggcaataactcgcaccacttcattatctctcccaccagtgtgcagggaaaagcagatatccgtattagagtcgcaattccgttagattatgagacagtcgatagatatgacttcgatctttttgccaacgagtctgtgcccgatcatgtggggtatgccaaagtgaagataactctgatcaacgagaacgacaaccgccctatctttagccagcccctgtacaacatctcgctctacgaaaatgtcacagtgggtacaagcgtccttactgtgttggtttccccacgattcaccgcaggacctctgtcgtccccaggcccaactgtcgtgcgccatccagagggattttgtcctagggacttgagcaatcagggtaggcgccatccccagataccagaattgtgcctcctcgtgtattag

SEQ ID NO: 216489 - DNA, 2187 bp, Artificial Sequence
  Description of Artificial Sequence: Synthetic coding sequence
gcaaccgataacgacgcaggaacgtttggcgaagtttcatacttcttcagtgatgacccagatcggttttcactagacaaagataccggcctgatcatgctgatcgcacgcttagactatgagctgatacagcgtttcaccctgactattattgctcgtgacggcggtggggaggaaacaactggacgggtacggatcaatgttctggatgtgaatgacaatgtcccaacttttcagaaggacgcatatgttggcgcattgagagagaatgaacccagtgttacgcaactggttaggttacgcgctactgatgaagattccccaccaaataaccagatcacatactctattgtctcagcctctgcttttggcagttatttcgatatatccctctatgaaggatacggtgttatttccgtctcccgacctctcgactacgagcagattagcaacgggctaatctacttgacagttatggccatggatgcgggaaacccacccctaaattccacagtgcctgtcacgatcgaggtcttcgatgagaatgacaatccaccaaccttcagcaagccagcctatttcgtaagcgtggtagagaatatcatggccggagccactgtcttgttcttgaatgcgaccgatcttgataggagccgagagtacgggcaggagtccattatttacagcctggaaggttcgactcagtttcggatcaacgccaggagcggcgagattactaccaccagcctgctggatagagagactaaatcagagtacattttgatcgttagggcagtggatggaggggtgggacataatcagaagacgggaatcgcaaccgtgaatatcaccttgctggacatcaacgataaccaccccacgtggaaggacgcgccttactacatcaacctggttgaaatgactccccctgactctgacgttactacagttgtcgcggtggatcctgacctaggagagaatggaacactagtttattctatccagccgcctaacaaattctatagcctgaacagcaccaccgggaagattagaacaacacatgcgatgctggatagagaaaacccggacccccatgaagcagaactgatgcgcaaaatcgttgtgagcgtcacggattgtggcagaccgcctctgaaggccacctcaagtgcgactgttttcgtgaatcttctcgaccttaatgacaacgatccaacctttcaaaatcttccatttgtagccgaggtattagaaggcattcctgccggagtgtccatataccaggtcgtcgcaattgatctggatgaaggcctcaatgggctggtgagctacagaatgcccgtggggatgcccagaatggattttcttattaattcttcttccggtgttgtcgttacaacaacggagttagatagagagcgcatcgccgaatatcagcttagagtcgtcgcaagtgacgcaggtactcctactaagtcctccacatcaacattgacaatccacgtgcttgacgtaaatgacgagaccccaacctttttccctgccgtctataacgtgagcgtgtcagaggatgtaccacgcgagtttcgtgttgtgtggctcaactgcacagacaacgatgtcgggctgaacgccgaactgtcttacttcataaccggtggcaacgttgacggtaagtttagcgtcggctacagagacgccgttgtcagaacagtggtcgggctggatcgcgagacaacagccgcttacatgctgatacttgaggctatcgacaacgggccagttgggaagagacacacaggcactgccactgtgttcgtgacagtgctggacgttaacgataatagacctatttttctacagtctagttacgaagccagtgtgcctgaagacatccccgaggggcactcaatcctgcaagaggatctcgcgtctccgtgtatcagccctgcccctccaaggcgggcattccagtcctcaggagaaaaagagacatcacagtttccagggaaggagttacgcagggaaccgggtccctcgaaggctcagaacagggccgcatttacagaacccctggccgaggcgcctctcttaggcagcaagcaagcccaggaagaaagggctcctctgcccagagagcaagcccaacagctgcaaggtagcgagggggaaaaaggcggaccctag

SEQ ID NO: 216490 - DNA, 2238 bp, Artificial Sequence
  Description of Artificial Sequence: Synthetic coding sequence
atgcgtaggtgtagatgggccgcattggcactcggtctgttacgcctatgccttgcccaggctaattttgctcctcatttttttgacaacggagttggctctactaacggcaatatggctttattttccctgcctgaggacaccccagtgggttcacacgtctacactctgaatgggacagatccagaaggcgatcccatctcctaccacattagcttcgacccctcaacacggagcgttttctctgtcgatccgacatttggaaacatcacactggtcgaagagttggatcgagaacgggaggatgaaattgaggctatcatcagcatatccgatggcttgaacctcgttgcagagaaagttgtgattcttgtgacagatgcgaatgacgaggcaccccgtttcattcaggaaccctatgtcgctctggtgcccgaagatatacccgcaggctctatcatttttaaggtccatgccgtggaccgcgataccggatctgggggaagcgtgacttactttctacagaatctgcactccccgtttgccgtggacaggcactcgggagtcctgcggttgcaggccggagccacactcgactatgaaagatcgaggactcattacattaccgtggtggcaaaggacgggggaggcagattgcacggggctgatgtcgtgttttcggccaccaccaccgtgacggtgaatgtggaggacgtgcaggatatggcccctgtcttcgtgggcactccatactacggctatgtgtacgaagacacactgcccggaagcgaagtgttgaaggttgtagctatggatggcgatagaggaaaacccaaccggatcctatattctttagtgaatgggaatgatggcgcattcgaaattaatgagactagtggcgctatttccattactcagtcaccggctcaactgcaacgggaagtttatgagctgcatgtgcaagtaaccgaaatgtcccccgctggaagccctgcggctcaggcaacagtgcctgtcaccataagaatcgtggacctgaataaccacccgcctactttttatggcgagagtggtcctcagaataggtttgaacttagtatgaacgaacatccccctcagggggagatcctcaggggcctgaaaatcactgttaatgatagcgaccaaggggcaaacgcaaaatttaacctgcagctggtcggccctcgtggaatcttccgggtcgtgcctcaaaccgtgctgaatgaggcgcaagtcacgatcatcgtagagaattcagccgctatagactttgagaaaagcaaagtactgacttttaaactgctggctgtggaggtcaacacacctgagaagttctcatcgaccgctgatgtcgtcattcagttattggataccaacgacaacgtgccaaagtttgactctctgtactacgtggctaggattccagagaacgctccgggagggtcctcggtagtggccgtcaccgctgtggatcctgacaccggcccttggggagaggttaagtattctacctacggcactggggcagatttgttcctaattcaccctagcaccggtctgatctacacgcagccttgggctagtctagacgcagaggccacagccagatataatttttatgtgaaagcagaggacatggaaggcaagtattccgtggcggaggtgtttatcacactgctggacgtcaacgaccaccctccccagtttggcaaatcagtgcaaaaaaagactatggtcctcggtacgccagtcaagatcgaggcaatcgacgaggacgctgaggagcctaacaacctggtggattattctatcactcatgccgagcccgctaacgtgttcgatatcaatagtcataccggagaaatatggcttaagaactctatcaggtcccttgacgctctgcataatatcacaccgggaagagattgtctgtggagcttagaggtgcaggcaaaggatcggggtagtccatctttcagcacgacagccttactgaaaattgatattaccgacgcagaggtcaggcgcctccggtacatgaagaacagcaacttccccggaaccaccaaaagtgtgcggaaacctaagttcaaacccaaaaagccgcactctagccaagggctgttcctccatccacactgcgagatcgccttgttcaacctgtcaaacgtgaacctgtactccagagtcttccagggcgcagctcaggctagctag

SEQ ID NO: 216491 - DNA, 2580 bp, Artificial Sequence
  Description of Artificial Sequence: Synthetic coding sequence
atgagaagatgtcgatgggcggcattggcccttggcctgctcagactgtgcttggcacaagccaacttcgcgccacattttttcgacaacggtgtagggagtaccaatggtaacatggcgttattctctcttccagaggatacaccagttggttcccatgtgtatacactgaatgggactgatcccgagggagatccaatttcatatcacattagcttcgatccctctacacgctccgttttcagcgttgaccccacatttggcaatatcactctggtagaagagctcgatagggagcgggaagacgagattgaagccattataagtatatcagatggcctcaacttggttgcagaaaaagtagtaattctggttaccgatgccaatgatgaagcacccaggttcattcaagagccatacgtggcgctggttcccgaagatatcccagccggttcgatcatcttcaaagtgcatgcagtcgatcgcgataccgggtcagggggtagcgtcacctacttcctgcagaatctgcactcaccttttgcagtcgaccgccacagcggagtgctgcgcctgcaggccggtgctacgctggattacgagcggtctagaacgcactacatcacagtggtcgccaaagacggtgggggacgtctacacggagcagatgtagttttttctgctacaaccaccgtgactgtcaacgtggaggacgtgcaggatatggcgcctgtctttgtgggtaccccatattatggctatgtatacgaagataccctccctggctccgaagtactgaaagtcgtggcgatggacggtgatcgaggcaagccaaatcgaatcctctattcgttggtgaatggcaatgacggcgcttttgagattaacgaaacatcaggagctatctccataacacagtcgcctgcccagttacagcgcgaggtctatgagcttcacgtacaggtaacagaaatgtccccggctggaagcccagctgctcaagctacggtccccgttacgatacgaatcgtggacctaaacaaccacccaccgactttttatggtgagtccggtcctcagaataggttcgagctgagtatgaatgagcatcctccccagggggagatcttgcgtggattgaagatcaccgtcaatgatagcgatcagggggcaaacgcgaagtttaatctgcagctggttggccctaggggtatttttagggttgtgcctcagaccgtgctcaacgaagcccaggtcaccattatagtcgagaattcagcagcaattgacttcgagaaatctaaggtgttgacatttaaacttctcgctgtggaggttaacacgccagaaaaattttcatcaaccgctgatgtagtcatccagcttctcgatacaaatgataacgtccctaagtttgactcgctgtactacgtcgcacgcattccggagaatgctccgggtgggagcagcgtggtagcagttactgccgttgaccctgacacaggaccctggggcgaggtaaagtactcaacctacgggaccggcgctgacttgttcctgattcatcccagtactggtctcatctacacccagccgtgggcttcactggacgcagaggccacagccaggtataacttttacgtgaaggcagaggacatggaagggaagtactctgtcgccgaggtgttcatcactcttctggacgttaacgatcacccaccccagtttgggaaaagcgtccagaagaaaactatggtgctcgggaccccagttaaaattgaggcgatcgatgaggacgccgaggaacccaataacctggtggactactccataacgcatgctgagcccgcaaatgtgtttgatatcaatagccataccggcgaaatatggcttaagaattccatcagaagcctggatgcccttcataatattactcccggtagggactgtctatggagtctcgaagttcaggccaaggataggggctctcctagcttcagtaccacagcacttctgaaaatagacattaccgacgccgaaactctaagtagatccccaatggcggcatttctgatccagaccaaagacaatcccatgaaagccgtcggtgttctggcaggcactatggccactgttgtagctattactgttctgatctcgactgctaccttctggagaaacaaaaaatccaataaggttctgccaatgcgacgggtcctaagaaagcgcccttcccctgccccacgcactatccggattgaatggctcaaatccaagtccactaaggcagccaccaagttcatgctaaaggaaaagcctcccaacgagaattgcaataacaactctcctgagtctagcctcctaccccgagccccagctctgcctcctcccccttccgtcgccccttcgaccggggctgcccagtggaccgttcctacagtgagcggatcattgaccccgcaacctacacagccccctcccaaacctaagactatgggctctccggtgcaatccactttgatctccgaactcaagcagaaatttgaaaagaagtctgtgcataacaaagcctacttttag

SEQ ID NO: 216492 - DNA, 1692 bp, Artificial Sequence
  Description of Artificial Sequence: Synthetic coding sequence
atggcccctgtcttcgtgggcaccccttactatggatacgtgtacgaggacaccctgcctggctccgaggtgctgaaggtggtagcaatggatggtgaccggggtaaaccaaaccgcattttgtatagtctagttaatggaaacgacggggcttttgagattaatgaaacctctggagcaatctccattacccagagcccagcacagctgcagagggaagtttatgagctgcacgttcaagtcacagaaatgtccccggcagggagtccagctgcacaggcaaccgtgccagtgaccatcaggattgtcgatttgaataaccacccacccaccttttacggagaatccggccctcaaaatcggtttgagttgtcaatgaacgaacatcctccccaaggcgagattctcagaggacttaagattacggtcaacgattctgaccagggggctaacgccaaattcaatttgcaattggtcgggcctcgcggtatctttagagttgttcctcagactgtgctcaacgaagcccaggtgacaattatcgttgagaactccgcagcgattgatttcgagaagtcaaaggtgcttacctttaaagctgttgatcccgataccggcccttggggcgaggtgaaatactctacctatggtaccggtgccgatctttttctgatccacccgtccaccggccttatttacacccagccctgggccagcttggatgcggaagcaacggcaaggtataatttttacgtcaaggccgaggatatggaaggaaagtacagtgtggctgaagtgttcattaccctcctggacgtgaacgaccacccaccccagtttggaaaatctgtgcagaagaaaacaatggtgctgggaacgcccgtgaaaattgaagctatcgacgaggatgcggaagagccaaacaatttggtcgattacagcattacacacgcagagcctgctaacgtgttcgatatcaatagtcacaccggagagatctggctgaagaactcaataaggtcgctggacgccctccataatattacacccggacgagactgcctctggagcctggaggtccaggcgaaggaccgcggatcgcctagtttcagcactactgcgctgttaaaaattgatatcactgacgccgaaacactttcccgttccccaatggcagctttcctgatccaaacgaaagacaaccccatgaaagcagtcggggtgctggcaggaaccatggctaccgtcgtggcgattactgtccttatttctacagccaccttctggcggaataagaagagcaataaagtgctaccaatgcggagggtgctacgtaaacgaccctcccctgcccctcggactattcgcatagagtggttgaagagtaagtcaacaaaagcagctactaagttcatgttgaaagagaagcccccaaatgaaaattgcaacaataattctcctgagtcatcccttctacctcgagcccctgccctgcctccccctccctcagttgcaccaagcactggtgctgcacaatggactgtcccgacagtctccggaagtcttaccccacaaccaactcagcctcccccaaagcctaaaactatggggtctccagtccagtctactctgattagtgagctgaaacagaagtttgagaagaagagcgttcataataaggcctatttctag

SEQ ID NO: 216493 - DNA, 1464 bp, Artificial Sequence
  Description of Artificial Sequence: Synthetic coding sequence
atgggatcttgggcactcctctggcctccgctcctctttactggcctgcttgtgagaccaccaggaacaatggcccaagcacagtattgctccgtcaataaggacatcttcgaggtagaggaaaacactaacgttactgagccactggtcgacatccatgttcccgaaggccaggaggtgaccctgggcgctttgagtactccctttgccttccgtattcagggtaaccagttgttcctgaatgtcacgccagactacgaggaaaaaagccttctagaagctcagctgctatgccagagcggcggaacgttggtaacccagctacgcgttttcgtgagtgttctagatgtgaatgataatgcccctgaatttccatttaagaccaaggagattagagtggaggaagatactaaggtgaactctacagttattcccgaaactcagctgcaggccgaggatcgcgacaaagatgatatactgttctacacgttgcaggaaatgactgccggagcctcagattatttctcactggtctcggtcaatagacctgcactgcgcctggatcgacccctcgatttttacgagcgaccaaatatgactttctggctcctcgtgagagataccccgggtgagaacgtcgagccatctcacaccgcaaccgccaccctcgtactgaatgtcgtcccagcagacttgaggcctccttggttcctcccatgcaccttttccgatggctatgtgtgtatccaggctcagtatcacggcgcagtgcccacaggtcacattttgccatcaccattggtcctgcgacccggacccatctacgcagaggacggagatagaggcatcaaccagccaatcatttattccattttccggggtaacgttaatggcacatttattattcatcctgatagcggaaaccttacagtcgctagaagtgtcccaagccctatgacctttctgctgctggtgaaaggccaacaagcggatctcgccaggtatagcgtgacgcaagtcacagttgaagctgtggcagccgcaggctcacctccaagattccctcagcgactttacagaggtaccgttgccaggggtgcgggagctggagttgtggtcaaggatgctgcggcaccatcacaaccccttaggattcaagcccaggatcccgaattttcagatctgaactctgctatcacgtatcgcatcacaaatcattcccattttcgcatggagggcgaggttgtgctcaccactactactctggcgcaggccggtgcattctacgccgaaccccctacttgtaccggagacctgcgtcatcccgctcacctgagaccccctgcaccggatcctactcaaaggcttcccggagaggcagaagaacctatgcagaccccaaaggcaactcacctgggagccggtggtttaaagcatttgcccggagtattagtccccttctag

SEQ ID NO: 216494 - DNA, 1956 bp, Artificial Sequence
  Description of Artificial Sequence: Synthetic coding sequence
atgggatcttgggctctcctgtggccacccctgttgttcacaggcctccttgtccgaccaccaggcactatggctcaggcccaatactgtagcgtgaacaaggacatcttcgaggtggaagaaaacacgaatgttaccgaaccactcgtcgatattcacgtgcctgaggggcaagaagtgacactgggcgcattgtcgaccccttttgccttcagaatccagggtaaccagctcttcttgaacgtaacccctgactacgaggagaagtcattactggaggcacaactgctctgtcagagcggagggactctggtgactcagctgagggtcttcgtgagcgtgctcgatgtaaacgacaacgctcccgagtttccgtttaagacaaaggagattagggttgaggaggacaccaaggtgaattccaccgtcatccccgaaacgcagctccaagctgaagaccgcgataaagatgatattttgttctatactttgcaggaaatgaccgctggagcctccgattacttttcgctcgtgtcagtcaatagacctgctcttcgcctcgatcgcccactggatttctatgagaggcccaacatgacattttggctgctcgtgagagacacccccggtgagaatgtagagccaagccacactgccaccgcaacactggtgcttaatgtcgtgcccgctgacttgcgtccaccctggtttctgccttgcacattcagcgatggctacgtgtgcatccaggcacagtatcatggcgctgtccctaccggtcacatcttgccatccccactggtcctccgacctgggccaatatacgcagaagatggggatcgtgggatcaaccagccgattatctacagtatctttcgcggaaacgtaaatggcacgttcattatacatccggacagtgggaaccttaccgtcgctaggtctgtgccaagtcccatgacttttctgcttcttgtgaagggacagcaggccgacctcgcccgatacagcgtgacccaggtaacagtggaagccgtggcagctgccggatcccctccacgcttcccccagaggctttaccgaggcacagttgcgcgtggcgctggggcaggggttgtcgtgaaagacgcagccgctccatctcaaccactgaggatacaagcccaggaccctgaattcagcgacttgaattctgccattacctatcggataactaatcactctcacttcagaatggaaggagaagtcgtcctgaccactacaaccctggcccaggccggagctttttacgctgaggtggaagcacacaatacagtcacctccggcacggccactacagttatcgagattcaggtgtctgagcaggaacccccttcgaccggcggaggccctagtgaggacaagcgatttagcgtcgtggacatggcagcactgggcggtgtgctgggagccctgctccttctggcactgctgggactggccgtactggttcataaacactacggccctcgcttaaagtgctgctgcggcaaggccccagagcctcagcctcaaggattcgataatcaggcatttctgccagatcataaggccaactgggcccctgtgcccagccctacccacgatcctaaaccagccgaggcacccatgcccgcagagccggctccccctggaccagcttcaccgggtggagctcccgagcctcccgcagcagccagagcaggtggatcccccactgcggtgcgatcgatccttacgaaagaaagacgacctgagggcggttataaggcggtctggttcggggaggacataggaacggaagccgacgtggttgtgttgaacgccccaacacttgatgtcgacggtgcaagtgattcaggctctggcgacgagggcgagggggcaggccgaggaggcggtccgtacgatgctccaggcggtgacgattcatatatatag

SEQ ID NO: 216495 - DNA, 2538 bp, Artificial Sequence
  Description of Artificial Sequence: Synthetic coding sequence
atggggagttgggctctcctctggccacccctgctctttaccgggctcctggtgcgtccgccagggaccatggcccaggcccagtattgcagcgtaaacaaggacatttttgaggtcgaggagaacactaatgtaactgaacctctggtagatatccatgtgcccgaaggccaggaagtgacattgggtgccctgtcaaccccattcgcctttcgtatccaaggaaatcagctgttcctgaacgtcacccccgattatgaggaaaagagcctccttgaagcccaattgctctgtcagtctggtgggacgctcgttacacagctgagagtgtttgtctccgtactcgatgtgaatgataacgctccggaattcccatttaaaaccaaggagatcagggtcgaggaggatacaaaagtcaatagtacagtgattcctgaaactcaactccaggccgaggacagggataaggatgacattctgttctacaccttgcaggagatgacagctggcgcaagcgattacttctctctggtatccgtgaatcggcctgcactgaggcttgatcgtccactggacttctacgaaaggcctaacatgactttctggctgctagtgcgggacacgccaggcgagaacgtggaaccatctcataccgctactgcaaccctagtgcttaacgtcgtccccgcagacctacgcccaccatggttcctgccctgtacatttagcgatggctacgtttgtatccaggcgcagtatcacggcgctgtccctactggccatattctcccttccccattggtcctgcgaccgggacccatctatgctgaagacggagatcgcggaattaaccagccgatcatctactcaatctttcgtgggaacgtaaacggtacgttcatcattcatcccgacagcgggaatctcacagtggcgaggtccgtgccgtcaccaatgacatttctgcttctcgtgaagggacaacaagctgatttagcaaggtacagcgtcacacaggtgactgttgaagccgttgcagccgctggatctccccctcgttttccccagcgtctctaccggggtacggtagccaggggtgctggagcgggtgtcgtagttaaagacgccgctgctccctcccaaccacttagaatccaagcccaggaccctgagttctccgacctgaactcagcaattacgtatagaatcacaaaccactctcatttcaggatggagggcgaagtggtcctgacaacaacaactctggcccaggcgggagcattttacgcagaggttgaggcccataacaccgttacttcagggacggccacaacagtcattgagatccaagtgtccgagcaggagcctccttctaccgatgttcctccttcacctgaagccggaggtaccacgggtccatggacaagcaccaccagtgaagtccccaggcccccagaaccctcccaggggcctagcaccacctcctccggcggaggcaccggccctcatccccctagcggcaccacactgcgacctccaacatcctccacgccgggaggcccacccggagccgagaacagcacctctcaccaacccgctaccccaggtggggataccgcccagacaccaaagcccggaacgagccaacccatgccccctggcgtcgggacaagcacaagccaccagccagcaactcccagtggaggcactgcgcagacacctgagcctggaacatctcagccgatgcccccatctatgggcacctcaacttctcaccaaccagcaacccccggtgggggaacagctcaaacccccgaggctgggacgtcgcagcctatgccccctggaatgggcactagcacatctcaccaaccaactacacctggcggaggaaccgctcagacacctgagccgggaacatcccagcctatgccactgagcaagtcaactccatcgtcaggcggtggcccttctgaagataagagattctccgtggtggacatggccgctcttggtggagtgctcggagctctgttgctgctggctctgctaggtctggccgtcttggtgcacaaacattacggacctcgactaaaatgttgctgcggtaaggcgccagagccgcagccacagggcttcgacaatcaggcctttctgcccgaccacaaggcaaattgggctccagtgccatccccgactcacgatcctaaaccagcggaggcgcctatgcccgctgaaccagcccctccaggaccagccagtccagggggagcgccagagccacccgcagcagctcgcgctggaggttcccctacggccgtgagaagtattctgacaaaggaacgcaggcccgagggtgggtacaaggccgtgtggttcggcgaggatatcggcacagaggcggacgtggtggtgttgaatgctcccaccctggacgttgatggcgcttcagattccggtagcggtgacgaaggagaaggcgcaggcaggggcggtggaccctatgacgcaccgggaggggacgacagctatatttag

SEQ ID NO: 216496 - DNA, 2538 bp, Artificial Sequence
  Description of Artificial Sequence: Synthetic coding sequence
atggggtcctgggctttgttgtggccacccctgctgttcaccggcctgctggtgcgccctccagggaccatggcgcaggctcagtactgctctgttaataaagacatttttgaagtcgaggagaacaccaatgtgactgaaccattggtggacatacacgtgcccgagggccaggaagttaccctgggagcattatctaccccgttcgcattcagaattcagggcaaccagctgtttctgaacgtcactccggattacgaggagaaaagccttctcgaagcccagcttctgtgtcagtccgggggaactctcgtgacccaactaagggtgtttgtctccgtcctggacgtgaacgataacgcccctgagtttccattcaagacaaaggaaatcagagtcgaggaagacacaaaggtcaacagcactgtgataccagaaacccagttgcaagctgaggatcgcgacaaagatgacatcctcttctacacacttcaggaaatgaccgctggcgcttcggattacttctcattagttagtgttaacagacccgcattgcgcctggacagaccgctggacttttacgaacggccaaacatgactttttggctcctagttagggacaccccaggtgagaacgtggagccttcacacacggcgacagctacactggtattgaacgtggtaccagccgatctcaggcctccttggttcctgccctgtacattcagcgacggctatgtctgtatccaagcgcagtaccatggggctgtccctacggggcatatactcccctcgccactggtcctccggccaggcccaatttacgcagaggacggggatagaggcataaatcaacccataatttattcaattttcaggggaaatgtcaacggcacattcattatacatcccgactcgggtaacttaaccgttgccaggtcagtcccctcccccatgacttttttgttattggtcaagggacaacaggccgacctcgcacgatactccgtgactcaggtgacggtcgaggctgtggccgctgccggttctcctccgagatttcctcagcggctataccggggtactgtggcgcgaggcgctggggcaggcgtcgtagtaaaagacgcggcagcacctagccagccactcaggatacaagcccaggatccagaattcagcgatctgaatagtgccattacatatcgcatcaccaaccactctcattttaggatggagggcgaggttgtgcttacgacaacaaccttggcacaggccggagcattttatgccgaggttgaggctcacaataccgtgacaagcgggacggccacaaccgtcattgagattcaagtgagtgagcaggagccgcctagcaccgatgtccctccttccccggaggccggaggaacaaccggtccctggactagtaccacatctgaagtgccaagaccccctgaaccgtcccagggtccaagcacaaccagcagcggcggagggacaggacctcatcctcccagtggcacaaccctgagacccccaacttcctccactccagggggacctccaggggctgagaactcgacatcacatcagcccgcaacccccggtggggataccgctcagacccctaagcctggcactagtcagcccatgccaccaggggtgggaacatcaacatcccaccagcccgctacgccaagcgggggaaccgcccaaaccccagagcccggaacctctcaaccaatgcctccctctatgggaacatcaacctctcatcagcctgcgacacccggaggaggcactgcccagacccccgaggcaggaacaagccagcctatgccacccggaatgggaacaagcaccagccaccaaccaacgactcccggaggcggaaccgctcagacccctgagccaggtacatcacagcccatgcccctctcaaaaagcacccctagctctggcggtggaccctccgaagacaagcggtttagcgttgtcgatatggcagccctcggcggagtgctcggcgctctcctgctactggccctgctcggactggccgtcttggtacacaagcattatgggccacgcctgaaatgttgttgtggcaaggcccctgagccacaacctcagggcttcgataatcaggcctttctgcctgaccacaaggccaattgggccccagtccccagtcccactcacgaccctaagccagctgaagctcccatgccagcagaacctgctccacctgggccagcctctcctgggggtgcccctgagccacctgccgcagctcgagcgggagggagccccaccgctgtgcgcagtatcctgactaaggagcggagacccgaaggtgggtataaggctgtatggtttggagaggacatcgggaccgaagccgacgttgtcgtactgaacgctccaacacttgacgtggatggagcctcggattccggaagtggcgatgaaggcgagggggctgggcgtggaggcggaccatatgatgcccctgggggtgatgacagctatatctag

SEQ ID NO: 216497 - DNA, 786 bp, Artificial Sequence
  Description of Artificial Sequence: Synthetic coding sequence
atggcagaatcccatttgcaatcctctctcattaccgccagccaattctttgaaatctggctgcactttgatgctgacggctcgggatatctcgagggtaaagagctgcagaatcttatccaggagctgcagcaggctaggaagaaggctgggttggaattgagcccagaaatgaagacattcgtcgatcagtacggacagcgggacgacggcaagattggcatcgttgagcttgcgcatgtgctgcccacagaggagaacttcttgcttttgttccggtgccagcagcttaaatcatgcgaggagttcatgaagacttggcggaagtatgatacagaccactcaggctttatagaaacggaggaactgaagaacttcttaaaggacctccttgagaaggccaacaaaactgttgatgatacaaagcttgcagaatataccgatctcatgctaaaattattcgattcaaacaatgatggcaagctggaattgacagagatggctcgcctcttgccagtgcaggaaaatttcctcttgaaatttcaggggatcaaaatgtgtggcaaggagtttaacaaggcatttgaactgtatgatcaggacggtaatggctatattgacgagaatgagttagatgcgttactgaaagacctgtgcgagaaaaacaagcaggacctggatattaacaacattactacatacaaaaagaacatcatggcactctcagacggaggaaagttgtacagaaccgatctcgccctgatcttatgtgccggtgacaactag

SEQ ID NO: 216498 - DNA, 615 bp, Artificial Sequence
  Description of Artificial Sequence: Synthetic coding sequence
atgaagacgttcgtggatcaatatgggcagcgtgacgatggcaagatcggcatcgtcgaactggctcatgtcctcccaaccgaggaaaattttctcctgctgtttcggtgtcaacagttaaagtcatgtgaagagtttatgaagacctggaggaagtacgacaccgaccactcaggattcatcgaaacggaagagctaaagaacttcctcaaagacctgctggagaaggctaacaaaaccgtggatgacaccaagcttgccgagtacactgatctcatgctaaagctgttcgattcgaataatgatgggaagctggagctcacagaaatggcacgactgctgccagtgcaagaaaactttctgctgaaatttcaggggatcaaaatgtgcggaaaagagttcaacaaggcctttgagctgtatgaccaggatggaaacgggtatatcgacgagaatgagttagacgctttactaaaagacctatgcgagaaaaataagcaggacttagatatcaataacattactacttataaaaagaatattatggcactgagcgacggtggcaaactgtatcgtacggatttagcccttattctgtgcgccggtgacaactag

SEQ ID NO: 216499 - DNA, 816 bp, Artificial Sequence
  Description of Artificial Sequence: Synthetic coding sequence
atggcgggaccccagcagcagcctccatatctgcacctggccgagctgacagcatcgcagttcctagagatctggaagcacttcgacgccgatgggaatggctacatcgagggcaaggagctcgagaactttttccaggagctggagaaagccagaaagggttccggcatgatgtccaagagcgataattttggggaaaagatgaaagaatttatgcaaaagtatgacaagaacagtgacggcaaaattgagatggcagagttagcccaaattctgccaaccgaggagaatttccttttgtgctttcggcagcacgtgggctcttctgcagaatttatggaggcctggcgaaaatatgacaccgatcgatccggttatatcgaagcgaatgagctcaagggctttttgagtgacttgctcaagaaggctaaccgaccgtacgatgagcccaagttgcaggagtatacccagaccattttgcgcatgtttgacctcaatggagatggcaagctgggcctctccgaaatgagtaggctgctccccgtacaggaaaatttccttctgaagttccaggggatgaagctaacgtctgaggagttcaacgcaatctttaccttctacgataaagatcgaagcggctatattgacgaacatgagctcgacgcactgttaaaagatctatacgagaagaataaaaaagaaatgaacatccaacagcttactaactacaggaaaagcgtgatgtcgctcgcagaagctggtaagctttacagaaaagacttagagattgtgctgtgcagcgagccccctatgtag

SEQ ID NO: 216500 - DNA, 579 bp, Artificial Sequence
  Description of Artificial Sequence: Synthetic coding sequence
atggccggaccccaacagcaaccaccctatctacacctagccgaactgaccgcatcacagtttctcgaaatttggaaacactttgatgcagatggaaacggatatatcgagggtaaagagctggagaattttttccaggaactagaaaaggcgcgaaaagggagcggcatgatgtccaagagcgacaatttcggggagaagatgaaggaatttatgcagaaatacgataaaaactccgatgggaaaatagaaatggcggaactggcccagattttgcctactgaggagaattttctgctgtgtttcaggcagcatgttggctccagcgccgagttcatggaagcatggaggaagtatgacactgaccgcagtggatacattgaagccaatgagctcaagggttttctgtccgatctcctcaaaaaagccaaccgcccttatgacgagccgaagctacaggaatacacccaaacgatcctgagaatgttcgatctgaatggtgacggcaagctgggtttgtctgaaatgagccggatcgaagctgcaactcttacctctatgtcatggatgccattttag

SEQ ID NO: 216501 - DNA, 6663 bp, Artificial Sequence
  Description of Artificial Sequence: Synthetic coding sequence
atgattcggattgctgccctgaatgcaagtagcaccatcgaagacgatcatgagggtagctttaaatcccacaaaacccagacaaaggaggcccaagaagccgaggcattcgccctgtaccacaaagcccttgatcttcagaaacatgatcgattcgaggaaagcgcaaaggcttatcatgaattactggaggcctctttgttgcgggaggcagtcagttccggcgacgagaaggaaggcctgaagcacccgggactgatccttaaatatagcacgtataaaaatctcgctcagctggcagctcagagggaggacttagagacagcgatggaattctacctagaggccgtgatgctggatagtaccgatgtgaatctgtggtataagattggacacgttgcactcaggttgatcagaattcccttggctaggcacgccttcgaggaaggtctccggtgcaaccccgaccactggccctgtttggacaatctgatcaccgtgctgtacacactttctgattatacaacatgcctctatttcatttgcaaagccctggagaaggattgtcggtattccaagggactggtcttgaaagagaagatcttcgaagaacagccatgtctccggaaggattctcttcggatgtttctcaaatgtgacatgtcaattcatgacgtgagtgtcagcgccgctgagacgcaggcaatagtagacgaagcattagggctgagaaagaagaggcaagctctgatcgtaagagagaaggaacctgaccttaaacttgtccagcccattccgttttttacgtggaaatgtctcggcgagtccttgttggctatgtataatcatctaacgacatgcgagccccctaggccctctctcggtaagcgtatagacctgtctgattaccaggacccatcgcagcccttggagtctagtatggtggtaacccctgtgaatgtcatccagccctctactgtgagcacaaaccctgcggtagcggtcgctgagcccgtggtgtcatacacgtccgtggccacgacgtcattcccactgcattctcctggcctcttagagaccggcgctcctgtgggagacatcagcggcggagataaatccaaaaagggtgttaaacggaagaaaatctcagaggagagtggtgagactgcaaaacgaaggtcagccagggtccgcaacacaaagtgcaaaaaagaagaaaaggtggactttcaggagttgctcatgaagtttctaccgtcccgactcaggaagttagacccagaggaagaggatgatagcttcaacaattacgaagtacagtctgaggcaaaactcgagtccttcccatccatagggcctcagcggttatctttcgactctgcgacattcatggagtccgaaaagcaggatgtgcacgaatttctgctggaaaacctgaccaacgggggtatcctagagctgatgatgcggtacctgaaggctatgggtcacaagtttctggtccgatggccgccaggtctggccgaagtcgtcctctccgtgtatcattcttggcggcgacactccacctcactgccgaatcctcttttgcgggactgtagcaacaagcatatcaaggatatgatgctgatgagcttgtcctgtatggagttgcaactggatcagtggttactgaccaaaggacgtagttccgcagtctcgccccgaaattgtccggcaggaatggtgaatggcaggttcggtcctgattttcctggtacgcactgcctcggggacctcctgcagctgtctttcgcctcatctcagcgggacctgttcgaagacgggtggctagaattcgttgttcgggtttattggttaaaagccagatttctggcgctgcagggcgatatggaacaagccctagagaattacgatatctgcacagaaatgctgcaatcgtcaacagcgatacaagttgaggccggagccgaaaggagagacatcgttattcggttgcctaacctgcacaacgatagcgtggtttcccttgaggaaatcgataagaatcttaagtccctcgaacggtgtcagtccctcgaggagattcaacgcctgtatgaggcgggtgattacaaggcggtcgtacacctgctgcggcctactctgtgtactagcggcttcgaccgggctaagcacctcgagttcatgacaagcataccagagagaccggctcaactcctactgctgcaggattctctcctcagattaaaggattatcgccaatgtttcgagtgctccgacgtggctctaaatgaagcggtccaacaaatggtgaacagcggtgaagctgcagctaaagaagagtgggttgccacggtaactcagctgttgatgggcatcgagcaggctttgagtgccgactcaagcggatctattcttaaggtgtcctcatctactacagggctagtgcggttgaccaacaacctcattcaggtgatcgactgtagcatggccgttcaagaggaagcaaaggaacctcacgtttcctcagtactcccttggattatcctgcatcgcatcatatggcaagaggaagacaccttccacagtctgtgccaccaacaacagctgcagaatcctgccgaagaaggcatgagcgagacccctatgctgccttcctctctgatgctgttgaacacagcacatgagtacctaggtcggcgaagctggtgttgcaacagcgacggtgccctgctcagattttacgttcgagtgttgcaaaaggaacttgcggctagcaccagcgaggacacacacccctacaaagaggagctggagacagctctggagcagtgcttctactgcctgtattcctttccaagcaagaaaagcaaagcacggtacttggaggagcactcagctcaacaggtggatctgatttgggaagacgcgctgttcatgttcgaatatttcaaacccaaaaccctgcccgaattcgacagctacaaaaccagcacagtcagcgccgatctggccaacctgctgaaacgaatagccaccatcgtgccgaggaccgagcgacctgctttgagcttggataaggtttctgcatatattgaagggacatcgaccgaggtcccctgccttccagagggcgcagacccctcgccccctgttgtcaatgagctgtattatctactcgcagactatcacttcaagaacaaagaacagagtaaagccatcaaattctatatgcacgatatttgcatatgccccaacaggttcgacagttgggcaggtatggctcttgcgagggctagcaggattcaggacaagctgaattccaatgagctgaaaagtgacggtccaatatggaaacacgcaacgcccgtgctgaactgcttcaggagggccctggagatagattcgagcaatttgtccctctggattgaatacggtaccatgagctatgccttacactcctttgccagccggcaactgaaacagtggaggggcgaactcccacctgagctggtgcagcaaatggagggtagacgcgattccatgctcgaaaccgcgaaacattgcttcacttctgccgcaagatgcgagggcgatggcgacgaggaagagtggctgattcattacatgctgggaaaggttgccgagaagcaacagcaaccccctaccgtgtacctgctccattaccggcaagccggacactatttgcacgaagaagcagcgagatatccaaagaagatccattaccataacccaccagaattagcaatggaggccctggaagtgtacttcaggttgcatgcctcgatcttaaaattactgggcaagcctgactcgggggtgggagcggaagtgctcgtgaactttatgaaggaagctgccgagggccctttcgctcggggtgaagagaaaaataccccaaaagccagcgagaaggaaaaggcgtgcctggtggatgaagactcacattcttccgccggaactctgcccggacccggagcctctctccccagctctagcgggcctggattgacttcacccccttacacagccacccccattgaccacgattacgtgaagtgcaaaaaacctcatcagcaggccacacccgatgacaggtcccaggattctacagccgtggcactaagtgactcttcaagcacacaggacttcttcaacgaaccaacatctctgctggaaggatctcggaagagctacaccgagaagaggctgcccatcctgagttctcaggccggagccactggtaaggatctccagggagccacagaggaaagaggcaaaaacgaggagtcactggaatcgaccgaaggttttcgcgctgctgaacagggcgtgcagaaaccggctgcagagactcccgcttccgcgtgcatcccgggaaagccgtcggcatcaaccccaactctgtgggacggaaagaaaagaggagatctgccaggggaaccggttgcctttccccagggcctccctgccggagcggaagagcagaggcagttccttaccgaacagtgcatagcctcttttaggttgtgccttagccggttccctcagcattataagtcactctatcgccttgccttcctttacacatactcaaaaactcataggaatctccagtgggccagagatgtactccttgggagttctattccctggcagcagttacagcatatgcctgcccagggcttattttgcgagaggaacaaaaccaactttttcaacggtatttggcggatcccagtcgatgagatcgacaggcccggtagcttcgcttggcacatgaacagaagcattgtgttgctcttaaaggtcctcgcacagctgagagatcatagtactcttttaaaggtgtcgtctatgctgcaacgtacccctgaccagggaaagaagtacttgcgggacgccgaccggcaggttctggctcaacgcgctttcattctaactgtgaaggtgctcgaggatacactctccgagcttgcagaaggatcggaacgaccaggccctaaagtgtgtggactcccaggagcccgtatgaccacagatgtgagtcataaagcatccccggaggacgggcaggaaggactcccacagcccaaaaaaccacccctggccgacgggagcggcccaggtcccgagccaggaggtaaagtcggccttctgaatcaccgacccgtcgcgatggatgccggtgatagtgccgaccagtcaggtgaaagaaaagataaagaaagccctagggcaggccctaccgagcccatggacaccagtgaagcaactgtttgtcacagcgacttggagcggacccccccactcctgcctggtcgccctgcacgcgaccggggacctgagagccggcctaccgagttgtctctggaggagcttagtattagtgccaggcagcaaccgacgccgctcacacccgctcaaccagctccagcccctgctcctgctaccaccaccggaacgagggcagggggacacccggaggagcccctgtctcgactgtcacgtaaacgaaaactactggaggataccgaaagtgggaagactctccttctggacgcatacagggtgtggcagcagggacagaagggagttgcgtatgacctgggtagggtcgagagaatcatgagcgaaacctatatgctgattaaacaggtggacgaggaggctgccctggagcaggccgtcaagttttgccaggtgcacttaggtgctgcagcccagcgacaggcgtcaggcgatactccaacgacacctaagcaccctaaagactccagggagaacttttttcctgttaccgtcgttcctaccgcaccagatccagtgcccgcagatagcgtgcagcgcccaagcgatgcccacacaaaaccccgaccagcactagctgctgctaccaccataatcacttgcccaccatcagcctccgcaagtacccttgatcaaagcaaggaccctggcccacctcgcccacataggccggaggccaccccttcaatggcgtctttgggccctgagggggaggagctggcaagggtggccgaggggacctcttttccaccacaggagccacgccattccccccaggtgaagatggctccaactagcagcccagctgaaccccactgctggcccgctgaagccgctctggggaccggtgcggagcctacatgcagccaagagggcaagctccgccctgaaccacgacgagacggagaggcccaggaggccgcttcagagacgcaaccgctctcgagtccacctacggctgcctcatcaaaggctccctcgtcaggaagcgctcagccccctgagggtcacccaggtaaacctgaaccatcgcgagcaaaaagtcgtcctctccctaatatgcccaaactcgtcattccgtcggcggcaactaagtttcctccagagattacggtgacacccccaactcccacacttctttcaccgaaggggtcaattagcgaggaaacaaagcaaaaactgaagagtgcaatcctgagcgcacagagtgcggcaaacgtgcgcaaggaaagcttatgtcaacctgccctcgaggtcctagagacatcttcgcaggagagctccctcgagtccgagaccgatgaggatgacgactatatggacatctag

SEQ ID NO: 216502 - DNA, 6662 bp, Artificial Sequence
  Description of Artificial Sequence: Synthetic coding sequence
atgattcgcattgcagctttgaatgcctcctccactatcgaggacgaccacgagggtagtttcaagagccataaaactcagaccaaagaggctcaggaagccgaggctttcgccctttaccataaggcattggatcttcagaagcatgataggtttgaagagtctgcgaaagcttaccacgaactgttagaggcttcactgcttcgcgaggctgtgagttcaggagacgaaaaggaaggactgaagcatcctggccttatcctgaaatattcaacttataaaaatctagcccagttagccgcacagagagaggatctcgaaactgccatggagttttacttagaggctgtaatgttggatagcactgacgtgaacctgtggtacaagataggccacgttgcccttcgtttgattcgaataccacttgcacggcacgcttttgaagaggggctcaggtgtaaccccgaccactggccatgtcttgacaatttaatcacagtactatacacattatctgactacacgacatgcttgtatttcatctgcaaggctctcgaaaaggattgtagatactccaaagggcttgtgctgaaagaaaaaatcttcgaagagcagccttgcctgagaaaggacagcctgcggatgttcctgaagtgcgatatgagcattcacgacgttagcgtatccgccgctgagacccaggccattgtcgacgaggccttgggattgagaaagaaaagacaggctctgatcgtacgtgagaaggagcctgaccttaaactggtccaacctatcccctttttcacctggaaatgcctaggggaaagtttgctcgccatgtacaatcatttaacaacatgcgaaccccctaggccgtccctgggaaagaggatcgatctcagcgactaccaagacccatcccagccccttgagtcttctatggtggtgaccccggtgaacgtcatccagcctagcacagtatccaccaaccccgcagttgccgtggccgagcctgttgtctcatacaccagtgtcgcaacaaccagcttccctttgcactcccctggcctgctcgagactggtgctccagttggagatatctctggtggcgataaatccaagaagggcgttaaacggaagaagatttccgaggaatccggggagacagcaaagcgccgatctgccagagtgcgcaatacaaagtgtaaaaaggaggaaaaggttgacttccaggaactgttgatgaaattcctgccctcaagactgagaaaactggaccccgaggaagaggacgactctttcaataactatgaagtgcagtctgaagcaaaactggagagttttccatccatcggccctcagcgcttgtcatttgattcagctacgtttatggagtccgaaaagcaggacgtccacgaattcctcctggagaacctgacgaatggtgggattcttgaactcatgatgaggtacctgaaggccatgggtcataagttccttgtgagatggcccccagggctcgcggaagtagtgctgtccgtgtatcacagctggcgcaggcatagtacaagccttcctaatccattgttaagagattgctccaacaaacacatcaaggacatgatgttaatgagtctctcctgcatggagctgcagcttgaccagtggcttctcactaagggcagaagttcggcagtttcaccacgtaactgccctgctgggatggttaacggcagatttggcccagacttcccaggaactcactgcttaggggatctgctacagctgagtttcgcaagctcgcagagagatctcttcgaggacggctggctggagtttgttgtcagagtgtattggttaaaagccaggttcctggcactgcagggagacatggaacaggctctggagaattacgacatttgcacagagatgctccaatcatccacagctatccaggtggaggccggagctgagcgcagagatattgtcattcgtctccccaacctgcacaacgattccgtcgtctccctagaggaaattgacaaaaacctgaaatctttagaaaggtgccagtccctggaagaaatccagcgcctgtacgaggcaggtgattacaaagctgtggtgcacctgctaagaccaacattgtgtacctccggctttgaccgagcgaagcacctggagttcatgactagtatcccagagcggcctgcccaactgctgctgctccaggacagcctacttaggctcaaggattataggcagtgtttcgagtgtagcgatgtcgctctgaatgaagctgtgcagcagatggtgaactccggggaggcggcagcaaaggaggagtgggttgcgacggtcacccagctgcttatgggaatcgaacaggcattatcagcggattcttccgggtctattctgaaggtatcgagctctacgactggcctagtgcgcttaaccaataacctaatccaggttatagactgttccatggccgtgcaggaagaggcaaaggagccccacgtcagcagtgtgcttccatggatcatactgcaccggatcatctggcaggaagaagatacattccattcactgtgtcaccaacagcaactgcagaatcccgcagaggaaggaatgtctgaaaccccgatgctgccttctagcctgatgctgctgaacactgcccacgaatatttgggcagaaggagttggtgttgcaatagcgatggcgcacttttgagattctacgtgagagtgctccagaaggaactagccgcatccacaagtgaggacacacatccctacaaggaggagctggagaccgctttggagcaatgtttttactgtctgtacagtttcccgtccaaaaagtctaaggcaaggtatctcgaggagcacagtgcacagcaggtcgacctgatttgggaagacgcactgtttatgttcgagtattttaaaccgaagacattgcctgagtttgacagctataagactagtacagtgagtgccgacttggccaatctgctgaaacggatcgctaccattgtacccaggacggagcgcccagcattgtctctagataaggtatctgcctacattgaaggcacaagcaccgaagttccttgtctcccagaaggggctgatccttccccgcctgtggttaatgaattatattatctgctggccgattaccactttaaaaacaaagaacaatctaaggctataaagttctacatgcacgatatttgtatatgtccaaacaggttcgacagctgggctggaatggcattagcacgcgcttctcgaatccaggataaactgaactcaaatgaactgaagtccgatggacctatctggaaacacgccaccccagtgctcaattgttttcgacgggcattagagattgacagcagcaacctttctctgtggatcgagtatgggacgatgagctatgccctgcactcattcgcctctagacagctaaagcagtggcgaggggagttaccacccgaattagtgcaacagatggaagggagacgggactccatgctggaaacagccaaacattgctttacctccgcagcccgttgtgagggagacggggacgaggaggagtggctaattcactatatgctcggcaaggtggccgaaaaacagcagcagccccctacggtgtacctcttgcactataggcaggctggacactaccttcacgaagaagccgctaggtatcctaaaaagattcattatcataacccacccgagctggccatggaagccttggaagtgtacttccggctccacgcaagcatcctcaagctgttgggaaaacctgacagcggggttggggctgaggtactggtgaacttcatgaaagaggctgctgaggggcctttcgccagaggtgaggagaaaaataccccaaaggctagcgagaaagaaaaggcttgtctcgtggacgaggatagccacagcagcgccggaactctcccgggacccggtgcaagtctgcccagctccagtggaccaggactcacctccccaccctataccgctaccccaatcgatcacgactatgtgaaatgcaaaaaaccacaccagcaggccacacccgacgacaggagtcaggacagcactgccgtggcgctgtcagactcttcttccacccaggacttcttcaacgaacctacaagcctcttggaaggatctcggaaatcctatacagagaagagactgccaattctctcctcccaagctggagccacagggaaagatctgcagggggctacagaggagcgcggtaagaacgaagaatcactggaatcgaccgaggggttcagagctgcggaacagggggtgcaaaagccagcagctgagactcctgccagcgcttgtatccccggaaagccgtctgcaagcactccaaccttgtgggacgggaaaaaacgcggagatctcccaggtgagcccgtcgccttcccccagggtctccctgccggagcagaggagcagcggcagttcctcaccgaacaatgcatcgcaagctttagactctgcctgtcaagattcccccaacactacaaatctttgtacagactggcatttttgtatacatactctaagacccatcgcaatttacagtgggcacgggacgtacttttagggtcatctatcccatggcagcagctccagcatatgccagctcagggactgttctgcgagcggaacaagaccaacttcttcaacgggatctggaggatccccgtggacgagatcgacaggcccggaagttttgcttggcatatgaaccggtcaattgttcttctgttaaaggttctggcccaactccgtgaccactcgactctgcttaaggtaagctccatgttgcagcgcactcccgatcaaggtaaaaagtatctcagagacgctgatagacaggtgctggctcagcgcgcattcattctgacagtgaaggtcctggaggacaccctctctgagttagcggaagggagcgagagacctggccctaaggtgtgtgggctgcctggggctaggatgaccaccgatgttagccacaaagcctcgcccgaggacgggcaagaggggctgcctcagcctaaaaaacctcccctggcagacgggtctggtcccggacccgaacctgggggaaaggtggggttactgaatcatcgtcccgtagccatggatgcaggtgactctgccgaccaatcgggggaacgcaaggacaaggaatcacctagagccggacccaccgaacctatggacactagtgaagcaacggtctgccatagcgacttagaacgcaccccccctctcttgcccggacggccagcccgagatagagggccagaatctcgaccaactgaattgtccctggaagagctgtcgattagcgccaggcaacagcccactccactaactcctgcccagccggcacccgctccagcccctgcaactactacaggcacaagggctgggggtcacccagaagagccactctcccggctgagtcgcaagaggaagttgttagaggatactgaatccggtaagacactcctgctcgatgcctacagagtatggcagcaaggccagaaaggggtcgcatatgacctaggaagagtcgaacggattatgtcggaaacctatatgctgatcaaacaagtggacgaggaagccgcactggagcaggcagtaaaattttgccaagtccatctcggggctgctgcacaacgacaggcttctggtgacacccctaccactccaaaacaccccaaagattctcgggaaaatttcttccctgtgaccgtggtacccaccgctccagacccagtgccggctgatagtgtccagagaccttcagatgctcacaccaaacctcgacctgccctggctgccgctaccaccatcataacgtgccccccttcggctagtgccagcaccttggaccagagcaaggatcccggtccgcctcgacctcacagaccagaagccaccccttctatggcttctttgggaccagaaggcgaggagttggccagagtcgcagaagggactagtttcccgcctcaggagcccagacacagcccacaagtcaagatggcccctacctcttcgcctgcagagccccattgctggcccgcagaggcagccctcggaactggagccgaaccaacatgcagccaggagggaaaactgcgccctgaaccccgtagggatggcgaggcgcaagaagcagcatcggagacacaacccttaagttccccacctactgccgcatcttccaaagccccatcttcaggatctgcccagccgcctgaaggccacccgggaaaaccagaaccgtcaagggccaaatctaggccacttcctaacatgccgaaactagtgatcccatctgctgcaaccaagttcccacccgaaatcactgtcactcctccaacaccaaccctcctatcgccaaaaggaagcatctcagaagagacgaagcagaaactgaagtctgctatactaagtgcacagtccgcggcaaacgttcgcaaggagtccctatgccagcccgctctggaagtgctggagacatcttctcaagaaagcagtctggaaagcgaaacagatgaggacgatgattatatggacatata

SEQ ID NO: 216503 - DNA, 1770 bp, Artificial Sequence
  Description of Artificial Sequence: Synthetic coding sequence
atgccgagacgttccaggcgcggaatatggcgcatcccagtagacgagattgatcgacctggctcatttgcatggcacatgaatcgctctatcgtgctgttgctgaaagtcctcgcgcagttgagagatcattcaactctcctaaaagtctcctcaatgttacagcggacacctgaccagggtaaaaaatacctccgagacgcagacaggcaggtgctggcccaaagagcgttcatactgacggtgaaagtgctggaggataccctatcagagctcgcagagggcagcgagcgacccggtccaaaggtgtgtgggcttccgggagccagaatgactactgacgtttctcataaagctagtcccgaggacggtcaggaaggcttgcctcagcctaaaaagcctcctttggcagacggatccgggccaggccctgagcccggtggcaaagtcggcctccttaaccacaggcctgtggccatggatgccggtgactcagcagaccagagcggtgagagaaaagacaaagagtccccgcgagccggtccaacagaacctatggatacctctgaagccactgtgtgccactcggatctagagcggactccccctctactccccggaagaccggctagggatagagggccagagtctcgtcctacagagctatccctcgaagagctgtctattagcgcgaggcagcaaccaactcctctcactccggcacagccggctcctgctcccgcacctgcaacaacaaccggaaccagggcaggtggccaccctgaggagccactgtctaggctatcaagaaaacgcaaactgctggaggacactgaaagcgggaagacgttactcttggacgcttatagagtctggcagcagggccaaaagggagtggcatacgacctgggcagggtggaacgtatcatgtccgaaacatacatgcttattaaacaggtcgacgaagaagctgctctggagcaggccgtgaagttctgccaggtccacttaggactccccccacgcgacagacctagggataccccaaccacccctaaacaccccaaagatagtagagaaaatttttttcccgtgacagtcgtccccacagctcccgacccggtgccagcggactctgtacagcgaccctccgatgctcataccaaacccaggcccgctttagcagcagccaccacaatcatcacgtgccccccttctgcttccgcctctaccttggatcaatctaaggaccctgggccacctaggccacacaggcccgaggccaccccatctatggcctcattgggccctgagggcaaactccggccagagccaaggcgggacggcgaagcccaggaggccgcttcagaaacccagccccttagttcccctcctaccgctgcctcttctaaggccccaagttccggcagcgcacagcccccagagggacaccccggtaagcccgaaccctcgcgcgctaagtcaagacccctgcctaacatgcctaaactcgtgatcccttcagctgcaaccaagtttcctcccgagattacggtgactccccctactcctactttgttatctccaaagggtagcatttctgaggaaactaaacagaaactgaagtctgcaatcctctcagctcagtctgctgcgaacgtgcgcaaagagtccctctgccagcccgctctcgaagtgttggagacttccagccaggaaagcagtctggagtccgagacagatgaggacgacgattacatggatatttag

SEQ ID NO: 216504 - DNA, 1224 bp, Artificial Sequence
  Description of Artificial Sequence: Synthetic coding sequence
atgatacggatcgccgctcttaatgcttcctcgacaattgaggacgatcatgaaggatctttcaagtcccataaaacacagaccaaggaggctcaggaggctgaggcatttgcgctgtatcataaggctctcgacttgcaaaaacacgacaggttcgaagagagcgcaaaagcataccacgagctgctagaggcctcgttgctgagagaggctgtttcctccggagatgagaaggaggggctaaaacatcccggtttgatccttaaatactcaacatataagaacctcgcccaactggcggctcaaagagaggacttggagaccgccatggagttctaccttgaggcagtgatgttggatagtacggacgtgaatctttggtacaagataggacacgtggctctgagattgattagaattccactcgctagacatgcatttgaggagggcttgcgatgcaatcctgatcactggccatgtctggacaatcttatcactgtactgtacactctctctgattataccacttgtctctacttcatctgtaaagccctggaaaaagactgtagatattccaaaggccttgtgttgaaggaaaagatatttgaggagcagccttgtcttcgcaaagattcactcagaatgttcttgaaatgtgatatgtccatacatgacgtcagtgtcagtgcagcagaaacccaggccattgttgacgaggctctgggactgcggaagaaacgccaggcacttatcgtgagagagaaggagcctgatctcaaactggttcagccgataccattttttacttggaagtgtctgggagagtcactcctcgctatgtataatcacctcacaacttgcgagccaccgaggccatccctgggcaagcgcattgatctgagcgattaccaggacccaagtcagcccctcgagagctccatggtcgtgacacctgtaaatgttattcagccaagtacagttagtaccaaccctgcagtggccgtggccgaaccagtggtgagttacacctccgtcgccaccacatcctttcccctccacagccccggactgctagagaccggtgcccctgtgggcgatattagcggcggtgacaagagcaagaagggagtgaagagaaaaaagatttcggaggagtcgggtgagacggctaaaagacgatcagctagggtgcggaataccaaatgtaaaaaagaggaaaaatag

SEQ ID NO: 216505 - DNA, 1527 bp, Artificial Sequence
  Description of Artificial Sequence: Synthetic coding sequence
atgcaattctcaggcgaaaagattagcggccagcgcgacctccagaagagtaagatgcgatttacatttacttctaggtgtttggctctgtttctgttattgaaccaccctacccctatactgccggcattctccaaccaaacctaccctactattgaacctaagccattcctgtatgttgtggggcgtaaaaagatgatggatgcgcagtacaaatgctacgaccggatgcagcagcttcctgcctatcagggcgagggcccttattgtaacagaacctgggacggatggttgtgttgggatgatacaccagctggagtcctgagttaccagttttgtccggactactttcccgattttgacccttctgagaaagtcaccaaatactgcgatgagaagggcgtatggttcaaacatccagagaacaatcgaacgtggagcaattataccatgtgcaatgctttcacccctgagaagctgaagaatgcgtacgttctgtactacctggcaattgtcgggcactctctgtctattttcaccctggtgataagccttggaatcttcgtctttttccgcaagctcaccacaatcttcccgctgaactggaagtatcggaaggcacttagccttgggtgccagagagttactctacataagaatatgttcctgacctatattctgaactctatgatcattataatccacttggtggaggtcgtgccgaatggtgaactcgttcgcagagatccagtgtcctgcaaaatcctccattttttccatcagtatatgatggcttgtaattacttttggatgttgtgcgagggcatttacttacacacattaattgtggtggccgtgttcacggaaaaacagcggctgcgatggtactaccttctcggttggggcttcccgctggttcccactacgattcatgctatcacgcgggctgtatatttcaacgataactgctggctctctgtggagactcatctgctctatatcattcatggaccagtcatggctgcactggtcgttaacttcttttttctgctgaatatagtacgcgtgttagtaaccaaaatgcgagaaacacacgaggcggagtcgcacatgtacttgaaggctgtcaaggccactatgatcctcgtccccctgctgggcattcaatttgtcgtgttcccttggcgcccttctaataagatgttgggtaaaatctatgattacgtgatgcactccctgattcattttcagggcttttttgtggcgaccatttattgtttctgcaataatgaagtgcagactacggtgaagagacagtgggcacagttcaaaatacagtggaatcagcgttgggggaggaggccaagtaataggagtgcacgagctgctgccgcagctgctgaggccggagatattcccatctacatctgccatcaggagctcaggaacgagccagccaacaaccagggagaggagtccgcagagatcattcctctgaacataattgaacaggagtccagcgcatag

SEQ ID NO: 216506 - DNA, 1473 bp, Artificial Sequence
  Description of Artificial Sequence: Synthetic coding sequence
atgaggttcacattcacctcccgctgcttagctctcttcctcttgcttaaccacccaacccctatactcccagctttctctaatcagacatatcctacgatcgagcctaagccgtttctttacgtcgtggggaggaagaaaatgatggacgcccaatataagtgctacgaccgaatgcagcagcttcccgcttaccagggagaaggcccttactgtaatcgaacttgggacgggtggctgtgctgggatgatactccagccggtgttctatcttaccaattttgccctgattatttccccgattttgatccatccgagaaagtaaccaaatattgcgatgaaaaaggagtgtggttcaagcacccggaaaataacaggacctggtctaattacaccatgtgcaacgccttcacgccagagaaacttaaaaatgcatacgtattgtactacctggccatcgtggggcattccctgtcaatctttaccctcgtcattagcctaggaatctttgtgttcttccgcaagctaaccaccattttccctttgaattggaaataccgcaaagctttaagcttggggtgccaacgcgtaaccttacacaagaatatgttcctcacttacatcctcaacagcatgattatcattatccacctggtggaggtggtgcccaatggggagctggtgcggagggatcctgtttcttgcaaaatactccacttcttccatcagtatatgatggcatgcaattacttctggatgctgtgcgagggtatttacctacacacactcatagtggttgccgtcttcacggagaagcagcgattgcgatggtactacctgctgggctggggctttcccttggtccctaccaccatccacgccatcactcgggctgtctactttaatgacaactgttggctgtccgtggaaacgcacttattgtacataatccatgggccagtaatggcagctttagtggtgaattttttttttctcctgaatatagtcagggtgttggtcactaaaatgagggaaacccatgaggcagaaagccacatgtacctcaaagccgtgaaggcgactatgatcttggtgcccctgctgggaatacaatttgtcgtcttcccctggcggccttccaataagatgctcggtaagatctacgactacgtcatgcacagtcttattcacttccaaggcttttttgttgcaactatatactgcttttgcaacaacgaagtgcagacgaccgtgaagcggcagtgggcacagttcaagatccagtggaatcagaggtggggcaggcggccatcgaaccgatcagctagagctgcagcggctgcagcagaggcaggcgatattcctatttatatctgtcatcaggagctgagaaatgaacctgccaataaccaaggcgaagagagcgccgagatcataccgctcaacataattgagcaggaaagttccgcctag

SEQ ID NO: 216507 - DNA, 1425 bp, Artificial Sequence
  Description of Artificial Sequence: Synthetic coding sequence
atgcgcttcaccttcactagccgttgcctcgccctgttcctccttctgaatcacccaacccctatactgccagccttcagcaatcagacataccctactatagagcctaagccattcctgtacgtcgtgggcagaaaaaagatgatggatgcgcagtataagtgttatgaccgtatgcagcagctgcctgcctatcagggcgagggcccttactgcaaccggacttgggatggttggttgtgttgggacgacacaccagccggtgtcctcagttaccagttctgcccagattacttcccggactttgatcccagtgagaaagtcacaaagtattgtgacgagaaaggtgtttggttcaagcatcccgaaaataataggacgtggtctaactataccatgtgcaacgcctttacccccgaaaaactcaagaatgcgtacgttctgtattatttagccattgtcggccactccctgagtatatttaccctggtcatttccctcgggatttttgtcttcttcaggtcacttggctgccagcgtgttacgctgcataaaaacatgtttctgacgtacatcctcaactctatgattatcataattcatctggttgaggttgtgcctaacggcgagctggtgagacgtgatccagtgtcatgtaagattctgcattttttccaccagtacatgatggcgtgtaactacttttggatgctctgcgagggcatctacctacacactctgatcgtcgttgccgtgttcaccgagaaacagaggctgcgttggtattatttacttggatggggtttcccattagtacccaccacaatccatgcaatcactcgcgcagtttattttaatgataattgttggctgtcagtagagactcatctgctctacatcatccacggacccgtgatggctgccctcgttgtgaacttcttcttccttttaaacatcgtgcgagtccttgtgacgaagatgcgcgagacacatgaagccgaatcacatatgtatctcaaggccgttaaagccacaatgatcctggtgccacttttgggcattcagtttgtagtatttccctggaggccgagcaataaaatgcttggaaaaatatacgactacgtgatgcattctctgattcatttccagggattttttgttgccacgatttactgtttctgtaataacgaagtacagacgacggtcaaaaggcagtgggctcagtttaaaatccaatggaatcaacgttggggacgccgaccctccaatagatccgcacgcgcagccgctgccgctgcagaggccggagatattcccatatacatctgtcatcaggagctcagaaatgaacccgctaataaccagggcgaagaaagcgccgagattatcccactgaatattatcgagcaagaatcttctgcatag

SEQ ID NO: 216508 - DNA, 825 bp, Artificial Sequence
  Description of Artificial Sequence: Synthetic coding sequence
atgcggttcacgtttacttcccggtgtctagcccttttcctccttttaaaccaccctaccccaatattgcccgcattttctaaccagacttacccgacgattgagccaaaacccttcctctacgtagtgggcagaaagaagatgatggacgcccaatacaaatgctacgatagaatgcaacagctgcccgcatatcagggcgaaggaccctactgtaacaggacctgggatggctggttatgttgggatgatacccccgcaggcgttctgtcctaccagttctgtcccgattacttccccgatttcgacccgagcgagaaagttacaaaatactgcgatgaaaagggggtgtggttcaagcacccagagaataaccgaacttggtcgaattatactatgtgcaacgctttcacaccagagaaactgaagaatgcttacgtgctgtactaccttgcaatcgttggtcattctctgagtatttttactctggtgatttcactgggcattttcgtgttctttaggtcactagggtgtcaacgcgtgacgctgcacaagaacatgttcctgacatacatccttaacagcatgatcattattatccatttagtagaagtggttccaaatggagagctcgttagacgtgaccctgtttcatgcaaaattctccatttttttcaccagtacatgatggcatgtaattacttctggatgctgtgcgaggggatctatttgcatacactgatcgttgtggcagtcttcaccgaaaagcaacgtcttcgatggtactatttgctgggctgggctcctgccttccacagggattag

SEQ ID NO: 216509 - DNA, 1473 bp, Artificial Sequence
  Description of Artificial Sequence: Synthetic coding sequence
atgaggtttacgtttactagcaggtgcctcgcccttttcttgctgctcaaccacccaactcctattctccctgccttcagcaatcaaacctatccaaccattgagcccaagccctttttgtacgttgtgggcaggaagaaaatgatggacgcccagtataaatgctacgaccgaatgcagcagctgcccgcatatcaaggggagggtccatactgtaacaggacttgggacgggtggttgtgctgggacgacacccctgcaggagtgctctcctaccagttctgtcctgactactttcctgactttgaccctagcgaaaaagtgaccaagtactgtgatgagaagggtgtgtggttcaagcaccccgagaacaacaggacttggtcaaattacactatgtgcaacgcctttacccccgagaagctgaagaatgcctatgtgctctactacttagcaatagttggtcattctctgtcaatcttcacactggtgatttccctggggatttttgtattttttcggaagctgacgaccatctttccgttgaactggaaatatcggaaagcgttaagcctggggtgccagcgcgtaacactgcataaaaatatgttcctcacctatattctgaatagtatgattattatcattcatctggtagaggtcgtgcccaatggggaattagtccggagagatcccgtgtcttgcaagatcttgcacttttttcatcagtacatgatggcttgcaattatttttggatgctgtgcgaagggatctatctgcataccctcatagtcgtggcagtgtttactgaaaaacagaggctgcggtggtactatctgttgggatggggcttccctctggtccccaccactattcacgctataacccgagcggtgtatttcaatgacaattgttggctgtctgtggaaacccatttactatacattattcacgggcctgttatggctgcactcgtcgtgaatttcttcttcctgcttaatatagtgcgggtgctcgtgacaaagatgcgggagactcacgaggcagaaagccacatgtacctgaaagcagtgaaagctactatgatcctggtgcctcttttggggatacaattcgtcgtctttccttggcggccatcaaacaagatgcttggcaaaatctacgactatgttatgcactccctgatccattttcagggtttctttgtcgcgaccatatactgtttctgtaacaacgaggtgcaaaccaccgtcaagaggcagtgggctcagttcaaaattcaatggaatcagaggtgggggcgacgcccttctaatagatcagctagagcggctgctgccgcagcggaggctggggacataccaatctacatttgccatcaagagcttcgcaacgagccagcgaataaccagggagaggagtctgcagaaatcattcccctgaatataattgagcaagagagcagcgcatag

SEQ ID NO: 216510 - DNA, 873 bp, Artificial Sequence
  Description of Artificial Sequence: Synthetic coding sequence
atgcgctttacctttacctcacggtgtctggctttatttctactgctaaaccaccctaccccaatcttgcctgcattcagtaatcaaacgtacccaactattgagcctaagcctttcctctatgtcgtcggtagaaaaaaaatgatggacgcccagtacaaatgttatgatcgaatgcagcagctgcccgcataccagggggaaggcccttactgtaaccgcacgtgggacggatggctgtgttgggacgataccccggcaggggtactgagctaccagttctgccctgattacttccccgacttcgatccaagtgagaaggtcacgaaatactgtgatgaaaagggggtatggttcaaacaccctgagaacaatagaacttggtccaattacactatgtgtaatgcgttcacgcccgaaaagttgaagaatgcgtatgtgctgtactatctcgcaatcgtgggacatagcctgtcaattttcacattggtgatttcactgggcatattcgtgtttttccgaaagttgacaaccattttccctttgaactggaagtacaggaaagccctgtcactgggctgccagcgggtgacactccacaagaacatgtttctgacctatatactcaattctatgatcatcattattcatctggtcgaggtggtgccaaacggcgagctggtgaggcgagatccagtctcctgcaagatcctgcattttttccatcaatacatgatggcttgcaactacttctggatgctctgcgaaggtatctatctgcatactttaattgttgtcgctgtgttcacagagaagcaaagactccgatggtattatctcctcggatgggctccggctttccatagggattag

SEQ ID NO: 216511 - DNA, 1425 bp, Artificial Sequence
  Description of Artificial Sequence: Synthetic coding sequence
atgagatttactttcacatcacggtgcctcgccctgtttctgctacttaaccatccgacaccaattctgccagcgtttagtaaccagacctaccccactattgagcccaagccttttttgtacgtggtggggcgaaaaaagatgatggatgcccagtacaagtgttatgacaggatgcagcagctgcccgcatatcaaggagagggcccatactgcaatagaacctgggacggctggctctgctgggacgatacaccagcaggcgtgttgtcctaccaattttgccctgattactttcccgatttcgacccttcagagaaggttactaaatactgtgacgagaagggggtttggtttaagcatcctgaaaacaacagaacttggtcgaattacacaatgtgtaacgcatttaccccggaaaaactgaaaaatgcgtacgtgctctattatcttgctattgtcggccactccctgagtattttcaccctggtcatctcactaggcatcttcgtcttcttcaggagtctaggctgccagagggtgaccctgcacaaaaatatgtttttgacgtacatcttgaattccatgattataatcatacacctggttgaggtcgtccccaatggcgagctcgtcagacgggatcctgtgtcatgtaaaattctgcatttctttcaccagtatatgatggcatgtaattacttctggatgctgtgtgaaggcatttacttacataccctaattgtggtggccgtttttactgaaaaacagcgcttgagatggtactacttgctagggtggggcttcccactggtaccaacaaccattcatgccattactcgtgccgtttactttaacgacaactgctggctgagcgtcgagacccacctcctttacatcatccacggacccgtgatggccgcactggtcgttaacttctttttcctgctgaacatcgtgagagtcctcgtaacaaagatgagagagacgcatgaagctgagtcccacatgtacctgaaggccgtgaaagctaccatgatcctggtccccttgctcggcattcagttcgtcgtgtttccctggcgtcctagcaataagatgctcgggaagatttatgactacgttatgcactcacttatccatttccagggattcttcgtggctaccatttattgcttctgcaacaatgaggtccaaaccaccgtcaaacgtcaatgggcccaatttaagattcaatggaaccagcggtggggccgaagaccgtcaaaccgctcagcacgggctgccgcagccgcagcggaagctggcgacatccctatttatatctgtcatcaggagctgcgaaatgagccagccaacaatcagggggaagaatctgctgaaattatccccctgaatattatagagcaggaaagcagcgcttag

SEQ ID NO: 216512 - DNA, 489 bp, Artificial Sequence
  Description of Artificial Sequence: Synthetic coding sequence
atgagatttacctttacttctcgctgccttgccctcttcctactgcttaaccaccccacacctattcttccagcgttctcaaatcagacatatccgaccattgagcccaaaccctttctgtatgtggtaggacgcaagaaaatgatggacgcacagtacaagtgctatgataggatgcagcagctgcctgcctatcagggggaggggccttactgcaatcgcacttgggacggatggctgtgttgggatgacacccctgcgggagttctgtcttatcagttctgtcccgattattttccagactttgatccgtccgagaaagtcacaaagtattgtgacgaaaagggcgtgtggttcaaacaccctgagaacaataggacctggtctaattacacaatgtgcaatgcttttactcccgagaagctcaaaaatgcctacgtgctgtattatcttgccatcgtcggccactcttgtcaattttcaccatag

SEQ ID NO: 216513 - DNA, 1386 bp, Artificial Sequence
  Description of Artificial Sequence: Synthetic coding sequence
atggagaaaaaatgcaccttgaactttctggtgcttctgccgttctttatgattctagtcactgccgagcttgaggaaagccccgaagatagcattcagcttggcgtaaccagaaacaagattatgaccgcccaatatgagtgctaccagaagattatgcaggatcccattcagcaggcagagggggtgtactgcaacagaacatgggatggttggctgtgctggaacgatgtcgcagcaggcacagaatctatgcaactgtgcccagactattttcaggactttgacccctcagagaaggtgacaaagatctgcgatcaggatggcaactggtttcgtcaccctgccagtaatagaacctggacaaattacacccagtgcaacgtgaacacacatgagaaagtcaagacagctcttaatctgttctatctcactattatcggtcacgggctatcgatcgctagcctactgataagtttggggattttcttctacttcaagtccttatcctgccagagaatcaccctgcacaagaatctgttcttctcattcgtctgcaactctgtggtgacaataattcacctcacggcggtggctaacaaccaagcactggtggcaaccaacccagtgtcatgtaaggtctcccagttcatacacctatacctgatgggatgcaattacttttggatgctttgcgaaggaatctacttgcacaccctgatcgtggtcgctgtgtttgcagaaaagcagcacctgatgtggtattacttcttaggttgggggttccctctgattcccgcttgcatccacgccattgccagatctctctattataatgacaactgttggatatcatcagacacacatcttttgtacatcatccacggccctatttgcgccgcattactcgttaacttatttttcctcttgaatatcgtccgggtcttgataaccaaattaaaggtgacccaccaggcggaatccaacctttacatgaaggccgtgagggccactctcatcctcgtgcccctcctcgggatcgaattcgtgctcatcccctggcgaccagagggtaaaatcgcagaagaggtctatgactatattatgcatattcttatgcatttccagggcttattggttagcacgatattctgtttttttaacggggaggtgcaagcaatcttgcggagaaattggaatcaatacaagatccagttcggcaattcctttagtaactcagaggccctgcggagcgcctcttacacagtgtccacaattagcgacggcccaggttactctcacgactgccctagcgaacacctgaacggcaagtctattcacgacattgagaacgttcttctcaagccagaaaacctgtacaattag

SEQ ID NO: 216514 - DNA, 1386 bp, Artificial Sequence
  Description of Artificial Sequence: Synthetic coding sequence
atggaaaagaaatgtacactgaattttttggtcttgctacctttctttatgatactggtaacggctgagcttgaggaaagccctgaagactctatccagctgggagtgactagaaacaaaatcatgaccgcccaatacgagtgctatcagaagattatgcaggatcccattcagcaagccgagggggtatattgcaatcgcacctgggatggctggctctgctggaatgatgttgcagctggtactgagagcatgcagctctgcccagactactttcaggactttgaccccagcgagaaggtcacaaagatatgcgaccaggacggaaattggtttcgccatcctgcgagcaatcggacatggactaattacactcagtgcaatgtgaacacacatgaaaaagtgaaaacagcgctgaatctgttttacctaacaattattgggcacggtctgagtatagccagtctccttatttccctgggcatatttttttacttcaaaagcctcagctgtcagcggatcaccttgcataaaaatttatttttttccttcgtttgcaattcagtcgtcaccattatacacctcactgcagtggctaacaaccaagcactggtcgcgacaaatccagtttcttgcaaagttagccagttcattcacttatacctgatgggctgtaattacttctggatgctgtgcgaaggcatatatctgcataccttaatcgtggtggcagtgttcgccgagaagcagcacctgatgtggtactattttctcggctggggattccccctgattccagcttgtattcatgcgatcgcgagatcactttattataatgataactgctggatatcctccgacacccatctcctgtacatcatacatgggcctatttgcgctgcgctcctcgtgaacttgttcttcctgctgaacatcgtcagggttttgattactaaacttaaggttacacatcaggccgagtcgaacctctatatgaaggctgtcagggccacactaatcctcgtgcctctgttgggaattgagtttgtcctcattccttggagacccgaaggaaaaatagccgaggaggtatatgattatattatgcacatcctaatgcacttccagggcctgctagtgtctaccatcttctgtttttttaatggcgaagtccaggcaatcttacgaaggaattggaaccagtacaagattcagttcggcaatagtttcagtaattcagaagcccttagatccgctagctatactgtgtcaaccatttctgatggacctgggtactcccacgactgcccaagcgagcacctcaatgggaagtccattcacgacatcgaaaacgtgctgctgaagcctgaaaatctctacaactag

SEQ ID NO: 216515 - DNA, 1386 bp, Artificial Sequence
  Description of Artificial Sequence: Synthetic coding sequence
atggaaaaaaagtgtaccctcaattttctagttctgctacccttcttcatgattcttgtgacagccgagcttgaggaatcccccgaggactctatacagctgggcgtgaccaggaataagattatgacagcccagtacgagtgttaccagaagatcatgcaggaccctatccagcaagccgaaggcgtgtactgcaaccgcacttgggacggatggctgtgttggaacgatgtagccgctggaaccgagtctatgcagctgtgtccagactattttcaggatttcgaccctagcgagaaagttaccaagatctgtgaccaagatgggaactggtttaggcacccagcaagtaaccgtacttggacaaactacacccagtgcaacgtaaacacgcacgagaaagtgaagacggccttgaacctattctacctcaccatcattggtcatggattgtcaattgcctctctgctgatttccttaggaatcttcttttattttaaatccctttcttgtcaaagaatcacgcttcacaaaaatctgttcttcagcttcgtgtgtaactccgtcgtgaccattatccacctgaccgccgtagcgaataaccaggcgctcgtggcgaccaatcccgtgtcctgcaaggtatctcagtttattcacctgtatctcatgggatgcaactatttctggatgctgtgcgagggcatctatctacatactttgatcgtggtcgccgtgttcgctgagaaacagcatctaatgtggtattactttctgggctggggcttccccttgattcccgcatgcatccatgccatagctcgcagcctgtattataacgacaattgctggatctcctccgatacacacctgctgtatatcatccacgggccaatatgtgcagccctcctggtgaacctcttctttctgcttaatatcgtgcgtgtgctgattacgaagctgaaagttactcaccaggcagagtccaatctttacatgaaggccgtgcgggctaccctcattctcgtgcccttactaggcatcgagtttgtgcttatcccctggcgccctgagggaaagatcgctgaagaagtctatgactacattatgcatattctcatgcactttcaagggctgctcgtctctacaatcttctgcttctttaatggagaggttcaagctattctacgcaggaactggaaccagtataaaattcagttcggcaattccttttctaactcagaggctctccgatcagcttcctacaccgtgagcaccattagcgatggcccaggatactcccacgattgccccagtgagcatctcaatggtaagagcatccacgatatcgagaacgtgttgttgaaacccgaaaatctctataactag

SEQ ID NO: 216516 - DNA, 114 bp, Artificial Sequence
  Description of Artificial Sequence: Synthetic coding sequence
atggaaaaaaagtgcacccttaacttccttgtgctgctacctttttttatgattttggtgacagctgagctggaggagtcacccgaagactccatccagttgggggtcacctag

SEQ ID NO: 216517 - DNA, 237 bp, Artificial Sequence
  Description of Artificial Sequence: Synthetic coding sequence
atggagaagaaatgcactctgaattttctcgtcttactgccttttttcatgattctggtgactgccgagttagaggaaagccctgaggacagcatacaattgggcgtgacacgcaataagatcatgactgcacagtatgaatgttatcagaaaatcatgcaggatcctatccagcaggcagaaggtgtgtactgcaatcggacctgggacgggtggctctgctggaacgatgtatag

SEQ ID NO: 216518 - DNA, 426 bp, Artificial Sequence
  Description of Artificial Sequence: Synthetic coding sequence
atgggctttcagaagttttcccccttcctggccctgtcaatcctggtcctcttgcaagccggaagcctgcacgccgctccctttcggtccgcacttgagagctctccggctgaccctgctaccctcagcgaagatgaagctcgcctcctgcttgctgccctggtacagaactacgtccagatgaaggcctccgaattggagcaggaacaggaaagggagggctcttcactggacagccccagatcaaaaaggtgcgggaatttatccacctgcatgttgggaacttatactcaggatttcaacaaatttcacacattcccccagaccgccataggggttggtgcaccaggcaaaaagagagatatgtcaagtgatctggagagggatcaccgtccacatgtgtccatgcctcaaaatgccaattag

SEQ ID NO: 216519 - DNA, 426 bp, Artificial Sequence
  Description of Artificial Sequence: Synthetic coding sequence
atgggtttccaaaaattttctccatttctggccctcagcattctggtcctgttgcaagcaggtagccttcacgctgccccattcagatcggcacttgaatctagccccgcagaccccgctacactaagtgaagatgaagctcggctgcttctagctgccctggtgcagaattacgtgcagatgaaggcaagtgaactggagcaggagcaagaacgcgagggttcctccctagacagtcctaggtccaagcgatgtggcaacctgtctacctgcatgttaggaacctatactcaagactttaataaattccatacttttcctcagaccgccatcggcgttggggcaccgggaaagaagagggacatgtcatcagacctggaacgggatcataggccgcacaaccactgcccggaagagagcctgtag

SEQ ID NO: 216520 - DNA, 387 bp, Artificial Sequence
  Description of Artificial Sequence: Synthetic coding sequence
atgggcttccagaagttctccccatttctggccctatcaatcctggtcctgcttcaggctggctccctgcacgccgcaccctttcgaagcgccttggagagtagccccgcagaccccgctactttatcagaggacgaggctcgcctactattagccgcattggtccagaattacgtgcagatgaaagcatctgaattagagcaggagcaagagagagagggcagccgcattatcgcgcaaaagcgagcctgtgataccgccacctgtgtgacccatcgcctggcaggactcctgtctcgctcaggcggtgtggtcaaaaacaattttgtgcccacaaacgtgggcagtaaagcttttggcaggagacggcgagacttgcaggcatag

SEQ ID NO: 216521 - DNA, 426 bp, Artificial Sequence
  Description of Artificial Sequence: Synthetic coding sequence
atgggctttcagaaattctcacctttcctcgccctctccatcctggttctactgcaagctgggagtctgcacgccgctcctttcagaagtgccctggagagtagcccagccgaccctgctactctcagcgaggacgaggctagattgctcctggcagcattagtacagaattacgttcagatgaaagcttcagagcttgagcaggagcaggagcgggaaggaagctcacttgattctccacggtccaagcggtgcggcaacctgtccacgtgtatgctgggcacctatactcaggattttaacaagttccacaccttcccgcagacagcaatcggtgtgggtgctcccggtaagaaacgggacatgtcatctgacctcgaaagggatcacaggccccacgtgtccatgccacaaaatgctaattag

SEQ ID NO: 216522 - DNA, 387 bp, Artificial Sequence
  Description of Artificial Sequence: Synthetic coding sequence
atgggcttccaaaaattctccccatttcttgccttgagcatcctggtcttgttgcaggcaggatcactgcacgctgcaccttttcgaagcgctttggagtcctctcctgctgatcccgctacgctaagtgaagacgaagctcggctgctattggccgcactcgtacagaactacgtgcaaatgaaggcaagcgagctcgagcaggaacaagagcgtgaaggctccagaatcatcgctcagaaacgcgcatgtgacacagcgacgtgtgttacgcaccgccttgccggactcctcagtcgatcgggaggagtggtcaagaacaattttgtccctactaatgtgggttcgaaggcattcggcagacgcaggagggacctgcaggcatag

SEQ ID NO: 216523 - DNA, 384 bp, Artificial Sequence
  Description of Artificial Sequence: Synthetic coding sequence
atgggatttcgcaaattctcgcctttcctggccctcagtatcctagtgctctatcaggcgggttccctgcaggccgcaccatttcgctctgcgctggagagcagcccagatcctgctacactctcaaaagaggatgccagacttttattggctgcattagtgcaagattacgtgcagatgaaggcttctgaactgaagcaggagcaggaaacccagggaagttcaagcgccgctcagaagagggcatgtaacacagcaacgtgcgttacccatcggctggccggactgctctcacggagcggcggaatggtcaaaagtaattttgtgcctacaaatgtcggctctaaagcattcggccgacgccgtcgcgatctccaagcatag

SEQ ID NO: 216524 - DNA, 417 bp, Artificial Sequence
  Description of Artificial Sequence: Synthetic coding sequence
atgaaaaaagaagccaatcttcagaggggtggcatgggatttcggaagttttcccctttcttagctttaagcatcttagtcttgtaccaggccggaagcctccaggccgcaccattccggagcgctcttgaatcttcacctgaccctgccacactttcaaaggaggacgccagacttctgctggccgctctggtccaggactacgtccagatgaaggcctctgagctcaaacaagaacaggagacccagggatcaagtagtgcggcacaaaaacgagcatgcaatacagcgacatgcgtcacacatagactggctggtcttcttagtaggagtgggggtatggtcaagtctaattttgtgcctactaacgttggttcgaaggcctttggcagaaggcggagggatctgcaagcttag

SEQ ID NO: 216525 - DNA, 384 bp, Artificial Sequence
  Description of Artificial Sequence: Synthetic coding sequence
atgggattcagaaagttttctcccttcctcgcactctctattcttgtcctttaccaggccggatccctgcaggctgctcccttccggtctgccctcgagtctagtccagatccagcgaccttgagcaaagaagacgctagactgctcttggcggcattggtgcaggattatgttcagatgaaggctagcgaattgaagcaagagcaggagacgcagggatcgtcaagcgctgcccagaagcgcgcttgcaatacggcaacctgcgtgacacaccgattggcaggtctgctcagccgtagcggagggatggtcaaatcgaatttcgtacctaccaatgtggggtctaaagcgtttggcagaagaaggagggacctgcaggcgtag

SEQ ID NO: 216526 - DNA, 1206 bp, Artificial Sequence
  Description of Artificial Sequence: Synthetic coding sequence
atgccagttcaactgtctgagcatcctgaatggaacgagtcaatgcactcattacgtatttctgtaggtggactaccagtcttagcctctatgacgaaggctgctgatcccaggttccgtccaaggtggaaggtgattctaacgttctttgtaggagctgccatcctgtggctcctttgtagtcaccggccagctcccggacggccacccacccacaatgctcacaattggagattaggccaggcacctgccaattggtacaacgatacatatccactgtcaccacctcaacgcacccccgcagggattcgctacaggatagccgtaatcgccgacttggacactgagtctagagcccaggaggaaaatacttggttctcctacctgaagaagggatacctgacactttcagattccggcgacaaggtagcggtggagtgggacaaagaccacggagttctcgaatctcacctggccgagaaagggcgaggcatggagctaagtgacctgattgtatttaatggcaagctatatagcgtggatgacagaaccggggtcgtctatcaaatagagggttctaaagcggtcccgtgggtgatcctgagtgatggggatggcacagtggagaagggttttaaggcggagtggctggctgtgaaagacgagcgcctgtatgtcggcggattaggtaaggagtggaccacgacgacaggggacgtggtgaacgaaaacccagagtgggtgaaagtcgtgggatacaaaggatcagtggatcatgagaactgggtgtctaactataacgccctgagggcagcagccggtatccagccacctggatacctcatccatgaaagcgcatgttggagcgacaccctgcagagatggttttttcttcctaggagagcgtctcaggagagatactccgaaaaagacgatgagagaaagggcgcaaacctgttgctcagcgcgagccctgacttcggggatatcgcagtgagccacgtgggagccgtggttcctacccatgggttcagttccttcaagttcatccctaacaccgacgatcaaattattgttgcattgaagagcgaggaagattccgggagggtagccagctatatcatggccttcactctagatgggcgttttctgctgcctgaaactaaaatcgggtcagttaaatatgagggcatcgaatttatatag

SEQ ID NO: 216527 - DNA, 1053 bp, Artificial Sequence
  Description of Artificial Sequence: Synthetic coding sequence
atgcccgttcagttgtcagagcacccagaatggaacgagtcaatgcactcactccgaatatcagtgggaggattgcctgtactggcaagtatgacaaaagccgcagacccacggttccggccaaggtccccccctcagcgcacacccgctggaatccggtatagaattgctgtcattgccgacttagacactgagtcaagggcacaggaagaaaacacatggttttcctacctcaagaagggctatctcactctttcagacagtggcgacaaggtggccgtggagtgggataaggaccacggagtactcgagtctcatctggctgagaagggtcgcggtatggaactcagcgacttgatcgtgttcaacgggaaactatattccgtggacgaccgaacaggagtggtttatcagatcgaaggaagcaaggcggttccctgggtgatccttagcgacggcgatggcacagttgagaagggtttcaaggctgagtggctagctgttaaagacgagcgactttacgtcggagggctaggaaaggaatggactacgaccacgggcgatgtcgtgaacgaaaaccccgagtgggtgaaagtcgtaggatataaaggcagcgttgaccatgagaactgggtcagtaactataatgccctgagggcagctgcgggaattcagccacctggttacttaatccatgagtcagcctgctggtccgacacactgcaacgctggttttttctgcctaggcgcgcttcacaggagcgctactccgagaaagatgatgagcgcaagggtgctaatttgctgctgagcgcctcacccgattttggagacatagctgtcagtcacgttggagccgtggtgccaacacatggattttcgtcgttcaagtttattcccaataccgatgatcagattattgtggccttgaagtcagaggaggactccggcagagtggccagctacataatggctttcaccctggatgggagatttctgctgcccgagacaaagatcggctcggtcaaatatgaaggtattgagttcatttag

SEQ ID NO: 216528 - DNA, 1206 bp, Artificial Sequence
  Description of Artificial Sequence: Synthetic coding sequence
atgccggtgcaactgtcagagcaccctgagtggaatgagagtatgcactccctcaggatatctgtcggaggtttgcctgtcctggcttcgatgacaaaagccgctgatcctcggttccgacctcggtggaaagtgatactgacattcttcgtgggcgctgccatcctgtggttattgtgttcccaccgaccggctcctggccgaccccctactcataacgcacacaactggcggctgggacaggctcccgctaactggtataatgatacttaccctctgagcccaccacagaggacccccgcaggaatcaggtaccggatcgccgtgatcgctgatctcgacacagagtcacgggcacaagaggaaaatacctggttcagttacttaaagaaaggctatttaaccctctcagactctggtgacaaggtggccgtcgaatgggacaaagaccacggtgttctcgagtctcacctggccgaaaaaggaaggggaatggagctttcagacttgatagtgtttaatggaaaactgtactccgttgacgaccggacgggcgtagtttatcaaatagaaggcagcaaagccgtgccatgggtgatcctgtctgatggtgacggaacagtggagaaaggctttaaggcagagtggctcgcagtcaaagacgaaagactgtatgtgggtggactgggtaaagaatggacaacgacaacaggtgacgtggttaacgaaaaccctgagtgggtaaaagtcgtgggatacaaagggagtgtggaccacgaaaactgggtctcaaactataacgccctgcgcgcagcagctggaattcaacccccaggctacctcatccacgagtcggcatgttggtcggacacactgcaacgatggtttttccttcctcggcgtgcatcgcaggagcggtacagcgagaaggatgacgagcggaagggcgcaaacctattgttgagcgcatctcccgattttggcgacattgccgtaagtcatgtgggtgctgtggtgcctacccacggcttttcttcatttaaatttatcccaaacacagacgaccagatcattgtcgccctcaagagtgaggaagatagcgggagagtggctagctatataatggccttcacccttgacgggcgatttcttttgccagagaccaagataggctccgtcaagtacgaaggaatcgagtttatatag

SEQ ID NO: 216529 - DNA, 738 bp, Artificial Sequence
  Description of Artificial Sequence: Synthetic coding sequence
atgcctgtgcagttgagcgagcacccagagtggaatgagtctatgcattccttaagaatcagcgtcgggggactccctgtgctcgcctccatgaccaaagccgcagacccacggttccgccctcgttggaaagtgattttgacattttttgtcggcgcagccatactgtggttactctgctctcacagacctgctcccggaaggcccccaactcacaatgcacacaactggaggttgggccaggcgccagctaactggtataacgatacctaccctctgagcccacctcaacgcactccggctggcatccgttatcgcatcgctgtgatcgcggatctcgacacagagtcccgcgcacaggaggagaacacatggttctcatacctgaaaaaagggtacttaacactgtccgactctggcgacaaggtggccgtggagtgggacaaagatcatggcgtattagagtcccatttagctgagaaaggcagggggatggagttgtctgatctgattgtgttcaacggtaagctgtattctgtggatgacaggacaggagtagtttaccaaatcgagggttccaaagcagttccttgggtgatcttatccgatggggatggaacagtcgaaaagggcgtcggcggagaatgggaagccgtgagagaaatagtccggaaacgctggcggctggtcaagcaggtctcccacgttggggtgctgggtcagtggatccagaggtag

SEQ ID NO: 216530 - DNA, 663 bp, Artificial Sequence
  Description of Artificial Sequence: Synthetic coding sequence
atgggcaattgcgcgaaaaggccatggcgccgtggacctaaggacccactccagtggctgggttcacccccacggggatcctgtccatctcccagttcatccccaaaggagcagggtgaccctgccccaggggtccaggggtattcggtgctgaacagcctggttgggccagcttgcatcttccttcgaccttctattgctgctacccaactggatagggagcttcgacccgaagagatcgaagaacttcaggtcgctttccaggagtttgatagggatcgagatggctacatcgggtgccgagagctcggcgcttgcatgagaaccctgggctacatgcccactgaaatggagctgattgagatctctcagcaaatctccgggggaaaagtggactttgaggatttcgtcgagctgatggggccaaagctgctggctgagacggccgacatgatcggagtccgggaactgcgcgacgcgtttcgggagtttgacaccaatggggacgggaggatcagcgtgggagagctgagagcggcactgaaagccctgctgggggagagactctctcaacgtgaagtagacgaaattttgcaggacgtcgatcttaatggagatgggctggtggactttgaagaattcgtgagaatgatgtcccggtag

SEQ ID NO: 216531 - DNA, 1026 bp, Artificial Sequence
  Description of Artificial Sequence: Synthetic coding sequence
atgcctttcccattcggtaaaagccacaagtcgcccgcagacatcgtgaaaaacctgaaggaaagtatggccgttcttgaaaagcaggacatctccgacaaaaaagctgagaaggccacagaggaagtatccaaaaatctagttgcaatgaaagagatcctgtacggaacaaacgagaaggaaccccagaccgaagccgtggctcagctcgcccaggaactttataatagcggcctgctcagcaccttggtcgccgacttgcagctaattgattttgaaggtaaaaaagacgtggcccagatcttcaacaacatcctgcggagacagattggcacacgaaccccgacagtggaatatatctgcactcagcagaacattttgtttatgttgctgaaaggctacgaatccccagagatagccttgaattgtggcatcatgcttcgggaatgtatccggcacgaaccactggctaagattatcctgtggtcagagcagttttatgactttttcaggtacgtcgagatgtcaacttttgatatcgcctccgacgcatttgcaacctttaaggacctgctgacccgacacaagttactgtcagccgagttcttggaacagcactatgaccgattcttctcagaatatgagaaacttctacacagtgagaattacgtgaccaagaggcagagtctcaagctgctgggcgaacttttgctagatcgccacaacttcaccatcatgaccaagtatatatccaagccagaaaacctgaagctcatgatgaacctgttgcgtgataagtctagaaacatccagttcgaagctttccacgtgttcaaggtcttcgtggccaacccaaataaaacccaaccaatcctggacatattactgaagaaccaagccaaactaatcgaattcctgtccaaattccaaaacgacaggactgaagacgaacagttcaatgacgagaagacctacctcgtgaagcagattagggacttaaagcgccctgcacagcaggaagcctag

SEQ ID NO: 216532 - DNA, 1026 bp, Artificial Sequence
  Description of Artificial Sequence: Synthetic coding sequence
atgcctttcccatttgggaaatctcacaaatcccctgccgacattgtcaaaaacctaaaagaaagcatggccgtgctagagaaacaggatatctcggacaaaaaggcagaaaaagccacagaagaggtgagtaagaacctggttgctatgaaggagatcctgtacgggactaatgagaaagaaccacagaccgaagcggtggcccagctagcccaggaattatataattcgggattactctcaactcttgtggctgatctccagttgattgattttgaaggcaagaaggatgtagcgcagatcttcaataacatcttgaggagacaaatcggtacaaggacgcccacggtggaatacatctgtactcagcagaacattctctttatgttgttaaaaggttacgagtcccctgagattgccttgaactgtgggattatgctgagggaatgcatccgccacgaacctctcgccaaaataattttgtggtctgaacagttttacgacttctttaggtatgtggaaatgtcaacttttgatatagcctctgatgctttcgcaactttcaaagacctgctgactcgccacaagctgttgagtgcggaattcctggagcagcactacgacaggttttttagtgagtatgaaaagctactccacagtgaaaactacgttacaaagcgacagagcctcaagctcttgggggagctcctgttagacagacacaattttacaatcatgaccaagtacatctcgaagccagagaatctgaagttgatgatgaatctgctgcgagataaatcgcggaacatccaatttgaagctttccatgtttttaaggtttttgtcgctaacccaaacaagactcaacctatcctcgacatacttctgaagaatcaggctaagcttatcgagtttctgtccaaattccagaatgataggacagaggatgagcagttcaatgacgaaaagacctaccttgtgaaacagattagggacctgaagaggcccgcacagcaggaggcttag

SEQ ID NO: 216533 - DNA, 1026 bp, Artificial Sequence
  Description of Artificial Sequence: Synthetic coding sequence
atgcccttcccttttggaaaatcccacaaatcccccgctgacatcgtaaaaaaccttaaagaatccatggcggttctggaaaagcaggatatttccgataaaaaagcagaaaaggctacggaagaggtgagcaagaatcttgtggccatgaaggagatcctgtacgggaccaatgaaaaagaaccccagaccgaggctgtcgctcagctcgcccaagaactgtacaatagcggccttctgtccacattggtggcagatttacaactgatcgactttgaaggcaagaaggatgtggctcaaattttcaacaatattcttaggcgtcaaattgggacccgcacgcccaccgtagagtacatctgcactcagcagaacattttgtttatgctccttaaggggtacgagtcaccagaaatcgcgctcaactgtggcattatgctgcgagaatgtataaggcacgagccactggcaaaaattatcctctggtcggagcagttttatgacttctttcgctatgtggagatgagtacttttgacattgcgtccgacgccttcgctacattcaaggatctgttaacaaggcacaaacttttgtcagccgagttcttggaacagcactacgataggttctttagtgagtatgagaagctgctgcattcagagaattacgttaccaagagacagtccctgaaactgttgggtgaactgttgttggaccgccataattttactatcatgactaaatacatcagcaaacctgagaatctcaagctgatgatgaacctcttgagggataagagcaggaacattcagttcgaggcgttccacgtattcaaggtattcgtggccaacccaaacaaaacgcagcctatcctagatatccttttgaaaaaccaggccaagctgattgaatttctaagcaaatttcagaacgaccggacagaggacgaacagtttaacgatgagaaaacataccttgtcaaacaaatccgcgaccttaagagacctgctcaacaggaggcctag

SEQ ID NO: 216534 - DNA, 1014 bp, Artificial Sequence
  Description of Artificial Sequence: Synthetic coding sequence
atgaaaaagatgcccctgttttcgaagagtcacaagaaccccgcagagatcgttaaaatcctgaaagacaacctcgcaatactggagaagcaggacaagaagacagacaaggcatccgaagaggtgtccaagagtctgcaggcaatgaaggaaatcctgtgcggcacaaacgagaaagaaccgcctacagaagccgtggcccaactcgctcaggaactatactcttcaggcctgttggtgacacttatagctgaccttcagttgatcgactttgaaggaaagaaagatgttacgcagatctttaataacatcctgcgccgtcagatcggtacgcggtctcctaccgtggagtacataagcgcacatccccacatcttgttcatgttgttgaaaggttatgaagcccctcagattgccctgagatgcggcattatgctgcgcgagtgtatccggcacgagcctttggcaaagatcatcctctttagcaatcagtttcgggatttttttaagtatgtggaactttccacgtttgatatcgcaagtgacgcatttgctacattcaaggatctgctcacacgccataaagttttggtcgctgattttctggagcagaattacgataccatatttgaggattacgaaaaacttctacagtccgagaattacgtaacaaagagacaaagccttaagctactgggcgagttaatccttgataggcacaactttgcaatcatgactaagtacatctcaaaacctgagaaccttaaactcatgatgaatcttctaagggataaatcccctaacatacagtttgaagcgttccacgtcttcaaggtctttgttgcttctccccacaagactcaacctatagtggagatccttctgaagaaccagcccaaactgatcgagttcctgtcatcatttcagaaagagcggactgacgatgagcagtttgctgacgaaaagaactacctcattaaacaaatcagggacctcaagaaaactgcgccttag

SEQ ID NO: 216535 - DNA, 1014 bp, Artificial Sequence
  Description of Artificial Sequence: Synthetic coding sequence
atgaagaagatgcctctatttagcaaaagccacaagaacccagcggagattgtcaagattctgaaagacaatctggcaatactggagaagcaggacaaaaagactgataaggccagcgaggaggtgagtaagtcccttcaagccatgaaggagattctgtgcggtacgaacgagaaagagcctcccaccgaggccgtggcccagctagcacaagaactctatagtagtgggctcctcgtgacactgattgccgatcttcagctgattgatttcgaggggaaaaaggacgtcacacaaatttttaacaacattctaaggcgacaaattggtacaagatcgcccactgtggagtacatttctgctcaccctcacatactgttcatgctcctgaaaggctacgaagctcctcagatcgcactgagatgtgggattatgctccgggaatgtataagacacgagcctcttgctaaaattattttgttttccaatcaattccgggacttcttcaaatacgtagaactctctacatttgacatcgccagtgatgcctttgctacatttaaagatctgctaacaagacataaagttctggtcgcagacttcctggagcagaactacgacaccatcttcgaagattacgagaaactcctgcagtccgaaaactatgtcactaaaagacaaagtctgaagctcctgggcgagctgattcttgacagacacaatttcgccatcatgactaagtacatcagcaaaccggagaacctaaagctgatgatgaacttattgagggataagagccccaacatccagttcgaagctttccacgtatttaaagtgttcgtggccagcccgcataagacacagcctatcgttgaaatcctgctcaaaaaccagcccaagctgattgagtttcttagcagtttccaaaaagagaggaccgatgacgaacagttcgcggacgaaaagaactatctgataaaacagatccgggaccttaagaaaactgctccttag

SEQ ID NO: 216536 - DNA, 945 bp, Artificial Sequence
  Description of Artificial Sequence: Synthetic coding sequence
atgcctctttttagcaagagccataaaaatcctgccgaaatagttaagatcttaaaggacaaccttgcgattcttgagaagcaagacaaaaagaccgacaaggcatcagaagaagttagtaaaagcctgcaagcgatgaaggagatactgtgtggtaccaacgagaaggagcctccaactgaggctgtagctcagttagcccaagaactgtatagctccggcctgcttgtcacactgatcgctgaccttcagcttatcgactttgaggggaagaaagatgttacccagatcttcaacaacatcctccggcgtcagattggcactagatctccaaccgtggaatacatcagtgctcatccccacatcctgtttatgctgctgaaaggctacgaggctccacaaatcgcgctccgctgcggcattatgctgcgtgagtgtattcgccatgagccccttgccaagatcatcctgttctccaatcagtttagagacttttttaaatacgtcgagctgagcactttcgacatcgccagcgacgcatttgcaactttcaaaatattcgaggattacgagaagcttttgcagagcgaaaactacgttacaaagcgacagtcactgaagctactgggcgaactgatattggaccgccataatttcgcaatcatgactaaatatatctcgaagcccgagaaccttaaactgatgatgaacctactgagagataaatcccctaatattcagtttgaagccttccacgttttcaaagtgtttgttgcctccccccataagacacagccaattgtggaaattctgctcaaaaaccagcccaaactgatcgagttcttgtcctcatttcagaaggagagaacagacgacgaacagttcgctgatgagaagaactatctgataaagcagatacgcgatttgaagaagaccgccccttag

SEQ ID NO: 216537 - DNA, 282 bp, Artificial Sequence
  Description of Artificial Sequence: Synthetic coding sequence
atgaagaagatgccgctgtttagcaagtctcataagaaccccgcagagatagtgaaaatccttaaggacaacctggccattctcgagaaacaagataagaaaaccgacaaggcctccgaagaggtgtccaagagcttgcaggctatgaaggaaattctctgtggaaccaacgagaaagagccacctacagaagccgttgcacagctggcccaggaactgtatagttcaggtctgctggtgaccctaattgcagatctgcagctcatagacttcgaggtctag

SEQ ID NO: 216538 - DNA, 1014 bp, Artificial Sequence
  Description of Artificial Sequence: Synthetic coding sequence
atgaaaaagatgccccttttttctaagtctcacaagaacccagccgagattgtaaagatcctgaaagataacctggcaatcctggagaagcaggataaaaagaccgacaaagcctctgaagaggtgtctaagagtttgcaggcaatgaaagagatcttgtgcgggacaaacgagaaggaaccccctaccgaagcggtggcacaactagcccaagaactgtattcgtctggtctcctcgtgacgcttatcgctgatttgcagctcatcgactttgagggtaagaaagatgtgacacagatcttcaataatatactacggaggcagatcggcactagaagtcccacagttgaatacatttcagctcacccacacattctctttatgttattaaagggctatgaagcccctcagatcgctctacgttgcggcataatgttgcgcgaatgtatacgccacgagccactcgctaaaattatcctcttttcaaatcagttcagggacttcttcaagtatgtggagttatccactttcgacattgcatccgatgcctttgctacctttaaggaccttctgacacgccataaggtgctcgttgcagatttcttggagcagaactacgacaccatatttgaagactatgaaaagttattgcagagcgaaaattacgtgactaaaagacagagtctgaaactgctgggagagctgatcctggacaggcacaacttcgctattatgaccaagtacatttcgaagcccgagaaccttaaactcatgatgaacttactcagggataaatctcccaacattcagttcgaagctttccatgtgttcaaagtcttcgtggcttctccacataaaacgcagccaatcgtcgaaatacttctcaagaatcagcctaagctgattgagtttctgagtagttttcagaaagaaagaaccgatgatgaacagttcgctgacgagaagaactatctcatcaaacagatcagggatcttaaaaagacagccccttag

SEQ ID NO: 216539 - DNA, 1014 bp, Artificial Sequence
  Description of Artificial Sequence: Synthetic coding sequence
atgaagaagatgcctctgttttccaaatcacataaaaatcctgctgagatagtgaagatcctgaaagataacctggctatcctcgagaagcaggataagaaaacagataaggccagcgaggaagtatccaaatctctccaggctatgaaagaaattctctgcggtactaatgagaaagaacctcccactgaagccgttgctcagctcgcacaagaactgtacagtagcggactcctggtgacactgatagcagatctacagctgatcgatttcgagggaaagaaggatgttactcagatcttcaataacattttacgaaggcagattggtacacgcagccctaccgtcgaatacatcagcgcccacccacatatactattcatgttgctcaaaggttacgaggccccacagatagctctgcgttgtggaatcatgctcagagagtgtatccggcatgaacctttagccaagataattctattctctaaccagtttcgggacttctttaagtatgttgagctgtcaacctttgacatcgcctctgatgctttcgcaacattcaaagatctactgaccaggcacaaagttctggtcgcagactttcttgaacagaattacgacacaatcttcgaagactatgagaaactgctccagagcgaaaactacgttaccaagcgccagtccctgaagctcctcggcgagcttatactggatcgacacaacttcgccattatgaccaagtatatctctaaaccagaaaatctgaagctaatgatgaaccttttgcgcgacaagtcaccaaatattcaattcgaggctttccacgtttttaaagtctttgtggcatcaccccacaagacacagcctatcgtggagatcctcctgaagaaccagcccaagctcatagagtttttatcctcctttcagaaagaacggacagatgacgagcagtttgcggatgaaaagaattacctcatcaaacagatcagagatctcaagaaaaccgctccctag

SEQ ID NO: 216540 - DNA, 387 bp, Artificial Sequence
  Description of Artificial Sequence: Synthetic coding sequence
atgaagaaaatgccactcttcagtaagtcccataagaatcccgcagaaatagtcaagatcctgaaagacaacctggcaattctggagaaacaggataagaaaacagacaaggcaagcgaggaggtgtccaagagcctgcaggcaatgaaggaaattctgtgtggtaccaacgaaaaagagccccctacagaggccgtcgcacagttggcacaggagctgtattcttcagggctcctcgtcacccttatcgctgatctgcagcttatcgattttgaaggcaagaaagatgtcacccagatcttcaacaatattcttaggcggcagattggtacgcgttccccaaccgtagaatatatctccgcccacccacacatactctttatgtag

SEQ ID NO: 216541 - DNA, 567 bp, Artificial Sequence
  Description of Artificial Sequence: Synthetic coding sequence
atgaagaaaatgcctctttttagcaaatctcacaaaaacccagctgaaatagtaaagatcttaaaagacaatttggccatccttgaaaagcaggataaaaagaccgacaaagcttctgaggaggtgtctaagagcctccaggccatgaaagagatcctgtgtggtaccaacgagaaggagccgcctaccgaagccgtggctcagttggctcaggaattatactcaagcggcctgctcgtcacattaattgctgacctgcagttaatcgactttgagggtaaaaaagatgttactcagattttcaataacattttgcggaggcagatcggaacccggtcgccaactgttgagtacatatcagcacacccacacatcctgttcatgctgctaaaaggctacgaagcacctcagattgctttgcgttgcggcattatgctcagggagtgtatcaggcatgagcccctcgcaaagataattttgttttccaatcagttcagagatttctttaaatatgtagaactgtcaacctttgacattgcctcagatgcttttgccacgtttaagtag

SEQ ID NO: 216542 - DNA, 828 bp, Artificial Sequence
  Description of Artificial Sequence: Synthetic coding sequence
atgacgactgagcaggcacgcggtcagcagggcccaaatctcgccattggacgacagaaaccacctgcaggcgtggtgaccccgaagtcagacgctgaggaaccaccattgacccgcaaacggagcaagaaggagcggggattacgaggctctagaaaacgaacaggttcatccggcgagcaaactggacctgaagcccctgggagttctaataaccccccatctacaggcgagggccctgctggcgctccacccgcatccccgggacctgcatctagcagacagagccatagacatagaccagactcacttcacgacgccgctcaacgaacttacgggcctttgctcaaccgcgtgttcggaaaggatcgcgaacttggacccgaggaactcgatgagctgcaggcggcattcgaggagttcgacaccgaccgggacgggtacatatctcaccgagagctgggggattgtatgagaacgctgggatatatgcctacagaaatggaactcctcgaggtcagccagcacataaagatgcgaatggggggtcgcgttgacttcgaggagtttgttgaactgattggccctaaactcagggaagagacagcccacatgctcggcgttagggagttgaggattgcctttagagaatttgatcgggacagagacgggaggattacagtggccgagttacgagaggcagtccccgctcttcttggggaaccacttgcaggacccgagttagatgaaatgcttagggaggtggacctgaatggtgatgggacagtggatttcgatgaattcgtcatgatgctctcgcgccactag

SEQ ID NO: 216543 - DNA, 513 bp, Artificial Sequence
  Description of Artificial Sequence: Synthetic coding sequence
atgacggaaccatggctggcgctcggcacctcctggacgctacccctgcaagaccgggagttaggccctgaggagctcgatgagctgcaggcagccttcgaagagtttgatacagaccgagacggatatataagccacagggagctaggggattgtatgcgcactctcggctacatgcccaccgaaatggaattgctggaggtgagccaacacatcaagatgcgcatgggtggacgggtagacttcgaggagtttgttgaactgatcggaccaaaactgcgggaagagacagctcatatgcttggagtgagggagctgcgtatcgccttcagggaatttgaccgtgatcgtgacgggagaatcaccgtggccgagctacgtgaggcggtccccgcactgctgggagagccattagctgggccagaactagacgagatgttgcgagaagtggacctgaatggcgacggcacagttgactttgatgagttcgtcatgatgctctcccgccattag

SEQ ID NO: 216544 - DNA, 522 bp, Artificial Sequence
  Description of Artificial Sequence: Synthetic coding sequence
atgcagttccccatggggcctgcctgcatttttctcagaaagggtatagcggaaaagcagcgcgaacgcccacttggccaagacgagatcgaagagttgcgagaggcattcctcgaatttgataaggacagggatggcttcatctcctgtaaggacttgggtaatctcatgaggaccatgggctacatgcccactgagatggagctcatagaactgggtcagcagatcagaatgaacctgggcggaagggtcgactttgatgactttgtcgaacttatgacaccaaagctcctcgcggaaacagctgggatgatcggagtccaggaaatgcgcgacgccttcaaagaatttgatacgaatggcgatggcgagatcaccctggtcgagttgcaacaagcgatgcagagactgctcggtgagagactgacccctcgggaaatatctgaggtggtccgagaggctgatgttaatggcgacgggactgtagatttcgaggagtttgtgaaaatgatgagtaggtag

SEQ ID NO: 216545 - DNA, 846 bp, Artificial Sequence
  Description of Artificial Sequence: Synthetic coding sequence
atggaaaagagcaccgacactgacgaagataacgtgactcggacggaatacagtgacaagacaacacagtttccctctgtgtacgcagtccctgggacagagcagacggaggctgtgggcggattgagttcaaaaccggcaacccccaagactacaactcccccttcatcccctcctcccacagctgtgagtccagagtttgcatatgtgccagcagaccctgcacaactggcagcgcagatgctggccatggcgacatccgagcggggtcagcctccaccatgttcaaacatgtggaccctgtactgtctgactgacaagaaccagcagggacatccgtcacctccccctgcccctggtccatttccacaagcaacattatatttgcccaaccccaaggatcctcaatttcagcagcatcccccaaaagtgacatttccgacctacgttatgggtgacacgaaaaagacttcagcccctccatttattctggtcggttcaaatgtccaggaagctcagggctggaagccgctgcctggacacgcggtcgttagccagagtgacgtgctgcgatacgtggcaatgcaggtccctatcgccgttcctgcggatgagaaataccagaagcacacattatcccctcaaaacgctaaccctccaagtggtcaggacgtgcccagacccaaaagcccagtcttcctttctgtggccttcccagtggaggatgtcgcaaaaaagagtagcgggtccggtgacaagtgtgcaccgttcggatcatacgggatcgcgggagaagtcacagttaccactgctcacaagagaaggaaggccgagaccgagaactag

SEQ ID NO: 216546 - DNA, 1188 bp, Artificial Sequence
  Description of Artificial Sequence: Synthetic coding sequence
atggagaaatccacagataccgatgaggacaatgtaacccgcactgaatactcggataaaaccacccagtttccctcagtgtacgccgtgcccggaaccgagcagacggaagcagtgggcggactgagtagtaaaccagcgacacctaaaactaccacacctccttcttcacccccacctaccgccgtttctccggagtttgcctacgttccagccgaccccgcacagcttgcggcacaaatgttgggtaaggtaagcagtatccatagcgatcagtctgatgtgttaatggtagacgtggcaacctctatgccggtcgtgattaaggaggtgccaagcagtgaggcggcagaggacgtgatggtcgctgccccacttgtgtgtagcggcaaagtgcttgaagttcaggttgtcaatcaaacatcagttcacgttgatctgggatctcagcccaaagagaatgaggccgaaccatcaaccgcttcgagcgtgccactgcaggacgagcaggagccaccggcttacgatcaggctcccgaggtgactctacaagctgatatcgaggttatgtctaccgtccatatttccagcgtgtacaacgatgtaccagttaccgaaggtgtggtttatatcgagcagctcccggaacaaattgtaatcccttttaccgatcaagttgcctgtctgaaggagaacgagcagagtaaggaaaatgagcaaagtcctcgcgtgtcccccaagtccgtggtcgagaaaacaactagcggtatgagcaagaaaagcgtcgagtcagtcaagttagcgcagttggaagagaatgcgaagtattccagcgtttatatggaggctgaggctacagctctgctgtccgacaccagtctgaagggccaacccgaagtgcctgcgcagctgttggatgctgagggtgcgattaagattggctccgaaaaatctctccatcttgaagtagaaattacaagcatcgtcagcgacaatacgggccaggaggagagcggggagaactctgttcctcaggagatggaggggaagcctgttctatctggcgaggctgctgaggccgttcatagcggcacttctgtgaagtccagtagcggaccattccctcctgcgccagaggggttgaccgcacctgaaatcgaaccagagggagaatctaccgctgagtag

SEQ ID NO: 216547 - DNA, 1140 bp, Artificial Sequence
  Description of Artificial Sequence: Synthetic coding sequence
atgatcagcagcaagccgagactggtagtcccctacgggctgaaaacccttctggaagggatctctcgggcagtactgaaaacaaatccaagcaacatcaatcagttcgccgctgcctatttccaggagctcacaatgtatcgcggaaataccaccatggacatcaaggacttagtgaaacagtttcaccagataaaagtcgagaagtggagtgaggggacgaccccacagaagaagctggagtgcttaaaagaacctggcaaaacaagcgtggagagcaaggtgcccacccaaatggaaaaaagcacggatacggatgaggacaacgtcactagaactgagtatagtgataagacgacccagttcccgtccgtctacgccgttcctgggactgagcagaccgaagcggtgggcggtctctcaagcaagccggctacccctaaaactacaacccctcctagcagcccaccccctacagcggtgtcccccgaattcgcatatgtgcccgcagatcctgcccaactcgctgcccagatgctcgctatggccacatctgagagagggcagcctcccccatgcagcaacatgtggaccctgtactgtttgacggataagaatcaacagggtcacccatccccgcctccggcacccggtccattcccccaggcaacactttacctgccaaacccaaaagatccgcaatttcaacaacaccctccaaaggtgacctttccgacctatgtgatgggtgacaccaaaaaaacttccgcgccacctttcatattagttggcagtaatgtgcaggaggctcagggttggaagcccttaccgggtcacgcggtggttagtcaatccgacgtgctcagatatgtggccatgcaggtgccaatcgctgtacccgctgacgagaaatatcagaagcacaccctgagcccccaaaacgccaatccaccaagcggtcaggacgtgccacgcccaaagtcacccgttttcttaagtgttgcttttccggtcgaagacgtggccaaaaaatccagcggatctggggataagtgcgctccatttggcagctacggaatagccggagaagtcacagtgaccacagcccacaagagacgaaaagctgaaacagagaattag

SEQ ID NO: 216548 - DNA, 1140 bp, Artificial Sequence
  Description of Artificial Sequence: Synthetic coding sequence
atgatctccagcaagccacgcttggtggtgccttacggcctgaagacgctcctggaaggcatcagcagagccgttcttaagacaaacccatcgaatataaaccagttcgcagcagcgtatttccaggaacttaccatgtacaggggaaacactaccatggatataaaagatttggtaaagcagttccaccagatcaaggtcgagaagtggtctgagggaaccactcctcagaaaaagctggagtgtttaaaagaaccagggaaaaccagcgtggagagtaaggttcctacccagatggagaagtcaaccgacaccgacgaagataatgtaacccggaccgagtattccgacaaaaccacacagttcccgtcagtgtatgccgtgccgggaacagagcagaccgaagctgtgggaggtctgagctccaaacctgcaactcccaagactactaccccccctagctcgccgccacccaccgccgtctctcctgaattcgcgtacgtgcccgctgatcccgcacagctggctgctcagatgcttgccatggctacctcagaacggggacagcccccaccatgcagtaacatgtggaccttatactgtcttacagacaaaaaccagcaaggacatccctctccaccaccggcacctggacctttcccacaggcaaccctgtatctgcctaacccaaaagacccccaattccaacaacatccccctaaagtaacttttcccacgtacgtcatgggtgacaccaagaaaacatctgctcctccgtttatactggtgggctcgaacgtgcaagaggctcagggatggaagcccctgcccggtcacgcagttgtgtcccagtctgatgttctacggtatgtggccatgcaggtcccgatcgccgtgcctgcagatgagaaatatcaaaaacacactttatctcctcaaaatgctaatccgccatctgggcaggatgtgccgagaccgaagtcaccagtctttctttccgtggctttccctgtggaagatgttgcaaagaagagctccgggagcggagataaatgtgctccatttggctcatatggcattgccggtgaagtgacggtgactactgctcataagagacgcaaggctgaaacagagaattag

SEQ ID NO: 216549 - DNA, 666 bp, Artificial Sequence
  Description of Artificial Sequence: Synthetic coding sequence
atgatctcaagtaagcctcgcctggtggtgccgtacgggctcaagactctgctggaaggtatatcacgcgctgtgcttaaaaccaacccttcgaatatcaaccagtttgccgctgcttactttcaggaactgacgatgtaccgaggcaacaccaccatggatattaaggatctggtgaaacagtttcaccagatcaaggtagagaaatggtctgaaggcaccacaccacaaaaaaagctggagtgcctgaaggagcccggaaagaccagtgtagagtcaaaagtccctacacagatggagaaatctaccgacaccgatgaagataacgtgactcgaaccgagtactctgacaagaccacacaattcccttctgtctatgcagtgccaggcactgaacaaaccgaggccgtcggaggattgagtagcaagccggctacacccaaaactactacgccacctagcagtccaccgccaacagctgttagtccagagtttgcatatgtgccagccgatcctgctcagttagccgctcagatgctggaagacgttgcaaagaagtcctcgggatcaggcgacaaatgcgctcccttcggcagttatggtatagctggggaagtgacggtaactactgctcacaagagaagaaaggctgagacagaaaactag

SEQ ID NO: 216550 - DNA, 1482 bp, Artificial Sequence
  Description of Artificial Sequence: Synthetic coding sequence
atgatttcatcaaaacccaggctggtggtgccatatgggctgaaaaccctgcttgaggggataagtagggccgtgctgaagactaacccatccaacataaaccagttcgccgcagcatacttccaggaacttacaatgtaccggggtaacactacaatggacatcaaggaccttgtgaagcagtttcaccagatcaaagtggagaaatggagcgagggaacaacaccccagaaaaagctggagtgtctcaaggagccgggtaaaaccagcgtggaatccaaggtgccgacacaaatggagaagtccaccgatacagacgaggacaacgttactcgcaccgagtatagcgataagactacccagtttccctccgtgtacgccgtcccaggaaccgagcaaacagaggctgtaggagggctgagttcgaaacccgcaacaccaaaaactacaacaccccctagcagtcctcccccaactgcggtctccccggaattcgcatacgtacccgcagatcctgcacaactcgccgctcaaatgctgggtaaagtgtcctcgatccactccgaccaatccgatgtgctgatggtcgatgtggccaccagtatgcccgttgtgattaaagaagtaccatcctccgaagcagcggaagacgtaatggtagctgctcctctcgtgtgttctggcaaggtcctggaagtccaagtagttaatcagaccagcgtgcacgttgatttaggctcacagcccaaagagaacgaagctgaaccatcaactgcatcatccgtgccacttcaggatgagcaggagccgcctgcatacgaccaggccccagaagtgactctgcaggcggacattgaggtaatgtcaactgtccacatttcctctgtctacaacgatgtgcctgtgacagagggcgtcgtatatattgagcagctgcccgaacagattgtaattccctttaccgaccaggtggcctgtctcaaagaaaatgaacaatccaaagagaacgagcagtcacctcgggtctctcctaaatctgtggtagagaagacaacatctggcatgtccaaaaaatctgtggaatcagtgaaactggctcagctcgaagagaacgcaaagtattcctctgtctacatggaggccgaggcgaccgccctgctcagcgatacttctctgaaggggcagcccgaggtgcctgcacaactcctcgacgctgagggcgctatcaaaatcgggagtgagaaaagcctacatcttgaagtggaaatcacaagtatagtttcggacaacacagggcaggaggagagcggagaaaattctgttcctcaggagatggagggaaaaccagtgctgagcggggaagcagctgaagccgtgcattctggcacatccgtgaaatcaagcagcgggccattccctccggcacccgagggacttacggctcccgagattgagccggagggtgagtcaaccgccgagtag

SEQ ID NO: 216551 - DNA, 1428 bp, Artificial Sequence
  Description of Artificial Sequence: Synthetic coding sequence
atgataagttccaagcccagactggtcgttccctacgggttgaagacactgctggagggaatttcgagggccgtcctgaaaacaaacccgagcaacatcaaccagtttgctgccgcatattttcaggaacttacgatgtacagagtggagaagtggtcagaggggacgacaccacagaagaaactcgagtgccttaaagagcctggaaagacttctgtggagagcaaggtacccacacagatggaaaagtccactgacacggacgaggacaatgtgacacggacagaatatagcgacaagaccactcagtttcctagtgtgtatgctgtccctggtactgagcaaaccgaggctgtgggcggattgagtagcaagcccgctacacccaagactaccacaccgccatcatccccacctcccacagctgtttcccccgaattcgcatacgtgcctgctgatcccgcacagctggccgctcaaatgctgggcaaggtgagcagcattcacagtgaccagtctgacgtgcttatggtggacgtcgcgacgagcatgccagttgttatcaaagaggtgccttcgtcagaggcggcagaggatgttatggtagctgcaccactggtctgttcaggcaaggtactggaagtccaagtggtgaatcagacttccgttcacgtagatctgggcagccaaccaaaagagaatgaagccgagccttcgaccgcgtctagtgttccccttcaggacgagcaggagccacctgcgtacgaccaggctcccgaggttacactgcaggccgatattgaagtaatgagcactgtacatatctcctccgtgtacaacgatgtgcccgtaactgagggcgttgtttacattgaacagctccctgaacagatagtgatccccttcacggaccaagtggcttgccttaaggaaaacgagcaatcaaaggagaacgagcaatcgccacgagtgtctcctaagagcgtggtggagaagacaacctcaggaatgagcaagaaaagcgtagagtccgttaagctggcccagcttgaagaaaatgctaaatactcttctgtgtatatggaggctgaggcgaccgctctgttgagtgacacctccttgaaggggcagcctgaagtgcctgcccaactgctggatgctgaaggggcaattaagatcgggtccgagaaaagccttcaccttgaggttgagatcacgtcaatagtgagtgataacactggacaggaggagtccggcgagaactctgtgccccaggagatggagggcaagccagtcctgtccggggaagcagcagaagctgtgcacagcggaacttctgtgaaaagctcaagtggcccatttccccctgcccctgagggtctcacggccccagaaatagaaccagaaggcgagtcaaccgcggagtag

SEQ ID NO: 216552 - DNA, 1452 bp, Artificial Sequence
  Description of Artificial Sequence: Synthetic coding sequence
atgtcattctccgactcttcagcaactttcctccttaatgagggcagtgcagacagttacaccagcaggccaagtctcgactctgacgtctcccttgaagaagatcgcgagtctgccagacgagaggttgagtcccaggcccagcagcagctcgaacgggcaaagcataagcccgttgccttcgcagttagaacaaatgtgagctactgtggggtgctggatgaagaatgcccagtgcagggctccggcgtgaatttcgaggcgaaggacttcctgcacatcaaggagaaatacagcaacgattggtggatcggtcgcctggtcaaagaaggaggcgacattgcattcatcccgagtccgcagaggctggagtctattcgcctgaaacaagagcagaaggctaggaggtctggaaacccatctagcttgagcgacattggcaaccggagaagccctcctcccagcttggctaaacaaaaacagaagcaggctgagcacgtacctccctatgacgtcgtgccctccatgcgcccagtcgttctggtcggcccatccctgaaaggatacgaggtgacggatatgatgcagaaggccctctttgacttcctgaaacaccgcttcgatgggaggatttctatcacccgggtgacagcggatctctccctggctaagaggtccgtgctgaacaacccaggaaagcgcaccataatcgagagatcaagcgcccgaagcagtatagcagaagtgcagagcgaaattgaacgcatatttgaactggcgaaatccctccagctcgtagtgcttgacgcagacacaatcaaccacccggctcaattggctaagacctccctggctcctatcattgtgttcgtgaaagtaagttcccccaaagtgctgcagcgacttatccgctccagaggtaaatcccagatgaaacatctgaccgtgcagatgatggcctacgataagctcgtgcaatgccccccagagtcctttgacgtcatactggacgagaaccaactggaggacgcgtgcgaacacctggcggagtatttagaagtatattggcgggcaacgcaccatcccgctcccggacccggtttgctcgggcctccaagtgcaatacctgggctgcagaatcaacagcttctgggcgagcgaggggaagagcactctccactcgaaagggactcactgatgcccagcgacgaggctagtgagtcatcaagacaagcttggactgggtcctcacagaggagttccagacatcttgaggaagactatgctgatgcctatcaggacttatatcagccacaccgccagcataccagtgggctgccgtctgctaatggacatgacccacaggataggctgctagcacaggattccgaacataatcatagtgataggaattggcagcgcaataggccttggcctaaagatagctactag

SEQ ID NO: 216553 - DNA, 1416 bp, Artificial Sequence
  Description of Artificial Sequence: Synthetic coding sequence
atggagggaagtgctgattcttatacctcgcgcccttccttggactccgatgtttctctggaggaagacagagagagcgctcggcgtgaggttgaaagtcaagcgcagcaacaactagagcgcgcaaagcacaaacctgtcgcttttgcggtgaggaccaacgtgtcttactgcggggtgctggacgaggagtgccccgtgcaggggtccggcgtgaattttgaggccaaggatttcttacacatcaaggaaaagtattccaatgattggtggatcggcaggctggtgaaagagggtggggatattgcctttattccgagtccacaacgactggagagcatccggctcaagcaggagcaaaaggctaggcgcagcggcaacccaagttcattgagtgatatcggaaaccgcagatccccaccaccaagcctggctaagcagaaacagaagcaggccgaacacgtgcccccttatgacgtcgttccatcaatgagaccagtggtgctcgtgggcccttccctgaaaggatacgaagttaccgacatgatgcagaaggctctcttcgattttctcaagcacagattcgatggacggatttctatcacaagggtcaccgccgatctgtctctcgcaaaacggtccgtccttaacaatccgggaaagcgcacgattattgagaggtcatcggccagatcctctatagctgaggtgcagtcagagatagaacggatttttgagctggccaagagcctccagctcgtcgtccttgatgccgataccataaatcaccctgcacagctggccaagacatcactggcccctatcatcgtgttcgtgaaggtgtcctccccaaaagtattgcagcgattaatccggagccgaggcaaatcccagatgaagcacctgaccgtgcaaatgatggcatatgataagctggtccagtgccccccagagagctttgacgtgattttagatgaaaaccagctagaagatgcatgtgagcatctggccgagtaccttgaggtgtattggcgcgctactcatcaccctgctccaggaccagggctcctgggacctccttccgcgattccaggtctccagaaccaacaattgctgggtgaacggggagaggagcattcccctctggagcgggattctctcatgccttccgacgaggcctcagagtcctccaggcaggcttggaccgggtccagccagagatcaagccgacacctcgaagaggactacgccgatgcttatcaggacctgtaccagcctcatcggcaacacacaagtggtttaccgtcagcaaacggtcacgatccacaggacaggctgctggcacaggacagcgagcacaaccactccgatcgcaattggcagagaaataggccatggcccaaggactcgtattag

SEQ ID NO: 216554 - DNA, 1332 bp, Artificial Sequence
  Description of Artificial Sequence: Synthetic coding sequence
atgtacgacgacagttacgtaccagggtttgaggactccgaagctgggtccgcagatagctatacgagccgtcctagtctggactccgacgtctctctggaagaagatagagaaagcgccagacgtgaagtggagtcccaggcccagcagcaactggagcgtgctaagaaatactcaaatgattggtggatcggaagactggttaaagaaggcggagacatcgcattcatcccaagtccccaacggttagagtcaatcagactgaaacaggagcagaaagcccgaagatccggaaatccatccagtctgtccgacatcggcaatcgccgaagtcctccaccctctcttgccaagcagaagcagaagcaggccgagcacgtaccaccctacgacgtggtcccctcaatgagaccggtggtactggtgggcccatccttgaaaggttacgaggtgaccgatatgatgcagaaagctctgtttgacttcttgaaacaccggttcgacgggaggatttccatcacaagggtgacagcagatctgtcactggctaagcggtcagtcctgaataaccccggtaagagaaccatcattgaaaggtcttccgcaagaagcagcattgccgaggtgcagtccgaaatcgagaggatttttgaactggcaaagagcctgcaactggtggtgctggacgccgataccataaatcatcccgcacagctcgctaagacatccttagctccaattatcgtgtttgtcaaagtatcatctccaaaagtgctccagcgcctgattagaagtcgcggaaagtcccagatgaagcacttgacagtccaaatgatggcgtacgacaaactggtgcagtgtcccccagaaagctttgacgtcattcttgatgaaaaccaattggaggacgcttgcgagcacctggcagagtatctggaagtgtattggcgagccacacatcatccggcaccgggacccggtctgctcggccctccttccgctatcccaggactgcagaaccagcaactgttaggggagaggggagaagagcactccccactcgagcgcgactctttaatgccaagtgatgaagcgagtgaatcgagtcgccaggcttggacagggagctcacagcgcagctcacgccatctggaagaagactatgcagatgcctaccaggatctgtatcagccacaccggcagcacaccagcggtctacctagcgcgaacgggcatgacccccaggataggctgctggcgcaggatagcgaacataaccacagtgacaggaattggcagcggaacagaccctggcccaaggattcctactag

SEQ ID NO: 216555 - DNA, 1377 bp, Artificial Sequence
  Description of Artificial Sequence: Synthetic coding sequence
atgtcctcaagctcatatgcaaaaaatggaacagcagatggtcctcactctccaacctcgcaggtggctaggggcactaccaccaggagaagccggttgaagcggtccgacgggtccaccaccagtacctcatttattctgagacagggcagcgctgatagctatacaagcaggccatctgattccgacgtcagcctggaggaagacagggaggccatacgccaggagcgcgaacagcaggccgctatccagctggagcgcgcaaagtcaaaacctgtggccttcgccgtcaagacgaatgtaagctactgcggggctctcgatgaagatgtgcccgtaccgagtactgcgatctcttttgacgctaaggatttccttcatatcaaggagaaatacaataacgattggtggatcgggcgactggtcaaggagggctgcgagatagggttcattccgtcccccctccgtcttgagaacatcaggatccagcaagagcagaagaggggaaggttccacggaggtaagtccagcggcaattcctctagctctttgggggaaatggtgtcgggcacctttcgggctacaccaaccagtacagccaagcagaagcagaaggttacagagcatattccgccttatgatgtggtgccgtctatgaggccggttgtcctcgtcgggcctagtcttaaagggtacgaggttaccgatatgatgcagaaagcactgttcgatttcttaaagcatcgctttgatggacgaatatcgattacgcgcgtgacggcggacattagcctcgctaagcgctctgtcctgaacaatccttccaaaagggctataatcgaacggagcaatacccggagttccctcgccgaggtccaaagtgaaatcgaacgaattttcgaactcgctcgaagcctgcagctagtggtgctggatgcagacaccatcaaccatccagctcaattaatcaagacctctctggcccctataatcgtccatgtcaaagttagctcccccaaagtccttcagcggctgattaagtctagggggaaatcacaatctaaacatctcaatgtgcagctcgttgctgcagataaacttgcacagtgccctccctctcagcggatgcgccactctaaccattccactgagaacagccctatcgagcgcagatccctaatgacatctgacgagaactatcataacgaacgagccaggaagtcacgaaatcgcctttcgagcagttcacagcattccagagatcattatcccctcgtggaggaagactatccagattcctaccaggacacctacaagccccaccgaaaccgcggttctcccggagggtattcccatgattctcgccaccgtctctag

SEQ ID NO: 216556 - DNA, 1509 bp, Artificial Sequence
  Description of Artificial Sequence: Synthetic coding sequence
atggatgtggtagctaggggcaccacaaccagaaggtccagacttaaacggtccgacggctcgactacctcaacttcatttattcttcgacagggcagtgcagatagctacacctctcgcccttccgattctgacgttagtctggaagaggacagggaggcaatccgccaggagcgcgaacagcaggcggctatccaactggagagggcgaaaagcaagcctgtcgctttcgccgtgaaaacaaatgttagctactgcggcgcacttgatgaggacgtccccgttccatctactgctatcagcttcgatgcaaaggattttttgcacattaaggagaaatacaacaatgattggtggatcggaaggctggttaaagagggatgtgagatcggtttcattccctcccctttgcggctggagaatattcggattcagcaagagcagaagcgcggacggttccatggcggtaagagttcagggaacagttcatcatcccttggcgaaatggtgtccggtacatttagagcaacgcccacttccacagcaaaacagaaacaaaaggtgaccgagcacatccccccttacgacgtggtgccaagcatgcgtcccgtggtcctggttggcccaagtcttaagggttacgaggtcactgatatgatgcagaaggcactcttcgactttctgaaacacaggttcgacggacgcatcagcataaccagggtgacggctgatattagccttgccaagcgttctgtattaaataatccctctaagagagcaatcatcgaacggtccaatacaaggtcttctctggcagaggtgcagtctgagattgagagaatcttcgagcttgctagatctctgcagctggtggtgctggacgctgacactatcaaccaccctgcccagttaattaagaccagtctagccccaattatcgtgcacgtcaaggtctctagccctaaggtgctgcagagactcatcaaatctagggggaaatctcagtcaaagcatttgaatgtccagcttgtggccgctgacaagctggcgcagtgccctcccgagatgtttgatgtgattctggacgaaaatcagctcgaagacgcctgcgaacacctgggagagtacctcgaagcatactggcgtgccacccataccacctcttcaactcccatgactcccctgttgggacgcaacttgggttcaactgccctgagcccttaccccaccgccatctcagggcttcagagccagcgcatgcgacactctaatcactcgacagaaaatagcccaattgagcgtagatctctcatgacttctgatgaaaattaccacaatgaaagggctcgcaagagcaggaataggctgtcatcctcttctcagcacagcagggatcactaccccctggttgaagaagattaccctgactcttaccaggatacgtacaagccccatcggaataggggatcgcccggaggttacagccatgactctagacatcgcctctag

SEQ ID NO: 216557 - DNA, 3438 bp, Artificial Sequence
  Description of Artificial Sequence: Synthetic coding sequence
atggccgtgccagcccgaacctgcggggcatcaagacctggacctgccagaaccgccagaccatggcctggttgtgggcctcaccctgggccaggcacccgacgcccaacctcagggccacctaggcctctatggctgttgctgccactcttgccgttgctggccgcaccgggtgccagtgcgtattcgttccctcagcagcacactatgcagcactgggccaggcggctggagcaggaagttgacggtgttatgcgcatatttggtggagtgcaacagctaagggagatctacaaggataatagaaatctgtttgaggtgcaggagaacgaaccccaaaagctggtggagaaggtggccggtgatattgagtctctcctagatagaaaggtacaggctctaaagaggctggccgatgccgctgagaatttccagaaagcacaccggtggcaagacaatattaaggaagaggacatagtatactatgatgctaaagctgatgctgagctagatgatcccgagagtgaagacgtggagcggggatccaaggcatcaacccttagactggacttcatcgaggacccgaactttaaaaacaaggtgaattacagttacgcagctgtacagatccccaccgacatctacaagggctcgactgtgattcttaatgagctgaattggacagaggcacttgagaacgttttcatggagaaccgacgccaggatccaactctcctgtggcaggtctttggatctgccaccggtgtgacgcgatattacccggctactccctggagagctccgaaaaaaatcgatctttacgacgtccgccgtaggccatggtacattcagggagcttcaagtccgaaggacatggtgataattgttgacgtctcgggatccgtttcaggtctgaccctgaagctgatgaaaaccagcgtgtgcgaaatgttagataccctatccgatgatgactatgtgaatgtagcaagcttcaacgagaaggcgcaacccgtttcatgttttacccatctggtgcaagccaatgtgaggaacaagaaggtgtttaaggaggctgtgcagggcatggtagctaagggtacaaccgggtacaaagcaggattcgaatacgcctttgaccaacttcagaactcaaatattacccgtgctaactgcaacaaaatgatcatgatgtttaccgatgggggagaggaccgtgtgcaggatgtattcgagaagtacaactggccaaacagaacagtacgtgtttttaccttttcagtggggcaacataactacgacgttactccactgcagtggatggcttgtgctaacaaagggtattatttcgaaataccctcgatcggggctatccgaatcaacacccaggagtacttggacgtgctcgggcgacccatggtgctggccggtaaagaagcaaagcaagttcagtggacaaacgtgtatgaggatgccctcggactgggcctagtggtcactggtaccctgcccgtcttcaatctgacacaggatgggcctggagagaagaagaatcagctcattctgggcgtgatgggaatagatgtggccctgaatgatataaaacgcttgacacctaactacaccctgggtgccaatggctacgtgttcgcaattgacctcaatgggtatgtgctgcttcatcctaatctcaagccacaaacaacaaacttccgtgaaccagtgacattagattttttggatgctgagctggaagacgaaaacaaagaggaaatccgtaggagtatgattgatggcaacaaaggacacaagcagatccgtactctcgtgaagtccctggacgaacggtacatcgatgaagttacgcgcaattatacttgggtcccgattagatccaccaactactcgctcggactcgtactgcccccttactcaacattttacctacaggctaaccttagtgaccagatcctgcaggtaaagtactttgagtttttactgccgtcttccttcgagtcagagggacacgtgttcatcgctcctagggagtattgcaaagatctgaatgcttcggataataacaccgaattccttaaaaattttatcgaattgatggagaaagtaacgccagattccaagcagtgcaacaattttctgttgcacaacctaattctcgacactggcattacccaacagctagtcgaaagggtgtggcgtgaccaggatctgaatacatattctctgctggccgtcttcgctgctaccgatggagggatcactcgcgtcttcccgaacaaggcggctgaagattggactgagaatcctgaacctttcaatgcatctttttacaggcgatctcttgacaatcacggatatgtctttaaacctccacatcaggacgcactgctgcggcctctagaacttgaaaacgatacagttggaatcctggtgtctactgcagtggagctttcactgggaagaaggaccctccgtccggctgttgtgggcgtgaagctggacctagaggcttgggccgagaagttcaaggtgcttgcaagcaacagaacccatcaggaccagccccagaaatgtgggccaaactcccactgcgaaatggattgcgaggttaataacgaggatctgctgtgcgttttgatcgatgatggcggtttcctggtgctgagcaatcaaaaccaccaatgggatcaggttgggaggttctttagcgaggtcgatgctaaccttatgctggcactctacaataactctttttatacaagaaaagagagctatgattatcaggccgcatgcgcgccacagccacccggtaacctgggcgctgcacccagaggagttttcgtccccacggtcgccgatttccttaacctagcgtggtggacctctgctgctgcctggagcctattccagcagttactgtacggcctgatttatcactcgtggttccaggcggatccagccgaggcggaggggagccccgaaacaagagaatcatcttgcgtaatgaaacaaacccaatactactttggaagcgttaacgcctcttacaatgccattatcgactgcggaaattgttctaggttgtttcacgcccaacgtctgaccaatacaaatctgcttttcgtggtggctgaaaagccactgtgcagccagtgcgaggccggaaggctcctccaaaaagagactcattgccctgcagacgggccagagcaatgtgaattggtgcagaggccgcgatatcggaggggaccgcatatatgcttcgactacaacgctactgaggataccagcgactgcggccgtggtgcgtctttccctccaagtctcggcgtcctggtctccttgcaactcctattgttgctcggtctgccacctcggccacagccacaggtactggtccacgcgagcaggagactctag

SEQ ID NO: 216558 - DNA, 3231 bp, Artificial Sequence
  Description of Artificial Sequence: Synthetic coding sequence
atgcaacactgggcacggagactcgagcaggaggtcgacggggtgatgcggatttttggcggagttcagcagcttcgcgagatatataaggataatcgaaacttgttcgaagtgcaggaaaacgaacctcaaaagctggtcgagaaagtagctggcgatatcgaatcactcctggacaggaaggtccaggctctcaaacggttggcggacgctgcggaaaattttcagaaggcgcatcgttggcaggacaatatcaaagaggaagatatcgtctactacgatgccaaagccgacgcagagctggacgacccggagtctgaggatgttgaacgaggatcaaaagcctcaacgctgcgactggatttcattgaggaccctaactttaaaaataaagtgaactactcttatgccgctgtccaaattccgactgatatctataaaggaagtaccgtcatactcaatgagctgaattggaccgaggcacttgagaacgtattcatggagaacaggcgacaggatcccacactcttgtggcaggtgtttggaagcgctaccggggtcactcggtactaccccgcaacgccgtggcgggcaccgaaaaaaatcgacctgtacgacgtgaggcgtcgcccttggtacattcaaggagccagtagccccaaagatatggtaattattgtcgatgtgagcgggtcagtcagcggactgacgctgaaactgatgaagacatccgtgtgcgagatgttggacactctctcagatgatgactacgtgaatgtagcctcttttaacgagaaggctcagccggtgtcttgcttcactcacctcgtacaggccaatgtgcgcaacaagaaagtgtttaaagaagcagtgcaggggatggtagccaaagggacaacagggtataaggccggttttgaatatgcctttgaccaacttcaaaacagcaatattacgagagcaaattgtaataaaatgattatgatgttcactgacggtggagaggaccgagtccaggatgttttcgaaaagtacaattggccaaacagaaccgttcgcgtgtttactttcagcgtggggcagcacaactatgatgtaacacctctccagtggatggcgtgcgccaacaagggatactattttgagattccatcaatcggagccatcaggataaacacacaggaatatctggacgtgctgggcaggcccatggtgctggctggaaaggaggccaagcaagtgcaatggacaaatgtctacgaagacgctctggggctgggcctggtcgtgacaggtactctcccagtcttcaatctaacccaagatggcccaggcgaaaagaaaaaccaattgatactgggtgtgatgggaattgacgtggcacttaatgatatcaaaagactgactccaaattatacactgggggcaaatggatacgtcttcgccattgatctgaacggatatgtgttgctgcacccaaacctcaaaccacaaaccacaaactttagggaacccgtgactctcgatttcctggacgcagaactggaagatgaaaataaggaggagatcagacgctctatgatcgatgggaataaaggtcacaaacaaattcggacactagtcaagagcttagacgagcgatatattgatgaggttacacgcaactatacctgggtacctatcaggtcaacaaattactcactgggcctggttcttcctccatacagcaccttctacttgcaagccaaccttagtgatcagattcttcaggtgaaatactttgaatttctcctcccatcctcttttgagtcggagggccacgtgttcatcgcccctagagaatattgcaaagacttgaatgcctccgataataacaccgaatttttaaagaattttatcgagcttatggagaaagttacacctgactcgaaacaatgcaacaactttttgttgcataatctgatcctggatacaggcattacccaacagctcgtggaaagagtctggcgagatcaggacctgaatacctacagcctgctggccgtgttcgccgctacggatgggggaattaccagagttttccccaataaagccgcagaggactggaccgaaaaccccgaaccgttcaatgcttcgttctatagaaggagtttggataaccatggatatgtttttaagccaccccatcaggacgcgctgcttagacctctggagctggagaacgatactgtgggtattctggttagcaccgctgtcgaattaagtctgggcagacgaactctaagacccgctgttgtgggggtgaagttggacctagaggcttgggccgaaaagtttaaggtactggcaagtaaccgtactcatcaggaccagccccagaagtgtgggccaaactctcactgtgagatggactgcgaggtgaacaatgaggacctcctgtgtgtactgatcgatgacggcggtttcctggtgctgagcaatcagaatcatcagtgggatcaagtaggacggtttttttcagaagtggacgccaatctcatgctggccctttacaacaacagtttctacaccaggaaagagtcctatgactaccaagccgcttgtgctccacaaccccctggcaatttgggagccgctccccgtggcgtctttgttcctaccgtggccgacttcttgaatcttgcatggtggaccagtgctgccgcttggtctttattccagcagctgctatacggcctgatctaccacagctggttccaggcggaccctgctgaagccgagggctctccggaaacacgcgagagcagttgtgtcatgaaacagacccagtattacttcggttctgtcaatgcctcttataacgccataattgactgtggcaattgctctagattgtttcatgcacagcgcttgaccaataccaatctcctcttcgtcgtggccgagaagcctttgtgctcgcaatgcgaagccggacgactattgcagaaagagacacattgccctgccgacgggcctgaacaatgcgaacttgtacagcgtccccgttatcgcaggggaccacacatttgtttcgactacaacgccactgaggatacctccgattgtggtagaggtgctagttttcccccttcccttggtgtgttggtaagtcttcagcttcttctgcttctggggctccccccaagacctcagccacaagttctcgtacatgccagccgacgactgtag

SEQ ID NO: 216559 - DNA, 3441 bp, Artificial Sequence
  Description of Artificial Sequence: Synthetic coding sequence
atggctgttccagcccgaacgtgtggagctagccgccctggcccagcgagaacagctcggccttggcctggttgcggaccacatcccggaccagggactagacgaccaacctcaggtccgccacgacccctctggctactgttacctctattgccactgttagccgcaccaggtgctagcgcatacagttttccccagcagcacaccatgcagcattgggcgaggcggttagagcaggaagttgatggcgttatgaggattttcggaggcgtgcagcagttgagagaaatctacaaagacaatcgtaaccttttcgaagtgcaggaaaacgagccccagaagcttgtggaaaaagtcgcaggcgacatcgagtctctgctcgatagaaaagtgcaagcgctcaaaaggctggcggacgctgccgagaatttccaaaaggctcacagatggcaggataacatcaaggaagaagatatcgtgtattatgacgccaaggctgatgcagaactggacgacccagaatctgaggacgtggagcgcggaagcaaagcttccacactccgactcgattttatagaggatccgaatttcaaaaacaaggtcaattacagttacgccgctgtacagatcccaacagacatttataaggggagtaccgttatcctcaatgaactcaattggaccgaggcactcgaaaatgtgttcatggagaaccggagacaggatccaaccctcctttggcaggtttttggatccgcgacaggcgtaacccgctattatcctgctacaccatggcgggctccaaagaaaattgatttatatgatgtccggaggagaccatggtacattcagggagcttcttctcctaaagacatggttataatcgtggacgtgagcggctcggtgtcaggcctgacgcttaaacttatgaagacctccgtttgtgagatgctagacaccctttccgacgatgattatgtgaacgtggcctcattcaacgaaaaggcacaaccagtgtcttgttttacccatttggttcaagccaatgtgaggaataaaaaggtgttcaaggaggcagtgcaaggtatggtcgcgaaaggcacaactggttacaaggccggtttcgagtatgccttcgatcagctccagaactccaacatcacgcgcgctaactgtaataaaatgatcatgatgttcactgacggaggcgaggaccgagtccaggacgtattcgagaagtacaattggccaaacagaaccgtccgggtattcaccttctccgtgggacagcacaattatgacgtgacccctttacagtggatggcctgcgccaataaggggtactatttcgagatcccgagcatcggggctattagaataaatacccaggaatatctcgacgtgttgggcaggcctatggtgctggcgggtaaagaggctaagcaggttcagtggacaaatgtgtacgaggacgctttgggtctgggcctggtagttacagggaccctcccagtcttcaacctgacccaggatgggccaggggaaaagaaaaaccagttgatactgggcgtgatgggcattgacgtcgcactcaacgacatcaagaggctcacccctaactacaccttaggcgctaatggatatgtatttgctatcgatctcaatgggtacgtacttttacatccaaacctgaaaccacaaaccacaaatttcagggaaccagtgaccttggacttccttgacgccgagcttgaggatgagaacaaggaagagatcaggcgttcaatgatcgatgggaataaagggcacaagcagatccggactctggtgaaaagcctagacgaaagatacatagatgaagtgactcggaattatacgtgggtccctattaggtctaccaattacagtctggggctggtcctgcccccttattctaccttctaccttcaggccaatctgtctgatcaaattttgcaagtgaagtatttcgaattccttcttccaagtagctttgaatccgaaggtcacgtatttattgccccacgtgagtactgcaaggatctgaacgccagcgataacaataccgagtttctgaaaaattttattgaactgatggagaaggtgactcctgatagcaagcaatgtaataatttcttgctgcataacctgatccttgacacaggtatcactcagcagttagtagagcgggtgtggcgcgatcaggatctgaacacatatagtctgttagccgtttttgcagccaccgacgggggtatcaccagagttttcccaaacaaggccgcagaagactggacagagaaccccgaaccttttaatgcatcattctacagacgcagtctcgataatcatgggtatgtttttaagccgcctcaccaagacgctctgctgcgcccactagaacttgagaacgatacagtgggaatactcgtttctacagcggttgaattaagccttgggcgtagaactctcagacccgcagtggtgggagttaaactggacctcgaggcatgggctgaaaaatttaaagtgctagcttcaaatcgtacccatcaagatcagccacaaaagtgtggcccaaatagtcactgtgaaatggactgtgaggttaataatgaggacttgctgtgcgtgttgatagacgacggcggttttctcgtgttgtctaatcagaaccatcagtgggaccaggtcggcaggttcttctccgaggtggatgccaatctcatgttagctctctataacaacagtttttacacccggaaagaatcctatgattaccaagctgcatgtgcccctcagcctccgggtaatctgggggctgctcctagaggcgtcttcgttccgaccgttgccgacttcttgaatctggcctggtggacttcagccgctgcttggtcactctttcaacagttgctgtatggcctaatttaccattcatggtttcaggccgatcctgctgaggcagaggggtcacctgaaacaagggaaagctcctgtgtcatgaaacagactcagtactactttggaagcgtcaacgcatcctataatgccatcatcgactgcggcaattgtagtcggttgtttcacgctcagcgcctgaccaacaccaacctcctgttcgtagtggctgagaaacctctgtgctctcagtgtgaggcaggccgactcctgcagaaagaaacccactgctgcccagctgatggacccgagcagtgtgagctggtccagcgtccccgttaccggcgtgggccacacatatgttttgactacaacgcgaccgaagacacctcagattgcggtcgcggagcttcctttcccccttccctgggtgtgcttgtgtcattgcagctgttactcctccttggactacctcccagacctcagcctcaggtcctggtccacgcaagtcgacgactctag

SEQ ID NO: 216560 - DNA, 3432 bp, Artificial Sequence
  Description of Artificial Sequence: Synthetic coding sequence
atggcagtgcccgctagaacctgcggtgcgagtagacctgggcctgctcgcacagcgagaccatggccaggatgcgggcctcaccctggtccagggaccagaaggccaactagtggcccaccacgcccactgtggttacttctgccattactgccactgctcgcagcaccgggagcctccgcctactcttttccccaacagcacaccatgcagcactgggcacggagactggagcaggaagtggatggggtaatgagaatcttcggtggagtgcagcaactcagagagatctacaaggataatcgaaatctgtttgaagtgcaggaaaacgagccccagaaactggtggaaaaagttgcaggggatattgaatccctgctggacaggaaagtccaagcactcaaaaggttagccgacgctgctgagaatttccagaaggctcatcgctggcaggacaatataaaggaggaagatattgtgtactacgacgcgaaggcagacgccgagctggacgaccctgagagcgaggatgttgagaggggctcaaaagccagcacgcttaggctcgacttcatcgaggatccaaactttaagaacaaagtcaactatagctacgcagcagtgcagattcctactgatatatacaaaggctcaaccgtgatcctgaatgagctgaactggaccgaagcactggagaacgtgtttatggagaaccgtaggcaggacccaaccctgctatggcaggtttttggaagcgctactggcgtgactcgctattaccccgctaccccttggagagcgccaaagaagatagacctttacgacgtacgaaggagaccttggtacatccagggggcatcgagtcccaaagacatggtcattattgtggacgtgagtggctcagttagcggcttgaccctgaagttaatgaaaacctccgtgtgtgaaatgttagacaccctatcagatgatgactatgtgaacgtcgcctctttcaacgagaaggctcagcctgttagctgtttcactcatcttgtgcaggctaatgtgcggaacaaaaaggtattcaaggaggcagtgcagggaatggttgccaagggcactaccggttacaaagcagggttcgagtacgcttttgaccaactccagaattctaacattacaagagcgaactgtaacaagatgattatgatgtttacagatggaggggaggatcgggtccaggacgtttttgagaaatataattggcccaatagaactgtgagagtgtttaccttctcagtggggcaacacaattatgacgtgacacctctccagtggatggcttgcgcaaataagggttactattttgaaatcccttcgatcggggcaattagaatcaacactcaggaatatctggatgtcctcggcaggccaatggtcttggccggaaaggaggctaagcaggtgcagtggaccaacgtgtacgaggatgcgcttgggttaggcctcgtggtcaccggcactctacctgttttcaacctgactcaggatggccctggcgaaaaaaagaaccagcttatcctcggagtgatggggatcgatgttgcactcaacgacatcaagaggttaacgcccaattatacgttgggcgcaaacggctatgtgtttgcaatcgacctaaacggttacgtcctcttgcaccctaaccttaaacctcaaacgacgaattttcgggaacctgtaacactggacttcctcgatgcagaactggaggatgagaacaaggaggagatccgcagatccatgatcgacggaaataaagggcacaagcaaattagaacactcgtgaagtccctggacgagaggtatatagacgaggtgactcgcaactatacttgggttccaatacggtcgacaaattattcattgggcctcgtgctcccaccctactcaactttctatttacaggctaatctctccgatcagattctccaagttaagtacttcgagtttcttctcccttcttcctttgagagcgagggacacgtgtttatcgccccaagggagtactgtaaggacctgaacgcttctgataacaacaccgagtttctaaagaacttcatcgagctaatggaaaaagtcacacccgactctaaacagtgtaacaatttcttactccacaatctgattctagatacgggaatcactcagcagctggtggagcgcgtttggagagaccaggacctgaatacatactctctgctggcagtttttgcggcaaccgatggcggaatcacccgggttttccccaacaaggcggctgaagactggacagagaatcccgaaccattcaacgcatctttctataggaggtcattggacaaccatggttacgtctttaaaccaccacaccaggatgccctgctgcgccctttggagctggagaatgatactgtcggtatccttgtgtctactgcggtggaactgtcgctgggtcgcagaactttacgcccagctgtggtgggcgtgaagttagacctggaggcatgggctgagaagttcaaggtcctggcctctaacagaacacaccaggatcagcctcagaagtgtgggccaaactcccactgcgagatggactgtgaggttaataacgaggatctcttatgcgtgctgatcgacgacggcggattcctcgtgctatcaaaccagaatcatcagtgggaccaggtcggtcgcttcttcagtgaagtggacgcaaatctgatgctcgcgctctacaacaacagcttttatacacgaaaggagagctatgattaccaagctgcttgtgccccacagcctccgggaaatctgggagccgcaccacgaggcgtgtttgtgcctaccgtggccgacttccttaatctggcttggtggacaagcgcagcagcctggtctctgttccaacagctgctgtacggtctaatctaccattcgtggttccaggcggacccagccgaggctgagggtagtccggaaacgcgggagtcaagttgcgtgatgaaacagacccaatattactttggcagcgtaaatgcaagttacaacgcgatcatagattgcggtaattgctcacgcctttttcacgcgcagcggctgacaaatactaacctgctgtttgtcgtcgccgaaaagcctctgtgtagccagtgcgaagccggacggttactacagaaagagactcacagcgacggccctgagcaatgcgagttagtccagcgcccaaggtaccgcagaggcccacatatttgctttgattacaacgcaaccgaggacacttcagactgtggcaggggggcatcattccccccttcactaggcgtgctagtcagcttacagctgctgttgctgctaggactgcccccacggccacagccgcaagtactagtgcatgcctctcgacgattgtag

SEQ ID NO: 216561 - DNA, 3462 bp, Artificial Sequence
  Description of Artificial Sequence: Synthetic coding sequence
atggccgtacccgctaggacttgtggagctagccggccagggccagcaaggaccgcgagaccttggcccggatgcggcccacatcctggcccaggaactaggaggcctacatctggtccccctcggccattgtggctgctgctgccactcctgcccctcctcgcggcaccgggagccagcgcctattctttccctcagcagcacacaatgcagcattgggctcgcaggctggaacaggaggtcgacggagtgatgagaatttttgggggagtccagcagctgagagagatctacaaagataacagaaatcttttcgaggtgcaggaaaacgaaccccagaagctggtcgaaaaagtggccggagacatcgagtccttacttgaccgcaaagtacaagccctcaagaggctagcagacgctgcggaaaactttcaaaaagctcacaggtggcaggacaatattaaggaggaggacatcgtatactacgatgctaaggcggacgcggagcttgacgatcctgaatccgaggacgtggagcgcggaagcaaggctagcacgctgagactggattttattgaagatccaaattttaaaaataaggttaactactcctacgccgcagtgcagattcccacagacatctacaaggggagtactgtcatactgaatgagttaaactggaccgaggcactggagaatgtctttatggaaaataggagacaggatcccactttgctttggcaggtgtttggaagcgcaacaggggtaacacggtactacccggctacgccttggagggcgccaaagaaaatcgacctgtacgacgttaggagacgtccttggtacattcagggtgccagctcccccaaggacatggtgattatcgtcgacgtgtcagggagcgtttctggcctgactctgaaactcatgaaaaccagcgtgtgcgaaatgcttgacactctatcggatgacgactacgtcaatgtagctagttttaacgagaaggcacagcccgtttcctgttttacacacctggtacaagccaatgtgagaaacaagaaagtgttcaaagaagccgtccagggaatggttgcaaaggggacaaccggctataaggccggatttgagtacgcttttgaccaactacaaaactcaaacattaccagagctaactgcaacaagatgataatgatgttcacagacggaggcgaagacagagtgcaagatgttttcgaaaaatataattggcctaacagaactgtccgggtatttactttttcagttggacagcataattatgatgtaactcccttgcagtggatggcctgcgctaacaaaggctattattttgaaattccttcgatcggagccatacgaatcaacacacaagaatacctggatgttctggggcgtccgatggtactggcagggaaagaggccaaacaggtgcagtggactaacgtctacgaggacgccctcggactcggcctggtggtgaccggtactctgcctgtgttcaacttgacgcaggacggcccaggcgagaagaagaaccagctcattcttggggtcatgggcatagatgtcgcattgaatgacattaagaggctcacacctaactatacattgggcgcaaatggctacgtgttcgccattgacctgaacggctacgtcctcctgcatcccaatctgaagccccagaccacaaattttcgtgagccagtcacactggatttcctggatgctgagctcgaagacgagaataaggaagagatacgtcgcagtatgattgacgggaacaaaggccacaaacagatccgaacactggttaaatccctggacgaacgctacatcgacgaggtgacccggaattatacttgggtaccaattaggtccacaaactattccctaggtttggtgttgccaccatatagcactttctacctgcaggcaaacctgtccgatcaaattctgcaggtcaaacttcccatcagcaaattgaaggatttcgagttcttactaccctcctcctttgagagtgagggccacgtgttcattgcgcctcgagaatattgcaaggacctgaatgcatctgacaataacacagagttccttaaaaacttcatcgagcttatggagaaggtcactcccgattccaaacaatgcaacaactttctactgcataatcttattctcgacaccggaattacccagcagcttgttgaacgcgtctggagagatcaagatctgaatacatactccctgctagctgtcttcgccgcaacagacggaggcattacacgagtttttcctaataaggctgcggaggactggaccgagaatccagaaccctttaatgctagtttctacaggcgttctctggacaatcatggttacgtcttcaagccaccgcaccaagatgcgctgctgcgacctctcgaactcgagaatgacaccgtgggcatactcgtgtccacggcagttgagctgtctttggggcgtcggactcttagacccgcagtcgtgggagttaagctggacttggaagcatgggccgaaaaattcaaagtgttggcctctaaccggactcaccaggatcagcctcaaaaatgtggacctaattcccattgtgagatggattgtgaggtgaataacgaggatttactttgcgtgctgatcgatgacgggggttttctggtcctgtcaaaccagaatcaccagtgggaccaggtcggacgttttttctccgaagtagacgctaacctgatgctagcactttataacaatagtttttataccaggaaagagagttacgactaccaggcagcctgcgccccacagccaccaggcaacctgggggcagcaccaagaggggtgtttgtccctacagtggctgattttctcaatctggcgtggtggacgtcagcggcagcctggtctctcttccaacagcttctctacgggttgatataccactcatggtttcaagccgatcctgctgaggccgagggcagcccagaaactagggagagcagctgcgtcatgaagcaaacacagtattacttcgggtccgttaatgcttcctacaacgccatcatcgactgtgggaattgcagtagattatttcacgcacagcggctcaccaatactaacctgctctttgtagtagctgaaaaaccactctgttctcagtgcgaagctggcaggctcctgcaaaaggagacacactgctgccccgctgatggacctgaacagtgtgaactggttcagaggccccgttataggagggggcctcatatttgcttcgactacaatgctacggaggacactagcgactgcggaaggggggcatccttccctccttcactgggcgtgttggtgtctctgcagcttctcttactcctggggttaccgccaaggccacagcctcaagtgttggtacacgcatcgaggcgtctgtag

SEQ ID NO: 216562 - DNA, 3453 bp, Artificial Sequence
  Description of Artificial Sequence: Synthetic coding sequence
atggccgttcctgcgagaacctgtggtgcctcccgacccggacccgctagaaccgccaggccctggccgggatgtggccctcacccaggaccagggactagacggcctacgagtggtcccccacggccactttggctgcttctgcccctgctacccctgttagcagccccaggcgcatctgcctatagttttcctcaacagcataccatgcagcactgggcacggcgtctggagcaggaggttgacggtgtcatgcgcatcttcggtggagtgcagcagctgcgggaaatctataaggataatcgcaacttgttcgaagtgcaggagaatgaaccacagaagctcgttgagaaagtcgccggtgacatcgaaagccttctcgaccgtaaggtgcaggccttaaaaaggttagctgatgccgctgaaaattttcagaaggcccataggtggcaagacaacattaaagaggaggatatagtgtattatgacgccaaggccgatgctgaattagacgatcccgagagtgaagatgtcgagagaggcagtaaggcttccactctacggttagatttcatcgaagaccccaatttcaagaacaaggtgaattactcttatgctgccgtgcaaatacctactgacatctacaaggggtccaccgtcattctgaacgagctgaattggacagaggccctggagaacgtgtttatggagaacaggcgccaagatcccaccttactttggcaggtgtttggcagcgccactggcgtgactagatattaccctgctacaccatggagggcacccaagaagatcgacctctatgacgtcagacggaggccttggtatatccagggagccagttctcctaaagatatggtgatcattgttgatgttagcggttcagtatcaggcttgaccctcaaactgatgaaaacgtccgtttgtgaaatgctagacactttgtctgatgacgattatgtgaacgttgcgtccttcaatgaaaaggctcaaccagtgtcatgcttcacacacctcgtacaggcgaacgttcgcaacaagaaagttttcaaggaggcagtccaggggatggtggctaagggcactaccggctacaaggccggttttgagtacgcgttcgaccaattgcaaaacagtaatattacaagagccaactgtaacaagatgataatgatgtttacagatggcggtgaagatagagtgcaagatgttttcgaaaagtataactggccgaataggacagttcgagtttttacgttctcagtcggtcagcataattacgatgttacccccctacagtggatggcttgcgcaaacaagggctattatttcgagatcccctcaataggagctatacgcattaatacacaggagtacctggatgtgttgggacggcctatggtgctggctggaaaggaggcgaagcaagtgcagtggacgaacgtgtatgaggacgctctgggattgggcctagttgttaccggaaccctccccgttttcaacctgacacaggatgggcctggtgagaaaaagaatcaactgatcctcggggtgatgggaattgacgtcgctctcaatgacatcaagaggctgacacctaattacaccctcggcgctaatgggtacgtctttgccatagatctgaacggatacgtgttattacatcctaatctgaaaccccagacaacaaatttccgggaacctgtgacactagattttctggatgcggaactagaagacgaaaacaaggaggaaattcgccgttccatgatagacggcaacaagggacataagcaaatcagaactctggtgaaatccctggacgaaaggtacattgatgaggtcacccggaattacacgtgggtcccaatcaggagcaccaactacagtttgggcctggtgcttccgccatactccactttttacctgcaagcaaacctctccgaccagatcctccaagtgaagctccctatcagcaaactcaaggatttcgaattcttgcttcctagtagtttcgagtccgaaggtcacgtcttcatcgccccaagagagtactgtaaggatttgaatgcgtcagacaataacaccgagtttctgaagaacttcatagaattaatggagaaggttactcctgactccaaacagtgcaacaactttctgcttcacaacctcatcctggataccggtatcacccagcaactggttgaacgggtgtggcgcgatcaggacctgaatacatattcactgctggccgtctttgcggctaccgatggtggtatcacacgggtctttccaaacaaagccgctgaagactggaccgaaaacccagaaccatttaacgcgagtttttatcggcgatctctggacaaccatgggtatgttttcaaaccccctcaccaggatgccctattgcgtccgctggaactggaaaacgacactgtgggaattctcgtgagcacagccgtggagctgtccctagggaggcgtacactccgacccgctgtggtcggagtcaaactggacctggaagcctgggccgagaaatttaaggttctagccagcaaccgaacacatcaagatcagccgcagaagtgtggtcccaactctcattgtgaaatggactgcgaggtgaataatgaagatctgctctgtgtgcttatcgacgacgggggttttctcgtcctttctaatcaaaatcatcaatgggatcaggtcggacggttcttttccgaggtggatgccaacttaatgctagcactgtataacaactccttctataccaggaaagagtcttacgactaccaggccgcatgtgcccctcagcctccaggaaacctcggggcagccccacgcggagtctttgttcccactgtcgcagattttctgaatctggcctggtggacgtctgcagccgcttggtctctatttcagcagctcctgtatggtctgatctatcactcctggttccaggcggatcctgcagaagccgaggggtctcctgagacccgagagtcctcatgcgttatgaaacaaacccaatattatttcgggagtgtcaacgcctcatacaacgccataattgactgtggaaactgtagccgcctatttcatgcccagcgccttaccaacacaaatctgctgttcgttgtcgccgaaaaaccgctctgttcccagtgcgaagcaggccgactcctgcagaaggagactcactccgatggaccagagcagtgcgagctggtgcagcggccaaggtacaggcggggtccccacatttgctttgactacaacgctaccgaggacacttcagattgtggacgcggagccagtttccctccaagcctgggcgtgctcgtctcattgcagctgttacttctgttgggcctgcccccaagaccccagccccaggtgttggttcatgcgagccgcaggctgtag

SEQ ID NO: 216563 - DNA, 3276 bp, Artificial Sequence
  Description of Artificial Sequence: Synthetic coding sequence
atggcaggcccaggcagcccacggcgagcgagccggggtgcgagcgcactactggcagctgccctactctacgccgcattgggcgacgtcgtccgttccgagcagcagatccccctgtccgtggttaaactttgggcttcggcattcggcggagaaatcaagtccattgccgcaaagtacagcgggagccagctgctgcagaagaagtataaagagtacgaaaaggatgtcgcaattgaagaaatagatggcctccagttagtgaagaaactcgccaaaaatatggaagagatgttccacaagaaatccgaagctgtcagaaggttagtagaagctgctgaagaggctcatctcaagcatgaattcgacgctgacctgcagtacgaatacttcaatgccgtgcttataaatgaaagggacaaggacgggaactttcttgagttaggcaaggaatttatcttggcacctaatgaccactttaacaacttaccagtcaatattagcctgtcagacgtgcaggtcccaacaaacatgtacaacaaggacccagcaatcgtcaacggtgtgtattggagtgaatccttaaataaggtgtttgtggataacttcgaccgagaccccagtctgatctggcagtatttcgggtcagctaaaggtttcttcaggcagtatcccggaattaaatgggagccggacgagaacggtgtaatcgcctttgattgtcgcaaccggaaatggtacatccaggccgctacatctcccaaagatgtggtgattctggtggacgtgtctggctccatgaaaggcttgagattgacaattgctaagcagaccgtttcttctatcctggatacgttaggcgacgatgactttttcaacatcattgcttataatgaggagctccattacgtcgagccttgcttgaatggaaccctggtgcaggcagaccgcacaaacaaggagcactttcgcgaacacctggacaagctcttcgcaaaaggtatcgggatgctggacatcgccctcaatgaagccttcaatattctgagcgattttaaccataccggccaaggaagtatatgcagccaggctatcatgctgataaccgacggggcagtggatacttatgacactatctttgccaagtacaattggcccgaccgcaaagtccgcatatttacatacttgattggacgggaagccgcatttgctgacaacctaaaatggatggcatgcgcgaacaagggcttctttacccagatctctacactagccgacgtacaagaaaacgtgatggagtacctgcacgtgctgtcgcgacctaaagtgattgaccaagagcacgacgtggtctggaccgaggcctatatcgattccactcttccccaggcgcagaaactcacggatgatcaaggacccgtgttgatgaccaccgttgccatgcctgtgtttagcaagcagaacgagactagatctaagggaattctcctgggagttgtggggacagacgtgcccgtgaaagaactgttgaaaactatccctaaatataaactcgggattcatggctacgcttttgctattacaaataatggctatatcctcacccaccctgagctccgtctgctttacgaagagggtaagaagcgcagaaaacccaattatagctccgtggatctaagcgaggtcgagtgggaggaccgcgacgacgttctaaggaacgccatggtaaataggaagaccgggaagttcagtatggaggttaaaaagaccgtggataaaggcaagagagtcctggtcatgacaaatgactactattatactgacatcaaggggactccattcagtttaggcgttgcactgagcagaggccacggtaagtatttctttcgcggaaatgtgactattgaagagggtcttcacgatcttgaacatcccgacgttagcctagccgatgagtggtcttattgcaacaccgatctgcatcctgaacaccgtcatctaagtcaacttgaggccataaaactgtacctcaaaggcaaagagccactgctgcagtgcgacaaggagctcattcaggaggtgctgttcgacgccgtcgtgtccgccccaatcgaagcatattggacaagtctggcgctgaacaaatccgagaacagcgacaaaggagttgaggtggcctttctgggcacacgaactggactgtcccgcatcaatctgttcgtgggcgctgaacaactgacaaatcaggacttccttaaggcaggggacaaagaaaatatcttcaatgctgatcattttccgttgtggtatagacgtgcagccgaacagatccctgggtctttcgtgtactccataccctttagcacaggcccagttaataaaagtaacgtcgtcacagccagcacttctattcaactcctggacgagaggaagagtccagtcgtcgcggctgtggggatacaaatgaagttggaattctttcagaggaaattctggacggcttctagacagtgtgcctccttagatggaaaatgttctatttcctgcgatgacgaaaccgtgaactgttatctgatcgacaataacggctttattctggtttcagaagattatacacagactggggatttctttggagagatcgaaggggcagtgatgaataagctcctgacgatgggaagtttcaaacgtattaccctgtacgattatcaggctatgtgtcgagccaataaagagtctagcgacggtgctcatggtttgcttgacccctacaatgcatttctgtccgccgtgaagtggattatgactgaactggtactcttccttgttgagttcaacttgtgttcctggtggcattcagatatgactgctaaggctcagaagttgaaacaaactcttgaaccatgtgacacagagtatccagcttttgtaagtgaacgcaccattaaggagaccacaggcaacatcgcatgtgaagattgttcaaaatcatttgttattcaacagattccttctagtaatctgttcatggtggtggttgactcatcttgcttatgtgaaagcgttgcacccataacaatggcgccaatcgagatccgatacaacgaatctctgaagtgcgagcgactgaaagcacagaaaattagacggaggcctgagagttgccacggcttccacccggaggagaatgccagggagtgtggaggtgctccttctctgcaggcacagaccgttctattgctgcttccgctcctgctgatgctgttttcacgctag

SEQ ID NO: 216564 - DNA, 2997 bp, Artificial Sequence
  Description of Artificial Sequence: Synthetic coding sequence
atgggcgaactacgccaggaacgaagtactgccctccagcggctggtggaggcggcagaggaagctcatctgaagcacgaattcgacgcagacctgcagtatgagtattttaatgctgtgctaattaatgagcgtgataaagacgggaacttcctggagctgggaaaagaattcatcctggcccctaacgaccactttaataatctgcccgtcaacattagcctgtccgatgtccaggtgcccactaacatgtacaataaggatccagccatcgtgaacggggtctactggtctgaaagcctcaacaaagtcttcgttgacaacttcgacagagatcctagcttgatttggcagtacttcggctcggcaaaaggattcttcaggcagtacccaggaataaagtgggagcccgatgaaaatggagtgattgccttcgattgccggaacaggaagtggtacatccaggccgctacctcccctaaggacgtcgtgatcttggtggacgtgtctggctcaatgaaagggcttcggctgactattgccaaacaaacagtgagttctatcttggatacattaggtgatgacgacttttttaatattattgcgtataacgaggagctccactatgtggagccttgtctcaacggtacgctggtccaagctgacaggacgaataaggagcacttccgggaacatctggacaagctcttcgctaaaggcattgggatgctggacatcgcgctgaacgaggccttcaacatcctatccgactttaatcatacaggacaggggagtatatgttcccaggccatcatgttaatcaccgacggcgctgtcgatacttatgacacgatctttgccaaatataactggccggatcgcaaggtgagaatattcacctacctaatcggcagggaagctgcctttgcagataatctgaagtggatggcctgcgccaacaagggctttttcacgcagattagcacacttgccgacgtgcaagagaatgtgatggagtatttacatgtcctgagcaggcccaaggttattgaccaggaacacgacgtggtgtggacggaagcgtacattgactccaccgtgagtcaggccgaacagctgactgatgaccaggggccagtgctgatgacgacagttgccatgcccgtgttctctaaacagaatgaaacgagatctaagggcatcctactgggagtggtcgggacagatgtgcctgtcaaggaacttctgaaaaccatccctaagtacaagttagggattcacgggtatgcgttcgctatcacaaataacggctacattttaacccacccggaactacgcctcttgtacgaagaaggaaaaaagaggcgcaaacccaattatagttcagttgacctgtctgaagtggagtgggaggaccgtgatgatgtcctgagaaatgccatggttaaccgcaaaaccggtaagttcagtatggaagtgaagaaaaccgtcgacaagggtaaaagagtccttgtaatgactaacgactactactataccgacatcaaaggaacacctttcagcttaggtgttgccctgtcaagaggacacggcaaatactttttcagaggaaacgtgactattgaggagggcttacacgaccttgagcatcccgatgtcagtctggcggacgagtggtcctactgtaacacggacctccatcctgagcatagacatctctcccagctggaagccatcaaattgtacctgaaaggaaaggagcctttgctgcagtgcgataaggagctgatacaagaggtgctttttgatgctgtcgtcagtgcccctatcgaggcatactggacatctctagcattgaataagtcagagaattcggataagggtgtggaggtcgcattcctgggcacgcgcaccgggctgtctcgaatcaatttgttcgtcggggctgagcagctaaccaatcaggacttcctgaaagcgggagataaggagaatattttcaatgctgatcatttcccgctctggtacaggagagccgcagaacagattcccggaagttttgtgtatagcattccgttcagcacaggtcctgtaaacaagtctaatgtggtcaccgccagtaccagtattcagctgcttgacgaacgcaagtctcctgtggtggccgctgtgggaatccagatgaagctggaattctttcagagaaagttctggactgcctctaggcaatgcgccagcctagatggtaaatgtagcatctcttgcgacgatgagactgtgaactgctatttgattgataacaacggctttatattggtctcagaagattatacacagacaggcgacttcttcggagagatcgagggcgcagttatgaataaactccttacgatgggttcctttaagcgtatcacgctctacgattaccaggctatgtgccgggcaaacaaagagtcgtccgacggtgctcacggcctgttagacccatacaacgcttttctatcagccgtgaaatggattatgactgaattggtgttgttcctcgtcgagttcaatctttgctcgtggtggcacagtgatatgacagcgaaggcccagaagctcaagcaaaccttggagccgtgcgatacagagtatcctgcgtttgtcagcgaaagaaccattaaggaaacaacaggcaatatagcctgtgaggactgttccaaatcctttgtaatacagcaaatcccatcatcaaacctctttatggtcgtggtcgatagtagctgtttgtgcgaaagcgtcgcgccaatcacaatggcacccattgagatctcacagcacaacgaaagcctgaagtgtgaacgtctcaaggcccaaaagataagaaggcgaccggagagctgccatggattccacccggaagaaaacgcgcgtgaatgcgggggtgcgccatcgctgcaagcccagactgtcctgctactcctgcctctcttgttgatgctgttcagcaggtag

SEQ ID NO: 216565 - DNA, 3276 bp, Artificial Sequence
  Description of Artificial Sequence: Synthetic coding sequence
atggccggacccggtagtccaaggcgagcttcacggggtgccagcgcactgctcgcagccgcactgctctatgctgcattaggggatgtcgtgcgctccgagcaacagattcccctttctgtggtgaagctctgggcctctgccttcgggggagagatcaagtccattgccgctaagtactctggctcccagttgctgcaaaagaaatataaagaatacgagaaggacgttgctatcgaagagattgatgggctgcagctggtcaagaagctggccaaaaacatggaagagatgtttcacaaaaagtccgaggcggttaggagactggtggaggctgctgaggaggcccatctcaagcacgagttcgatgcagacctgcagtatgaatattttaatgcagtattaatcaacgagagggataaagacggaaattttctggaacttggcaaggagtttatcctcgctcccaacgaccattttaataacttaccagtcaatatcagcttatctgacgttcaggtgcctactaatatgtataacaaggaccccgctatcgttaatggtgtatactggtccgaatcactgaataaagttttcgtggacaacttcgacagggatccatccttgatttggcagtatttcggaagcgccaaagggttttttaggcaatatcccggtatcaaatgggaaccagacgaaaacggtgtaattgcatttgattgcaggaatagaaagtggtacatccaagctgctacaagccctaaggacgtggtaatcctggtagacgtttctggcagcatgaaggggctcaggctgaccatagctaaacagacagtgtcttcaatcttggataccctgggtgacgacgatttttttaatatcatagcatacaatgaagagttgcattatgtggaaccatgccttaatgggacactggtacaagcagatcgaaccaataaggagcacttcagggagcatttggataagctgtttgccaagggtatcggaatgctggatatcgcactcaacgaggccttcaatatccttagcgacttcaatcacacaggccagggttctatttgttctcaggcaattatgctgataactgatggagcagtcgatacatacgatacaatattcgcgaagtataactggcccgaccggaaggttaggattttcacttatctgatagggagagaggctgcattcgcagacaatctaaaatggatggcttgcgcgaataaaggattcttcacccaaattagtacactagctgatgtgcaggagaatgtaatggagtatcttcacgtcctctcccggccaaaggtcattgaccaggagcatgacgtagtgtggaccgaggcctacatcgactctactcttcctcaggcacagaagctgacagacgatcagggacccgtattgatgaccacagtggcaatgcctgtcttttccaagcagaatgagacaagaagcaaaggcatattactgggagtggtgggcaccgacgtgccagttaaagagctgttaaaaactattccgaaatacaagctgggcatccatggctacgcgtttgcgatcacaaataacggttacattcttactcatccagaactgagactgctctacgaagagggtaagaagagaagaaagcccaactactcttccgtagacctgagcgaggttgaatgggaggatagagacgacgttctccggaacgccatggtaaacaggaagacaggcaagttctcaatggaagtgaagaagaccgtcgacaagggcaagagggtcctcgtaatgacaaatgactactattataccgacattaagggaacaccattttcattaggcgtcgcccttagccgagggcacggaaagtatttttttaggggcaacgtgacaatcgaagagggcctccacgatttggaacatcccgatgtcagcttggctgatgaatggtcgtattgtaatactgatctgcatccagagcatagacacctctcacaactcgaagcaatcaagctctatttgaaaggcaaggagcctttgctgcagtgcgacaaggaacttatacaggaggtcctattcgatgccgtcgtaagcgcacccatcgaagcctattggacatccctggcgctcaacaaatctgagaattcagacaagggtgtggaagtcgcgttccttgggacacgcacaggcctttcccgtataaacctttttgtgggcgctgagcagctcactaatcaggattttctcaaagcaggtgacaaagagaatatttttaacgccgaccacttcccactttggtaccggagagccgcagaacaaattccaggaagcttcgtttactccatcccattttccaccggacctgtgaataagtctaatgtcgtgacagctagtacgagtatacagctcctggatgaaagaaagtcaccagtcgtggcagcagttggaattcagatgaagctggaattctttcagagaaaattctggacagcatctagacagtgcgcaagcctcgacggtaagtgctctatctcttgcgacgatgaaaccgtgaactgttacctcattgataacaatgggttcatactggtgtccgaagactatactcagaccggggatttctttggcgaaatagagggcgcagtcatgaataagttgctaaccatgggctcatttaagaggatcactctgtacgactaccaggctatgtgtcgggcaaacaaagaatcatccgacggtgcccatggcttgctggatccgtataacgcattcctttctgccgtgaaatggatcatgacagagctcgtcctgtttctcgttgagttcaatctgtgctcgtggtggcattctgatatgaccgctaaagctcagaagcttaaacagactctggagccttgcgacacggaatatccagcattcgtgtctgaacggaccatcaaggagaccacgggcaacatcgcatgtgaggactgttccaagtccttcgtgatccaacagatacccagcagcaatctgttcatggtggtggtggattcctcatgtctctgcgagagcgtcgctccaattacaatggcccctatagagatccgctacaacgagtccctgaaatgtgaacggctgaaggcccagaagatcagacgcaggccagagagctgccacggctttcaccccgaagaaaatgcgagagagtgcggaggcgcaccctccctccaggctcagactgtgcttctgctgcttccgctacttctaatgttattctcgcggtag

SEQ ID NO: 216566 - DNA, 1557 bp, Artificial Sequence
  Description of Artificial Sequence: Synthetic coding sequence
gagattctgttccaccagatgcagaatcagattaaacggttagtcgaggctgctgaagaagctcacctcaagcatgaatttgacgcagacctgcagtacgagtatttcaacgccgtcctgatcaacgagcgagacaaggacggtaatttcctggagctcggcaaggaatttattttggcacccaacgatcatttcaacaatcttccagtcaatataagtctcagtgatgtgcaagtacctacaaacatgtacaataaggatcctgccattgtgaacggtgtgtactggagcgagagtttaaataaagtcttcgtggacaactttgacagggacccaagcctgatctggcagtattttggctcagcgaagggtttcttcagacaataccctggcataaagtgggaaccggatgagaatggtgtcatagcgttcgactgtagaaaccgtaagtggtatatacaagcagccacctccccgaaagatgttgtcattctagttgatgtctctggaagcatgaaaggcctcagattgaccatcgctaagcagactgtaagtagtatcctcgacaccctaggcgacgatgatttcttcaatatcatcgcatacaatgaggagttgcattatgttgagccatgtctaaacgggactctggttcaagccgacagaacaaacaaggagcatttcagagaacacttggataagctgttcgccaaagggattgggatgcttgacatagcactcaatgaggcattcaatatattgtcggactttaaccacaccgggcagggctcaatttgtagccaagctattatgctgattacggatggcgcagtggacacgtatgatacgatttttgccaagtacaattggccagaccgcaaagtgcgaattttcacatacttgatcggtagagaagcagcttttgccgacaacctcaaatggatggcatgcgctaacaaaggctttttcacccagatctccactctggccgatgttcaggagaacgtgatggagtatctgcatgtgctgtcccgcccaaaggtaatcgatcaggaacatgacgtagtgtggaccgaggcttatatcgattctaccctaaccgatgaccaaggcccagtgctcatgacaactgtagctatgccagttttctcaaagcagaatgagacaaggtcgaaagggattcttctgggcgtggttgggacagatgtgccagtgaaagaactgcttaagactattcctaagtataaattgggaattcacggctacgctttcgcaattacaaataacgggtatattttgacccatccggaactgcgcctcttatacgaagaaggtaagaaacggagaaagccgaactactcttctgtggaccttagtgaagttgagtgggaggaccgggacgacgtgctcagaaatgccatggtgaatcgaaagacaggaaagtttagcatggaagtgaagaagacagttgacaagggcttccgctgcggtgcttttcagaggtcctgggaaatatttttgcctagggagtgcaatcaccgacggagacccgcttag

SEQ ID NO: 216567 - DNA, 3276 bp, Artificial Sequence
  Description of Artificial Sequence: Synthetic coding sequence
atggcgggtccagggtccccccgtcgcgctagcaggggcgcatcagcacttctcgctgccgcactcctctacgcggcacttggggacgttgtgcgctctgagcagcagattccccttagtgtagttaagctttgggccagtgcttttggaggggagataaagagcatcgccgctaaatactccgggtctcagctcctgcagaaaaagtataaggaatacgaaaaggatgtggccatcgaggagatcgacggcctacagctagtgaagaagctggctaaaaacatggaggagatgttccacaaaaagagcgaagccgtgcggcgactcgtcgaagcggctgaagaagctcacctgaaacatgagttcgacgccgatctccagtacgagtattttaacgccgtcctgattaacgagcgcgataaagacggaaactttctcgaactcggcaaagaattcattttggctcccaatgatcactttaacaacctgcccgtcaacataagcctaagcgatgtacaagttccaaccaacatgtacaacaaggaccccgctatcgtcaacggtgtatattggtcggaatcgttaaacaaggtgtttgtcgacaattttgaccgtgatccctcactgatctggcaatattttggcagcgcaaagggattcttcaggcagtacccgggaatcaaatgggaacccgatgaaaacggggtcatcgcttttgattgcagaaatcggaagtggtacattcaggctgcaacgtcaccgaaagatgtagtgattttggtcgatgtgtccggcagcatgaaaggcctgcgtctgacaattgccaagcagactgtgagctcaatactggataccctcggagacgatgactttttcaacataattgcatataacgaagagctccactatgttgaaccctgtctgaatggcacactggtacaggctgatcgcacaaataaagagcattttcgggaacatctcgataaactcttcgcgaaaggcattggtatgctggatattgctctcaatgaagcattcaatatcttatctgactttaaccatacagggcagggctccatctgtagccaggctattatgctgatcactgacggcgctgtagatacatacgatactatctttgctaagtacaactggcccgaccgcaaagtcagaatctttacgtatctgattggacgcgaggcagcattcgccgacaatttgaagtggatggcttgcgccaataaagggttcttcacccagatctctaccctcgcagacgtgcaggagaacgtaatggaataccttcacgtcttatctcgccctaaagtaatagatcaagagcacgacgtggtgtggacggaggcctatattgatagcacactaccccaagcccaaaagttgaccgatgaccaagggccagttctcatgacaaccgtcgccatgccagtcttctccaaacagaacgagaccaggagcaaggggatcttgcttggagttgtcggcaccgatgtgccggtgaaggagttgctgaagactattccaaaatataagctaggcatccacggatatgccttcgccatcaccaataacggttatattctcactcatcctgagttacgcttgctttacgaggagggcaagaaaaggagaaagccaaactacagtagcgtcgatctctcagaagtggagtgggaagatcgcgatgacgtcttgaggaacgcaatggtgaatcgcaagacaggcaaattctcaatggaggtaaaaaagaccgtggacaaaggtaaacgagttctggtcatgacaaacgattactattatactgatatcaagggcaccccattctcacttggcgtcgcactaagtcgcggacatggcaaatactttttcagagggaacgtgaccatcgaggagggtttgcacgatctggagcaccccgacgtcagtctagccgacgagtggtcctattgcaacaccgatcttcacccagaacataggcatcttagtcagctggaagcaatcaaattgtacctcaaagggaaggaacctctactacagtgcgacaaggagctcatccaagaagtgctatttgatgccgtggtgtccgcgccaatcgaggcctattggacttctttggccctgaacaagtccgaaaactcagataagggcgtggaggtcgcatttctgggcaccagaactggcctgagtcggatcaatctgttcgttggagccgaacagctgaccaatcaggatttcctcaaggccggtgacaaggaaaatatattcaacgcggatcactttcctctctggtaccgaagagctgccgaacagattcccggatctttcgtgtatagtatccctttttctaccggccctgtgaacaagtccaatgtggtcacagcctcaactagtattcagttgctggatgagagaaaaagtccagtagtcgcggcagttggtatccagatgaagctggagtttttccaacggaagttctggacagcctcccgacaatgtgctagcctggacgggaagtgttctatatcatgcgacgacgagaccgtaaactgctacctcatcgataataatggttttatcctcgtttcggaagactacacacaaacaggggactttttcggcgagattgagggagcggtaatgaacaaactgctgaccatgggcagcttcaagaggattacgctgtacgactaccaggccatgtgtcgtgccaacaaggaatcttccgacggcgcacacggtctgctggacccatacaatgctttccttagcgccgtcaagtggattatgacggaattggttctcttcctggtggagtttaacctgtgttcctggtggcattcagacatgacggccaaggcacagaagttgaaacagactttagagccttgcgacactgagtatccagcattcgtgtctgagcggactattaaagagactactggtaacatcgcatgtgaagattgctctaagtccttcgtgatccagcaaatcccttcctccaacctctttatggtagttgttgactcaagctgtctgtgcgagagtgtggcacctatcaccatggcccctattgaaatccgctacaacgaatcattgaagtgcgagaggcttaaggctcaaaagatcaggcgccgaccagagagttgccacgggttccatccggaagagaacgcccgagaatgtgggggagccccatctctccaggcccagaccgtgctcctgctcctgcctctcctcctgatgctgttctctcgctag

SEQ ID NO: 216568 - DNA, 1578 bp, Artificial Sequence
  Description of Artificial Sequence: Synthetic coding sequence
atggaggaaatgttccataagaaatctgaagcagtaagaagactagtggaagccgctgaggaagcccaccttaaacacgaatttgacgccgacttgcaatatgagtactttaacgcagttttaatcaatgaaagggacaaagatggcaacttcctcgaactggggaaagaattcattctggcaccaaacgaccatttcaataatttaccagtgaatatttccttgtccgacgtgcaggtcccaacaaatatgtacaacaaagatccagctatagtgaacggggtgtattggtcggagagcctgaataaggtgtttgtagataactttgaccgtgacccctccctcatatggcaatatttcggcagcgcaaagggatttttccgccagtatcccggaatcaaatgggagcccgacgagaacggcgttatcgctttcgattgtcgaaaccggaagtggtatattcaggccgcaacatcacctaaggatgtggtcatccttgtggatgtgtccgggtccatgaaaggcctccggctgacgatcgcaaaacagactgtttcttccatactggatactcttggcgatgatgacttcttcaacataattgcctacaacgaggagctgcactatgtggaaccttgcctcaatggcaccctggtgcaggccgaccgcacaaacaaggagcattttcgggagcatctcgataagttgtttgcaaagggaatcggcatgctcgacatagctctgaatgaagctttcaacatcctctccgactttaaccatactggccagggctcaatatgcagccaagctataatgctgattactgacggagcagtggatacctacgataccattttcgccaaatacaactggccagatcgcaaggtgagaatctttacgtacctcattgggagggaggccgcttttgctgacaacctgaaatggatggcatgcgctaacaagggcttttttacacagatttccacgctggccgacgtgcaggaaaacgtgatggagtacctacacgtgctatcacggcctaaagtcatcgaccaggaacatgatgtcgtttggaccgaggcttacattgatagcacactgccacaggcccagaaactgacagatgaccaaggacccgtccttatgaccacagtcgctatgccggtgttttccaagcagaacgaaacacggagtaaggggattttgctgggagtcgtcggtactgacgtgccagtgaaggagttattaaagaccatacccaagtataaattgggaattcatggttacgcattcgcaattaccaataatggctacatcttaacacaccccgagctccgacttctgtatgaagaaggcaagaagaggcggaaaccaaactactctagcgtagacctaagtgaagtcgagtgggaagacagagacgatgtactccgcaacgccatggtgaatcgtaagaccggcaagttttctatggaagtgaagaagacggtcgacaagggcttccggtgcggcgcattccaaagatcctgggaaatttttctccctagggagtgtaaccacaggcggcgaccagcttag

SEQ ID NO: 216569 - DNA, 2994 bp, Artificial Sequence
  Description of Artificial Sequence: Synthetic coding sequence
atggaggaaatgtttcacaaaaagtctgaagctgtccgcagactggtggaagcagctgaagaagctcacttaaagcatgagtttgacgctgacctgcaatatgaatactttaatgctgtgctcatcaacgagcgcgacaaggatggcaacttcttggaactggggaaagagtttattctggctccaaacgatcattttaataatctaccggtcaacatctccctctccgacgtgcaggtcccaacgaacatgtacaataaggatccagcaattgtgaacggcgtgtactggagtgaatctcttaacaaggtcttcgtcgataatttcgatagggaccccagtctgatatggcagtattttggatccgccaaagggttctttcgacagtaccccggaattaagtgggagcccgacgaaaatggcgttatcgccttcgattgtcgcaaccgtaaatggtacatccaggctgccacctctccaaaagacgtagtgatcctggttgacgtctctgggagcatgaagggactgagactcactatagcaaaacagactgtttcctccattttggacaccttgggagacgatgatttttttaatatcattgcctataatgaagaactgcactacgtcgaaccatgccttaatgggaccttggttcaagcagatcgcaccaacaaggagcactttcgggaacaccttgacaagctcttcgccaagggaattggaatgctggatattgccctgaatgaggccttcaacattctgtcagattttaatcataccgggcagggatcgatttgttcccaggcaatcatgctgattaccgacggcgcagtcgatacttacgacacgattttcgccaagtacaactggccagaccgcaaagtccggatattcacctacctcatcgggagagaagctgcatttgcggataacctgaaatggatggcttgtgccaacaagggttttttcactcagattagtacattggctgacgtccaagagaatgtaatggaataccttcatgtgctcagtaggccaaaggtcatagatcaggaacacgacgttgtttggactgaagcctacattgatagtactctgcctcaggcccagaagttaactgacgaccaagggcctgtattgatgacaactgtagcaatgccggtgtttagcaagcagaacgagaccaggagcaaaggcatccttttaggtgtcgtaggcaccgatgtgccagtgaaggagctgctcaaaacaatcccgaagtataagttgggaatccatgggtacgcttttgccatcacgaacaacgggtatatccttacacacccggagcttagactcctgtacgaggagggcaagaagagaagaaagccgaactatagctcagttgacctttccgaggtcgaatgggaagacagagatgacgtgctcaggaacgcaatggtgaatcggaagacgggcaaattcagtatggaagtgaaaaagactgtcgacaagggaaagcgcgtcttggtgatgaccaatgattattactacactgacatcaagggaaccccctttagcctcggcgtagcgctctcgagaggtcacgggaagtacttctttcggggaaatgttacgatcgaggagggcctgcacgacttggagcatccagacgtttcactagcagacgagtggagttattgtaataccgacctgcatccagaacacaggcatctttcccaattagaagccatcaagttgtatctgaaaggtaaagaaccgctactacaatgcgacaaggaactgattcaagaggtcctcttcgatgcagtggtgtctgcacccattgaggcctactggacctccctcgccctcaataaaagtgagaattctgacaaaggagtggaggtcgcattcctcggaacgcgcaccgggctgtcaagaattaatctgttcgtcggggctgaacagctcaccaaccaggacttcctgaaagcaggggacaaggagaacatattcaatgccgaccattttcctctatggtataggcgcgctgctgaacagatcccaggcagcttcgtctactccattcccttctctacgggcccagtgaataaatccaacgtcgtgactgcttccacctcaatccagctcctcgacgaacgcaaatcaccagttgttgcggctgtgggcatccagatgaagctcgagttcttccagaggaaattttggaccgccagtcggcagtgcgcctctctcgacggcaagtgctctatatcctgcgatgatgaaactgtgaactgctatcttatagataacaatggtttcattctggtctctgaagattatacacagacgggggattttttcggggagattgaaggtgctgtgatgaataagctcctgaccatgggtagcttcaagcgaattaccctatatgactaccaggcgatgtgtcgagctaataaggagtcttccgatggggctcatggactgctggacccgtataatgcatttttgtctgctgttaaatggattatgacggagctggtcttgtttttagtggagttcaatctctgtagctggtggcactctgatatgactgccaaggctcagaaacttaaacagacgttggagccttgcgacaccgagtacccagccttcgtttcagaacgcactattaaagaaaccacaggcaatatcgcttgcgaagattgtagcaagagttttgtgattcagcagattccatcgtcaaatctcttcatggtggtcgtagactcttcttgcttgtgcgagagtgttgccccaatcacgatggctcccatcgaaatcagatacaacgagtctttaaaatgtgaacggctgaaagcacagaaaatccgccgtcgccctgagagttgtcacggattccatcctgaggagaatgccagagaatgtgggggagctccaagcctccaggcccagaccgtgctccttctgctgccactcctgctgatgctctttagccggtag

SEQ ID NO: 216570 - DNA, 381 bp, Artificial Sequence
  Description of Artificial Sequence: Synthetic coding sequence
atggaagaaatgttccacaagaagtccgaggctgttaggcgattagtggaagccgcagaggaagcccaccttaagcacgagttcgacgccgatctgcagtacgagtactttaatgcggtcctcattaatgaaagggataaggacggaaactttcttgagttaggcaaagaatttattctcgcgcctaatgaccactttaataacctgcctgtgaacatttcattgtcagatgttcaggtgcccaccaatatgtacaataaagaccctgcaatcgtgaacggagtatactggtctgagtctctcaataaggtgtttgtggacaacttcgatagggacccatcattgatctggcaatactttggatccgcaaaagggttctag

SEQ ID NO: 216571 - DNA, 2925 bp, Artificial Sequence
  Description of Artificial Sequence: Synthetic coding sequence
atggtttgcgggtgctccgccttgttacctcttcccaacccaaggcccaccatgcccgctactcctaattttttggccaatccgtcctcttcttctaggtggattcccctccagccaatgcccgtcgcatgggcattcgtgcagaaaacgagtgctttgctttggttgttgctactcggaaccagcctgagccccgcttggggccaggccaagataccactggagactgtgaagctctgggcggatacctttggcggtgacctgtacaataccgttactaaatacagtggatccctcctgttgcagaaaaagtataaagatgttgagtcttccctaaagatagaggaggtcgacggacttgagttggtcaggaagttcagcgaggacatggagaacatgcttagacgaaaggtggaagcagtacaaaacctggtggaggccgctgaggaggcggaccttaaccatgagttcaatgagagcctcgtttttgattattataatagcgtcctgatcaatgagcgcgacgaaaaaggtaactttgtggagctcggagctgaattcctgttggagagtaatgctcacttctcaaacttgccagtaaataccagtatctcgtccgttcagcttcccacaaacgtgtacaataaggatccagacatcctaaatggagtatatatgagcgaggcgctgaacgctgtgtttgtcgagaatttccagcgggatcccaccttgacatggcagtatttcgggtccgctacaggattctttcgcatttaccccggtataaagtggacacctgacgaaaatggagtgatcacctttgactgtaggaaccggggatggtacatccaggctgccacatcccctaaggatattgtgatccttgtggacgtctcgggctccatgaagggcttaagaatgacaattgctaagcacaccattaccactattttggacactctcggggagaatgattttattaatataattgcttacaatgattacgtacactacattgagccgtgttttaaagggatcctggtgcaggctgacagggataatagagagcacttcaagctcctagtcgaagagctgatggttaagggggttggggtagtggaccaggcattgagggaggcttttcagatacttaaacagttccaggaagctaagcagggctctctgtgtaaccaggctatcatgttgatctcagacggcgctgtggaagattacgagccagtcttcgagaaatacaattggccagactgcaaggtgcgggtgtttacttatctgattggaagggaggtctccttcgcagacagaatgaaatggatagcttgcaacaataagggatattatacccagattagcacgctggccgatactcaggaaaatgtcatggaatacctccatgtgcttagtcggccaatggtgatcaatcacgatcatgacatcatctggaccgaggcctacatggactctaaactgctgagctcccaggctcaaagtctcactctcttaacaacagttgccatgcctgtatttagcaaaaaaaacgaaaccagaagccatgggatcctccttggggtcgtgggatccgatgtggcccttcgtgaactgatgaagctagctcctcggtataaactgggggtgcacggatatgctttcctcaacaccaacaatggctatattctgtctcaccccgatctccgaccattgtacagggaggggaagaaactcaagcccaagccaaactataattccgtggacctcagcgaggtggagtgggaggaccaagctgaatccctccggacggctatgataaatcgtgaaacaggcacattgtccatggatgtgaaggtccccatggacaaggggaaacgggtcctcttcctgacaaacgactacttttttactgatatctccgatacgcctttctcactgggggttgttctgtcacgagggcatggcgagtatattttgctggggaacacttcagtggaggaaggcctccacgatctattacatcccgacttggctttggccggagattggatatattgcattaccgatatcgaccctgaccatcggaaactgtctcagctggaagcgatgatacgattcctgacgcgcaaggatcctgatctggagtgtgatgaggaactggttcgcgaggtgctgttcgatgcagtggtgactgcccctatggaggcatattggaccgcgctggctttgaacatgtcggaggaatctgagcacgtggtcgatatggcatttttgggaacaagggccggtctcctgcggtcctccctcttcgttggatctgagaaggtttcagatagaaaatttttaactcccgaggatgaggcttctgtcttcacgctcgaccgattcccattatggtatagacaggcttcagagcatcctgctggaagcttcgtatttaacctgcggtgggctgaaggccctgagtctgccggtgaaccaatggttgttaccgcaagcacagccgtcgcagtcacagtggacaagcggacagctatcgcagcagctgccggagtacaaatgaagcttgagttcctgcaacggaagttttgggccgctacaaggcagtgtagtacagtggacggaccctgtacacagtcctgtgaagattcagatctggactgtttcgttatagataataacggattcatcctgatcagcaagcgatcccgagagaccggtcgttttttaggggaggttgatggagccgtgctcacccaactcctgtcaatgggcgtgttctctcaagttacaatgtacgattatcaggccatgtgcaagccatcttcccaccatcacagtgcagctcagcctttggtctcgcccatctccgccttcctgactgctacacgatggctgcttcaggaactagtgctgtag

SEQ ID NO: 216572 - DNA, 3414 bp, Artificial Sequence
  Description of Artificial Sequence: Synthetic coding sequence
atggtctgtggttgttcagctctgctgcctcttcccaatcctaggcctaccatgcctgcaacgccgaacttccttgcgaatccgagctcttcttctcggtggattcctctgcagccgatgcccgttgcatgggcattcgtccagaaaacttcagcattgctttggttactcttgcttggaacaagtctgagtcctgcttggggccaagcaaaaatccctcttgaaactgttaaactatgggcggacactttcggtggagatctttataacacggtgaccaagtattcgggttctctcctgctgcagaagaaatacaaagatgttgagtcatcactgaagatcgaggaagtggatgggctagagctggtccgaaagttcagcgaggatatggaaaacatgctccgccgaaaggtcgaagccgtccagaacttggtggaggcagccgaggaagcagatctgaaccacgagtttaacgagtctctggtgtttgattactacaacagcgttcttatcaatgagagggatgagaaggggaacttcgtggagcttggcgctgaattcctactcgaatcaaacgcacacttctcgaacctgcctgtaaatacctctatttcgagcgtacaattacccactaatgtttacaataaggaccctgacatcctcaatggggtgtacatgagcgaggccctgaatgcagtatttgtcgagaatttccagagggaccccactctcacttggcagtactttggaagcgcaacaggtttttttagaatctaccccggaatcaagtggaccccagatgagaacggagtgataacgtttgattgtcgtaatcgcggatggtacattcaggccgctacaagtcctaaggatatcgttatactcgtggatgtatccggctccatgaaagggcttcggatgacaattgccaagcacaccatcaccactatcctggataccttgggtgagaacgattttatcaatatcattgcatacaacgattatgtgcattacatcgaaccctgttttaaggggatcctggtgcaggcagacagagacaatcgggaacatttcaagctgctcgtggaggaactgatggtcaaaggggttggagtggtggatcaggcattgcgagaggcatttcagattcttaagcaatttcaagaggccaagcagggcagtctctgcaatcaagctatcatgttgatcagcgacggcgcagttgaggattatgagccggtgttcgaaaaatacaattggccagactgcaaggtcagggtgttcacttatttgataggcagggaggtgtcattcgccgataggatgaagtggatcgcatgcaacaataaagggtactacacacagataagtacccttgccgacacgcaagagaatgtcatggaatacttgcacgtgttgtcaaggcctatggttatcaatcacgatcacgatatcatttggaccgaggcctatatggactctaagctcctgtctagtcaggctcaatctcttaccctccttaccacggtggctatgccagtgttctcaaagaagaatgaaacacggagccacggaatcctgttgggcgtggtggggtccgatgtggcccttagagaactgatgaaactcgctcctagatacaagctcggggtgcacggatacgcgtttctgaacaccaataatggttacattctcagtcacccagacctgcgacccctgtaccgcgaggggaagaagcttaagcctaaacctaattacaattcggtggatctgagcgaggttgagtgggaggaccaggccgagtccctgcgaacggctatgatcaatagggaaactgggaccctgtccatggatgtaaaagtgcctatggacaaaggcaagagagtgttatttcttactaatgactacttctttacagacatctccgacacccccttctccctcggggttgtgctgtcgcgaggccatggagaatacatcctgctggggaacacaagcgtggaagagggtctgcacgacttactccatcctgatttggcactggccggtgattggatatactgcatcactgatatcgatcccgaccatcgcaagttgagccagcttgaagctatgatcaggtttctgacacgaaaagatccagatttagaatgtgacgaggagcttgtaagggaagtgttgtttgacgcagtggtcaccgcacccatggaagcctattggacagccctcgctctcaacatgagcgaggagtccgagcatgtggtcgacatggctttcctggggaccagagccggtctacttcgctccagtctcttcgttggctcagagaaggtgtcagatagaaaatttctgactccagaggatgaagcctccgtcttcactctggatagatttccgctttggtatagacaggcctccgagcatccggctggatctttcgtttttaatctcagatgggcagaggggccagagtctgctggggaacctatggtggtgacggcctctaccgccgtggctgtgaccgtcgataagcgcactgccatagctgcagctgcgggagtgcagatgaaactagagttcctgcagaggaagttctgggcagcaactcggcagtgttctacggtggatgggccttgtacccaatcatgcgaggacagtgatctcgactgctttgtcatcgataacaacggatttatcctgatttcaaagcggagccgagagacagggagattcttgggagaggttgacggggctgttctcacccaattactttctatgggcgtcttctcccaggtgaccatgtatgactaccaggccatgtgcaagccatcttctcatcatcattccgccgctcaacccctcgttagtcctatttcagcctttctgaccgccacacgatggttactccaggagctcgtgttgttccttctggagtggagcgtgtggggcagctggtatgatagaggagccgaagccaaatccgtatttcatcatagccacaaacacaaaaaacaagatcctttgcagccatgcgatacggagtaccctgtgtttgtttatcaacccgcaattagagaggccaatgggattgtggagtgcggcccttgccagaaggtgtttgtggtgcagcagatccctaattcaaacctgctgctactcgtcactgatcctacatgtgactgctcaatatttcctccggtgctccaggaagctacggaagtcaagtataatgcttcagtaaagtgcgaccggatgcgctctcaaaaactgcggaggcggcctgacagttgtcatgcctttcatccagaagagaatgcccaggattgcggtggggcatcagacacttcagcctccccaccactcctgctactacccgtgtgcgcgtggggattgctaccccagctgctccgttag

SEQ ID NO: 216573 - DNA, 3222 bp, Artificial Sequence
  Description of Artificial Sequence: Synthetic coding sequence
atggccgtcgctctaggaactagaagacgagaccgcgtaaagctttgggcggacacatttgggggagatctgtacaatacggtgaccaaatactccggtagtcttctacttcagaaaaaatacaaggatgtcgagtccagtctgaagatcgaggaagtggatggcctggagctcgtcagaaagttctctgaagatatggaaaatatgttacgccgtaaagtcgaggcggtacagaacctcgttgaggccgctgaagaggccgaccttaaccacgagttcaacgagtcactcgtctttgactactacaattcagtcctgatcaatgagagagatgagaaagggaactttgtggagctgggggctgagttcctgttagagtctaacgcgcatttttctaacttacctgtgaataccagcatctcttcagtccaactccccacaaatgtgtataataaggaccccgacattctgaacggagtgtacatgagtgaagctctgaacgcggtctttgtggagaatttccagcgagacccaacgttgacgtggcaatatttcgggtcagccacgggcttttttaggatctatccaggtattaaatggaccccagatgaaaatggggtcattacattcgactgccggaacaggggatggtacatccaagcagccacaagcccaaaagacattgtgatccttgtcgacgtgagtgggtccatgaagggcctccgcatgacaatagcgaaacacaccattacgacaatcctcgataccttgggcgaaaatgacttcataaacatcatcgcctacaacgattatgttcactacattgaaccgtgtttcaagggaatcctggtgcaggccgatcgtgataatcgcgagcatttcaagctattggtggaagaactaatggtgaagggggtgggagtagtggaccaggcactccgtgaagctttccagatcctgaagcagttccaggaggccaaacaagggtcattgtgtaatcaagctattatgctgatctctgatggcgcagttgaggactatgaaccagtcttcgagaaatacaattggcccgattgcaaggttcgtgtcttcacataccttatcggccgagaagtgtcatttgcggaccgaatgaagtggattgcctgcaacaacaaaggttactacactcaaatcagcaccctcgcagacacccaggaaaatgtaatggaatatctgcacgtcctgagccggccaatggtgatcaaccacgatcatgacatcatctggactgaagcctacatggactcgaaactgttgagttctcaggcccagagtctgacgctactcactactgtcgctatgcccgtttttagcaagaagaacgagactcggtctcatggtattctcctgggtgtggttggaagtgacgtggccctgagggaactcatgaagcttgctccccgatacaaattgggcgttcacggctacgcattcttgaatacaaataacggatacattctgagtcatccagacctgcggccactgtatcgggaaggaaagaagctcaagccgaaacccaactataatagcgtggacctcagtgaagtggaatgggaagatcaggccgagagtctgagaaccgcgatgattaatcgcgaaacgggaaccttgagcatggacgtcaaggtgccaatggacaaagggaagagagtgctatttctgacaaacgactacttcttcacagatatcagcgatactcccttctctctgggggtcgtgctatcaaggggtcacggggagtatatcctattggggaacacgagtgtcgaagagggtctgcatgaccttctccatccggatctggccctggccggagattggatttattgcatcacggacattgacccagaccatagaaagcttagccagctggaagccatgatccgctttcttacacggaaagatcccgatcttgagtgcgatgaagagcttgtgagggaggtgctctttgatgccgtggtgaccgcccctatggaggcctattggaccgccctggccttgaatatgagcgaagagagtgaacatgtggtggatatggcatttctcggtaccagagccggtcttcttaggtcttccctgtttgtcggaagcgaaaaagtctcagaccggaagttcctcacgccagaggacgaggccagcgtcttcactctggatcgattcccactctggtatagacaggcctcggagcaccccgcaggatcatttgtgttcaatcttcgctgggcagaaggacctgaatcggccggagaacccatggtcgtcactgcgtcgacagccgtcgcagtcaccgtcgacaagcggaccgctatcgccgcagcagcgggagttcagatgaaactggaatttctgcagcgcaagttctgggctgccacaaggcaatgctccacagtcgacggaccatgtacccaatcatgcgaggacagtgatctggactgttttgtcatcgacaataacggctttatcttaatctcaaagaggtctcgtgaaactggaaggttcctgggagaagtggatggtgccgtactaacccagctccttagcatgggggtgttcagtcaggtgacgatgtacgactatcaggcaatgtgcaagccaagtagccaccatcattccgcggcacaaccgctggtgtcacctatctctgcgtttctgacggcaactagatggctgttgcaggagttagtactgttcctcctcgaatggtctgtatggggaagttggtatgacagaggggctgaggctaaatccgtcttccaccattctcacaagcacaaaaaacaggacccactacagccatgtgacaccgagtatccagtctttgtgtaccaacccgcaatccgcgaagctaacggcattgtggagtgcggcccatgccagaaagtgtttgttgtgcagcagattcccaacagcaatctgttgctgcttgtgacagaccccacgtgcgattgctcaatttttccgccagtgttgcaagaagctactgaagtgaagtataatgccagcgtgaaatgcgacaggatgagatctcagaaattaaggcgcaggcccgactcttgtcacgcttttcacccagaagaaaatgcccaagactgcggaggtgctagcgataccagtgcatcccctcctctgcttctgctgcctgtgtgcgcttggggtctcctgccacaactgctgagatag

SEQ ID NO: 216574 - DNA, 615 bp, Artificial Sequence
  Description of Artificial Sequence: Synthetic coding sequence
atgtacgactatcaggccatgtgtaaaccatctagccaccaccattcggcagcccaaccactcgtgagtcccatctccgccttcctcacagcaacaagatggcttcttcaggagctcgtgttatttttgctggaatggagcgtatggggaagttggtatgaccggggtgccgaggcgaaaagtgtgttccatcactctcacaaacacaaaaaacaggacccgttgcagccttgtgataccgagtacccagtattcgtataccagcctgcaatccgcgaggctaacgggatcgtggagtgtggcccttgccaaaaggtgttcgtcgttcagcaaattcctaattccaatcttctgctccttgtcactgaccctacctgcgactgttctatttttcctcccgtgctgcaggaagccacagaggtaaaatataacgcatcagtcaagtgcgatagaatgcgctcccagaagttgcggcgtcgtcctgatagctgtcacgccttccatcctgaagagaacgctcaggactgcggaggggcttcggatacttctgcctcgccccctctgctacttctcccggtatgtgcctggggtctgctgcctcagttgttgcgatag

SEQ ID NO: 216575 - DNA, 615 bp, Artificial Sequence
  Description of Artificial Sequence: Synthetic coding sequence
atgtacgattaccaggccatgtgcaaaccctcttcacaccaccactccgctgctcagccacttgtctcccctatctccgcttttctgaccgcaactagatggcttttgcaggagcttgtgctgttcctgttagagtggtctgtgtgggggtcatggtacgataggggcgcagaggccaaaagtgtattccatcatagccataagcacaaaaagcaggaccctctgcagccgtgtgacacggaatatcccgtgtttgtctatcagcccgctatcagagaggccaacggcatagtggagtgtgggccttgtcagaaggtgttcgtcgtacaacagatcccaaacagcaatcttctcctgctagtaacagacccgacctgcgactgtagcatctttcctcctgtcctacaggaggccacggaagtaaaatataacgcttcagtcaagtgcgatagaatgcggagccaaaaactgcgcagacgcccagattcctgccacgcgttccaccccgaagaaaacgctcaggattgcggaggcgctagtgataccagcgcctcaccccctctgctcttgctccctgtctgcgcttggggactgctgccccaactgttgcgttag

SEQ ID NO: 216576 - DNA, 804 bp, Artificial Sequence
  Description of Artificial Sequence: Synthetic coding sequence
atgaaactggagttcctgcagcgcaagttctgggccgcaacaaggcaggacctggactgcttcgtgatcgataacaatggttttattctgatttcaaagcgctcgcgggagacaggtcggttccttggggaagtggacggggcagtccttacccagctcttgagcatgggagtcttcagccaagttactatgtatgactaccaagctatgtgtaaaccctcatcccaccaccattcagcagcgcagcccctcgtaagcccaatcagcgcttttctgacagccaccaggtggctgctgcaagaactagtactgttcctcctggagtggagcgtgtggggctcatggtacgatcggggtgcggaagcaaaatcagtgtttcatcactcccacaaacataagaagcaggatccgctgcagccttgcgatactgagtatccagtcttcgtgtatcagccagccattcgagaagctaacgggatcgtcgagtgcggcccttgccagaaggtgttcgtggtccagcaaattccaaactctaatctgctgctacttgtgacagaccccacttgcgactgcagcatcttccccccagtgctgcaagaggcaactgaggttaagtacaacgcctctgtgaaatgcgaccgaatgagaagccaaaaactgcgcaggcggccagatagttgccatgcttttcatcccgaagagaatgctcaagattgcggaggagcctccgacacatcggcttcccctcccctgctgctactgcctgtctgcgcatggggcctcctgccccagctgctgagatag

SEQ ID NO: 216577 - DNA, 615 bp, Artificial Sequence
  Description of Artificial Sequence: Synthetic coding sequence
atgtatgactaccaggcaatgtgtaagccaagttcccaccatcacagtgctgcgcaacctcttgtatcccccatctcagcgttcctgactgccacacgctggctcttgcaggagcttgtgctgttcctgctggaatggtctgtttgggggtcctggtatgaccgtggggcagaggccaaatccgtgttccaccactctcacaaacacaaaaagcaggaccccctgcagccctgtgacacagaataccctgtgttcgtctatcaacccgctatccgagaggcgaacggaatagtggagtgcggcccatgtcagaaagtgtttgtggtgcagcagatcccaaactccaacttattgttattagtaacggacccaacatgcgattgttctatcttccctccggtactccaagaagcaacggaggtgaagtacaacgcatctgtgaagtgtgacagaatgagaagtcagaaactccgacgacgacccgacagctgccacgctttccaccccgaagagaacgctcaagattgcgggggagcttccgacacttcagcatcgccccctctgctattactgcccgtgtgcgcctggggactgcttccccagctgctgaggtag

SEQ ID NO: 216578 - DNA, 1572 bp, Artificial Sequence
  Description of Artificial Sequence: Synthetic coding sequence
atggtgcagaaaacttccatgtcaaggggaccctatcccccatctcaggagattccgatggaagtattcgacccttccccacaaggcaaatacagtaaacggaagggcaggtttaaaagatccgatggctcaacctcctctgacactacctcaaactccttcgtccggcagggctctgcggaatcttacacctccaggccctccgactctgatgtttcccttgaggaggaccgcgaggcgcttaggaaagaagccgagagacaggcactggcgcaattggagaaggccaaaacaaaacctgttgcattcgccgttcgaactaatgtgggctataacccttctccaggcgatgaggtgcccgtccagggtgttgcgattacgtttgaacctaaggatttcctgcacatcaaagagaaatacaacaacgactggtggataggtcgactggttaaggagggctgtgaagtgggatttattccctcacctgtgaaactagacagcctgagactcctgcaggagcaaaagcttcgccagaatcggctgggatcatcaaagtcaggtgacaacagttcctccagtttaggcgacgtcgtgactggaacaagacgccctacaccaccggcaagcggcaatgagatgaccaacctggccttcgagctagatcctctcgagcttgaggaagaggaagccgaactgggcgagcaatccggttccgcgaaaactagcgtcagctcagttaccacccctcccccacatgggaaacgcattcccttttttaaaaagaccgaacatgtgcctccatacgacgtcgtgccctccatgagacctattattttagtgggaccgagtctaaaaggttacgaggtgaccgatatgatgcagaaggcgctcttcgacttcctcaagcacaggtttgacggccgaatctcaataaccagagtgaccgctgatatttctctcgccaaacggtccgtactcaataacccctccaaacacattattattgagaggtcgaacactcgttcatctctggccgaagtccagtctgagatcgagagaatcttcgagctcgcacgcacactgcagttagtggctctggatgccgacaccattaaccaccccgcacagctcagcaaaacgagccttgcgccaattatcgtttatataaagattactagcccaaaggttctccagcgactgattaagagccggggtaaatcccaatctaaacacctcaacgtgcaaattgctgcgagcgaaaaactggctcagtgtcccccagagatgtttgatattatcctcgacgagaaccagttagaggacgcttgcgaacatctagcagagtacttggaggcttattggaaggcaacacatcccccatcttccacccccccaaatcccctgctgaacagaactatggccaccgctgcacttgccgctagccccgcaccggtgtccaatttacaggtgcaagtattgactagccttaggcgtaacttagggttttggggcggtcttgagtcctcccagcgcggaagcgtggtgccacaagaacaggaacacgcaatgtag

SEQ ID NO: 216579 - DNA, 1797 bp, Artificial Sequence
  Description of Artificial Sequence: Synthetic coding sequence
atggtgcaaaaaacatccatgtctcgcggtccctatcctccatctcaggagatcccaatggaggtgttcgatccctcaccccaggggaagtactccaaaagaaaaggcaggttcaaacggtcagatggcagcacttccagcgataccactagcaactcattcgttagacaggggtccgcagaatcatacacctcccgtccaagtgactctgacgttagcctggaagaggaccgcgaggctctccgcaaggaagccgaacggcaggccctcgcacaactcgaaaaagccaagaccaagccagttgctttcgccgtacgcactaatgtcggatataatccttcccccggtgacgaggtgcccgtgcagggtgtcgccatcacctttgaacccaaagacttcctccatatcaaggaaaagtataataatgattggtggataggcagactggttaaagagggctgcgaggtcggctttatcccaagcccggtaaaacttgacagcctcagactgttgcaggaacaaaaactacgccagaaccggctcggaagctcaaaaagtggagacaattccagctcttcattaggagacgttgtgactggaacacgaagacccacccctcctgcatcggcgaagcagaaacagaagagcactgagcacgtccccccttacgacgtggtgccctcgatgcgcccaatcatccttgtgggcccatctcttaaagggtatgaggtgactgacatgatgcaaaaggcactctttgactttttgaagcatagatttgacgggaggatttcaattacccgcgtcacagcagatatctcgttggccaagcgatctgtcctgaacaatccgtcaaagcacatcattattgagcggagtaacacacgctctagtcttgcggaggtgcaaagcgagattgagcggatcttcgagctggccagaaccctacagctcgtggccctcgacgccgacaccataaaccaccccgcacagctgtccaaaaccagtctcgccccaattatcgtgtacatcaagattacttctcccaaggtgcttcaacggctcattaagtctcggggtaagtcacagtcgaaacatcttaatgttcagatcgctgcatcagagaagctcgcccaatgcccgcctgagatgtttgacatcattcttgacgagaatcagctcgaagatgcgtgcgaacatcttgctgaatatctggaggcttactggaaagctacccatccccctagcagcactcctcctaaccccctgctgaaccggaccatggctactgcagctctcgccgctagtcctgcccctgtatccaatctccaagggccttacctggcttcaggtgaccagcccctggaaagggcaacaggcgagcacgcctctatgcatgaataccctggcgaactgggccagccacccggtctgtatccgagctctcacccaccaggtagagctggcacactgcgcgctctgtccaggcaagacacctttgacgccgacacccccggatcaagaaattccgcttatacggaactgggtgattcttgtgtcgacatggaaaccgacccttccgagggaccaggcctgggcgatccggctggcggaggtaccccgcctgcccgacagggctcttgggaggatgaagaagaggattatgaagaggagctgaccgacaatcgcaacagggggaggaataaagcacgatattgtgctgaggggggaggacctgtgctggggaggaataaaaacgaactggagggctggggaaggggtgtatacatcaggtag

SEQ ID NO: 216580 - DNA, 1437 bp, Artificial Sequence
  Description of Artificial Sequence: Synthetic coding sequence
atggttcagaagacctccatgtccaggggcccatatccacccagtcaggagattccaatggaggtctttgatccgtcacctcagggcaaatattctaaacggaaagggagattcaaaagatctgatggatcaaccagctccgacacgacgtccaacagtttcgttaggcagggcagcgctgaatcctatacaagtcgcccttcagactccgatgtctccttagaggaggatcgagaggctctaaggaaagaggcagagagacaggctctggcccaactggaaaaagcgaagactaagcccgtggccttcgctgtgcgcaccaacgttggctacaatcctagccccggtgatgaagtgccagtgcagggggtcgctatcaccttcgaaccaaaggacttcctgcacatcaaggagaaatacaacaatgattggtggatcggccgactggtcaaagagggatgcgaggttggtttcattccgtccccagtgaagcttgattcactccgattgctccaagagcagaagttaaggcagaaccgcttgggatccagtaagtctggcgataattcaagttctagtctgggggacgtagttaccggaacacggaggccaacaccccctgcttctgcaaaacagaagcaaaagagcaccgaacatgtaccgccttatgatgtggtgccctcaatgaggccaattatcctcgtcggaccctctcttaagggctacgaggttaccgacatgatgcagaaggccttgttcgattttctaaagcaccgttttgacggcaggatctcaattacccgcgtgaccgcagatatcagccttgccaaacggtccgttctcaataacccttctaaacatatcatcattgagagatcaaatactaggtcttcgctggctgaggtgcagagcgaaatcgaaagaatctttgagctggcaaggactttgcagctcgtggccttagatgctgacaccataaatcaccccgctcagctgtcaaagacgtcattggcgccaattatagtgtatatcaagatcaccagccctaaggttctgcagcgattaattaaatccagaggcaagtcccagtccaagcatttgaatgttcaaattgccgcaagcgaaaagctagcacaatgtccccctgaaatgttcgacattatcctggacgaaaaccagctggaagatgcctgcgagcacttggctgagtacctcgaagcctattggaaagctacgcaccccccttccagtacccctcctaaccccttactgaatagaaccatggctacagccgcacttgccgcatctcccgcacccgtttctaacctacaggttcaagtgctgactagcctgcggagaaacctgggattttgggggggtctggagtcctcccaaaggggctctgtggtgccccaggaacaggagcatgcaatgtag

SEQ ID NO: 216581 - DNA, 1290 bp, Artificial Sequence
  Description of Artificial Sequence: Synthetic coding sequence
atggaggctccatctaggactgtcgtcgtgggcagcgcagagagctacacatcccggccatctgattcagacgtcagccttgaggaagaccgagaggcgctgcgcaaggaggcagaaagacaggcactcgcacagttggaaaaagctaaaactaagcccgtggcctttgccgtgaggacaaatgtcggctacaatccctccccaggggatgaggtccctgtgcagggcgtggcgattaccttcgagcctaaggatttcctacatattaaagagaagtacaacaacgattggtggattggtcgccttgtgaaggaaggttgcgaggtgggatttatccccagcccagtgaagctggacagcctcaggctgttgcaggagcagaagctaaggcagaatcggctcggttcctcaaagagcggtgacaacagctcttccagcttaggcgatgttgtgacaggaacccgacgtccaacccctcccgctagtgattctccagtgcagaccgagcatgtgcctccctacgacgttgtcccctcgatgcgcccaattattttggtgggcccaagcctgaaaggctacgaggtaaccgatatgatgcagaaagcactgttcgactttctaaagcaccgcttcgacggcagaatttccatcactcgggttaccgccgacatctcccttgccaagcgcagcgtactgaacaacccttccaaacacattatcattgagagatcaaacaccaggagctcccttgctgaggttcagtctgaaatcgaacgaatctttgaactggctcgcaccctgcagctggtggcactggacgccgatactatcaaccatcccgcacagctgtctaagaccagccttgctcctatcattgtgtacattaagatcacgtctcctaaggtactccagcggctgattaaatctagggggaaaagtcaaagcaagcatctcaacgtccaaattgcagcttcagagaaactggcacagtgtccaccggagatgtttgatatcattctggacgaaaaccagttagaagatgcttgcgagcatctggcagaatacctggaagcttactggaaggctactcatccgccttcttccactcctcccaacccacttcttaatagaacaatggcaactgcagccctggctgcttctccagcccctgtgtcgaatctgcaagtgcaggtgctgacatccctgaggcgcaatttggggttctggggcggactcgagtccagtcagagggggagcgtcgtcccacaggaacaagagcatgccatgtag

SEQ ID NO: 216582 - DNA, 1647 bp, Artificial Sequence
  Description of Artificial Sequence: Synthetic coding sequence
agcgggtccctgtatttccagggaagtgctgaatcttacaccagtaggcctagcgactcggatgttagccttgaggaggatcgggaggcgctgcggaaggaggcggaaagacaggctttggcccagctggaaaaagctaagactaaacctgttgccttcgcggtgagaacaaatgtcgggtacaatccaagtcctggcgacgaagtgccggtgcaaggcgtggccattacttttgagccaaaagatttcctgcatatcaaggagaaatacaataacgattggtggatcggtagattggtgaaggaaggttgtgaagtggggtttatcccatcacctgtgaaactcgactcccttcgcttgctccaggagcagaagctgcggcagaatagattgggatccagcaaaagcggagacaatagttcctctagcttgggggatgttgtcactggtactcgccgtcctacgccccctgcttcagggaaatcccaccggcacgcaacagaacacgtcccaccctacgatgtggtccctagcatgagaccgattatcctcgtgggaccatctctcaaggggtacgaggtcacggatatgatgcaaaaggccttattcgactttttgaagcatcgattcgatgggagaatctccattaccagggtgaccgctgacatatctctggccaaaagatccgtgttgaacaatccatccaagcacattatcatagagagatccaatacaaggtcttccttggctgaggtacagagcgaaattgaacggatttttgagctggcacgcaccctccagttagttgctctggacgccgacaccattaatcaccctgcccaacttagcaaaaccagcctggctcccataattgtgtacattaaaatcacctctcctaaggtgctccagcgcttaattaaatcccggggtaagtcccaaagtaaacaccttaacgtgcaaatcgccgctagtgaaaagctcgctcagtgcccaccagagatgtttgacatcatcctggacgagaaccagctcgaagacgcatgtgaacatcttgctgagtaccttgaggcctactggaaagcaacgcacccaccgtcatcgactcccccaaatccattgctgaatcgcacaatggccactgccgcacttgccgcatcgccggcacccgtctccaacctgcaaggaccttacttggcgtcaggagatcagcccctggaacgcgcaacaggcgagcatgccagtatgcatgaataccctggtgagttagggcagcctcctggcctgtatccctccagtcatccaccaggccgtgccggaactctgcgcgcactgtccagacaggacacgtttgacgctgatacccccggttcaagaaactccgcttacaccgagttaggcgattcttgcgttgatatggagacggatccatccgaggggccaggcctgggagacccagccggtgggggaacaccccctgctcgtcaaggcagttgggaagacgaggaggaagactatgaggaggagctcaccgacaataggaatcggggacggaataaagcccgttattgtgccgaaggcggaggcccagtgctgggacggaacaaaaacgagcttgagggatggggaaggggcgtctacatccgctag

SEQ ID NO: 216583 - DNA, 1899 bp, Artificial Sequence
  Description of Artificial Sequence: Synthetic coding sequence
atgaaccaaggcagcggtcttgacttattaaagatctcttatggcaaaggagcaaggcgcaaaaatcggttcaaggggtccgatggatcgactagcagtgatacgacttccaactcatttgtccgtcagggcagcgccgacagctacactagcaggccctctgacagtgacgtgtctctggaagaagatcgggaggcggtcaggagagaggcagagcgtcaggcccaggctcaactcgagaaagcaaaaaccaagcctgtcgccttcgctgtgaggacgaatgtgtcttatagtgcagcccatgaggatgatgtgcccgtgcccggaatggccatctctttcgaggctaaggatttcctccacgtgaaggagaagttcaacaatgattggtggatcgggagactcgttaaagaaggctgtgagattgggttcattcccagtcctgtgaaattagagaacatgaggcttcagcatgaacagagagccaaacaaggcaagttttactcaagcaagagtggcggaaactccagtagcagtctgggagatatcgttccatcctccagaaagtcaacaccccctagttcagcgatagatatcgacgctactggcttagacgccgaggagaatgatattcccgctaatcacaggtcgcccaaaccatcagcgaattcggtgacttccccgcactccaaagaaaaaaggatgccattcttcaaaaagaccgagcacacaccaccctacgatgtcgtgccttccatgcggcctgtggtgctggtcggcccttccctgaaagggtatgaagtcaccgatatgatgcagaaagccttatttgacttcctgaagcaccgattcgagggaagaatctccatcacgcgggtcacagccgatatatcactcgccaagcgttctgtcttgaataaccccagcaagcacgctatcatcgaacgctccaatacccgcagctccctggccgaggtacagtccgaaattgagaggattttcgaactcgctcggaccctgcagctcgtggtgctggatgcggacaccattaatcacccagcgcagctgtctaaaactagtctggctcctatcatcgtgtatgtgaagatcagcagtcccaaagtattgcaaaggctcattaaaagtcgcggtaaaagccaagccaaacacctgaatgtgcagatggtggccgcagacaagctggcccagtgtcctcccgagctattcgatgtaatccttgacgaaaatcagctcgaggacgcctgcgagcatctggccgactacctcgaagcctattggaaagccacacaccctccttcctcaagtctccctaatcctctgctgagccgtacacttgccactagcagtcttcctctaagcccgacactggcctctaacagccaaggaagccagggggatcaacgcacggacagaagcgcgccaattcgatccgcatcccaggctgaggaagaaccctccgttgaacctgtaaaaaagtcacagcaccggagttcctcttccgccccacaccacaaccaccgcagcgggacttcccgaggtctcagccggcaggagactttcgactcggagacacaggagtcacgcgattccgcttatgtcgaacccaaggaggattacagccacgaccacgtagaccattatgcgtcacaccgggaccataaccatcgggacgaaacccacggcagttctgaccaccggcacagggagagccgccacagaagccgcgacgtggatagggagcaggatcacaacgagtgcaacaaacagcggagtagacacaaaagtaaggataggtactgcgaaaaagatggcgaggtcatttctaaaaaaagaaacgaagctggcgaatggaacagagatgtgtatataaggcagtag

SEQ ID NO: 216584 - DNA, 1983 bp, Artificial Sequence
  Description of Artificial Sequence: Synthetic coding sequence
atggtgcagagggacatgagtaaatccccccctacagctgccgctgccgtagcccaggaaattcaaatggaactcctggaaaacgtagctcccgctggagctctcggcgctgccgctcagtcctacggaaagggggctaggcggaaaaatcgcttcaagggctccgacggctccacctctagtgataccacttctaacagctttgtcaggcagggatcagccgatagctacacgtctcgcccaagcgattctgatgttagtttagaagaagaccgcgaggcagtgagacgggaagcagagcgacaggcacaggcacagctcgaaaaggccaagacaaaacccgtcgcttttgccgtccgaacgaacgtgagctactcagccgcacatgaggacgatgtgccagtccccggaatggccatttcctttgaggcaaaggacttcctacatgtgaaagagaagttcaacaatgactggtggatcggcagacttgtgaaggaaggttgtgagataggcttcatcccaagtcctgttaagctcgaaaatatgaggctccagcatgaacagcgagccaaacaagggaaattctatagcagtaagtccggaggaaactcctcctcctccctgggcgatatagtgccttcatctcgcaaatctacccctccctcaagcgctatagacatcgacgcgaccggcctcgatgctgaggagaatgacatccctgctaaccaccgttcgcctaaaccctcagccaactcagtgacgagtccccactcaaaggagaagcgcatgccattctttaagaagaccgagcatacacctccctacgatgtcgttcccagcatgagaccagtcgtcttggtgggtccaagcctaaaggggtatgaagtcaccgatatgatgcaaaaggcattatttgactttctgaaacatagattcgaaggcagaattagcataacaagggttaccgctgacatttcccttgccaagagatcagtcctaaataacccatcgaaacacgcaatcatcgaacgatctaacacaaggagttcgctcgccgaagtgcaatctgaaatagaaagaatcttcgaactcgcgagaacactccagctagtggtgttggatgctgacacgattaaccacccggcacagctttctaagacctctttggcgcctataattgtgtatgtcaaaatctctagcccgaaagttcttcagcggctgatcaagtcccgtggcaagagccaggcgaaacacttaaacgtccagatggtcgccgcagacaaactggctcagtgtcccccagagctctttgacgtcattctggacgagaatcaactggaggacgcatgtgaacacctcgcagactacttggaggcctactggaaagccacacacccaccttcctccagcctgcccaaccctctcctgtcacggacactcgcaacatcctccctgccgctgtctcctactctagcaagcaactcacagggctcccagggtgaccagcgcactgaccgctccgccccaataagaagtgcctcacaagccgaggaggagccttctgtggaacccgtaaaaaagagccagcatcgcagttcctcctcagcccctcaccataatcatagaagcggcacaagtaggggtctgagcagacaagaaacgtttgactccgagacccaggagtctagggattcagcctatgtcgaacctaaggaagattattctcacgatcacgttgatcattatgcctcccacagagatcacaaccacagggacgagactcatggcagctcagatcatcgacacagggaatctcgtcacaggtcgcgggacgtcgatagggaacaggatcacaatgaatgcaataaacagcggagccggcataaatccaaggatcggtactgtgagaaggatggagaggtgatatcaaagaaaagaaacgaagccggagaatggaatcgggacgtgtatatccggcaatag

SEQ ID NO: 216585 - DNA, 1911 bp, Artificial Sequence
  Description of Artificial Sequence: Synthetic coding sequence
atggtgcagagagacatgtctaaatccccgccaacggcagccgcagcagtggcgcaagagatacaaatggagctgctggaaaatgtggccccagcaggagctcttggggcagccgctcaaagttacggaaagggcgcacggcgaaagaacaggttcaagggttccgacggctctacctcctccgataccacaagtaactccttcgtacgccagggcagcgctgactcttatacttctcgcccatccgactctgacgtcagtttggaagaggacagggaggccgtccgaagggaagccgagcgccaggcccaggcccagctggagaaggctaagacaaagcccgttgcctttgccgtgcgcacaaacgtgagttacagcgcagctcatgaagatgacgtaccagtgcctggtatggcgatctctttcgaggccaaagacttcctgcacgttaaagagaagtttaacaatgactggtggattgggagactggttaaagagggttgcgagataggcttcatcccaagtcctgtgaagctcgaaaacatgagactgcagcacgagcagcgagccaagcagggaaaattctactccagcaaatccggcggtaatagttcttcctccctgggggatatagtcccttcctcacggaagagcacgcctccttctagcggcgctaaatcggccgatgaacaggatcagtggaagaccgcaggcctcttctggcggtttacaacagagcacactccaccttacgatgtcgtaccctctatgagaccagtcgtccttgtggggcctagcctgaaaggctatgaggtcacagacatgatgcagaaggccctattcgacttcttgaagcataggtttgaaggcaggatatccattacccgagtgaccgcagatatttcactcgcaaagcggagtgtgttgaataaccctagtaaacacgcgattatcgagcgaagcaacacaaggtcctctctagccgaggttcagtcagagattgagcgcatcttcgaactagcccgaactttacagctcgtggtactggacgccgacacaatcaatcatccggcacagttgagtaagacatccctggcccctatcatcgtatatgttaagatttcctcacctaaggtactgcagaggctgataaagtcacggggtaagtcccaggccaaacacctgaatgtccaaatggtggctgcagataaactggcacagtgcccaccggaactcttcgatgtgattctggacgaaaaccagttagaggacgcctgtgaacatttggccgactatctagaagcctactggaaggctacccatccgccatcgagctcccttcccaatcctctgctatcacggaccctggcaactagcagtctccctctttctcccacactggccagcaactcccaaggcagccagggagatcaacgaacagatagatccgcacctattcggtctgccagtcaagccgaggaggagccgagcgtggagccggtgaaaaagtcccaacatcggtcgagctcaagtgccccacaccataatcatagatccggaacctccagagggctttcccgtcaggagacgtttgactcagagacccaggagagcagggactctgcgtacgtagagccgaaagaggactactctcacgaccatgtagaccactacgccagtcacagggatcacaatcatcgtgacgagacacacgggtcctctgaccaccggcatcgcgaatctaggcacaggagccgtgacgtggacagagagcaagaccataatgaatgcaataagcagcgaagtcggcacaaatccaaagatcggtactgtgagaaagacggggaagttatatctaaaaaaaggaatgaagccggtgaatggaacagagacgtgtatatcaggcaatag

SEQ ID NO: 216586 - DNA, 1839 bp, Artificial Sequence
  Description of Artificial Sequence: Synthetic coding sequence
atgaaggcgacatggatcagactgttgaagagggccaagggtggcagacttaaaaacagtgacatctgcgggagtgctgatagctacacttccaggccgtctgattcagatgtgagcctggaggaagatcgggaggccgttcgtcgagaggccgagaggcaggctcaggcccagctagaaaaagcgaagacaaagcccgtagcatttgctgtgcgcacaaacgtttcttactccgcagcccacgaagatgatgtgccagtgcccggaatggccatttcatttgaggctaaggactttctgcacgtgaaggagaaatttaataacgattggtggatcggtcgactggtgaaggaggggtgcgagatcgggtttatcccatcccctgtaaagctggagaatatgaggctacagcatgaacagagagccaaacagggcaaattctactctagtaaaagtgggggaaactcatcctcgtcgttgggcgacattgttccatcctcccgcaaatctactcctcctagttcggccatcgatatcgacgccactggtctggacgcagaagaaaatgatataccggctaaccacagatctcctaaaccttctgcaaattccgtgacctcgccccattctaaagaaaagcgcatgcccttctttaaaaagactgagcacactcccccatacgacgtggttccctcaatgaggcccgttgtgttagtcggcccatccctgaagggttacgaagttactgacatgatgcagaaggcgctgttcgactttctgaagcaccgttttgagggaaggatctccataactcgggtcacggcagacatctccctggccaaacgctccgtactgaataaccccagtaaacatgcaatcatagagaggagcaataccagatcaagcttagccgaagtccagtctgagatcgagcggatcttcgagttagcgagaacactgcagttggtcgtactggacgctgacaccattaaccaccctgcccagttatctaaaacttccctggcgccaatcatagtgtacgttaaaatttccagtcccaaggttctccagcgtttaatcaaatccagaggcaagtcacaagctaagcacctgaacgttcagatggtagctgccgacaagctcgcacagtgtcctcccgaactttttgatgtgattctggacgagaaccaactggaagatgcatgtgagcacctggccgattacctggaagcctactggaaggcaacacatccgccttcaagctcgctgcctaatccactgcttagtcgtaccctcgccaccagtagtcttccactttcacctactttagcaagtaacagccagggctcccaaggcgatcaaagaacagaccgatctgcacctattcgaagcgcctcccaggctgaagaagagccaagtgtcgagccagtgaaaaagtcccagcaccgctcatctagctccgctcctcaccataaccaccggtcaggcacctcgagaggtcttagcagacaggaaacatttgatagcgagactcaagaatctcgggattctgcatacgtagagccaaaagaagactacagccatgatcatgttgatcactatgcatcccatagggaccacaatcaccgtgatgagacacacggcagttctgatcaccgccaccgcgagtcccggcatcgatcacgcgacgtggacagagagcaggatcataacgaatgtaataaacagagaagccggcacaagagcaaggatagatattgcgagaaggacggcgaagtaatttccaaaaagcgaaacgaggctggtgaatggaacagagacgtttacatccgtcagtag

SEQ ID NO: 216587 - DNA, 1704 bp, Artificial Sequence
  Description of Artificial Sequence: Synthetic coding sequence
atgcagtgttgtggcttagtgcacagacgaagagtgagggtatcttacggttctgctgacagctatacctctagaccctcggacagcgacgtgagcctggaggaagatagggaagctgtaaggcgcgaggcagagcgacaagcccaggcccagttagaaaaggccaaaactaagcctgttgcattcgctgttaggacaaacgtttcatacagtgccgcacacgaggatgacgtgcccgtccccggaatggcaatctcattcgaagcaaaagactttttgcacgttaaagaaaagttcaacaacgattggtggataggaagactggtaaaagagggatgtgagattgggtttatacccagccctgtgaaactggagaacatgcgacttcagcacgaacagcgggcaaaacagggtaaattttacagttctaagagcggcggtaatagcagcagcagcctcggggacatcgtgccaagtagcaggaagtctacccccccatcatcggccaaacaaaaacagaagtctactgagcataccccaccttacgacgttgttcctagcatgcgcccagtggtgctggtcggccctagcctgaagggctacgaggtgacggatatgatgcagaaagcccttttcgatttcctcaaacaccgattcgaaggtcggatctcaatcacccgcgtgacagccgatatcagcctggctaaacgaagcgtccttaataatccctctaagcatgccatcatcgaaaggtctaatacaaggtcgtccctggcagaagtacagtctgagatcgaaaggatcttcgagctcgcaaggactctacagctcgtagtccttgacgccgacaccataaatcaccccgcacaactgagtaagacctcactggccccaattatcgtctatgttaaaatttcatcgccgaaagttttacagaggctcatcaagtccagagggaagtcacaggcgaaacacctgaacgtgcagatggtggccgcagataagctggcgcaatgcccgcctgaacttttcgatgtgattctggatgaaaaccagctggaggatgcgtgtgagcacctcgccgattatttggaggcgtactggaaagcaacgcaccctccaagcagctcgttacctaatccattgctgtcacggacacttgcaaccagttctctccctctcagccccactttagcttcaaactcccaaggctcacagggagatcagcggaccgaccgttctgctccaatccggtccgctagtcaggccgaggaagagccttcagtcgaacctgtgaagaaaagtcagcatcgaagttcttcaagtgccccacaccataatcatcgctccggcactagccgcggtctcagcaggcaggagacattcgattcagagacccaggaaagcagggattcagcatacgtggagcccaaggaggattacagccatgaccatgtggaccactatgcttcgcaccgcgaccataaccaccgcgacgaaactcatggtagctctgaccatcgccatcgggaatcacgtcatagaagcagggacgtcgatcgggaacaggatcataatgagtgcaacaagcagcggtctcggcataagtccaaggaccgctactgtgaaaaagatggcgaggtgatctcaaaaaagcgtaatgaagccggagaatggaaccgtgacgtctatattaggcagtag

SEQ ID NO: 216588 - DNA, 1821 bp, Artificial Sequence
  Description of Artificial Sequence: Synthetic coding sequence
atgttagacagaaggctaatcgctccgcaaactaagtatattattcccggtgggtccgctgacagctacacatctcggccatcggactccgatgtgtccctggaggaggatagagaggccgtgcgcagagaagccgaaaggcaggcccaggcccagctcgaaaaggcgaagacaaaacccgtggccttcgcagtccgtacgaacgtttcatacagtgccgctcacgaggacgacgtcccagttcccggaatggccatcagtttcgaagcaaaggactttctccatgtaaaagaaaagttcaacaatgactggtggattggccgtctcgtgaaagaaggatgtgagatcggttttattccctcacccgtgaagctcgagaacatgcgcctgcagcacgagcagcgcgcaaaacaggggaaattttatagcagtaagagcggcggaaactccagctcatcactcggggatatcgttccctcatcaagaaaatctaccccaccctcaagtgcaatcgacatcgatgccaccggccttgacgcagaggagaatgatattcccgctaatcaccggtctccaaaaccaagcgccaacagcgtcactagtccgcactcaaaagaaaaaaggatgcctttcttcaagaagaccgaacacacacctccctatgatgtagtgccttccatgcggccagtggtgctggtgggcccaagcctgaaaggctacgaggttactgacatgatgcagaaagcactattcgacttcctcaaacacagatttgagggccgtattagcataactcgtgtgaccgccgatatttccctggctaaaaggtctgttctaaacaatccatccaaacatgcaatcatcgagaggtccaatactcggtcttccctggctgaagtccagtcagaaattgagcgaatcttcgaactcgccaggacattgcaactagtggtgttagacgctgacacgattaaccatcctgctcagttgagcaagacttctcttgcacccatcatcgtttacgtgaaaatatcaagccctaaggtgctgcagcgactgatcaaatctcggggtaagagccaagcaaagcacttgaacgtgcagatggtggctgctgacaagttagctcagtgtcccccagaattgtttgacgtaatactggatgaaaaccagctggaggacgcatgtgagcatctcgctgattacctcgaggcatattggaaagccactcatccaccgagctcatccctgccaaatcccctcctttcccgaaccttagccactagctctctgcctctgtctcctacccttgccagtaattcacagggcagtcagggagatcagcggaccgatcgatccgcccctatccggagcgcttctcaggccgaagaagaaccctctgttgagccggtcaaaaaaagtcagcatcgctcgtccagcagcgcccctcaccacaaccataggtcagggacatcacgcggactctctcggcaagagaccttcgattccgagacccaggagtcccgggatagcgcatacgtcgagcctaaagaggactactcccacgaccacgtcgatcattatgcatctcaccgcgaccacaaccacagggacgagacccacgggtcttcggaccatcggcatagggaaagccgtcatcgctctagagatgttgatcgtgagcaagatcacaatgaatgcaacaagcagcgatctaggcacaagtccaaagacaggtattgtgaaaaggacggcgaggtgatcagtaagaaaagaaacgaagccggtgagtggaaccgggacgtgtatatacggcagtag

SEQ ID NO: 216589 - DNA, 1827 bp, Artificial Sequence
  Description of Artificial Sequence: Synthetic coding sequence
atgaatcagggatcagggctcgacctgctgaagatatcctatggtaaaggcgctaggagaaaaaatcgctttaaggggtccgacggatctacctcttccgacactaccagtaattcttttgttagacagggctctgccgacagctacacctctcgtccaagcgacagtgatgtcagcctggaggaagaccgagaggccgtgagacgagaggccgagagacaggctcaggcacaactagagaaggctaaaacaaagccggtcgcttttgccgtgcgcacaaatgtgtcctattccgccgcacatgaggacgatgtgcccgtgcccggtatggccatatcctttgaggcaaaggacttcctgcacgtgaaagaaaagttcaacaatgactggtggataggccgactcgtgaaggaaggttgtgaaatcggatttataccaagccctgtcaagttggagaacatgcgcttgcagcatgagcagcgggctaagcagggaaagttctacagttcgaaatccggcggaaatagttcttcttccctgggcgatatcgtccccagcagccggaagtctacaccacccagcagtggggctaagtctgcggacgaacaggatcaatggaagacagctggattgttctggcgctttaccaccgaacacactccaccttacgatgtcgtcccttctatgcgccctgtcgtgctggtcggcccttccctgaaaggctatgaggttacagatatgatgcagaaagcactgttcgacttcctcaagcatcgctttgaggggcgtataagcattacaagagtaaccgccgacatatctctggccaaacgatctgtgttgaacaatccgtccaaacatgccattattgaaaggagtaatacccgaagttctctagcagaggtccagagcgagattgaacgcatcttcgagttggccaggaccctgcagctggtggtccttgatgcagataccattaatcatccagcacagctgagcaagacttcattagcgccaattatcgtgtacgtgaagatatcgagccccaaggtactgcagcggctgatcaagtctagaggaaaaagccaagcaaagcatctgaatgtgcagatggtggctgccgacaaactagcccagtgtccacccgagctttttgatgtcattctggacgagaaccagcttgaagacgcttgcgaacacctcgcggactacctggaagcctactggaaagcgactcatccaccctcatcctctctgcccaatcctcttctgtccagaaccctggctacctcatctctgcccctcagccctacattagctagtaatagccagggcagccagggcgatcagcggacggacagatctgctcctataagaagcgcttctcaggccgaagaggaaccgtccgtggaacctgtgaaaaaatctcagcatcgctccagctctagcgccccacatcacaaccatcgtagcggcacttccagaggattgagtcgccaggagacatttgacagcgaaactcaagaaagcagagatagtgcctacgttgaacccaaagaggattatagccatgaccacgttgaccactacgcttctcaccgcgaccataatcatcgggatgagacccatggatccagtgatcacaggcacagagagtctcgtcataggagccgagacgtggaccgtgagcaggatcacaatgaatgcaacaagcagcgttcccggcataaatccaaagaccggtactgcgagaaagacggagaagtcatctcaaaaaagaggaatgaggctggcgagtggaatcgggatgtatatatcaggcagtag

SEQ ID NO: 216590 - DNA, 1818 bp, Artificial Sequence
  Description of Artificial Sequence: Synthetic coding sequence
atgcagtgttgtggcttagtccataggagaagggttcgagtgtcctatggatccgctgattcatacacctctagaccatccgacagcgacgtgtcgctggaagaggaccgagaggctgttcggagagaagcggaacgccaggcccaggcccaactcgaaaaggctaagacaaagcccgtggcattcgccgtcagaactaatgtgtcctactccgccgctcacgaagacgacgtgcctgtccccggaatggcgatcagcttcgaagcaaaagactttttgcatgtaaaggagaaatttaataacgattggtggattgggcgtcttgtgaaagagggctgtgagatcggattcatccctagcccggttaaactggaaaatatgaggttgcagcatgagcagcgtgcgaagcagggtaagttctattcctctaagagtggtggaaactcctccagcagtctgggggatattgtgccgagttcacgcaaatctaccccaccaagctccgcaatagatattgatgccaccgggctcgacgccgaagaaaatgacatacctgcgaatcaccggtcgccaaagcctagcgccaactctgtgacatccccccatagtaaagagaagaggatgcccttcttcaagaaaacagaacacacccccccatacgatgtcgtgcccagcatgagaccagttgtgctagtgggaccttcactcaaggggtacgaggtgaccgacatgatgcagaaagcactcttcgatttccttaaacatcgattcgaaggacggatatccatcactagagtcaccgccgatatcagtttagcaaagagatccgtgcttaacaacccaagtaagcatgctattatcgaaagatcaaacacacgctcatccctggctgaggtgcaatccgagattgaacgtatatttgagctggcccgaacactgcagctggtcgtgctggacgcggataccattaaccatcccgcacagttatccaaaacgagcttggcgcctatcatcgtatacgtaaagatctcctccccgaaggttctgcagcgtctgatcaaatctcggggaaagtctcaggccaagcatttgaacgtccagatggtggctgccgataagctggctcagtgccccccagagctgtttgatgtgatactggacgaaaaccagctcgaggatgcatgcgagcacctcgctgattaccttgaagcgtattggaaggccacccatcctccctcttcatcgttgcccaacccattactgagtaggaccctggctacgagttccttgcccctgtctccaacactggcatccaatagccaaggatcccagggtgaccaacggacagaccgatccgcccctattagaagcgcctctcaagctgaggaggagccgagcgtggagcctgttaagaaatcacaacacaggtcttccagcagcgctcctcaccacaaccacaggagcggaacctcacggggtttatcccgccaggagacctttgattccgagactcaggagtcaagggactctgcttacgtggagccaaaggaagattacagccatgaccacgtcgatcactacgcttcccatagagatcataaccaccgagatgaaacccatgggtcgagtgatcatcggcatcgtgaaagtcggcaccgcagcagagacgtggaccgagaacaggatcataatgaatgtaataagcaacgctcgcgccataaaagtaaggaccggtactgtgagaaagacggcgaagtgatttcaaaaaagcggaacgaagccggtgagtggaatcgagatgtatatattcggcagtag

SEQ ID NO: 216591 - DNA, 1455 bp, Artificial Sequence
  Description of Artificial Sequence: Synthetic coding sequence
atgtatgacgactcctatgtgcccggatttgaggactcagaagctggcagcgcagatagttatacgagcaggccttctcttgatagtgacgttagcctcgaagaggaccgggaatccgccagacgtgaagtggaaagccaggcacaacaacagttagagcgagctaaacacaagcccgtagccttcgccgtacgcacaaatgtgtcgtattgtggtgtactcgacgaagagtgccctgtacagggcagcggcgtcaactttgaggcaaaggacttcctacacatcaaggagaagtatagtaatgactggtggatcggcagattggttaaggagggaggcgatattgcctttatcccttcgccacagcgcctggagtctatccggctaaagcaagagcaaaaggctaggagaagtggtaacccgagttcactgtccgacatagggaaccgcaggagcccccctccgagtttggccaagcaaaagcagaagcaggcggagcatgtgccgccatacgatgtggtgcccagtatgcgtccagtggtcctggtgggcccatcactgaagggttacgaagtcacggacatgatgcagaaagccctgttcgatttcttaaaacatcgcttcgacggcagaatttcaatcactagggtcacagctgacctgtccctggcaaagcgcagcgtgttgaacaatccgggtaaaagaacaatcattgagcgctccagtgcacggtcctcaatcgccgaggtgcagagcgagatagagcgcattttcgagttagccaagtctctgcagttggtcgttctggacgctgacaccatcaatcatccggcacagctggccaagaccagcctagcgcctattattgtgttcgtcaaggtctcttcccctaaggttctccagcggttaattaggagtcgtggaaaaagtcagatgaaacacctgactgtgcagatgatggcatacgataagctggtccagtgcccccctgagagcttcgacgtgattcttgacgagaatcaattggaagatgcctgcgagcacctggctgagtatctggaggtgtactggcgggcaacgcatcaccctgccccaggcccaggcttgctaggcccaccatcagccatccctggcttacaaaatcagcagctgttgggtgaaaggggcgaggagcacagccctctggagcgtgactcgttgatgccgtcggacgaggcatcagaatccagcaggcaggcgtggacgggcagcagtcagcgcagtagtcgacacctcgaggaggattatgcggacgcttaccaggatctctaccaaccacataggcagcacacgtcgggcctgccatctgcaaacgggcacgacccccaggatcggctcctggcgcaggacagcgagcacaaccattccgacagaaactggcagcgcaatcgcccttggcccaaggactcgtactag

SEQ ID NO: 216592 - DNA, 1566 bp, Artificial Sequence
  Description of Artificial Sequence: Synthetic coding sequence
atgtcttctagtagctatgctaagaatggcaccgccgacggtcctcattccccgacttcacaggttgctcggggaacaacgaccagacggagcagacttaagcgctccgatggtagcactaccagcacctccttcatcttgagacagggaagtgcagatagctacacgtctcgtccgtcagatagtgatgtgtctctcgaagaggatcgggaggccattagacaggaacgtgaacagcaggcagccatacagctggagagagcaaaatctaaaccagtagcattcgcagtaaagaccaatgtgtcttactgtggggctcttgatgaggacgtgcccgtcccctccacagcaatcagtttcgatgccaaggatttcctccatattaaagaaaaatacaataacgattggtggatagggagactggtgaaggagggatgcgagatcggatttatcccatctcctctcagactcgaaaatatccgcatccagcaggagcagaaaagaggcagatttcacgggggaaaaagcagcgggaattcctcttctagtctgggggagatggtgtctggcactttccgcgcaacccccacctcaacggtcaagatggtgttgaaaatccacaccgagcacatccctccatacgacgttgtgccatctatgcggcctgtggtgctcgtgggcccttccctcaaaggctatgaagtaactgacatgatgcagaaggccttgttcgattttctaaagcaccgcttcgatggccgaatctcgatcacacgcgtcaccgccgacatctcgttagcgaagaggagcgtcctgaataacccctccaagagggctatcatcgagaggtccaatacaagatctagcctggcagaggttcagtccgaaattgaaagaatctttgaactcgccaggtcccttcagctggtagtgcttgatgcagacacaatcaaccatccagcccagctgattaaaacttcgctggctccaattatcgtgcacgttaaagtgagctccccaaaagtgctccagaggctcattaaatccaggggaaagagccaaagtaaacaccttaatgtgcagctggtggccgcagataaattggcccagtgccccccagagatgttcgacgtcatacttgacgaaaatcaattggaggacgcatgtgaacacctgggagaatacctcgaagcatactggagagccactcatacaacctcaagcaccccaatgacccctttactgggcagaaatcttggatctaccgccctgtccccatatcctactgccatttctgggctgcagtctcagcgcatgagacacagtaatcactctacagaaaattccccaatcgagaggcgctcactgatgactagtgacgagaattaccataatgagcgtgcacggaaatctcgcaaccgcctgagtagtagctcacagcactcaagagaccactatccactcgtagaggaggactatccggactcttaccaggatacttataaacctcaccgcaatcgtgggagccccggtgggtactcacatgactcacgtcatcgcctctag

SEQ ID NO: 216593 - DNA, 1464 bp, Artificial Sequence
  Description of Artificial Sequence: Synthetic coding sequence
atgtatgataacctgtacctgcacggcatagaagattcagaagcaggtagtgctgacagttataccagcaggccatcagacagcgatgtgagccttgaagaggacagagaggctatccgacaggagagggaacagcaggccgcaatacaacttgaacgtgctaaaagtaaacccgtcgcctttgctgttaagacgaatgtgagttattgcggtgctttggacgaagatgttccagtcccttctacagcgattagtttcgacgctaaggattttttgcacattaaagagaagtataacaacgattggtggatcggaagactagtgaaagaaggatgtgaaattgggtttatcccatcgccacttagactggagaacatcagaatccaacaggaacagaagcggggtagattccacggagggaagtccagcggcaattcttcttcaagcctgggtgagatggtatccggtacctttcgcgctactccaacatccaccgtaaaaatggtgctgaagatccataccgagcatatccctccatacgacgtagtgccttctatgcggcctgtggtgctggtgggccctagcttgaaaggatatgaggtgaccgacatgatgcagaaagctctgttcgactttctgaagcacagattcgacgggaggatttcgattacccgagtaaccgctgacatctctctggcaaagagatcggtgttgaataacccctcgaagcgtgcaattattgagcgttccaacaccagaagctccctcgccgaagtgcagtcagaaatcgagcggatatttgagctcgcccgatctttgcagctcgtcgttttagacgccgatacgataaaccaccctgcacaactgatcaagactagcttagcccctatcatcgtgcacgttaaagtgagttcacccaaggtcttgcagaggctcattaagtctcgcggtaagagccagtcaaaacacctgaatgtgcaactcgtggcagccgacaagctcgcacagtgccccccagagatgtttgatgtcattctggatgaaaaccaactcgaagacgcctgcgagcacctcggggagtaccttgaagcatattggcgagccacgcataccaccagctccactccaatgactcctctgctgggtaggaatcttggcagcacggcattatcgccctatccgaccgcaatctcaggcctccagagccaacgaatgcggcactcaaatcacagcaccgagaatagtcctattgaacggcgatcactgatgaccagtgatgaaaactatcataacgaacgggctcgaaagagccgcaaccgactatcatcaagtagccaacatagccgggatcactaccccctggtcgaggaggactaccccgacagttatcaggacacgtataaacctcaccggaatagaggctcgcccggtggctactcgcacgactctaggcacaggttatag

SEQ ID NO: 216594 - DNA, 1461 bp, Artificial Sequence
  Description of Artificial Sequence: Synthetic coding sequence
atgtatgacaacctgtacttgcacggtattgaggactctgaagctggctcagctgacagctatacttcccgcccttcagactctgacgtatccctagaggaggatcgcgaggccattcgccaggaaagggagcagcaggccgcaatccagttggaacgcgctaaatctaagcccgtcgcatttgccgttaagactaacgtaagttactgcggcgctcttgacgaagacgtgcctgtaccaagcacagcgatctcattcgacgctaaggacttcctccacattaaagagaaatacaacaatgattggtggataggacgccttgttaaggagggatgtgagatcggatttatcccatcccctctgagactcgaaaatattcgtattcaacaggagcagaaacgaggccgtttccacggtggaaaatcttctggcaactcatcttcttccctgggagaaatggtgagcggaacctttagagcaacacctacatctactgcaaagcagaaacagaaggttacagagcacatccctccttatgatgtcgttccctctatgcgaccggtcgttctagttggcccatccctgaagggttatgaagtgacagatatgatgcagaaagccttattcgactttctcaaacaccgattcgatggaagaatttcaataacccgcgtgacagccgatatatctctggctaagcggagtgttcttaacaatcccagcaagcgtgcaattatcgaacgaagcaatacccggagctcactggccgaggttcagtctgaaatcgagaggatcttcgagctagctcgatccctgcagctagtggtgctcgacgctgataccattaaccaccctgcgcagttaattaaaacttccctggcacctatcattgtgcacgtgaaggtcagcagtcccaaagtgttgcagagactcatcaagtccaggggtaaatcccagagcaaacatctgaacgtgcagctcgtcgccgctgataaattggctcagtgtcctccagaaatgtttgacgtgatcctcgacgagaaccagttggaagatgcgtgtgagcaccttggggaatatctcgaagcgtactggagggccacccacaccaccagcagtacacccatgacccctttgctaggtcgcaatcttggttctacagccctgagtccttacccaacggcaatctctgggctccagagtcaaagaatgcggcattctaaccatagtactgaaaactcaccgattgagagacggagtttaatgacttcagacgaaaactaccataacgagagggccagaaaatctcggaaccggctatcctcctcctcacagcatagccgggatcattaccccctagtcgaggaagattatcccgactcgtaccaggacacttacaaacctcatcgcaatcggggaagccccggaggatactctcacgactccagacatcgactttag

SEQ ID NO: 216595 - DNA, 1563 bp, Artificial Sequence
  Description of Artificial Sequence: Synthetic coding sequence
atgtcctctagttcctatgcaaaaaacggcactgcagacggtccccactcccctacatctcaggtggccagaggcacgacaacacgcagaagtcggctaaagagaagtgacggctcgaccacatccacttcttttatcctgcgtcaaggctccgctgactcttacacttctcggccatccgactctgacgtttccttggaggaagaccgggaagcgattagacaggagcgtgagcagcaggctgccattcagttggagcgggcaaaatctaagcctgtggcttttgccgtgaaaaccaatgtcagttactgtggcgctctcgatgaggatgtgcctgttccatctaccgccatttccttcgacgcgaaggacttcctgcatattaaggagaaatataataacgactggtggatcgggcgattagtgaaggaagggtgcgagattgggttcataccaagcccacttcggctcgagaacattcggatacaacaggagcaaaagcggggtagattccacgggggtaagtcaagtgggaacagttcatcgtcactgggtgaaatggtaagcggtactttccgggctacgcccaccagcaccgctaagcagaagcagaaggtgacagaacatattccgccttatgatgtggtaccgagtatgcgtccagttgtgctggtcggcccttccctgaaaggatacgaggtcacggatatgatgcagaaggccctctttgactttctcaaacatagattcgatggtaggataagcatcaccagggtaaccgccgacattagtttggctaagagatccgttttaaataatccctccaagcgggctatcatagagcgatcaaatactcggtcctccctcgctgaagtccagagcgagattgagagaatctttgagctggcccgtagtttacagttggtcgtgctggacgcagacacgatcaaccaccctgcccagcttataaaaacaagcttggcccctataattgtgcacgtaaaagtgagtagtcctaaggtgctgcagcggctcattaaatctagggggaagagccagtctaagcatctcaacgttcagcttgtcgcagctgacaagcttgctcagtgccctcccgagatgtttgatgtgattctcgatgagaaccagttagaggacgcctgtgagcacctgggcgaatatcttgaagcctactggagggcaacccatacaactagctcaactcccatgactccactccttggacgaaatctgggatctactgctctgtcaccttatcccaccgccatttccgggctccaatcacaaagaatgagacactcgaatcactctacagagaattcgccaatcgagagaaggagcctgatgacatccgacgaaaactatcacaatgaacgagctcggaagtcccggaaccgcctatcctcttcatcccagcacagtcgggaccactaccctcttgtggaggaagattatcccgactcctaccaggatacctacaaacctcataggaatagaggtagccccggtgggtattcccacgattctagacaccggctgtag

SEQ ID NO: 216596 - DNA, 1248 bp, Artificial Sequence
  Description of Artificial Sequence: Synthetic coding sequence
ttttacttcctatgtcagggctcagcggactcctatacatctagaccctctgatagcgacgtcagcctggaagaagacagagaggcaatccgccaggaaagagaacaacaggcagcgatacaacttgagagagctaaaagcaaacctgtggccttcgccgtgaagacaaacgtgagctattgtggtgcgctcgacgaagacgtaccagttccttccaccgcgatcagctttgatgccaaagatttcctgcatattaaggagaagtataataacgattggtggattggcagactggtaaaggaaggctgcgagatcggattcatccccagtccgcttcgtttggaaaatattagaattcaacaggagcagaagcggggaaggtttcatggcggtaagtcatctggtaatagcagctctagccttggggagatggtgagcggcacatttcgcgctacccccacaagtactgccaagcagaagcagaaggtcaccgagcacattcctccttacgatgtcgttccttctatgcgcccagtggtcctggttggcccttctcttaagggctacgaagtgacagatatgatgcaaaaagcgctgttcgattttctgaagcatcggttcgacggcagaataagtatcacccgcgtcaccgctgacatatccttggctaagagaagcgtgctgaacaacccatccaaacgcgctatcattgagcgttcaaatacaaggagtagtctcgccgaagttcagtcagagatcgagagaatcttcgaactcgcccgtagcctgcaactcgtggtgctcgacgccgacaccatcaatcaccccgcacagctgataaagacctcccttgctcccattatagttcacgtcaaagtaagctcacccaaggtgttacagagactaattaaatccagaggtaaatctcagagcaaacacctgaatgtgcagttggttgcagccgataagctggcacagtgtcccccatcacagagaatgcggcacagcaatcattcaaccgagaactcaccgattgagagaagatcactcatgacaagtgatgagaactaccacaatgaaagggctcgcaagtcgcggaataggctgagtagctccagccagcattcccgcgaccactacccgctcgttgaagaggattaccccgatagctaccaagacacatataaacctcatcgcaatcggggaagcccaggtggctacagccacgatagtagacatagactgtag

SEQ ID NO: 216597 - DNA, 558 bp, Artificial Sequence
  Description of Artificial Sequence: Synthetic coding sequence
atgtcaggcagttttgagctgagtgttcaggacctgaacgatctacttagcgacggatccgggtgttactcactcccttctcagccatgcaatgaggtcaccccacgaatttacgtgggcaacgctagtgtggcccaagatatccccaagttgcagaagctaggcattacgcacgtattaaatgcggctgagggccgaagctttatgcatgtgaacacaaacgccaatttttacaaggacagtggaatcacatatttgggtatcaaagctaacgacacccaggagttcaatctcagtgcctacttcgagcgtgccgctgattttatagaccaggctctcgcccagaaaaacggaagggtcctggtgcactgccgtgaaggatattcacgaagcccaaccctagttatcgcttatttaatgatgcggcagaagatggacgtgaaaagtgccctgtcaatcgtaagacagaacagggaaatcggtccaaatgacggcttcctggcacaactctgccaattgaatgaccgcctcgcaaaagaaggaaagctgaagccctag

SEQ ID NO: 216598 - DNA, 972 bp, Artificial Sequence
  Description of Artificial Sequence: Synthetic coding sequence
atgggactcttcgatcggggagtgcagatgttactcaccacagttggcgctttcgccgcttttagtctcatgaccatcgctgttgggaccgattattggctctattcccgcggtgtctgtaagacaaagagcgttagcgaaaacgagacctctaagaagaatgaggaagtgatgacccacagtggactttggagaacatgctgcctcgaaggcaacttcaaggggctctgtaaacaaattgatcacttccccgaggatgcagattatgaggcagacacagccgaatacttcctcagagctgtcagggcgtcttccattttcccaatactaagtgtcattctgctgttcatggggggtttgtgtattgctgcttctgagttctataaaacccggcacaacatcattctgtctgcgggtatttttttcgtttcagctgggctgtccaatatcatcggcatcatcgtgtacatcagtgccaacgcgggagatccttccaaaagcgactctaagaaaaatagctacagctatgggtggtccttctattttggagctttgagcttcattattgcagagatggtgggcgtgctggctgtgcacatgttcattgatcgccacaaacagctgcgggcaactgctagggcgacagactacttgcaagccagcgcgattactaggatcccatcatatagatatcgataccagcgcagatcacggtcctcttcccggagtacggagcccagccactcaagagacgcatctcctgtgggtattaaagggtttaacactctgccctccacggagatcagtatgtatactctgtccagggatcccttaaaggcggctactacgccaacagccacatacaacagtgacagagataatagtttcctgcaagtgcacaattgcatacagaaggaaaacaaagactcattgcattccaataccgctaaccgcaggacaacacccgtgtag

SEQ ID NO: 216599 - DNA, 948 bp, Artificial Sequence
  Description of Artificial Sequence: Synthetic coding sequence
atgaggatgtgcgataggggcatccagatgctgataaccactgtcggagccttcgccgctttctctctgatgacaatcgccgtcggaaccgactattggctgtactctcggggagtgtgtagaacgaagtcaacttcagacaacgaaacgtcccggaaaaatgaggaagtcatgacccattcaggcttatggaggacttgttgcctcgagggcgcattcaggggcgtgtgcaagaaaatcgaccattttcccgaggatgcagactatgaacaggacacagctgaatacctgctaagagctgttcgagctagtagcgttttccctatcctgtccgtgaccctgttgttctttggcggactctgtgtggccgcatctgaatttcaccggagcagacataatgtgatcctgagcgcaggaatttttttcgtctcggccggattgagcaatatcatcggcatcattgtttacatcagcgctaatgcaggggatcccggacaacgagatagtaagaaatcttactcctacgggtggagcttctactttggagccttctcatttataattgcagagatcgtgggcgttgtggcagtgcatatatatatcgagaagcatcagcagcttagggcaaagtctcattccgaatttttaaagaagtccacattcgcgaggttgcccccttacaggtatcgcttcaggcggcgatccagttctcgaagcaccgaacctagatctagggaccttagtccaatttcaaagggctttcacactattcctagtacggacatctccatgtttaccctgagccgtgatccttcaaagatcacaatgggtaccctgttgaattctgacagggaccacgccttcctccagttccataatagcacgcctaaggagttcaaagagagtctacacaataatcctgcaaatcgtcgtaccactcccgtgtag

SEQ ID NO: 216600 - DNA, 891 bp, Artificial Sequence
  Description of Artificial Sequence: Synthetic coding sequence
atgagcgcttgcggcaggaaagctttgaccttgctgtcatcagtattcgccgtatgcggcctcggactacttggaatagccgtgagcactgattattggctgtatttagaagagggcgttatcgtgccgcagaaccagtcaacagaaatcaaaatgagcttacactctgggctttggcgagtatgctttttggcaggagaggaacgaggcagatgcttcaccatcgagtacgtcatgccaatgaatactcaactgacatcagaatccaccgttaacgtgctgaaaatgatccgtagcgcaacaccattccccctggtgtctctgttttttatgtttatcggtttcatcttgaataacatagggcacatccgccctcatagaactatcttggcctttgtgagcggcatatttttcattctatccggtcttagcttggtggtgggcctggtcctgtacatctctagtataaacgatgaaatgcttaaccgtacgaaggacgccgagacatacttcaattataaatacggatggtcatttgccttcgcggcaatttcatttttactgacggaagttaagcccgtgaccctgtcgatggatcgcttgggcctgggtaccgcacccctcagtcgcggagaatggggatggggcaggcgcgatatccctcagccgttttggacccccgaccaccccctgtattttccttcttcaagccagaatgtgagtttatcatatctttccggatcacctcccgcacggatgagcccgggaccctgcagttgtccccacgtgcactttccccctcattccagctgcgtactctgcaggccacagccacgagaaatgaggcaggctccggcagcatccccctcctccgcagttttttccctctag

SEQ ID NO: 216601 - DNA, 828 bp, Artificial Sequence
  Description of Artificial Sequence: Synthetic coding sequence
atgtctgcgtgtgggaggaaggctctaacactgctgtctagtgtgtttgcggtatgcggacttggcctgctaggaatcgccgtgagtaccgactactggctctatctagaggagggtgtgatagtgcctcagaaccaaagcacagaaatcaagatgagtcttcactcagggctctggcgcgtgtgtttcctggcgggtgaggaaaggggaaggtgtttcacaattgaatacgtgatgccgatgaatacccagctcacctctgaatccacagtcaacgtcctgaagatgattaggtccgctactcccttcccactagtgtctctgtttttcatgttcatcggcttcattcttaacaatattggacacattcgtccacatcgcacaattctggccttcgttagtggcatcttcttcattctgagtgggctgagtctagtggtggggctcgtgctctatattagctcaatcaacgatgagatgcttaatcgaacaaaggacgctgagacttacttcaactacaagtacggatggtcattcgctttcgcagctattagtttcttactgaccgaaagcgccggagtgatgtctgtgtatctgtttatgaagaggtacaccgctgaagatatgtatcgcccacatcccggattttaccgtcctagattgagtaattgcagcgactattcaggccagtttctccaccccgacgcctgggtgcggggaaggtctccctctgacatttcgtccgaggcctccttgcagatgaacagcaactatccagctttgctgaagtgtccagactatgatcagatgtcttcctctccgtgttag

SEQ ID NO: 216602 - DNA, 828 bp, Artificial Sequence
  Description of Artificial Sequence: Synthetic coding sequence
atgtccgcctgcggaagaaaggcccttacgcttctgtcgtctgttttcgctgtgtgtgggctgggcctgttgggcattgctgtgtctacagattattggctgtatctggaggagggcgtgatagtgccgcagaaccagagcaccgaaattaaaatgtccttacactccggtctgtggagagtctgttttttggccggagaggagcggggtcgttgttttactattgagtatgtgatgccaatgaatacccagcttactagcgagagtaccgtgaatgtactgaaaatgatccggagcgccactccttttcccctggtgtccctcttcttcatgttcattggttttatactgaataatattggccacattaggccccatcggactatcctggctttcgtgagcggaatttttttcatactgagtggcttatcattagtggttggactagtactctatatatcatccatcaacgatgagatgttaaatcgcacaaaagatgccgaaacctactttaattacaaatacgggtggtccttcgcttttgccgctatatcgtttctccttaccgaatccgccggagtcatgtccgtgtacctgtttatgaagcggtacacggccgaagatatgtatcggcctcacccaggcttttatagacccaggttaagcaattgcagcgattactctggtcaatttctccacccagacgcatgggtcagaggacgctctcctagcgacatatccagcgaagccagtttgcagatgaactccaattacccagctttactgaaatgtccagattacgatcaaatgtcttcatccccttgttag

SEQ ID NO: 216603 - DNA, 783 bp, Artificial Sequence
  Description of Artificial Sequence: Synthetic coding sequence
atgatgtggagcaactttttcctccaggaagaaaacagaaggcgaggcgcagcgggtaggaggagggcgcacggccaaggcagatccggtctgacaccggagcgtgaggggaaggttaaactggcactgcttctcgcagccgtcggagccacgcttgccgtgttgtcagtcggcaccgagttttgggtagaattgaacacctacaaggcaaatggcagcgctgtttgcgaagcagcacacttgggcctgtggaaggcttgtactaagaggttatggcaggctgatgtacctgtcgatagagacacatgcggcccagcagagctccctggagaagcaaattgcacctacttcaaatttttcactactggggaaaacgcaagaatttttcagaggacaaccaaaaaagaagtgaaccttgcggcagcagtcatcgccgtgctgggcctggccgttatggctcttggatgcctatgcattattatggtcctgtcaaaaggcgcagaatttctgcttcgggtaggtgccgtgtgctttggcctttccggtcttctgctgctagttagtctcgaagtgtttcggcacagtgtgagggcactgctgcaaagggtcagccctgagcctccccctgccccacgcctgacctatgagtacagttggtccctgggttgtggcgtgggcgcaggactgatactcctgctgggagctggctgctttcttctgctgaccctgcctagctggccttggggatcactgtgcccaaaacgaggccatcgagcaacctag

SEQ ID NO: 216604 - DNA, 645 bp, Artificial Sequence
  Description of Artificial Sequence: Synthetic coding sequence
atgatgtggtctaacttcttcctccaggaagaaaaccgcagacggggtgcggcaggccgtaggcgagctcacggccagggtcggtccggtctcacccctgaacgggaggggaaagtgaaactcgcgctcctactcgccgcagtgggagcaacactggctgtcctgtcggtgggtaccgagttttgggttgaactgaacacatataaagcgaacgggagcgctgtttgtgaggccgcacacctgggcctttggaaagcctgcaccaaaagattatggcaggccgacgtaccggtggaccgcgatacctgcggacccgcagagttgccaggagaggctaactgcacatacttcaaattttttactaccggtgagaatgccagaatctttcagagaactaccaagaagggtctactgctcctggtgagcttggaggtgttccggcactctgtgagggcactactgcagagggtgtcacccgagcctcctcccgctcccaggcttacatacgaatatagctggagtttgggttgtggagtcggggctggtttgatcctgctgctaggggctggatgttttcttctgctgaccctcccatcatggccctggggcagcctatgccctaaaagagggcacagggccacatag

SEQ ID NO: 216605 - DNA, 570 bp, Artificial Sequence
  Description of Artificial Sequence: Synthetic coding sequence
atgatgtggtctaacttcttcctgcaggaggagaaccggagaagaggggcagccggaagacgtagagcgcatggacagggcaggtcagggttaacccctgaacgcgaaggaaaagtgaaactcgcgcttcttctggccgctgtaggggctaccctggccgtactctctgtggggacagagttctgggtggaactgaacacttacaaggcaaacggttcggctgtatgtgaggcggctcacctgggcctgtggaaagcttgcactaaaagactgtggcaagccgatgtgcctgttgacagagatacatgcggaccagccgagctgccagggggtctgctccttctggtgtcactggaagtctttcgacatagcgtccgcgctctgcttcagcgggtgtcgccagagcctccccctgcacctaggttgacttacgagtactcctggagcctggggtgtggggttggagccggactcattcttttgctcggcgctggctgttttctgctactgaccctccctagctggccctggggctctctctgccccaagcgcggacatcgcgctacttag

SEQ ID NO: 216606 - DNA, 321 bp, Artificial Sequence
  Description of Artificial Sequence: Synthetic coding sequence
atgtctacaaataacatgtcggatcctagaagacccaacaaagtgctccgctataaaccgccaccaagtgaatgtaaccccgctcttgacgatcctacaccggactatatgaacttgttggggatgatcttttctatgtgtgggttaatgctgaagctgaaatggtgcgcctgggtggccgtgtactgctctttcatttccttcgccaacagccggagcagtgaagacaccaagcagatgatgagttcctttatgctgtctatctcagcagttgttatgtcatacctgcagaatccccagccaatgacaccaccttggtag

SEQ ID NO: 216607 - DNA, 828 bp, Artificial Sequence
  Description of Artificial Sequence: Synthetic coding sequence
atgagccattgctcatcccgagctctgacccttctgagctctgtattcggcgcttgcggcttgcttctggtgggcatagccgtcagcacggattactggctgtacatggaagagggcaccgtcctgcctcagaaccagaccacggaggttaagatggccctgcacgcaggactgtggcgcgtctgcttcttcgctgggagagaaaaggggagatgcgtcgccagcgaatacttccttgaaccagagatcaacctggttacagagaataccgagaacattcttaagacagtccggacagccaccccattccctatggtgtcactctttttagtgtttaccgcttttgttatcagcaacatcggtcacatccgcccacaaaggacaatactggccttcgtatccggtatattctttatactgtcaggactgagcctcgtggttgggttggttctgtacatttcctccataaatgacgaagtgatgaatcgcccatctagtagcgagcagtactttcactaccgttatggctggagcttcgccttcgctgcctcatcttttctgctgaaggaaggagcaggggtcatgtctgtatatctctttacgaagagatatgccgaggaggaaatgtacagaccccaccctgctttttaccgccctcgactgtcagactgcagcgactacagtggccagttcctgcaacccgaggcctggcgcaggggcaggtccccgtcagatatatcaagcgacgtttcaatccagatgacacagaattacccccctgccatcaaataccctgaccacctccacatttccacctcaccatgctag

SEQ ID NO: 216608 - DNA, 1278 bp, Artificial Sequence
  Description of Artificial Sequence: Synthetic coding sequence
ttggaatcacttaaacgttggaacgaagagcgcggtctctggtgtgagaaaggggtccaggttctcctgactaccgttggggcttttgcggcttttgggctcatgactattgccatctccactgactactggctgtatacaagagctctgatttgtaacactactaatttaactgccggaggggacgatgggacaccgcacagaggaggtgggggagccagcgaaaagaaggacccaggaggtctgactcacagcggactttggaggatttgctgtctggaagggctgaagaggggtgtatgtgtcaaaatcaaccatttccctgaagatacggactatgatcacgacagcgcagaatatctcctgagagtcgtgagagcatccagcatctttccaatcctctctgccatcctgctgctcctgggcggagtctgtgttgcagcgagtcgggtatataaaagcaagagaaacatcattctgggtgcaggtatactgtttgtggcagctgggttatctaacatcattggggtgattgtgtatattagtgccaatgccggtgagccaggacctaagcgggatgaagagaagaagaaccattatagttacggctggagcttctattttgggggtctgagctttattctggccgaggtgataggtgtgctcgctgtgaatatctatatcgaaaggagtcgcgaagcccattgccagtcaagatccgatctgttgaaggccggagggggagccggtggatctggcggatcagggccaagcgcaattttgcgactgccgagttaccgcttccgctacagaagaagaagccgttcctcttctcgctctagcgagccttctccaagccgggatgcttcccccggaggacctggtggcccagggttcgctagcacagatatctctatgtatactttgagcagagacccttctaaaggatccgtcgccgctgggttggctggggctgggggtggcggtggtggcgctgtgggcgcttttggaggggcagccggtggcgcaggcggaggaggagggggagggggtggcgctggtgccgagagggacaggggaggcgcttcaggatttttgacacttcacaacgcctttccaaaggaggccggaggcggtgttaccgttactgtgaccggaccgcctgctcctccggcaccagccccacccgctcctagtgcaccagcccctggcaccttagccaaagaggcggctgcttctaacactaacacactcaacagaaagacaactcccgtatag

SEQ ID NO: 216609 - DNA, 6539 bp, Artificial Sequence
  Description of Artificial Sequence: Synthetic coding sequence
atggtgaacgagaatacacgcatgtacatcccagaagagaatcatcagggtagcaattatggcagccccagaccagcccatgccaatatgaatgcgaacgctgcggcaggattggctcctgagcatatacccacgcccggtgcagccctgagttggcaggcagcaatcgatgccgcaaggcaggcaaagctgatgggcagcgcaggcaacgccaccatatccacggtgtcttctactcagcggaaaaggcaacagtacggcaagcctaagaagcaggggtctaccaccgccacacgccctcccagagcactgctgtgtctcacactgaaaaaccccatccggagggcttgcatctcgatagtggagtggaaacctttcgagatcatcatcctgctgacaattttcgccaattgcgtcgctcttgctatttacatcccgttcccagaggatgacagcaacgcaacaaattctaacctcgagagagtggaatatttattcctgatcatatttactgttgaggcctttttgaaggtcattgcgtacggcctgctttttcaccccaacgcctatctgcgcaatgggtggaatctcctcgacttcataattgtagtggtgggactattctcggccatattggagcaagcaaccaaagccgacggggcaaatgcgctggggggaaagggcgcagggttcgatgtcaaagctttaagagcatttagagtgctgaggcctctgcggttggtatcaggcgtgccctccctgcaggtggtgcttaatagcatcatcaaagctatggtgcctctgctccacatagccctgcttgttctgttcgtgatcatcatttacgccattatcggtttggagctgttcatgggtaaaatgcacaagacatgttacaatcaggaggggatcgcagatgtcccagccgaggacgatcccagcccttgtgctctagaaactggacacggaaggcaatgccagaatggcactgtctgcaagccgggatgggatgggccaaaacacggcataacaaacttcgacaactttgcgttcgccatgctgaccgtgttccagtgcattacaatggaaggctggacagatgtgttgtattgggtgaacgacgctgtcggcagagattggccatggatctacttcgtcaccctgattatcatcggttccttcttcgttttaaatctggtgctgggagtgcttagcggagaattttctaaagaaagggagaaagctaaggccagaggcgacttccagaaactacgtgaaaagcagcagttagaggaagatctcaaggggtatctagattggatcacacaggccgaagatattgacccagaaaacgaggacgagggcatggatgaagaaaaacctaggaacatgtccatgccgacctcagagaccgagagcgtgaacaccgagaacgtggcagggggtgacatcgagggagagaactgcggcgctagattggcccatcgcatttcaaaaagtaaattcagcagatattggcggaggtggaaccgtttctgccgtaggaagtgcagagccgctgtgaaaagcaacgtgttttattggcttgtgatcttcctggtatttttgaacacattgaccattgcctctgagcattataatcagcctaattggctgactgaggttcaggacacggctaacaaagccctcctcgcactgtttactgcagaaatgctgctcaagatgtacagcctgggactacaggcctacttcgtttccctctttaatcgatttgactgcttcgtcgtctgcggcggaatattggaaaccatcctcgtggagacaaagatcatgtccccacttggtatttccgttctccgttgcgtgaggctgttacgcatatttaaaatcacaagatactggaattcactgtctaacttggtggcatcacttctgaactctgtgcgatcaatagcctccctcttactgctgctattcctgtttatcatcatcttcagcttgctgggaatgcagctattcggtggcaagttcaactttgatgagatgcaaacccggaggtccacctttgacaatttccctcagtccttgctgacagtttttcagatccttactggcgaagattggaatagcgtgatgtacgatggcatcatggcctacggtggaccatcttttcccggaatgctcgtgtgtatatactttatcatcctgtttatatgtgggaattacatcctgttgaacgtcttcctggcaattgctgttgacaaccttgccgatgcggagagcctgaccagcgcccagaaagaggaagaggaggaaaaagagagaaagaaactcgcgagaaccgctagtccagagaaaaagcaggaactggtggagaagccagctgtgggggaatcaaaggaggagaagatcgagctgaaaagtattacggccgacggggaatcccccccagcaaccaaaatcaacatggacgatctccagcctaacgaaaacgaagacaaaagtccttatccaaatcccgagacgactggcgaggaggacgaggaggagccagagatgcccgtcggcccaaggcctcggcctctgtctgaacttcatctgaaggagaaagccgtaccaatgccagaagctagcgcctttttcatttttagctcaaataacagattccgattacagtgtcacaggattgtcaacgatactatcttcaccaatctcatactgttcttcatcctcttgtcctccatctccctcgccgcagaggatccagtccagcataccagcttccgcaatcacatcctgttttacttcgacattgtgttcaccaccatcttcacgatcgaaatagctctcaagatgaccgcttacggcgcttttctgcacaagggttcgttttgtagaaattactttaatatcctcgatctgttagtggtgtctgtgtctcttatctccttcggtattcagagtagcgctattaatgtggtcaagatcttgagagtgttgcgagttctgcggcctctgcgggcaatcaaccgggcaaagggcctgaagcatgttgtgcaatgtgtatttgtcgctattcgcaccatcggaaacatcgtgatcgtaacgaccttactacagtttatgtttgcctgcattggagtgcagttgttcaaggggaaactctacacttgcagcgactcatctaagcagaccgaagccgagtgtaaaggcaactacatcacctacaaagacggagaagtcgaccatcctattatccagccacgaagctgggagaatagtaagttcgactttgataatgtgctggccgctatgatggctctgtttaccgttagcacatttgagggctggcctgagctactctataggagtatcgactcacacactgaggataagggtcctatttataactatcgcgtggaaatcagcattttcttcatcatttatatcatcatcatcgctttttttatgatgaatatcttcgttgggttcgtgatcgtgactttccaggaacagggtgaacaggaatacaaaaattgcgagttggacaagaatcaacgccagtgtgttgaatatgccttgaaagccagacctctgcgacgctacatacccaaaaatcagcaccagtataaagtctggtatgtagtgaatagtacatatttcgagtacctgatgttcgtcctgattctgctcaacacaatctgtcttgccatgcagcattacggtcagagttgcctgttcaagattgctatgaatatcctgaatatgctgtttacaggtctgttcactgttgaaatgattctcaaactcattgcattcaaacccaaacattatttctgtgatgcttggaacacgttcgacgcgctgattgtagtaggatccatcgttgacatagcaattacagaagtgaaccctgccgagcacactcagtgtagcccaagtatgggcccaagttgttctcatccacctctggcagtgctgactgcaccgcctgtcgccgacggcttccaaaatgccgaagagaactctaggatctccataaccttttttagactgttcagagtgatgaggctagtgaaacttctgagtcggggagagggcatacggactctcctctggaccttcatcaagagctttcaggccttgccatacgttgcactgctgatagtcatgctctttttcatctacgcagtaatcggtatgcaagtgtttgggaagattgccctcaacgacactaccgaaatcaaccgcaacaataattttcagaccttcccccaggcagtgcttctgcttttcagatgtgctactggcgaagcctggcaggatattatgttagcatgtatgcccggtaagaaatgcgcacccgagtccgagcccagtaactcgaccgaaggcgaaactccttgtggctcgtcattcgcggtgttctacttcatcagtttctatatgctgtgtgcctttttgatcatcaatctgtttgtggccgtcattatggacaacttcgactatctgactcgggattggtccattctgggccctcatcatctggacgagttcaagcgcatatgggctgagtacgatccagaagctaagggtcgcattaaacacctagacgttgtgacactgctgcgacgcatccagccacctttgggcttcggcaaactctgtccacaccgagtggcttgtaaacgcctcgtctctatgaacatgcctctcaattctgatggtactgttatgtttaatgctactttgttcgccctcgtaaggacggccttgagaatcaagacagaagaaggcccatcacccagcgaggcccatcaaggggcagaggacccattcagaccagctgggaacctcgaacaggccaatgaggagctgcgggcaattattaagaaaatttggaaacgtacaagtatgaaactgttggatcaagtagtgccacccgctggtgacgatgaggtcaccgtcggaaagttttatgccacttttctgatccaggaatatttcaggaagttcaagaagcgaaaagagcaaggcctcgtaggtaagcctagccagcgcaatgctctctccctgcaggcaggcctacggacactgcatgacatcggtcctgaaattcggagggcaataagtggggatctgaccgctgaggaggagttggataaagctatgaaagaggcggtgtccgccgcatccgaggatgatatcttccggagagcgggtggtttatttggcaatcatgttagttattaccagagcgatggcagatctgcctttccccagactttcaccactcaacggccattacacatcaacaaagctggctcttcacagggggacaccgagtctccgtctcatgaaaaactcgtagatagcacttttacccccagctcttactcgtctacaggaagtaacgccaatattaacaacgctaataacactgccctggggagattgcccagacctgcaggttaccccagcacagtatccaccgtggagggccacggtcctcccctcagccctgcaatccgggtgcaagaagtcgcttggaaactgtcaagtaatcgctgtcattcacgagagtcccaggcggctatggcagggcaggaggagacttctcaggacgaaacttatgaagtgaagatgaaccacgatacagaggcatgcagcgaaccctcattactgtctacagagatgttatcttatcaggacgacgagaaccgccagctgactcttcccgaggaagacaaaagagatatacgccagagtccaaagcgcggattcctgcgcagtgcctctttgggaagaagggcatcctttcacctggagtgccttaaaagacagaaagataggggaggtgacattagccagaagaccgttctgccactgcatctcgtccaccaccaggccctcgctgttgctgggctcagtcccctgctgcagcggtcacattcccccgcatccttccccagaccttttgctacacctcccgcaacgcctggaagtcggggttggcctccccagcccgtgcctaccttaaggcttgaaggcgtggaatcttcagagaaactcaattcctccttccccagtattcattgtgggtcttgggccgagaccaccccaggtggcggaggctcctcagccgctaggagggtcaggccagtgtccctaatggtcccctctcaggccggagctcctggacgacagttccatggatcagcttcatccctagtggaagccgtcctcattagcgagggcttgggccagtttgctcaggacccaaaattcattgaggtgactacccaggagctggctgatgcctgtgacatgaccattgaggagatggagtctgccgcagacaacattttatcaggcggtgcgcctcaaagcccaaacggggctctattgccgttcgtaaattgccgtgacgcgggacaagacagggcgggtggtgaagaggatgccggatgcgtgcgcgcacgaggaagaccctccgaggaggaactccaggactcacgcgtctacgtctccagcctgta

SEQ ID NO: 216610 - DNA, 6560 bp, Artificial Sequence
  Description of Artificial Sequence: Synthetic coding sequence
atggtaaatgagaacacacgcatgtatattcctgaggagaatcatcagggcagcaactacggaagcccgcgtccggcacacgccaatatgaatgcaaacgctgcagccggactcgcaccggagcatatcccaaccccaggagcagctttaagctggcaagccgctattgacgccgcacgccaggcaaagctgatgggctcagctggaaacgccactatttctacagttagtagtacccaaagaaaaagacaacagtacggcaaacctaaaaaacaagggtcgacgacagccactagacctccccgtgccctcctctgccttacactgaagaatccaatccgcagggcatgtatctccatcgtcgagtggaagcctttcgagataattattctgctcaccatctttgccaactgtgttgccctggctatttacattccctttcccgaggacgacagtaacgcaactaactctaacctggaacgggtggagtatttatttctgataatttttactgtagaggcctttctcaaagtgattgcttacggtctgctgttccacccgaatgcataccttcggaacgggtggaatctgcttgacttcattatcgtagtggttggccttttcagcgccatcttggaacaggctactaaagccgacggtgctaatgccttgggcggaaaaggggctggcttcgacgtcaaagccctgagagctttccgcgtcttgcgacctctgcgtttggttagcggcgtgccgagcctccaagtagttctgaattcgataatcaaggctatggtgcccttgctccatattgctctgctggtcttgttcgtgataatcatctatgcaattattggattggagctgtttatgggcaagatgcacaagacttgttacaaccaggaaggcattgccgacgtgccggctgaggacgatccttccccttgcgccttggagacgggtcatgggaggcagtgccaaaatgggacagtgtgcaagcccggttgggatggtcccaagcacgggatcacaaacttcgataacttcgcctttgctatgctgacagtatttcagtgcataacaatggaaggctggacagacgttctctactgggtcaacgacgcggttgggagggattggccctggatttatttcgtcacactgataattatcggctcattcttcgtgctgaatctggtgctgggagtgttgtcgggcgaattttccaaggaaagagaaaaagccaaagctcggggagatttccagaagctgagggagaaacagcagctggaagaggacttgaaaggatatctggattggattacccaggccgaggatatcgaccccgagaacgaggacgaggggatggatgaggagaaacccaggaacatgagtatgccaacgagcgagactgaaagcgtcaatacggagaacgtcgccggtggagatattgaaggcgagaattgcggggcacggctggcccataggatatccaagagcaagttcagtagatactggcgccgatggaatcgcttctgccgtaggaaatgccgagctgctgttaaatccaacgtattctattggctcgtgatattcttggtctttcttaacacccttactatcgctagcgagcactataatcagccgaactggctcacggaggtccaggacactgctaataaggcgctgctggctctgttcaccgctgagatgctgctcaaaatgtactccctgggactgcaggcttatttcgtatccctattcaacagattcgattgctttgtcgtgtgcgggggtatcttggagaccattctggtggagaccaaaataatgtcaccgctcggcatctcggtgctgcgctgcgtccggctgttacgcattttcaagattactcgctactggaactccctttccaacctggttgccagtctgctgaactcagtcagatctatcgcatctttacttctgttactcttcctgtttatcattattttcagtctgctcgggatgcagctgttcggcggaaagttcaactttgacgagatgcagacacggagaagtactttcgataacttcccacagagcttgctaacagttttccagattcttaccggagaagactggaactccgtcatgtacgacggtatcatggcctacgggggaccaagctttccaggcatgctggtgtgcatatatttcattatattgtttatctgtggcaactacatattactcaatgtgtttctcgccattgctgttgacaacctcgcggatgctgaatcacttacatcagcccagaaggaggaagaggaagaaaaggagagaaagaagcttgctagaaccgcaagccccgagaagaagcaagaattagtagaaaagcccgctgtgggagaaagcaaggaagagaagatcgagctcaaatcaatcaccgcggatggcgagtccccacccgcaaccaagataaacatggatgacctccagcctaatgagaacgaagataaaagtccataccccaacccggagaccacaggcgaagaggacgaggaggagccagaaatgcctgtgggtccgcgtcccaggcctctgtcagagcttcatctgaaggagaaggccgttccaatgcctgaagccagcgcattctttattttctccagtaataacaggttcagactgcagtgtcacaggatcgtgaatgacactattttcaccaacctcattctgttttttattctactgtctagtatttctttggccgcagaagatcctgtccagcatacttccttcagaaaccacattctgttttatttcgatatcgtattcaccactatcttcaccattgaaatcgctctgaagatccttggtaatgccgactacgtattcacctctatctttaccctggaaattatcctgaagatgaccgcatatggcgctttcctgcacaagggatctttttgccggaattattttaacatccttgacctactggtggtgtcggtgtcactgattagcttcggcattcagagctctgccatcaacgtggtgaagattctccgtgttctgcgggtacttagaccccttagggccattaatagggccaagggactcaagcatgtggtgcaatgtgtgtttgtggccatccgtaccatcggaaacatcgtgattgtcaccactttactgcagttcatgtttgcctgcataggcgtccagcttttcaaaggaaagctgtatacatgtagcgactcctccaaacagactgaggccgaatgcaagggaaattacattacctacaaggacggcgaggtagaccatcccataatccagcccagaagttgggagaattctaaatttgattttgataatgtgcttgcagccatgatggcgctcttcacagtatctactttcgagggctggccggaattgctgtaccgctccatcgatagtcacactgaagataagggccctatctataattacagggtcgagatttcaatcttctttatcatctacatcattatcattgcatttttcatgatgaacattttcgtggggttcgtgatagtgacctttcaggagcagggcgagcaggaatacaagaattgtgagctggacaaaaatcaacgtcagtgtgttgaatacgccttaaaggccaggccgcttagacgttatattcccaagaatcagcatcagtacaaagtctggtacgtggtgaactcaacttattttgaataccttatgttcgtcctaattctcctgaacaccatctgtctggctatgcaacattatggccagtcttgcctgttcaagatcgccatgaacattctgaacatgctgttcacgggtcttttcacggtcgagatgatcttgaaactgatagctttcaagcctaagggctatttcagtgatccctggaacgtattcgacttcttaatcgtcattggcagcattatagacgttattctgtccgagaccaatcactacttctgcgacgcatggaacacattcgatgccctcatcgtcgtaggttctattgtggacattgccattactgaagttaaccccgcagagcacacccagtgttccccatctatgaatgcagaggagaattcaaggatatcaattacattctttaggctgttccgcgtgatgcggctcgtcaagctgttatcacggggtgagggcattcggaccctgctgtggacctttattaagtccttccaggcgttgccatacgtggctctccttattgtcatgctcttcttcatctacgccgtgatcggaatgcaggtgtttggcaagattgccttaaatgatacgaccgagattaatcgcaataataacttccagactttccctcaggccgtgttgctgctctttaggtgcgccaccggggaggcatggcaggatatcatgttggcgtgtatgccaggaaagaaatgtgctcccgagtcagagccttccaacagcacagaaggtgagacaccttgtggatcttcctttgcagtcttttacttcatttcattttacatgctatgcgcgttcctgatcattaatctctttgtggccgtgatcatggacaactttgactatctgacccgggattggagcatccttgggcctcaccacctggatgagttcaagcgtatttgggctgaatacgaccctgaagcaaaggggaggatcaagcacctggacgtggtcacactgctgcgcaggattcaacccccactcggcttcggcaaactctgtccacaccgagtggcctgtaagaggctggtctctatgaatatgcccttaaatagcgatggtacagtaatgtttaacgctactctttttgcgttggtgagaactgccctgcggatcaagaccgaagggaatcttgaacaagcgaacgaggaattaagggcaataataaaaaagatttggaaaaggacttcaatgaagttgcttgatcaggttgttcctcccgctggcgatgacgaggttacagttggcaagttctacgcaacctttttgatccaagaatatttcagaaagttcaagaagaggaaagagcaggggctggtgggcaagcctagtcaacgaaatgctctgtccctgcaggcaggcctgcggacgctccacgatatcggccctgaaatccgaagagcaatctccggggatctcaccgctgaagaggaattggacaaggcgatgaaagaggctgtttcagccgcttcagaagatgacatctttaggagggcgggtggcctgtttggcaatcatgtgagttactatcagtccgacggccgttccgcctttccacagaccttcactacccaacggcctcttcatataaacaaggcgggtagctcccaaggtgacaccgagtcgcccagccatgagaagctggtagactccacattcacaccctcaagttacagctcaactggttccaacgcaaatattaacaacgccaacaacacagctctgggtcggcttcctagaccagcagggtacccatcaacggtatcaacggtggaggggcacggcccacctctgtcgcctgcgattagggtccaggaggtggcatggaagttgagctccaaccggtgccatagtagagagagccaggcagccatggctgggcaagaagagacgtcccaggatgaaacctatgaggtgaagatgaatcatgacaccgaagcttgtagcgagccgtcgcttctttccactgaaatgctttcttatcaggacgatgagaaccggcagctaactcttcctgaagaagataagcgcgacatccggcaaagtccaaagaggggttttttgaggtcagcatccctgggccgtagagcttcattccatttggagtgcctgaaacggcagaaggatcggggtggagacatctcccaaaaaactgtgttacccctgcatctcgtacatcaccaggcactggctgttgccggtctgtcacccttattgcagcgctcccactccccagcatccttcccacgcccatttgcgacccctccagcgacacctggcagcaggggttggccacctcaacctgttcctacacttcgcctggaaggcgttgagagcagcgaaaagcttaactcttcatttccctcaattcactgtggctcctgggctgagactacacctgggggtgggggatccagcgccgcacgcagagtccggccagtgagtctcatggttccctctcaggcaggcgctccaggccgtcagttccatggatccgcctcatccctagtcgaagccgtcctgatctctgaaggcctgggccagttcgcgcaggatcctaaatttattgaggtcacgacccaggaacttgcagatgcctgcgacatgaccatcgaagagatggaaagtgccgcagataatatactgagtggcggagcgccacagagcccaaatggcgcactcctgccctttgtgaattgccgtgatgctggtcaggatagagctggcggagaggaggatgcgggttgtgtccgcgcacgtggacgcccatcagaagaggaactgcaggattccagagtgtacgtgtccagcttata

SEQ ID NO: 216611 - DNA, 6440 bp, Artificial Sequence
  Description of Artificial Sequence: Synthetic coding sequence
atggtcaacgagaatactcggatgtacataccggaagaaaaccaccagggctccaactacggtagccccaggccggctcacgctaacatgaatgcgaatgctgctgcgggactcgccccagaacatatccctactccaggggctgcactgtcttggcaggcagccattgacgcagcgcgtcaagcgaaactcatgggtagtgcgggtaatgccactatttccaccgtctcttctacccagaggaagcgtcaacagtatggaaaacctaagaaacagggctcaactacagccacccgtcctccccgagccctgctttgcctgaccttaaagaacccaatccgcagggcctgtatcagcatcgtggaatggaaacctttcgaaatcatcattctgttaaccatattcgcaaactgcgtagccctggctatttacattcccttcccagaggacgacagtaacgccacgaatagcaatctggaaagagtcgagtatctatttcttattatctttaccgtagaagcttttctcaaggtcatcgcgtatgggttactgtttcacccaaatgcttacctgagaaatgggtggaaccttctcgatttcataatcgtcgtcgttggcctcttttcagctattctggaacaggctaccaaagccgatggtgccaatgctttgggcggtaaaggagcagggttcgatgttaaggcactgagggcctttcgtgttctgcgaccattgaggctcgtctccggtgttcccagccttcaagttgtgttgaattccattatcaaagccatggtccccctcctgcacatcgcactgctggtactgtttgtgataataatttatgctataatcggactcgagttgttcatggggaagatgcataagacctgttataatcaggaaggaattgctgacgtgcccgcagaggacgacccttcaccctgcgccctcgagaccggacacggaagacagtgccaaaatggaaccgtttgtaaacccggatgggatggccctaagcatggaatcacaaatttcgataactttgcctttgcaatgctgactgttttccagtgtataaccatggagggatggacagacgtgctgtactgggtgaacgatgcagtggggagagattggccttggatctatttcgtgactctgatcataataggctctttcttcgtcctgaacctagttcttggggtgctcagtggagaattttccaaagaaagggagaaggccaaggctcgcggagattttcaaaagttgcgtgaaaagcagcaactggaagaagacctgaaagggtacctggactggattacccaagcagaggatatcgaccctgagaacgaggacgaaggcatggacgaagagaagccgcgaaatatgtccatgccaacctcagagacggagtctgtgaatactgagaacgtcgcaggcggtgatattgagggggagaattgcggcgctcgtctggcccataggatatcaaagagcaagtttagccgctattggcgccgttggaaccgattctgcagaaggaaatgtagggcagctgtcaaatccaacgtgttctattggctcgtgatttttctggtcttccttaatacgctcaccatcgcgtctgaacattataaccagcccaattggttaaccgaggtgcaggacaccgccaacaaagcactcttggccctgttcactgccgaaatgctgcttaagatgtattcattgggactccaggcctacttcgtgagcctctttaatcgctttgattgttttgtagtgtgcggagggatcttagagactatattagtcgagaccaagataatgtctccacttggcataagcgttctgcggtgcgtacggctgcttagaatattcaagattactcggtattggaatagcttatcgaatcttgtggccagcttattgaactcagtgagatccattgccagccttcttctcctgctgtttctgttcatcatcatctttagtctgctcgggatgcaactgtttggcggaaagttcaactttgatgagatgcagacacgaaggtctaccttcgataacttcccccagtccctgctcacagttttccaaatcttaactggagaggattggaacagcgtgatgtacgatgggatcatggcgtatggcggtccatcctttccaggaatgctggtttgcatttatttcatcatccttttcatatgcgggaattacatattacttaatgtatttttggccatcgctgtggataaccttgccgacgctgagagtctgacctctgcccaaaaggaggaagaggaggaaaaagagagaaaaaagctggctcgtaccgcctctccagagaagaaacaggaactcgttgagaaacccgcagttggagagtctaaggaggaaaaaattgagttaaagagcatcaccgccgatggggagagtccgccagcaacaaaaatcaacatggacgacctgcagccaaacgaaaatgaagacaaaagcccctaccccaatcccgagacaacaggggaggaggatgaggaagagccagaaatgccagttggcccacgcccaagacccctctcagaactgcacctgaaggaaaaggctgtccctatgccagaagcatccgccttttttattttcagtagcaataatcgattcaggctccagtgccacaggattgtcaatgataccatttttaccaacctcattctgtttttcatcctgcttagttccatatctttggccgctgaagatcctgttcaacacacctcatttagaaaccatatcctgggcaacgccgactatgtattcacttccatcttcacgctggagattattcttaagatgacggcctatggcgcttttctccacaaaggcagcttctgtcggaactatttcaacatactggacttgctcgttgtttcagtatcactcatctccttcggaattcaatctagtgctattaacgtggttaagatcctccgcgtgctgagggttttacggcctttacgggcaataaacagggcgaaggggctgaaacatgtcgtgcagtgtgtgtttgtggctatccgcactatcggaaatatcgtgattgtcaccaccttgcttcagtttatgttcgcatgtatcggcgtgcagcttttcaagggtaaactgtacacctgttcagacagcagcaaacagactgaggcggagtgcaagggaaattacatcacctacaaagacggtgaggttgatcatcccatcatccagccacgctcttgggaaaacagcaagtttgatttcgataatgtgctggcagctatgatggcccttttcacggtgagtaccttcgaggggtggcctgagctcctctacagaagcattgacagccatacggaggacaaaggtccaatctataattatagagtggagatttcaattttttttataatttatataattataattgcctttttcatgatgaacatcttcgttgggtttgttatcgtgacgttccaagagcagggcgaacaggagtataagaactgtgaactagacaaaaaccagagacaatgtgtggagtatgctctgaaagctcgtcctctgaggaggtacatccctaagaatcaacaccaatacaaagtgtggtacgtcgtcaatagcacgtatttcgaatatcttatgtttgtcttgatcctgctgaacacgatatgtttagccatgcagcactatgggcagtcgtgtctgtttaaaatcgctatgaatattttaaacatgttgtttacaggtctatttacagtagagatgatcctgaaattaattgcattcaaacctaagcactatttctgtgacgcttggaataccttcgatgccctgatcgtcgtcgggtcaatagtagatatcgcaatcacggaggtgaataatgcggaagaaaacagcaggataagtattaccttcttccggttgtttcgggttatgcggttagtgaaactcctgtctcggggagagggaattagaactctactgtggaccttcattaagagcttccaagcactcccctacgtggcccttctgattgtcatgctgttctttatatacgctgtcatcgggatgcaggttttcgggaagattgctctcaacgatacgacagaaatcaataggaataacaactttcaaacatttccacaggcagtcctgctactgttcagatgtgctacaggtgaggcctggcaggatatcatgctagcatgtatgcccggtaagaagtgcgccccagagtcagagccatctaattccaccgagggcgaaacgccgtgtggttcctcatttgccgtcttctacttcataagtttctacatgctctgtgcgttcttgatcatcaatctgttcgtcgccgtgatcatggacaacttcgattatctgacaagggactggtctatcctaggaccacaccatctggacgagtttaagcgtatctgggcagagtacgatcctgaagctaaaggccgaattaagcatcttgatgtggttaccctgctgcgcaggattcagccacctttggggtttgggaaactctgtccacaccgagtggcctgcaaaaggctggtcagcatgaatatgcctctcaattctgatgggacagtcatgttcaacgccacactgttcgctttagtgcggaccgccctccggatcaagaccgaggagggcccttcccctagcgaggcccatcagggagctgaagacccctttcgtcctgccggtaacctggaacaggccaatgaggagttgcgtgctatcatcaagaagatatggaagaggacatccatgaaactcctggaccaggtggtaccacccgctggcgacgatgaggtaactgtgggtaagttttatgccacttttctcatacaggagtacttccgaaagttcaagaaaagaaaggagcagggtctagtgggtaagccttcacagaggaatgctttgtcacttcaagctggcctgcggacgctgcacgatatcggtcccgagattcggcgtgctatcagcggggacctgactgccgaagaggagctggataaggctatgaaggaggccgtgtccgctgcatcagaagatgacattttcagacgagcgggtggtctcttcggcaaccacgtgtcttactaccagtcggacggcaggagtgcctttccccaaacgttcactactcagcggccacttcatatcaacaaggccggttccagtcagggcgacacagagtctccaagccacgaaaaattagtggacagcaccttcactccctccagttattcatccacaggctcgaatgcaaacatcaacaacgccaataacacagcattgggacggttgccccgaccagcgggatacccttccacggtctcaacagttgaaggtcatggtcctcccctttccccagccattcgtgtgcaggaagtcgcctggaagctgtcctcaaaccggtgccattcgagggagtcgcaggcagcgatggccggtcaggaggagacatcgcaggatgaaacctatgaagtcaaaatgaatcatgatacagaagcttgttctgaacctagtctgctatcgacagagatgctgtcttatcaggacgacgaaaatcgacaacttactttgccagaagaggataagagagacatccgtcagtcccccaaacggggttttctgagaagcgcctccttgggaaggagggcgtcgttccacctggagtgcttgaagaggcaaaaggaccggggaggtgatatctcccagaaaactgtcctgccgctccatctcgtacaccatcaggccctcgccgttgccggactgtctcccctgctccagcgcagccacagtcctgcaagtttccccaggccatttgccaccccacctgctaccccaggaagccgcggatggccaccacagcctgtacctacattgagactggagggcgtggaatcttctgaaaagctgaattcctcattcccatccatccattgtggatcctgggctgagactaccccaggaggagggggttccagtgcggctcgacgagtcagacccgtttcactgatggtacctagtcaggccggagctcccggtaggcaatttcacggatccgcctcttccctagtggaggcggtgcttattagtgaagggctgggccagttcgcacaggatcccaaatttattgaagtgactactcaagaactcgctgatgcgtgcgatatgaccatagaagagatggaatccgccgcagataatatcctgtcaggcggagcaccccagagcccaaatggcgctctgctccctttcgtcaactgtcgcgacgcgggtcaggatcgggctggaggcgaggaagacgccggttgtgtgcgagcgagggggagaccatccgaggaggaactgcaggactcccgggtgtatgtgagttcactgta

SEQ ID NO: 216612 - DNA, 6440 bp, Artificial Sequence
  Description of Artificial Sequence: Synthetic coding sequence
atggtcaatgagaacactcggatgtatattccagaggagaatcaccagggtagcaactatgggagccctaggcctgctcatgccaacatgaacgcaaacgccgcagctggactggcccctgaacacattcctacccctggggctgcacttagctggcaggcagctatagatgcagcgaggcaagccaagttgatgggcagcgctggcaacgcaaccattagcaccgtttctagtacccagcgaaaacgtcaacaatatggcaagcccaagaaacagggctccaccaccgccacacggccacctcgtgcattgctttgccttacattaaaaaatcccattcgaagggcatgcatcagcattgtcgaatggaaacccttcgagatcatcattctgctgaccatattcgccaattgtgtggcactcgccatttacatccctttcccagaagatgatagtaatgcaaccaattccaatctggaacgcgtggaatacctcttcctgattatctttactgtcgaagcatttctgaaggtcatcgcatatggtcttctatttcacccaaatgcctatttacggaacggctggaacctgcttgactttatcatagttgtggtgggccttttctcagccatcttggaacaggcaaccaaggccgatggagccaacgcccttggaggaaagggggctggattcgacgtcaaagcccttcgcgcttttcgggtactgcggcctcttcggctggtgtcgggggttccctcactgcaggtcgtgctgaactccataatcaaggcaatggttccgctgctgcatatcgccctcttggttctgttcgtgattattatatacgccatcatcggattggagctcttcatgggaaagatgcacaagacctgttataaccaagaaggcattgcagatgtgccggctgaagatgacccatcaccgtgcgccctggaaaccggacatggtcgacagtgtcagaatgggacggtctgcaaacctggatgggacggccctaagcacggcatcacaaatttcgataactttgcgtttgccatgctgaccgtttttcaatgcattacaatggaaggatggaccgatgtgctatattgggtgaacgatgcagtgggtcgcgactggccgtggatctattttgtaactttgattattattgggtccttttttgtgctgaacttggtgctgggcgtcctctccggcgaattcagcaaggagagggagaaagccaaagctcgcggagactttcagaaacttcgtgaaaagcagcagttagaggaggatcttaagggatacttggactggattacccaggccgaggatatagatcctgagaatgaagacgagggcatggatgaggagaaaccccgaaatatgtcaatgccaacatcagagaccgaaagcgtcaacactgagaacgtcgccggaggggacatagagggggagaattgtggggctaggctggctcatcggatctcgaagagcaagttttccaggtattggaggcggtggaacaggttctgtcgccgaaaatgccgggctgcagtgaagagcaacgtgttttactggcttgtgatctttctcgttttcctgaatacactgacaattgcctctgagcattataatcagccaaattggctaacagaggtgcaagacacggctaacaaggctctgctggctctgttcactgctgaaatgctgctgaagatgtacagcctgggtttgcaggcctatttcgtgtccctcttcaatagatttgactgcttcgtggtgtgtgggggaattcttgagaccattcttgtagaaactaaaattatgtcacctcttggtatttctgtactccggtgtgtgagactgttaagaatctttaaaattacccgatattggaactctctgagtaacctggtcgccagcctgctgaatagcgtccggagtattgcctctttgttgttactgctctttctgtttatcattatcttcagcctgttgggcatgcaacttttcggaggaaagtttaacttcgacgaaatgcagacccgcagatcaacctttgataacttcccacagtctctccttactgtgtttcagattttgacaggcgaggattggaattccgttatgtatgacgggataatggcttatgggggaccatcgttccctggaatgctggtctgtatttactttatcatcctctttatttgcggaaattacatcctgcttaatgtctttctggccatcgccgttgacaatctcgccgatgccgaaagtcttacgtctgctcagaaggaggaggaagaggagaaggaacggaagaaactggccagaactgctagccctgaaaagaaacaggaattggtggagaaaccagcagtgggagagtcaaaggaggagaagatcgagcttaagtcaattaccgccgacggagaatcccctccggctaccaagataaacatggatgacctccaacctaacgagaacgaagacaaaagcccttatcctaacccagaaaccacaggggaggaggatgaagaggagccagaaatgccggtgggaccccgtcccagaccccttagtgagttgcaccttaaggagaaagcagttccaatgcctgaggcaagcgccttttttattttctctagcaataaccgattccgtctccagtgccatcggatcgtgaatgacacaattttcacgaaccttatcttgtttttcatactgctgagcagcatttccctggccgctgaagaccctgtgcagcataccagttttcgcaaccacatattgttctactttgatattgtgtttaccacgatcttcaccattgagatcgccctgaagatgaccgcatatggtgcttttcttcataagggatccttctgtaggaactattttaacatcttggacttactggtggtatctgtgagtctcattagttttggtatccagagctcggctattaacgtcgttaagatcctgagagtgctccgtgtgctgcgcccattgcgcgctatcaatcgggctaaagggctgaagcacgtggtccaatgtgtgttcgtggccattcgcaccatcggtaacatcgtcatcgtaaccactttgctgcagttcatgtttgcctgtattggagtccaattattcaagggcaagctgtacacttgtagtgattcctccaagcaaaccgaggccgagtgcaaaggcaattacattacatacaaggatggagaggtagatcatcctatcatccagccccgttcctgggagaactccaagtttgatttcgacaacgtgctggcagctatgatggctctctttacagtatccacattcgaagggtggcctgagctgctgtacagatcgatagactcccataccgaggacaagggcccaatttacaactatcgggtggaaatctccattttcttcatcatttacatcataattattgcctttttcatgatgaatatttttgtcgggttcgtaatcgttacatttcaagagcaaggggagcaggaatacaaaaattgtgagttagacaaaaaccagcgccagtgcgtggagtacgcactcaaagccagaccgctccggagatatattccaaaaaaccaacatcaatacaaggtctggtatgtggtgaactccacttactttgaatacttgatgttcgtcctcatccttctgaacacaatttgcctggccatgcagcattatggccagagctgtctgtttaagatcgcaatgaacatcctgaacatgctgttcactggcttattcacagttgaaatgatcctgaagctgattgcattcaaacctaaacactatttttgtgatgcctggaacacatttgacgctcttattgtggtgggctctattgtcgacatcgcaatcaccgaggtcaataacgccgaggagaactctcggatcagcataacattttttaggctgttccgggtcatgaggcttgtgaaactcttgagcaggggtgagggcattcgcacgctgctttggactttcatcaaatcctttcaagcgcttccctacgttgccttactaattgtcatgctattttttatctatgccgttattggcatgcaggtcttcggcaaaatcgctcttaatgatacgaccgaaattaacagaaataataacttccagacattcccgcaagctgtgcttttactgttccggtgtgctaccggggaggcttggcaggatatcatgttagcctgcatgccaggcaagaagtgcgcaccagagtctgagccgagcaacagcaccgaaggagaaaccccctgcggctcttccttcgctgtcttttacttcatcagcttttacatgttgtgcgccttcttaatcatcaacctctttgttgctgtcataatggataacttcgactacctgacaagagattggagtattctaggtcctcaccatttagacgaattcaagcgcatttgggctgaatacgatcccgaggccaaaggccgaattaagcacctggatgttgtcactctgctacgcaggatccaaccaccacttggattcggaaagctgtgcccccaccgagtggcctgcaagcgcttggtttccatgaacatgcccctaaatagtgacggtacagtcatgttcaatgctaccctgtttgctttggtgaggacagcccttcgaattaagaccgaagaagggccatcccctagcgaagcgcaccagggcgctgaggatccctttcgcccagccggaaacttagagcaggcgaacgaggagctgcgcgcaatcataaagaagatctggaagaggacgagcatgaagctcctggaccaagtggtcccaccagcgggtgacgacgaggtaaccgtcgggaaattctacgccacatttctgattcaagagtacttccgcaagtttaagaaaaggaaagagcagggactggtcggcaaaccctcccagagaaacgccctgtccctgcaagcgggactgcgcactttgcacgatatcggaccagaaatccgacgcgcaatctctggggacctgacagctgaagaagagctggataaagcaatgaaggaagctgtttctgccgctagcgaggatgatatttttcggagggcaggcggtttattcggcaaccacgttagttactatcaaagcgacggcagatctgcatttccgcagactttcaccacccagcggccattacatatcaacaaggcagggtcttcacaaggagatacggaatctccaagtcacgagaagctggttgactccactttcactccttcctcctacagctccaccggctcgaatgccaacattaacaatgcaaacaacaccgctctgggcagactaccacggccagcaggctatccctctacggtgagtaccgttgagggccacgggccacccctgagcccagctattagagttcaggaagttgcatggaaactctctagcaaccggtgtcatagtagagaaagccaggctgcaatggctggccaggaagagaccagtcaggatgaaacatacgaggtgaaaatgaatcatgacactgaggcctgctccgaaccttctcttctcagcaccgagatgctgagctaccaggacgatgagaacaggcagttaactctgccggaggaggataagcgcgacataaggcagtctcccaaacgcggtttcctgcgaagcgcttccctcggacgcagagcctctttccacctggagtgcctcaaacggcagaaagacaggggaggagacatttcacagaagaccgtactgccgcttcatctggtacaccaccaggctctcgccgtggccggactgagcccattactgcagagaagtcactctccagccagtttcccaaggccattcgctacacccccagccacgcccggtagtcggggatggccccctcagcctgtgcccacgctcaggttagagggcgtggaatctagtgagaaactgaactcgtcattcccctcaattcactgtggcagctgggccgaaactacacctggcggtggcggttcctcagcagcccgacgcgtaaggcccgtgagcctaatggtgccttctcaggctggggcaccaggaaggcagtttcacggttccgccagttcgctcgtggaagcagtcctcatttctgaagggctcggccagtttgctcaagatccaaagttcatagaggtgaccacacaggagctggcggacgcatgtgacatgactatcgaagagatggagtcggccgctgacaacatccttagcggaggcgctccccaatctcccaacggagcactgctcccctttgtgaattgcagagacgccggtcaagaccgcgctgggggagaagaagatgccggttgtgtaagagcacgaggacgtccgtccgaagaggaacttcaagacagcagagtttacgtaagcagtctgta

SEQ ID NO: 216613 - DNA, 6416 bp, Artificial Sequence
  Description of Artificial Sequence: Synthetic coding sequence
atggtgaatgaaaacacacgaatgtacattcccgaagagaaccaccaaggaagcaattatggatcacctcggcctgcccatgcaaacatgaatgccaatgccgcagccggattagccccagaacacattcctacacccggagccgctctcagttggcaggcagcaatcgacgcagccagacaggctaagctcatgggctctgccggtaacgctactatttccacggtgtctagtacacagagaaagcggcagcagtacgggaaaccaaaaaagcaaggctccaccactgccactcgtccccctcgggctctgctgtgtctgaccttgaagaaccccatccggcgtgcttgtatcagcatcgtggagtggaaaccctttgagattattatactgctcactatttttgctaactgtgttgcccttgcgatctacatcccttttcctgaggatgacagcaacgccacaaactcaaatctcgaacgtgtagagtatttgtttctgatcatattcaccgtagaggctttcctgaaagtaattgcttacgggctgttgttccaccctaacgcatatctgcgtaacggctggaacctgctggactttattatcgtggtcgtcggtctcttctcggccatacttgaacaagccaccaaagctgatggtgctaacgctctggggggtaaaggagcgggatttgatgtcaaagcccttagggcttttagagtgctccggcctctgcgtcttgtgtccggcgtgccatccctacaagtcgtgctcaacagtatcatcaaggccatggttccgttactgcacatagccctgctcgtgctgtttgtaattatcatttatgccatcattggcctcgagttgtttatgggtaaaatgcacaagacgtgctacaatcaggaagggattgcagatgtccctgccgaggacgatccttctccgtgtgctctagaaaccggccacggtaggcagtgccagaatggaacagtatgtaaaccaggatgggacggccctaagcacggcattactaattttgataattttgcgttcgccatgcttactgtttttcagtgcattaccatggaaggctggacagacgtcctctactgggtgaacgatgcagtgggcagggattggccatggatttatttcgtgactctcatcatcattggaagcttctttgtgcttaatctggtgctcggggtcttatcaggagaatttagcaaagagcgcgagaaagctaaggccaggggagattttcagaaactgagggaaaaacagcagctcgaagaggacctaaagggttacctggattggattacccaggctgaagatattgaccccgaaaacgaagacgaaggtatggatgaagagaagcctcgtaacatgtcaatgcctacatcagagactgaatccgtgaacacggagaatgtagccggaggggacattgaaggcgagaattgtggagccagactggcccatcgcataagtaaatcaaaattctcgagatactggcggcgttggaatcgcttctgccgaaggaagtgtcgcgcagctgtaaaatctaatgttttctactggcttgtgattttcttggtttttctgaatactctgaccattgcctccgagcattacaaccagcccaactggctcacagaggtccaggatacggctaacaaggcactgttagccctgttcacagcggagatgctcctgaaaatgtattctttagggcttcaagcctactttgtctcactgtttaatcggttcgattgctttgtggtatgtgggggtatcctcgagacaattctcgtggagaccaaaatcatgagccccctcggaatttccgtcctcaggtgcgtgcgcctgctccggatcttcaaaatcacgcgctattggaattcgctatccaatctggtagcgagcctgttaaactccgtgcgttccatcgcttcactgttgctgctgctgtttttgttcatcataatcttctctctgctggggatgcagctgttcggcggaaagttcaatttcgacgagatgcaaactcgacgctctacgtttgacaattttccacagtcacttctgaccgtgtttcagatcctaaccggggaggactggaactccgtgatgtacgacggcattatggcttatggcggaccatcattccccggtatgctggtgtgcatctacttcataatcttgttcatttgcggaaattatatcctcctgaatgtctttctggccatcgcagtggacaacttggccgatgcggagtccctgacgtccgcacagaaggaagaggaggaagagaaggagaggaagaagcttgccagaaccgccagtcccgaaaagaagcaggagctggttgagaagcccgcagtcggagagagtaaggaggagaaaattgaactcaagagcatcactgcagatggcgagtcgccgccagccactaaaatcaatatggacgacttacagcccaacgagaatgaggataagtcgccgtacccaaatcctgagaccactggcgaggaggatgaagaggagccagaaatgcctgtgggccctcgcccacgacccctgtcagaactgcacctcaaagagaaggcagtgccgatgccagaggcatccgcattttttatctttagctctaataatagattcagattgcagtgtcaccgcatagttaatgacacgatattcactaacctcatattattcttcatcttgttgagctccatctcgctcgccgcagaagatcccgtacagcatacaagctttagaaaccacatcctgttctacttcgacattgtcttcaccactatcttcactattgagatagccctgaaaatgaccgcctatggcgctttcttgcacaaaggctctttctgtaggaattattttaacatattagacctactggtagtgtcagtgagccttataagtttcgggatccagtcatctgccatcaacgtcgtcaagatcctgagagttttacgcgtgttgcgaccccttagggctatcaatcgggctaaaggcttaaagcatgtggtgcagtgcgtatttgtggctatcagaactattggaaacattgtgatcgtgacaacattgttacagtttatgttcgcctgtatcggcgttcagctgttcaagggcaagctgtatacatgcagcgactcgtctaagcagaccgaagctgagtgcaaaggaaactacattacttacaaggatggcgaagttgatcatcctatcatccaaccgaggagttgggagaactccaagttcgattttgataacgtgttggcggctatgatggccctttttaccgtgtcaacctttgaaggctggcccgagctcttgtacaggagcatcgactcgcatacagaggataagggccctatctataattatcgggttgagatatcaatcttctttatcatatacattatcatcatcgcattctttatgatgaacatcttcgtgggatttgtcattgtcacctttcaggagcagggagagcaggaatacaaaaactgcgagctggataagaaccagcgccaatgtgtggagtacgcactgaaggccagacccctgcgcaggtacatcccgaagaatcagcaccaatacaaagtatggtacgttgtcaactctacatactttgaatatctaatgtttgtcttaatactcttgaacactatctgcctggccatgcagcactacggacaatcttgcctcttcaagattgcaatgaacatactgaatatgctatttaccggcctgttcacagtcgagatgatcttaaaactgattgcattcaagcctaagggatatttttccgacccttggaacgttttcgatttcttaattgtgatcggaagcatcattgacgtgatcctctccgaaacaaaccccgctgagcacacacaatgctctccttccatgaacgctgaggagaactcaaggatatctatcaccttttttcgtcttttcagagtcatgaggttagtgaagttactgtcacgcggagaagggatccgcaccctgttatggactttcatcaagtcttttcaagcactgccatacgtggccctcctgatagtgatgctcttcttcatatatgcagtcattggcatgcaggtgtttggaaaaattgccctgaatgatactacagagatcaaccgaaacaataactttcagacattcccccaggcagtcctgctgctgttccggtgtgccacaggagaagcctggcaggatataatgctggcctgcatgcccggaaagaaatgcgcgcctgagagtgagcctagcaactctacagagggagaaacgccatgtggaagcagttttgccgtattttatttcatatccttttatatgctttgtgcttttttgattatcaatttgttcgtcgctgtcataatggataactttgactatctaactcgcgattggagtatcttgggaccacatcatctggatgaattcaagcgcatctgggctgagtatgatccagaagccaaaggtcgcattaaacatctggacgtcgtgaccttgcttaggaggatccagcctcccctcgggttcggcaagctttgtccccacagggtggcatgtaagcggcttgtgtcaatgaacatgcccctcaacagtgatgggaccgtcatgttcaatgcgacattattcgcactggttcgaaccgctctgagaatcaaaacggagggaaacctggagcaagcgaatgaggaactaagggccatcatcaaaaaaatctggaagaggacctctatgaagctgctggatcaggtggtccctcccgcaggcgacgacgaagtgacagtagggaaattctacgccacgttcctcattcaggagtatttcaggaagtttaaaaaacgcaaggagcaggggcttgtgggtaaacccagccagcggaacgcattgtcgcttcaggcaggacttaggacattgcatgacatcggccctgagattaggcgcgcaatttccggagacctcaccgccgaggaagagcttgataaggcaatgaaagaagcggtgtccgctgcatctgaggacgatatttttcgcagagctggcggactttttggaaatcatgtaagttactatcaaagtgatggtaggtctgccttcccccagacgttcacaacccagcggccactgcacattaataaagctggcagttcccagggagacaccgagagtccctctcatgagaaactcgtcgatagtactttcacaccttcctcttactctagcaccgggtctaatgccaatatcaataacgcaaataacaccgctctaggtcgactgcccaggccagcaggatatccttctacggtgtctacagtggagggtcacgggccaccattgagccctgcaatacgagtacaggaggtggcctggaagctgtctagtaataggtgccatagccgggaaagtcaagccgctatggccggacaggaggagacatcacaggatgaaacctatgaggtcaaaatgaaccacgataccgaggcctgcagcgagccaagtctcctgagcacggagatgctctcctaccaagatgacgagaacagacagttgacactgcccgaggaggacaagcgcgatatacggcagagccccaagcgcggattcctgaggtccgcctcattgggtcgcagggcttcattccatttggagtgccttaagagacagaaagatcggggtggcgacatctctcagaagactgttctgcccctgcaccttgtgcaccaccaggccctcgcagtggcaggcctatctccgctgctgcaacggagccattcaccggcaagtttccctcgcccatttgccacacctccagccactccgggaagccgcggatggccaccgcagccggtgcccacccttaggctcgagggcgtagagagttctgagaaactgaacagttcctttccttcaatccattgcggcagctgggccgaaacgacgcctggcggtggagggtcctctgccgctagaagagtgcgccctgtctcattaatggtaccctctcaagctggggcacctgggcgacagtttcatggctccgccagtagtttagtggaggcagtcctcatcagcgaaggcctgggccagtttgcacaggacccaaagttcatcgaggtaaccactcaggaattggcggatgcttgtgacatgacaattgaggagatggagagtgctgctgataacatcctgtccggaggggcaccccagtctcccaacggcgctttgctcccttttgttaattgtagggatgctggtcaggatagagctgggggtgaagaagacgcgggatgcgttagagcacggggacggccaagtgaggaagaattgcaggatagtcgagtatacgtctctagtctata

SEQ ID NO: 216614 - DNA, 6416 bp, Artificial Sequence
  Description of Artificial Sequence: Synthetic coding sequence
atggttaacgagaacacaagaatgtacatcccggaggagaaccaccaaggctccaactatggaagtccgcgaccagctcacgccaatatgaatgcgaacgcggcagctggtctagcccctgaacacatccctacacccggagccgctctgtcctggcaagctgcgatcgatgctgccagacaagcaaaactcatgggttccgccggaaacgccacaataagtaccgtctcctccactcagagaaaaagacaacagtatggcaagcccaagaagcagggctctactaccgccactcgccctccaagggcactgctgtgcctcaccctgaaaaaccccatcaggcgcgcttgcattagcattgttgagtggaaaccattcgagatcataatcctgttgactatttttgcgaactgcgtcgcgctagcgatatatattccttttcccgaggacgactcaaacgccaccaattctaatctggaaagagtagagtacctgttccttattatttttaccgtggaggcattcctcaaggtgatagcatacggtcttctcttccatccaaacgcttacctccgcaatgggtggaacctgctcgactttatcattgtggttgtcggccttttttcagccatactggagcaggccactaaggccgacggcgctaatgcgctgggcggaaagggcgctggattcgacgtgaaggctcttcgtgcctttcgcgttctgcggccactccgccttgtgtctggcgtcccatccctccaagtcgtgctgaacagcatcattaaggctatggtccctctgttacacattgcactgcttgtgctgtttgtcattatcatctatgccattattggcctggagctgtttatgggcaagatgcataaaacctgttataaccaggagggtattgcggacgtacccgctgaggatgatcctagtccttgtgctcttgagacaggccatgggagacagtgccagaacggcacagtgtgcaagccgggttgggacggacccaaacatgggatcacaaattttgacaatttcgcattcgcgatgctcaccgtcttccaatgtatcaccatggagggctggacagacgtgttatactgggtcaacgatgctgtggggagagactggccatggatttatttcgtaaccctgattataataggatccttcttcgtactgaacctggtgctgggcgtactgtctggtgaattttcaaaggagcgtgaaaaggctaaggctagaggcgatttccaaaaactgcgggagaagcaacagctggaggaggatctcaaggggtacctggactggattactcaggccgaggacatagatccagagaacgaggacgaaggaatggatgaggagaaaccccgaaacatgtccatgccgacaagtgaaaccgagtctgttaacacagaaaacgtggctggcggagacatagagggagagaactgtggtgccaggctggctcacaggatctccaaaagcaagtttagccgctactggcgcagatggaatcgattttgtaggcgaaaatgcagagctgccgtaaaaagcaacgttttctactggctcgttatctttcttgtgttcctcaacacgctgacaatcgcctcggagcactacaaccagcccaattggttgacagaggtgcaagacaccgctaataaagccttgttggccctcttcaccgctgagatgcttcttaagatgtatagcctcggccttcaggcctattttgtatcactctttaaccgcttcgactgtttcgtggtgtgtggcggtattctagagacaattttggtggagacaaagattatgtcccctttgggaatcagcgtgctcaggtgcgtacggctcctgcgcattttcaaaatcacccgttattggaacagcctgtctaatttggtggcctcactgttgaatagtgttcggtcaatcgcctctctgctcttgttactgttcctcttcatcatcatatttagtttgttgggcatgcaactgtttggtggaaagtttaacttcgacgaaatgcagactcgcaggagcacctttgataactttcctcagagtttgttgacagtcttccagatcctgactggcgaggattggaattccgtgatgtatgacggcatcatggcctacggagggcctagctttcccggaatgctggtgtgcatttactttattatactcttcatctgcggcaattatattttgctaaatgttttcctggccattgccgtggacaacttagcggacgccgaatctcttacctctgcgcagaaggaggaggaagaagaaaaagagaggaagaaactggccagaaccgcctctccagagaaaaagcaggagctcgtcgaaaagcccgctgttggggagtcaaaggaggaaaagattgaacttaaatctattacagccgatggcgagtctccacccgcaacaaaaattaacatggatgatctgcagcccaacgagaatgaggataagtcaccatatccgaatccagaaaccaccggggaggaggacgaagaagagccagaaatgcctgtgggccctagaccaagaccactgtctgagctccatttaaaggagaaagcagtgcccatgcccgaggcatccgccttcttcatatttagtagcaataatcggtttagactgcaatgccacaggattgtaaatgacaccatcttcaccaacctgatcctgttctttattctgctgtcttccataagtttagcagctgaggatcccgtccagcacacaagcttccgaaaccatatcctaggcaatgctgactacgtgttcacctcaatatttacactggaaatcatcttaaagatgaccgcatacggagcctttctccacaagggaagtttctgtaggaattacttcaacatcttggatcttcttgtggtctcagtgtctttgatttccttcggcattcaatcctcagctattaatgtggtgaagatccttcgcgtcctacgcgtactgagacctttgcgagcaattaaccgcgcaaagggcctcaaacacgtggttcaatgtgtttttgtggccattagaactatcggtaacatcgtcatcgtcactacgctcctgcagttcatgtttgcatgcattggcgtgcaactttttaagggaaaactttacacctgttccgactcttccaagcagactgaggcggaatgtaaaggcaactatatcacttataaggatggagaggtagatcacccgatcattcagccccgatcttgggaaaattctaaatttgacttcgacaatgtgctggccgctatgatggcgctgttcactgtctcaacctttgagggatggcccgaattgctctaccggtccatcgattcccacaccgaggataagggacccatctacaattatcgcgttgagatttccatattcttcatcatttacatcattattatcgcctttttcatgatgaatatcttcgtcgggttcgtaatcgtgacgttccaggaacagggcgaacaggagtataagaactgtgaactggataagaaccagcggcagtgcgtcgagtacgcgctgaaggcacgccctttgcggcgatacatccctaagaatcagcaccaatataaggtctggtatgttgtgaacagcacttacttcgagtatctgatgttcgtccttatcctgctcaataccatttgcctggctatgcagcactatggccagtcatgtctctttaagatagcaatgaatattctgaatatgcttttcaccggcttgttcacagtggaaatgattctgaagttaattgcctttaagcccaagcattacttttgcgatgcgtggaatacttttgatgccctgatagtagtgggatccattgtcgacattgccataaccgaagtaaaccccgcagagcacacccagtgctccccaagtatgaacgctgaggagaatagccgcatcagcatcacctttttcaggctgttcagggtgatgcgcctggtcaaattgctgagccgcggtgaaggcatcaggaccctgctatggacctttatcaaaagcttccaagctcttccatatgtggctctcttgatagtgatgcttttcttcatctacgccgtgataggtatgcaggtctttggtaagatagcactgaatgacactaccgagataaatcgcaataataacttccaaacttttccccaagctgtgctcctcctgtttagatgtgccactggagaagcgtggcaagacataatgctggcttgcatgcctgggaagaagtgtgccccagagagtgagccttctaatagcactgaaggagagaccccgtgcggttcatctttcgccgtgttctacttcatatctttttacatgctgtgtgcttttctgataattaatctgtttgtcgccgtgataatggataacttcgattatctgacaagggactggagcatattgggcccacatcatctggatgagtttaaacgcatctgggcagagtacgatcctgaggctaagggcagaattaaacatctcgatgtcgttactttgctcaggcgaatccagcccccactgggatttgggaagttatgcccccaccgcgtcgcatgcaagcggttggtaagcatgaacatgccattaaacagcgacgggacggttatgttcaatgccacgcttttcgcacttgtgaggactgcactgagaatcaaaacggagggaaacttagagcaagccaatgaggaactcagggcaatcatcaaaaaaatatggaagcgaacttctatgaagcttctcgatcaagttgtgccccctgccggtgacgatgaagtgactgtcggtaagttctatgctacatttctgatccaggagtacttcagaaagttcaaaaaacgcaaggagcagggccttgtgggcaagcctagccaacgcaacgccctctcgctacaagctgggctgagaactctccacgacattggtcctgagattcggagggcgattagcggggaccttacagctgaggaggagttggacaaggcgatgaaagaggctgtaagtgccgcttctgaggatgacatatttagacgagcaggcggattattcgggaatcatgtatcctattatcaaagtgacgggaggagtgccttccctcagacttttaccactcaaagacctctgcacattaataaggccggatcatcccagggtgacacagagtctccatcccatgagaaattggtggacagtactttcactccatccagctatagtagcaccgggtccaatgccaatatcaataacgctaataatacggcgctgggacggctccctagacccgcagggtacccctctaccgtaagcacggtcgagggacacgggccacctctctctccagccatcagagtgcaggaggtggcgtggaaattgagcagcaacaggtgccacagcagagagtcccaggctgctatggccggacaggaagagacctcccaggacgaaacatatgaggtgaaaatgaaccacgatactgaggcatgcagcgagccgagcctcctgagcacagaaatgctatcctaccaggatgacgagaatcgccagctaacacttcctgaggaggacaagcgtgatatcagacagtcccctaaacggggtttcctgcggtccgcatccctgggaaggagagcctcctttcatctcgagtgtctgaagagacaaaaagataggggtggagatattagtcagaaaacggtgctccctttgcatctggtccaccatcaagccctcgcagtcgcaggattgagccctctgctacagcggagccatagcccggcatctttcccaagaccttttgccacccctcccgcaacgcctggatctcgaggttggccaccacaacctgtgcccacacttagattagagggggttgagagttctgagaagctgaattcatctttcccatcaatccattgtggttcctgggctgaaaccacacccggaggcggaggatcctcagccgctcgaagagtgagaccggttagtttgatggtaccctcccaggccggagcccctggcagacaattccacggctccgccagctcacttgtggaggctgtgttgattagtgaggggctggggcagtttgcccaggaccccaagttcattgaggtcaccacccaggagttggctgatgcctgtgacatgactattgaggaaatggagagtgcagcagataacatcctcagcggcggtgcacctcagagccctaatggagctttactgccctttgttaattgtcgcgatgcaggccaagacagagctggcggagaagaggacgcaggttgcgtgagagctaggggacgcccttctgaggaggagctgcaggatagcagagtgtacgtcagttctttgta

SEQ ID NO: 216615 - DNA, 6416 bp, Artificial Sequence
  Description of Artificial Sequence: Synthetic coding sequence
atggtgaatgagaacaccagaatgtacattcctgaggagaaccatcaggggagtaattacgggtctccacggcctgcccacgccaacatgaatgcgaacgcggcagccggattggccccagaacatatccccacccctggcgcagccctatcttggcaggcggcaattgacgcagccaggcaggcaaaactgatgggctcagccggaaacgccaccatctctactgtgtcctccacacagagaaaaagacagcaatacgggaagccgaaaaaacagggatccaccactgccactagacccccaagagctctgctctgtctcaccctaaagaacccaattaggcgggcatgtatttctatagtcgagtggaagccctttgaaatcatcatcttacttacgatcttcgccaattgtgtcgccctggctatctatattccattccccgaggacgatagtaacgcgaccaacagcaaccttgagcgcgtcgaatacctgttcctgattatcttcaccgtcgaggctttcctcaaggtaatcgcgtatggtttgctgttccaccccaatgcttatttgaggaacggctggaacctgctggattttatcattgtggttgttggactattttctgccattcttgaacaggccaccaaggccgatggagcaaatgctttaggcggaaagggggctgggttcgatgtgaaagcactgcgcgcttttcgagtgctccgtccgttaaggctggtctccggggttcctagtcttcaggtggtgctcaactccattattaaagccatggttccactgcttcacattgcacttctcgttctgtttgtgatcatcatatacgctatcatcggactcgagctgtttatgggaaagatgcataaaacatgctataaccaggagggtatcgccgatgtacccgctgaggacgatccttctccttgcgcactggaaactggacacggtcggcagtgtcagaatggaaccgtgtgcaagcctggatgggatggccctaagcacggcataactaactttgacaacttcgccttcgcgatgctgacagtgttccaatgcattaccatggaaggttggacagatgtactgtattggatgcaggacgcaatgggctatgagctgccttgggtttatttcgtgtccctggtgatcttcgggtccttctttgtcctcaacctcgtgctgggtgtcctctctggtgagttctctaaagagcgcgaaaaagcaaaggccagaggggattttcagaagcttcgcgagaagcagcagctcgaagaggacctcaaagggtacctggactggatcacacaggccgaggacatcgacccggagaatgaggatgaaggcatggacgaggagaagccaaggaatatgtccatgccgacatcagagacagaaagcgtgaatactgaaaacgttgccggtggggacattgaaggagaaaattgtggagcgaggttggcccatagaattagtaaatccaagttttctaggtactggcgcaggtggaacagattctgcagaaggaaatgccgggctgcagtaaagagcaacgtattttattggctggtaatcttccttgtatttctgaatactctgaccatcgcaagcgaacattacaaccagccaaactggctgactgaagtacaggacactgcaaataaagccctcttggcactgttcactgctgaaatgctactgaaaatgtatagcttgggtcttcaggcttatttcgtcagtcttttcaatagattcgattgctttgtggtgtgcgggggaattcttgagacaatcttagttgaaacaaagattatgtcccccctgggcatttccgtgctgcgatgcgttcgcctgttgcgaatttttaaaatcactaggtattggaactcactttcaaacttggtggcctcactcctaaattctgtcagaagcatcgcttccctgcttctactgttattcctttttataatcattttctccctcctggggatgcagctgtttgggggtaagttcaacttcgatgagatgcagacacgcaggagtacattcgataactttccgcaatcactcctgacagttttccagatcctcaccggggaagattggaattctgttatgtacgacggtataatggcttatggtggaccttcatttccgggtatgttagtgtgcatctacttcattatccttttcatttgcggtaactacatacttctgaatgtctttttggcgattgcagtcgacaacctggctgacgcagagagtttgaccagcgcacaaaaggaggaagaggaggagaaagaaaggaagaagctcgccagaactgctagccccgaaaagaaacaagaacttgttgaaaagccagccgtgggagagtctaaggaagagaagattgagctgaagtccattaccgccgacggtgaatctccacccgctactaagatcaatatggacgatctgcagccgaacgaaaatgaggacaagtctccctaccctaaccccgaaacaactggcgaggaagatgaggaggagcccgagatgccggtgggtccgcgtccaagacccctttctgaactccatctcaaggaaaaggccgtgcccatgcctgaagctagtgcattcttcatcttcagctcgaataatagatttcgcctccaatgtcaccggatcgtgaacgacactatctttaccaacctgatcctgttttttatcctgctgtccagcatctccctcgcagcggaggatccagttcaacacaccagttttcggaatcacatcctgttttactttgacatagtgttcactaccatattcacaatcgagatagccctgaagatgaccgcatatggtgcgttcttacacaaagggagcttctgtagaaattacttcaatatactggacctgctggtggtctctgtttctctcatatcattcggcatccaaagctccgctattaatgtcgtgaagatcttacgtgttctgagagtcctgcggcctcttagggcgattaatagggcaaaggggctgaaacacgtcgtgcagtgcgtgtttgttgctatccggacgataggcaatatcgttatagtcactaccctcttacagttcatgttcgcgtgtatcggcgtccagctgtttaagggaaagctgtacacatgctccgacagttctaagcagaccgaggccgagtgcaagggcaattacatcacttataaggacggcgaggtcgaccatccaatcattcagccgagatcttgggagaactccaaattcgacttcgataatgtgctggccgcaatgatggctctatttacagtttcaaccttcgaaggctggccagaactgctttaccggagtattgacagtcacaccgaggataagggtcccatttacaattaccgggtggaaatctcaatcttcttcatcatttacattattatcatcgctttttttatgatgaacatatttgtaggtttcgtgatcgttacttttcaggaacagggtgaacaggaatataagaactgtgaattggacaaaaatcaacgacaatgcgtcgagtacgcactcaaggcacgtccgctccgtaggtacattcccaagaaccagcaccaatataaagtctggtacgtcgtgaactccacttattttgaatacttgatgttcgtgctcatcctactgaatactatttgtctggctatgcagcattacggacaaagctgtttgttcaaaattgccatgaacattttgaacatgttgtttacggggcttttcaccgtggaaatgattctcaaacttatcgccttcaagcccaagggctacttttccgacccttggaacgtatttgacttcttgattgtcattggaagcataatagatgtcatattgagcgagactaacccagccgaacacactcagtgtagcccgagtatgaatgctgaggagaattctcggatcagtataaccttttttcgtctctttagggtcatgagacttgttaagctgcttagtaggggggaaggcattcgaaccttgctgtggactttcatcaagtcgtttcaagccctgccctatgttgccctgctgattgtgatgctgttctttatctatgcggtcatcggaatgcaagtctttggcaagatcgccctcaacgatactactgagatcaatagaaataacaatttccagacattcccccaggcagtcctcctactcttccgctgcgcaaccggcgaggcttggcaagatattatgctggcttgcatgcctggcaaaaagtgtgcaccagagtccgaacctagcaactctaccgaaggtgagacaccctgcgggtcttcatttgccgtcttctattttatcagcttctatatgctatgcgcatttttgataatcaatctgttcgtagccgtcatcatggataatttcgattatctaactagagactggtccatcttggggcctcaccatctggatgagttcaaacgcatatgggccgaatacgatccagaggcaaaaggtcgaataaaacacctggacgtagtcactcttctgagaagaattcaaccccctcttggatttggtaaattgtgccctcaccgggtggcctgtaagcggctcgtctccatgaatatgccattaaactcagacggaacagtgatgttcaacgccactcttttcgctctggtaagaaccgcccttagaatcaagaccgaagggaatctggaacaggccaatgaagagctgagagcgatcattaaaaaaatctggaaaaggacatctatgaagctgttagatcaggtggtcccacccgcaggagacgacgaggtgaccgtcggcaaattttacgcgaccttccttatccaggagtattttcgcaaatttaagaagcggaaagaacagggtcttgtggggaaaccatcgcagcggaacgcactttccttgcaagctggactgagaactttgcacgatatcggtccagagatcagacgggctatttcgggcgatctgacggccgaagaagagctggacaaggccatgaaggaagctgtatctgcggcatccgaggatgatatttttcgtagagcgggtggtctgtttggtaaccatgtctcatattatcagtcagacggtcggagcgcgttcccgcaaacgttcacaactcagaggcctttgcatattaataaagctggatccagtcagggtgataccgagtcccctagccatgagaaactggtggattccacttttaccccctcttcgtattcaagcaccggtagtaatgccaatatcaataacgccaacaacacggctctcggcagacttccacgtccagccggatatccgagtactgtgtcaacggtggaaggtcatggtcctccactgtctcctgccatccgggtgcaggaagtagcttggaagctgtcctccaaccgctgccatagccgtgagtcgcaggctgccatggccggacaggaagaaacgagccaggacgagacgtatgaagtaaaaatgaatcacgacaccgaagcatgctctgaaccttctcttctgtcaaccgaaatgttatcctaccaagacgacgagaaccgacagctcacattgcccgaagaggataagagagatattagacagagccccaaaagaggttttctgcggtctgcttccttggggaggcgggctagttttcaccttgagtgccttaaacgacagaaggatagaggtggggatatttcacaaaagacagtgttgcccctgcacctggtgcatcatcaggccctggcggtcgctggcctgtcacctctgctccagagatcccattcccccgcttcattcccacgtcccttcgcgacaccgccagccacccccggatctcggggttggccaccacagcccgtcccgacattgagactggaaggggtagagagctcagagaaattgaactcatctttccccagcatccactgcgggtcttgggccgagactacacctgggggtgggggtagtagtgccgctcgccgagtgcggccagtgtccttgatggtcccgtcccaggcaggcgcaccagggcgacagttccatggatccgccagcagcctcgtggaggccgttctcattagcgagggccttggccaatttgcccaggacccaaaattcattgaggtcaccacccaggaactggcagatgcttgtgatatgaccattgaggagatggagtccgccgcagataacatcctctcaggtggcgctccacagtcccctaacggcgcactcctgccgttcgtcaactgtcgcgatgccggacaagatcgtgccggtggggaggaagatgccggatgtgtgcgcgcacgagggaggcccagcgaggaagagctgcaggatagccgagtctatgtgtcaagtcttta

SEQ ID NO: 216616 - DNA, 6477 bp, Artificial Sequence
  Description of Artificial Sequence: Synthetic coding sequence
atggtgaacgagaacacgcgaatgtatatcccagaggagaaccatcaaggcagtaattacgggagtccaagacctgctcatgctaacatgaacgcaaatgcggcagcgggtctggccccagagcacatccctacgcccggagccgctcttagttggcaagccgctatcgacgccgcacgtcaggcaaagctaatgggctctgccggaaacgccactatatctactgtctcctctactcaaagaaagagacaacagtacgggaagcccaaaaagcaaggaagcactaccgccactagaccaccaagggccctcctgtgtctgaccctcaaaaatccaatcagacgagcctgcatcagcatagttgagtggaaaccattcgaaatcatcatcctgctgaccatctttgcaaattgtgtcgccctcgccatatatattcccttcccagaagatgactctaacgcaactaactcaaatctagagagggtcgaatacctgtttctcatcatttttacagtcgaggcattcctgaaggtgattgcttacggcctcctcttccaccctaatgcctatttgaggaatgggtggaacttgcttgatttcattatcgtggttgtgggactgttcagcgcaatcctggaacaggcgacaaaggctgatggcgcaaacgcgctggggggaaagggcgctgggtttgacgtcaaggccctgcgcgcattccgagtactcaggcctctccgcctggtgagcggggtcccatcactgcaggtggtgctgaactcaatcatcaaggctatggtgccgctgctgcatatcgccttattggtgttatttgtgataataatttatgcgatcatcgggcttgagctgttcatgggaaagatgcacaagacctgctacaaccaagagggcatcgctgacgtccccgcagaggatgatcccagtccgtgcgcccttgagactggacatggcagacagtgccaaaatggaacagtttgcaaacctggatgggacggccctaaacacgggatcaccaattttgataacttcgcttttgccatgttgactgtgttccagtgtatcaccatggagggatggaccgacgtgctttactgggtcaatgacgccgtgggtagagattggccatggatttacttcgtaacgctcattattatcggctctttcttcgtattaaatctggtactgggcgttctgagtggagaattttccaaagagagagagaaagctaaagcacggggtgacttccagaagctccgggaaaagcaacagctggaagaggatctcaaaggatatctagattggatcactcaggcggaagatatcgaccccgaaaacgaggacgagggcatggacgaggagaagccgagaaatatgtcaatgccaacaagtgagactgaaagcgttaataccgaaaacgtggcaggtggggacattgaaggggaaaactgtggagctaggctggcccatcgtattagcaaaagtaaattcagtcggtactggagaagatggaacaggttctgcaggaggaagtgcagggccgctgttaaatccaatgtgttctattggctggtcatattcctggtatttttgaacaccctcactattgcgtccgaacactacaatcagccaaattggctgactgaagtgcaggacacagcaaataaagcactattagccctgtttaccgcagaaatgttactgaagatgtacagcctcggcttacaggcatattttgtgagcctgtttaatcggtttgattgcttcgtggtgtgtggcggaatcctcgagacaattctagtcgaaaccaagatcatgagtccactcggcataagcgtgctgcgttgcgtgagacttttgaggatctttaaaatcacacggtactggaattccctgtctaaccttgtggcctccctgctaaactctgtcaggagcatcgcgagtttattgctcctgctgtttttattcatcatcattttttctcttctaggtatgcagctgtttggtgggaaatttaactttgatgaaatgcagacgagaaggagcacgttcgacaacttcccccagagcctgttgactgtgtttcaaatcctgaccggagaggactggaacagcgtgatgtatgacggtataatggcttacggaggccctagcttcccagggatgcttgtatgcatctatttcatcattcttttcatctgtggtaattacattctactcaatgtcttcttggccatcgctgtggacaatttggccgacgctgaatcacttacatctgctcagaaagaggaagaggaggagaaagagcgaaagaagcttgccaggacagccagccccgagaagaagcaagagctggttgagaaacctgccgtgggtgaatcaaaagaagagaagatagagctgaagagcatcaccgcagatggagaaagtcctcccgcaaccaagataaacatggatgatcttcaaccgaacgagaacgaggacaagtccccctacccaaatccagagaccacaggggaggaggacgaagaagagcccgaaatgccagtgggacccagaccaaggccattgtctgagctacacctgaaagagaaagccgtgcctatgccagaggcatccgcgttctttatcttttctagcaataatagatttcggctgcagtgtcatagaattgttaatgatactatcttcactaacctcatactgttcttcatactgctttctagcattagtctggccgcagaagacccagtacagcacacttctttcagaaatcatatcctgttctacttcgatatcgtttttaccaccatattcacgatcgaaatcgccctgaagattctgggcaacgccgattatgtctttacatcaatattcacccttgagatcattctgaagatgacagcttacggtgcctttctgcacaagggctccttctgccgaaattattttaatattttggacttgcttgtggtctcggtgtcactcatcagcttcggtattcaatcttccgcaattaatgttgtgaaaatcctgagggtgcttagagtcctcagacccctcagagcgattaatcgggctaagggtctgaaacacgtggtgcagtgcgtctttgttgctattagaacgataggaaacatagtgatcgtgacaacgctgttgcagttcatgttcgcctgtataggagtacagcttttcaaaggaaaactgtacacttgttctgacagtagtaaacagaccgaggccgagtgcaaagggaactatattacatacaaagacggagaggtcgatcaccccataatccagcccaggtcgtgggaaaattccaagttcgactttgataatgtgctggcggctatgatggcactctttaccgtttccacctttgaaggatggcccgaactgctgtaccggtctatcgactctcacactgaggacaaaggacctatttacaactatagggtggaaattagtattttctttatcatttacatcattatcatcgcgttctttatgatgaatatctttgtggggttcgtgatcgtgacttttcaggaacagggagagcaagaatataaaaactgcgagctggacaagaatcaaagacagtgcgtggagtacgccctgaaagctcgacccctccgcaggtatatacccaaaaatcaacaccagtataaggtgtggtatgttgtaaacagtacatacttcgagtacttaatgttcgtcctgatcttgctcaacactatttgcctggctatgcagcattatgggcaatcttgcttgttcaagatcgccatgaacatacttaacatgctgtttaccgggctcttcactgtggaaatgatcctcaaactgatcgccttcaaaccaaagcactatttttgtgacgcctggaatacattcgacgccctgatcgtcgtggggtctatcgtggatattgccattactgaagtcaaccccgcagagcatacccagtgctctcccagcatgaacgccgaggaaaattccaggatctcaattacctttttccgcctgttcagagttatgagacttgtcaaactcttaagcagaggcgaaggcattagaactctgctctggacctttatcaaatcattccaagctctcccatatgtcgccctactgatcgtgatgctgtttttcatctacgcagtgatcggcatgcaggtgttcgggaaaatcgctttaaacgatacaaccgaaatcaatcgtaataataactttcagaccttcccccaggcagtgttactcctcttccgctgcgcaactggggaggcttggcaggacatcatgcttgcttgtatgcctgggaagaagtgtgctcctgaatctgagccaagtaactcaaccgagggagaaactccctgtggatcctcttttgccgtgttttactttatctcattctatatgctctgtgcgttcctcatcatcaatctgtttgtggccgtgattatggacaactttgactatctgacaagggattggagcattctcgggcctcaccacttagacgagtttaaacggatctgggccgaatatgatcccgaggcgaagggacggatcaaacatcttgacgttgtgaccctgctgagaagaatccagccacccctaggtttcggaaagttatgcccccacagggtcgcctgcaagaggctggtgtcaatgaacatgccactgaactctgacggcaccgtgatgtttaacgccaccctcttcgctcttgtcaggaccgcccttcggatcaagaccgaaggcaatctagagcaggccaatgaagaactgcgtgcaattattaaaaaaatatggaaaaggacctctatgaagctcctggaccaggtggtgccccctgccggagatgatgaggtcaccgtaggcaagttttatgcaacgtttctgatacaggaatacttccgcaagttcaaaaaaagaaaggagcagggactcgttggcaaaccatcccagcggaatgccctttccttacaggctggactcaggaccctacatgatataggtcctgagatccggagggccatttctggcgacttgaccgctgaagaagagctggataaagcaatgaaggaagccgtgagtgctgctagcgaggatgatatttttcgtcgggctgggggtctttttggaaatcacgtgtcatactatcaaagtgatgggaggtcggcattcccccagacattcacaactcagcggccactgcacattaataaggcaggttcatcccagggcgacacagagagcccttcacatgagaaactggtcgatagtactttcacgccctcatcctacagcagcacagggagcaatgcaaatatcaataatgcaaataatactgctcttgggagacttcctcggccagctggctacccctccaccgtctctacagtggagggtcatggccctcctctgtctccagcgattcgcgtccaggaggtggcctggaagctgtcttccaatcggtgtcactcgagggagagccaggctgcaatggccggtcaggaggaaactagccaggacgagacttacgaagtgaagatgaatcatgatacagaagcttgcagcgagccatctcttctgtccacggagatgctgtcctaccaagacgacgagaatagacaactgacactgccggaagaggataaacgagatatccggcagtctccaaagcgaggtttccttcgttctgccagcctagggcgtcgtgcctcttttcacctagaatgtctcaaacgccagaaggaccgcggaggggatataagccagaaaaccgtcctccccctgcatctagtccaccaccaggctcttgccgtcgctggcctgtcgccgttactgcaaaggtctcactccccagcgtcttttcccaggcccttcgcgacaccccctgctactccaggctcaagaggctggccgcctcagccagtgcctaccttgaggctggagggcgtggaaagtagtgaaaaactcaactctagttttccatctattcactgcggctcttgggctgaaaccacccctggaggtggaggctccagtgctgctagacgagttagacctgtgtcactgatggtcccctcccaagccggagcccctggaaggcagttccatggatctgcaagctccctcgttgaggcagtattaatatctgaggggcttggccagtttgctcaggatccaaagtttattgaggtgacaactcaggagctggccgatgcctgcgacatgactattgaggagatggagagcgccgcagataatatactgtctggaggcgcaccgcagtcgccaaacggggctctgttgccctttgtgaactgccgggatgcaggtcaggatcgggctgggggtgaggaggacgcagggtgtgtgcgcgcacggggaagaccttctgaagaagaactacaagattcccgtgtctacgtgtcgagtctgtac

SEQ ID NO: 216617 - DNA, 6521 bp, Artificial Sequence
  Description of Artificial Sequence: Synthetic coding sequence
atggttaacgaaaacacccggatgtatatccctgaggaaaaccaccaaggttccaactacggtagccctaggcccgcacatgctaatatgaatgccaatgcggcagctggcttggcaccagagcacatacccactccgggagccgcacttagctggcaggcagcaatagatgccgctcgacaagccaagctgatggggtcagccggaaatgccactatttccacagtcagcagtacacagcgaaagcgacagcagtacggtaaacctaaaaagcagggtagtaccactgccacgcgtccgcctcgcgcattgttgtgtctgacactcaagaaccctattaggagagcttgcatcagcattgttgaatggaagccatttgaaattataatcctgctgaccattttcgctaattgtgtcgcactcgccatctatatcccctttcccgaggacgatagtaacgcaaccaacagcaacctggaacgggtggaatacctctttttgataatcttcactgtggaggcgttccttaaggtaatcgcgtacggcctcctgttccaccctaacgcatatctgcgcaatggatggaacctcctggattttattatcgttgtggtgggcctgttctcagcaattctggagcaggccacaaaggccgacggtgctaacgcactgggcggaaagggagcaggttttgatgttaaggctctccgggctttcagggtgctgcggccattgaggctggtttcaggcgtcccaagtctgcaggtagtgctgaactcaatcatcaaggcgatggttccactcctccacatcgcactcctggtgttattcgtgattataatatacgccatcattgggctggaactgtttatgggcaaaatgcacaagacatgctacaatcaagagggtatcgccgatgtgccagccgaagatgatccctctccatgtgccttggaaacaggtcacggcagacagtgccaaaatggcacagtatgtaaacccggttgggatggccctaagcatgggatcacgaattttgacaatttcgccttcgccatgcttactgttttccagtgtatcacgatggagggctggacggatgtcctgtattggatgcaagacgccatgggctacgagctcccatgggtgtattttgtctctctcgttatattcgggtccttctttgttttgaacctggtcctgggagtgctgagtggtgagtttagtaaggagagggagaaggcgaaggccaggggtgatttccagaaattgcgagagaagcaacagctggaagaggaccttaagggctatttagactggatcacacaggcggaggatatcgacccagaaaacgaggacgaaggaatggatgaggagaagcccaggaatatgagcatgcctaccagcgaaactgagagtgtaaacacagaaaacgtagcagggggagacattgaaggcgagaactgtggagcgcgtcttgcccacagaatcagtaaatccaaattttccaggtactggagaaggtggaatagattttgtaggaggaagtgtcgtgctgcagtgaagagtaacgtgttctactggctggtgatctttctggtctttctaaacactttgacgatcgcatccgagcactacaaccagcccaactggcttaccgaagttcaagataccgccaataaggcgttgctggccctatttactgctgagatgctcctgaagatgtattccctgggcctacaggcttattttgtcagtctctttaacaggttcgactgcttcgtcgtctgcgggggaattctggagaccattctggtggagactaaaattatgagtcctctggggataagtgttcttagatgcgtccgcctgttgagaatatttaaaattactcggtactggaactcattgtccaatctcgtcgcaagcctgctgaacagtgtcagatccatcgcatccctccttctgctgcttttcctattcataatcatcttctccctgcttggaatgcaactcttcggaggtaagtttaactttgatgagatgcagacccgaaggtcgacctttgacaatttcccgcagagcttgctgacagtgttccagattcttactggcgaagactggaactctgtgatgtacgatggcatcatggcatacgggggtccaagttttccaggcatgctggtttgcatctactttatcatccttttcatctgtgggaattatatactgctcaacgtgtttctagccatagcagttgacaatctggcagacgctgaatccctgacatccgctcaaaaggaggaagaggaggagaaagaacgtaaaaaactcgccaggacagcatcgccagaaaaaaaacaagaactcgttgagaagcccgctgttggtgaatctaaggaggagaaaatcgagttgaagtcgattacagccgatggcgagtcccccccagccaccaagattaatatggatgacctgcagcctaacgaaaacgaggacaagagcccgtacccaaaccccgaaacaaccggggaggaggatgaagaggagcccgagatgcccgtcgggccacggcctcgccctctttcagaattgcatctaaaggaaaaggccgtccctatgcccgaagcgagtgcgtttttcatcttctctagcaacaatagatttcgtcttcagtgccaccggattgttaacgacacgatctttaccaatctcattctgtttttcatactgcttagctccatctctctggcagcggaggatcctgtccagcatacttcctttcgtaatcatatcctgttttactttgatattgtctttactaccatcttcactatcgagatcgctctgaagatgactgcttacggggctttcctccataaaggatccttctgtcgcaattattttaatattttagaccttctggtggtcagcgtcagcctgatttcatttggcatccagagttccgcgataaacgtggtgaagatactgcgcgtgttgcgcgtacttcgcccactgagagccatcaaccgggcaaaaggcttgaaacacgtagtccagtgtgtgtttgttgctatccgaactatcggaaacatcgtgattgtcactactctgctgcaattcatgttcgcctgcataggggtgcagctgtttaaaggaaagctttatacctgctccgatagctccaagcagactgaggccgaatgcaaaggtaattatattacatataaggacggggaggtcgatcatccaattatccaacccaggtcctgggagaacagcaagtttgacttcgataatgtgctggctgccatgatggcacttttcaccgtgtccacttttgagggctggcctgaactgctttacaggtccattgatagccacacagaggacaaagggccaatatataattatagggtcgagatttcgatttttttcattatctatattatcatcattgcattttttatgatgaacatcttcgtgggcttcgtaatcgtgacgtttcaggagcagggcgagcaagagtataagaactgtgagctggataagaaccaacgccagtgcgtcgagtatgccctgaaagccaggccactgagacgctacatccccaaaaaccaacatcaatacaaggtttggtacgtcgtgaattctacatatttcgaatatctgatgtttgttctgatattactgaataccatttgcctcgctatgcaacactacgggcagagctgcttgttcaaaatcgctatgaatatcctgaacatgctcttcactggcctgtttacagtggagatgattctcaagttgattgcctttaagcccaagggctactttagcgatccctggaatgtgttcgacttcctgatcgtaataggcagtatcatcgacgtgattttaagcgagacgaacccggctgaacatactcagtgcagccccagcatgaacgcagaagagaattccaggatttcaatcacattttttcggttgtttagggtgatgaggttagttaagctcctctcccgaggagaaggcatccgcactttgctctggaccttcataaaaagttttcaggcgcttccctatgtggcgcttctcatcgtcatgctgttctttatctacgcagtcattggaatgcaggtgtttggcaaaatcgcactcaacgacactaccgagatcaacaggaacaacaactttcagactttcccacaggcagtgttattgctgtttcgttgcgctaccggggaagcctggcaggatatcatgcttgcctgcatgcccggaaagaaatgtgcgcctgaatctgaaccgtcaaactctaccgagggggaaactccatgtggctctagttttgctgtattctacttcatttcattttatatgttgtgcgcctttcttatcatcaaccttttcgtagctgtcatcatggataactttgactaccttaccagggattggagtatccttggccctcatcacttagatgagttcaagcgcatctgggcagagtatgatccagaagctaaaggcagaataaaacacctggacgtcgtgacgctccttcggcgtatccaaccacctctgggctttggaaaactttgtcctcaccgggtcgcatgcaaaaggctggtttctatgaatatgcccttaaattcagacggaaccgtaatgttcaacgcgaccctgtttgcactggtgcgtacagccctgcgaattaaaacagaaggtaacttagagcaggccaatgaggaactgcgggcaattatcaagaaaatttggaaaaggaccagtatgaaactgttggaccaagtggtgcctccagccggtgacgacgaggtaaccgtgggtaagttctatgctacgttcctgatccaggagtattttcgcaaatttaagaaaagaaaagaacagggtttggtggggaagccaagccagaggaatgccctctccctgcaagcgggactccggacccttcatgacataggcccagaaatcagaagagccatctctggagacctgacggccgaggaagagttggacaaggccatgaaagaggccgtgtccgctgcgtcggaagatgacatttttagacgcgcagggggactttttgggaaccatgtgtcatactaccagtccgatggccgtagcgctttcccacagactttcactacgcagaggccattgcatatcaacaaagctggaagctcccagggagataccgagtcacccagtcacgagaagcttgtggattctacctttacaccctcgtcatactcttcaacgggcagcaacgcgaatataaacaatgccaataacacagcacttggtcgcttgcccagacctgcaggataccctagcactgtttcaactgtggaggggcatgggcctcctctgtcccccgcaatcagggtgcaggaggtcgcatggaagctcagctctaaccgagaacgtcacgtaccgatgtgcgaggatctcgaactgcgccgtgatagcgggtctgccggtacacaggctcattgcctgctcctccgaaaagccaacccttcacggtgccacagccgggagagccaggctgccatggcgggacaggaggaaacctcacaggatgagacatacgaagttaaaatgaaccatgacactgaggcttgcagtgaaccatcattattatctactgagatgttgtcttaccaagacgacgaaaatcgacagctcaccttgccagaggaggataagcgggatatcaggcagtctcctaagagaggttttctcagaagcgcttcactcgggcgaagggcatcttttcacctggagtgtcttaagcggcagaaagataggggcggagatatctctcagaaaacggtcctgcctctccacctcgttcaccaccaagccttggcagtagcaggcctgtcacctctcttacaaaggtcacactcacctgcatcattccccaggcccttcgcgacacccccagccacccctggatcgagagggtggccacctcagccggtgcccacgctgcgccttgagggagtcgagagcagtgagaagcttaactctagctttccctccatacactgcggttcttgggccgaaactactcccggtggcggtggaagttcagccgctcggagggtgcgacctgttagcctcatggtgcctagccaggcgggagcacccggtcggcagtttcatggcagcgccagctcactggtggaggccgtgctgatcagtgaagggttgggccagttcgcacaggatcctaaatttatcgaggtaacgacccaggagttagctgatgcgtgcgacatgaccatcgaggagatggagagcgccgctgataatatcctttctggtggcgctcctcagtcccctaatggtgctcttctgccctttgttaactgtagagacgcaggtcaagacagggctggcggagaggaggacgcgggttgtgtgcgcgcaagaggtcgacctagtgaggaggaactacaggactctagagtttacgttagcagccttta

SEQ ID NO: 216618 - DNA, 6474 bp, Artificial Sequence
  Description of Artificial Sequence: Synthetic coding sequence
atggtgaacgagaatacccggatgtacattcccgaggagaaccaccagggatctaactacggctcacctcggccagcccacgccaacatgaacgctaacgcagcggctggcctggcgccagagcacatccctacccccggagcggctctgtcatggcaagcagctattgatgctgctagacaggcgaaattgatgggctcagccggaaacgctaccatcagtactgtctcaagcacccagaggaagagacaacaatacggtaaacctaagaagcagggctcgaccacagcgacccgacccccaagagctctcttgtgcctgactctcaagaaccccattcggagggcatgtatctccatcgtggaatggaaaccattcgaaataattatcctgctcaccatatttgctaactgcgtggctctcgccatatacatcccatttccagaggacgactcaaacgcaaccaactcaaacttggagcgagtggagtatctattcctcattatttttacggtcgaggcgtttcttaaggtgattgcctatgggctgttattccaccccaatgcttatttgagaaacggatggaaccttttagactttatcattgtggttgtgggtctcttctcagccatcttggaacaggcgactaaggcagatggcgcaaatgcactgggcggtaagggagccggtttcgacgtgaaggctctgagggccttcagggtgcttcgtccactccgcctggtgtccggtgtcccatccttgcaggtggttcttaatagcatcatcaaagccatggttccactcctacacattgctctacttgttttgttcgttattatcatttacgctataatcggccttgagctctttatgggtaagatgcataagacatgttacaatcaggagggcatcgcggatgtgcccgcagaagacgacccatctccctgcgcactcgaaacgggccacgggagacagtgccagaacggcactgtctgcaaacccggatgggacgggccaaagcacggtatcaccaacttcgataactttgcttttgccatgctgacagtttttcagtgcatcacaatggaaggttggacagatgtgctctactgggtgaacgatgctgtcggtagggattggccctggatttatttcgtgacactcatcataatcgggtctttcttcgtgctgaacctggtattgggggtgttaagcggggagttcagtaaagagagggagaaagcaaaggcgcgaggcgattttcaaaaactgagagaaaaacagcagttagaagaggatctcaaggggtacctggactggatcacccaagccgaagatattgaccctgaaaatgaggacgagggcatggatgaagagaagcccagaaacatgagcatgccgacctctgagactgagagtgtgaatacagaaaacgtggctggaggtgatatcgaaggcgaaaactgcggcgcaaggttggctcaccgcatttcaaagtctaaatttagtaggtattggaggagatggaacaggttctgtagaaggaaatgtcgggcagctgtgaaatctaatgtgttttattggctggtaattttcttggtcttcttaaacaccttgaccatcgcctcggagcattataaccagcccaattggcttacggaagtccaggacaccgccaacaaggccctgctggccctctttaccgccgaaatgctgctgaaaatgtattccctgggtcttcaggcctacttcgtctcccttttcaataggttcgattgtttcgttgtttgtgggggaatcctcgagacaatcctggtggaaacaaagattatgagtccgttgggcatctcagtactgaggtgcgtgagacttctccgcatatttaagataaccaggtactggaacagtctctccaaccttgtggcttcactgctgaactctgtgaggtctattgctagtctgcttctgctgttatttttgttcatcatcatctttagcttactgggcatgcaactcttcggcggaaaattcaatttcgacgagatgcagacccgccgatctacattcgataacttcccccaatcgcttctcacagtgttccaaattttgacaggcgaagactggaatagcgtcatgtatgatggcatcatggcatatgggggaccatcgtttcctgggatgctggtgtgcatttattttataattctgtttatctgtggaaattacatccttctcaatgtgtttctcgccatagctgtggataatctggcggacgcggaatctcttacctccgcacagaaagaggaagaggaggagaaggaacgaaaaaagctcgcacgtactgcgtcacctgaaaaaaagcaggagttggttgaaaaaccagctgtaggcgaatccaaggaggagaagatcgagcttaagagcatcacagccgacggtgaatctccccctgcgactaaaatcaatatggacgatctgcagccaaatgagaacgaggataagagtccatacccaaacccagagaccacaggcgaagaggacgaggaagaaccagagatgcctgtgggaccgaggcctcgtccactatccgaactccacttgaaagaaaaagccgttccaatgccagaagcctccgcattctttatcttttcctctaacaaccgctttcgtctgcaatgccatcgtatagtgaatgacacaatcttcacaaaccttatcctgtttttcatactgctttctagtatatccctggccgcagaggaccctgtacaacacactagctttcgtaatcacattctgttttattttgatatcgtgttcacgacaattttcaccatcgaaatcgcgctcaagatgaccgcatacggggctttcctccacaagggtagcttctgtaggaattatttcaacatactggaccttctcgttgtatccgtgtccctgatctccttcggaatccagtcatccgcgattaatgtggttaagattctgcgggtgctgcgggtcctgaggcctctcagagccatcaatcgtgctaaggggctgaaacacgtcgtgcagtgtgtgtttgtggccattcgtacgattgggaacattgtgatcgttacgaccctgctgcagttcatgttcgcctgcattggtgtgcagttattcaagggtaagctgtacacttgttccgatagtagcaaacaaactgaggctgaatgcaaaggcaattacattacctataaagatggggaggtggatcacccaataattcagccccgaagctgggagaattcaaaattcgatttcgacaatgtgctggcagctatgatggcactgttcacagtgtctacatttgaggggtggcccgagttactgtacaggtcaatcgactcacatacggaggataagggccctatatacaactatagggtcgaaataagcatctttttcatcatatacattattattatcgctttctttatgatgaatatcttcgtaggcttcgtcatagtgacttttcaggagcagggagagcaagaatacaaaaattgcgagctggataaaaaccaaagacagtgcgtggaatatgccctaaaggctcgcccacttaggcgatatattccaaagaatcagcaccagtataaggtgtggtacgtggtgaattccacctatttcgaatatcttatgttcgtgctgatccttctcaatacgatttgtcttgctatgcagcactacgggcaaagctgcttgtttaaaatcgccatgaacattttaaacatgctgtttactggactcttcactgtggaaatgatactgaaattaatcgcctttaaacctaagcattatttctgtgacgcttggaatacgttcgacgctctgatcgttgttggttccatcgttgacattgccattactgaagtgaatccagcagagcacacacagtgctctccctctatgaacgcagaagagaacagccgaatcagcataacattctttcgtctgttccgcgtcatgaggctagtaaagctcctgtcacgcggagaggggatcaggaccctgctatggacattcatcaaaagtttccaggcacttccatatgtggcactccttatcgtaatgcttttcttcatctacgctgtgatcggcatgcaggtcttcggcaagatcgcgctgaatgatacaacagaaataaaccgcaacaacaatttccagacatttccccaagcagttttactgctgtttcgatgcgccaccggagaagcatggcaggacattatgctcgcttgcatgcccggaaagaaatgcgcacccgaatcggagcccagcaatagcactgaaggagagaccccatgcggctcttcctttgctgtgttttatttcataagcttttacatgttgtgcgcttttctgatcataaacctcttcgtcgctgtgataatggataattttgattatctgacgagggactggtccatcctcggccctcaccatttggatgagtttaagcggatatgggctgaatatgacccagaggcaaaaggtcggattaaacatttggacgtggtcaccctgttgagacgcattcagccacctctgggatttggcaaactgtgtccacatcgagttgcttgcaaacggcttgtgtcaatgaatatgcctctcaactccgacggcaccgtcatgttcaatgccacattattcgccttagttcgcaccgcactaaggatcaagacagaggagggtcccagtccctcagaagctcatcagggcgcagaggacccgtttcgccctgccggtaaccttgaacaggctaatgaggaacttagagcgatcattaagaaaatctggaagcgcacgtctatgaagctgctggatcaggtggtgcctcccgcaggcgatgacgaagtaacagtcgggaaattttatgccacattcctcattcaggaatactttcgaaaattcaaaaagcgcaaagaacagggactggtgggcaaaccatctcagagaaacgccctcagccttcaggctggactgcgcacactgcacgatatagggcctgaaatccggagggccatatcaggcgatttgaccgctgaggaggagctcgataaagctatgaaagaggcagtgtccgccgcttcagaggatgatattttcaggcgggcaggcggactcttcggaaaccacgtgtcctactatcaatcagatggacgttccgcgttcccccaaacgtttacaacccagcgcccactccacattaacaaagcaggaagcagccagggggacaccgagtccccctctcatgagaaactggtagacagcacattcactccctcctcttatagtagtactggtagcaatgctaatattaataatgcgaataacaccgcactcggaagactgcctcgcccagccggatacccctccaccgttagcaccgtcgagggtcatggcccaccacttagcccagcgattcgtgtccaggaagtcgcctggaaacttagctctaatagatgtcacagcagggaatcacaagccgctatggctggacaggaagaaacatctcaggacgaaacgtacgaagtcaagatgaaccatgatacagaggcctgtagcgaaccaagcttgcttagcacagagatgttatcctaccaggatgatgaaaatcggcagctcacactgcctgaagaagacaaaagagacatacgccaatcgccgaagcgaggctttctacggtccgcgagtttgggcagaagggccagtttccacctggagtgtctcaagagacagaaggatagaggtggcgatatttctcagaaaacggttctaccactgcatctggtgcaccatcaagctttggcagtcgccggtcttagccctctgctgcagcggagccactctccggcttcctttccaaggcccttcgccactccccctgctactccgggatcccggggttggccgccacagccagtgccaaccctccggttagaaggcgtcgagtcatccgagaagctcaacagcagcttcccgtcaatccattgcggctcctgggctgagactacgcccggtggcggtggctccagtgcagcacgccgtgttagacctgtgtcccttatggtgccctcccaggcgggagccccagggagacagtttcatggaagtgcaagttccttggtggaggctgttcttatctcggaggggctcgggcaatttgcgcaggatcctaagtttattgaagtgacaacacaggagctcgcagatgcatgcgatatgaccatagaagagatggaatccgctgcagacaacattctgagcggcggtgctcctcagagccctaatggagccttgctgcctttcgtgaattgcagggacgccggtcaggatcgggctggtggagaggaggatgccggatgcgtccgggcacgaggaagaccttctgaggaagaactgcaagattcaagagtatacgtttcatctctctac

SEQ ID NO: 216619 - DNA, 6468 bp, Artificial Sequence
  Description of Artificial Sequence: Synthetic coding sequence
atggtgaacgaaaacacacggatgtacatacccgaggagaaccaccagggctctaattatgggtcaccaaggcctgcccacgctaatatgaatgccaacgccgcagcagggctcgcccctgagcatatcccaacacccggagcggcactcagctggcaggccgcaatagatgcagcacggcaggctaagttgatggggtccgcaggcaacgcgacaatctctaccgtcagctcaactcaacgaaaacggcagcagtatggaaagcctaaaaaacaagggagtacaacggctacacgaccccctagggcactgctctgcctgactcttaagaaccctatccgcagggcttgcattagcatcgtcgaatggaagccatttgagataataattctgctcacaattttcgccaattgtgtcgccctggccatctacattccctttcccgaggacgacagcaacgccacgaattccaatctggagcgggtggagtatctgttcctcataatttttacagtcgaggcctttttgaaggtcatcgcctatggactgctcttccatccgaatgcgtacctccgaaacggctggaatctgctcgacttcatcatagtggtggttggcttattttcggcgatcttggaacaggccaccaaggctgacggagcgaatgcactaggcggaaagggagcgggttttgatgtgaaggctctgcgcgctttcagagtgcttcggcctctgaggctcgtttccggtgtaccttccctacaggtggtgctgaatagtataatcaaggcaatggtccctcttctgcacattgccctgctcgtgctgttcgttatcatcatctacgcaattattggactggagctgttcatggggaaaatgcacaagacatgctacaatcaagagggaattgccgatgtgcctgctgaagatgaccccagcccatgcgcactcgaaactgggcacggtcgacaatgtcaaaacggcacagtctgcaaaccgggatgggacggaccaaagcatggaataaccaatttcgataattttgcatttgccatgcttactgtgtttcaatgtattactatggagggatggacagacgtgctgtactgggtgaacgacgccgtgggcagggactggccttggatctactttgtgactttgatcattataggcagtttctttgttctgaatcttgtgttaggcgtgctcagcggtgaattcagcaaggagagggagaaagccaaggccaggggagacttccaaaagctgcgggagaaacagcagttagaagaggacctaaaggggtatctggactggataacccaggcagaggatattgaccctgaaaatgaagacgagggaatggacgaggaaaagcctcggaatatgtccatgccaacctccgagacggagtccgtgaatacggagaatgtcgcgggtggagacatcgagggtgaaaactgtggtgccagattagctcaccggatttcaaaaagcaagttctccaggtactggcgcaggtggaatagattctgtcgtcggaaatgccgcgcagccgttaaaagtaacgtgttttattggctggttattttcctggttttcttaaatactttgacaattgcaagtgagcactataaccagccaaactggcttacggaagtccaggacaccgccaataaagcgctccttgcccttttcactgctgagatgctgctcaaaatgtattccctggggctgcaggcatacttcgtttccctctttaacaggttcgattgcttcgtcgtttgcggcggaattttggagaccatcttggtcgagacaaaaatcatgagtcctctgggaatctcagtgctccgctgtgtgcgtttgctcagaattttcaagattacccgctactggaactcgctgtccaacctcgtggctagcttactgaactctgttcggtctatcgcatcacttttgctcctgctctttctttttataatcattttctctctgctggggatgcaactgtttggaggcaaattcaatttcgacgaaatgcagactagaagaagtactttcgataatttcccccagtctttgctgaccgtcttccagatccttactggcgaggactggaacagcgtgatgtatgacggaatcatggcctatgggggtccatcctttccgggtatgctggtatgcatttactttattattttatttatttgcgggaattatatactccttaacgtgtttcttgctatcgctgttgacaacctcgcggatgccgaaagcctgacatctgcacagaaggaggaggaggaggagaaagaaagaaaaaaactggccagaacagcatcaccagagaaaaagcaagaactggttgagaagccggctgtcggcgagtccaaggaagaaaagatagaactcaaatctataaccgcggacggtgagtccccgccagcaactaaaatcaacatggacgacttgcagcctaacgaaaatgaggataagtccccgtacccgaatccagagaccactggcgaagaggacgaggaggagcctgagatgcccgtgggaccgagaccaagacccctttcggaactccacctgaaagagaaggcagtcccaatgcccgaggcttctgcattcttcatctttagctctaacaatcggtttaggctccagtgtcataggatcgtaaatgacacaatattcactaaccttatcctgtttttcattcttctgtcttccataagcctcgcagcagaggatcccgtgcagcatactagtttccggaaccacatattagggaacgccgactatgtgtttacctctattttcacactcgaaataatactgaagatgacagcctacggcgcttttcttcataagggatccttttgcaggaattacttcaacatactggacctcttagtcgtgtcagtgagcctcatttcattcggtatccagtcatctgctataaatgtggtgaaaattctgagggtgcttagggtgttgcggcctttgagagccatcaaccgcgctaagggtctcaaacacgtagtccagtgcgtcttcgttgccatccgcacaattgggaacatcgtcatcgtcaccactctattacagttcatgttcgcctgtatcggtgtgcagctttttaaagggaaactgtatacttgtagcgacagctccaagcagacagaggcagaatgcaagggcaattatattacctataaggatggcgaggtagaccatccaatcatacagcccagatcctgggaaaactctaagttcgatttcgacaatgtcctcgctgccatgatggcccttttcactgtctctacatttgaaggatggccagaactcctctacagatctatcgatagccataccgaggacaaaggtcctatctacaactaccgagttgagatctctatcttttttattatctacatcatcatcatcgctttttttatgatgaatatctttgtcggtttcgtgatcgtgacctttcaggaacaaggtgaacaggaatataagaactgcgagcttgacaagaatcagcggcaatgcgtggaatatgctttaaaggccagacccttaagacggtacatccctaagaatcagcaccagtacaaggtttggtacgtggtgaactcaacctatttcgagtatcttatgttcgtcctgattcttctgaacaccatttgtctcgccatgcagcactatggacagtcctgtctgttcaaaattgcgatgaacatacttaacatgcttttcactggcctgttcacagttgaaatgatcctgaaactcattgcctttaagcccaagggttacttctcagacccttggaacgtgtttgactttctaatcgtcattggaagtatcatagacgtgatcctgagcgaaaccaatcactacttctgtgatgcatggaatactttcgacgcgcttattgtcgtggggtccatagtggatattgctattacggaagtgaacaacgctgaagagaactctcggatatccatcaccttttttcggctgttcagggtaatgcggctggtcaaattactgtcaagaggggagggcattcgaacactgctgtggactttcattaaatccttccaggcactgccttacgtggcactgttgattgttatgctattttttatttacgcagtgatcgggatgcaggtttttggcaagatcgccttaaacgacacaaccgagataaaccgaaataacaacttccaaacctttccacaggctgtcctgttattgtttcggtgcgctactggcgaggcgtggcaggatatcatgcttgcgtgtatgccgggaaagaagtgtgcccctgaatcagagccttctaactctactgagggagagactccatgcggatcgtccttcgcggtcttctatttcatttcattttacatgctgtgtgcttttctgatcattaatttgttcgtggctgtgatcatggataatttcgattatctcactagggattggtccattctgggccctcaccatctggacgagttcaagcgcatctgggcggaatatgatcctgaggccaaaggacggatcaagcacctggatgtcgtgactctgctgcgcagaattcagccacccctaggcttcggcaaactgtgcccacacagagttgcttgtaagagactcgtgtcaatgaatatgccacttaatagcgacggaaccgtgatgttcaacgccaccttattcgctctggtgagaaccgctctgcggataaaaaccgaaggaaacctcgagcaagctaacgaggaattaagggcgatcattaaaaagatctggaagagaaccagtatgaagttgcttgaccaggtggtacctcccgctggtgacgacgaggttaccgtgggtaaattctatgccacgtttcttatccaggaatactttcggaagtttaagaagagaaaagaacagggcttggtgggtaagccatcccagcgcaatgccctttctctgcaggctgggctgcgcacgctacacgacatcgggcctgagataaggcgagcgatctccggagacctgactgccgaggaggagctcgacaaggcaatgaaggaagcagtatccgccgctagtgaagacgacatcttccgcagggctggcggactgtttggtaatcacgttagctattaccagagcgatggcagaagcgctttcccacagacattcacaactcagcggccattacatataaacaaggccggtagcagtcagggggacactgagtccccgtctcacgaaaagctggtcgatagcactttcaccccctccagttactcctcaacagggtcaaatgccaacatcaacaatgcgaataatacggcccttggtagacttcctcgccctgcaggctacccgtctaccgtcagcacagtagagggtcacggtccgcctctctcccctgctattcgggtgcaggaggttgcatggaaattgtcaagcaacaggtgccactccagagagtctcaggccgctatggccggacaggaagagacttctcaggatgaaacgtatgaagtgaaaatgaatcacgacaccgaagcctgctccgagccgtcactgttatcaacagaaatgttaagctaccaggatgacgaaaaccgccagctaactttgcccgaggaagataagagagacatccgacaatccccgaaaaggggctttctgagatctgctagcctaggcaggcgggcttcatttcatctggaatgcctgaagcgtcagaaggatcggggaggagacatttctcaaaaaacggtgctccccctccatctggtgcatcatcaggccttggccgttgccggacttagcccccttctacagcggagccattcacccgcaagcttccctaggcctttcgcaactccccctgctactcctggcagtcgtgggtggcctcctcagccggtgccaacgctccgactggaaggtgtggagagcagcgagaaactgaacagctcatttcccagcattcattgcggatcctgggctgaaaccactccaggtggtggtggcagctcggccgctcgcagggttcggccagtcagtctcatggtgccttcccaggccggagcgcctgggcgacagtttcacggttccgcgagttcacttgtcgaggcagtgttaatttccgaaggattgggtcagttcgctcaagatccgaaattcattgaagtcaccacccaagaactggccgacgcctgtgatatgaccatcgaggaaatggagtccgccgctgataatatccttagcggtggcgcacctcagtcccctaatggcgcacttcttccctttgttaactgcagggacgctggccaagatagggcgggaggggaagaggatgcaggctgcgtccgcgctagaggcaggccatctgaggaggagcttcaggattcacgggtctatgttagctctctctag

SEQ ID NO: 216620 - DNA, 6629 bp, Artificial Sequence
  Description of Artificial Sequence: Synthetic coding sequence
atggtgaatgaaaatacaagaatgtatatccccgaagagaaccatcaggggtccaactatggatcaccgagaccagcccacgccaatatgaatgctaatgccgcagccggtctagcacctgaacacattcccaccccaggcgcagcattatcttggcaagcggcaattgacgcagccaggcaggcgaagttgatggggagtgcaggcaacgcgaccatctctactgtatctagcacccagaggaagcgccagcagtatggcaaacctaagaaacaaggtagcactaccgccactcgccctccccgagctttactttgtctgacgctaaagaacccgatccgcagggcttgcatctcaattgtggaatggaagccgtttgagattattatcctccttaccattttcgctaactgtgtggcactcgccatctacatccctttcccggaagacgattccaatgctacgaactccaacttagagagggtggagtatctgttcttgatcatcttcacagtcgaagcttttctgaaggtgattgcgtacggcctgcttttccaccccaacgcttacctgcgcaacggatggaatctgctggactttatcatcgttgtcgtcgggttgtttagtgcaattctggagcaggctaccaaagcagatggggctaacgcactggggggaaaaggcgctggcttcgatgtcaaagctctgagagcgttccgtgtgctaagaccactcaggttggtcagcggagtgccgagcctccaggtagtgctgaatagtattataaaggccatggtcccattactgcacatagcattattggttttgtttgtgatcattatctacgccattattggcctggagctgttcatgggcaagatgcacaagacttgttataatcaggaggggatcgccgatgtcccagccgaggatgatccttcaccttgtgccctggagaccggacacggtagacaatgccagaatggaaccgtctgtaaaccaggctgggacggaccaaagcacggtatcaccaactttgacaatttcgcctttgcaatgctgactgtgttccagtgtatcactatggaaggatggaccgatgttctttactggatgcaggacgctatggggtacgagttaccttgggtctactttgtaagcctggtaatctttggttctttcttcgtactgaatttagtgctcggcgtgctgagcggagaatttagcaaagagcgcgagaaggcgaaggccagaggcgactttcagaagctacgcgagaaacaacaattggaggaagaccttaagggatacttggactggatcacacaggccgaagacattgacccggagaacgaggatgaggggatggatgaggaaaaacctcgaaatatgtctatgccgacatccgaaacagaatctgtgaataccgaaaacgtcgctggcggagatatcgagggggaaaattgcggtgctaggttagcacacagaatctcaaagagcaagttttccagatactggagacgatggaatcggttctgtcggagaaagtgtcgagctgccgttaaatccaacgtgttttactggctggtgatctttctggtatttctcaacaccctcactattgcctccgaacactacaatcaacctaactggctgaccgaagtgcaggatacagcaaacaaggccttactggcactatttacagctgagatgctgctgaagatgtattcgctcgggctgcaggcatattttgtgtctctcttcaatcgcttcgactgcttcgtcgtgtgcggagggattttagagacaatcctggtggagaccaagataatgagtcctctgggtatcagcgtcttgagatgtgttcgcttgctgcgtatattcaagatcactcggtactggaattctctttctaacctggtagcgtcattgctgaacagcgtgcgcagcatcgcaagtctcctcctcctgctgttcctgtttattatcatcttttctctcctcggaatgcaattgtttggtggaaaattcaacttcgacgaaatgcagacgagacgctctactttcgataatttcccccagtcacttctgactgtttttcagatcctgaccggtgaggactggaactctgtgatgtacgatggcattatggcgtacggcggaccttctttcccgggtatgctggtgtgcatctacttcatcatcctgtttatctgcggaaattatatcttgttaaacgtttttctcgcgattgctgtcgacaatctcgcggacgctgagtctttaacttcggcccagaaagaagaggaagaagaaaaggagcggaaaaagttagcccgaactgccagccccgaaaaaaaacaggagttagtcgagaaacccgctgtaggagagagcaaggaggagaagatcgaactcaaatcgatcacggccgatggagaaagtccccctgctacaaagattaacatggacgatctgcagcccaatgaaaatgaggataagagtccctatcctaatcctgaaaccactggcgaagaagacgaggaggaaccagaaatgccagtgggccctcgcccaaggcctttgagcgaactgcacctcaaggaaaaagctgtccccatgccagaagcatctgcgttttttatttttagctcgaataacaggtttcgtctccagtgtcaccgcatagtgaacgatacaatttttacaaacctcatcctttttttcatactcctgtccagcattagtctcgccgcagaggacccggtgcagcatacatcttttcggaatcacatcctcttttacttcgacattgtattcactaccattttcaccatcgaaattgcactcaagatgactgcctacggggctttcttacacaagggatccttctgtcggaattacttcaacatcttggacttactggtagttagtgtgagtctgatatcctttgggatccagtcttccgccattaatgtcgttaagatcttgcgtgtgctgcgcgtcttgagacccctgcgggctatcaatcgggctaagggcctgaaacacgtggtgcaatgcgtcttcgtcgctatcaggacgatcggcaacattgtcattgtgactacattgctgcagttcatgttcgcatgtatcggcgtgcagctgtttaagggaaaactctatacatgctcagactccagcaagcagacagaggccgaatgcaaaggcaactatatcacctataaggatggagaagtggaccacccgatcatccagccacgatcctgggagaacagcaaattcgacttcgacaatgtgttagcagcaatgatggccttgttcacagtgtccacgtttgaggggtggccagagcttctgtaccgatcaattgactcacacacagaggacaaaggccctatttacaactaccgcgtggagatttccattttcttcatcatctatatcatcatcatcgcattctttatgatgaacatattcgtaggtttcgtaatcgttacgtttcaggaacagggtgagcaagagtacaagaattgtgaactcgataagaatcaacgccaatgtgtcgagtatgctctgaaagcccgaccgctgaggcgctacatacctaagaaccagcatcagtacaaggtgtggtatgtagtcaactctacctactttgaatatctgatgttcgtgctgatcctgttgaataccatatgtctggcaatgcaacactatggccaaagttgcttattcaagatcgcaatgaatatcttgaacatgctgttcacgggcctgtttactgtggaaatgattctgaaacttatcgcatttaaaccaaaacactatttctgtgatgcctggaataccttcgacgccctcattgtggtaggctcaatagttgatatagctatcactgaggtgaatccggcagaacatacacagtgttccccgtccatgaatgccgaggaaaactctcggatctctataacattttttcgccttttcagggttatgcgtttggtgaaattgcttagtcgtggagaagggatcaggactctgctgtggacgttcatcaagtccttccaggctctgccctatgtggcactgctgatcgtgatgctcttctttatctacgcagttatcggcatgcaagtctttggtaagattgctctcaacgacaccaccgagatcaataggaacaataattttcagacctttccgcaggcagtgttgctcctattcagatgtgctaccggagaagcatggcaagatattatgctggcctgtatgcccggtaagaagtgcgcacctgaatcggaaccaagcaactccactgagggggaaactccctgcggcagtagcttcgcagttttttatttcatcagcttctacatgctttgtgccttcctgatcataaacctcttcgttgccgtcatcatggacaacttcgactatttgacacgggattggtccattctgggccctcatcacttggacgagtttaagcgaatctgggcggagtatgatcccgaggccaagggacgcattaagcacctcgacgtggttactctattgagacggattcagccgccactcgggtttggaaagctctgccctcatcgtgtggcatgcaaacggctggtaagcatgaacatgccactcaattctgacgggaccgttatgttcaatgccaccctcttcgctcttgtgagaacagccctacggattaaaacagaggggaacctggagcaggccaatgaggaactgagggctataatcaaaaagatttggaaacgaacctccatgaagttgcttgatcaagttgtcccacctgccggagacgacgaggttaccgtcggcaaattttacgccacttttctcatccaagagtactttcgtaagttcaaaaaaaggaaggagcagggcctcgtgggcaagcccagccagcggaatgcccttagtctgcaggccggactgcggaccttgcacgatatcgggcctgagattcggagggccatctctggggacctgacagccgaagaagagctggataaggccatgaaggaagccgtgagcgctgcctcggaggatgatatatttagacgcgcaggaggactcttcggtaaccatgtgtcctattatcaatccgacggaagatctgcgttccctcagacgttcaccactcagcggcctttacacattaataaagctgggtcatcacagggggatacagaatctccctctcatgaaaagttggtcgacagtacatttacccctagttcatactccagcactggctcaaatgccaatatcaacaatgccaacaataccgctctaggcagactgcccaggcctgctggctatccttctactgtgtcgaccgtggagggccacgggcctccactgtctccagcaattcgggtgcaggaggtcgcgtggaagctgagctcaaaccgcatgcattgctgcgacatgttggatgggggaacctttccacctgccttagggcctcgcagggctcctccctgtctgcatcagcagctacagggaagtctggccggattgagggaggacaccccctgcatagtaccaggacatgccagtctgtgttgctctagtcgagtgggggagtggctgccggcaggttgcactgcaccacagcatgcgagatgccatagccgggagagccaagctgctatggcaggtcaggaagaaacaagtcaagacgaaacgtacgaggtgaaaatgaatcacgatacagaggcatgttccgagcctagcctgttatctacagaaatgctcagctatcaagatgatgaaaacaggcagctgactctgccggaggaggataaacgggacattaggcagagcccaaagagaggattcctgcgtagcgcttcccttggacggagagccagtttccacctggaatgtctcaagaggcaaaaggatcgtggtggagatattagccaaaagacggtccttccactgcaccttgtgcatcaccaggctttggccgtcgcgggattaagtccactacttcagcgaagtcattcccccgcatccttccctcgccctttcgctactccgccagcaacaccgggaagccggggatggccaccccaacccgtgcccacccttagactggagggagttgagagctctgaaaagctgaactcctcttttccaagcatccactgtgggagttgggcagaaaccacccccggaggagggggatctagcgctgccagacgcgttagaccagttagtctcatggtcccaagccaagcgggagcccctggacggcagtttcacggatctgcaagcagcctcgttgaggctgtgctcatctctgaaggactcgggcagttcgcccaagatcctaaattcattgaggttaccacccaggagctggcggatgcttgtgatatgaccatcgaggagatggaaagcgcagcggataatatcctttcaggtggagcgcctcagtcacccaatggcgctcttctgcctttcgtcaattgtagagacgcaggacaggacagggctggcggtgaagaggacgctggctgcgtgcgcgcacggggacgcccttccgaggaagagttacaagacagtagagtttatgtaagctcacttta

SEQ ID NO: 216621 - DNA, 6474 bp, Artificial Sequence
  Description of Artificial Sequence: Synthetic coding sequence
atggtcaacgagaacaccagaatgtacatccccgaggaaaatcatcaggggtccaattatgggtccccacgtccagcgcatgctaacatgaatgctaatgccgcagcaggcttggctccagaacacattcccaccccaggcgcagcactctcttggcaggcagccatcgatgcagcacgtcaggctaaactaatgggttccgctggaaatgctaccatatctacagtaagctccacccagcggaaacgccagcagtacgggaagcccaaaaagcagggttctaccacagccactagaccccctcgagcgctgctgtgtctgactctgaagaatccgatcagacgggcttgtatctcaatcgtggaatggaaacctttcgagatcatcattcttctcacaatttttgctaattgtgtcgccctcgcgatctacatcccctttcctgaggatgacagcaacgcaacgaattcaaacttagaacgagtggaatatcttttcttgatcatcttcacagttgaggctttcctaaaggtgattgcatacgggctgctgttccaccccaacgcatacctccgaaacggctggaatctactcgacttcattatcgtcgtcgtcggcttgttctctgctattctagagcaggctaccaaggccgatggggctaatgccctgggcggaaaaggagcaggcttcgacgtgaaggcactgagagcgttcagagtcctgaggccacttcggcttgtctcaggagtgccctctctccaggtggtgttgaactccattattaaagccatggtgcccttacttcacatcgccctgttagtgctgtttgtaattattatttacgccataatcgggcttgagctgtttatggggaaaatgcataagacctgctacaaccaggaaggaattgctgacgtgcccgctgaagacgatccgtccccctgcgcattagagaccggtcacggcagacagtgtcagaacggtacggtgtgtaagccaggttgggacgggccaaaacacggcattaccaactttgacaactttgctttcgcaatgttgacagtgttccagtgcataacgatggagggatggaccgacgtgctgtattgggtcaatgatgccgtcggcagagattggccatggatttatttcgttactttgataataattggtagcttctttgtcttaaacctggtcttgggagtattgagtggggaatttagcaaagaaagggaaaaagcaaaggcgagaggggattttcaaaagttgagagaaaagcagcagctggaggaagacctgaagggctatttggattggattacccaggccgaggacatcgatcccgagaacgaggatgagggcatggacgaagagaaacctcgaaacatgtccatgccgacaagcgagaccgaaagtgtcaacactgaaaacgtggcaggcggagatatcgaaggcgagaattgtggcgctagactggcacatcgcatctctaagagtaagttctcccggtattggcgacgctggaatagattttgtaggcgtaaatgccgggctgccgttaagagcaacgtcttctactggctggtgatttttcttgtgttcctcaacacacttacgatcgcttcagagcactacaatcagcccaactggttaaccgaggtacaggacactgctaacaaagctttgctcgcgctattcacagccgaaatgctattaaagatgtacagcctgggcctccaagcctacttcgtgagtctgtttaatcggttcgactgttttgtggtttgcgggggtatattggaaaccatactggtggaaacaaagataatgtcccccctgggaatttctgttttacgctgtgtgcgcctgctcaggattttcaagattaccagatattggaattcactaagcaacctggttgcatccctcctgaactcagtccgaagtattgcaagcctactactccttctgttcctgtttatcatcatctttagtctgctaggcatgcaactgtttggcggaaaattcaattttgacgaaatgcagactcgacggagcacattcgacaactttccccagagtttattgaccgtgtttcagatcctaactggagaagactggaattctgtgatgtacgatgggataatggcatacgggggaccgagctttcctggaatgttggtgtgtatatactttatcatcctgttcatctgcggcaactacatcctcctgaacgtttttcttgcaatcgccgtagacaatcttgccgatgcggaaagccttacctccgctcagaaggaagaggaagaagagaaagaaaggaagaagctggccaggactgccagccccgagaagaaacaagaattagtggaaaagcccgcagtgggtgaatcaaaggaagaaaagattgaattgaagtctataacagccgatggagagagtccccctgccacaaagataaatatggatgacctccagccaaatgagaacgaggacaaaagcccataccccaaccccgagaccactggcgaggaagacgaggaggagcccgagatgcccgtggggccacgcccacgccctctgtctgagctccacctcaaggagaaggccgttcctatgcccgaagcttcagccttttttatattttcaagcaataataggttcagactccaatgccacagaattgtgaatgacacaattttcacaaatctgatcttgttctttatcctgttatctagtatttcattggccgctgaagacccagtacaacatacatctttccgcaatcatatcctgggcaatgctgactacgtgttcacttcgatatttacgctggaaataatcctcaaaatgacagcttatggcgcttttctccacaagggatccttctgcaggaattactttaacatacttgacctccttgtagtctctgtgtccctgatctcattcggcattcagagtagcgccattaacgttgtgaagatattgcgcgtgctgagagtgctgcggcctctcagggcaatcaacagggcaaagggccttaaacacgtggtccagtgcgtgtttgtcgctatccgaactattggaaacatcgtgattgttaccacccttttgcagttcatgttcgcgtgtatcggcgtccagctgttcaagggcaaattgtatacatgtagcgacagcagtaagcagaccgaggcagaatgcaaggggaactacatcacatacaaggacggcgaggttgatcatccgatcattcaaccacggtcctgggagaattcaaaattcgacttcgataacgtgctggctgcaatgatggcactgtttacagtttccacatttgaagggtggcccgaactgctctacaggagtattgactctcatacggaagacaaaggaccgatatataattatcgagtcgaaattagcatatttttcattatatacatcatcattatcgcattcttcatgatgaacattttcgtggggttcgttatagtgacattccaagagcaaggcgagcaagagtacaaaaactgcgagctggacaaaaaccagaggcagtgcgtggagtacgcattaaaggccagacctttgaggcggtatatacctaagaaccagcaccagtacaaggtgtggtatgttgtgaacagcacttatttcgagtatctcatgtttgtcctgatacttctgaacactatttgtctcgcgatgcagcactacggccaaagctgtttgtttaagatcgcaatgaatatcttgaacatgctcttcaccggcctgtttaccgtggaaatgatcctgaaactgatcgccttcaaaccaaaacactatttttgcgatgcctggaataccttcgacgcgttaattgtggtgggttccatagtggacatcgccattaccgaagtgaaccctgcagagcatacccagtgctctcccagcatgaatgcagaggaaaactcaagaatcagcattacctttttcagactgtttagagtgatgcggctggtgaagctactcagccggggagaaggcattagaaccctactctggactttcattaaatctttccaagccttaccatacgtcgccctcctcattgtgatgctattttttatatatgccgttattggcatgcaagtgttcggtaagatagccctgaatgatactactgagatcaatcggaataacaactttcagactttcccgcaggccgtcctgctgctcttccgatgtgccaccggggaggcatggcaggacataatgcttgcctgcatgcccggtaagaagtgcgcaccggaatctgagccgagcaattctacagaaggtgagaccccttgcggctcaagctttgctgttttttacttcatcagcttctatatgttgtgcgcattcctcatcataaacctgttcgtggccgtcataatggataatttcgactatctcacacgtgactggtccatcttgggtccacatcatttagacgagttcaagagaatttgggcggagtatgatcccgaagccaaaggcagaattaaacacctggacgttgtgacactgctgagacgaattcagcctcccctgggcttcgggaagctctgcccccatagagttgcttgcaaaagattagtgtccatgaatatgcccctgaacagcgacggaaccgtgatgtttaatgccaccctgttcgccctggtccggaccgcattaaggatcaagacagaggaagggccatcccctagtgaagcacaccagggcgctgaggacccgttccgccctgccggaaatctggagcaggctaatgaggaactccgagccatcattaagaagatttggaaacgcacgtccatgaagctgctggatcaggtagtgccccctgccggagacgacgaagtcacggtggggaagttctacgccacgttcttgatccaagaatacttcagaaagtttaagaaacgaaaggagcagggtctggtcggcaagcccagtcagcgaaatgccctttcactgcaagctggtttgcgcaccctccacgatataggacccgaaatcaggagggccatctccggcgatctcacggctgaagaggagctggacaaggctatgaaggaggccgtgtccgccgcatctgaggacgatatatttcgcagagctggcggactgtttggaaatcatgtctcatactatcaatctgacggacgcagcgcattcccccagacgttcactacgcagcggccactacacattaataaagcgggatcgtcacagggagatacagaatcgccttcgcatgagaagctcgttgattcgaccttcactcccagctcctatagcagtacagggtccaacgcaaacattaataacgccaacaataccgcacttggcaggctgccgcgaccggctggctacccctccaccgtctctactgtcgaggggcatggcccaccactgagccctgcaattcgcgtacaagaagtagcctggaagctcagcagtaatcggtgccactccagggaatcacaggccgctatggcagggcaggaggaaacctcccaggatgagacttatgaggttaagatgaaccacgacaccgaagcttgttccgagccatcgctcttgagcaccgaaatgctgtcctatcaggacgacgaaaacagacagcttaccctgccagaggaagataagcgcgacatccgacagtcgcctaaacgaggctttctgcgctccgctagcctggggcgacgagcttcattccacctggagtgcctcaaaagacagaaggatcgagggggagatatctcccagaaaacagttctgcccctgcacctggtgcaccatcaggcattagccgtcgcaggtttaagccccctgttacagagatctcactcacctgccagcttcccgcgaccatttgctaccccaccggctacccctgggtctcgcggatggccccctcaaccggttccaactcttaggttggaaggggtcgaaagctccgaaaaactgaattcatcattcccctctattcactgcgggagttgggccgagacaaccccagggggtggtggatccagcgctgccagacgcgtgcgacctgtgtcactcatggttccctcgcaagctggcgcaccgggacggcagtttcacggatcagcaagctcacttgttgaggccgtactgatctcagaggggcttggtcagtttgcccaagatccaaagttcatcgaagtgaccacccaagaactggctgatgcatgcgatatgaccatagaggaaatggagtccgccgcagacaatattctttcaggcggagcaccccagtcccccaacggcgctctgctgcccttcgttaattgccgggatgctggacaggatcgcgctgggggagaggaagatgcaggttgtgtgcgtgccagaggcaggcccagtgaagaagagctgcaggatagccgagtctacgtcagctcactttat

SEQ ID NO: 216622 - DNA, 6500 bp, Artificial Sequence
  Description of Artificial Sequence: Synthetic coding sequence
atggttaacgaaaacacaaggatgtacatcccggaagaaaatcatcagggctcaaactacggctcccccaggccagctcacgcaaacatgaacgccaacgccgctgccggactggcccctgaacacatccccacccccggtgccgcactcagttggcaggcggcaatcgatgctgctcgccaggccaaactgatggggtcagccggaaatgccacaatctcaactgtaagctccacgcagcggaagcgccagcagtacggaaaacctaaaaaacaaggaagcactaccgcaacccggccacctcgcgctctgttgtgtttgactctcaagaatcccattcggcgagcatgcatcagcatcgtagagtggaagcctttcgagattatcatcttgctgacaatcttcgctaattgtgtggctttggctatctatattccctttcctgaggatgactcaaatgcaacaaactctaatctggaacgcgtcgagtacctctttttaatcatcttcactgtcgaggccttccttaaagttatcgcttacggactcctgtttcacccgaatgcatatttgagaaacggatggaatctgctggacttcataatagtggtcgtgggtttgtttagcgcaatactcgagcaggccacaaaagcagacggcgctaacgccttgggcggaaagggagctggcttcgacgtgaaggcccttagggcctttcgtgtcctccgacccttgcgcctggtgtccggggtacctagcctgcaggtggtcctcaattcgatcatcaaagctatggtaccacttctgcatatcgcccttctggtgttgttcgtgattattatctacgccataattggcctcgagctctttatgggcaagatgcacaagacctgttacaatcaggagggaatcgcagatgtgccagcagaggatgacccctctccctgtgctctagagacgggccacggcaggcagtgtcaaaatgggaccgtgtgtaagcccggttgggacggacctaaacacggaattacgaacttcgataattttgcctttgctatgttaacagtgttccagtgcatcactatggagggatggactgacgtgctttactgggtgaacgatgcggtcggaagggactggccctggatctacttcgtgaccttgatcattatcgggtccttttttgtcctcaacttggtgctgggggtgctttccggcgagttctctaaggaaagagagaaagccaaggccagaggagactttcagaagcttagggagaagcagcaactggaggaggacctcaagggttacttagactggataacgcaggccgaggatatcgatcccgaaaacgaggacgaggggatggatgaggaaaaacctcggaatatgagtatgcctacaagcgaaaccgaaagtgtcaataccgagaacgtcgcagggggagatatcgagggggagaactgcggcgctcggctggcccacaggatctctaagagcaaattttcaaggtactggagacggtggaataggttttgccgacgtaaatgccgcgcagcggtgaagtcaaatgtgttttactggttggtgatcttcctggtctttttgaacaccctcacaatcgccagcgagcactacaaccagcctaattggctgacggaagttcaggatacagcgaacaaggcattgcttgctctgttcaccgccgaaatgctcctgaagatgtatagcttaggtctgcaggcttatttcgtgagcctgttcaatcgtttcgactgcttcgtggtgtgcggcggtattttagagaccatcttggttgaaaccaagatcatgtctcctctcggcatctcagtgctgagatgtgtgcgacttcttaggatttttaagattacgcgttattggaattccctctcaaacctggttgcttcactgctcaactctgtgagaagcatcgctagcttgttgttactgctcttcctgtttatcattatcttctccttgctgggaatgcagctcttcggcggtaagttcaattttgacgagatgcagaccagacggagcaccttcgacaacttcccacaaagcctcctgaccgtttttcagatcctgaccggcgaagactggaattccgtgatgtatgacggcattatggcctacggcggaccgagcttccccggaatgcttgtgtgcatctattttattatattattcatctgcgggaactatatccttctgaacgttttcctagctatcgcagtggacaacctggccgacgcagagtcgctgacttcagcccagaaggaagaggaagaggagaaggagcgaaaaaagctagctcggaccgcttcccctgagaagaagcaggaactcgtggaaaagccggctgtgggggaatcaaaggaggaaaagattgaactcaagtcaatcactgccgacggtgaatcccctccagcaacaaaaataaatatggatgacctccaaccaaacgaaaacgaagataaatcaccataccccaatccagaaactaccggtgaagaggacgaagaggaacccgagatgccggtggggccaaggccaaggccgttgtccgagctacacctgaaagaaaaggccgtccccatgcctgaggcgtcagctttctttattttctcaagcaacaatagattcagactgcagtgccatcggattgttaatgacacgattttcactaatctgattctgtttttcatactcttgagcagtataagtcttgcggcagaagatccagtacagcacacctcattcagaaatcatatcctcttttacttcgacatagttttcactacgatcttcaccattgagattgccctcaagatgacagcatatggagcttttctgcacaagggcagtttttgccgtaactattttaatattttggacctgttggtcgtatccgtctcactcatctccttcggtattcagagttcagcaattaatgttgtgaagattctgagggtacttagggtgctgaggcctctaagagctattaacagagccaaagggctgaagcatgtggtgcaatgcgttttcgttgctattaggacaattgggaacatcgtgatcgtaactacactcctgcaattcatgtttgcctgcatcggcgtacagctgttcaaggggaaattatacacctgcagtgactcttccaaacaaacagaggcagagtgcaaaggaaactatattacatacaaagatggggaagttgaccaccccattattcagcccaggtcatgggaaaactctaagttcgactttgataatgtactggccgctatgatggcgctatttacggtttccacatttgaaggatggcctgagttactctacaggtcaattgactcccacaccgaggataagggcccaatctataattaccgggtggaaatttcaatcttttttattatctacattattataatagcgttcttcatgatgaatatttttgtgggatttgttattgttacgtttcaggaacagggggaacaggaatacaaaaattgtgaactggataaaaatcaaaggcagtgtgttgagtatgccctcaaagccagacccctccggaggtacatccccaagaatcagcaccaatataaagtatggtacgtggtgaattcaacatacttcgaatacctgatgttcgttctgatcctcctgaacactatctgcctagcaatgcaacactacggccagagctgcttgtttaagattgcgatgaatatcctcaatatgctgttcaccggcctgttcaccgtcgagatgattttgaaactcatcgcttttaagcctaagggctatttcagtgatccatggaatgtgtttgatttcctgattgtgattggaagcatcatcgatgtcatcttgtccgaaaccaaccactatttctgcgatgcgtggaacacctttgatgcccttattgtcgttggcagcattgtagacatcgcgatcacagaggtgaatcctgccgaacacactcagtgcagcccgagtatgaatgcggaggagaactcccggatcagtattaccttcttccgcctgttccgagtcatgcgcctcgtaaaattattgtctcgcggagagggcattcggacactgctgtggacttttattaagtccttccaagcgctgccctatgtggcgttgctgattgtgatgctctttttcatttacgcggtgattggcatgcaggtgtttgggaaaatcgcactcaatgacacaactgaaattaaccggaataataattttcagacttttccccaggccgtcctgctgctgttcagatgtgctaccggcgaagcgtggcaggacatcatgttagcatgcatgcctgggaagaagtgcgcccctgaaagcgagccttctaactccaccgaaggggagacaccgtgtgggagctcttttgcagtcttctatttcatctctttctacatgctttgtgcctttttgatcattaacctgtttgtggccgtgatcatggacaattttgactatctcactcgggattggagcattttgggccctcaccatctggacgaattcaaaaggatctgggcagaatacgatcccgaggccaaaggcaggatcaaacacttagatgtcgtgacactcttaaggcggatccaacctcccttagggtttgggaaactgtgccctcatagggtcgcttgcaaacggctggtgagcatgaacatgcctcttaactccgacggaaccgtaatgttcaacgccacactttttgcattggtcagaacagccctgcggatcaaaaccgaaggtaacctagagcaggccaatgaagagttgcgcgctattataaaaaaaatctggaaacgaacatctatgaagctgttggaccaggtagtgcccccagcaggagatgacgaggtaacagtgggcaagttttatgccaccttcctcatacaggaatatttccggaaattcaaaaagaggaaggaacaaggactggtggggaagccatcccagcggaacgctttgtcattgcaagctggtctcagaacccttcatgatattggccctgaaattcggagggccatatccggagaccttacagccgaagaagaactggacaaggcaatgaaagaagctgttagcgccgcatctgaggatgacatcttcagaagggccggtggactgttcggcaaccacgtgtcatactatcagagcgatgggaggtctgcctttccccagacctttaccactcagaggcctctgcacattaacaaggccggatcaagtcagggcgacactgaatcgccctcccacgaaaagctggtagactccacttttaccccatcgagctactccagtactggaagtaatgcgaatatcaataatgcgaacaacactgcactgggccgattgcccaggcccgctggctatccgagtaccgtgtcaaccgtggagggccacgggccaccgttatcacccgctattcgggttcaggaagtagcctggaagcttagcagtaatcgctgtcacagtcgcgagtcccaagcagccatggcgggacaggaggagacttcccaggatgagacttatgaggtcaaaatgaatcacgatacggaggcttgcagtgaaccctcactattgtcaaccgagatgctatcgtaccaggacgacgagaatcgacagcttactttgcctgaggaggataagagggatatacgccagagcccaaaaagggggttccttaggtcggcctcgttgggtaggagggcttcttttcacttagagtgcctcaagaggcagaaagatcggggtggtgacatttcccagaaaacggtgctgcccctgcacctggttcaccaccaggcactggccgtggcaggcctatcaccattgcttcaaagatcgcattcacctgctagtttccctagaccgttcgctacccctcccgcaactcctgggagccgtggatggccccctcaaccagtgcccaccttgagactcgagggggttgaaagcagcgagaaactgaactcctccttcccatctattcattgtgggtcatgggctgagactacccctgggggtgggggttcttccgcagctcgaagagtgcgacctgtttcactaatggtgccctctcaggctggagctcccggacgccagtttcatggcagcgctagctccctggttgaagcagtgctgatctccgaaggcttgggacagttcgcacaggatcctaaattcatcgaggtaacgacccaggaactggcagacgcttgcgacatgaccatcgaagagatggaaagcgcggctgataacatcctaagcgggggagctcctcaatctcccaacggcgctttactgccatttgtgaattgccgcgacgctggccaagatcgggcaggcggtgaagaggatgcgggatgcgttcgggcacgtggcagacccagcgaggaagagctgcaggatagcagagtgtacgtgtcttcactcta

SEQ ID NO: 216623 - DNA, 6417 bp, Artificial Sequence
  Description of Artificial Sequence: Synthetic coding sequence
atggtgaacgagaataccaggatgtacattcccgaggagaaccaccaaggtagcaattatgggtccccgaggcccgctcatgccaacatgaatgccaatgctgccgcagggttagcccctgaacacatcccaacacctggagcagccttgtcatggcaagcggctatcgatgccgcacggcaggcaaagttaatggggtctgccggaaatgccaccattagcactgtgtcctccacccaacggaaaaggcaacagtacggcaagcccaaaaaacaggggagtactacagccacccgaccaccaagggcactgctatgtctgaccctgaagaaccctatccgaagagcttgcatcagtattgttgagtggaaacctttcgaaatcatcattctgctgacaatttttgctaactgcgtcgctttagcgatctacatcccgtttccagaggatgactctaatgctacaaattctaatctcgaacgcgtggaatatttgtttctgataatctttacagttgaggctttcctgaaggtgatagcctatggactgctgtttcacccaaatgcctaccttaggaatggttggaatttactggatttcattatcgtggtggtgggccttttcagcgctatcttggaacaggcgactaaagccgacggggcaaacgcgttgggcggtaagggtgccggtttcgacgtgaaggctcttagagccttcagggtgctgcgccctctcagactcgtgtccggagtgccctctttgcaggttgtcctgaatagcattattaaggccatggttccactgcttcacatagctctgctggtgttattcgtgatcataatctacgccatcatcggccttgagctctttatgggaaaaatgcataagacctgttataaccaggaggggatcgccgatgtgccagctgaggacgaccccagcccctgtgccctggagacaggccatggtcgccagtgccagaatggaactgtgtgtaaacccggatgggatggccctaagcacgggatcactaattttgacaatttcgcctttgctatgctgacagtcttccagtgtataaccatggagggctggacagatgtactgtactggatgcaagacgcgatgggctatgagctgccctgggtttacttcgtgagcctagtgatttttggctctttcttcgtgcttaatcttgttcttggagtacttagcggcgaattctctaaggaacgcgaaaaggccaaggccaggggtgattttcagaaactccgcgagaagcagcaactggaggaggatctgaagggctacctggattggattacacaggctgaggatatcgaccccgagaacgaagacgagggcatggatgaggagaagccgagaaacatgtccatgccaacctctgagaccgagagcgttaataccgaaaacgtggcagggggagacatcgagggcgagaactgcggagctcgactggctcaccgtattagcaaaagcaaattctcgagatattggcgacgctggaatagattctgcagaagaaaatgccgagccgctgtgaagtctaacgtgttttattggctcgtgattttcctcgtgtttctcaataccctgacaattgcctcagaacactataaccagccaaattggctcactgaagtgcaggacactgccaacaaggcactactcgccctcttcaccgctgaaatgctgctgaagatgtattcactgggcctgcaggcctattttgtttccctgtttaaccgctttgactgtttcgtggtttgtgggggtatcctcgagactattctggtagaaaccaaaatcatgtcacctctgggaatctccgtgctcaggtgcgtgaggcttctgcgaatcttcaagatcacacgctattggaatagcttatccaatctggttgcctcccttctgaattccgttcggagcattgcaagtctgttattgctcctgtttctgttcatcataatcttcagtctgctggggatgcagttattcggagggaagtttaatttcgacgagatgcaaactcgcaggtcaacattcgacaacttcccccagtcgctacttaccgtttttcagatactcactggtgaggattggaattctgtgatgtatgacggaattatggcctacggcggaccttcctttcccggaatgctggtttgcatctatttcatcattctgttcatttgcgggaattatattctgttgaacgtgtttctcgctatcgccgtcgacaacttggctgacgctgaatctctgacctccgcccaaaaggaggaagaggaagaaaaagagaggaagaaactggcacgcacagcatctcccgaaaagaagcaggaacttgtggagaaaccagctgtgggcgagtcaaaggaggaaaagattgagctaaagtctataaccgctgatggcgagtcgccaccggcaacgaaaatcaatatggacgacctgcagccaaacgagaacgaggacaaatctccataccctaacccagagaccactggcgaagaagacgaagaagagcccgagatgcctgtgggacctaggcctagaccgctgtcagagctccatctaaaagagaaggccgtgccaatgcccgaagcctccgctttttttatatttagttcaaacaaccgattccggcttcaatgtcacagaattgtgaatgacacaatctttactaatctgatcctcttttttatcctcctgtcttccatttccttggccgctgaggatcccgtgcagcacacatctttcagaaatcacattctggggaatgccgattatgtgttcaccagtattttcacattggaaataatcttgaagatgactgcctacggagcatttctgcacaaaggaagcttctgtcgaaactacttcaacattctcgacctgctggtggtgagtgtgagtttgatcagtttcggcattcagagtagtgccatcaacgtcgttaagatcttacgcgtccttagggtcctgagacctctgagggccattaaccgggctaaaggcttgaaacacgtggtccaatgcgtgtttgtagcaattagaacaatcgggaatatcgtcattgttactaccttactacagtttatgttcgcttgtatcggtgtgcagttgttcaagggcaagttgtatacttgctcagacagcagtaagcagaccgaggcagagtgtaagggcaactatatcacttacaaggacggtgaggtggatcatcccatcatacaacctagaagttgggagaattccaaattcgatttcgataatgttcttgccgctatgatggctctctttactgtgagcaccttcgaggggtggccagagctgctctaccgatccatagactcccatacagaggataagggcccaatttataactatagggtcgagatttctattttcttcatcatttatattattatcattgcctttttcatgatgaacatctttgtgggtttcgtgattgtgacgtttcaggaacagggggaacaggagtacaagaattgtgaacttgacaagaaccagcgtcaatgcgttgagtacgccctcaaggctcgccctctcagacgctatatccctaagaatcagcaccagtataaggtatggtacgtggtcaatagcacctatttcgagtatttgatgtttgtgctgattctgttaaacaccatctgcttggccatgcaacactatggacagagctgcctgtttaagattgcgatgaacatcctgaatatgctgttcaccgggctctttactgtggagatgatactgaagctcatcgcgttcaagccaaaacattacttctgcgatgcttggaatacctttgacgcattgatcgtggtgggctccattgtggatatcgctattacagaggtgaacccagctgagcacacacaatgttctccgtctatgaacgccgaagagaactccagaattagtattacatttttcagactgtttagagttatgaggctcgtgaagttactttcacggggagaggggattaggactctgctgtggacttttattaagtcatttcaagcccttccctacgtagcccttctgatagtgatgcttttctttatctacgcagtgattggtatgcaggtgtttgggaagattgccctgaacgacacgacggaaattaacaggaataacaatttccagactttcccccaagcggttctgttgctcttcagatgcgctacgggggaagcctggcaggacatcatgctcgcatgcatgcccggaaagaaatgtgctcctgagagcgagccatctaattctactgaaggtgagaccccttgcggatctagctttgccgtcttctattttataagcttttacatgttgtgcgctttcttgattatcaacctctttgtggctgtgatcatggacaactttgattacctgactcgagattggtcaatcctgggcccacaccatctggatgaattcaagagaatttgggcagaatatgatccggaagccaagggaagaataaaacatctcgacgtggttactctgctgcggagaatccaaccacctctgggtttcggcaagctgtgcccacatcgggtggcctgtaaaaggttagtttctatgaatatgccactcaatagcgacggaactgtcatgttcaacgccaccctttttgcactggtgagaaccgctttacgtataaagactgaaggaaacttggaacaggccaacgaggaattacgggcaatcatcaagaagatctggaagcgtacaagtatgaaattgctcgaccaggttgtcccccctgcaggggatgacgaggtgacagtcggcaagttctatgccacctttctgatccaggagtattttcggaagtttaagaaacggaaggagcagggattggttggtaaaccctctcagagaaacgctctctcacttcaggccggactccgtacactgcacgatattgggccagaaatccgaagagccatttccggcgatctgaccgcagaggaagagttagataaagctatgaaagaggctgtttcagctgccagtgaggatgacatctttaggcgggctggcggtctattcggtaaccatgtgtcgtactatcagtccgatggcaggtctgcttttccccagacattcaccacacagagaccactacacataaacaaagcgggtagttcccagggggacactgaatcaccgtcccatgaaaagcttgtggacagcaccttcactccatctagttactcgtccacaggcagtaatgcaaatatcaataatgcaaacaacactgcccttggtcgtctaccgaggcccgctgggtacccctccacagtctctactgtagagggacacgggcctcctctgtccccggcaattcgtgttcaggaagtcgcctggaaactttcttccaaccgatgccactcacgcgagagccaggcagctatggccggtcaagaggaaacatctcaggacgagacatacgaggtcaagatgaaccatgataccgaagcatgctccgaaccctctcttctgagcacggagatgctgtcctaccaggatgatgagaacaggcaactaaccctccctgaggaagacaagcgggacatcagacagagccccaagcgtggatttctgagatctgcctctcttggcaggcgggcatcctttcatctggaatgtcttaagaggcagaaggataggggcggagacatcagccaaaaaactgttctaccccttcacctcgtccatcatcaggccctcgcagtggctggcctgtcccctctattgcagaggtcacatagccccgcttctttcccacgaccatttgccacccccccagccacgcctgggtcacggggttggccaccacagccagtcccgactctacgactagaaggtgtcgaatcaagtgagaagttgaacagtagtttccccagcatccattgcggttcatgggctgaaactacccctggcggaggcggatcgtcggctgccagacgagtgcgaccagtgtcactgatggtgccatcacaggctggcgctcctggtaggcagttccacgggtccgctagttccttggtcgaagcagtgctgatttctgaagggctggggcagttcgcccaggatccaaaattcattgaagtgaccactcaagagctcgccgacgcgtgcgacatgaccatcgaggaaatggagtctgcggctgataacatcctgagcggtggagctccacaaagccctaatggggcactgctccccttcgttaactgcagggatgccggacaggacagggcaggaggcgaggaggacgcgggttgtgtgagagccagaggcaggccttccgaagaagaactccaggacagccgcgtgtatgtgtcttcattgtag

SEQ ID NO: 216624 - DNA, 6417 bp, Artificial Sequence
  Description of Artificial Sequence: Synthetic coding sequence
atggtcaatgagaacacgcgtatgtatatacccgaggaaaatcatcaggggtctaactatgggtcaccaaggccagcgcacgctaatatgaatgccaatgcagccgcaggattggccccagaacatataccgaccccaggcgctgcactgtcctggcaagcagcaattgatgcggctagacaagccaaactcatggggtcggcaggtaatgccacaatttcgaccgtcagtagtacccagaggaagcgccaacagtacggtaaacctaaaaagcaggggagtactaccgctacccgccctccccgtgccctgctgtgtctgaccctcaaaaaccctattaggagggcctgtatctccatagtcgaatggaagccattcgagatcatcatactcctgaccatcttcgccaactgtgtcgcactcgctatatatattccttttccggaggatgacagtaacgcaacaaattcaaacctcgagcgtgtggagtaccttttcctgataatatttacagtggaggcttttttgaaggtgatcgcctatggactcttgttccacccgaatgcctacctgagaaatggctggaacttgctggactttatcatcgtggtagttggactgttctccgccatattagaacaggccactaaagccgatggcgctaacgccctgggcggaaagggagctgggtttgatgtgaaggccctgagggcttttagagtcctaagaccccttcgcttggtgtccggggtcccatcgctgcaagtggtgctgaactcaatcatcaaagctatggttccactgttacatattgcccttctggtgctctttgttattataatttatgctattatcggcttggaactttttatgggtaagatgcataaaacttgctacaatcaggaggggatcgctgacgttccagcagaagacgatcccagcccatgtgccctggagaccggtcatggaaggcaatgccaaaatggaaccgtatgtaagcccggatgggacggcccaaaacacggtatcacaaatttcgacaacttcgccttcgcaatgctgaccgtgtttcagtgcatcaccatggaaggttggaccgacgtgctgtactgggtcaatgacgccgtgggtcgggactggccttggatctacttcgtgactctgataatcatcggaagcttttttgtgctcaacctggtgctaggagtgttgtccggagagttctcaaaagagcgcgaaaaggctaaagccaggggcgatttccagaagctacgcgagaagcagcaactcgaggaagatctgaaggggtatttggactggataacccaggccgaagacattgacccggagaacgaggacgaggggatggacgaagagaaaccccgtaatatgtctatgccaactagcgaaaccgaatctgtcaacacagagaatgtggccggtggtgacattgaaggagagaattgcggcgcaagactggcccatcgcatctccaaatcaaagttctctcggtactggcgtcggtggaaccgtttctgtcgcaggaaatgtagagccgctgtgaagtcaaatgtgttttattggctggttatcttcctcgtctttctgaacactctgacaatagctagcgagcattacaaccaacctaactggctgactgaagtgcaggatactgccaacaaggctttactcgccctcttcacggcagagatgctgctaaaaatgtactcccttggcctgcaggcctatttcgtgtcgcttttcaatagatttgattgctttgtggtctgtgggggaattctggaaaccatcttggtggagactaaaataatgtcccctctgggcatatcagttctgagatgtgtacgcctgcttcgcatcttcaagatcacccggtattggaattcattaagcaatttggtggctagtttgctgaattcagtgcgatctattgcatcccttttgctgctgctgtttctattcattatcattttcagcttattaggtatgcagttgttcggtgggaagtttaacttcgatgagatgcagactagacggagtacctttgataacttcccgcaatcactcctgaccgtgttccagatcttgactggcgaggactggaattccgtcatgtacgatggcattatggcttatggcggaccgtctttcccgggtatgctggtgtgtatttattttatcatcctctttatctgtggaaattacatactcttgaatgtgtttctagcaatcgctgttgataatctggctgacgcagagtccctcactagtgcccaaaaggaggaggaagaagagaaggaacgcaagaagctcgcgcgtactgcctcccctgagaaaaaacaggaattagtggagaaacctgctgtgggagagtcaaaagaagagaaaattgaactaaagtctatcaccgctgacggagaaagtccaccggcaaccaagataaatatggatgatctccagcctaatgagaatgaggacaaatccccatatccgaaccccgagacaactggggaggaggacgaagaagaacctgagatgcccgtcgggcctagaccacggcctctcagtgagctgcacctgaaagagaaagccgtgccaatgccagaggcgagcgctttctttattttctctagcaataatcgatttcgtctgcagtgccataggattgtcaacgacaccatttttacaaatctgatcctgttcttcattctcctgtcatcgattagtctcgcagcagaggatccggtgcagcacacctccttccgcaaccacatcttaggcaacgctgattatgtgtttacatctatctttactctggagattatcttgaaaatgaccgcctacggagcgttcctacataaaggaagtttttgtcggaactactttaacattttggacctgttagtggtatctgtgtcgctgatctcttttggcattcagagttccgccattaacgtagtgaagatcctgagagtccttagagtcttgcgccctctgagagccatcaacagagctaagggtttaaaacatgtagtgcagtgcgtttttgtcgcgatcagaacgattggcaatattgtcattgtaacaaccttactgcagtttatgtttgcctgtatcggtgtgcagcttttcaagggaaagttgtatacctgtagcgatagttccaagcaaacagaggctgagtgtaagggcaattacattacatacaaagatggcgaggtggatcaccccatcatccagcctcgctcatgggaaaattcgaagtttgacttcgacaatgtgctcgccgcaatgatggcactgtttacagtgtccacctttgaggggtggcctgagctgctttatcgcagcatagactctcacaccgaggataaaggccctatctacaactaccgagtggagatctctatcttctttataatttatatcattatcatagcgtttttcatgatgaatatctttgtgggtttcgtgatagtgacttttcaggaacaaggagaacaggaatacaagaactgcgagctcgataaaaatcagcggcaatgcgtcgagtatgcgctgaaagctagaccactgagacggtacataccgaagaaccagcaccagtacaaggtgtggtacgtggtaaactctacttatttcgaataccttatgttcgtgctaattctgcttaatacaatctgtctcgctatgcagcattatgggcagtcatgcctattcaagatcgcaatgaatattctgaatatgctcttcactgggcttttcactgtggagatgattttgaagctaatcgcctttaaaccgaaaggttacttttctgatccatggaatgtgttcgattttctcatcgtgatcggctccataattgacgttattctgagcgagacgaatcctgccgagcacacccagtgtagtccgagtatgaacgcggaagagaactctcggatctctatcacgttttttcgtctgttcagggtcatgcgcctggtgaaactgctgagtagaggagagggcatccgcaccctgctctggacctttataaaaagttttcaagctctcccctatgtagctctactgattgttatgctgttcttcatctacgcagtgattgggatgcaggtcttcggcaaaattgcactgaatgacacaaccgagataaacagaaataacaacttccaaactttcccacaagccgtcctcctcctctttagatgcgcaaccggtgaagcatggcaagatattatgctggcatgcatgcccggaaagaagtgcgcacctgagtcagagccttctaactccacggagggcgaaacgccctgtggctcttcttttgccgtgttttattttatttccttttacatgctgtgcgctttcctgatcatcaacctctttgtagcggttattatggacaatttcgactacctgacacgggactggtctatacttgggcctcaccacttggacgagttcaaaagaatatgggccgagtatgacccagaagccaaggggagaatcaagcatttagatgttgtcaccctgctgaggcgaattcagccgccactgggatttggtaagctgtgtccacaccgggttgcttgcaaaagacttgtgagcatgaacatgccactcaactccgacggaactgtgatgttcaacgccactctgttcgccctggttcgaaccgcactgcggataaaaaccgaaggcaacctggaacaagcaaacgaagagcttcgagccatcattaagaagatatggaaacgcacctccatgaaacttttggatcaggtagttccaccagccggtgacgacgaagttacagttggtaagttttacgcaacattccttatccaggagtactttagaaagttcaagaaaagaaaggaacaaggcctagttgggaaacctagccagagaaatgccctgagcctgcaagcaggacttcgtacgttgcacgacattgggcctgaaatccgccgagccatctccggcgacctgactgccgaggaagagcttgacaaagctatgaaagaggctgttagcgcagcttcagaagacgacattttcaggagagccggtgggctgtttgggaaccacgtgtcctactaccagagtgacggcagatcagcatttccccagacgttcaccacacagaggccgctgcacataaacaaagccggaagcagccagggggacactgaatctccctcccacgagaagctggtggactcaacgttcactcccagctcctattcctccaccggatctaatgctaacatcaataacgccaacaacaccgcccttggcagactgccccgtcccgctggatacccttcaacagtatctaccgtggaaggacacgggccacctctaagcccagccatcagagtgcaggaggtggcctggaagctcagctccaacaggtgccatagccgagaatcacaggcagctatggcaggccaggaagagacttcacaggacgaaacctacgaagtgaagatgaatcacgatacagaagcctgtagtgagccttctcttctgtccactgaaatgctgagttatcaagacgatgagaaccgccaattgactctccctgaggaggataaaagggatatccggcagtcacccaagcggggattcctgcgctctgcttcgctagggcgacgcgcatctttccaccttgagtgtttgaaaaggcagaaagacagaggcggagatatctctcagaagaccgtcttacccctacacctcgttcatcaccaggcactagcagtggcagggctctcgcccctgctgcagcggagccatagtccagctagtttcccccgtccatttgccaccccccctgctacccctggaagtcgcggttggccccctcaacccgtgcctaccctgagattagaaggcgtcgaatccagtgaaaagttgaattccagctttcctagcattcactgcggctcctgggcagaaactaccccagggggtggcggttccagtgcagcccgtcgcgtccgccctgtgagtctgatggtcccctcgcaggcaggcgctccagggcgtcagtttcacggaagcgcctcctcacttgtggaagcagtgctgatcagcgaagggctggggcagttcgcacaggatcctaagttcattgaagtgacgacacaagagctcgcggatgcttgtgatatgacaatagaggagatggagtcggccgctgataacatcttatctggcggagctcctcagtccccaaacggcgctcttctgcctttcgtgaactgtagagatgctggccaagaccgggcagggggagaagaggacgccggatgcgtcagagcacgaggaagaccttctgaagaggagctgcaagacagccgtgtgtatgtctcctccctgtag

SEQ ID NO: 216625 - DNA, 6434 bp, Artificial Sequence
  Description of Artificial Sequence: Synthetic coding sequence
atggtgaatgaaaatacacgcatgtatatcccagaggaaaatcatcagggaagtaattatggtagtcctcggccagcccacgctaatatgaatgccaatgccgctgctggtctagcccctgagcacattcctacccccggagctgccctcagctggcaggccgctattgatgccgctcgtcaagccaagctgatggggtccgcaggtaacgccacaatttccacagtcagcagtacacaacgaaaacgtcagcagtacggcaaacctaagaaacagggctcaaccacagccacccgccctcctcgcgctttattatgcctcactctgaagaaccccatccgaagagcctgcatttccatagtcgagtggaagccctttgagatcataattctacttacaattttcgctaattgcgttgccctcgctatctacattccatttccagaggatgattctaatgccactaatagcaatttggagcgggtggagtacctgttcctcatcatatttaccgtagaagccttccttaaggtcattgcctacggcctgctgtttcacccaaacgcctacctgcggaatggctggaacctgctcgactttataatagttgtggtgggattgtttagcgccatcctcgaacaggccaccaaggctgatggagcaaacgccctgggcggaaagggagccggttttgatgttaaggctttgagggcctttagagtgttgcggcctctcagactggtgagcggagtgccatccctgcaggtagtgttgaactccataatcaaggccatggtgcctctccttcacattgcactgttggtcctgtttgtcataataatctacgctatcattggtctggagttgtttatggggaaaatgcataaaacctgctacaaccaggaaggaatcgcagacgtgcccgctgaggacgacccaagcccgtgtgctctcgagacaggacatggtaggcaatgccagaacggcaccgtgtgtaaacctggttgggacggaccaaaacatgggattacaaacttcgataacttcgccttcgcaatgctgacggtattccaatgcatcactatggaggggtggaccgatgtgctttactgggtaaatgacgccgtgggtcgggattggccctggatttattttgtgacactgattattattgggtccttcttcgtactcaacttggtgcttggggtcctaagcggagagttctccaaggagagggaaaaagcgaaagctcgtggtgactttcaaaaactgagagagaagcagcagctcgaggaagatctgaaaggttatcttgattggatcacacaggcagaggatatagatcccgagaatgaagatgagggcatggatgaagaaaaaccgcgtaacatgtctatgccaacctccgaaaccgagtctgtgaacaccgaaaacgtggcgggaggagacatcgaaggagaaaattgcggcgcacgattggctcatcggattagtaagtctaagttttctcgatactggagacgctggaacaggttctgccgacgaaaatgccgggcagcggtgaagtcgaatgtgttctactggctggtaatattcctggtctttctaaacactctcacgattgcatcagaacattacaatcagcccaactggcttactgaggtgcaggatactgctaacaaagccctactcgcactattcactgcagagatgttgctgaaaatgtactctttggggctgcaagcatattttgtgtctctctttaaccggtttgactgctttgtggtgtgtggcggtatcttagaaacaattctcgtagagacaaagatcatgagcccgctgggaatctctgtgttacgatgcgtgcgcctcctccggattttcaaaataacaaggtactggaattcactgtctaacctggtggcctccctactcaactctgtccggtccattgcttccctcttactactgttatttctatttatcattatctttagtttgctggggatgcagctctttggcggtaagttcaattttgacgaaatgcaaacaagaagatccaccttcgacaactttccccagagcctgctgaccgtgttccagattctgactggtgaagactggaacagcgtgatgtacgatggcatcatggcatacggagggccttcgttcccaggaatgctggtttgtatctattttattatactgttcatatgtggcaactatattctcctgaacgtgtttttggcaatcgccgtcgataatctggccgacgcagagagcctgaccagtgcccagaaggaggaagaagaagagaaagaacgcaagaaactggctaggacagcaagcccagagaaaaagcaggagctcgtagaaaaacccgcagtaggtgagtcaaaggaggagaaaatcgagctgaagtctatcacggccgacggagagtctccaccagccactaaaatcaatatggatgaccttcagcccaatgaaaacgaagacaagagcccctatcctaaccctgagacaaccggcgaagaggacgaggaggagccggagatgcccgttggacctcgtcccagaccactgtctgagctacacttaaaggaaaaagctgttcccatgcccgaggcttccgctttttttatcttcagcagtaacaatcgtttccgtctccagtgtcatcgcattgttaatgatacaattttcaccaacctaatcctcttcttcattctgttgtcctctatttcactggcagctgaagatcctgtgcagcatacctcctttaggaaccacatcctgttctattttgacatcgtgttcactactatctttactattgaaatcgcccttaagatgaccgcgtatggagctttccttcataaggggagcttctgcaggaactatttcaatatcttggacctgttggtggtgagcgtgagtctaatcagctttggaatccagagctctgccatcaacgtggtcaagattctcagggttctgagggtactccgcccactcagggccatcaacagggctaaggggctgaaacacgtcgtccagtgtgtatttgtggccattcgcacaatcgggaatattgtgatcgttacaacacttctccagtttatgttcgcctgcataggcgtgcaactgtttaaaggcaagctgtacacttgctccgattcgtccaagcaaaccgaagccgaatgcaaaggtaattacattacatataaggatggggaagtcgaccatccaatcatccagccaagaagttgggagaattctaaatttgattttgacaacgtgttagccgctatgatggctttatttactgtgtcaaccttcgaggggtggcccgagctcctctacagaagcatcgacagtcacacggaggataagggcccaatttataactaccgcgtcgaaatctcaatcttcttcatcatctacattatcatcatcgcctttttcatgatgaatatcttcgttgggtttgtgatcgttacgttccaggagcagggcgaacaggaatacaagaattgcgagttggacaagaatcagagacaatgtgtcgagtacgcgctgaaggccagacctttgcggcgttacatcccgaaaaaccaacaccagtataaggtgtggtacgtggtcaattcaacctactttgagtatctcatgtttgtccttatactgttaaatactatatgcctcgcgatgcaacattacggccagtcttgtctgttcaaaatcgcaatgaacattctgaacatgttatttacaggactttttaccgtcgaaatgatactgaagttaattgccttcaagccgaagcattacttctgcgacgcctggaatacatttgatgctcttatagtggtcgggtcgatcgtggacatcgctattactgagaatgctgaagagaatagtagaatttcaatcaccttctttagattattccgcgtgatgagactcgtgaagttactaagccgcggagaggggatacgtaccttactatggacttttatcaagagttttcaggcgctaccatatgtagctctgctaattgtgatgcttttctttatatacgccgtgatcggcatgcaggttttcggcaaaatcgcccttaatgacaccacagaaattaacagaaacaataacttccagactttcccccaggccgtgcttttgctttttcgctgtgcaacaggcgaggcgtggcaggatattatgctcgcatgtatgccaggaaagaaatgcgccccagaatcggagccctcaaactccacggagggagaaaccccctgtggatctagcttcgccgtcttttattttatctcgttctacatgctgtgtgcatttttgatcatcaacctgttcgtggctgtcattatggacaattttgattatctcactagagattggtcgattctgggaccccaccaccttgacgagttcaagcgcatatgggccgagtacgacccggaggcaaagggtcgcattaagcaccttgatgtcgtgactctcctaagacgcattcaaccgccactcggttttggcaagctgtgtccacacagagttgcatgtaagcgtttggtgagcatgaatatgcctttaaactctgatggcacagttatgtttaacgccactttgtttgcactcgtgagaacggcgctgcggattaaaaccgaagaagggcctagtccctcagaagcacatcaaggagccgaagaccctttccggcctgcaggcaatctggaacaggccaacgaggaactcagggctattatcaagaagatatggaaaaggacatccatgaagctactggaccaggtggtgcctcctgcaggtgacgatgaagttacagtgggcaaattttacgcaaccttcctcatccaggaatatttccggaaattcaaaaagcgaaaggagcagggactggtgggcaagccaagccaaagaaacgctctgtcactgcaggccggattacgcacattgcatgatattggccctgagattcggagagctatctccggagacctgactgcagaggaggaactggacaaggccatgaaggaggccgtttcagccgctagcgaggatgatattttcagaagggcaggtggcctctttggcaatcatgtttcctactaccaaagcgacgggagatccgcgttcccacagacttttaccactcaaaggcccctccatatcaacaaggcagggagttcccagggggacactgaaagtccgagccatgaaaagctggttgacagcacgttcacaccttcctcctacagctccactgggagcaacgccaacattaacaatgcaaacaacacagccctggggagattgcctcgacctgctggctatccctctaccgttagcacagttgaggggcacggccctccgctctccccggcaattagggtccaggaggtcgcctggaagctctcctccaataggtgccactcccgagagagtcaggctgccatggcaggccaggaggagacctcccaggacgagacctacgaggtcaagatgaatcacgacacagaagcctgtagtgaaccctcccttctctctacagaaatgctcagctaccaggatgacgaaaataggcagctcaccctcccagaagaagataagagagacatcagacagtcccctaagcgcggttttctgaggtctgcttcactgggaaggcgagcgagcttccacctcgagtgtctgaagagacaaaaggataggggcggagatatctcccagaaaacagttttgcccttacacctcgtccatcatcaggctctggccgttgcaggcctgagtccgctgttgcaacgctcacactctcctgcaagcttcccaagaccttttgctaccccaccggctacacctggtagtagagggtggccaccacagcctgtaccaacattgaggctggaaggggtcgagtccagcgaaaaactaaattcatccttcccatccatccactgcggctcctgggccgagactacccccggtgggggtggctcctccgcggctaggcgcgtcagacctgtttcactgatggtgccctctcaagctggagctccgggacgccagttccatggctccgcttcttcccttgtcgaggccgttctgatttcagagggactgggtcagttcgcccaggatcctaaatttattgaagtcaccactcaggaactagccgacgcctgcgacatgaccatcgaagagatggagagtgcagcagacaatatactgagcggaggcgctccacagtcacctaatggcgcactgctgccattcgtgaattgtcgggatgccggacaagacagggcgggtggcgaggaggacgccggatgcgtgcgagctagaggtcgcccttcagaagaggagttgcaagactctagagtctatgtatctagcctgta

SEQ ID NO: 216626 - DNA, 6416 bp, Artificial Sequence
  Description of Artificial Sequence: Synthetic coding sequence
atggtcaacgaaaacacgcggatgtacatacctgaggagaatcaccagggaagcaattacggtagccccagacctgcgcatgccaacatgaatgctaacgctgcggcaggactggcaccggagcatatccccacacccggtgccgcactgtcttggcaagctgccatcgatgcagcacggcaggctaagttaatgggatccgcagggaatgctaccatcagtaccgtcagtagcactcagagaaaacgtcagcagtacggtaagccaaagaagcagggctcaacaacagcaacacgaccgccacgcgcacttttatgcctcaccctcaaaaacccaatcaggcgggcttgtatcagcattgttgagtggaaacctttcgagattatcatcctcttgaccatcttcgctaactgtgttgctctggctatctatatcccatttcctgaagatgatagcaatgccaccaattccaacctggagagggttgagtatctatttctgatcatcttcacggtcgaggctttcctgaaagtaattgcttatggcctcctgtttcatcccaacgcctatctgaggaatggttggaatctgttggattttatcatcgtggtggtaggcctgtttagtgcaatcctggagcaagctactaaagctgacggggctaatgccctgggcggtaagggcgctggctttgacgtgaaggccttacgcgctttcagagtgctccggcctctgcgactggtgagcggtgtgccctctctccaggtagttctgaattcaatcattaaggccatggtgcccttgttgcatatagcactcctagtgctgttcgtgatcatcatttacgccatcatcggattggaactttttatggggaagatgcataagacgtgctataaccaagagggcatcgctgatgtgccggcagaagatgacccatccccttgcgctctggagacaggccacgggagacagtgtcagaatggcacagtctgcaaacccggttgggacggcccaaagcatggtatcacgaattttgacaatttcgcgttcgcaatgctcaccgtcttccagtgtataacaatggagggttggacagatgtcctttactgggtgaatgacgctgtgggtcgagactggccgtggatctatttcgtcacactgataatcattgggagctttttcgtactgaacctggtgctcggggtgctctctggggagttttcaaaagaaagggagaaggcaaaagcacgtggtgactttcagaaattaagggaaaaacagcagctcgaggaagacctcaagggatacttggattggatcactcaagcagaagatatagatccggagaacgaggatgaaggtatggatgaagaaaaacctcgcaacatgagtatgcctacaagtgaaactgagtcagtgaataccgaaaatgtcgccggaggagatattgagggcgaaaattgcggggcacgcctggctcatagaatttctaagtcaaagttttcccggtactggcgtagatggaataggttttgtcgcagaaagtgtagagcagcagtcaaatcaaacgtgttctattggctggttatcttcctggtcttcctgaatactctgaccattgcgtcagaacactacaaccaacctaattggctgactgaagtccaggacacggccaacaaggcactgctcgctctcttcactgcggaaatgttgctgaaaatgtatagcttggggctccaggcctattttgtgtccctcttcaaccgttttgattgctttgttgtgtgcgggggaattctcgagactatcctggtggagaccaaaattatgagccctctgggcatctcagtgttgagatgcgtacgtttgctgagaattttcaagatcacgagatattggaactccctctccaatctcgtagcctcactgcttaacagcgtgcgcagcatcgccagcttattgttgctcttattcctcttcataattatcttttccctgttgggcatgcaacttttcgggggaaaatttaacttcgacgaaatgcagaccagacggtccaccttcgacaactttccacagagtctgctgaccgtcttccagattctaactggggaagactggaatagcgtcatgtacgacggcattatggcctatggcggaccatcattcccaggtatgctggtgtgtatttactttatcattctttttatctgcggaaattacatcctcctgaatgttttccttgccatcgccgtggataatctggcggatgccgagtctttaaccagtgcccagaaagaagaagaggaggagaaggagcgcaaaaaactggcaagaaccgcctcaccagagaagaaacaggagctcgtggagaagcccgcagtaggggaatctaaggaggagaagatcgagctgaaaagtatcacagccgatggtgagagtcccccagcgaccaagatcaatatggatgatcttcaacccaacgaaaacgaggataagagcccttaccctaatccggagaccacgggcgaggaagacgaggaagagcccgaaatgcccgtgggcccaagaccacgtcctctctctgagcttcatctgaaggaaaaggccgtgccaatgcccgaagcttctgccttttttatattttcttcaaacaacagattccgcctacagtgtcaccgaattgtgaatgacaccatattcaccaatctgatcctcttttttatattgctgtcttccattagcctggccgcagaggaccccgtccagcacacctctttcagaaaccatattttgttttattttgacatagtattcacaaccatctttaccatcgagattgctttaaaaatgacagcctatggcgctttcctacataaagggtccttttgtcggaactacttcaacattctcgaccttttagtggtctccgtgagccttatcagcttcggtattcagagctccgccattaacgttgtaaagatactgcgcgtgttgcgtgtcctgagaccactgagggctattaacagagcaaagggccttaagcatgtggtacagtgcgtcttcgtggctatcagaaccattggcaatattgtcatcgtgaccacccttctgcagttcatgtttgcttgtattggcgtgcagctgtttaagggcaaactgtatacatgcagcgactctagcaaacaaaccgaggccgagtgcaaaggcaactatattacttataaagacggggaagttgaccacccgattatccagcctcgatcatgggaaaatagcaagtttgatttcgacaatgtcctggctgctatgatggctttgtttaccgtttcaactttcgaggggtggcccgagctgctctaccggtcaattgactctcataccgaagacaagggacctatttataactaccgtgtggaaatctctatcttttttattatctacatcatcatcatcgcttttttcatgatgaacattttcgtcggatttgtgatagttacctttcaggaacagggcgaacaagagtataaaaattgtgagctcgataaaaaccaacgccagtgtgtggagtatgctctgaaagcacgcccacttcgccgatatatcccaaagaatcaacatcaatataaggtttggtacgttgtcaattctacatacttcgagtacctgatgtttgttcttatcctgctgaacaccatctgtctcgccatgcagcattacggccaatcgtgcctcttcaagatcgccatgaacatcttgaatatgctcttcacagggctgttcacagtggagatgatcctgaaattgattgcgttcaagcccaagcactacttttgcgatgcatggaatacctttgacgccctgattgtggtaggcagcatcgtggacatcgctatcacggaggtgaatcctgcagagcacactcagtgctctccttcaatgaatgccgaggaaaactctaggatttctatcacattcttccgactgtttagggtgatgcgcctcgtcaagttgctctcacggggagaagggattagaaccctcctttggacgtttatcaaatcattccaggccctgccatacgtggccctgctaatagtcatgctattttttatctatgccgttattggaatgcaagtatttggaaaaattgcgctcaacgatacaactgaaattaaccggaataacaattttcagactttcccacaggccgtgctgttgcttttcagatgtgccaccggagaggcctggcaagacatcatgctggcctgcatgccaggcaagaagtgcgcccctgagtcggagcccagtaatagtacggagggcgagaccccctgtggctccagttttgccgttttttactttatcagcttctatatgctttgcgcgttcctgatcattaatctatttgtggcagtcataatggacaacttcgactacttaacccgcgactggtccatcctgggccctcaccacttggacgaatttaagaggatctgggcggagtatgaccccgaagcgaaaggaagaatcaagcaccttgacgttgtgaccctattgagacgcattcagccccctctcggcttcggaaaactatgcccgcatcgcgtggcatgtaagcgtttggtgtccatgaacatgccactaaattctgatggtacagtgatgttcaacgcaaccctgtttgctctggtccgaacagcccttcgaatcaagacagagggcaacctcgaacaggcgaatgaggagcttagggccattatcaaaaagatttggaagaggactagtatgaagctgctcgaccaggtggtgcctcccgctggggatgacgaagtgaccgttgggaagttctacgcaacattcctgattcaggaatacttcagaaagttcaagaagcgcaaggagcagggcctggtgggaaagccatcacagagaaatgcactgtccttgcaggcaggtctgagaacactacacgatatagggccagagatccggcgtgcaatcagtggggacctgactgccgaggaggagcttgacaaagctatgaaggaggccgtttcggctgcatccgaagatgatatctttcgacgggcaggcggattgttcgggaatcacgtcagctactaccaatctgatgggaggtcagccttcccacaaaccttcacaacacagagaccactccacattaacaaagccggaagctcacagggcgacacggagagtccatctcacgagaagctggtcgactccacctttaccccctcctcatatagtagcaccggatctaatgcgaacataaataacgccaataatactgctctgggacgactccctaggcccgctggttacccctctaccgtgtctactgtggagggccatggcccacctttgtctcccgctattcgagtacaggaggtggcatggaagcttagctcaaacagatgccacagtagagagtcacaggctgctatggccggacaggaggaaactagccaggacgagacgtacgaagtgaagatgaatcatgacacagaggcttgctccgaaccatcccttctctcgaccgaaatgctgtcctatcaggacgacgagaatcggcagctcacattgcccgaagaagataaacgtgacattcgtcaaagccccaagcggggtttcctccgttcggccagcttgggacggagagccagctttcatctcgaatgtctaaagagacaaaaagataggggtggagacatttctcagaaaacggttctgcctcttcatcttgtgcaccaccaggccctcgctgttgcaggcctgagtcctctcctccaaagaagccactctccggcttcattccccagacctttcgcaactccacctgcaacccctggttcgcggggttggcctccacaaccagtgccaaccttgagactggagggagtggagagcagcgagaagctgaattcatcctttccaagcatacactgcgggtcgtgggctgaaaccacacctggtggcggtggatcatcggcggctaggagggtccggccagtgtctctgatggtaccatctcaggccggagctccaggcagacagtttcacgggtcagcttccagcctcgtggaggccgtcctgatatccgagggattaggtcaatttgcccaggacccaaaattcattgaagtaactacccaggagctggccgacgcctgcgacatgacgattgaggagatggagtcggcagctgataacattctgagcggaggagcgcctcagtctcccaacggtgccctgctgccctttgtaaactgtcgagacgccggacaggacagagctggtggggaggaagacgccggatgcgttcgagccaggggcagaccttctgaagaagagttgcaagattcgagagtgtatgtaagcagtttata

SEQ ID NO: 216627 - DNA, 6473 bp, Artificial Sequence
  Description of Artificial Sequence: Synthetic coding sequence
atggtgaatgagaacactcgcatgtatattccagaggagaaccatcagggcagtaactacggatcacccaggccagctcatgcaaacatgaacgcaaacgcagcggcaggccttgccccagagcatatacccacccccggagctgccctgagctggcaggcagcgattgacgctgccaggcaagctaaactcatggggagcgcagggaacgccactatatccaccgttagttccactcagcgcaaaaggcagcagtacggcaagcctaagaagcagggatctaccaccgcaactcggcctccccgtgcacttttgtgtttgacacttaaaaacccaattcggagggcctgcatctccatcgtcgaatggaaaccttttgaaatcatcatcttattaacgatctttgctaattgcgtggctctggctatctatatcccgtttcccgaggacgatagcaacgccaccaattctaacctggaacgcgtagaatacctctttctgataatctttactgtggaagccttcctgaaggttatcgcttatggtttactgtttcatcctaacgcgtatctcagaaatggatggaatttactggacttcattatcgtcgtcgtcggactcttctccgccatcttggaacaggcgaccaaagccgacggcgcaaatgctctgggaggcaagggcgctgggttcgatgtgaaggcactccgggcttttcgagtcctcagacccttgaggttggtctccggcgtaccctcgttgcaggtcgtgttaaattctataattaaggccatggtacccctcttgcacatcgcactgctcgtattatttgtgataatcatttacgctatcataggtttggagctgttcatgggcaagatgcataagacgtgttataaccaggagggaattgccgatgtgccagcagaggacgatccctccccatgcgcccttgagaccggccatggccgacagtgccagaacgggaccgtctgcaaacccggatgggacgggccaaagcacggcattactaacttcgacaatttcgccttcgccatgctcaccgtgttccaatgtatcaccatggaggggtggactgatgtactgtactgggtaaacgacgccgttggcagagactggccctggatatacttcgtcacactgatcatcattggctcattcttcgtactgaatttggtgttgggtgtactttcaggagagttctccaaagagcgggaaaaggctaaggcgagaggggatttccagaaattgcgcgagaagcagcagctcgaggaagatctgaaagggtacctcgactggataacacaggctgaagacatcgatcctgagaacgaggacgaaggaatggatgaggaaaaacccaggaatatgtcaatgccaacttccgagacggaatccgttaacaccgaaaatgtagcgggaggggacatcgaaggggaaaattgtggagctcgcttagcccacagaattagcaagtccaagttcagcagatattggcggagatggaaccgcttctgccgtcgcaaatgcagagctgccgtgaagagcaacgttttttactggttggttatctttctggtttttctaaatactttgactatcgcgagcgaacattacaatcagccgaattggctgactgaggtccaggatactgcaaataaagccctattggctttgttcacagcagagatgctcctgaagatgtactccctgggtctgcaggcctacttcgtgtcactgttcaatagattcgactgcttcgttgtgtgtggtggcatactcgagaccattcttgtggaaaccaaaatcatgtcacctttaggtatctctgtcctgcgctgcgttagattgctaaggatcttcaagataacccgctattggaactctctctcaaaccttgttgcctccctgcttaacagtgtgaggtctattgcatcgttgttgttgctattgtttctgtttatcatcattttttccctgcttggtatgcagctgtttgggggaaagttcaacttcgacgaaatgcaaactcggcgaagtacgtttgacaatttcccccagtcgctgttgacggtctttcagattctgacgggcgaggactggaacagcgtgatgtacgatggcatcatggcctatggaggaccgtcctttccgggaatgttggtctgcatctatttcatcatccttttcatctgcggcaactatattctgctaaacgtgtttctcgccatagctgttgataatttggccgatgctgagagtcttacgtctgctcaaaaggaggaggaagaagagaaggagagaaagaagctcgcaaggactgccagccctgagaagaagcaggagcttgttgaaaagcctgcggttggtgagtctaaagaggaaaaaatagaactgaagtcgatcaccgccgacggggagtcgccacccgctaccaagatcaatatggacgatctgcaacccaatgaaaatgaggacaagagcccttaccctaatcccgagactactggcgaggaggatgaggaagagcctgagatgccagttggtcctcgcccacggcctctttccgaattgcacctgaaggaaaaggctgtgcccatgcccgaggcaagtgccttctttatattttcctcaaataatcgttttagattgcagtgtcaccggatcgtgaacgacactatttttaccaacctgatcctgttttttatactcctgtccagcatcagtctggcggctgaggatccggtccagcacacctcctttaggaatcatattttgttctacttcgatatagtgttcaccactatctttaccatcgaaattgcccttaagatgacggcgtatggcgcatttctgcacaaaggtagcttctgcaggaattatttcaacatcttggatttattggttgtttctgtgagcctgatctccttcggcattcagagtagcgctataaacgtggtcaagattctgcgagtcctccgcgtattgcgcccacttagagctatcaacagggccaaaggtctgaaacacgtggtgcagtgtgtgttcgtggccatccggaccatcgggaacatcgttatcgtgacaacgctattacagtttatgttcgcatgcatcggcgtgcaactattcaagggtaagctatacacctgttctgactcaagtaaacagacagaggctgaatgcaagggaaattatatcacatataaggacggagaagtcgaccaccccattatccagccaagaagctgggagaattcaaaattcgatttcgacaatgtgctggcagctatgatggccttgttcaccgtaagcacatttgaaggttggcccgaattgctttatcgaagtattgattcacacactgaagacaaagggcctatttataattaccgagttgagattagcatattcttcatcatctacatcattattatcgcttttttcatgatgaatatcttcgtcggctttgttattgtgacattccaggaacagggagagcaggagtataaaaattgtgagctcgataaaaatcaaagacagtgcgtagagtacgctctcaaagcacgccctttgcggcgttatatacctaagaatcagcatcagtataaggtgtggtacgtggtcaatagcacctactttgaatatctgatgtttgtactcatccttctgaacacgatttgcctggccatgcaacactacggccagagctgtctgttcaaaattgctatgaatatcttgaacatgttgtttacgggcctgttcacagttgaaatgattctgaaattaatcgcatttaaacccaagggctacttctccgatccctggaacgtgtttgactttctgatcgtgatcggctctataattgatgtaatactctctgaaacgaaccccgctgagcatactcagtgctctccctccatgaatgccgaagagaactcacgaattagtataacattttttcgcctgttccgtgtcatgcggcttgtcaaactgctaagtcgcggtgagggcatccggacccttctttggactttcattaagagcttccaggctttgccgtatgtggccctcctgatagtgatgctgtttttcatctacgccgtcattgggatgcaggtctttggcaagatcgccctgaacgatacaacggagatcaatcggaacaataactttcagaccttccctcaggctgttctccttcttttccgttgcgctaccggggaagcctggcaggatattatgttggcctgtatgcctggtaaaaagtgcgctcccgaatccgaaccaagcaactctacagaaggcgaaacaccttgcgggtcttctttcgcagtgttctacttcattagcttttacatgctgtgtgcatttctgatcattaacctttttgtcgcagtaatcatggataattttgactatctaactcgagattggtctatcctggggcctcaccacctagacgagttcaaacggatttgggcagagtatgatccagaggctaagggaagaatcaagcacctggatgtagtgaccctgctgcgcagaatccagccccctctcggcttcggcaaactttgtccccaccgtgttgcttgtaagcggctagtgagcatgaacatgcccctgaactcagatgggacagttatgttcaacgctactttgttcgccctagtgcggaccgctctccgcataaaaactgaggagggccctagtccatctgaggcacaccaaggcgctgaagatccttttcggcctgcgggaaacctagagcaggctaatgaggagttgcgagctatcattaaaaagatttggaagagaacaagtatgaaactgctggatcaggtcgttccacccgctggcgatgatgaagtgaccgttggaaaattttatgcaacgtttttaatccaggaatacttccgaaagtttaagaagcgaaaggaacaaggactcgtcggcaaaccctcccagaggaatgcgttgtccctccaggccggtctacgaaccttacatgacattggaccggaaattcgcagggccattagtggggacctcaccgcagaggaagagctggacaaagcaatgaaggaagcggtgtccgccgcaagcgaggacgatatcttccggcgtgctggcggattgtttggcaatcatgtgagttattaccagagcgatggtcggagcgcatttccacagacatttactactcaacgtccattgcacataaataaggctggcagttcccagggcgatacagagtctcctagccatgaaaagttggtggattcgactttcacaccctcctcgtattcctcaaccggaagcaacgccaatattaacaacgctaataacaccgcgctgggacgcctccctcgccctgcaggctacccgagcaccgtcagcaccgtggaaggacacggaccccctctctctcctgcgattcgagttcaggaggtcgcctggaagcttagttcaaaccgctgtcattcccgggaatctcaggccgcaatggccggtcaagaagaaacttcacaagacgaaacgtatgaggtgaagatgaaccacgataccgaggcatgcagcgagccaagcttgctgtctactgaaatgctttcctatcaagacgacgaaaatagacagttaaccctgcctgaagaagacaagcgggacatccgtcagtctccaaaacggggttttctcagaagtgccagtctgggtcgcagagcctcttttcacctagagtgcttgaagcggcagaaggatagaggtggcgacatctcacagaaaacagtgctgccactgcaccttgtccaccatcaggctctcgccgtagctggcctctctcctctccttcagagaagccattccccggcatcatttcccagaccctttgctactccccctgctacccccggttctcgcggatggccaccccagcctgtgcctactttacgcttggaaggcgttgagtcaagcgaaaagttgaattcatctttcccctctatacactgcggctcttgggccgagacaaccccaggcggtggcggaagttccgcggcacggagggtgcgaccagttagccttatggtgccctcacaggcaggcgcacccggtaggcagttccacgggtccgcctctagtcttgtggaagcagttcttatttctgagggtttgggccagtttgcacaggacccaaaatttatcgaggtcacgacacaggagttggccgacgcctgcgacatgaccatcgaagagatggaatccgccgcagacaacatactttccggcggtgctccacagtcaccgaacggcgcactgctgccgtttgtgaattgccgggatgcagggcaggacagggcaggaggagaggaagatgctggatgcgtgcgagcgagagggcgaccctctgaggaggaactgcaggattcccgggtctacgtatcttcacttta

SEQ ID NO: 216628 - DNA, 6629 bp, Artificial Sequence
  Description of Artificial Sequence: Synthetic coding sequence
atggtaaacgagaatacccggatgtatataccggaagagaaccatcaggggtcgaactatggaagtcccaggcccgctcacgccaatatgaatgcaaacgctgccgctgggttggccccagagcacatccccactcccggagcagcgctctcctggcaggccgcaatagatgctgccagacaggcaaaacttatggggtctgctggaaatgcaacaattagcacagtctcgagcacccagcggaaacgacagcaatacgggaagcccaaaaagcagggatccacaactgccactcgacctcctcgggcactactgtgcttgacactcaagaatcctattcggcgagcctgcatttcgattgtggagtggaaaccgtttgagatcattattcttttgacgatatttgcaaactgtgtggccttggctatttatattcctttcccagaggatgatagcaatgcaaccaactctaatctcgagcgcgtagaatacctattcctgatcatttttacagtggaggccttccttaaagtaatcgcttatggcctgttgtttcacccaaatgcatatctgcgcaacgggtggaacctcctcgatttcattatcgtagtcgtcgggctcttttctgctatcttggagcaggccaccaaggccgacggggcaaatgccctcgggggaaaaggggctggctttgatgttaaggccctcagagctttcagggtgctgcgcccactgcgactagtctccggcgtcccatccctgcaggtagtccttaatagtattataaaagctatggtgccgctgctccacattgcgcttctcgtgctctttgtgatcattatatacgcaataatcggtctggagctgtttatggggaaaatgcacaaaacctgctacaatcaggaaggtatcgcagatgttcccgcagaggacgacccatctccgtgtgctctggagactggacacggaagacaatgccagaatgggaccgtgtgcaagccgggatgggacgggcctaagcatgggataacaaactttgacaacttcgctttcgctatgttgaccgtgtttcaatgcatcaccatggaggggtggactgatgtgctgtattggatgcaggatgccatgggctacgaactgccctgggtgtattttgtatctctggtgatcttcggctcgttctttgtcttgaacctagtgctgggcgtgctttcaggggaattcagtaaggaaagagagaaggccaaggccagaggtgactttcagaaactccgggagaagcagcagctggaggaagatttgaagggttacctagattggatcacccaagcagaggacattgaccctgaaaatgaggatgaaggaatggatgaggaaaaacccaggaacatgagcatgcccaccagtgagactgaatctgttaatactgaaaacgttgccggaggtgacattgagggtgagaactgtggagcacggttagcccacagaatctctaagtccaaattttcaagatattggagaagatggaaccggttctgcaggaggaagtgccgggcagcagtgaagtcaaacgtgttctattggttggtcatcttcctcgtatttcttaatactctgacaattgcctccgagcactataatcaaccgaactggcttaccgaagtacaagacaccgccaataaggccttacttgctctttttacagcggaaatgcttttgaaaatgtacagcctaggtctgcaggcatattttgtctcgctattcaataggtttgactgctttgtggtgtgtggagggattctagagacaatcctagtcgagacgaagattatgtcacctctcggaattagcgtgttgcggtgcgtcagactcctgcggatcttcaagattacaagatattggaactctttgagcaatctcgtggcttccctgctcaacagtgttaggtccatcgcgtccttgttattgctgctgtttctgttcattatcatcttctcactacttggcatgcagcttttcggaggcaaatttaacttcgacgaaatgcagactcgcaggagtacctttgacaacttcccccagtcattgctcacggtcttccagatactgaccggcgaggactggaacagcgtgatgtacgacggaattatggcttacggcggaccaagcttccccggaatgcttgtgtgtatatattttatcatcctattcatctgtgggaactatatcctcttaaatgtgttcctcgccatcgccgtggacaacctcgccgacgcggaatctttaaccagtgcccagaaggaagaagaggaagagaaggaaaggaaaaagctcgcccgaaccgcttctccagagaagaaacaagaattggtcgagaaacctgccgtaggtgagagcaaagaggagaagattgagctcaagagcatcacagccgacggagaatccccacccgcaactaagatcaacatggacgacctgcagcccaacgaaaacgaagacaaatctccatacccgaacccggagaccaccggcgaggaggacgaggaggagcccgaaatgcccgtcggccctcgacccaggcctttgagtgaactccacctcaaagagaaagctgtgcccatgccagaggctagcgcgtttttcatctttagctctaataatcggttcaggctacagtgccatcgaattgtgaatgataccatattcacgaatcttattctgttttttatattactcagttcaatctccttggctgcagaggacccagtgcaacatacttcttttcggaaccacatcctgttctactttgatattgtttttacaactatttttacaatcgaaatcgcgttgaagatgactgcatacggcgcttttctgcataaaggatctttttgtcggaactatttcaatattctggacttgttggttgtgagtgtatccctgatcagcttcggaattcagtccagcgcaatcaatgtcgtaaagattctgagagtactgagagtcctgcgtcccctgagagcaatcaaccgagccaaaggcctgaagcacgttgtccagtgcgtctttgtcgcaatcagaacaatcgggaatattgtgatcgttacgacgctcctgcagttcatgttcgcatgtatcggagtccagctctttaaaggtaaactctacacatgtagcgattcaagcaagcagacagaggctgagtgcaaaggtaattacataacttataaggacggggaggtggatcatccaataattcagcccagatcttgggaaaactccaaattcgactttgataatgtgttggccgctatgatggcactgttcacggtcagcactttcgaaggctggccggagcttctctataggtctattgattcccataccgaagacaaaggacccatctacaactatcgagtggagatcagtattttttttatcatctacatcatcatcatcgctttctttatgatgaacatatttgtcgggtttgtgatcgtgaccttccaggaacaaggtgagcaggagtataaaaattgtgaactggacaaaaaccagcgacaatgcgtcgaatatgctttgaaggctaggccgcttcggaggtatatacccaagaaccagcatcagtataaagtgtggtatgtggtcaattccacctatttcgaatacctgatgtttgtgctgatcctgttgaataccatctgcctggctatgcagcactatggtcagtcgtgtttattcaagatcgcaatgaatatcctaaacatgctgttcactggtctgtttaccgtcgagatgatcctgaaactgattgcatttaagcctaagggatacttttccgacccatggaatgtgttcgactttctcatcgtgattggctcgattatcgacgtcattttatcagagactaaccccgctgagcatacccagtgtagtccgagtatgaacgccgaagagaactcaagaatatcaatcaccttcttcaggctattcagggtgatgcgactggtgaaactgttgtcccgcggtgagggcattcgtacccttctctggactttcatcaaatctttccaggcactgccgtacgtcgctctgctcatcgttatgctctttttcatctacgcggttatcgggatgcaagtgtttgggaagatcgccctgaacgacacaaccgagattaatagaaacaataattttcagaccttccctcaggctgtgttgctcctcttcaggtgcgcaacaggtgaagcctggcaggacattatgcttgcctgtatgcctggcaagaaatgcgcccctgaaagtgagccttcaaacagcaccgagggagagactccttgcggatcgtccttcgccgtcttctattttatttccttctacatgctatgcgcttttctcatcattaatctgtttgttgcagttataatggacaactttgattacttgacaagagactggtcaatcctcggaccacatcacctcgacgagtttaagcggatatgggccgaatacgaccccgaggctaaaggacgcatcaaacatctggatgttgtcacactactgagacggatccaacctcctctgggcttcggtaaattatgtccccatcgggtcgcctgtaaacggcttgtgagtatgaacatgccattaaattcagacggcaccgtgatgtttaatgccacgctgtttgccctcgtgcggaccgctctcaggattaaaactgaggggaatttggaacaggccaatgaggaattgcgcgctattattaagaaaatctggaagcggacaagcatgaagctccttgaccaggtggttccgccagctggcgatgacgaggtgactgtcgggaagttttacgccacttttttgatccaggagtatttcaggaaattcaaaaaacggaaagaacagggcctggtcgggaagccatcccagcggaatgccctgtcactccaggctggcctgagaactctgcatgacattggacctgagatccgcagggctatctccggtgatttaacagccgaagaggagcttgataaggctatgaaggaagctgtgtctgctgcaagtgaagacgacatcttcaggagggcgggtggacttttcggcaaccatgtgagctattatcaaagcgacggtagaagtgccttcccccagacttttacaacacaaaggccattgcatataaacaaggctggctcgtcccaaggcgacaccgagtctcccagccatgaaaaactggttgactctacctttaccccatcaagctattcgtccaccggttctaacgccaacatcaacaatgcaaacaacaccgcccttgggaggctcccgaggccagcgggatacccctctactgtttcaaccgttgagggtcatggacctccgctttcccccgctattcgcgtgcaagaggtggcatggaagctttcatccaaccgtatgcattgctgcgacatgcttgatggcggaaccttccctccggctctaggtccaaggagagcccctccttgccttcatcagcagttgcagggtagcctggcgggactaagagaggatacgccctgtatagtgcccggtcacgccagtctttgctgttcatccagggtgggcgaatggctgcccgcaggctgtaccgcaccccaacacgcgagatgccacagcagagaatcacaagcagccatggcaggacaagaggagacgtcgcaagatgagacctatgaggtgaaaatgaatcacgatacagaagcctgtagcgagcctagcttgctgtccacagagatgctatcttaccaggatgacgagaaccgacaattaaccttgccggaggaggacaagagagacatacggcagagccctaagcgtggcttcctgaggagcgcttcacttggtagacgcgctagctttcacttggagtgcctcaaacgccaaaaggatcggggaggcgacataagccaaaagactgttttacctcttcacctggtgcaccaccaggctctggcagttgcgggattatcgccacttctgcagcggagccattcgcctgcctctttccccaggccttttgcgacccctccagccactcctggctctcgcggttggccgccacagcctgtccccacccttcgcttggagggggtcgaaagttctgagaaattgaatagcagcttcccaagcattcactgtggatcctgggccgaaacaacacctggcggtggaggatccagcgccgctcgccgtgtgaggcccgtcagcctcatggtgcctagccaggccggagcgcctggacgccagtttcacggttccgcctccagcttggtggaggcagtgctcatctctgagggtttgggccaatttgcgcaggacccgaaatttattgaggtgacaacccaagaacttgcggatgcctgcgatatgaccattgaggaaatggagtctgctgctgataatatactgagtggaggggctccacagagccctaatggagccctcttaccattcgttaattgccgtgatgccggtcaggatagagctgggggagaagaggacgcaggatgcgtgagagccaggggaagaccctctgaggaggaactgcaggacagccgggtgtacgtgtcgagcctcta

SEQ ID NO: 216629 - DNA, 3840 bp, Artificial Sequence
  Description of Artificial Sequence: Synthetic coding sequence
atggtgaatgagaacacccgtatgtacattcccgaggaaaaccaccaagggagcaactatggcagtccaagaccagcacacgccaatatgaacgctaacgccgcagctggcctcgcaccagaacatatccctactcctggtgcagcccttagctggcaagccgctatcgatgcggctcgccaggcgaagctgatggggagtgctggtaatgccacaatcagtaccgtgtcctctactcagcggaagagacagcagtatggtaagccaaaaaaacaggggtctaccaccgcgacccgcccaccacgggcactgctttgtctaactctgaaaaaccctattaggagggcttgcatctctattgtcgaatggaaaccattcgaaatcatcattctgttaaccattttcgctaattgcgtggccctggctatatacatcccttttcccgaggacgatagtaacgctactaactctaatctggagagggtggagtaccttttcttaattatattcacagtcgaagcatttctcaaggttattgcgtacggcctgctattccatccgaacgcctatctgaggaacggttggaatttgctggatttcatcattgtcgtggtcggccttttcagtgccattctcgagcaggctactaaagcagatggagcaaacgctctggggggaaagggtgccggattcgacgtcaaagccctgcgcgcattccgagttctgcgcccactccggctggtttccggtgtgccatccctccaagtggtccttaactcaattattaaggcaatggtgccactacttcatatcgcccttctcgttctgttcgtgatcatcatctatgctatcatcgggttggagctgtttatgggtaaaatgcacaagacctgttataaccaagaggggatcgctgatgtgccagccgaggacgacccctctccatgtgctttggaaacgggtcatggacggcagtgccagaatggcacagtgtgtaaaccagggtgggatggtccaaagcacggaatcactaacttcgacaattttgctttcgccatgctgaccgttttccagtgtatcaccatggaggggtggaccgacgtgctatattgggtgaatgatgccgtcggcagggattggccttggatctatttcgtgactctgatcatcatcggaagctttttcgtcctcaatctggtgttgggagtgctctcaggggaattctccaaggaaagggagaaagccaaggctcgcggagacttccaaaaactccgagaaaagcaacagttagaggaggacttaaaaggatatctggactggatcacacaagctgaagatatagaccccgaaaacgaagatgaggggatggacgaagagaagcctcggaacatgtctatgcccacatccgaaaccgaatccgtgaataccgaaaatgtggccggaggagacatcgagggcgagaattgcggtgctcgattagctcatcgcatttctaagagtaagttcagccggtactggaggcgatggaataggttttgtaggaggaaatgccgagccgcagtgaagtctaacgttttctactggctggtgatctttctggtttttttgaacactctgacgattgcatctgagcactacaaccagcctaattggctcacagaggtccaggacacagcaaacaaggccctcctcgctttgttcacagccgaaatgctgctgaagatgtactcgttgggtctgcaggcgtattttgtttctctgtttaatagattcgactgttttgttgtttgcgggggaattctcgaaaccatcctcgttgagaccaaaatcatgtccccactggggataagcgttctgcgctgcgtgcgtctgctgcgtattttcaaaattactaggtactggaattctctaagtaatctcgttgcctctctgctaaatagtgtaaggagtatagcctctctgctgctactactctttctttttattataatttttagtctcctcggaatgcaactgtttggcggtaagtttaacttcgacgagatgcaaactaggcggagcacattcgacaatttcccacagagtctgcttacagtgttccagatcttgacaggtgaagactggaatagtgtgatgtacgatgggatcatggcgtacgggggtccgtcatttcccggtatgctggtttgcatttactttatcatcctgttcatatgcggaaattatattcttctgaatgtgttccttgctatcgccgtagataaccttgcggatgcagaaagcctgacaagcgcacagaaagaagaagaagaagagaaagaaaggaagaaattggcacgcactgcatcccctgaaaagaagcaagagctggtcgagaaaccggcagtgggagagtccaaggaagagaaaatcgaactgaaatccattaccgctgacggtgagagcccgcctgccaccaagatcaacatggatgatttacagcccaatgagaacgaggataagagcccgtaccctaaccctgagaccaccggggaagaagacgaggaggaaccagaaatgccagtcggccctcgacctagacccctgagtgagttacatttaaaagaaaaagcggttcctatgccggaggcgtctgcatttttcatctttagttccaacaatcgattcagactgcagtgtcaccggattgtcaacgatacaatcttcactaatctaatactgttctttatcttactctcctccatctcactggcagctgaggacccggttcagcataccagttttagaaatcacattctgggcaatgccgattacgtctttacttccatttttaccctggagatcatactgaaaatgacagcttatggcgcttttctgcacaaaggatccttttgccggaactactttaacattttagacctcctggtagtgtccgtgtcactcatctcattcggcatccagagtagcgcgatcaacgtggttaagatcctccgggtcctgcgcgtactccgcccactcagagcgattaaccgtgctaagggcctaaagcacgtggttcagtgtgtatttgtggcgatccggacaatcggaaatatcgtaatcgttactactcttctccagttcatgttcgcctgtatcggagtgcagcttttcaaagggaagctttacacatgctccgacagtagtaagcagacagaggcggaatgcaaaggcaattatatcacgtataaggatggagaagtcgaccatcccattatccagcccagatcttgggaaaactctaaatttgatttcgataatgtgctggccgctatgatggctcttttcaccgtcagcacttttgaagggtggccggagctgctgtacagatcaattgacagtcacaccgaagacaagggtcccatttacaactaccgggtcgagatctcgattttcttcattatttacataatcatcatcgccttcttcatgatgaacattttcgtagggtttgtcattgtcacattccaggaacaaggggaacaggagtacaagaattgcgaacttgacaaaaaccagcggcagtgcgtggagtacgccctgaaggcaaggccactccgcagatacatacccaagaaccagcaccagtacaaagtctggtacgtggtgaactctacatactttgagtacctcatgttcgttttgattctgctgaacaccatttgtctcgctatgcagcactacggccagtcctgcctcttcaagattgcaatgaatatcctcaatatgctgtttactggcttattcactgtggagatgatcctgaagcttattgcctttaagccgaaagtgggactttag

SEQ ID NO: 216630 - DNA, 6546 bp, Artificial Sequence
  Description of Artificial Sequence: Synthetic coding sequence
atgatgatgatgatgatgatgaagaaaatgcagcatcagcgtcagcagcaagcagaccacgcgaacgaagccaactatgcgaggggtaccaggttgcccttgtcaggcgaaggacccacgtcacagcctaattcatcaaagcagactgtgctttcctggcaggccgcaatagacgcagccagacaggcaaaggcagcacaaaccatgtccacctccgcgccaccgcctgtcggcagcctgtcccagcggaaacgacagcagtatgctaaatcaaaaaagcaggggaatagcagcaatagcagacctgccagggccttgttttgtctgtccctcaataatcctatcagacgggcatgtatcagcatcgtggagtggaagcccttcgatattttcatcctattagccatttttgccaattgtgtggccctggcaatctacatccccttccccgaagacgactcaaattccacaaatcacaatctggaaaaagtggagtatgcatttctgatcatctttaccgtggagaccttcctgaagatcatcgcatatggcctcttgctgcatcctaatgcgtacgttagaaacggctggaatctgttagacttcgtgattgtgatagtcgggctcttcagcgtgatacttgaacagctgaccaaggagaccgaggggggaaatcacagttctggtaaatccggcggatttgatgtgaaggctcttcgagcctttcgcgtgctacgccctttgagacttgtcagcggtgtcccaagtttgcaggtcgtcttgaactctattatcaaggccatggtgccattgctccacatagccctgctggtgctttttgtcatcattatttacgccattataggcctagaattgttcatcggcaagatgcacaagacctgcttctttgctgactctgacattgtggccgaagaggaccccgctccttgtgctttttctgggaatggtcggcaatgtaccgctaacggaaccgagtgcaggagcggctgggtgggtcctaatgggggaattaccaactttgataattttgccttcgcaatgctgactgtcttccagtgtattaccatggaaggctggaccgatgtcttgtactgggtgaatgacgccattggttgggaatggccatgggtgtacttcgtgagcctgattatcctggggtccttcttcgtactgaatctcgtgctgggagttctgagcggagaattttcaaaagaacgggaaaaggcaaaggcaaggggagactttcaaaagctgagagaaaagcagcagttggaggaagacttgaaaggctacctagactggattacacaagctgaggacattgaccccgagaatgaagaagagggaggggaggaaggaaaaaggaatactagcatgcctacatctgagacagaaagcgtaaacacggaaaacgtaagcggggaaggagagaaccggggttgctgcggatccctgtggtgctggtggcgacgccgtggagccgcaaaggccggaccctccggttgccgcagatggggacaggctattagcaaatcaaaattgtccaggaggtggaggcgatggaacaggttcaaccgacgccgttgtagggcagctgtcaagtctgtcacgttctactggctggtcattgtgctggttttcctcaataccctcacaattagtagcgaacactacaatcagcccgattggcttacacagattcaggacatcgctaacaaggtgctgctggctctgttcacctgcgaaatgctggtcaagatgtacagcctgggcctgcaggcttatttcgtgagcttgttcaatcgattcgattgctttgtagtttgtggaggtattacagagaccatcttggtggagctggaaattatgagtccgttgggaatatctgtgttcagatgcgtaagactgttgcgcatcttcaaggtgactcgtcactggacgtcactctcgaacctggtcgcaagcttattgaactccatgaagtccattgcgtcattgctactgctgctcttcttgttcattatcatcttctcactcttaggcatgcaactgtttgggggaaagtttaattttgatgaaacccagacaaagaggtctacatttgacaactttcctcaagccttgttaactgtgttccaaattctgacaggcgaggattggaatgccgtgatgtacgatggtatcatggcatatgggggaccatcctcgagcggcatgatagtgtgcatatacttcattatcctcttcatttgtgggaactacattctcctgaatgtgtttctagcaatcgccgtcgataacctagcagacgcggaaagtttgaacacggctcaaaaggaggaggccgaagaaaaagaacggaaaaagatcgcccgaaaagagagcctggaaaataagaagaataataagcccgaggtcaaccaaattgccaactcagacaacaaggtcacaatcgatgactatagggaggaagacgaggacaaggacccttatccgccttgtgacgtgcctgtgggtgaggaggaagaggaagaagaggaagatgagcctgaagtgccagcagggcctaggccccgacggatctctgagctgaacatgaaggagaagatcgccccaatccctgaagggagcgccttttttattctcagtaaaacaaaccctatcagagtgggctgtcacaagcttatcaatcaccacattttcaccaacctgattttggtatttatcatgctgtccagcgctgcgctcgctgccgaagatcctatcaggtctcatagctttcggaacacgatccttggctatttcgactacgccttcaccgctattttcacagtggaaattctgttgaagatgaccacattcggggcattcctgcataagggggctttttgccggaactacttcaacctactcgacatgctggttgttggggtgtctctggtgtcgtttggcattcagtctagcgccattagcgtggtgaaaattctgagagtgcttcgggtcctgagacctctgcgggctattaatagggccaagggtctgaagcacgtggttcagtgcgttttcgtggccattcggacaatcggaaacataatgattgtaaccacgctgctccagttcatgttcgcctgcatcggagtgcaactgtttaaaggtaaattttataggtgcaccgacgaagcgaagtccaacccggaggaatgtaggggcctgtttattctgtataaagatggcgacgtcgattctcctgtcgtccgcgaacgtatatggcagaattcagattttaactttgacaatgttctgtcggccatgatggccctgttcaccgtgtcaacttttgaggggtggccggctctgttatataaggcaattgattccaatggtgaaaacattgggcctatatacaaccatcgggtcgaaatctcaatctttttcattatatacatcattatcgtcgctttttttatgatgaacatcttcgtgggtttcgtgatcgttaccttccaggagcaaggagagaaagagtacaagaactgtgaactcgacaaaaaccaacgccagtgtgttgagtatgccctgaaggcgagacctcttaggagatacattcctaagaatccgtatcagtacaaattctggtatgtggtcaatagcagtccatttgaatatatgatgtttgtgcttattatgctgaacacattatgtctagctatgcagcactacgaacagtctaagatgttcaatgacgctatggacatcctcaatatggttttcaccggcgtgtttacagtcgaaatggtcctgaaggttatcgcttttaagcctaaggggtacttcagtgacgcctggaacactttcgacagcctgatagtaatcggatcaattattgatgtcgctctgtcagaggcggatccaactgaatcagagaatgtgccagtccctacggcaactcccggtaactctgaagaatcgaaccggatttctatcacatttttccgcctgtttagggttatgaggctcgttaagctgttgagcagaggcgaggggatcaggactctgctctggaccttcatcaagtcatttcaggcgctgccgtacgtggcgctgctgatcgccatgctcttttttatctacgcggtgattggcatgcagatgttcggcaaggtcgctatgagggacaacaaccagataaatcggaataataatttccagacgttcccgcaggccgtgctgctgttgttccggtgcgccacaggtgaagcatggcaggagatcatgttggcatgtctccctggcaagctctgcgatccagaatccgattacaatcccggtgaagaatatacatgtggatctaacttcgccatagtgtacttcatatctttctacatgctctgtgcattcctcatcattaatttgtttgtagccgtgatcatggacaactttgactacctgaccagagactggtcaattctgggccctcatcacctcgacgagtttaaacgcatatggtccgaatatgacccagaagctaaaggcaggatcaagcacttagatgttgtcacccttctgagaagaatccagccaccattggggtttggaaaactttgcccacatagggtggcttgcaaaagactggtagcaatgaacatgcccctgaatagcgatggtacagttatgttcaacgcaacactatttgctctcgtgcggacagccctgaaaatcaaaacagagggcaatctcgagcaagccaatgaggagctccgagccgttattaaaaagatttggaagaagacctctatgaagctcctggatcaggtggtcccgcctgccggagacgatgaagtcacggtcggaaagttttatgctacttttcttatccaggactattttcggaaatttaaaaagaggaaagagcagggtctggtgggcaagtatccagcaaaaaacacaacaattgccctgcaggccggactgcgcactctgcatgacattggtccagagatccgcagagccatcagctgcgacctgcaggatgatgagcccgaagaaacgaagcgggaagaagaagatgacgtgttcaaaagaaatggcgcactcttggggaaccacgtaaaccacgtcaactcggaccggagagattcgctgcagcaaacaaacactacgcacaggccacttcacgtacagagacctagcatacctcctgccagcgacactgaaaaacctttgttcccacctgctggcaacagtgtgtgccacaatcaccataaccacaacagtataggcaagcaggtgccgaccagcaccaatgcgaacttgaacaatgcaaacatgtctaaggccgctcatggtaagcggccatccattggaaatctggaacacgtttctgagaacggccatcactccagccacaagcacgaccgagagccccaaaggcgttcaagtgtgaaaagaacacgctattacgaaacatatattagatccgattcgggcgatgaacaactaccaaccatatgccgcgaggaccccgaaatccatgggtacttccgcgacccacactgtctgggcgaacaggagtacttcagtagcgaggagtgctacgaggatgatagttccccaacttggtcccggcagaattatggctactacagcagatacccaggtcgcaacatcgacagcgagagacctcggggatatcatcatccacaaggatttctggaggacgatgattcccccgtttgttatgattctaggcgctcacctcggcgaagactcctgccccctacccctgcttcgcaccgccgatccagttttaactttgagtgcctacgtcgtcagtctagtcaggaagaagtgccatcttcccccatttttccacatagaactgccctgccacttcacttaatgcagcaacagatcatggccgtggcgggtcttgatagcagcaaggcccagaaatattccccctcacatagtaccaggagctgggccaccccccctgcaacacccccataccgcgactggaccccctgttacactccacttatccaggtggagcaaagcgaagcgctggatcaggtgaatggatccctccctagtctgcacagaagttcctggtacactgacgagcccgacatatcatatcgtactttcacacctgcttccctaacagtgccctcctctttcagaaataaaaatagcgataaacagcggtcagccgactccctggtggaggccgttttgatcagcgagggcctcggcagatacgcgagagatccaaagttcgtcagcgccacaaaacacgagatagctgacgcctgtgacctgaccatcgatgaaatggagagcgcagcctccactctcttaaatggtaacgtgagacctcgtgccaacggcgacgtgggccctctgagccatcgccaggattatgagctgcaggacttcggaccaggttattccgatgaggagcctgaccctggtagggacgaggaggacctggctgacgagatgatatgtattacaaccttgtac

SEQ ID NO: 216631 - DNA, 6485 bp, Artificial Sequence
  Description of Artificial Sequence: Synthetic coding sequence
atgatgatgatgatgatgatgaagaagatgcagcaccagcgccaacaacaggcggatcatgcgaatgaggccaactacgcacgcggaactcgtctcccactgagcggcgaaggacccacttcacagccaaattctagcaaacagactgtgctctcctggcaggccgctattgacgctgccagacaagccaaggccgcacagaccatgagcaccagtgctcctccccctgtaggttctctctcgcaaagaaagcggcaacagtacgccaaatcaaaaaagcaaggtaatagctcaaattctcggccagcaagagccctgttttgtctttcactgaataatcctattcggagagcttgcatttcaattgtcgaatggaaaccatttgatatctttatcctgcttgccatctttgccaactgcgtggccttagcaatctatatcccattcccagaagatgacagcaatagcactaaccacaatctcgagaaagtcgagtatgctttccttattatttttacagttgagacctttctcaagatcatagcctatggcctgctgctgcaccccaatgcttacgtgcgcaacggctggaacctgttagattttgtcatcgttatcgtgggactgttttccgtgatactggagcagctgaccaaggagaccgaagggggtaatcattccagtggcaagtccgggggattcgatgtcaaagccctgcgcgctttccgggtgctccggcctcttaggctggtcagcggcgtcccatctctgcaggtggtcctgaatagtatcatcaaagcaatggtgcctctgttgcacatcgcactgttagttctcttcgtgattatcatttatgccataatcgggttggagcttttcatcggaaaaatgcacaagacttgtttctttgcggacagtgatatcgtggcagaggaagaccccgctccctgtgcattctccgggaatggcagacagtgcacagccaacggcactgagtgccgaagcggctgggttgggccaaacgggggaattacaaacttcgataacttcgccttcgcaatgttaacagttttccagtgtatcacaatggagggctggaccgatgttctgtactggatgaacgatgcgatgggctttgagttgccctgggtttacttcgtgtctttggtgattttcgggagtttcttcgtgcttaacttggtgctgggggtgttatctggggaatttagcaaagagcgcgagaaggctaaggccaggggtgatttccagaaattgcgcgaaaaacagcagctcgaagaagacctcaagggttatctagattggataacccaggctgaggatattgacccagaaaacgaagaggagggcggagaagaagggaagcgcaacacctcgatgcctacctccgagactgaaagtgtcaataccgagaatgtctctggggaaggagaaaataggggctgttgcggaagcctgtgccaggctattagtaagtccaagctttccagaaggtggagacgttggaacaggtttaacagacgcaggtgcagagccgcagtgaaatccgtgaccttttactggctcgtaatagtgctcgttttcctgaacactctgacgatctcatctgagcattataatcagccagattggctcacccagattcaggatattgccaacaaagtcctgctggccctttttacctgcgagatgttggtgaagatgtattcgctcggcttgcaggcatactttgtgtccctgtttaatagatttgactgttttgtagtctgtggaggaataaccgagacgattctggtagagctcgaaataatgagcccgctcgggatttctgtgttccggtgtgtcaggctgctgcgaatctttaaggtaacaagacactggaccagcttgtctaacctcgtggcatcactgctcaactctatgaagtctatagcctccctgctgctcttactcttcttgttcatcattatcttttcactcctgggtatgcagctgtttgggggaaagtttaacttcgacgagacccaaaccaagagatctacattcgacaactttccccaggctcttctgaccgtttttcagatcttaaccggagaggactggaacgccgtcatgtacgacggaatcatggcttatggaggtccgtcctccagcggtatgattgtctgcatttacttcatcatactgtttatttgtgggaactatattcttctgaatgtgttcttagccattgcggtcgacaacctggctgacgcggaatcacttaacacagcccagaaggaagaagccgaggaaaaggagaggaagaaaatcgcacgcaaagagtcacttgaaaataagaagaacaataagcctgaggtcaaccagattgctaactcagacaacaaagtgacaatcgacgactatagagaggaggacgaggacaaggatccctatcctccctgtgacgtgcctgtgggggaggaggaggaggaggaggaggaggacgagcctgaagtgcctgcaggtccccgacccagacgaatcagcgaattaaatatgaaagaaaaaatcgctccgattcctgaaggaagcgcctttttcatcttatctaaaactaatcccatccgcgttggatgccataagcttataaaccatcatatttttacgaacctcatactggttttcattatgctttcctctgcagccttagctgctgaagaccccattcgcagtcattctttccgtaacaccatcctgggatattttgattatgccttcaccgctattttcactgtcgaaatcctactgaaaatgaccacttttggcgcattcttacacaaaggcgcattttgcaggaactacttcaaccttctggacatgctggtcgtaggggtctctctagtgtcctttggcatccaatccagtgcaatttctgtggtgaagatccttcgcgtgctgcgagtactgcggccactgagagcgattaatagggcaaaggggctgaagcatgtcgtgcagtgcgtgttcgtggctatcagaaccattggtaatattatgatagtaacaactctgctgcagttcatgttcgcatgtatcggtgttcagctcttcaaaggcaaattttacagatgcactgatgaggcaaaatcaaatccagaggagtgccgcggactgtttatcttgtataaggacggtgacgttgacagtcctgtagtccgcgaacgaatctggcagaatagcgacttcaacttcgataacgtcctgagcgcgatgatggccctgtttactgtttccacctttgaaggttggcctgccctgctgtacaaagcgattgactccaacggggaaaatatcggtcctatttacaatcaccgtgttgagattagtattttcttcataatctacattatcattgtggcgttcttcatgatgaatatttttgtcggttttgtgatcgtgacgttccaggagcagggagagaaagaatacaagaactgcgagttggacaagaaccagaggcagtgcgtggaatatgccctgaaggctaggcctctgcgtcgctatatccccaaaaatccctaccagtacaaattctggtatgtcgtgaactccagccctttcgaatatatgatgtttgtgcttatcatgctgaacactctatgtttggcgatgcagcactacgaacagtcaaaaatgtttaatgatgcaatggatattttgaatatggtgttcactggcgtgttcaccgtagaaatggtgcttaaggtgatcgcattcaagcctaagggatacttctcagacgcctggaacacatttgactcactcatcgtgattggctcgataatcgacgtggctctcagcgaagccgaccctactgaaagtgaaaacgtgcccgtcccaactgcaaccccagggaactctgaggagtcaaatcggatttctatcaccttttttcgtctctttcgcgtcatgaggcttgttaagttgctgtcacgaggcgagggaatccgtacattattatggaccttcattaagtcttttcaagcgctcccatacgtggccctccttatagcgatgctttttttcatttacgccgttatcggaatgcagatgtttggcaaggttgctatgagggacaataatcagataaataggaacaataacttccagacatttccccaggcagtgttgctcctatttagatgtgccaccggcgaagcatggcaggaaatcatgctggcgtgccttcctgggaagctgtgtgaccctgaatctgattacaacccaggggaagagtatacttgcggaagcaacttcgctattgtttactttattagtttttacatgctctgcgcattcctgatcatcaacctcttcgttgctgtcataatggataatttcgattacctgacccgggattggagcatcctcgggccacatcatctagatgaatttaagcgaatttggagtgaatatgacccagaggccaaggggagaatcaagcatctggatgtcgttaccttgttgagacgcattcaaccacccctgggatttggtaagctttgccctcatcgggtggcatgcaaacgcttggtcgcaatgaatatgcccctcaacagcgacggcaccgttatgtttaatgcaaccctgtttgctctggtcagaactgcactgaaaattaagaccgaaggcaatctcgaacaggccaacgaagagctaagagcagttattaagaagatatggaaaaaaacgagcatgaagttgcttgatcaggtcgtgccacctgccggtgacgatgaagtcacggtcggaaagttctacgctaccttcctcatccaggactactttcggaagttcaagaaacggaaagaacagggtctggtcggaaaatatccagccaaaaacaccactattgctttacaagctggcctgcgcacgctacatgacataggccctgagattagacgggcaattagctgtgacctgcaagatgacgaacctgaggagaccaaacgtgaggaggaggatgacgtcttcaaacgcaacggcgctctcctgggcaatcatgtaaatcacgtgaactccgatagacgtgatagtttacagcaaaccaatacaacccaccggccacttcacgtccaaaggccttcgatccctccagcttctgatactgaaaagcctttgtttccaccagccggtaactctgtgtgccacaaccatcacaatcacaattccattggaaagcaggtgccaacctcgactaacgctaatcttaataacgcaaatatgtctaaggccgctcatgggaagcgcccttctataggtaacttggagcacgtctctgagaatgggcatcatagttctcataaacacgaccgcgaaccccaacggcgaagtagtgtcaaaagaacacggtattacgagacgtacatccgctctgacagcggcgacgaacaattgcccactatatgcagggaagaccctgaaatccacgggtacttccgggacccccattgcctaggagaacaagagtattttagcagtgaagagtgttatgaggacgactcatctcccacctggtctcgacagaattacggttattattctcgctacccaggcaggaacattgactccgaaagacctcggggttaccatcacccacaggggttcctggaggatgatgattcccctgtgtgctacgattcccgccgatcccccagaagacggctgctccccccaacacctgccagccaccgtcggtcgagtttcaacttcgagtgtctcagaagacaatccagtcaggaggaggtgccttcttcaccaattttcccacaccggacagcgctgcctctccatttaatgcaacagcagattatggcagtggccggtctggatagcagtaaagcccaaaaatattctccgtcacacagcactcggagttgggccacccccccagctacccctccatacagggactggacaccatgctacactcccctcatccaagttgaacaatcagaggccttggaccaggtcaacggttcactccctagcttacaccgaagttcctggtatacggacgagcccgatatcagctaccgtaccttcactcccgcttcccttacggtcccctcgtctttcagaaataaaaattccgacaagcagcggagcgccgacagcctggtggaagccgtgttgatttctgagggtctgggtaggtatgccagggatccaaagttcgtgtcagctacgaagcacgaaatcgctgacgcttgcgatctgaccatagacgagatggagtccgccgcaagtactctcctgaatgggaacgtccggccacgcgcaaatggcgatgtgggacccctgtcccaccggcaggactacgagttgcaggatttcgggcctggttattctgatgaggagcctgatccaggacgggacgaggaggacctggctgatgagatgatttgtattaccaccctata

SEQ ID NO: 216632 - DNA, 6413 bp, Artificial Sequence
  Description of Artificial Sequence: Synthetic coding sequence
atgatgatgatgatgatgatgaaaaaaatgcagcatcagcggcaacagcaggccgaccacgccaatgaggcaaactacgctagaggaacccgattgcccttgtccggggagggccctaccagtcaacccaattccagcaagcagactgtgctgtcttggcaagcagcaattgatgctgctaggcaggccaaagccgctcaaactatgagtaccagcgcaccaccacccgtgggcagcctctcgcaacgcaagaggcagcagtacgcgaaaagtaaaaaacaggggaactccagtaattccaggcccgcacgtgccctattttgcttaagccttaataatcccatccgaagggcctgtattagcatagtggagtggaaaccttttgacatcttcatcttgcttgcaatattcgcaaattgtgtcgctctcgcaatctatataccattccccgaggatgactcaaactctaccaatcataacctcgagaaggttgagtacgcattcctaattatcttcaccgttgagacatttctgaagataattgcatatggactgttgctccaccccaacgcttacgtgcgcaacgggtggaacctcctggactttgtcattgtcatcgtgggccttttttcggtaatattggaacagcttacaaaagagacggaagggggaaaccattcgtcgggcaaaagcggcggatttgatgtcaaggcgctgcgcgcttttagagtgctgcgacccttacgattagtgagtggtgtaccatccctgcaggtggtcctgaactccatcattaaggctatggtccccctccttcacattgccctcctggtgctctttgtgatcattatctatgctattatcggcctcgagctattcataggaaaaatgcataagacgtgcttctttgccgactcagatatcgtggcggaggaggacccagccccatgcgcctttagcggaaacggcagacagtgcactgcaaatgggacggaatgcaggtcgggctgggttggccctaatgggggtatcaccaacttcgataacttcgcatttgccatgctcactgtcttccagtgtatcaccatggaaggttggaccgatgttctgtattggatgaatgacgccatggggtttgagctgccgtgggtgtatttcgtcagcctggtgatatttggctccttttttgtgctcaacctggtcctgggggtgctgtcaggggagttcagcaaagaacgagagaaggcgaaagccaggggagattttcaaaaactgcgggagaagcagcagctggaagaggatctgaagggctatctagactggataacccaggccgaagatattgacccagagaacgaagaagagggaggagaagaaggaaagcggaatacaagtatgccaacgagtgaaacggagtccgtcaacactgagaatgtgagcggagagggagaaaatagaggttgttgcgggagcttgtgccaggccatctccaagtccaagctgagcaggaggtggagaagatggaacaggtttaaccgcagacgctgccgggctgccgttaagtcggtgacattttactggttagttattgtcctcgtgtttctcaacactcttaccatctcatctgaacactacaaccaaccagattggctaactcagattcaggacattgctaataaggtcctcctggcactgttcacttgtgagatgttggtgaagatgtacagtttggggctgcaggcctattttgtctccttgtttaatagatttgactgttttgtggtctgtggcggaatcactgaaaccatactcgttgaactggagataatgagccccttgggcatatccgtatttcggtgtgtgcggcttctacgcatcttcaaagtgacaaggcattggaccagcctgagtaaccttgtggcttcacttttaaactctatgaagtctatcgcttcactgctgctgttactgttccttttcatcataattttctccctactgggtatgcaactgtttggcggaaagtttaattttgatgagactcaaaccaagcgcagcacatttgataatttcccacaggctttgctgacagtgtttcagatcctaactggagaggattggaacgctgtcatgtacgatggcataatggcttacgggggtccttctagctccggcatgatcgtctgcatatatttcattatcctgttcatctgtgggaactatatcctgttgaacgtctttctggctatagccgtagacaacttggccgatgctgagagcctcaatactgcccagaaggaggaagctgaggagaaggagagaaaaaagattgctcgtaaggagtccttggaaaacaagaaaaacaataaacctgaagtgaaccagattgcgaactcagataacaaggtgacaattgacgattatagggaagaggacgaagacaaagatccctatcccccttgcgacgttccagttggagaggaggaagaggaggaagaggaggatgagcctgaggttcccgctgggcctaggccccgaaggatcagcgaacttaacatgaaagagaagattgcaccaatcccagaaggatcagctttttttattttaagcaagacaaacccaatcagggtgggatgtcacaagctgatcaatcaccatatctttaccaaccttattctagtatttatcatgctctcatcagctgccctcgcagcggaggaccctatccgatctcattccttcagaaatactatcttgggttattttgactacgctttcactgctatatttactgttgagatactactgaaaatgactacattcggcgctttcctgcacaagggtgccttctgcaggaactattttaacttgcttgacatgttagttgtgggtgtaagtcttgtgagtttcggtatccagagcagtgcaatctcggtggtcaaaatcctccgcgtcctgagagtcctccgtcccctgcgcgctatcaatcgggctaaaggtctgaaacacgtggtccaatgcgtattcgtggccattcgcacaatcggtaacatcatgattgtcacaaccctcctacagtttatgtttgcctgcatcggggttcaattgttcaagggtaagttttaccgctgcactgatgaggctaaatctaaccctgaggagtgccgaggcttgtttatcttatacaaggatggcgacgtcgactccccagtggtccgcgagagaatttggcagaactcggattttaacttcgacaacgtattaagcgcaatgatggcattattcacagttagcactttcgagggatggcccgcactgttatataaggcgattgacagcaatggagaaaatatcggtcccatttacaaccatagggtagaaattagcattttttttataatctacatcatcattgtcgcatttttcatgatgaatatcttcgttgggttcgtgatcgtgacgtttcaggagcagggcgagaaggaatacaaaaattgtgaactcgacaaaaaccagcggcagtgtgttgaatacgcgctgaaggcaagaccactccgtcgttacatccccaaaaatccttaccagtacaaattctggtacgtagttaactcatctcctttcgagtatatgatgtttgtcctgatcatgctgaacaccctgtgcctggcgatgcagcactatgagcagagcaaaatgtttaatgatgctatggacatcttgaatatggtgtttacgggtgtctttactgtcgagatggtgctcaaagtgattgcttttaaacctaaaggatacttctccgatgcctggaatacgtttgatagcctgatagtgatcgggtctatcatagacgtcgccctgtctgaggcagacaatagtgaagagagtaaccgaatttccattacgtttttcaggctgttcagggtgatgaggctggtgaaactactctcaaggggggagggcattcggacattgttgtggacctttattaagagcttccaagcgctgccctacgtagctttgttgattgccatgctcttctttatctacgcagtgattggtatgcagatgtttggcaaagttgctatgcgcgacaacaaccagatcaaccgcaacaataacttccagacgttccctcaggccgtacttctgctgtttcggtgcgctaccggggaagcatggcaggagattatgctggcatgtctgcccggaaaactctgcgatcccgaatcagattacaatccaggggaggagtatacctgtggctcaaactttgccattgtctacttcataagtttttacatgttatgcgcctttctgattatcaatctgttcgtggccgtcatcatggataacttcgattatctgacccgggactggagcattctgggtccccaccacctggacgagtttaagcggatttggagcgaatatgatccagaagcaaagggtcgcatcaaacacttagacgtggtcacattactgcgaagaattcaacctcccctgggttttggcaagctgtgcccccatcgcgtagcctgcaaacgcctcgtagccatgaatatgccactgaacagcgatggaaccgtcatgtttaatgctacgctctttgctcttgtgagaacggccctgaagataaagacagaaggtaacttagagcaggctaatgaggagctgcgggctgttattaagaagatttggaagaagacaagtatgaagctcctcgatcaggtggtaccaccagcaggggacgacgaggttaccgtgggaaaattctatgcaacttttctcatccaagactatttccgcaaattcaagaaaaggaaagagcaaggactcgtggggaagtaccctgccaaaaataccaccatagccttgcaggctggactcagaacactccacgatatcggccctgaaataagacgggcaatttcctgtgatctccaggacgatgaacccgaggagaccaagagggaagaagaagacgatgtcttcaagcgtaacggggctttgctcggcaatcatgtgaatcatgttaattcagacagacgggacagtctgcagcagacaaacacaacacacagacctcttcatgtgcagaggccctctatcccgcctgccagcgataccgagaaacccctgttcccaccagccggaaactccgtgtgccataatcaccacaaccataactccatcggtaagcaggtgccgacatctaccaatgcaaatctcaacaatgcaaatatgtcaaaggcagcccatggaaagcgccctagcatcggtaatctagaacacgtgtctgagaacggccatcacagcagtcataagcacgacagggagccccagaggaggagttctgtcaaacggtcagattctggcgacgagcaactgccgacaatctgccgcgaagacccagagattcacgggtacttcagggacccacactgcctgggtgaacaggagtacttctcttccgaagaatgctatgaggacgacagctctccaacatggagtcgccaaaactatggctattacagccgatatccaggcaggaatatcgattcagagcggcctagaggctatcatcacccccaggggttcctcgaagacgatgacagtccagtgtgctatgacagccgtcggtcacccagacggagactgttacccccaacccctgcttcccaccgcagatcgtcgtttaacttcgagtgtctgcgcaggcagtcttctcaggaggaagttccatcttcccccatatttccacatcgaacagcacttcctctacacttgatgcagcagcagatcatggcagtcgcgggactggactcttcaaaggctcagaaatattccccctctcattcaacacgttcctgggccacgccacctgcaacaccaccctaccgagactggaccccatgctacactccactgatccaggtggagcagagcgaggcacttgatcaggtaaatgggtctctgccaagtctgcaccggagcagctggtataccgatgaacccgatatctcatatagaacctttaccccggctagcctcacggtgccctccagctttcgtaataagaatagtgataagcagcggagcgctgacagcctcgtcgaagcagttctcatttccgagggcctggggaggtacgcccgtgaccctaagtttgtgagcgcaactaagcacgagatcgcggacgcatgcgacctgacgatcgatgagatggaatcagcagccagcaccttactgaatggcaatgttcggcctcgggctaacggggacgttgggcctctatcccaccgacaggattacgaactccaggattttggacccggatactcagacgaagaacctgaccctgggagagatgaagaggatcttgctgacgagatgatttgtatcactaccctata

SEQ ID NO: 216633 - DNA, 5564 bp, Artificial Sequence
  Description of Artificial Sequence: Synthetic coding sequence
gccaacggcaccgaatgtcggagcggctgggttggacctaatgggggaatcactaacttcgacaactttgcctttgcaatgctgaccgtgtttcaatgcattacaatggaggggtggaccgacgtgctttactggatgaacgatgcgatggggttcgaactcccttgggtctactttgtctcgctggtgatttttggctcatttttcgtgctgaacctcgtgcttggcgtcctgtcaggcgagtttagcaaagagcgggaaaaggccaaagctagaggtgatttccagaagttaagggagaagcagcagttagaagaggacttgaagggctatttagactggatcacgcaggccgaggacatcgaccccgagaatgaggaggagggcggagaagaggggaaaaggaacacctcaatgccaacaagcgagaccgagtccgtgaacacagagaacgtgtccggggaaggggagaaccggggatgctgtgggagcctctggtgttggtggcggaggagaggagctgcgaaggctggccctagcggatgtcgaaggtggggccaagccatctccaaatcaaaactatcgcgcagatggcgaaggtggaatcggttcaaccgtcgaagatgccgggcagcagtgaaatccgttacattttactggttagtgatcgtgcttgtgttcctgaatactcttactatctcaagcgaacactataatcagccagattggcttacccaaattcaggacatcgctaacaaggtattgcttgcactcttcacctgtgaaatgctggttaaaatgtatagtctcggattacaggcctatttcgtgtcactgtttaatcgcttcgattgcttcgtcgtatgcggtggaatcacagagacaattctagttgagcttgagattatgtcccccctgggcataagcgtattcagatgtgtcaggctgttgcggatttttaaggtgacacgccactggactagcctatccaaccttgtggcctctcttctgaactccatgaagtcgatcgctagcctgctacttctgctcttcttattcatcatcatttttagtttgctgggcatgcaactgttcgggggtaagtttaatttcgatgagacccaaaccaaacgctccaccttcgataatttcccccaggctctactgacagtgttccagattttaactggcgaggattggaacgctgttatgtatgacggtattatggcttacggcggacctagcagtagcggcatgatcgtgtgcatctacttcattattctcttcatctgcggtaactatatattgctgaatgtgttcctggcaattgctgtcgacaacctggccgatgctgagagcctgaatactgcccaaaaggaagaagcagaagagaaagagcgaaagaaaattgcccgtaaggaatccttggagaacaagaagaacaataagccagaagtcaaccagatcgccaattctgacaacaaagtcactatcgatgattatcgcgaagaggacgaggacaaggacccatatccaccttgcgacgttcccgtgggagaggaagaagaggaagaagaggaagatgagcccgaagtgcccgcaggccctaggcctaggcgcattagtgaactcaacatgaaggaaaagatcgctcccattcctgagggcagtgccttcttcattctctccaagactaacccaattagggtgggatgtcataagcttatcaatcatcacatattcactaacctaattctcgtgttcattatgctgagtagcgctgcactggcggcagaagacccgattaggtcacatagctttaggaataccattctgggctacttcgattacgcctttacagccatttttaccgtggagatcctgctgaagatgaccacatttggcgcatttttgcataaaggcgcattctgccggaattattttaacctgctggatatgctggtcgttggagtttcactggtgtctttcggcattcaatccagcgcgatttccgtagtgaagatcttaagggtcctcagggtcctgagacctctcagagccatcaaccgcgctaaggggctgaaacatgtcgtgcagtgtgtgttcgtggccataagaactataggcaacatcatgatcgtaactactctgctgcagttcatgtttgcatgtatcggggttcagttatttaagggaaagttttaccgctgcacagatgaggccaaatcaaaccccgaggagtgcaggggactctttatcctctacaaagatggggatgtggactcaccagtcgtgagagagcgcatttggcagaatagcgacttcaacttcgataatgtcttgagcgcaatgatggctctgttcactgtgagtactttcgagggttggcccgctctcctttataaggccatcgacagtaacggcgagaacattggacccatctacaatcacagggtggagatcagcattttcttcatcatatatattattattgttgcgtttttcatgatgaatatctttgtgggcttcgttatcgtcacattccaggagcagggcgagaaggagtataagaattgcgaactggacaagaatcagcgccagtgcgttgaatacgcccttaaagctcggccactgagacgctacattcctaagaatccctatcaatataaattctggtatgtggttaactccagtcccttcgagtatatgatgtttgtgttgatcatgctgaataccttgtgtcttgccatgcaacattatgaacagagcaaaatgttcaatgacgccatggatatactcaatatggtgtttaccggcgtgtttacggtcgaaatggtgctgaaggtcattgcttttaaaccaaaacattattttactgacgcttggaatacgtttgatgcccttatagtggtaggatctgtggtagacatcgcgattacggaggtaaaccctaccgagagtgaaaatgtgcctgtgccaacggcgacccctggaaacagtgaagagagtaacaggatcagtatcaccttcttcaggctctttcgggttatgcgtctggttaaacttctcagtcgtggcgaaggcataaggacgctgctgtggacgttcatcaaaagttttcaggcactgccgtacgtagccttgctgattgccatgctcttttttatctatgccgtcattggaatgcagatgttcgggaaagtggcaatgcgcgacaacaatcaaatcaaccgtaacaacaactttcagacttttccgcaggccgttctcctgctattccggtgtgccacgggcgaggcctggcaagaaattatgcttgcatgcctcccaggcaagctgtgtgacccagaatcagactataaccccggagaagagtacacctgcggttcgaatttcgcgattgtctatttcatttcattttacatgctgtgtgcctttctaatcattaatcttttcgttgccgtcattatggacaacttcgactacctcacacgtgattggagtattctgggcccacaccatctggacgagttcaaaagaatttggtccgaatacgatccagaggcaaaaggccgaatcaaacacctggatgttgtgacacttctgcggaggatccagccgcctctcggctttgggaagctctgtccacacagagtagcgtgtaaacgtcttgttgccatgaatatgcctctcaactcagacggtacagtgatgttcaacgccacgctctttgcactggtcagaactgcgctgaagatcaaaacagaaggaaaccttgagcaggctaatgaagagttacgagctgtgatcaaaaagatttggaagaagaccagtatgaagctactggaccaagtcgttccccctgctggggatgatgaagttacagtcggcaagttttatgcaacattcctgatccaggactatttccggaagtttaaaaaaaggaaggaacaagggctggtagggaaatacccagccaagaacactactatcgcgctgcaagccggtcttcgcactctgcatgacattgggcctgagatcaggagagccataagttgcgacttacaagacgatgaacctgaggagactaagcgggaagaagaagatgacgttttcaagcggaatggtgctctgctgggaaaccacgtaaatcacgtaaactccgacaggcgggactcactgcagcagacgaacaccacacacaggcctctgcatgtacagagaccgtccatcccaccagccagtgacacagaaaagcctctgtttcctccagccggtaatagcgtgtgtcacaaccatcacaaccacaacagtatcggtaagcaggtgcctacctcgaccaacgccaacctcaataacgctaatatgtctaaggccgctcacgggaagcgaccctcaattggaaaccttgagcatgtgtctgaaaatggtcatcactcttcacataagcacgatcgggaacctcagagacgaagctcagtcaagcggacccgctattatgaaacttacataaggagcgacagtggagacgagcagctgcctactatttgtcgcgaggatcccgagattcatggctatttccgagaccctcattgcctgggagaacaggagtatttctcgtccgaagagtgctacgaggatgattcctcgcccacatggagccggcagaattatggctactacagtcggtacccagggaggaacattgattccgagcggccacggggataccaccatcctcaggggttcctggaggacgatgattctccagtgtgttatgacagtcgtagaagtccccgaagacgacttctgcctcccactccagcatctcaccgtcgctcgagtttcaatttcgagtgtcttagaaggcagtcctcccaggaagaagtcccatcaagccccatttttccccaccgcaccgcactgcctctgcacctgatgcagcagcaaatcatggccgtggccggtcttgactcgtctaaggcgcagaagtactctccctcgcattccacccggagttgggctactccacccgcaacccctccctatagggactggactccttgttacacacctctgattcaggtggaacagtcagaggctctggatcaagtaaatggatctctccccagtcttcaccggagctcttggtacactgacgaacctgatatatcgtatcgcaccttcactcctgcatcccttacagtgccctcgtctttcagaaataaaaattctgacaaacagaggagtgcagactctctggtcgaagcagtccttatatcagagggcttgggcagatatgctcgggaccccaaatttgtaagcgccactaaacatgagattgctgatgcctgcgacctgacgattgacgaaatggaatccgctgcatctactcttttgaatggaaatgtgcgccctcgggcaaatggagacgtaggacctttgagccaccgtcaagactacgaacttcaggactttggtcccggttacagtgatgaggaaccagaccccggacgtgacgaggaggatctcgctgacgaaatgatttgtattaccacacttta

SEQ ID NO: 216634 - DNA, 1620 bp, Artificial Sequence
  Description of Artificial Sequence: Synthetic coding sequence
atgggggaaacctggttgtgtccggcagctctgggactgctctataaagcaattgattcaaacggagagaatattggccctatttacaatcacagagtggagataagcatcttttttatcatttacataatcatagtggcgttcttcatgatgaacatctttgtgggctttgtcatcgtgacgttccaagagcagggtgaaaaagagtacaaaaattgcgagctcgacaagaaccagcgacagtgtgtcgagtatgcacttaaggccaggccgctcaggcgttacattcccaagaacccatatcagtacaaattctggtatgtggtaaattcatccccatttgaatacatgatgtttgtcctcattatgctgaacactttgtgcctcgctatgcagcactacgagcagtctaagatgttcaacgatgcaatggacattttaaatatggtttttaccggtgtgtttactgttgagatggtgttgaaggtcatagcctttaaacctaaggggtacttctccgacgcctggaataccttcgactcactgattgttataggctccattatcgatgtcgccctgagtgaagcagacaactccgaagagagcaacagaatctcaataacctttttccggctctttcgcgttatgaggttggtgaagctgttgtccagaggcgagggcattcgtaccctgctctggacattcataaagagctttcaagccctgccatatgtggccttacttatagctatgttattcttcatttacgctgtgataggcatgcaaatgtttgggaaagtggccatgagggacaacaatcagataaaccggaacaacaactttcagaccttcccccaggcagtgttactgctttttagatgcgcaaccggcgaggcctggcaggagatcatgttggcgtgtctcccgggaaaactgtgtgacccggagtcggactataatccaggggaggagtacacgtgtgggtcaaattttgcaatcgtatacttcatatcattctatatgctgtgcgctttcctgattataaacctgtttgtagccgttatcatggacaactttgattaccttacccgtgattggagtattctgggccctcatcacctcgacgaattcaagcggatttggagtgagtacgatcccgaagcgaagggacggattaaacacctcgatgtagtcacactgctcaggcgcatccagccgccattgggctttggcaaattatgcccgcatagggtcgcttgtaagagactggtggcgatgaatatgcctctgaattccgatggaaccgtaatgtttaatgctaccctgttcgcgttagtaaggactgctctaaagatcaaaacagagggtaatctggagcaggccaatgaagaactgcgcgcagtgatcaaaaaaatctggaaaaagacatccatgaagttgctcgaccaagtggtcccaccagccggtgacgacgaggtgacagtggggaagttttatgctacctttctcatacaggattattttcggaaattcaagaaacggaaggagcaaggcctggttggaaagtacccagctaagaatacaactattgcattgcagatgctggagcggatgttgtag

SEQ ID NO: 216635 - DNA, 1056 bp, Artificial Sequence
  Description of Artificial Sequence: Synthetic coding sequence
atgaacgggcttgctcagtctagattagagacttgcatctcatacctgcactgttactctgccggactgcggactctgcacgatatcggacccgaaatccgtagagctatctcttgcgacttacaggatgatgaacccgaggaaactaagagagaggaagaggacgatgtattcaagcggaacggcgctctgctgggtaatcacgtcaatcatgtaaactctgaccgccgtgactctctgcaacagaccaatactacacatagacctttgcacgtgcaaaggccctccatccctcccgctagcgacaccgagaagcccctattccctcccgctggcaactcagtgtgccacaaccaccacaaccataactccattgggaagcaggtgcccaccagcacgaacgctaatctcaacaatgcgaacatgtctaaagctgcccacggaaagcgcccatccataggcaatctcgagcacgtgtccgaaaacgggcatcattcctctcacaagcatgatcgtgagcctcagagacggagctccgttaaaagaactaggtattatgaaacctacattcgctcagattccggggatgagcaactgcctacaatatgcagggaagacccagagatccacggctactttcgggatccccactgtctcggcgagcaggaatatttttcctccgaagaatgctacgaggacgactcctcccccacctggagtcggcagaactatggttactactccagatacccagggaggaacattgacagtgagcgtccaagaggatatcaccaccctcaaggcttcctggaagacgatgactcccccgtttgttacgacagtaggaggagcccccgtagaagactgctgcctccaacaccagcttctcatagacgttccagctttaactttgagtgtcttcgtcgtcagtcttcccaagaggaggtgccgtcctcccccatcttcccacacaggacagcgctgccgctgcatctgatgcaacagcagtcaccactgtctagtgatcatggtagttgtcgccctcgtttcaaatag

SEQ ID NO: 216636 - DNA, 5900 bp, Artificial Sequence
  Description of Artificial Sequence: Synthetic coding sequence
atgagtgaatccgaggggggtaaagatacgacgcctgagccttctcctgcaaatggtgcgggtcctggcccagagtggggtctctgccccggaccacctgctgttgaaggcgaatcgtccggggcatcaggacttggcacgccgaagcggagaaatcagcattccaagcataagacagtagcggtcgcatctgcacagagaagcccaagagctctgttctgcctgacgttagccaatcctctccgaagatcttgtatctctattgttgaatggaagccctttgacatcctgattctgcttaccattttcgccaattgcgttgctctgggcgtgtacattcccttccccgaagatgacagcaatacggcaaatcataacttagagcaggtcgaatacgtttttctggttattttcacggtcgagacagtcctgaaaattgtcgcgtatgggcttgtgcttcatccatcagcatatattcgcaacggatggaatctgctggattttattatcgtggtggtggggctcttctcagtcctgctggagcagggacctggaaggccgggtgacgcacctcatacaggcggaaaacccggagggtttgacgttaaagccctgcgagcatttcgcgtgctccggcctctccgcctggtgagcggtgtgccctctttacatatcgtcttgaactcaataatgaaggccttggtgccgttacttcacatcgcactgctcgtcctattcgtcatcataatctacgccattattggacttgagctctttctgggtaggatgcacaagacttgttatttcctggggagcgacatggaagctgaagaggacccgagtccctgtgcctcaagcggaagtggcagagcatgcaccctcaaccaaacagaatgccggggtagatggccgggtccaaacggtgggatcaccaactttgacaatttctttttcgccatgctcaccgtatttcagtgcgttaccatggaagggtggactgatgtgctgtactggatgcaggatgccatgggctacgaactcccctgggtgtatttcgtgtccttggtgatttttggcagctttttcgtcttgaacctggtgctgggagttctgtcaggggagtttagcaaagagcgggaaaaggccaaagccaggggtgattttcagaagcagagggagaagcagcagatggaagaggacctcagaggctacctggattggatcacccaggcggaggaacttgatatggaggacccttccgctgatgacaatctgggaccacagctggcagagctcactaacagaaggcgcggtcgccttagatggttctctcactctacacgctccacgcatagcacctcatctcacgccagtctgcccgcatcagacaccggcagtatgacagagactcaaggagacgaggacgaagaggaaggggctctggcctcttgcacaagatgcctgaacaagatcatgaaaacccgcgtgtgccgcaggctgcgccgagcaaaccgtgtgctcagagcaagatgccgacgtgccgtgaagagtaacgcatgttactgggccgtgctgctgctggtgttcctcaacactcttacaattgcttccgaacaccacggccagccggtctggcttacccagatccaggaatatgccaacaaagtcttgctgtgcttattcaccgttgaaatgctgctgaaactctacggcttaggcccttccgcgtacgtgtcgtccttttttaacagattcgactgtttcgtagtgtgtggagggatcctagagacgactttagtggaagtgggcgcaatgcagcccttaggaatcagcgtgctgaggtgcgttagactgctgcgaatctttaaagtgacgcggcactgggcaagtctcagtaatctcgtcgctagcctgctgaactctatgaaaagcatagctagcttgcttctgttgctgttcctctttataattatattcagtctactggggatgcagctttttggagggaagttcaatttcgaccagacgcacacaaaaagaagtacttttgacacttttccgcaagctctgctaacggtgtttcagatcttgaccggtgaagattggaatgtggtgatgtatgacggaattatggcttacgggggtcctttctttcccggtatgcttgtgtgcatttacttcatcatccttttcatttgtgggaactacatcctgctcaacgtatttctggccattgccgtggacaacctggcgagcggggatgccggaaccgctaaggacaaaggaggtgaaaagagtaacgaaaaggacctgcctcaggagaacgagggacttgtcccgggagtggagaaggaggaagaggagggagccaggagagagggggcagacatggaagaggaagaagaagaggaggaggaggaggaggaggaagaggaggaggaaggcgctgggggagtggagctcttgcaggaggtggtgccaaaggaaaaagttgtgccaatccccgaagggtccgccttcttttgtctgtcacagaccaatcccctgcggaaaggatgtcatactctcattcaccaccatgtgttcaccaatctcatccttgtgttcattattcttagtagcgtcagcctggccgctgaagaccccatacgcgctcacagctttcgtaatcacatcctggggtatttcgattacgcctttacatccattttcaccgttgaaattctgctgaaaatgaccgtattcggcgcattcctgcatcgaggttcattctgtagaagctggttcaatatgcttgacctgctagtcgtatccgtaagcctcatttcatttggcatacacagttcagcaatcagtgtcgtcaaaatacttcgggtgctgcgcgtactgaggcccctgcgcgctattaatagagccaaaggcctcaagcatgtcgtgcagtgcgttttcgtggccatcaggacgataggcaacataatgatcgtgaccaccctgctccaattcatgtttgcatgtattggcgtgcagctcttcaaaggaaaattttacacatgcaccgacgaagccaagcatacaccgcaggagtgtaagggaagtttcctggtctatcccgacggtgatgtctctaggccactggtccgagaaagattatgggttaatagtgattttaacttcgataacgtcctgagcgctatgatggccctatttaccgtttctaccttcgaaggctggccagccttgttgtataaggccatcgacgcttatgcagaggaccacgggcctatctataattatagagtcgagatttccgtgttcttcatagtctacataatcatcatcgctttctttatgatgaacattttcgtcggatttgtgattattacatttagggctcaaggcgagcaagaatatcagaactgtgagctggataagaatcagagacagtgcgtggagtatgccctcaaggcccagccattgcgcaggtacatccctaaaaatccacatcagtacagagtgtgggcaacagtgaactctgctgccttcgagtacctgatgttcctgctgatcctcctgaataccgtggcccttgcaatgcagcattacgagcagaccgccccttttaactacgctatggacatcctgaacatggtgttcacaggtctttttaccatagagatggtcctgaaaatcatcgcctttaaaccaaagcattattttacagatgcctggaacacctttgacgccctgattgtggttggcagtattgttgacatcgctgtgaccgaggtcaataacggtggtcatttgggcgagtcttccgaggattcctcgaggatatcaatcacctttttcaggctgtttcgtgttatgaggttggtcaagctgctgtcaaagggcgaaggcataaggaccctcctctggacatttattaagtcctttcaggctctgccttacgtggctctgttgatcgccatgattttctttatttatgcagtgattggcatgcagatgttcggcaaggtcgccctgcaggatggaacgcagatcaaccggaataataacttccagaccttcccacaggccgtgttgttgctgtttaggtgcgccactggagaagcatggcaagaaatcatgcttgctagtctcccaggaaatagatgtgaccccgaaagcgactttgggcctggcgaagagttcacgtgtggttctaacttcgctatcgcatacttcatcagctttttcatgttgtgcgccttcctcatcataaatctgttcgtggccgttatcatggataacttcgactacctgacgagggactggtcaattctgggtccacaccaccttgacgaattcaaaagaatatggtctgagtatgatcccggagcaaaaggcagaatcaagcatttagacgtggtggcccttttgcggaggatccaaccacctttgggctttggaaagctgtgcccacatagagtggcatgcaagaggcttgtcgccatgaacatgcccctgaatagcgatggaaccgtgacgtttaacgcaaccctctttgctctcgtgcgcactagcctgaagatcaaaacggaggggaatctggaacaggcgaaccaggaacttcgaatcgtcatcaagaagatctggaagcgcatgaaacagaagcttctcgacgaggtgatccctccacccgacgaagaagaggtgacagttggtaaattttatgccacctttctgatccaggattattttcggaaattcagaagacggaaagagaaaggcctcttggggaacgacgccgctccaagtacttctagtgctcttcaggctggtctccgctcactgcaagacctcggccctgagatgcgccaagcactcacctgcgacaccgaggaagaggaagaggaaggccaagaaggagttgaggaagaggacgaaaaagatctggaaaccaataaagccaccatggtctcccagccatccgcacgcagagggtccgggatcagtgtatcactccccgttggtgaccggctgcctgactccctcagttttgggccttctgatgacgatcgcggtacccctacctcgagccaaccgagcgtccctcaggccggttccaacacccataggcgcggaagcggggcactgatattcaccatccctgaggagggtaattcccagcccaagggcacaaaagggcagaataaacaggatgaggacgaggaagttcctgataggctaagctatttggacgagcaggccggaactcctccctgctccgtcctgctgcctccacaccgggcacaaagatatatggatggacatttagtccccagaaggcggctgctgcccccaactcctgccggtagaaagcctagttttactattcaatgcctccagcgccagggttcctgtgaagatctgcctattccaggcacctatcatcggggacggaactctggcccaaatagggctcaggggtcatgggcaactccgcctcaacgcggtcgcttgctttatgctccattattgttggtggaggagggtgcagctggcgaagggtacctcggacgtagttcaggcccacttcggacttttacatgtcttcatgtaccagggacacactcagacccaagtcacggtaagagagggtcggctgactccctggtggaagccgtgctcatcagtgagggcctaggtctcttcgccagagatcctcgcttcgtggcccttgcaaaacaggaaattgcagacgcctgtagattaaccctcgacgagatggataatgctgcaagtgacctgctggcccagggcacctcctccttgtattctgatgaagaaagcattttatctaggttcgacgaggaggacttgggcgatgaaatggcatgtgtgcacgctttgta

SEQ ID NO: 216637 - DNA, 5738 bp, Artificial Sequence
  Description of Artificial Sequence: Synthetic coding sequence
atgtccgaatccgagggcggtaagggtgaacgtatcctcccctccctccagactctcggggcttctattgttgaatggaagccatttgacattctcatcctgctaacaatcttcgcgaactgcgtcgccctcggcgtatacattccatttccagaagacgactccaacaccgcgaaccacaatctcgagcaggttgaatatgtcttccttgtaatttttaccgtggagaccgtgctgaaaatcgttgcctacggcttggtgcttcacccctccgcttatatcagaaacggatggaatctgttagattttatcatcgttgtagtgggtctcttctcagttctgcttgagcagggaccgggacggcctggagatgcaccccacactggtggtaaaccagggggttttgacgtgaaagcgctccgggcattcagagtgttgcgccctttacgtctggtttctggcgtgccaagtctgcatatcgtgctgaactccattatgaaagctctcgtgcctcttctgcatatcgcccttctggtgctgttcgtgatcattatttacgcaatcattgggttggaactcttccttggtaggatgcacaaaacttgctactttctcggctcggatatggaagcggaagaagatccgtcaccatgcgcctcatccggaagcggcagggcgtgtaccttgaaccagacagaatgtcgagggaggtggcccggacctaatggcggaattaccaactttgataatttcttttttgccatgttaacagtgttccaatgtgtgacaatggagggatggaccgacgtcctctactggatgcaagacgccatggggtacgagctgccctgggtgtactttgtgagccttgttattttcgggagctttttcgtgctaaacctagtgctcggtgtgctttctggggagtttagtaaagagagggagaaagcaaaagccagaggcgactttcagaagcagcgagaaaagcaacagatggaggaagacctgcggggttatctagactggatcactcaggcagaggagcttgatatggaggatccatcggcagatgataacttgggatctatggcagaagagggccgagctggacatagaccacagctggctgaactcaccaacagacggagaggcaggctgaggtggttttctcattctactagatcaactcactctacgtcctctcacgcatctttgccagcctctgataccggttctatgaccgagacccaaggcgatgaggatgaagaggagggggctttggcatcatgcacccggtgtctgaataaaataatgaaaactagggtttgtcgcagactgagacgggcaaaccgcgtgctgcgagctcggtgccgacgcgctgttaaaagcaacgcatgttactgggccgttctgctgctagtgtttctgaataccctgactattgctagcgagcatcacgggcagcctgtttggcttacacagattcaggaatacgccaacaaagttctactttgtctgtttactgtggagatgttgctcaaactgtacggcctcggaccatctgcttacgtgtcttcattttttaaccgtttcgactgtttcgtggtctgcggtgggatacttgagactaccctcgtagaagtcggagcaatgcagccccttggaatttccgtgctgaggtgcgttagactcctgaggatctttaaggtcacaagacattgggcatccctcagtaatctcgtggcctctctattgaacagcatgaagtctattgccagcctcctgttgctgctgtttctcttcatcatcatcttcagcctgctgggtatgcagctgtttggaggcaagttcaattttgaccaaacccacaccaaaagatctaccttcgacaccttcccacaggcgctactgacggtgttccagatcctgacaggtgaagattggaatgtggtaatgtatgatggaattatggcttacggcggaccctttttcccgggtatgctggtatgtatctacttcatcatactttttatctgcggtaactatattctgctgaacgtgttccttgccatcgcagtggacaacttggccagcggtgacgcagggacagcaaaagataagggaggcgaaaagtccaacgaaaaagatctaccgcaggagaatgagggactcgtacctggcgttgagaaagaggaggaagaaggggctcggagggagggtgccgacatggaagaagaagaggaggaggaggaggaagaggaggaggaagaggaagaagagggtgccggtggtgtagagctgctgcaggaggtagtccccaaggagaaggtagttccgatccctgagggttccgcattcttctgcctgagtcaaacaaatcctctgcggaaaggatgtcatacactaattcatcaccacgtctttaccaacctgattttagtgttcattatcctgtcatcagtgtctttggctgctgaggatcctatcagggcccactctttccgcaaccatatccttggctatttcgactatgcctttacctcaatcttcactgttgagatcctccttaaaatgaccgttttcggggcattcctgcatagaggatccttttgtcggagctggttcaatatgctggacttgcttgtcgttagtgtgtccctcatatctttcgggatccactcctctgctatttcagtggttaagatccttcgggtcctgcgcgtgctgcggcctttacgcgcaataaatcgcgcaaaaggcctgaagcacgtcgtgcagtgcgtatttgttgctattcgtacaatcgggaatatcatgatcgtgacaactctgttgcagtttatgttcgcatgcatcggtgtgcaactgttcaaagggaaattttatacttgcacagacgaagcgaagcatacgccacaggagtgtaaggggagctttctcgtgtatccggatggggacgtaagcagaccactggtcagagagaggctgtgggtgaacagcgattttaactttgataacgtgttgagcgcgatgatggccttattcacagtgtccacattcgaaggctggcctgctctgctgtataaggctatcgacgcctatgcagaggaccacggacccatttacaactaccgcgtagagatcagtgtcttttttattgtttatatcattataattgcattcttcatgatgaacattttcgtgggattcgtgataattacgttccgggcacagggggagcaagagtatcagaattgtgagttagacaaaaaccagagacaatgcgtggaatacgcattgaaggcccagcctcttagaagatacatcccaaaaaaccctcatcagtaccgagtgtgggctacagttaattccgccgctttcgaatacttgatgtttctcttgatcctcctaaacacagtagctctggctatgcaacactacgagcagactgcacctttcaactacgccatggatatcctgaatatggtgttcaccggcttatttaccattgagatggtactaaagattattgcattcaagcccaagcactactttacagatgcgtggaatactttcgatgcccttatcgtggtgggcagtatagtcgatattgcagttaccgaggtcaacaatggcggacatctcggcgagtcatctgaagattccagccgcatttcaatcacatttttccgtctttttagagttatgaggttggtaaaacttctcagtaaaggcgagggaatcagaacgcttctttggacttttatcaagagcttccaggcgttgccctacgtcgccttactgattgccatgatcttcttcatttatgcagtgattggaatgcagatgttcggaaaggtagctttacaggatggcacgcagatcaaccggaacaataacttccagacttttccacaagctgtgctattgctattccgctgcgcgaccggtgaggcctggcaggagatcatgctagcatctctccccggtaatcggtgcgatcctgagagcgattttggcccaggcgaggagtttacttgtggtagcaattttgccattgcgtattttataagtttctttatgttgtgtgctttcctcataataaacctgttcgtggccgtgatcatggacaactttgattacctgacacgagattggtccattctgggacctcaccatctagacgagttcaagagaatctggtctgaatacgaccctggggcaaaaggaaggattaaacacctcgacgtcgtggcactgctccgtcgtattcaaccgccattgggatttggtaaactctgcccccacagagtggcttgcaaacggctggtcgccatgaatatgcccctgaattccgacggaactgtaaccttcaacgcaacgctgttcgcccttgtgcgtacatcactcaaaattaaaaccgaaggcaatctggagcaggctaatcaggagctgcgaatcgtgattaaaaagatttggaagcggatgaaacaaaagttgttagatgaggtgattcccccaccggatgaggaggaggtgactgtgggcaagttctacgcaacattcctcatccaagactactttagaaaattccgacgtcgtaaggagaagggtctgcttggcaatgacgccgctcccagtacgagcagcgccctgcaggccggactgagaagcttgcaggacctaggacccgaaatgcgtcaagccttgacatgtgacacagaggaagaggaggaggagggtcaggaaggagtagaagaggaggatgaaaaagacctagaaaccaacaaagccaccatggtcagccaacctagtgccaggagaggatctggaataagcgtaagtttgcccgttggagataggctccccgacagtctctcatttggcccttccgatgacgacaggggaacacctacatcttcacagccttctgtgccacaggctggttccaatactcaccggcgaggaagcggggcactgatctttacaataccggaggagggcaatagccagccaaaagggacgaaggggcagaacaagcaggacgaggatgaagaagtacccgataggctcagttatctagacgagcaggccggaacccctccatgtagcgttctcctccccccacatcgagcgcagcgctacatggacgggcacctggttcctcgcaggaggcttctgcctcctacccccgctggtcgaaagccctccttcaccatccaatgcctccagcgtcagggctcttgcgaagatctgccgattcctggaacttaccacagaggacggaattcaggcccaaatcgggcacagggatcatgggcgacccctccccagcgtggaagactcctctacgctccgctcttactggtggaagagggagccgctggcgagggttacctcggccgttctagcggaccacttaggaccttcacctgtctccacgtccctggtacccactcagatccctctcatgggaagcgcggaagcgctgatagtctggtagaggcggtgctcatatccgaaggtttggggctgtttgccagggaccctcgatttgtcgcattggctaagcaggaaattgcagacgcttgccggctcacccttgacgagatggataacgcagccagcgatctcttggctcaagggacatccagtttatactctgatgaggagtctatcctgtcccggtttgacgaagaagatctcggtgacgagatggcatgtgtacacgctctgta

SEQ ID NO: 216638 - DNA, 5933 bp, Artificial Sequence
  Description of Artificial Sequence: Synthetic coding sequence
atgtcagaaagcgaaggtggtaaagatacaacacctgagccttctcctgctaatggagccggaccaggccctgagtggggtctgtgccctgggcctcctgctgtggaaggtgagtctagcggtgctagtggtcttggtacacccaagcgccgaaaccagcactctaaacacaaaacagttgctgtggcctcagcccagagatccccaagagccctcttctgcctgacattagcaaaccccctgcggcgatcctgtatttcaattgttgagtggaaacctttcgatattctgatcctgcttactatttttgccaactgcgttgctcttggcgtctatattcccttccccgaagacgactcaaacacagccaatcataatctggagcaggtggaatatgtgttcctggtcatcttcacggtcgagacagtgctaaaaatagtggcttacggtctggtgctgcatccctcggcttatatccggaacggatggaatctgctggacttcataatcgtggtcgtcggtctattttccgtactccttgagcaaggccctggtcgtccgggtgacgcgcctcataccggcggaaaaccgggaggttttgatgtaaaagcccttagagccttcagggtgctgagaccgctgaggttggtgagtggggtgccctctctgcatattgtcctgaattccattatgaaagctctggtacccttgcttcacattgcactattggtcctgttcgtcataattatttacgccattatcggattggagctttttctgggtcgcatgcacaaaacttgttacttcctcggttccgacatggaagcggaagaggacccatcaccctgtgcgtcctctgggtcaggtagagcctgcaccctaaaccaaaccgaatgtcggggtcggtggccaggtccaaatggtggaatcaccaactttgacaatttttttttcgccatgctgaccgtcttccagtgtgttaccatggagggttggacagatgtgctctactggatgcaggatgcgatggggtacgagttgccatgggtgtacttcgtgtcgctagtgatctttggcagctttttcgttcttaacctagttttgggtgttctgtctggggagttttcaaaggaaagggagaaggccaaagcacgcggtgatttccagaaacaacgcgaaaaacagcagatggaagaagatctgcggggttatctggactggattacacaggcagaggagctggatatggaggacccatcagctgatgataatctgggcagcatggctgaagaggggcgtgccggacacagaccacaattggctgagttgaccaatcgaaggcggggaaggctcaggtggttctcccattccacgaggtcaacccattctacatcatctcacgccagtcttccggctagtgatactgggtccatgacagagacacagggggatgaggacgaagaggaaggcgctcttgcttcctgcaccagatgcctgaataaaatcatgaagacaagggtatgtagacgtctccgcagggcaaatcgcgtcctgcgcgcaaggtgccggagggccgtgaagtcaaatgcatgttattgggcagttctgctgctggttttcttaaatacattaaccatcgcgtcagaacaccacgggcaaccagtgtggctgacgcagatacaggagtatgccaataaggtgctgttgtgcctattcaccgtcgagatgctgcttaagctatacggtctggggccaagtgcctacgttagctccttcttcaaccggttcgattgctttgtcgtatgtggaggaatcctggaaacaacactggtagaagtcggcgctatgcagccgttgggcatctcagtgctgcgctgtgtgagacttttgagaatatttaaggtcacacgccattgggctagcctctcaaatcttgtcgcctcgctgctcaatagcatgaaatccattgcctccctactgcttctcctcttcttattcatcatcatcttcagcctgctggggatgcaattatttgggggtaaattcaatttcgaccagactcacaccaagcgaagcacattcgacaccttccctcaagccctgctgaccgtgttccagattctgacgggtgaggactggaacgttgtgatgtatgatggtattatggcatacgggggtccattctttccgggaatgttggtgtgtatttatttcattattttgtttatttgcgggaactacatcctgcttaatgtatttctggccatcgcagtggacaacctggccagcggagatgccggaaccgcaaaagataaggggggagagaaatctaacgagaaagaccttccccaggagaacgagggactggtcccgggagtggaaaaggaagaggaggagggggctcgcagggaaggggctgacatggaagaagaggaagaggaagaggaagaggaagaagaggaagaagaggaggagggcgcaggaggagttgaactgctgcaagaggtcgtccccaaggagaaggtggtacctatccctgaggggtcggcgttcttttgcctctcacagactaatccattgagaaaaggatgccacactcttattcatcaccacgtcttcacaaacctgatactggtcttcattatcttgtcgtcggtctcgctggcagctgaggaccctattcgagcgcactcctttaggaaccacatcctgggctattttgactatgccttcacgtctatcttcactgtcgagattttgcttaagatgaccgtgtttggagcttttctgcacagggggagcttctgccgaagttggtttaacatgctagatctcctggtggtaagcgtgagcctaatatcttttgggatacacagctcggccattagtgtcgtcaaaatcctccgcgtgctacgggttctcagaccccttagggccatcaaccgagccaaggggctcaagcacgttgtgcagtgtgtatttgtggctatcagaacaatcggaaacataatgattgtgactacacttctgcagtttatgtttgcttgcattggggtgcagctgtttaaaggtaagttctacacatgcacagacgaagctaagcataccccgcaggaatgcaagggaagtttcctggtgtaccccgatggtgatgtgagcagaccgctggtgcgagaacggctctgggtgaactcagatttcaattttgacaatgtcttgtcagccatgatggctctgttcaccgtgtcaacattcgaaggatggcccgcactgctgtacaaagccatcgacgcttatgcagaggaccacggaccaatctataactacagggtggagatctctgtgttcttcatcgtttacatcattatcatcgcctttttcatgatgaacattttcgtggggtttgttataatcaccttccgcgctcagggagaacaggagtaccaaaattgtgaactcgacaagaatcagcggcagtgcgtggaatacgcactgaaagcacagccgttgaggaggtatatcccaaagaatcctcatcagtatagagtgtgggcaaccgtaaatagcgccgcatttgaatacctcatgtttttactgatcctcctgaacaccgtcgcccttgcgatgcagcactatgaacagactgccccatttaactacgccatggacattcttaatatggtgttcactgggctgtttaccattgaaatggtgctgaaaatcatcgccttcaaaccaaagcactactttaccgatgcttggaacacctttgatgccctgatagtggtgggcagcatcgtggacatcgccgtgacagaggtgaacaatggaggacacctcggcgagagttcagaggactcctcccgcattagcattaccttctttagactgttccgagtgatgcgcttggtgaagctgctctcgaagggggaaggtattcgcacactgctctggacctttataaaaagctttcaggcgcttccctatgtcgctcttctgattgccatgatcttttttatttacgcagtgatcggcatgcagatgttcgggaaggttgctctgcaggacgggacccagatcaatcggaataacaatttccagaccttccctcaggccgtgttacttctgttcaggtgcgctactggggaggcctggcaggagataatgctggcaagcctcccaggaaatagatgtgatcctgagtctgatttcggccctggcgaagagttcacctgtggttctaacttcgccatagcctacttcatatcctttttcatgttatgtgcattcctgattatcaacttattcgttgcggtcatcatggataacttcgactacctcactagggattggtccattctgggcccacaccacctagatgaattcaaacgtatctggtccgagtacgacccaggggcaaaaggtcgaataaagcatctcgacgtcgtggcactactgcgccgaattcaacctccactcggcttcggaaaattgtgccctcacagagtcgcctgtaagcgcctcgttgcgatgaatatgcccctcaatagcgatggaacagttaccttcaacgctacactgttcgcccttgtgaggacgtcccttaagatcaaaactgaaggtaacctggagcaggcaaatcaggaactgcgaatagtgataaagaagatttggaagaggatgaaacaaaagctccttgatgaagtgatcccaccacctgatgaagaagaggtgacagtggggaaattttacgccaccttcctgatccaggattacttccggaaattccgccgtagaaaggaaaagggcctgctcggcaacgacgctgcacccagcaccagtagcgccctacaggccggactcagatctttgcaggacctgggtcctgagatgaggcaggccctcacttgtgacactgaggaagaggaagaggagggacaagagggcgtcgaggaagaagatgaaaaagacctggaaactaacaaggctactatggtcagccagccatcagctcgtaggggctctggcatttccgtgtcacttcctgttggggaccgcctacccgacagcctttcttttgggcctagcgacgacgacagaggcactcccacttccagtcagcccagcgtaccacaagccggttcaaacacacacagacggggttctggtgcattaatttttacaattccagaggagggcaattcccagcctaaaggaaccaaggggcagaacaagcaggacgaagatgaagaggtgcccgacagacttagctacttggatgagcaggccggaaccccgccatgttctgtgctgctgccaccacacagagcgcaacgttatatggatggccatctcgtgcccagaaggcgattgctcccaccgactccggctggccgaaagccctcattcactattcaatgtctccagcgtcagggttcttgcgaagatctgcccattcctggcacttaccacagggggagaaattccggcccaaaccgcgctcaagggtcctgggccacccctccgcagaggggccgattgctgtatgcgcctctgcttctcgtagaagaaggagccgcaggagagggttacctaggtagatcctctggcccattgaggaccttcacttgtctccatgtccccggtacacacagtgatccatcccacggaaagcgaggttccgccgactccttagtggaggcagtgctcatcagtgagggcctggggctatttgcacgggatcccagattcgtggcactagctaagcaggaaatcgcggatgcctgcaggctgacactcgacgagatggacaacgcagcaagtgatctactggcgcagggaacatcctccctgtattccgatgaagaatcgatcctcagtagattcgatgaagaggacctcggcgatgaaatggcttgcgtccatgccctcta

SEQ ID NO: 216639 - DNA, 5621 bp, Artificial Sequence
  Description of Artificial Sequence: Synthetic coding sequence
atggagccaagctctcctcaagatgaggggctgcgtaaaaagcagccgaagaagccagtgcctgagatattgccgaggccaccccgagccctgttctgcctgaccttagagaaccctcttagaaaggcctgtattagcattgtggagtggaagcccttcgaaaccatcatcctgctaacgatctttgcaaattgcgtcgctctcgcggtttatctgcctatgcctgaggatgacaacaacagcctgaatctcggcctggagaaactcgaatactttttcctcattgtcttttcaatcgaggccgctatgaagatcattgcctacggcttcctattccaccaggatgcatacctgcgatccggttggaacgtgcttgattttacgattgtatttctgggcgtattcaccgtaattctcgagcaggtgaacgtgattcagagccacactgcccctatgtcatcaaagggggctgggttggacgttaaagctctgagagcatttagggtgctacggcctctgaggctagtctctggcgtgccttcattgcaggtggtgcttaactctatattcaaggcgatgctgcccttatttcacatcgcactactagtcctgtttatggtcattatttacgccattattgggctggagctgttcaaaggcaagatgcataaaacatgctattttatcggcacagacatagttgccaccgtggagaacgaggagccatctccctgtgccagaactgggtccggaagacggtgcacaattaatggctccgagtgccgcggtggttggccgggtcccaatcacggcatcacccacttcgacaattttggtttctccatgctcacagtgtatcagtgtattactatggaggggtggacagacgtcctttactgggtaaatgacgccattgggaatgagtggccttggatttacttcgtcactcttattctgttgggctccttctttattttgaatctcgtgctgggtgtactctctggtgaattcacaaaagagcgcgaaaaggcaaagagtaggggaactttccagaagctcagagaaaagcagcagcttgatgaggatttgagagggtatatgtcttggatcactcagggcgaagtcatggacgtggaggactttcgtgaagggaaactctctctcgatgaaggtggttccgacacagaaagtctttatgagatcgccggactaaataaaataatccagttcatccgtcactggaggcagtggaataggatttttcgatggaaatgtcacgatatagtcaagtcaaaggtgttttactggctcgtgatcctcatcgttgccttaaatacactgtctatcgccagtgagcaccacaaccaacccctgtggctaacccgtctacaagatatcgccaaccgcgtgcttctttctctttttactaccgaaatgctgatgaagatgtacggtcttgggctgagacagtacttcatgtctatctttaaccgttttgactgctttgtggtttgctcagggattctcgagatattgttggtggagtccggagctatgacacctctgggaatctctgtcctacggtgtatcaggttgcttagaatctttaaaatcaccaaatattggacctctctcagcaatctagtcgcatcactgctgaattctatcagatctatagcgtctcttttattgctcttattcttatttatcgtgatcttcgccctcctgggcatgcagctgttcgggggacgatacgacttcgaggacactgaagtgcggaggtctaatttcgataattttcctcaggcacttatttctgtttttcaggtgctgacgggagaagattggacttcaatgatgtataacgggatcatggcttatggcggaccctcttatcctggaatgctggtatgcatttacttcattattctgtttgtgtgcgggaattatattttgctgaatgtgttcctggctatcgcggttgataacctggctgaagcagaatccctgacatccgctcagaaagctaaagccgaagaaaaaaaacgcagaaaaatgagcaaaggactgccagacaaatcagaagaggagaagtcaacgatggccaagaaactcgagcagaaacccaagggcgagggtatcccaactacagcaaaactaaagatcgatgagtttgagagcaacgtgaatgaggtgaaggatccctatccgagtgccgattttcccggagacgatgaggaggatgagcctgagattcctctgagccctcgccctcggcctctggctgagttgcaattaaaggaaaaagccgtgccgataccagaggccagctcattttttattttcagccctaccaacaagattagggtactgtgccaccgcatcgttaacgccacttggttcacgaatttcattttgctgttcatcctgctgtcgagtgccgctctggccgctgaggaccccatcagagccgactcaatgagaaaccagattctgaaacattttgacatcgggtttacaagcgtattcaccgtggaaattgttttgaaaatgactacatatggagcctttctgcacaaaggctcgttctgtagaaactacttcaacatgctggatctcctcgtggtagccgtgtccctaatatctatgggcctggagtcctctgcgatatccgtggtaaagattctaagagttctaagggtattgcggcctctaagggccattaatcgagcaaaaggcctcaagcacgtggtgcagtgcatgttcgtcgccataagtactatcgggaacatagtgttagtcacaaccctattacaattcatgttcgcttgcattggtgtgcagttgtttaaaggcaaattcttccgctgtactgatctttcaaagatgacggaagaggaatgccgcggatactactacgtttataaggatggagatcccatgcagatcgagctgcgacatagggaatgggttcattcagacttccacttcgataacgtgctctcagccatgatgtccctgtttacagtcagcaccttcgaaggctggccgcagcttctttataaggctattgattctaatgctgaagatgttggccctatctacaataatagggtcgagatggccatcttcttcattatctatattatcctcatcgccttcttcatgatgaacatattcgtggggttcgttattgtgacctttcaagaacagggcgagaccgaatataaaaactgtgagttagataaaaaccagaggcaatgcgttcagtacgccctcaaagcacgcccactccggtgctacataccgaagaacccttatcaataccaggtatggtacatcgtcacaagctcttatttcgagtacctgatgttcgccctgatcatgttgaatacaatatgtttgggtatgcaacactataaccagtctgagcagatgaaccacatctcagatatccttaacgttgcctttacaataatcttcacacttgagatgatcctgaagctgatggctttcaaggcccgagggtattttggcgatccatggaatgtattcgacttcctgatcgtgattgggtctattatcgacgtcatcctgagcgaaatcgacactttcttggcttctagcgggggtctttactgcctgggtggcggatgcggcaatgtagatccagatgaatcagcaagaatatcctctgctttctttcgactgtttagagtgatgaggctcatcaaacttctaagtcgggctgagggcgtgcgtacattgctgtggacatttatcaaatcattccaggctctcccatatgtggctctactgatcgtgatgctcttctttatatacgccgttatcggtatgcagatgtttggaaagatagcactggttgatggtacacagattaatcgaaataataattttcagaccttcccacaggctgtgctattgttgttccgctgtgcaaccggagaggcgtggcaggagattctgctggcctgctcatatgggaagctttgtgatcccgaatcagattacgctccgggtgaagagtacacttgcggcactaactttgcatattactattttatctcattttacatgttgtgtgccttcctggtcatcaacctcttcgtcgccgtcatcatggacaactttgactacctcaccagagactggagcattcttggcccacaccatctagacgaatttaaggcgatatgggcagaatacgaccccgaggcaaagggtcgtattaaacacctggacgtggtgactctcctgaggcgtatccagcctcccctgggcttcggcaagttttgcccccaccgtgtcgcctgcaaaaggctggttggaatgaatatgccactaaactctgatggtactgtgaccttcaacgccactctgtttgccttggtacggacagctctaaaaatcaagacagaaggcaatttcgaacaggccaacgaggagttgcgagctatcattaaaaaaatctggaaacggacatctatgaagttgctggaccaggtcatacccccaataggagacgacgaggtgacagtgggcaagttttacgccaccttcctgatacaggaacattttaggaagtttatgaaaagacaggaggagtattacggatatagaccgaaaaaggacatcgtgcagattcaggccggactcagaacgatagaagaggaggcagcgccagaaatctgtcgtaccgtaagcggggatctggccgcagaggaggaactggagagggcaatggtcgaagccgctatggaagagggtatcttccggaggacaggagggctgtttggacaggtggataattttttagagcgcaccaactcgcttcctcctgttatggcaaatcagcgtccattgcaatttgccgaaattgagatggaggagatggagtcacccgtgtttctggaagactttccccaggacccccgtacaaatccattggcgagagctaacacaaacaacgccaatgctaatgtggcctatgggaatagcaatcactcaaacagtcacgtgttttcctctgtgcattatgagagagagttccctgaggaaaccgaaacccccgcaacacggggacgtgcgctgggccagccatgccgggttcttggtccccacagtaaaccctgcgtagagatgctaaagggactcctgactcagagggctatgcctcggggacaagcccctcccgcaccgtgtcagtgcccgagagtcgaatccagcatgcctgaggatagaaaatcatctaccccaggttccctccatgaggaaacccctcattcaagatccacgcgggagaataccagtagatgctctgctcccgcaactgccctgttaattcagaaagctctggtgcggggaggtctcggaacccttgcagccgacgcaaattttattatggccaccggtcaagccctcgccgatgcttgccagatggaaccggaagaagttgagatcatggcaactgaacttctgaaaggtagagaagctccggaaggtatggccagctctctgggctgcctgaatctaggaagtagcctgggaagtctggatcaacaccagggctcccaagaaaccctcatacctccgaggctgta

SEQ ID NO: 216640 - DNA, 5564 bp, Artificial Sequence
  Description of Artificial Sequence: Synthetic coding sequence
atggagccatcatccccccaggatgaagggctgagaaagaagcagcccaaaaagcctgtgcctgaaatcctaccaaggccacctcgcgctctgttctgtctcaccctggagaatccactgaggaaggcgtgcataagcatcgttgagtggaagccctttgagacgatcattctgcttacaatattcgccaattgtgtcgctctggctgtgtatttgcccatgcccgaagatgacaacaattctttgaatctgggtcttgagaagctcgaatacttcttcctaatcgtgttctccattgaagctgcaatgaagataatcgcgtatgggttcctctttcatcaggacgcctatctgcggtcgggctggaatgtactcgactttaccatcgtgttcctgggagtgttcaccgtgattctcgaacaggtaaacgtcatccagagtcacaccgcacccatgagcagcaaaggagccggtttggacgtaaaggcgttgagagctttccgggtcctgcgccctctgagactagtgagtggggtgccctccctgcaagtggtactgaactcaatcttcaaagccatgcttcccctgtttcacattgccctgctcgtcctgttcatggtgatcatttacgctatcatcggactggagctgttcaaaggaaagatgcacaagacctgctatttcatcggtacggacatcgtggccacagtggaaaatgaagagcctagcccttgtgctcgcacaggtagcgggagacgttgcaccataaatggcagtgagtgtcgcggagggtggcctggaccaaaccatggaatcacacatttcgacaacttcggattctcgatgcttaccgtctaccagtgtatcaccatggaggggtggacagatgtgctctactgggttaatgacgcaattggcaatgagtggccctggatatacttcgtaacattgattcttcttgggagtttctttatattgaacctagtgcttggggtactcagtggcgagttcactaaggagagggagaaagcgaaaagcagggggacattccagaagctgagggaaaaacagcagctagatgaagacctcagaggttatatgtcctggattactcagggcgaagtcatggatgtggaggacttccgcgagggcaaattgtctctggacgagggtggctccgacacggagtcattgtatgagatcgctggtctaaacaagataatccagttcattcgccattggcgccagtggaatcgcatctttcggtggaagtgtcacgatatcgtcaagtccaaagtgttttactggttggtaatcctgattgtcgccctgaacaccctgtcaatcgcctccgagcaccataaccagcctctgtggctcacgcgcttacaagacatagccaacagggtgctgctgagcttgttcactacggagatgcttatgaagatgtatggtttagggctcagacagtacttcatgagtatttttaatcgattcgactgtttcgtggtgtgcagtggaatccttgaaatcttgctcgtggaatcaggtgcaatgactcccctgggcataagcgtgctccgctgcataaggcttctgcgtatcttcaaaatcactaagtactggacaagtctttctaatctggttgcttccttattgaacagtatacgttccatcgcgagtctcctcctgctgctattccttttcattgtcatctttgccctccttgggatgcagctgtttggaggtagatatgattttgaggataccgaggtgcggcgaagcaacttcgacaattttccacaagccctcattagtgtgttccaggtcctgaccggtgaggattggaccagtatgatgtataacggtatcatggcctacggaggaccatcctaccccggaatgctggtctgcatttatttcatcatcctcttcgtttgcggaaactatattttgctaaacgtatttttggccattgctgtcgataatctagccgaagctgaaagtttgacctcagcacagaaggctaaagctgaagagaaaaagcggcgaaaaatgtcaaaaggattacccgacaaaagcgaggaggaaaaaagcacgatggccaaaaagctggaacagaaacccaagggggaagggattcctaccactgctaaactcaaaatcgatgagttcgagagcaacgtgaacgaggtgaaagatccatatcctagcgcagacttcccaggtgacgacgaagaggacgaacctgaaattcccctgagccctcgccctcgccctcttgccgagctgcagctgaaggaaaaagccgtgccaatccccgaggcctctagtttcttcatcttctcccccactaacaagatcagggtcctctgtcatcgcattgttaacgccacatggttcaccaacttcatcctgctgtttattctgctgagctctgctgctttggcggctgaggacccaataagggccgactctatgaggaaccagatcctcaaacactttgacatcggctttacctctgtatttacagtggaaatcgtgctgaagatgaccacatatggtgcatttcttcataaagggtccttttgccgaaattatttcaacatgctggatttgctagttgtcgccgtttccctgatttctatgggccttgagtcatcagcaatatctgtggttaagatcctcagggtcctcagagtactgcgacccctgagagccatcaaccgggctaagggactcaagcacgtggtgcaatgtatgtttgtcgcaataagcaccattgggaacatcgtgctggtgactaccctccttcaattcatgttcgcctgcatcggtgttcaactgtttaaagggaagttcttccgatgcacagacttatcaaaaatgaccgaagaggagtgtagggggtactactacgtctacaaagatggcgatcccatgcagatcgaactgagacaccgagagtgggtgcacagcgattttcattttgataatgtgctgtccgcaatgatgtcattgtttaccgtgtcaactttcgagggctggccccagctactgtataaggcaatagactcgaatgctgaagatgtcggcccaatctacaataacagggtcgaaatggccattttttttatcatctacatcatattgatcgcattttttatgatgaatatattcgtgggcttcgtaattgttacttttcaggagcaaggagagactgaatataaaaattgcgagctggacaaaaaccaaaggcagtgtgttcagtacgccttgaaagccaggcccctgaggtgctatattcctaagaacccataccagtaccaggtgtggtacatagtgacatccagttattttgagtacctcatgttcgcgctgatcatgcttaacaccatttgtcttggcatgcaacattacaatcagagtgagcagatgaaccacatatccgacatcctcaacgtggcgtttaccatcatcttcacccttgagatgattctgaagttgatggcattcaaggcaagagggtactttggagacccttggaatgtgttcgacttcttaatcgtgatcgggtccataatagacgtgattctgagcgaaattgacgatccagatgagagcgcccgaataagctcggcattcttccggcttttcagagtcatgcgtctgattaaattactgtctcgcgcagagggggttagaacccttttgtggacttttattaagtcatttcaggctctcccatatgtcgcgctgctcatcgttatgctgttcttcatctacgccgttatcgggatgcagatgtttggaaagatagcactggtggacgggacacaaatcaataggaacaacaattttcagacctttccacaggccgtgctcctgctgttcaggtgtgcgactggagaggcttggcaagagatcttattggcttgctcctatgggaaattgtgtgacccggagtcggactacgcacccggagaagaatatacatgcggtactaatttcgcctactattatttcatctcattttacatgttatgcgcatttctcgttatcaatctgttcgtcgccgtcattatggacaacttcgattaccttacacgggattggagtatactgggtccccaccacctggatgaattcaaggccatttgggctgagtatgacccagaagcaaagggcagaatcaaacacctggacgtggtgacgttgctgcggaggattcaacccccactggggtttggtaaattttgtccacacagggtggcttgtaaaagactagtaggcatgaatatgccgcttaactctgacgggaccgtcacctttaacgcaacactgtttgctcttgttagaaccgccctgaagatcaagacagaaggaaacttcgaacaggcaaacgaggaattgcgggcaatcataaagaaaatctggaagcgaacatccatgaagctcctggaccaggtgattcccccaattggggacgatgaggtcactgttggaaagttctatgcaaccttcctgatccaggaacatttccgtaagtttatgaagcggcaggaggaatattatgggtatcggccaaaaaaggacattgtacagatccaggcaggtctgcggaccattgaagaggaggcggcacccgagatttgtagaactgtttccggagaccttgcggctgaggaagagctggagcgcgctatggttgaagccgctatggaagaaggaattttccggcgtaccgggggtctctttggccaggtagacaatttcctagagagaactaactctctgccacctgtcatggcaaaccagaggcctcttcagttcgcagagattgaaatggaggaaatggaatcaccagtcttcttggaagacttcccccaagaccctcgcaccaaccctctagcacgggcaaataccaacaacgctaacgctaacgtcgcatatggaaactccaatcattctaatagtcacgtttttagctctgttcactacgagcgggagttcccggaagagaccgagacgcccgcaactcgcggaagggcgttagggcagccatgtagggtcctgggcccacattcaaagccatgcgttgagatgttgaaaggcctgctcacccagcgcgctatgcctagaggacaggctccgccagccccatgtcagtgccctagagttgagagctccatgccggaggaccggaagagctcaactccgggtagcctacacgaggaaacgccccactcaagatctactcgcgaaaacacatcacgatgctccgccccagcgactgcactcctcatccagaaagcactagtccgcggaggcctcggcactctggccgctgacgccaactttataatggctacgggccaggcccttgcggatgcgtgtcagatggagcctgaagaggtcgaaatcatggctactgagctcctcaagggaagagaggccccagagggtatggcttcaagcttggggtgtttgaacctggggagttcgctcggaagcctggatcagcatcaggggagccaggagacactgattcccccaaggctgta

SEQ ID NO: 216641 - DNA, 4602 bp, Artificial Sequence
  Description of Artificial Sequence: Synthetic coding sequence
atgaaaactcacctggaccgaccactggtggtcgagctaggcagggatggcgcacggggtcctgtgggcggaaaagcacgtcctgaggctgccgaagctccagagggagtcgatcctcccaggcgccaccatcgacatagagacaaagacaaaaccccggctgctggggaccaagatcgggctgaggccccaaaggcagaatcaggtgagcccggagccagagaggaaaggccaaggccccaccgctcacactccaaagaagcagccggaccgcctgaagcgcgttcagaaagggggagaggcccaggaccagagggcggtcgaagacaccatcgacgaggctcccccgaggaagcggctgagagagaacctaggcggcaccgggcacacagacaccaagatccttctaaggagtgtgcaggagccaaaggcgagcgaagggctagacatagaggcggacccagagctggaccacgggaggccgagtctggcgaggaacccgctaggagacatagggccaggcacaaggctcagccggctcacgaggctgtggaaaaggagacaacagagaaggaggccacagaaaaggaagccgaaatcgtcgaagcagataaagagaaggagcttcggaatcatcagccgcgtgagccccactgcgatttggagaccagtggaaccgtcacagtggggcctatgcataccttacccagcacatgcctccagaaagttgaggaacagcctgaggatgctgataatcagagaaatgtcacccgtatgggaagtcagcctccggatcctaacactattgtccacattcccgtgatgctgacaggaccactaggagaagctaccgtcgtgccatctggcaatgtggatctggagtcacaggccgaggggaaaaaggaggtagaggcagacgacgtgatgcgcagtggccctaggccaatcgtgccctactcctctatgttctgtctgtctcctacaaatctcctgcgtcgcttctgccactatattgtaactatgcggtattttgaggttgtgatcttggtagtaatcgctttaagctccattgctctcgcagctgaagatcccgtgcgaacagatagccctcggaataatgcactgaaatacctcgactatatctttacgggtgtgttcaccttcgagatggtgattaaaatgattgacctcggtctgcttctgcatcccggtgcttactttcgcgatttgtggaatattcttgatttcatagtggttagcggtgcgcttgtggccttcgcatttagcagcttcgtaggcggatctaagggtaaagatatcaatacaattaagtcacttagggtgctgcgcgtactgcgaccgctcaaaactatcaagcgtttacctaaacttaaggccgtgtttgattgtgtggtgaatagcctcaagaatgtgctcaatatcctgattgtatacatgctctttatgtttatatttgccgtcatcgccgtgcagctgttcaagggaaaatttttctactgcaccgacgagtcgaaagagctcgagcgcgactgtcgcggtcagtatctggactacgaaaaggaggaggtggaagcccagcccaggcagtggaagaagtatgactttcattacgacaatgtgctgtgggcactgctgacactgttcacagtgtctacaggagagggttggcctatggtgctcaaacattcagtcgatgccacttatgaagagcagggacccagtcccggatatcgcatggagcttagcattttctatgtggtatactttgtggttttccccttcttctttgtaaatatttttgtggcgctgataatcatcacattccaggagcagggagacaaggtcatgtctgaatgctcactagaaaaaaatgaacgcgcttgcatagatttcgcaattagtgcaaagcccttgactagatacatgccacagaaccggcagagcttccaatacaagacatggacgttcgttgtttccccgcctttcgagtatttcattatggcaatgatagcactgaacactgtcgtgcttatgatgaaattttacgacgccccatacgaatatgaactcatgctgaagtgtctgaatatcgtattcaccagtatgttttctatggagtgtgttctcaagattatcgcctttggcgtcctgaactatttccgggacgcctggaatgttttcgattttgtaactgtgctgggaagcatcacagacatactggtgactgagatagccaataatttcattaacctctcttttttacggttgtttagagcggcaaggcttatcaagcttctgcggcaaggatatactatccgaatcctcttgtggacattcgtccagagttttaaagccctgccctatgtttgcctgctcatcgctatgttgttcttcatctacgcaataattggcatgcaggtgttcggtaatatcgctctggacgatgatacgagcatcaacaggcacaataactttcgaacatttcttcaagccttaatgctcttgttcagatctgctacgggggaggcctggcatgaaatcatgctctcctgtctaagcaaccaggcatgtgatgaacaggccaacgccacagagtgcggatccgacttcgcgtacttctacttcgtgtcgttcatcttcctctgcagcttcctcatgctaaatctcttcgtggctgtgatcatggacaacttcgaatacctcaccagggattcatctatactcggcccacatcatttggatgagttcatacgagtgtgggccgaatatgaccctgcggcttgtggcaggatcagctataatgacatgtttgaaatgttaaagcatatgtctcctcccttaggactcggaaagaaatgtcccgcacgtgtcgcgtataaacgtctggtgcggatgaacatgccgattagcaatgaggatatgacggtccactttacctcaaccctcatggcactgattagaaccgctttggagatcaagctcgctcccgctggaactaagcagcaccagtgcgatgcagagctgaggaaagagatttcagtggtgtgggccaacttgcctcagaagactctggacctgctcgtaccgcctcataagccagacgaaatgacggtgggcaaggtctacgccgcacttatgatcttcgatttttacaagcagaataaaaccaccagggaccagatgcagcaggctccgggaggactttcacagatggggcctgtgagcctcttccaccccctgaaagccacactggagcaaactcagcctgcggtcttacgcggtgctagggtgttcttgcgtcagaagtcctcgacctcactaagcaacgggggagctatacagaaccaagaaagtggtattaaggaatccgtgtcatgggggacacagagaacacaggacgcccctcacgaggcgagacctcccctagaaagaggtcacagtacggagattcctgtcggacgctccggagccttagcggtagatgtgcaaatgcaatcgatcacgcgaagaggcccagatggggagccacagccaggcctcgagtcccagggcagagctgcctctatgccccgactcgctgctgagacacagcccgtgacggatgccagtccaatgaagcgatcaatatcaaccctggcacaacggcctagagggacacacctgtgtagcaccaccccggaccgacccccaccaagtcaggcctctagtcaccatcaccaccaccggtgtcaccgaaggcgtgataggaagcagagaagcctggagaaaggcccatctcttagtgcagacatggacggtgctccaagcagtgcagttggcccaggactgccccctggagaagggccaactggttgtcggagagaaagagaacgtcgacaggagcgcggacgatctcaggagcgcaggcaacctagctcttcttcttctgagaagcagaggttctattcctgcgatcggtttggaggcagagagccgccaaaacctaagccaagcttgtcctctcaccccacatcccccacggccggtcaggagcccggtccgcacccacaaggaagcggatccgtgaacgggtctccactgctctcgactagcggagcctccacgcccggacgcggtggaagacgccagttaccacagacaccactcactcctaggccaagtattacgtacaaaacagctaacagctcacctatccacttcgcaggtgcccagacctcattaccagcgttcagtcccggacggttgtccagggggctgagcgaacataatgcccttttgcaaagagaccctctgtctcagccactggcccctggatcgcgtatcggaagcgacccatatctaggacagcgcctggacagcgaggcatcagtgcacgcattaccagaggataccttaacgttcgaagaggccgtggcaactaacagtggcagaagcagccgaacatcttacgtgtcctcgttaactagccagagtcacccattgcggagggtgcctaacgggtatcactgtaccctgggcctgtcctccgggggtcgtgcccgtcactcataccaccatccagatcaagaccattggtgttat

SEQ ID NO: 216642 - DNA, 306 bp, Artificial Sequence
  Description of Artificial Sequence: Synthetic coding sequence
gacaatttagctaacgcccaggaattaactaaagatgaggaagaaatggaagaggccgcaaatcagaaactggctctgcagaaagccaaagaggtggctgaggtgtcaccaatgagcgcggcaaatataagcatagccgcttttgtgaagcaggctcgtggcacagtcagccggagtagttccgtttcctcggtgaacagccctcgacagcagaattccgcgaaagcaagatccgtttgggagcaacgcgcttcacagttaaggctgcagaacttgagggctagctgtgaagcattgtactcctag

SEQ ID NO: 216643 - DNA, 6714 bp, Artificial Sequence
  Description of Artificial Sequence: Synthetic coding sequence
atggtgcgctttggagatgagctgggaggcaggtacggtggcccaggtgggggtgagagggctcgtggcggtggggctggcggagccggtggcccaggccctggcggactgcagcctggccagagagttctgtacaagcagtctattgcgcagcgcgcaaggactatggccctgtacaacccaattcccgtgaagcagaactgcttcactgtgaatcggagtctgttcgtcttttcagaggataacgtcgtacgcaagtatgcaaagcgtatcaccgagtggccgccatttgaatacatgatcctggccacaattatagcaaattgtattgtgctagccctcgagcagcatctgcccgacggcgacaaaactcctatgtcggagaggctggatgataccgaaccttactttatcggcatattttgttttgaagctgggattaagattatcgctttaggattcgtgttccacaagggctcctatctccgcaatggatggaacgtgatggactttgtggtggtactcacaggcattttggcgaccgccggaacagacttcgacctgaggacccttcgagcagttcgagtgctgaggccactgaaactggtttccggaataccaagcttacaggttgtgctcaaaagtattatgaaagccatggtccctctcctgcaaatcgggctgttgctcttctttgccattcttatgtttgccatcataggactcgaattttatatgggcaaatttcataaagcctgtttccccaatagcactgacgcagagccagtgggagatttcccctgcggtaaggaggctcccgcaaggttgtgtgagggagacactgaatgtagggagtactggcctggacctaattttggcataacaaattttgataatattctctttgcaatactcaccgtctttcaatgtattactatggagggatggacggacatattatacaacacaaatgatgctgcgggaaacacttggaactggctgtactttatcccgcttattataatcggatccttttttatgcttaacctggtactcggcgtcctgtcaggagaattcgctaaggaaagagagagagtggaaaaccgcagggcgtttctgaaacttaggaggcagcaacagatcgagcgggagctgaatggatacctggagtggatctttaaagcagaagaggtgatgctggctgaagaggatcgtaacgcggaagaaaagagtcctctcgacgttctgaaaagagcagccacgaagaagtcacgcaacgatttaattcacgccgaggaaggagaggaccgctttgctgatctgtgtgcggtgggctcgccatttgccagagcgtctttgaagtccggcaagactgagtctagcagttattttcgcaggaaggagaaaatgttcagattttttattaggcgaatggtcaaggcacagtccttctactgggtagtgctctgcgttgtcgccttaaataccctctgcgtggctatggttcactataaccaacctcggagactcacaacaactttgtactttgcggagttcgtgttcctggggctatttcttactgagatgagtctaaagatgtatggactgggcccacgatcttactttcgcagttctttcaattgtttcgatttcggtgtgatcgttggaagcgtgtttgaggtagtctgggccgctattaagccgggttcttcattcggaatctcagtgctgcgggcactccgcctccttaggatctttaaggttactaagtactggagcagcttaagaaatttagtggtcagtctgctgaactcaatgaagagtattatttcacttctgtttctgttatttctcttcatcgtggtctttgctctgctgggcatgcagctgtttgggggtcaattcaacttccaggacgaaacaccgacaacgaatttcgatacttttcctgcagcaatactcaccgtatttcagatcctgaccggcgaggattggaacgcagtgatgtatcacggaatcgaatctcaaggcggtgtgagtaagggtatgttttccagcttctacttcatcgtgttgacactgttcggaaactacacgctgctgaatgtcttcctcgctatcgccgtggataacctggccaacgctcaagaactaaccaaggacgaagaggaaatggaggaggccgctaatcagaaactggcactgcagaaggccaaggaagtcgctgaggtctctcccatgtccgctgcgaacatatcgatcgccgctcgccaacagaacagcgcaaaggccaggtccgtgtgggagcagcgggcaagtcagctgcgactgcagaacttgcgtgcttcctgtgaggcactgtattcggaaatggatcctgaagagagattacggtttgctactacccgccacctacgacctgatatgaagacacacctagatcgtcccctcgtggtggaattggggagagacggagcccgtggccctgtggggggaaaggccaggcccgaagctgccgaggcccctgaaggagtggatccacccaggagacaccaccgccacagggataaggataagacccccgcagccggtgaccaggatagggccgaagcacctaaggccgaatcaggagagccgggagccagagaggaacggcctagaccacaccggtctcactccaaggaggctgccggaccccctgaagccaggtctgagaggggcaggggccctgggcctgaagggggaagaagacatcaccgcagaggctcccccgaagaggcggctgagagggagcccaggaggcatcgcgctcatagacatcaggacccttcaaaggagtgtgccggagctaagggtgagaggcgcgcacgccaccgtggcggacccagggcaggcccaagggaggccgagtccggcgaagagccggctcgtcggcacagggccaggcataaggctcagcctgcccacgaagcggtggaaaaggagaccaccgaaaaagaggccactgaaaaggaggcagaaattgtggaagctgataaggagaaagaacttcggaatcaccaaccgagggaaccgcactgcgatcttgagaccagcggaaccgtgacagtcggaccaatgcatacccttccttctacttgcctacagaaggtcgaagaacagcccgaggacgctgacaaccagaggaatgtgacccgcatgggtagccaaccgccagatcctaataccattgtgcatatccctgtgatgctgaccgggcctctgggtgaggccaccgttgtgccttctggcaacgtcgacctggagagccaggcagaggggaagaaggaagttgaggctgatgacgttatgagaagtggaccccgacccatcgtaccgtattcatccatgttctgtttgagcccaaccaacctcctgcgcaggttctgtcattacattgtgactatgaggtatttcgaggtcgttatcttagtggttatcgccctcagtagcattgctcttgccgctgaagatcctgtgaggacagactctcccaggaataacgcactcaaatatctggactatatttttactggagtgtttaccttcgaaatggttatcaagatgatcgacttgggtttgctgctgcatccaggcgcatacttcagagatttgtggaacatattggacttcattgtagtgagtggtgccctagtggcattcgccttctccggcagtaaggggaaggatatcaacactatcaagtccctgcgagtacttcgcgtgttgaggcctctgaaaacaatcaagaggctgcctaagcttaaagcagtgtttgattgcgtcgtgaactctctaaagaatgtattaaatatcctcattgtgtacatgctgtttatgttcatttttgctgtgatagcggtccaactctttaagggaaaatttttttactgtactgatgagtcaaaggagcttgagagagactgtaggggtcaatacctcgactacgaaaaggaggaggtcgaggcccaacccaggcagtggaaaaagtacgacttccattacgataacgtgctatgggccttactcacactatttaccgtttccacaggtgagggctggcctatggtgttaaagcactccgtagacgcgacttatgaggaacagggtcctagcccaggatacagaatggagctgtctattttttacgtcgtttattttgttgtgttccccttctttttcgtcaacatcttcgtggccctgattatcattacgttccaggaacagggggacaaggtgatgtcagaatgctccctagagaaaaatgagagagcttgtattgactttgccataagcgccaagcctctcacacggtatatgccacaaaatagacagtccttccagtataaaacgtggactttcgtggtttctcccccatttgagtacttcatcatggctatgattgccttaaatacggtggtactgatgatgaagttttacgatgccccatatgaatatgagctgatgctcaagtgtctgaatattgtgttcacctcaatgttcagcatggaatgtgtgttgaagataatcgcctttggtgtcttgaactattttcgcgatgcttggaacgtcttcgattttgtcaccgtgttgggtagcatcacagacatcctcgtgactgaaatcgccgaaactaacaattttatcaacctcagcttcctgaggctgtttagagctgccaggctcattaagctactgagacaaggatatacaataaggatactgctgtggacgttcgtgcaatcgttcaaggccctgccttacgtgtgcttgctcattgccatgctgtttttcatctatgcaataatcggaatgcaggtgttcggcaatatcgccctggatgacgacacctcaatcaaccgacacaacaacttccgaaccttcttgcaagcgcttatgctgctgtttcgctcagcaactggagaagcctggcacgaaatcatgctatcatgtctcagtaatcaggcctgcgacgagcaggccaacgccaccgaatgcggtagcgacttcgcgtatttttactttgtatctttcatttttctatgctcctttttgatgctcaacctgttcgtggctgtgattatggataatttcgaatacctcacacgggattcctccatactgggacctcaccatctggatgagtttatcagggtctgggccgaatatgatccagctgcatgcggaagaatttcttataatgacatgtttgaaatgctgaaacacatgagcccgccactggggttaggtaaaaagtgtccagccagggtcgcttataaaaggttggtgagaatgaatatgccaatatccaatgaagacatgacagtgcattttacttcaacacttatggctcttattcgcacggccctcgagatcaagttagctcctgccggaaccaaacaacaccagtgcgacgccgaactgcgtaaagagatcagcgtcgtctgggctaatttgccccagaaaactctcgacttgttggtgcctcctcataagcctgatgagatgaccgtgggaaaggtttatgccgctctcatgatatttgacttttataagcagaacaagacgacgcgggaccagatgcagcaagcgccaggagggctgtctcagatggggcctgtttctctgttccacccgctgaaggctaccctcgaacaaactcagcccgctgtcttgcgtggcgctagggttttcctccgccagaagagctcaacatcgctcagcaacggtggagcgatccagaaccaggaatcagggattaaggagagcgtgagttggggcacgcaaaggacccaggacgcaccccacgaggcacgtccacctctggaacggggtcacagcacggagatacccgtaggaagaagtggcgctcttgcagtggatgtgcagatgcagtctatcactagaagagggccagacggagaaccacagccgggactagagagtcagggcagagccgctagcatgccccgattagcggctgagactcaaccagtcacagatgcctcacctatgaagcgctcaatctctaccctggctcagaggccaagggggacccacctgtgcagtactacgcccgaccggccacctccgtcacaagcctcatctcaccaccatcatcatagatgtcataggcgccgtgatcggaagcaacgatccctcgaaaaaggacctagcctgagtgccgacatggatggggctcctagtagcgccgttggacctgggttgccacctggcgaggggcctactggatgtcggagggagagagaaagacgccaggagcggggaaggagtcaggaacggaggcaacctagctcgagctctagcgagaaacagcgcttctactcgtgtgaccggttcggcggaagggaacctccaaagcctaaacccagcttgagctctcaccccacctctccaacagcaggccaagaacctggtccgcatcctcaggcaggctcggcagtgggcttccccaacactactccctgttgccgcgaaaccccctcagcctctccttggcctctggcactggagttggcactaactctgacttgggggtctgtgtggaccgtgcgaccactcagcactccttgtctgcgcaccctcagcctctctcgtcggttgtggcctccaacacgagctgccccaccagggctgcccacctgtcctccataa

SEQ ID NO: 216644 - DNA, 7022 bp, Artificial Sequence
  Description of Artificial Sequence: Synthetic coding sequence
atggtccgattcggcgacgagctgggaggacgctatgggggaccagggggtggcgagagggccaggggagggggtgccggtggggcagggggacccggacctgggggtctgcaacccggacagagagtgctgtataaacagtccatcgcccagcgcgctagaacaatggctctctacaatcctattcccgtgaaacagaattgtttcactgtcaatcgatccctcttcgtgttttccgaggacaacgttgttcgaaagtatgccaagcgtataaccgaatggccaccatttgaatatatgatactggctaccatcattgccaattgtatagttttagctctggagcagcacctgcccgacggagataaaaccccaatgtccgagcgtttagacgacaccgaaccatactttatcggcatcttctgctttgaggcaggcatcaaaatcattgcactcggattcgtgttccacaagggttcttacctccggaacggctggaatgtgatggacttcgtggtagtcctgaccggaatccttgccaccgctggaacagatttcgatctgcgaacccttagagcagtccgggttctcaggccactcaaacttgtttccggaatcccctctctccaggtggtattgaagtctattatgaaagccatggtacctctattgcagatcggcctgctcctgttttttgctatcctgatgtttgccataattggccttgagttttatatggggaaattccacaaggcctgcttcccaaattccactgatgccgagcctgtgggggactttccatgcgggaaggaagcaccagcccgtctgtgtgagggcgatactgagtgccgcgagtactggcccggacctaattttggtatcacaaattttgataatatcctcttcgccatcctgactgtgttccaatgtatcaccatggaaggctggactgacattttgtacaatacaaatgatgccgcaggaaatacatggaactggctatattttatccctcttatcattattggctcctttttcatgctgaatctggtcttgggagtgttatccggtgagttcgctaaggaacgggagagagtcgaaaacagacgggcatttctgaagctgcggcgacagcagcagatagaacgcgaactgaatggataccttgaatggatatttaaggctgaggaagtcatgctcgcagaagaggatcgaaatgccgaagagaaatccccacttgacgctgtactgaagagggccgcaactaagaaaagtcgcaatgatttaatccatgccgaggagggagaggatcggtttgctgatctgtgtgccgtgggatcgcctttcgctcgagcatctctaaagtccggaaagacagaaagcagcagctacttccggaggaaagagaagatgttcagattcttcattcgcagaatggttaaggcgcagagcttttactgggtggttctgtgcgtggttgctctgaataccctctgtgtagccatggttcactataatcagccacggaggttgacaactacactctacttcgccgagttcgtgttcctcgggctctttctgactgaaatgtctctgaaaatgtacggcctgggacctcgatcgtatttccgcagcagctttaactgttttgactttggcgtgatcgtgggtagtgtgttcgaggtggtctgggcagccatcaaacccggaagctctttcggcatttccgtacttcgggctctcaggctgcttcggatctttaaagtgacgaagtactggtcgtctttgagaaaccttgtcgttagtttgctcaattccatgaagagcatcatcagtctgctgtttctcctgtttcttttcatcgtggtgtttgccctcctggggatgcagttgtttggaggtcaatttaactttcaggacgagacgcctacgaccaactttgatacattcccggcagccatcctgacggttttccagattctaaccggagaggattggaacgccgtcatgtaccacggaattgaatcccagggtggtgtgtccaaaggcatgttttctagcttctatttcatagtgctgacactcttcgggaattacaccctgctgaatgtattccttgccatcgcagttgataacctggccaacgctcaggagcttacgaaagacgaggaagaaatggaagaggcagctaaccaaaagctggcattgcagaaagctaaagaagtggcagaggtaagtccaatgagtgcggctaacatcagcattgctgccagacagcagaatagtgccaaggcacgctccgtttgggagcaacgcgctagccagcttcgtctacaaaatctgcgcgcaagctgtgaggctctttactccgagatggaccctgaagaaaggcttagatttgctaccacacgccatctgagacctgatatgaaaacacaccttgaccggcctttagtggtcgagctagggagggatggtgcacgcggtccagttggcggtaaggctcggcctgaggccgcagaggcccctgaaggtgtcgacccccctcgcagacaccaccgccaccgggataaggataagactcccgctgctggagaccaagaccgtgcagaagctccgaaggcagagtcgggcgaacctggggcaagagaagagcgaccccgaccgcaccggagtcactctaaggaagcagccggtccgccagaagcgcgttcggaacgcggacggggaccgggacccgagggtggtaggcggcatcaccgcagagggagccccgaggaagctgcagagcgagagcccagaaggcaccgtgcccacaggcaccaggacccctccaaggagtgtgctggagccaagggggaaaggcgggcacggcaccgaggtgggcctcgtgccggacctagggaagcggagtcgggcgaggagccagcccgaaggcaccgggcacgccacaaggcacaaccagcgcatgaagctgttgagaaggaaacgactgaaaaagaagccaccgaaaaagaggcagagatcgttgaggcagataaggaaaaagagctgagaaatcatcagcccagggaaccacactgcgatctcgaaacttccggtaccgtgacagttgggccaatgcacactcttccaagcacttgcctccaaaaggtagaggagcaacctgaagacgcagataaccagcgaaacgtaacgcgcatggggagccagccacccgacccaaacacaatcgtgcacatccctgtgatgctcacgggcccactcggtgaagctaccgtcgttccaagcggaaacgtcgacctagaatctcaggcagaaggaaagaaggaagtggaagccgatgatgtcatgagaagtgggccaagacctatagtcccctattcaagcatgttctgcttgtcccccaccaaccttctgcgacggttttgccattacatcgtcaccatgcgatactttgaggtggtcatccttgtcgtcatcgccctttcatccatagctctggccgctgaggatcccgtaagaacagattccccacggaataacgccttgaagtatctggactatatctttaccggagtgttcacatttgaaatggtaatcaagatgattgatcttggactcctcttacacccgggagcctacttcagggatctctggaatatcctggactttatcgttgttagcggcgcactggttgccttcgctttctcagggtccaagggaaaggacattaacacaattaagagtctacgggttctgcgggttctgcggccactgaaaaccataaaacggttgcccaagctgaaagccgtcttcgattgtgtcgtcaatagcctgaaaaacgtcttaaatattctgatcgtgtatatgctctttatgttcatcttcgcagtcatagccgtgcagctgtttaagggtaagtttttctattgcacagatgagtccaaggagctggaaagagactgccggggacagtatttagattacgaaaaggaagaggtggaggcccaacctcgccagtggaagaaatacgatttccactacgataacgtgctgtgggccttgctaactcttttcaccgtctcgacaggagagggttggccgatggtcctgaaacactccgttgatgcaacctacgaagaacaggggccatcccctgggtatcgtatggaactctcaatcttttatgtcgtctactttgttgtattcccttttttctttgtcaacattttcgtggcgctaatcattattacgttccaagagcagggcgacaaggtaatgagcgaatgctccctcgagaagaacgagagagcctgcatcgactttgcgatttccgcaaagcctttaactaggtacatgcctcagaatcgccagtcttttcagtacaagacttggaccttcgtggtgagtcctccatttgaatactttatcatggctatgattgctttaaacaccgttgtgctcatgatgaagttttacgacgctccatacgagtatgaactgatgctcaagtgtctgaacattgttttcacctcgatgttcagcatggagtgcgtcttgaagattatagcttttggggtgctgaactattttcgcgatgcatggaacgtcttcgactttgtgacggtcctgggctctattactgacatacttgtcacggaaatcgccgaaactaacaacttcatcaatttgtcttttctgcggctctttagggccgcaagactgattaagctccttaggcagggctataccatcagaatcctcctgtggaccttcgtgcaatcattcaaggctctgccttacgtctgcctgcttattgctatgttatttttcatctacgccattataggaatgcaggtcttcggtaacatcgcactagatgatgacacatctatcaatagacacaacaactttcggacattccttcaggcacttatgctgctgttcagaagcgccacaggtgaggcttggcacgagatcatgctgagctgcctgagtaatcaagcctgcgacgaacaggcaaatgctaccgagtgcggctcagactttgcctacttctacttcgtatcttttatattcctctgttccttcctaatgctcaatctgttcgtcgccgttattatggacaattttgagtaccttacacgagactcttccattcttggccctcaccatctcgatgagttcataagggtttgggctgaatacgatcccgctgcttgcggacgaattagttataatgacatgttcgaaatgttgaaacacatgtctcccccacttgggcttggaaaaaaatgtccagccagggtggcctacaagagactggtgaggatgaatatgccaattagcaatgaagatatgaccgttcatttcacttcaacactcatggcgcttattagaacggcccttgaaatcaaattggccccagccggtactaaacagcatcaatgtgatgcagagttaaggaaggagatctccgttgtctgggccaatctacctcagaaaacccttgacctgctcgttccccctcacaagcctgatgagatgacagtcggcaaagtatatgccgctctgatgatcttcgacttctataagcagaacaagacaacacgggaccagatgcagcaggctcctggtggattaagtcagatgggcccagtctccctcttccaccccctgaaagctaccctggaacagacccaaccagccgtgctaaggggcgcacgagtgtttctcaggcagaaatcatctaccagcctgtctaatggcggtgcaattcagaaccaagagtccggtatcaaagagtccgtgtcttggggtacgcagcgcacccaagacgctccccatgaggcgagaccacctctggagcggggtcattcgactgagatccccgttgggcgatccggggctcttgctgttgatgtccagatgcagtcaattacacggagaggtcctgacggagagccccagcccggactggagtcccagggacgcgctgccagcatgccacggctagccgcagaaacccagcccgtcaccgatgctagcccaatgaagaggtctatttctaccctggcccagcgtcccaggggcacccacctgtgctccactactcctgataggccccctccatctcaagcctcaagccaccatcatcaccacaggtgccatcggagacgggacagaaagcagcgttctctggagaaagggccatcactgtcagccgatatggacggtgccccaagctctgccgtgggtccagggctgcccccaggggaaggaccaaccggttgcagacgcgaaagggagcgtcggcaggagcgagggaggagccaggagcgacgccagccttcctcctcttcctctgagaagcagaggttctacagctgtgacaggttcggcggtagagagccccctaagccgaagccttcattgagctcccatcccacgagccccactgccggtcaagagcctggaccccatcctcagggaagtggtagtgttaatgggtcccccctcctgagtacttctggcgcttcaactccaggcagggggggaaggcgacagctgccccagactcctctaactcctagaccctcgatcacctacaagaccgccaattctagtccaattcactttgctggagcgcagacatctcttcccgctttcagccctggtcggttaagccgcggactgagcgagcacaatgccttgctgcagcgggacccccttagtcaacctctggcccctggaagtaggattggatctgacccgtatctcggacaacgcctggattccgaggcatccgtgcacgcactgcctgaagatactttaacctttgaagaagctgtggccacgaatagtggaaggagcagcaggacgtcctacgtgagctctctgacctcgcagtcacatcctctgagacgggtgcctaatgggtatcactgtacgttaggattgtcttcaggcggacgggcacgtcacagctaccaccaccccgaccaggatcactggtgtta

SEQ ID NO: 216645 - DNA, 7016 bp, Artificial Sequence
  Description of Artificial Sequence: Synthetic coding sequence
atggtcaggttcggagatgagctgggcggaaggtacggcggacctggaggcggtgagcgggcacgcggaggtggtgcaggtggggcaggaggccctggcccaggcggtctgcagccaggccaaagagtgctctataagcaatccatcgcccaacgggcaagaaccatggcgctgtacaatccaattcccgtcaaacagaactgctttactgtcaatcgctccctgttcgtgtttagcgaagataacgtggttcggaaatacgcaaagcggatcaccgagtggccaccctttgaatacatgattctcgctacgatcatcgcaaattgtatagtgctggcgctggaacaacacctgcctgatggtgacaaaacgccaatgagcgaacggctggacgacaccgagccttacttcataggcattttctgcttcgaagctggtataaaaatcatagccctgggtttcgtttttcacaagggttcatatctgcgtaacggatggaatgtaatggactttgtggtggtgctaacgggcatccttgctaccgccggaactgactttgatttgcgcactcttcgtgccgtcagggtattgagaccactcaagctggtgtcaggaatcccgtctttgcaggtggtgctgaagtctatcatgaaagcaatggtgcctcttctgcaaatcgggctgctcctctttttcgctattctcatgttcgctattatcggcctggaattctacatgggcaagttccacaaggcatgttttccaaactcaacagatgctgagccagtgggagattttccttgcggtaaagaagcaccagcccgtctttgcgagggcgacactgagtgccgcgaatactggccaggcccaaattttggcatcactaactttgacaacatactgtttgccatcctgacagttttccagtgcatcactatggagggatggacagacattctgtataatacaaatgatgcggctggcaatacttggaactggctgtatttcattccgcttattattataggttcattcttcatgttgaatctcgtcttgggagtgctctcaggcgagttcgccaaggaaagggagcgggtggagaacaggcgcgctttcctaaaactccgtaggcaacaacaaattgagcgcgaactgaacgggtacctggagtggatcttcaaggccgaagaggtgatgctcgcagaagaggacaggaacgccgaggagaagtcaccccttgatgccgtccttaagagagcggctacaaaaaagagcaggaacgatctgatacacgcggaagaaggagaggaccggttcgcggacctgtgtgctgtgggatccccgttcgcaagagcaagcttgaagtctggcaagaccgagtcctccagttacttccgtaggaaagaaaaaatgttcaggttctttattcggagaatggtcaaggctcagtccttctactgggtagtgctgtgcgtggtggcactcaacaccctttgtgtggcgatggttcactataatcagcctcggaggctcacgacaacgctgtacttcgcagagttcgtatttctgggcctgtttttgaccgagatgtcactgaaaatgtatggcttgggacctaggtcctattttcggtcaagcttcaactgttttgacttcggagttatcgtgggatccgtcttcgaagtagtgtgggctgccattaagcccggttcgtcattcggcatttctgttctccgcgctctcaggctactccggatcttcaaagtgacaaagtactggtcatcgttacggaatctcgtggtcagcctcctgaacagtatgaagtctattataagcctcctgttcctcctattcctcttcatcgtggtgtttgctctcctgggaatgcagttatttggtggacagtttaatttccaggacgaaaccccaacaaccaacttcgacacgtttcccgctgcaatcctgactgtgtttcaaatccttaccggggaggattggaacgcagtaatgtatcatggtattgagagtcagggaggcgtgtctaaaggtatgttttcctctttttatttcatcgtgctgacactgttcggaaattacacgttgcttaacgtatttctcgcaatcgccgttgataatctggccaacgctcaggagctgactaaagacgaggaagagatggaggaagctgctaaccagaagttagctctccagaaggcaaaggaggtggctgaggtgagcccaatgtccgcagctaacatctccatagcagcgcgacagcagaactccgcaaaagccagatccgtctgggaacagcgcgcatctcagttacggctgcagaacttgcgagcttcatgcgaggccttgtatagtgagatggaccctgaggaaaggttgcgcttcgccaccacgaggcatctgagacccgacatgaaaacccatctggatcgaccactggtggttgagctgggcagggacggcgctcgcggacccgtggggggaaaggcgagaccagaggctgctgaggccccagaaggggtggacccgccacggagacatcacaggcacagggataaggacaagactcccgctgctggcgatcaggatagagcagaggctccgaaggccgaatcaggcgagcccggagcacgcgaggaaagacccagacctcacagatcacatagtaaagaagcagcgggtcctcctgaggcgagaagcgagcggggacggggaccaggcccagagggaggacgcaggcaccacagacgtggcagcccagaggaggccgcagaacgtgaacctcgcaggcacagggcacaccgtcaccaggaccccagtaaagagtgtgccggagcaaaaggcgaacgccgtgctaggcaccggggagggcctcgagctggccctcgggaagccgagtccggagaggagcccgcacggcgacaccgggcaaggcataaggcgcagccggctcacgaggccgtggagaaggagacgaccgaaaaggaagccactgagaaggaggccgagatcgtcgaggcagataaagagaaggaactccggaaccaccagcctagagagcctcactgtgacctagagactagtggcactgttacagtgggcccaatgcatacactccccagtacttgtcttcaaaaagtagaggaacagccagaggacgccgataatcagcgcaacgtaactcgcatgggcagccagcctcccgatcccaatacaattgtgcatattcccgtgatgttaactgggcctctgggggaggctactgtcgtcccatctgggaacgtggacctggagtctcaggccgagggcaaaaaagaagtggaggccgatgacgtcatgagaagtgggcctcggcctatagtgccatacagctccatgttctgcttatccccaaccaatttgctgaggcgcttctgtcactatatagtgaccatgcgttacttcgaggtggtgatcctggtcgttatagcgttatccagcattgccttggctgccgaagacccagtgaggaccgactctccaagaaataatgccctgaaatatcttgactacatctttactggggtcttcacctttgaaatggtcattaaaatgatcgatttaggtctgctattgcatccaggggcatacttccgggacctgtggaacattctggactttattgttgtgtcaggggcactggtggcattcgcattctccggaagtaaaggtaaggatatcaacacgatcaaaagtctgcgagttctccgagtactgagaccactgaagacaatcaagcgcctaccaaaactgaaggctgtgttcgactgtgttgtgaactctttgaaaaacgttctcaacatcctaattgtttacatgcttttcatgttcatcttcgctgttatcgctgttcagctttttaaaggaaagttcttttattgcaccgatgaaagcaaagagttggagcgagactgtagaggacaatatctcgactatgagaaggaggaggtggaggcacaacctcgacagtggaaaaagtatgattttcactatgataatgtcctgtgggcactccttacccttttcaccgtcagtacaggtgaaggctggccaatggtcctgaagcattccgtggatgccacgtacgaagagcaggggcctagcccgggatatcggatggaactgagtatcttctacgtagtctacttcgtggtattcccctttttcttcgtaaatatctttgtggctctgattataataacatttcaggaacagggggacaaggtcatgtcagaatgcagtctagagaaaaacgagagggcatgcattgatttcgccatctccgccaagcccctgacccgctacatgccacagaatcggcagagtttccagtacaagacctggaccttcgttgtatcccctccctttgagtacttcattatggccatgatcgccctgaatactgttgtcttaatgatgaaattctacgacgcaccctacgaatatgaattgatgctgaaatgcctaaatatagtttttacaagtatgttcagtatggaatgtgtcctgaaaattattgccttcggggtactgaactactttcgggatgcttggaatgtgtttgattttgtcactgtgctgggatctattacagacatcctggtaaccgagattgcaaacaattttataaatctgagctttctcaggttattccgagcagccaggctgatcaaactcctgagacaggggtacacaattcgcatcctattgtggacttttgttcagagcttcaaagcattaccctatgtatgcctcctgatagccatgctgttttttatctacgctattattggcatgcaggtgttcggcaatatcgccctcgatgatgacactagcatcaataggcacaataatttccggactttcctgcaagctctcatgcttctatttcgaagtgcaaccggcgaagcctggcacgagattatgttgtcgtgcctttctaaccaggcttgtgacgagcaggctaatgctactgagtgtggatctgactttgcctacttttactttgtgagcttcatttttttgtgttctttcctcatgcttaatcttttcgtggcagtaataatggataattttgaatatctgactcgcgatagttcaatcctagggccacaccatctggacgaatttatcagagtctgggctgagtatgatcctgctgcctgcgggcgaatatcttataacgatatgttcgaaatgctgaaacacatgagtccaccacttgggctgggcaaaaagtgtccggcacgggtggcctacaagcggttggtacggatgaatatgccaatcagcaatgaggacatgacggtccattttaccagtaccctgatggctcttattcggaccgcccttgagatcaagctcgcccctgcaggaaccaagcagcaccagtgtgacgccgagttgcgcaaggaaattagcgtcgtctgggccaacctcccacagaagaccctggacctgctggtgccccctcacaagcctgatgagatgacggttggaaaggtctacgcggctcttatgatctttgacttttacaaacagaacaaaacaactagagaccagatgcagcaagcacccggtgggttgagccagatgggtcccgtctccctatttcaccccctgaaagcaacgctggagcagactcagccagcagttctgaggggtgcgcgagtgttcctacggcagaagagttccacatcgctgtccaacgggggtgcaatccagaaccaggagagcggaataaaggagtccgtctcatgggggacccagcggacccaggatgcaccgcatgaggcacggccacctttggagcggggtcattcaaccgaaatccctgtggggaggtcgggagcactggccgtagatgtacagatgcaaagtattacacgcaggggcccagacggcgagccacagccaggcctggagagccaggggagagccgcatccatgccgagactcgctgccgaaacacaaccagtgaccgatgcctcacccatgaaaagaagcatcagtacactcgcccagaggccaagaggtacacacctgtgtagcaccaccccagaccgcccacccccaagccaagccagttcccatcaccatcaccacagatgccatcggcgtagggaccggaagcagcggtcacttgaaaagggtcctagcctctccgccgacatggatggtgcgccatccagcgcagtggggcctggcctgccacccggagagggccctaccgggtgccggagggagcgggaacgcaggcaagaacggggtcgttcacaggagcgtcgacagccttccagcagctcctccgagaaacaaaggttttactcttgcgaccggttcggcggacgagagccaccaaaaccaaaacctagcctgagcagccatccgacgtcacccacggctgggcaagaacctggaccccacccccagggatccggctctgttaacgggtcacccttgctcagtactagtggggcttcgaccccaggacggggaggacggcgtcaactgccacagactcctctgacacctcgcccatccattacttataagaccgccaatagctcacccatccatttcgcaggcgctcaaacctctttgccggctttttctcccggaaggctctctagaggactttcagagcacaacgccctactgcagcgagacccactgagccaaccactcgccccaggctcacgcatcgggtctgatccttatctgggccagcgcctggactctgaggccagcgtgcacgccttaccggaggataccctgacattcgaagaggctgtggctactaacagcggacggtcaagtagaacctcgtacgtgtctagcttgacaagccagtctcacccccttcggagagtgccgaacgggtaccattgtacattggggctctccagcgggggacgtgctcgtcacagctaccaccatcccgaccaagatcactggtgcta

SEQ ID NO: 216646 - DNA, 7013 bp, Artificial Sequence
  Description of Artificial Sequence: Synthetic coding sequence
atggtgcgattcggagatgagctgggaggccgttacgggggaccagggggaggggagagagctagggggggaggcgctggcggagccggtggacccggtccaggaggcctccaacccggacagagagttctttataaacaatccatcgctcagagggcccgtaccatggctctgtacaatcctatacccgtcaaacagaactgttttaccgtgaatcgtagccttttcgtattctcagaggataatgtggtgaggaagtacgcaaaacgcatcaccgagtggcccccatttgagtacatgattctggctactatcatcgctaactgcatcgtgctggcgctcgaacagcacctgcccgacggcgacaagacacccatgtcagaaagactagatgacacggagccctactttattggaatcttttgctttgaagccggaatcaagattatcgccctcgggtttgtttttcacaagggatcttatctaagaaacggatggaatgttatggatttcgtggtggtgctgacaggcatactcgcgactgccggtacagacttcgacctgcgaaccctgcgcgctgtcagagtcctcaggccacttaaactagttagcggaatcccatctttgcaggtggtcctaaagagtattatgaaggccatggtacctctgttacaaatcggactcttgctcttctttgccatcctaatgtttgctataatcggactggaattctacatgggtaagttccataaagcttgcttcccaaactccaccgacgccgagccagtcggggattttccctgcggcaaagaagcaccggcaaggttgtgcgaaggcgatactgaatgcagggaatactggccagggccaaacttcggaatcactaatttcgataacattctgtttgcaatcctgaccgtgttccaatgcattacgatggagggttggaccgacatcctgtataacactaatgatgccgctggtaatacgtggaactggctatactttatccccttaataatcatcggaagcttcttcatgctgaacttggtgctgggggttctatccggtgagtttgctaaagagagagagagagtggagaataggcgtgcattcctcaaattgcgcagacagcagcaaattgagagggaactcaacggctacttggagtggatttttaaggccgaggaagtcatgctggctgaggaagaccgcaacgctgaagagaagtccccactggacgtgctgaaaagagctgcaactaaaaagtctcgtaatgacctgattcacgccgaggagggggaagatcgattcgccgacctgtgcgcggtgggctcgccattcgcgagagcctcgttgaaatccggcaagaccgagagctcttcatacttcagacgcaaggaaaaaatgttccggttcttcattcgtcgtatggtgaaagctcagtctttttattgggtagtgctctgtgtggtcgcactgaacaccttatgtgtagctatggtacactataatcagcccagacggttgacgactacattatacttcgcagagttcgttttcttaggattattccttacggagatgagtcttaagatgtatggcctggggccacgcagctacttccgctccagctttaactgcttcgattttggagtcatagtgggcagcgtattcgaggtggtttgggctgccataaaaccaggcagctcattcggcatcagtgtgctgcgcgctttgcgcctcctccggatttttaaagtcacaaagtactggagcagcctgcggaacctggtggtctccctgctaaactccatgaaatccattatttctctcttatttctcctttttttgttcattgtggtgttcgccctcctcggcatgcaactcttcggaggccagtttaacttccaggacgaaacgcccaccaccaacttcgatacctttcctgccgctattctgactgtcttccaaatcctgaccggtgaggactggaacgcagttatgtatcatgggatcgagtcgcaggggggagtctccaaaggcatgttttctagtttttattttatcgtgctcaccttgtttggtaattacaccctcctgaacgtcttcctggcaattgccgtcgataatctggccaatgcacaagaattaaccaaagatgaggaagagatggaagaggcggcaaaccagaagttggcattgcagaaagccaaagaagtggctgaagtatcccctatgtctgctgcaaacatttctatcgcagcaagacagcaaaactcagccaaggccagatcggtgtgggaacagcgtgcctcgcagctcaggctccaaaacctgcgcgcatcttgcgaggccttgtacagcgagatggatcccgaggagaggttaaggtttgccacgacccgccacctgaggccagacatgaaaacccaccttgatcggcctcttgtagtggagctgggacgagacggtgcacggggacctgtcggcggtaaggcacgtccagaggcggctgaagcccctgaaggcgtcgatccgccacgtaggcatcatcgccatcgcgacaaagataaaacccccgcagctggtgatcaggatagggccgaggctccgaaggctgaatctggtgaacccggtgccagagaggagcgacccagaccacaccgctctcacagcaaggaggcagctggaccgccagaggcacggagcgagcgtgggagaggccctggtccagaaggagggagacgacaccaccgcagagggagccctgaagaggccgctgaacgagagccacgacgtcaccgcgctcaccgacatcaggacccctctaaggagtgcgctggcgctaaaggggagagaagggccagacacagggggggacccagagccggtccaagggaggccgaaagcggtgaagagcctgcaagaagacaccgcgcacgccataaagcccaacccgcacatgaagccgtggaaaaggagaccacagaaaaagaagccactgagaaagaggcagaaatagtggaggctgacaaagagaaagaacttagaaatcatcaaccccgagaaccacattgcgaccttgagacaagtggtacagtcactgtagggccaatgcacaccctgccatccacctgcctgcaaaaggtggaggaacagccagaagatgctgacaatcaaagaaacgtaactcgcatggggtcacagccccctgacccaaacaccatagtgcatattccagtgatgttaacgggacctcttggcgaggcgacagtcgtacccagtgggaacgtcgatttggaatcccaggctgaggggaagaaagaggtcgaggcagatgacgtgatgcgttccggaccgaggccaattgtgccttactcatccatgttctgtctaagcccaaccaatctgctgagacgtttttgccattacatcgtgaccatgcgatacttcgaggttgttatactcgtcgtgattgctctctcctccatcgccctagcggcagaagatcccgtaagaacggactctcccaggaataatgccttgaaatacctcgattacatattcacaggcgtgttcacgttcgagatggtgatcaagatgatcgatctcggactcttgctgcatccaggtgcttatttcagggacctgtggaatattctcgatttcatcgtcgtcagtggtgctcttgtcgccttcgccttttcaggatccaaaggtaaggacattaacacgataaaaagcttgagggtcctccgggtgcttcggcctcttaaaacaataaaacggctaccgaaactgaaggccgtatttgactgtgtcgtcaatagtcttaagaacgtgctgaatatattaattgtttacatgcttttcatgttcatttttgcagtgattgccgtccagctgttcaaaggtaagtttttttattgcaccgacgagtcaaaggaactcgagcgagactgcaggggccagtatctggattacgaaaaagaagaggtcgaggctcaaccacgccagtggaaaaagtacgattttcactacgacaatgttctctgggcactcctaactctgttcactgtctcgacaggcgaagggtggccaatggttctcaagcacagtgtggacgccacttatgaggaacagggtccgagtcctggttaccgtatggagctgtcaatcttttacgtggtctacttcgtggtgttcccattttttttcgtgaacattttcgtagctctcattataattactttccaggagcaaggcgataaagtcatgagcgagtgctccctggagaagaatgaaagggcttgtattgactttgcaatcagcgctaaacctctgacaaggtatatgccgcagaatcgccagagctttcaatataagacttggacctttgtggtatcccccccattcgagtattttatcatggctatgattgccctgaacacagttgtcctgatgatgaagttttatgatgccccatatgaatacgaactcatgctgaaatgcctcaacattgtttttacttctatgttctctatggagtgcgtgctgaaaattatcgctttcggagtcctaaactatttccgtgacgcctggaatgtgttcgactttgtgacagtcctcggttcaatcacggacatacttgttacagaaattgccaacaatttcataaatttatcttttctgcgcttgttccgggctgcaaggctcatcaagttgctgcggcaaggctatactatccgaatactactgtggaccttcgtccagtcttttaaggctctcccttatgtgtgcctgcttatcgctatgctcttcttcatctacgcgatcatcggtatgcaggtgtttggcaatatagcattggatgatgacaccagtattaacagacacaataacttcaggactttcttacaagccctgatgctactgtttcgctcagcaacaggtgaagcgtggcatgagattatgctgtcatgtctgtccaaccaggcctgcgatgaacaggctaacgccacagaatgtggatccgacttcgcctatttttattttgtgtcattcatcttcctatgcagttttcttatgctgaatctgtttgtggcggtcattatggacaactttgagtacctgacacgggattcttctattctggggccacatcacttagatgaatttatcagggtgtgggcagaatatgacccagccgcttgcgggcgaatctcatacaatgacatgttcgaaatgctgaaacatatgagccccccactgggactggggaagaagtgtcctgccagagtcgcttataaaaggttggtgcgcatgaatatgcctataagcaacgaagacatgactgtgcatttcaccagtactctaatggcgttgattaggactgccctcgagatcaagttggctcccgctgggaccaagcagcatcaatgcgatgcagagcttcggaaagagatttctgtcgtctgggccaatctaccccagaagactctggatcttttggttcctccacataagccggacgaaatgacagtgggaaaagtctacgcagccctgatgatttttgatttttacaagcagaataagaccactcgcgatcagatgcagcaggctccagggggtctgagccagatgggaccggtgtccctgttccatccattgaaagccacactggaacagacccaacccgcagtccttagaggagctcgcgtgttccttcgccagaagagtagcacaagcctcagtaatggtggagcaatccagaatcaagaatcagggattaaggagagcgtgtcttgggggacacagagaactcaggatgcgccacacgaggcaaggccaccgctcgagcgaggccactctacagagatcccagtcggacgttcgggagctctcgccgttgatgtgcagatgcagagtattacccgtagaggccctgacggagaaccgcagcccggacttgagtcccaggggcgtgccgctagcatgcctaggttagcagcagaaacacagcctgtgacggacgcatcacctatgaaacgttcaattagtactctggctcagaggcccagagggacccatctctgttccactacacctgataggcctccaccctcgcaggccagttcccaccaccaccaccatcgctgccatcggaggcgggatagaaagcagcgaagcctcgaaaaggggcctagcctctccgccgatatggacggtgcgccatccagtgctgttgggcctggtctcccccctggcgaggggcctacggggtgtagacgagaacgagaacggaggcaggaacgaggacgcagtcaagaaaggcgtcaacccagctcatcctcttcagagaagcaacgcttctattcatgcgatcgcttcgggggtagagagcctcctaagcctaagccctctctaagttcacatcctacttctccaaccgcaggccaggaaccgggacctcatccccagggaagtggttcagtcaatggatcacctctacttagcacctccggagcctcaactcctggtcggggaggcagacggcaacttccgcagacgccgttaacacctcgaccaagcatcacgtataagactgcgaacagttccccaattcacttcgctggcgctcagacctcgttacctgccttttccccagggaggctgagccgcggtctgtccgaacacaacgcgctgcttcagagggaccccttgagccagccattggccccaggttctcgcatcgggagcgatccttacctcggccagcgtctggatagtgaggcgagcgtgcatgccctccccgaagacacgctgactttcgaagaagctgtggcaactaatagcggcagaagtagtcgcaccagctacgtcagtagcctcacttctcagagccatccgctgcggagggtgccaaacggataccattgcaccctcggactttcatcaggaggacgagcccgtcattcctatcaccaccctgatcaggatcattggtgcta

SEQ ID NO: 216647 - DNA, 495 bp, Artificial Sequence
  Description of Artificial Sequence: Synthetic coding sequence
aacttccggacctttctgcaggcactaatgttgcttttcaggtcggctaccggagaggcttggcatgagatcatgctctcctgcctgagcaatcaagcgtgtgatgagcaagccaacgcaacagagtgtggatcagattttgcgtacttttacttcgtgtcgtttattttcctgtgtagttttttaatgctgaacctgtttgtcgccgtaatcatggacaattttgagtatctgacacgtgatagcagcattctagggccacatcaccttgatgagtttatccgggtgtgggccgagtacgatccagccgcatgttgccggatccactacaaggatatgtattccctgttaaggtgcatcgccccacccgtggggctcgggaagaactgtccgcgacgtttggcttacaaaaggcttgtgaggatgaacatgccaatctcgaacgaggacatgaccgtccactttacctccacgcttatggctcttatccgttag

SEQ ID NO: 216648 - DNA, 327 bp, Artificial Sequence
  Description of Artificial Sequence: Synthetic coding sequence
ttaaggaatcaccagcccagggagccccactgtgacctggagaccagcggtacagtgacagtcggtccaatgcacacactgcctagcacatgtcttcagaaggtggaagaacagcccgaagacgctgacaaccagcgtaacgtaacgcgtatgggctctcaaccacccgaccccaataccatcgtgcatatcccagtaatgctcactgggcctttaggcgaagctaccgtagtccctacgctcgagaaaaacgtttgcctgtttcttctaacaagcatggtctctgacgaaaaatccactgtgatcagaattgtattctttttgtag

SEQ ID NO: 216649 - DNA, 7019 bp, Artificial Sequence
  Description of Artificial Sequence: Synthetic coding sequence
atggtccgctttggcgatgaacttggtggcagatacggcggacctggtgggggtgaacgagccagaggcggaggcgctggtggtgctggcggaccgggaccaggcggactgcagccaggtcagagggtgctgtataaacagagcattgcccaacgcgctcgaactatggccctatacaatccaatccctgttaagcagaattgcttcaccgtcaatcgctcgctgttcgttttctcagaagacaatgtagtcaggaaatatgctaaaaggatcactgaatggcctcccttcgagtacatgatcttagctactatcattgctaactgcatagtacttgccctggagcaacatctgccggatggagataaaactccgatgtctgaacgcttggatgatacggagccatacttcattggtatattctgcttcgaagctggcataaagataatagcactcgggttcgtatttcacaagggatcctatctgcgcaacggttggaatgtgatggatttcgtggtcgtcttaacaggcatactggccaccgcaggcaccgacttcgacctgagaaccctgagggccgtccgagtactgcgccctctgaagcttgttagcggtatacccagcctccaggtcgtcttgaagtcaataatgaaggccatggttccactcctccagattgggctgttattatttttcgcaatactgatgtttgccataatcgggctcgaattttatatgggcaagttccacaaggcctgctttccaaatagcaccgacgctgagcccgtgggcgattttccgtgtggcaaggaggccccagccagactgtgtgaaggcgacacagaatgcagggagtactggcccggtcccaatttcggaatcacgaactttgataacatcctatttgccatcctgaccgtctttcaatgcatcacaatggagggctggaccgacatcctttacaacacaaatgatgccgcaggcaatacctggaattggctgtattttataccccttatcatcatcgggagtttttttatgctaaacctggttcttggagtgcttagcggcgaatttgctaaggagagggaaagggttgagaatcggagggctttcctgaagcttaggcggcaacagcagatcgagcgcgaactcaacggctacttagagtggattttcaaagctgaggaagtgatgctcgctgaagaggatcgaaacgcagaggagaagtccccactggatgtactgaagagagccgcaaccaagaagtcaaggaacgacctcattcacgcagaagaaggggaagaccgcttcgccgatttgtgcgccgtcggaagccccttcgctagagcctcgctgaagagcggcaaaactgaatccagttcttactttcgcagaaaggagaagatgtttcgttttttcatccgtagaatggtgaaagcccagtccttttactgggtggttttatgtgttgtggctctgaacactctttgtgtggccatggtccactacaaccagcccagacgcttgaccacaacgctctatttcgctgagtttgtgttcctgggattatttctgacggaaatgagcctgaagatgtacggcttaggaccccgttcctatttcaggtcgtcttttaattgtttcgacttcggcgtcatcgtgggatctgtattcgaggtcgtttgggctgctatcaagcccggatccagcttcggaatttccgtgctgagggccctgcgactactacgcatttttaaagtgaccaaatactggagcagcctgcgaaacctcgttgtgtcccttttgaactctatgaaatccataatcagcctgttgtttctgctgtttctgttcattgtcgtgtttgccttactcggcatgcagctcttcggaggacagttcaatttccaggacgagacaccaacaaccaatttcgatacatttccagcggcaatactgaccgtgtttcagattctgaccggggaagattggaatgcagtcatgtaccacggaatcgagtcccaggggggtgtctcgaagggcatgttctccagcttttacttcatcgttctaactctgtttggcaattacacactgctgaacgtttttctcgccatagccgtggacaatctggccaacgctcaggagctgaccaaagacgaggaggagatggaagaagctgctaaccagaagctcgccctccaaaaagctaaggaagtagccgaggtatcccccatgagtgctgctaacattagtatcgctgcaaggcagcaaaattctgccaaggcccgttctgtgtgggagcagcgagcttctcagctgcgcttgcagaatctgagggcatcatgcgaagccctctactccgaaatggaccctgaagagcgcctgagattcgctaccaccagacacctacggccagatatgaagactcacctagatagacctctggtggtagaactaggaagagatggggctagaggcccagtgggcggaaaagctaggcccgaagccgcagaggctccggaaggcgtcgatccacctcgacggcaccatcgccaccgcgacaaggacaagacccccgcagctggcgaccaggatcgggcagaggccccaaaggccgagagtggcgaaccaggggcacgagaggagcgccctcgaccacataggtcccatagcaaggaggcagctggtcctcctgaggcgagaagcgagcgtgggagaggacccggacccgagggagggaggcgccaccatcgcaggggctcccctgaggaggccgcagaaagagaaccgagacggcacagagctcatcgacaccaggatcctagtaaggaatgcgcaggcgcaaagggcgagaggcgggcacgccatcgcggagggccacgggcagggcctcgtgaggctgagtctggtgaggagccagcaagaagacaccgagctcgccacaaggctcagccagctcacgaagccgtcgagaaagaaaccacggaaaaggaggctaccgagaaggaggctgaaatcgtggaggctgataaggagaaggagctccgtaatcaccagcccagggagccacattgcgatcttgaaacctctggtaccgtcacggtagggcctatgcacactcttcctagcacatgtctgcagaaagttgaagagcagccagaggacgccgataaccagagaaatgtgacccggatggggtctcagccaccagatccaaacaccattgtgcacattcccgtgatgttgacaggaccccttggagaggccacagtggtaccctcaggcaatgttgacttggagtcacaagcagagggtaagaaagaggtggaagcggacgacgtgatgaggagcggcccacgtcctatcgtcccctacagtagtatgttttgtctgtcaccaacaaatctgctaaggcggttttgccattatattgtcacaatgagatactttgaagtcgtgattctggtagtaatcgccttgtcaagtatcgcactagccgcagaggatcccgtccggaccgactctccccgtaacaatgctctgaagtatctcgattacatttttaccggggtattcacatttgagatggtgatcaagatgatcgacctcggtttgctcctgcatcccggagcttactttagagacttgtggaatatactggacttcattgttgtctcaggcgctctggtagctttcgcattttcaggaagcaagggaaaggatattaatacaatcaaaagcctaagggtgctccgggtgttgagaccacttaaaacaatcaaacggctgcccaaactgaaagccgtgtttgactgcgtggtcaactccttgaaaaatgtgctgaacattttgattgtctacatgctgttcatgtttattttcgccgtcatcgctgttcagctgtttaagggcaaatttttttactgcactgatgagtccaaagaattggaaagagactgtagagggcagtatctggattatgaaaaagaggaggtagaagctcagcctcgtcagtggaaaaaatacgactttcattacgataacgtgctgtgggccctgctaacactattcacagtctctacaggggagggttggcctatggtgcttaaacattcagtggacgccacttacgaggagcagggacccagtccaggatatcgtatggagctgagcatcttttatgtcgtttacttcgtggtgtttccatttttttttgtgaacatctttgtcgcgctcattatcatcaccttccaggagcagggggacaaggtaatgtccgaatgttcactggagaagaacgaaagggcttgcatcgactttgccataagcgcgaagccactcacaagatacatgccacaaaatcgacagtccttccagtataaaacatggacctttgttgtgtccccccctttcgaatacttcatcatggctatgattgctcttaacaccgtcgtgctaatgatgaaattctatgacgctccctatgagtacgaactgatgctgaaatgtttgaacatcgtgtttactagtatgttctctatggagtgcgtgttaaagatcatcgctttcggcgtgcttaattattttcgggacgcatggaatgtgtttgattttgttactgtgctgggctccataaccgacatactggtgactgaaatcgccgagactaataactttattaatctgagcttcctacgcctgttcagggctgcccgtctcattaagttactgcggcagggctataccattaggatactactttggactttcgtccagtctttcaaggccctgccctacgtttgtttgcttatcgctatgctctttttcatttacgctatcatcggaatgcaggtctttggcaacatcgccctggatgacgatacgagcatcaatcggcacaacaacttcaggaccttcttgcaggccctgatgttgctgtttcggtcagcaacaggagaggcatggcacgaaataatgctctcttgcctgagcaaccaggcctgtgatgagcaggcgaacgctaccgagtgtgggagtgatttcgcatatttctattttgtctcatttattttcctgtgctcattccttatgctgaacctatttgtggccgtgattatggacaattttgaatacctgaccagggattcgtccatccttggtcctcatcacctggatgaattcatccgggtctgggcagaatatgacccagcggcttgcggtcgaatttcctacaatgatatgttcgagatgctgaaacacatgtccccacccctcggtctgggaaaaaaatgccccgcacgagtcgcgtacaagcgtttggtaagaatgaacatgccaatcagcaacgaagatatgactgtgcatttcacctcaacattgatggctctgattcgcaccgccctcgagatcaagttagctccagccggtacgaagcaacaccagtgtgacgccgagctgcgcaaagaaatcagcgtcgtttgggcaaatttgccccagaagacactggatttactggtgccaccacacaaaccagacgaaatgaccgtgggcaaggtctatgctgcgttaatgatctttgatttctacaagcagaataaaactacacgggaccagatgcagcaagccccaggtggtctctcccagatgggcccagtcagtctgtttcatcccctgaaggctactctcgaacagactcagcccgcagttcttcgaggcgctcgggtcttcctaaggcagaagtcatccaccagtctctctaatggcggagctatacagaatcaagagagtggtattaaggaaagtgtgagttggggcacccagaggacacaggacgctccccacgaggccaggccgcctcttgaacgtgggcactcaacagaaattccagtgggcaggtctggcgcactcgccgtggacgtgcagatgcagagcataacacggagaggccctgacggcgagcctcaaccaggtcttgagagccagggtcgagctgcctcaatgcctcgactggctgcagagacccagcccgtgaccgatgcctccccaatgaaacgaagcatcagtacgcttgcccaaaggccacgaggtacccatctttgcagcacgactcctgaccgaccccctccaagccaggcatcaagccaccaccatcaccaccggtgtcatcgaagacgcgatcgcaagcagagatccctcgaaaagggccctagcttatcagcagatatggacggagccccatcaagcgctgtgggcccagggctcccccctggagagggaccaacaggctgcagaagggaaagagagcggcgtcaggagagaggcagatcccaggagcgccgtcagcctagtagctcatcctcagagaaacagagattctactcatgtgataggtttggtggcagggagcccccaaagccaaagccgtctctgagcagtcacccaaccagtccaaccgctggtcaagaaccagggcctcatcctcaggggagcggaagtgtgaatgggtctcctctgctttcaacatctggagccagtacaccagggagggggggtcgccgacagctcccccagacgccacttaccccaagaccaagtatcacatataaaacggctaactcatcccccatccatttcgcaggcgctcaaacctctctgccagccttctccccaggtcgcttgagtcgtggattgtcagaacacaatgcgctcttgcagagggatccactttctcagccccttgccccaggtagtcgcattggctctgatccctatcttggacagcggcttgatagcgaggcaagtgtgcacgccttaccagaagatacattgaccttcgaggaagctgtagccacgaacagcggtagatcttcacggacttcttacgtatcctctctgacgagccagtcacaccccctgcgtagagtgccgaatgggtaccactgtaccttgggtcttagttcaggcggacgagcccgacatagttaccaccacccagaccaggaccattggtgcta

SEQ ID NO: 216650 - DNA, 498 bp, Artificial Sequence
  Description of Artificial Sequence: Synthetic coding sequence
taaaattttagaactttccttcaggctctgatgctgctgtttaggtccgcaaccggcgaggcatggcatgaaattatgttgtcttgcctgtctaatcaagcatgcgacgagcaggccaacgctacagaatgcggtagtgactttgcatacttctactttgttagttttattttcctgtgttcttttctgatgttgaatcttttcgttgctgttattatggacaattttgaatatctcacgagggactcctcgatactcggcccacaccaccttgatgagtttatcagagtctgggcagagtacgatcccgcagcttgttgtagaatccattataaagatatgtatagtttgctgcgatgtattgcaccccctgtgggcttaggcaaaaactgcccaaggcggctcgcctataaaagactggtcagaatgaacatgcctatatcaaacgaggacatgactgtgcacttcacatctaccctaatggcccttataaggtag

SEQ ID NO: 216651 - DNA, 564 bp, Artificial Sequence
  Description of Artificial Sequence: Synthetic coding sequence
ctgaggaatcaccaacccagggagccccattgcgatctggaaacatccgggactgtgaccgttggccctatgcacacactgccctctacctgcctgcaaaaggtagaagaacaacctgaggacgcagacaaccagagaaacgttaccagaatgggatcacaacctcccgatcccaacacaatagtgcacatccctgtcatgctgactggccctctaggtgaagccaccgtggttccatcacccacgatcggcagactgcaggccgaggagcaaggtgagcctgccagggtttccaagcttaatttggagagcgacgtgcgtgggcaggaagcttcatccaccggcgagaggtaccggctggggggaggcaatgtcgaccttgaatcacaggccgagggaaagaaagaagtggaggctgatgacgtcatgaggagtgggccacgcccaatcgttccgtacagttcgatgttctgtctgagccctaccaaccttctcagacggttttgccactatatcgtgacaatgcggtacttcgaggtggtgatcttggtggtgattgcctag

SEQ ID NO: 216652 - DNA, 6785 bp, Artificial Sequence
  Description of Artificial Sequence: Synthetic coding sequence
atggcaagattcggagatgaaatgcccgcacggtacggaggcggagggtctggggcagctgcaggggtggtggtcggatccggtggcggtaggggggcaggagggtcaaggcaaggcggacagccaggtgctcagaggatgtataagcagtcgatggctcagcgggctcggaccatggcgctatacaatcctattcctgtccggcagaattgccttactgtgaacaggtctctcttcctgtttagcgaagacaatgtggtccgtaagtatgcgaagaagatcactgagtggcctccatttgaatacatgatcttagccactattatcgcgaactgtattgtgctcgcccttgagcagcacctgccagacgatgacaagacccccatgagtgagcgattggatgacaccgagccgtacttcattggcattttctgtttcgaggcagggatcaagataattgcactgggcttcgctttccataaaggcagctacttgagaaatggttggaacgtgatggacttcgtggtcgtactcacaggcatattggctaccgtcggaactgagttcgatctccgtaccctgagggcagtgagggttttgcggcctctgaagctagtgtctggcatccctagtctgcaagtggtactgaagtccattatgaaggctatgattcccctgctgcagatagggttgttgctgttctttgccatactgatctttgccataatcgggcttgaattctatatgggcaaattccacaccacatgcttcgaagaagggactgatgatatccagggagagtcaccagccccatgcggcaccgaggaaccagcccgtacctgtccaaacggcacgaaatgtcagccctactgggagggcccaaataatggcattacccagttcgacaacatcttgttcgcggtcctaaccgtgtttcagtgtatcactatggaagggtggactgatttgctgtacaattcaaatgacgcctcaggcaatacttggaactggttgtattttatccccttgatcatcatcggatcctttttcatgctgaacttagtactgggcgtgttatccggagaatttgcgaaagagagagagagagttgagaataggcgagccttcctgaaactgagaagacagcaacagatagaaagggaactgaacgggtacatggagtggatttctaaggcggaagaggtcattctggccgaggatgagacagacggagagcagcgtcatccgttcgacggcgcactcaggcgcacaacaatcaaaaagtccaaaacagacctactgaatccagaagaggcggaggaccaactggccgacattgcctcggttggctccccctttgcccgtgcaagcatcaaatccgccaagttggagaatagtacctttttccataagaaggaaagacgtatgcgattctatatcaggaggatggttaagactcaggccttttactggacggtcctctccctggtcgcacttaatactttatgtgtggccatagtgcattacaaccagcctgaatggttgtcagactttttatattacgccgagttcatcttcctggggcttttcatgtccgaaatgttcattaaaatgtatggattgggtacccgtccctattttcatagctccttcaactgttttgattgcggcgtgatcatcggatctatattcgaagtcatctgggcggtgattaagcccggaacttccttcggaatctcagtgctccgcgcattacgccttttgcggattttcaaggtgacgaagtattgggcgagcctgcggaatctggtggtctctctgttaaacagcatgaagtccatcattagcctgctgttcctactgtttttatttatcgtggttttcgcccttttggggatgcagcttttcggaggccagtttaattttgacgaaggcacccctcctaccaactttgacactttcccggcagcgatcatgacggtttttcagatcctgactggcgaggactggaatgaggtaatgtacgatggcatcaagagtcagggtggcgtccaaggagggatggtcttctccatctactttatcgtactcactctgtttggtaattatacgctgctgaatgtttttctggccattgctgtggataacctggcgaacgcacaggagctgaccaaggatgagcaggaggaagaggaggcagctaaccagaaattggctctgcagaaagccaaagaagtggcagaggttagtcctctgtccgccgctaatatgtccatcgccgtaaaggagcaacagaaaaaccagaagccggctaaatccgtttgggaacagcgaacctcggagatgcgcaaacagaaccttctggctagtagggaggctctttataacgaaatggatcccgatgagaggtggaaagccgcttatacccgtcacctaagaccagacatgaagactcacctggatcggccattggtggtcgatccacaggaaaatcgcaacaataacactaataagagccgggcagctgagcccaccgtggatcagcgactgggacaacagcgcgctgaagactttctgagaaagcaggccagataccatgatagagccagagatccctccgggtctgcaggactcgacgctcgtagaccatgggccggaagccaagaggcagagctgtcccgcgagggcccttacgggagagagtccgatcatcacgctagggagggctcactggagcaaccgggattctgggagggagaggcggaaaggggtaaggccggagatcctcatcggcgtcatgtgcatcgccagggtggctctcgtgagagcagaagcggatctcctcgtactggggcagacggagagcatcggaggcaccgggcacaccggaggcctggcgaggagggaccagaggataaggctgaaaggcgcgctcggcatagggagggcagcaggcctgctcgtggaggggagggagagggcgagggacctgacggcggagaaagacgaagacggcataggcacggcgcacccgctacatacgagggcgatgcaaggagagaggataaggagagacgccatcgcaggcgcaaagagaaccagggaagtggcgtgccagtctcaggtccaaatctctccactacacggcctatccagcaggacctgggccgtcaggaccccccactcgcagaagacatcgataacatgaaaaataataagcttgccacggctgagagtgccgctccccatggttcactggggcacgccggactgccacagtctccagccaaaatgggcaattccaccgatcctggccctatgctggcgattcctgcgatggccacaaacccccaaaacgccgcttctagaaggacccctaacaacccaggcaacccttccaatccgggtccccctaaaacccccgagaacagtctaatagttacaaatccctccggtacgcagacaaacagcgcgaagactgccagaaagcccgaccatacaacagttgacataccccctgcctgcccaccaccactgaaccatacagtggttcaggttaacaaaaatgcgaaccccgacccactgcccaagaaggaagaagagaaaaaggaagaggaggaggacgacaggggtgaggacggtccaaagccaatgcccccatacagcagcatgtttatcttgagtactaccaaccccttgcggaggctctgccactatatcctcaatctacggtatttcgaaatgtgtatcctgatggtgatagccatgtccagcatagctctggccgcagaggaccccgtccagcccaacgctccaagaaacaacgtgttgaggtacttcgactacgtctttacgggcgtgtttactttcgaaatggtaataaagatgatcgatctggggctggtgctccatcagggagcctacttcagggacctatggaacatcttggacttcattgtcgtcagcggtgctttagtcgcctttgccttcacaggcaattccaagggtaaggatattaacacgatcaaatcactgcgcgtactgagggtactccgcccattaaaaaccatcaagcggctgccaaagctgaaagccgtgttcgattgtgtagtgaacagcttgaagaacgtgtttaatattttaatcgtctacatgctgttcatgtttattttcgccgtggttgctgtccaactttttaaaggcaaatttttccattgtacagatgagtctaaggaatttgagaaggactgcagggggaaatacctgttatatgaaaagaatgaggtcaaagccagggaccgggagtggaagaagtacgagtttcattatgacaatgtcctgtgggccctgttgacactattcacggtgtccacgggagaaggttggccccaagtgctgaaacacagtgtcgatgccacctttgagaaccagggaccaagtccgggatatcgcatggaaatgtccatattctacgttgtctattttgtagtctttccgtttttcttcgttaatattttcgtggccctcattattattactttccaggaacagggagataaaatgatggaggagtattccctggaaaagaacgagcgggcttgtatcgatttcgccatcagcgcaaaacccctgacgagacatatgccacaaaataaacagagttttcagtaccgcatgtggcagtttgtggtgagcccccctttcgagtatactatcatggctatgattgccttaaacaccatcgtgctgatgatgaaattctacggggcttcagtggcctatgagaacgcgctgagagtttttaacatcgttttcacatccctcttctcactagaatgtgtgctgaaggtgatggcctttggcatcctgaattactttagggacgcctggaacatcttcgattttgtgactgttctgggctcgatcacagatattcttgtgactgagttcggaaataatttcatcaatctgtccttcttgcggctattccgcgctgcccgattaatcaaactattgagacagggctacaccatcagaatcctgttgtggacatttgtacagagtttcaaagcactcccttatgtgtgcctgctcatagccatgcttttttttatctacgctataatcggaatgcaggtgttcggtaatatcgggattgacgtcgaagatgaggattcggacgaagatgagtttcaaattactgaacataacaactttcgcacatttttccaggccctgatgcttctgtttcgctccgctacaggcgaagcctggcacaatattatgctgtcatgcctgtctggtaaaccatgcgataaaaatagtgggatcctaacacgcgagtgtggtaacgagttcgcgtacttctacttcgtgtcctttatttttttatgcagcttcctgatgctgaatctctttgtagcagtgataatggataatttcgagtatctcactagggattccagcatcttggggcctcaccatctcgatgagtacgttcgggtgtgggcagagtacgatcccgcagcatgcgggagaattcattacaaggacatgtacagtctattacgagtaatcagcccccctctaggcctaggtaagaaatgtccacatcgggtggcctgtaagcgcctgctgcgtatggatcttcctgtggcggatgacaataccgtgcattttaatagtacacttatggcactgattcgcacagctctcgacattaagatagcgaaggggggagcggacaagcagcagatggatgccgaactgcgcaaggaaatgatggccatctggcctaacctgtcccagaaaacgttggacctgctggtcacaccgcataaaagcaccgatctgaccgtgggaaaaatctacgccgcaatgatgataatggagtactacagacagtcgaaggctaagaaacttcaggccatgcgcgaagagcaggacagaacacccttgatgtttcagagaatggagcccccaagccctacccaggagggtgggccaggccagaacgccctcccctcaacccagctcgaccccggtggagcactgatggctcacgaaagcgggctgaaggagagcccttcatgggttacacaaagagcgcaggagatgttccagaagacggggacgtggtcgccagaacagggcccacccactgacatgcctaactcccagccaaacagccaaagcgtcgaaatgcgtgaaatgggaagagacggatattctgatagcgagcattatttgcctatggaaggccaggggcgagctgcatcgatgcccagattgcccgctgaaaatcagcggaggcgcggtaggccacggggaaataatttaagtacaatatcagacacttctccaatgaaacggtccgcctctgtgctggggcctaaagctagaagattggacgactacagtctggagcgagtaccccctgaagagaaccaaagacatcaccagagacgcagagatagatcccatagagcctcagaacgatccctgggtcgttacacagacgttgacactggcttggggacagacctctctatgacgactcagagtggcgacctcccatctaaggagcgggatcaggagcgtggtaggccaaaagaccgtaaacaccgacagcaccatcatcaccatcaccaccatcaccacccaccacccccagataaggaccgatatgcacaggaacgacccgatcacggtagggccagggcccgtgatcagcggtggtctagatctcctagcgagggccgtgagcacatggcacacagacagta

SEQ ID NO: 216653 - DNA, 7487 bp, Artificial Sequence
  Description of Artificial Sequence: Synthetic coding sequence
atggcaaggttcggcgacgaaatgcctgcaagatacgggggtggcggaagtggggcagccgctggcgttgtggtcgggtcaggagggggaaggggcgctgggggaagcagacagggcggacaacctggcgcacagcgcatgtacaaacaaagtatggcccagcgtgccagaactatggccctctataatcccatccctgttagacaaaactgtctgaccgtcaatagatccctcttcctcttctccgaagacaacgtcgttagaaagtacgcaaagaagattacagaatggcctccattcgaatacatgattttggccacgattatcgcaaattgcatcgtgctggcgctggagcagcacctaccagatgacgataaaacacccatgagcgagaggcttgatgatactgaaccctacttcatcggcattttttgtttcgaggccggaattaaaattattgcccttggcttcgccttccacaagggttcctacctgcggaacgggtggaacgttatggacttcgttgtggttcttactggcatcttagccactgtcggtactgagttcgatttaagaactctccgagcggtcagagtactgcgcccactcaaactggtctccggcatacctagcctgcaagtagtactcaaaagtataatgaaggccatgatccccctcctgcagataggactgttgctgttcttcgcaattctcatcttcgccatcatcggactcgagttctacatgggtaagtttcatactacgtgtttcgaggaaggtacagacgacatacagggggaaagccccgctccttgcggcactgaggagcctgccagaacctgcccaaacggtacaaaatgtcagccttattgggagggtcccaacaatggaattactcagttcgacaatatcctgttcgcagttcttaccgtatttcagtgtattaccatggaaggatggactgacctactgtataatagtaacgatgcgtccggcaatacttggaactggctatactttatcccgctgatcattatcggtagcttcttcatgctgaatttagtcctaggcgtgctgtcaggcgaattcgcaaaggaaagggagcgggtcgagaaccgccgtgcctttttgaaactgagaaggcagcagcagatagaaagggaactcaacggctatatggagtggatttcaaaagctgaggaggtgattctagccgaagacgaaactgacggagagcagagacacccctttgacggggctctgaggcggacgacaatcaagaagtcaaagacggatctactcaatccagaggaggcggaggatcaactggctgatattgcctcagtagggagcccctttgccagggcctctattaaaagcgccaagttagagaacagcactttttttcataagaaagagaggagaatgcggttctacatccggagaatggtgaagacccaggccttttactggacggtattgagtttggtggccctgaatacattgtgtgtggctatagtccattataatcagcctgaatggctgtcggatttcttatactacgcagaattcatcttcctaggtctttttatgagcgaaatgtttataaaaatgtatggtctgggtacccgcccatacttccacagtagtttcaactgcttcgactgcggtgtgataattgggtccattttcgaggtcatctgggctgtaattaaacccggaacctcattcgggatctcagtgttacgggctctgcgacttcttcgcatcttcaaagtcactaaatattgggcctccctccggaatctcgtggtgagtctgctgaactcaatgaagtccattatctcactcctattcctgctgtttctattcatcgtggtgttcgcactgttagggatgcaactattcggaggccaatttaattttgacgaggggacacccccaaccaacttcgatacgtttcctgcggctattatgacagtcttccaaatactgactggggaggattggaatgaagttatgtacgatggcatcaagagtcagggaggagtccaggggggaatggtgtttagtatctacttcatcgtcttaacgctatttgggaactacaccctactgaacgtattcctggcgattgccgtggacaatctcgccaatgcccaagaactcactaaagacgaacaggaagaggaagaagctgcaaatcaaaagctagccctgcagaaagctaaggaagtagctgaagtgtctccccttagcgctgcaaatatgtccatagccgtaaaagaacagcagaagaatcagaaaccagccaaatccgtgtgggaacagaggacttccgagatgcggaagcagaatctgttagcctcaagagaagcattgtataatgaaatggaccccgatgagcggtggaaagctgcatacacaagacatctgcggcctgatatgaaaacacatttggatcgccctttagtcgtggatccacaggaaaatcgcaacaacaatactaataagtccagagccgctgagcccacagtagaccaacggctggggcagcagagagccgaggacttcctgcggaaacaggccaggtaccacgatcgagcaagagatccctctggtagcgccggtctagacgccagacgtccctgggccggttcccaggaagctgagctgtcgcgggaggggccatacggacgcgaaagtgaccaccatgccagagagggttcgttggaacagcccggtttctgggaaggagaagctgaaaggggcaaagccggagatccccacagaagacatgtgcaccgccaggggggatcccgtgagtcgcgctccggcagcccaagaaccggtgcggacggagaacacagaagacatcgggcacaccgaaggccaggggaggagggacccgaagataaggctgagcggcgtgctagacacagggaagggtcacggcctgcgcgaggaggtgagggcgagggcgagggcccagatgggggagaaaggcggagacggcacagacatggagcaccggctacttatgagggagacgctaggagagaagataaagagaggagacatcggcgacgcaaagagaatcagggctctggggtgccagtgtctggacctaatctgagcactactcgcccaatccaacaggatctggggagacaggatccgcctctggctgaggacatagacaatatgaagaataacaagctggccaccgccgaatccgccgcaccacatggcagtctcggccacgctggcctacctcagtcaccggcaaaaatgggcaattcgactgatccaggtcctatgttagccatccctgctatggccacgaatccacaaaatgcagcgagccgacgaacacccaacaacccaggcaatcccagtaatcctggaccacccaaaactcccgagaacagtttgatcgtgactaatcctagcggtacccagactaattctgccaaaacagcaaggaagcccgatcacaccactgtggacatcccccctgcatgcccgcctcccttgaatcatactgttgtgcaggtgaataagaatgctaatccggaccccttacccaagaaagaagaagaaaaaaaggaagaagaggaggacgacagaggtgaggatggcccaaagccgatgcctccttactcctctatgttcattctcagcacaacaaatcctctgagaaggctatgccactacatactcaacttgagatacttcgagatgtgtattctcatggtcatcgccatgtcgtcaattgccctcgctgcagaagaccccgtacaaccaaacgcccctagaaataacgttttgcggtattttgactatgtcttcacgggtgtttttacattcgagatggttatcaaaatgatcgacctgggccttgtactgcaccagggtgcatactttcgcgacctatggaacatcctggacttcatagtggtgtccggcgcactggtcgcgttcgcctttacagggaactccaagggaaaggacattaacactatcaagagcctcagggtgctgcgggtactacggcctttgaaaacgattaagcggctgccaaaactcaaagccgtttttgactgtgtcgtgaactcattaaagaatgtcttcaatatattgatagtttacatgctctttatgttcatcttcgctgtggtggcggttcagctgttcaaaggcaaatttttccactgtaccgatgaatcaaaggaattcgaaaaggactgtagagggaagtatctgctttacgagaaaaacgaggtaaaagctagagacagggagtggaaaaaatatgagttccactacgataacgtattatgggcactgctcaccctgttcacagtgtctaccggggaaggctggccccaggtgcttaagcactcagtagacgcaacattcgagaaccaaggtccttcaccaggttaccgcatggaaatgagcatcttctatgtagtgtactttgttgtgttcccatttttctttgtcaacattttcgtggcactgatcataataaccttccaggagcagggcgacaagatgatggaagagtactcccttgaaaaaaacgagagagcatgtatagacttcgccatcagtgccaagcctctgacgaggcacatgcctcagaacaagcagtcgtttcagtacagaatgtggcagtttgttgtgagtcctcctttcgagtataccatcatggcaatgattgctctgaacaccatcgtgcttatgatgaagttctatggggctagtgtcgcttacgaaaatgccctgcgagtctttaacatagtgtttaccagcttgttctccctggaatgtgtgctgaaggtgatggctttcggcatactcaattactttcgggacgcgtggaacatcttcgactttgtcacggtgctgggctccattacagacatcctggtgacagagtttggtaacaatttcattaatctgtcattcctccgactgttcagagccgcaagactcattaagctccttcggcagggatacacaataagaatattgctgtggaccttcgtccagagtttcaaggccctaccatatgtgtgtctgcttattgccatgcttttctttatttatgcaattatcggtatgcaagtgtttggaaacataggtatcgatgtggaggacgaagactctgatgaggatgaattccagataaccgaacataataattttaggaccttttttcaggccttgatgttgctttttagatccgcgacaggggaggcttggcacaatattatgttatcctgcctttctgggaaaccctgcgataagaattcaggcatccttaccagggaatgtggcaacgagttcgcgtatttctacttcgtctcctttatctttctctgtagcttcctgatgctgaacctgttcgttgcagtgattatggacaacttcgagtacttgacccgggatagtagcatactggggcctcatcatcttgacgaatatgtcagagtgtgggccgagtatgatcccgctgcctggggacggatgccttacttagatatgtaccaaatgcttcgccacatgagtcccccactgggcttaggaaagaaatgccccgctcgggttgcatacaagcgtctgctacgcatggacctgcccgtagcggatgacaacactgttcatttcaattccactctcatggccttgatcagaactgccttggatatcaaaatcgccaaggggggagccgacaaacagcagatggacgccgaactgaggaaagaaatgatggccatatggcccaacctcagccaaaaaaccctggacctgctggtaacaccacataaaagcacggatctgacagtgggcaagatctacgcagcaatgatgatcatggagtattaccgtcaatccaaggcgaaaaaactgcaggccatgagagaggagcaggaccgcacaccactgatgttccagcggatggaacctccatctcctacacaggagggcggacccggacaaaatgcattaccttcaacacagctggacccaggcggtgccctgatggcccacgagtcaggacttaaagaatccccgagctgggttacccaacgtgctcaggagatgttccagaaaacggggacctggagccctgaacaaggcccacctactgatatgcccaacagccagccgaacagccagtccgttgaaatgcgcgaaatgggtagagacggttatagcgattccgagcactacttacctatggagggtcaggggagagccgcttctatgccacggttgcccgctgaaaatcaaaccattagcgacacgtccccaatgaagaggagcgcctcggtgctaggtcctaaggctaggcgcctggatgactactcactggagcgggtccctcccgaggaaaaccagaggcatcatcagcgtcggagggacaggtctcatcgcgctagtgaaagatcgctgggccgttacaccgatgtggatactggcttgggcaccgacctgagtatgaccacccagtctggtgacctccctagcaaggagagagatcaggaacgcggtagacccaaagatagaaagcacagacagcatcatcaccatcatcaccaccaccaccatccgccaccgcctgacaaagacaggtacgcacaagaaagacctgatcacggcagagccagagcaagggatcagcgctggtcccgctctccatcagagggtcgggagcacatggcccataggcagggaagtagcagtgtatctggcagccctgccccttcaacaagtggtactagcactcccagacgaggacgcagacagctgccccagactccttcgacccctaggccccacgtgtcttactccccggtgatcaggaaagcaggtgggtccgggccaccacaacagcaacagcaacagcaacagcaacagcagcagcaggccgtggcgcgacctgggagagccgctacatctggcccacgtagatatccgggtcccaccgccgagcccttagccggtgaccggccacctacgggtggacattcttcaggcagatcacctaggatggaacgtagggttcctggccctgcacgtagcgagtcaccacgcgcttgtaggcacggaggtgcgagatggcctgccagtggccctcacgtgtcagagggcccacctgggccacgacaccacgggtattaccggggaagcgactacgatgaggctgacgggcctggatcagggggaggcgaggaagccatggctggtgcatacgatgcccctcccccagtccgacatgcctctagcggcgctaccggacgttcgccgaggacgcccagggcctctggaccagcctgcgcctctcccagccgacacggccgaaggctgcccaatggctattacccagctcacggtctggctcggcctagggggccaggctcacgcaaggggctgcatgagccttactccgagagcgatgacgattggtgtta

SEQ ID NO: 216654 - DNA, 7520 bp, Artificial Sequence
  Description of Artificial Sequence: Synthetic coding sequence
atggccagatttggtgacgaaatgccagctcgctatggcggagggggaagcggcgcagccgctggggtagtagttgggtcagggggtggcagaggcgcaggcggaagtcgccaggggggtcagcctggcgctcaacgtatgtataagcaaagcatggcccagagggccagaacgatggcactctataaccctatccctgtccgacagaattgcctgaccgtaaacagaagcctgttcttattttctgaagataacgtcgtcagaaagtacgcgaagaagattaccgagtggccaccattcgaatacatgatcctggccacgatcattgcgaactgcatcgtgctggcgctcgaacaacacttgcccgacgatgacaagaccccgatgtctgagcgactggatgatacagagccatatttcattggaatcttctgcttcgaggctgggattaagatcatagccctggggtttgccttccataaagggtcttatttgcggaatggctggaacgttatggactttgtggtcgtcctgacaggtattctggccactgtaggaactgagttcgacctcagaacgctcagggccgtgcgtgtgctgaggccattaaaactcgtaagcggaatcccctccttacaagttgtcctcaaatcaatcatgaaagccatgatcccactgctgcagatcgggctcctactgttcttcgcgattcttatctttgctataatcggactggagttctacatgggcaagtttcacacaacttgcttcgaggagggcacggatgatattcagggggaatctccagctccctgtgggacagaggaacctgccaggacctgccccaacggcacaaagtgccaaccgtactgggagggaccgaacaacggcattacccagttcgataatattttgttcgcagtccttaccgtgtttcagtgtatcactatggagggctggactgacctgttatacaactcaaatgacgcgtcaggcaacacttggaattggctatatttcatccccctgatcattatagggagcttcttcatgctgaacttagtgctgggcgtgctctccggggagttcgccaaggaacgggagagggtggaaaatcgtagggcatttttaaaattacgacgccaacagcagatcgagcgagaattgaatggctatatggaatggatcagcaaggctgaagaggtaattctggccgaagacgaaacggatggagaacagagacatccatttgacgccctcaggcgcacaacaattaagaagagcaaaaccgacctactcaaccctgaggaagctgaagaccagctggccgatattgcgagcgtcgggtcaccttttgcacgcgcaagtatcaagtccgcgaagctggagaatagcaccttttttcataagaaggaacggcgaatgcggttttatattagacgcatggtgaagacccaggctttttactggaccgtactgtctttagtcgctctcaacaccctctgcgtggccattgtgcattataaccagcctgagtggttgagcgactttctttattacgcggagttcatttttctcggtctgtttatgtctgagatgttcataaagatgtatgggttgggtaccagaccgtacttccacagctcctttaattgctttgactgtggagtcatcattggctctatcttcgaggtgatttgggccgtgattaaacccggaacctcctttggaatcagtgtgctccgagccttgcgtcttcttcgtatctttaaggtgaccaagtattgggcttcccttcgcaacttggtcgtctcccttctcaactctatgaaatctattatttccttattgttcctgttattcctgtttatcgttgtgttcgccctgttagggatgcagttattcggagggcagttcaatttcgacgagggcacccccccaactaatttcgatacatttcccgctgccattatgacagtctttcaaatcctgaccggagaggattggaacgaagtgatgtatgacggtatcaagagtcaagggggagtgcaaggcggaatggtattcagcatctacttcattgtgcttaccttgttcggaaactatactctgctgaacgtgttccttgcaatcgccgtcgataacctcgcaaacgcccaggagctcaccaaggacgaacaggaggaggaagaggcggctaatcagaaattggcactccagaaagctaaagaggtcgcagaggtatcgcctcttagcgcagccaacatgtctatcgcggttaaagagcaacagaagaatcaaaagccagctaaatctgtttgggagcagcggacaagtgaaatgagaaaacaaaatctcctagcttccagagaggccctgtacaacgaaatggaccctgacgagcgatggaaagccgcttatacccgccatctcaggccagacatgaagacacacctggatcgccctctggtcgtggacccacaagaaaatcgcaataacaatactaacaaaagccgggctgccgagcccaccgtggatcagagactgggacagcaaagagccgaagacttccttagaaagcaggctcgatatcatgatcgcgcaagagacccctcgggttctgccggtctggacgcacgtcgaccttgggccggtagccaagaagccgaactctcccgggagggcccttacgggagggagtcagatcatcacgcgcgagagggaagtctggaacagccaggattttgggaaggtgaagctgagcggggtaaggctggcgatcctcatagaaggcacgtacaccgtcagggtggaagtcgggaaagtcgctccggcagccccaggaccggtgctgatggagaacaccgcagacaccgggcacacagacggccaggcgaggagggaccggaagacaaggccgagcggagagcccgacaccgcgagggctcgcggccagccagaggtggtgaaggtgagggggagggccctgacggaggtgaaagaagaagaagacacaggcacggagcaccagcgacctatgaaggggatgccagaagggaagataaagagaggagacacaggaggcgcaaggagaaccagggttctggagttcccgtgtctggccctaacctttcgaccacgcggcctattcagcaagacttaggacggcaagaccctccactcgcagaagacatcgataacatgaagaacaataagttagctacagcagaatcagcggctccacatggcagtcttggtcacgcaggactgccccaaagccctgcaaagatgggtaactccactgaccctgggccaatgctggcaatcccagctatggccactaatccccagaacgccgcttcacgtcggacacccaacaatcctggaaacccctccaatcctgggcctcctaaaacaccagagaattctctcatcgtgactaatcctagcggtacacagaccaacagtgccaaaaccgctcggaagcctgaccacactaccgtggatatacctcctgcctgtccaccacctctcaatcatactgttgtacaggttaataagaatgctaatcccgatccccttcccaagaaggaggaagagaaaaaggaagaagaggaggatgacagaggagaagatggacccaaacccatgccaccttattcgtccatgtttattctgtccaccaccaatcccctcagacggttgtgccattatatcctcaatctgagatacttcgaaatgtgtattctgatggtgattgctatgagttctatcgccttggccgctgaggatccagtgcaacccaacgcaccccgtaacaatgtgctgcgttattttgactatgtgttcaccggcgtgtttacatttgaaatggtaataaagatgatcgaccttggattggtcttacaccaaggtgcttactttagagacctatggaatatcctggacttcatagttgtgagtggcgctttggtggccttcgcattcactggcaatagtaagggtaaggatataaacactattaagtcgttgcgtgttcttagggtgctacgccctctgaaaaccatcaaacgactcccaaagctcaaggccgtgtttgattgcgtggtgaattcactgaaaaatgtcttcaatatcctgatcgtgtacatgctctttatgttcatattcgcagtggtcgccgtgcaattgtttaagggcaaattcttccattgcactgacgaatccaaggagttcgaaaaggattgccggggtaagtatctgctgtacgagaaaaatgaggtcaaggctcgagatcgggagtggaagaagtacgagtttcactatgacaatgtactatgggcactgctgaccctgttcacggtcagcactggggagggatggccccaggtactaaagcatagtgtagacgcaacatttgaaaatcagggaccgtcacctgggtatagaatggagatgtcaatcttctacgtcgtctattttgtggtgttccctttttttttcgtaaatattttcgttgctcttattattatcacgtttcaggaacagggagacaaaatgatggaggagtacagcctcgagaagaacgagagggcatgcattgattttgcaatttctgctaaaccacttacgcggcatatgccccagaataaacagtcctttcaataccgtatgtggcagttcgtggtctcacctccctttgagtataccatcatggccatgatcgctttaaataccattgtgttgatgatgaagttctacggggcttctgtggcttacgaaaacgcactgcgtgtgtttaacattgttttcaccagtctgttctccctcgaatgtgtgctgaaagtaatggctttcggaatcctgaactatttcagggacgcttggaatatttttgatttcgtaactgtgctggggagcatcacagacatactcgttactgaatttggaaacaattttatcaacttaagctttctgcggctctttagggctgccagattgattaaactgctgcgacagggatacaccataagaatcctcctctggacctttgtgcaatcatttaaggcactcccatatgtctgccttctcattgcgatgctattcttcatatatgcaataatcggaatgcaggtctttggaaacatcgggattgatgtggaggatgaagactctgatgaagacgagtttcagatcaccgagcataacaactttagaacgttctttcaggccctgatgcttctgttccgttcagcgactggcgaagcctggcataatatcatgctgtcatgcttatctgggaagccatgcgacaagaattccggcatcttaaccagggaatgtggtaacgagtttgcctatttctatttcgtgtccttcattttcctctgttcattcttaatgctgaatcttttcgtggctgtgattatggacaactttgagtatctgacccgagactccagtattttgggcccacatcacctcgatgagtacgtgagagtttgggcagagtacgaccctgcagcatggggacgtatgccatacttagacatgtaccagatgcttcgtcatatgagtcccccactggggttgggaaaaaaatgcccagcacgagtagcctacaagaggctgctgaggatggatctgcccgtggccgatgacaacacggttcatttcaactccacgctgatggccctgatcaggactgccttggacataaaaatagcgaaggggggagcagacaaacagcagatggacgcggagctccgaaaggagatgatggctatttggccaaatctgagtcagaagaccttagatctgttggtaactccccacaagagcacggacttgactgtcggtaagatctatgccgctatgatgattatggagtattatcgccaatctaaagcaaaaaagttacaggccatgcgggaagaacaagatagaacgcctcttatgtttcagagaatggagcctcctagccccactcaggagggcggtcctggccagaatgctttaccttcaacccagctggatcccggtggagctctgatggctcacgagtccgggttaaaagagtccccctcatgggtcactcagagagcacaggaaatgttccagaagactggcacctggagcccagagcaggggccacccaccgatatgcctaattctcagcctaactcccagagcgtggaaatgcgcgagatgggcagggatggatattccgactccgagcactaccttcctatggaaggacagggcagagctgcctcaatgcctagactgcccgctgaaaaccagcggaggcgtggccgacccaggggcaacaacttgagcactatcagtgacacaagtcccatgaagagatctgcttccgtcctaggcccaaaggcccgtcgcctcgacgattacagtctggaaagagtgcctccagaggaaaatcagcgccaccatcagaggagacgggatagatctcaccgggcatccgagaggagcctcgggcgttataccgatgtggataccgggctggggactgatctatccatgactacacagtcaggggatctgccttctaaggaaagagaccaggaacggggacggccaaaagacagaaaacatcgacagcatcatcaccatcaccaccatcaccaccacccacctccacccgataaagataggtacgcccaggagcggcctgaccacgggcgagccagggccagggaccaaaggtggagtcgaagtccctccgagggtagagaacatatggcccatagacaggggagtagctctgtgtcgggatctccagctccaagtacaagcggcacgagcacgccacgcagggggagaaggcagctacctcaaacgcctagcactccgagaccccatgtctcatacagtcctgtgatacgtaaagcgggaggctctggccctccgcaacagcagcaacagcagcagcagcagcagcagcagcaggcagtggcgagacccggtcgagccgcaacttccggtcccaggcgatatccgggacccaccgccgaacctttggccggagacaggccgccaacaggcggacacagctccggcaggagcccacgcatggagagacgggtacctggtcccgcacggagtgagagtccccgagcctgcagacacggaggagcgagatggcccgcatcagggccacacgtgagcgagggtccaccgggtcctagacatcacggttattacaggggaagcgattacgatgaagccgatggcccagggtccggagggggtgaggaggcaatggccggtgcttacgatgcgccaccaccagttcggcatgcctccagtggcgcaactgggagatctccaaggactcccagagcttcgggaccagcgtgcgcaagtccctcccgacacggcagaagacttcctaatggatattatcccgcacacgggctggctagaccaagaggccctggatcacggaaaggcctgcacgagccatatagcgagagcgatgacgattggtgcta

SEQ ID NO: 216655 - DNA, 7538 bp, Artificial Sequence
  Description of Artificial Sequence: Synthetic coding sequence
atggcaaggtttggcgatgaaatgccagcacgctatgggggtggcggatctggtgcagctgctggcgtcgtggttggctccggtggcggaagaggggcagggggatcccgacaggggggacagccaggggcacagcgaatgtacaagcagtccatggcccagcgggctagaactatggccttatacaaccccattccagtgcggcagaattgtcttacagtgaatcggagtctgttcttgttctccgaagacaatgtcgtgagaaaatatgctaaaaaaattacagagtggcctccgtttgaatacatgatcctcgctaccatcatcgccaactgcatcgtgttggcgttggagcagcacctgccagacgacgacaaaactcccatgtcggagaggctcgatgataccgaaccgtactttatcggaattttctgcttcgaggcgggaattaaaatcatcgcactggggttcgcattccacaagggtagttatctgaggaatggttggaacgttatggatttcgtcgttgtgctcaccgggatcctggcaacagtcggaaccgaatttgatttgagaaccttacgcgctgttagagtgctcagacctctgaaattagtaagcggcattccaagcctccaggtagtgcttaagagtattatgaaggctatgatcccattgctgcagatcgggctgttactgttctttgctatcctgatttttgctattattggcctggaattctacatgggtaaattccatactacttgttttgaggaaggtacggacgacattcagggagaatcccctgcaccttgcgggactgaggaacccgcacggacctgccccaacgggaccaaatgtcagccatactgggagggccctaataatgggattacacagttcgacaacatactgtttgccgtgcttactgttttccagtgcatcacaatggaaggctggacagatctgctttataacagcaatgacgctagcgggaacacctggaattggctgtattttatccctctaattatcatcggttctttcttcatgctcaacttggttttgggcgttctgagcggtgaattcgcaaaggagcgtgaacgggtggaaaaccggagagcttttctgaagctcagacgccagcagcaaatcgagagggaactaaatgggtacatggaatggatctctaaagccgaagaggtaatcctcgcagaggatgaaactgatggggaacagcgccaccccttcgacggggctctgaggagaaccaccataaagaagtctaaaaccgacctgttaaacccagaagaagccgaagaccagctggccgacatagccagcgttggatcccccttcgcccgagcaagtatcaaaagcgctaagctggaaaatagcactttctttcacaagaaagagaggcgaatgcgcttttacatccggagaatggtgaaaacacaggcattttattggaccgtgctgtccttggtggctctgaacacactttgtgtggccattgtacactacaaccagccagagtggctgtcagattttctctattatgccgagtttatttttctggggctgtttatgtccgagatgtttatcaagatgtatggactggggaccaggccttactttcacagctcttttaactgctttgactgcggggttattattggatcaatatttgaagtcatctgggccgtgattaagcccggaactagttttggaattagcgtgctgagggcacttcgactgctgaggatctttaaggttacaaagtattgggcctctctgaggaaccttgtggtgtcactgctgaattccatgaagtctatcatttctcttctgtttctgctgttcctatttattgtcgttttcgctctgctgggtatgcagctgtttggcggacagttcaactttgacgagggcactcctcccacaaatttcgacactttccccgcagccattatgaccgttttccagatactaaccggcgaagattggaacgaggtgatgtatgacgggatcaagtctcagggaggagttcaggggggaatggtcttcagcatatattttatagtgcttacactgtttgggaattataccttgttgaatgtgttcctcgctatagccgtggacaatctagccaatgcccaagagctcactaaagtcgaagccgacgagcaagaggaagaagaggctgcaaaccagaagttggcactccagaaggcgaaagaggtggcagaggtaagccctcttagtgctgccaacatgtcaatcgcagtgaaggagcagcagaagaaccaaaaacctgccaagtccgtgtgggagcagcgcacaagtgagatgcgtaagcagaacctgctggcttcacgtgaggcactgtacaatgagatggacccagacgaaaggtggaaggccgcatacactcgtcacctgcgcccagacatgaagacacacctggatagaccgctggtcgtagaccctcaggagaatcgcaataataatacaaataagagcagggcagcagagccgaccgttgaccagcgactgggacaacagcgcgctgaggacttcttacggaagcaagccagatatcacgatcgggcacgcgacccttctggatcagccggacttgacgcccgacgaccttgggctggatcccaggaggccgagctgagtagggagggaccctacgggcgtgagtccgaccaccatgctagagaggggtcactggagcagccaggattctgggagggcgaagccgagcgcggaaaagcgggagaccctcaccggagacatgtgcacagacaagggggatcccgcgaatctagatctggttcccctcgaaccggagccgacggcgagcaccggagacatagagcccatcggaggccaggagaggagggtccagaggataaagctgagagacgtgccaggcatcgtgagggcagccggccagccaggggaggcgaaggcgaaggggaaggcccagacgggggagagcggagacgcaggcataggcacggagcacccgctacctacgagggtgacgccaggcgagaagataaggagaggcgtcaccgccgtcgaaaggaaaaccaggggtccggcgtgcctgtctctggccctaatctgagcacaacccggccaatacaacaagatcttggcaggcaagaccctccactggctgaagatatcgacaatatgaaaaacaataagctggcaaccgcggagtcggccgcacctcatggctccctgggacatgccggactgccccagtcacccgcaaaaatgggcaactccacggacccgggacctatgttggccatcccagcgatggccacaaatccacagaatgccgcttccaggagaaccccgaacaaccccggtaatccctccaatcccggtcccccaaaaacccctgaaaatagtcttatcgtgaccaatcctagtggaacccagaccaactcggccaaaaccgctcggaagcctgatcatacgactgttgatatcccacccgcatgccctccaccgttgaaccatacagtcgtgcaggtgaataagaacgccaatccagatccactacccaaaaaagaggaggaaaaaaaggaggaagaggaagacgatcggggtgaggacggccctaaacctatgcctccatattcatctatgttcatcttatcaacaactaacccgctgcggcgactctgccactacatactcaacctgcgctacttcgagatgtgcatactaatggtgattgcaatgagttccattgccttggccgctgaagatcccgttcagcccaatgcccctaggaataatgtcctacgctattttgactatgtattcaccggagtgtttacttttgagatggtcatcaagatgattgacctcggactagtgcttcaccagggcgcttactttagggatttgtggaacatccttgattttatcgttgtgtctggtgccctggtggctttcgcttttaccggaaatagcaaaggtaaggacatcaacacaattaaaagccttcgcgtgctgcgagtgcttagacccttgaagactattaaaaggcttccaaaattaaaggcagtgtttgattgtgttgtcaattcactcaagaatgtgttcaatatcctgatagtctacatgcttttcatgtttattttcgccgttgtggccgtgcaattatttaaaggtaaattctttcactgcactgacgaatcaaaagaatttgagaaagactgtcggggaaaatatctcctgtacgaaaagaacgaggttaaggcgagggaccgggagtggaagaaatacgagttccattacgataacgtcctatgggccttgctcactttgtttaccgtgagtaccggtgagggctggcctcaggtgctgaaacacagtgtggacgccacttttgagaatcagggcccttcacccggttaccgaatggaaatgtccatcttttatgtggtgtactttgtggtcttcccattctttttcgtgaatatcttcgtggccctgatcatcattacattccaggaacaaggcgataagatgatggaggagtacagtttggaaaagaatgagagagcgtgcattgacttcgcaataagcgccaagccacttacgaggcacatgccacagaataagcagtctttccagtatcggatgtggcagttcgtggttagtcctcctttcgagtacacgatcatggccatgattgctctcaatacgattgtattgatgatgaaattttatggtgccagtgtcgcatacgagaatgctctgagggtgtttaacattgtgttcacgtccttgttttccttagagtgtgtcctgaaagtgatggccttcggaatccttaattatttccgcgacgcttggaacatttttgactttgtcacggtgcttgggagcattacggacattctggtcactgagtttggaaatcccaataacttcattaatctgagctttctgaggctattccgggcagcgcgtcttattaaactgctcaggcaggggtatactattcggattctcttgtggacattcgtccagtctttcaaagcccttccttatgtgtgcctcctgatagcaatgctgttctttatctacgctattattgggatgcaggtgttcggaaacattggaattgacgttgaagatgaagactccgacgaagatgagttccagattaccgaacataataacttccgcaccttcttccaggccctgatgctgctttttagatcggccactggggaagcttggcacaatatcatgctgagctgtctttctgggaagccttgtgataaaaactcaggtattctcaccagggaatgcggcaacgaattcgcctacttctacttcgtgtccttcatcttcctgtgtagctttcttatgcttaatttatttgttgccgtgataatggataatttcgagtacttgacccgcgattcaagtatcctcggccctcaccatctggatgagtacgttcgcgtatgggccgagtatgaccccgcagcctggggaagaatgccttacctcgacatgtatcaaatgctgaggcatatgtcccctcctctcggcctgggaaagaaatgtcccgctcgagtcgcttacaagcgcctgctcaggatggacttgcccgtggccgacgacaacacagtgcactttaattccaccttgatggcgctcataagaaccgctcttgacataaaaattgccaaggggggtgccgataagcagcagatggacgctgaactcagaaaggaaatgatggccatctggcctaatctatcacagaagaccctggaccttctggttacccctcacaagagcaccgacctcacagtggggaagatctacgctgcgatgatgattatggaatactacagacaaagtaaagcgaagaaacttcaagcaatgcgggaggagcaggatcgaacgccgctgatgttccagaggatggagccgccatccccaactcaggaggggggtcccggacagaacgctttgccgtcaacacagttagaccctgggggagcgcttatggcccatgagtcagggctgaaagagagccccagttgggtaacacagcgggcacaggaaatgttccaaaagacaggaacttggagccctgaacaggggccacccacagacatgccaaattctcaaccaaacagtcagtcagtcgaaatgcgggagatgggtagggatgggtattccgatagcgagcactacctgccaatggagggccagggcagagccgcaagcatgccgcgacttccagccgaaaatcaaaggcgcagaggaagaccacgaggaaataacctgagcaccatatcagacacctctccaatgaagagaagcgcctctgttctcgggcctaaagctagacgccttgacgactatagtctcgagagggtgccaccagaagaaaaccaacgacaccatcagcgtaggcgcgataggagccatcgtgcatccgaaagatcactagggagatacaccgacgtggacactggactgggtaccgatctgtctatgacaactcagtctggcgatttgccgagtaaggaaagagaccaggagagaggcaggccaaaagatcgcaaacaccgccaacaccaccaccaccaccaccaccaccaccatcctccaccacctgataaagataggtatgctcaggaacgaccggatcacgggagagcgagggcaagagatcagcgctggtctagatctccctcagaagggagagagcatatggcacaccgtcagggaagcagctccgtcagcgggtccccggctcccagcacctcaggcacctctaccccacggaggggtcggagacagctgccccagactccgagtacccctagaccccatgtgtcctatagcccagtcataaggaaggcagggggaagcggccctcctcagcaacagcaacagcaacaacagcagcagcagcagcaagctgttgctaggcccggacgcgcagccacctcaggacccagacggtaccccggtccgaccgccgagcccctcgccggtgacagaccccctaccggcggtcactcctcggggaggtcacctagaatggagcggcgagtaccaggccctgcaagatcagagtcgccacgcgcttgcaggcatgggggtgccagatggcctgcctctgggccacacgtctctgagggacctcctggaccacgacaccatggatactacaggggttcagactatgacgaggccgatggtccaggctccggtggcggagaggaagcaatggctggagcatacgatgcccctccacccgtgcgccacgccagcagcggggcaactgggagaagtcccaggacacctagagcgtcaggaccggcatgcgcgtcacccagccggcacgggaggcggctgcccaatggctattatccagcccacggcctggccaggcctaggggccctggctcacgtaaggggctgcatgagccctacagcgaaagcgacgatgattggtgtta

SEQ ID NO: 216656 - DNA, 804 bp, Artificial Sequence
  Description of Artificial Sequence: Synthetic coding sequence
atgctctttatgttcatcttcgcagtcgtggctgttcagttgttcaaaggtaagttcttccactgcaccgatgaatcgaaagaatttgagaaagactgtagaggcaaatacttgctgtacgagaaaaacgaggtgaaagcccgagaccgggaatggaagaagtacgaattccactacgataatgtgctgtgggctctacttacactgtttaccgtgagcacaggggagggttggccccaagtgctgaagcattctgtcgatgctacatttgagaaccagggccctagcccagggtatagaatggagatgagtattttttacgtagtgtacttcgtcgtctttccatttttctttgtaaacatcttcgtggctctgataatcattacctttcaggaacagggcgataagatgatggaagagtactcacttgaaaagaacgagcgtgcctgcatcgacttcgccataagcgcgaaacctctgacaaggcacatgccacagaacaaacaatctttccagtatcgtatgtggcagttcgtggtatcacccccatttgagtatacaataatggcgatgatcgctcttaacaccattgttctcatgatgaaattttatggcgcatccgtggcgtacgagaacgccctgcgcgttttcaacattgtgttcacttccttattttccctggagtgtgtgctgaaggtgatggccttcggcattcttaattatttcagagatgcttggaacatctttgacttcgtcacggttttgggaagcattacggacatcctggtcaccgaatttggatag

SEQ ID NO: 216657 - DNA, 6794 bp, Artificial Sequence
  Description of Artificial Sequence: Synthetic coding sequence
atggcgctctacaatcccatccccgtgagacaaaactgtttcaccgtaaatcggagcctattcatctttggcgaagacaacattgtcaggaaatacgctaagaaactcattgattggccacccttcgagtacatgattcttgcaactataattgccaactgtattgtgctcgctctggagcagcacctgcccgaagatgataaaacacccatgtctcgtaggctcgaaaaaaccgaaccatattttatcggaatcttctgttttgaagctgggataaagatcgtagcgctgggcttcatttttcataagggctcctatctgcgaaatggatggaatgtcatggatttcattgtggtgctatctggtattcttgctaccgcaggtactcactttaacacgcacgtagatctgcgtactctcagagccgtacgggtgctgagacccctcaagctcgttagcggtattccgtctctgcagattgttctgaaaagtattatgaaggcaatggtgcctttgctccagataggtttgttgctgttcttcgcaatcctgatgtttgccattattgggctcgaattttattcgggtaaactgcaccgcgcttgtttcatgaacaacagcggaatccttgagggatttgatcccccacacccctgtggcgtgcaggggtgcccagctggatacgagtgtaaggactggataggaccaaacgacgggataacccagtttgacaatattctgttcgccgtgctcacagtcttccagtgtattaccatggaaggttggacgaccgtgttgtataacaccaacgatgcccttggagcaacctggaactggctctatttcatcccactgattattatagggtccttctttgtgctgaacctggttctgggcgtgctctctggtgagtttgcaaaagagagggagagggtcgagaatcgtagggccttcatgaagttaagacgtcaacagcaaattgagcgcgagctaaatggatacagagcatggatagataaggctgaggaagtgatgttggccgaggaaaataaaaacgctgggacttctgctctggaggtgctgcggagagcgaccattaaacggtcccgcacggaggcgatgacccgggactctagtgacgaacactgcgtggatatctcctccgttggaactcctctggcaagggccagtatcaaaagcgctaaggtcgacggggtttcatatttcaggcataaggagcgactgctgagaatttccataagacacatggtcaagagtcaggtcttttactggatcgtgctctcgcttgtggccttgaataccgcctgcgtggcgatagtgcatcacaaccagcctcagtggctgactcatctactatactacgccgagttccttttccttggcctgtttctcctggagatgagcctcaagatgtatggaatgggaccgagactttattttcactcctcctttaattgtttcgactttggggttaccgtgggttccatttttgaagtggtgtgggcaatcttcaggcccggaacctccttcggaatcagtgtgctgcgcgcactcaggctcctgaggattttcaaaatcaccaaatattgggctagtctcagaaacctggtcgtaagcctgatgtcctctatgaagtctattatctctctcctgtttctgctgttcctctttattgtcgtctttgccttgctcggaatgcagcttttcggaggccgtttcaacttcaacgacggtacacccagcgctaacttcgatacgttccccgcagccattatgaccgtcttccagatactgaccggcgaagactggaacgaggttatgtacaacggaatcaggtcacagggcggagtttctagtgggatgtggtcagccatatactttattgtactgaccctgtttggtaactatactctgctcaacgttttccttgcgatcgcagtggacaacttagctaacgctcaagagcttactaaagacgagcaggaggaagaggaggcctttaaccaaaaacacgctcttcagaaggcaaaggaggtcagtcccatgtctgcgccaaatatgccgagtatcgagcgtgaccgcaggcgtcgccaccatatgtctatgtgggagccaaggagtagtcatctgcgggagcggagacggagacaccacatgagtgtctgggagcaaaggacctcccagttacgaaaacacatgcaaatgtcaagccaagaggcactgaacagggaggaggcccctaccatgaaccccctgaatcccctcaatccgttgagttctctgaacccacttaatgctcatccctcgctatataggagaccgagggcaattgaaggcctggctctcggtttggctctggagaagttcgaggaggaacgaatatccagggggggaagcctgaagggcgatgggggtgataggtcttccgccctggacaaccagcgtacacccttgagcctcggccaaagggaaccaccctggttggcacgcccttgccacggcaactgcgaccctactcagcaggaagcaggtgggggtgaggcagtagtcaccttcgaggaccgcgctcgacacagacagagtcagcgcagaagtagacatcgccgagttagaacggagggtaaggagtcgagctccgccagtcggagtcgctccgccagccaggaacggagtctcgacgaagcgatgccgactgagggggagaaggaccatgagctgagggggaaccatggagccaaggagccgaccatccaggaagagagagctcaagatctccgaaggactaatagcctcatggttagcagaggctctgggctggctggcggattagatgaggctgatacacctttggtgctgccacacccagaactggaggtggggaaacacgtggtgttaactgagcaggaaccggaaggcagtagcgagcaagcgctcctcggcaacgtacagctggacatgggccgagtgatcagtcagagcgagcctgatctgtcatgcatcactgcaaacacagataaggcgacaaccgagtctacttctgtaacagtagcaatcccggacgtggaccccctggtagacagcacggtagtgcacataagtaataagaccgacggggaggccagtcccttgaaagaagcagagatccgggaagatgaagaggaagttgagaagaaaaagcaaaagaaagagaaacgcgagacgggaaaggctatggtaccccacagcagcatgttcatattttcaacgacgaaccctattcggagggcttgccactatatcgtcaaccttcggtatttcgagatgtgtatactgctggtgattgctgcttcttccatcgccctagctgccgaagaccccgtcttaaccaattccgagcggaacaaggtactgaggtattttgattatgtgtttactggagtgttcacattcgagatggtgataaaaatgattgaccaagggttaattctccaggatggttcctacttccgggacttatggaacatactggacttcgtggtggtggtgggggctctcgtagcgtttgccttagctaatagcatgaagactaacaagggacgagacatcaagactattaagagtctgagagtactgcgcgtattaaggccactcaagaccataaaaaggctcccgaagttgaaggctgtgttcgattgcgtggttaccagcctaaagaacgtgtttaatattttgattgtctacaagctgttcatgttcatatttgccgttatcgcggtacagctgttcaagggtaagtttttttattgcacagactcttcaaaggacaccgagaaggagtgtattggcaactacgtggaccatgaaaagaataaaatggaagtaaaaggcagagaatggaagagacatgagtttcattatgataacattatttgggccttactcacactctttacagtgtctaccggagaaggttggccacaggtcctccagcattccgtggacgtcaccgaggaggatcgcggtccatcgagatctaatagaatggagatgagcatcttctatgttgtgtacttcgtcgtctttcccttcttctttgttaatatttttgtcgctctgataattattaccttccaagagcaaggagacaagatgatggaagaatgctcgctggagaaaaatgagcgcgcatgtatcgatttcgctatctctgctaaacccttaactcggtatatgccccagaacaggcataccttccagtacagggtgtggcatttcgtcgtgtcgccaagctttgagtacacgatcatggctatgatcgccttgaatacggtggtccttatgatgaaatactatagcgccccatgcacttatgagcttgccttgaaatatctgaacattgcgttcacaatggtgttctcactggaatgcgtgctcaaggtgattgcgttcggttttctgaattattttagagacacctggaatatcttcgacttcatcacagtgatcggtagtattactgaaattatcctgactgactctaaactggtcaacaccagcggcttcaatatgtccttccttaagctgttcagggccgctcgcctaattaaattgctccggcagggctacacgatccgcatactactgtggaccttcgttcagtcctttaaagccctgccctatgtgtgcttgctcattgctatgctcttcttcatctacgcaataatcggtatgcaggtgttcgggaacattaagctcgacgaagagagccacatcaaccgacacaacaacttccgctcgttcttcggcagcctcatgctgctgtttcggagtgccactggcgaagcctggcaggaaattatgctctcgtgcctgggtgaaaaaggatgcgagcccgatacaaccgccccttcaggccagaatgaaaatgaacggtgcggaacagaccttgcatatgtgtactttgtcagctttatctttttttgcagtttcttaatgctcaacctgttcgtcgcagtgattatggataattttgaatacctgacacgagatagttccatcctaggtccccaccacctggatgagttcgtccgggtgtgggcagaatatgaccgcgctgcatgcggacgcatccattatactgagatgtacgagatgctaaccttgatgtctcccccactggggctcgggaagcggtgtccgagcaaagtggcctacaaaaggctggtactgatgaacatgcctgtcgcagaagacatgaccgtgcatttcacctctaccttaatggctctgattaggaccgccctggatatcaagatagccaaagggggtgcagatcgccagcagctcgactccgaacttcagaaagaaacgttggctatctggcctcatctgtcccaaaagatgctcgaccttctggtgcccatgccaaaggcgtccgatcttacagtgggaaagatatacgccgcaatgatgataatggattattataaacagtctaaagtgaagaagcagagacaacagttggaggaacagaagaatgcgccaatgttccagagaatggaaccaagctcactgcctcaggaaataatagccaatgctaaggcgctgccctatctgcagcaggatcctgtgagcggtctctccgggagatccgggtacccctcgatgtcacctctatccccccaggatattttccagctggcttgtatggatcccgctgatgatggacagttccaagaacgccagtctctcgaacccgaagtgtcagagctgaagagcgtacaaccctcaaatcatggcatctatctgccgtcagacacccaggagcatgccggtagcgggcgtgcttcgagtatgccccgtctgactgtcgatccacaggtggtcactgacccttcatcaatgaggcggtcattcagtacgatcagagataagcgtagcaattcctcctggctggaggagttcagtatggaacgatcttcagaaaatacatataaatcgagacggaggtcttaccattcctccctgcggcttagtgcacatcgactgaattcagactcaggacacaaaagcgacacacatcgatcaggtgggagagagcgagggagatctaaggaaaggaaacacctgctgagccctgacgtgtcccgctgtaactccgaagagagaggaacacaggcggattgggagagtccagagagacgacagagtaggtctcccagcgaaggcagaagccagacaccaaaccgccaagggacaggctcgctgagcgagagctccattcctagcgtatcagatacatccaccccaagaagatctcgcaggcagctgcccccagtgccacctaaacctcgtccacttctaagttatagctccctgatccggcacgcaggctccatttctccacccgcagacggaagcgaggagggcagccctttaacctctcaggcgttggagtccaataatgcctgtctgacagagtccagcaactcaccacatcctcagcagtctcagcacgcgtcccctcagcgatatatttctgaaccttacctcgccctgcacgaggactcgcatgcctctgattgtggggaagaagagactctcaccttcgaagccgctgtggctacctccttggggagaagcaatactattggctccgcccctccattgcgccattcatggcagatgccaaatggacactatcgacgccgtcgcagaggaggaccgggtcccggaatgatgtgcggcgctgtgaacaatctcctaagtgatactgaagaagacgataaatgcta

SEQ ID NO: 216658 - DNA, 6608 bp, Artificial Sequence
  Description of Artificial Sequence: Synthetic coding sequence
atggccctatataatccgattccagttcgccaaaactgttttactgtgaaccgtagcctgttcatctttggtgaggacaacatagtgaggaagtatgctaagaagcttatcgattggccaccattcgaatacatgattttagccacaattattgcgaactgtatcgtgttggccctggagcagcatttgcctgaggacgacaagacacccatgtctcgacgccttgagaagacggagccctatttcataggcatcttttgtttcgaggcagggattaagatagtcgccttgggttttattttccacaagggcagctacctccggaatggatggaacgtgatggactttattgtggtgttaagcggaatcctggccaccgccggaactcattttaatacacatgtagatctccgaaccctgcgagctgtccgggtgcttcggccactgaagttggtctcgggaatcccctccctgcagattgttcttaaatctattatgaaagcgatggtccctctgttgcagataggcctactcctgttcttcgccattctgatgtttgctattattggacttgaattttattcaggcaaacttcacagagcgtgcttcatgaataacagcgggatcctagaaggcttcgatcctccgcatccgtgcggagtgcaagggtgccccgcaggctatgaatgcaaggactggattggccctaacgatggcatcacgcagttcgacaatatactgttcgccgtactcacggtgtttcagtgcatcacaatggaggggtggactacggtcctatacaacacaaacgacgcactaggagcaacatggaactggttgtactttatacctctgatcatcataggtagcttcttcgtgttaaacttggtcttgggagtgctgagtggagagttcgcgaaggaacgtgaaagagtggaaaatagaagggcctttatgaagcttagaaggcagcaacagattgagcgggagctgaatggctacagggcctggattgataaggctgaggaggtcatgctcgcggaagaaaacaagaacgccggtacctctgcactcgaagttctgcggagagccacgattaagcggtctcgtacggaagcaatgaccagggacagctccgacgaacactgcgtggacatcagttccgtgggtacccctctggctagagcctctatcaagagcgcaaaagtggatggtgtgtcctatttcagacacaaagagcgcttgctccgcatctcaattcggcacatggtgaaatctcaggtattctactggatcgtgctcagtctggtggccctgaacaccgcgtgcgtcgcgattgtgcatcacaatcaacctcagtggctgactcatcttctctactacgccgagtttctattcctaggactgttcctgttagagatgagtttgaagatgtatggcatgggtccaagactgtattttcacagttcattcaactgctttgacttcggcgttactgtcggaagcatcttcgaagtagtctgggctatttttagacctggtacgtccttcggcatcagcgttcttcgcgctttgagattgctccggatctttaaaatcacaaaatactgggcaagtcttaggaatcttgtggtgagtttaatgtccagtatgaagtccatcataagcctgttgttcctgttgttcttattcattgtggtctttgcactgctaggtatgcagctctttggaggccgattcaactttaatgatgggactccctccgcaaactttgacacatttccggctgctattatgactgtgttccagatccttacaggagaggattggaatgaggtaatgtataacggaattaggagccaggggggagtgtcttccggtatgtggagcgccatctacttcatagtgctcactttgttcggcaactacactctgttaaatgttttccttgcaatagcagtagacaaccttgctaatgcccaggagttgactaaagacgagcaggaggaagaagaggcttttaaccagaaacacgcactgcagaaagcgaaagaagtgtcccctatgtctgcaccaaacatgccctcgatcgaacgagagcgtcggagacgtcatcatatgtccgtgtgggaacagcgtacatctcagctgcgcaagcatatgcaaatgtcatcacaggaggctctgaatcgcgaggaagctccgactatgaaccccctgaacccgctgaacccactcagttccctaaaccccctcaacgctcacccctccctctataggaggccacgtgcaatcgaaggcttagcacttgggcttgcgctagaaaaatttgaggaggagagaatctcccgaggtggttctcttaagggggatggcggtgatcgctcctccgccctcgataaccagcgaactcccttatccctgggacagcgagagccaccatggcttgccagaccctgccatggcaattgcgaccccacccagcaggaggccggtggcggagaagccgtggtgacctttgaggatcgcgcaagacatcgccagtcccagcggagaagccggcaccggagggtaagaaccgaagggaaggagtcctcaagtgccagccggagtcgtagcgcgtctcaggagaggagcttggacgaagccatgcctacagaaggagagaaggatcacgaactacgtggcaatcacggcgcaaaagaacccactattcaggaagaacgcgcacaagatttgcgccgtaccaattccctgatggtatcaagagggagcgggttggccggtggcctggatgaggccgataccccccttgttctgcctcacccagaattggaagtcgggaaacatgtcgttctgacagagcaagaaccggagggatcttccgagcaggccctgctgggaaacgtgcaactggacatgggcagggtcatctctcaaagtgagcccgacctttcgtgcataactgcaaacaccgacaaagccaccactgagtcaacttcggttacagtggcaatccccgacgtggacccgctggtggactctacagtagtgcacatatccaataaaactgacggcgaagcatcaccccttaaagaggccgagatccgcgaggacgaagaggaggtggaaaaaaaaaagcagaagaaagagaaaagggaaaccgggaaggctatggtcccacattcatctatgttcatcttttctaccactaaccctattcgacgcgcatgccattacattgtcaatctcaggtatttcgagatgtgtatcctgctggtgattgcggcttccagtattgccctcgccgcagaagatcccgtattaacaaatagtgagaggaacaaggtcctcagatacttcgattacgtgttcacaggtgtgttcacttttgagatggttatcaagatgattgaccagggactgattcttcaggacggctcttacttcagagatctgtggaatatcttagatttcgtcgtggtggtcggcgcactcgtagccttcgcattggccaatagcatgaagaccaacaaggggagggacatcaagaccatcaaatcccttagggtcctgagagtcctccgccctctgaagacgataaagagactccctaagctgaaagcggtgttcgattgcgtggtcacatctctaaagaatgtttttaacatcctcatcgtgtataagctgttcatgtttattttcgccgtgatagctgtgcagctcttcaagggcaagtttttttactgcactgattcatccaaggacaccgagaaggagtgtatcgggaactacgtggaccatgaaaagaataagatggaagtgaaaggcagggaatggaagagacatgagttccattatgataacattatatgggctctgctgacgttgttcaccgtctcaacaggtgagggctggccacaagtgcttcagcacagtgtggacgtgactgaggaggatcggggtccgagccgcagtaaccgcatggagatgagcatcttctacgtggtttattttgtggtctttcctttctttttcgtcaatattttcgtggcactgattataatcacatttcaggaacagggcgacaagatgatggaggaatgctctctggagaagaatgagcgcgcttgcatcgacttcgccatatctgctaaacctctaacacgctacatgccgcaaaatcggcatacttttcagtacagagtctggcacttcgtggtgtcacccagctttgagtacacaattatggcaatgatcgctctgaatactgttgtcctgatgatgaaatactattcggcaccctgtacctacgaactggctctgaaatatctgaacatcgcctttacaatggtcttttccctggagtgcgtgctgaaagtcatcgcatttggcttcctgaactacttcagggacacctggaatatattcgatttcatcacagtaattggctcgataactgagatcatcttgacggactcaaaactggtgaacaccagcggctttaacatgtcattcttgaaattgttccgggcagctcgtctgattaaacttttgcgccagggctataccattagaatcctgctctggactttcgtccagtcttttaaagccctcccatatgtatgtctgctgatcgctatgctattcttcatttacgccattatcggaatgcaggtgttcggcaacattaaattggacgaagagtctcatatcaatcgccataataacttccggagcttcttcgggtcactgatgctactcttccgttccgccactggtgaggcctggcaagagattatgctgtcgtgtctaggggagaagggctgcgaacctgacaccacagccccttcaggccaaaacgaaaacgaaaggtgtggtactgatctcgcttacgtgtactttgtctcatttatcttcttttgcagcttcctgatgctgaacctatttgtggcagtgattatggacaacttcgaatacctgacccgggactcctccattctgggtcctcatcacttggatgagttcgtgcgggtatgggcggagtatgacagggccgcttgcgggcgtatcccatacaaggacatgtataaactggtacgggtaattagcccccctctgggactgggggagaactgcccctacagagtggcatgtaagcgcttagtattgatgaatatgccagtggccgaagatatgaccgtgcacttcacctcaaccctgatggctctgattcgcacagccttggatatcaaaatcgccaaggggggagccgacaggcaacaattggactcagagctacagaaggaaactctcgccatttggcctcatctatcccagaaaatgcttgacctgcttgtgcccatgcctaaagcatccgatttgacagttgggaagatctacgccgctatgatgataatggactattataaacagtcaaaggtgaagaagcagcgtcagcagttggaagagcagaaaaatgccccaatgttccagcgaatggagccaagcagtctaccacaggaaatcatcgcaaacgcaaaagccctgccctacttgcagcaggacccggtctcggggctgtccggcagaagtggctacccctccatgtctccactctcacctcaagatattttccagctcgcatgcatggacccagccgacgatggacagttccaagagcgccagtcactggtcgtgacagacccttcctcaatgagacggtccttcagtacaatacgcgataagcggtccaactcttcttggctcgaagagtttagcatggaaaggtcctctgagaacacctacaaatctcgaaggaggtcatatcacagtagccttagactctctgctcacaggctgaacagtgattcagggcataagagtgacactcacaggtctgggggacgcgaacgcggaagatccaaagaacgcaaacatctcctaagcccagacgtgagtcgatgcaatagcgaggaacggggaacacaagccgattgggagagccccgagcgcagacagagtcgttcaccctcagagggcaggagccagactcctaaccgtcaggggaccggttcgcttagcgagtcatcaattccatccgtgtctgatacctccactcccaggaggtcccgtcggcagcttccgccagtccctccgaaacccagaccgctcctgtcctatagttctttgattcggcatgctggcagtatttctcctcctgcagatggcagtgaagagggatcaccacttacgagccaggcactggaaagtaataatgcctgcctgaccgagtcctccaattcaccacatccacagcagagccaacatgcctccccccagcgctatataagcgaaccgtacctagccctgcacgaggattcacatgcatcagactgcggagaagaggaaactctgacctttgaagctgctgttgcaacctccttgggcagatccaacacaattggcagcgccccacctctccgacattcctggcaaatgcctaatggacattatcggaggcgacgtcgcggagggcctggtccaggcatgatgtgcggagccgtgaataacttactgtctgacaccgaggaagatgataaatgcta

SEQ ID NO: 216659 - DNA, 6884 bp, Artificial Sequence
  Description of Artificial Sequence: Synthetic coding sequence
atggcgaggtttggagaggcagttgttgccaggccagggtctggggacggtgattctgaccagagccgtaacaggcagggaacaccagtgcctgcttccgggcaggcagcagcctataaacaaaccaaagcacagcgcgctcggaccatggcactctacaacccaattccagtgagacagaactgctttactgtcaatcgctccctgtttatcttcggcgaagataatattgtgaggaaatacgccaagaagctgatcgactggccacctttcgaatatatgatcctggccaccatcatagccaactgcatcgtgcttgcattggaacagcatctgccagaggatgacaaaacccccatgtccagaagactggagaaaaccgaaccatattttataggaatcttttgctttgaagcgggtattaagatagtcgcactggggttcatattccataaaggttcgtacctacgcaacgggtggaatgtgatggacttcattgttgttctgagcggtattcttgccacggcgggaacccactttaacactcacgttgatctacgcaccttaagagccgttcgggtactgcggcctctgaagctggtgagcggcattccttccctgcagatcgtccttaagtctattatgaaagccatggtgccactcttgcagatcggcctgcttttgttttttgcgatcctaatgttcgccatcatcggactagaattttactcaggcaaactgcaccgtgcatgttttatgaataattctgggatcctggagggattcgacccccctcacccctgtggcgttcagggatgcccagctggttacgagtgtaaggattggattggccctaacgacggcattacacagtttgataacattcttttcgcagttctcaccgtgttccagtgtataactatggaaggctggactacagtgctctataacaccaacgacgcactgggtgcaacctggaattggctgtacttcattccactgatcatcataggttctttttttgtgctgaatctcgtcctcggtgtgctctcaggagagttcgcgaaggagagggagcgtgtcgaaaacagaagggccttcatgaagttgcgacgccaacagcagatcgagcgcgagctcaatggctacagggcctggattgacaaggctgaggaagtgatgctggcggaggagaataaaaacgcaggaacttccgccctggaggtactgaggcgcgcaactattaaaaggagtagaacagaggccatgacacgcgattccagtgacgaacattgcgtcgacatttcttcagtgggaactccccttgcacgtgcgtcgatcaagtccgctaaagtcgacggtgtatcatattttagacataaagaacggttactgcggatctctattcgacatatggtgaagtcccaggtgttctactggatcgttctgagcctggtggctctgaacaccgcgtgcgttgcaatcgttcaccacaatcagcctcagtggctaacccaccttctttactatgcggagtttctcttcctcggtctgttcttactggagatgtccctgaagatgtacggcatggggcctcgactttacttccacagtagcttcaactgttttgacttcggggtgaccgtagggagcatttttgaagtagtgtgggctatcttccgcccaggaacaagctttggcatctccgtcctgagggctcttcgtctgctgaggatttttaagataacaaagtattgggcttcactccggaacctggtggtttccctgatgtcctccatgaagtctattattagcctgctgtttctgctctttctcttcatcgtcgtcttcgcacttctcggaatgcaactgtttggaggcagatttaattttaacgatggtacaccaagcgcaaactttgatacatttcctgccgctatcatgactgtgtttcaaatcctgactggcgaagactggaacgaggtcatgtataatgggatacgctctcaggggggtgtgagctctggtatgtggagcgccatttattttattgtcctcaccctattcggtaattacaccttacttaatgtatttttggccatcgcggtggataacttagccaatgcccaggagctaaccaaagatgagcaggaggaagaggaggctttcaatcaaaagcacgcactgcagaaggcgaaagaagttagcccaatgagcgcacctaacatgcccagtatagagcgcgaacgcagaaggaggcatcatatgtctgtgtgggaacaacgaacctctcagttaaggaagcacatgcagatgagcagccaggaggcccttaatagggaggaagccccaacaatgaacccactcaatccactcaaccccctttcaagcctgaaccctctgaatgcacacccctcactgtacagaaggccaagagctatcgagggtttggcactggggctggccctagaaaaattcgaagaggagcgcatcagccggggaggtagtctaaagggcgatgggggtgataggagcagcgcgctggataatcaaaggacgccactctctctcggccagagagagccaccatggttagctagaccctgccatggaaactgcgatccgacccagcaggaggcagggggtggtgaagcagttgttacgttcgaggatcgggctagacacagacaatcacagcgccgttcaaggcaccgcagggtccggaccgagggcaaggagtcatcatccgcgtctcgtagtcgaagcgcctcgcaggaacggagtttagacgaagccatgcccacagagggcgagaaagatcacgagttgcgcggtaaccatggggcaaaggagcctaccatccaggaagaacgagctcaagatctgcgccgaactaactcattgatggtgtcccgcggatccggactggccggtggcttggacgaagccgacacaccactggtgctgccacaccccgagttggaggtaggaaaacacgttgtgcttaccgagcaggaacccgaaggatcctctgaacaagccctgctggggaacgtccagctggatatgggcagggtgatctcccagagtgaaccggacctctcttgtatcactgctaacaccgataaggcaaccactgaatcaaccagcgtcacagttgctatcccggacgtggaccccttagttgacagcactgtggtccacatatctaacaaaactgatggtgaagcctcgccactcaaagaagctgaaattagagaagacgaggaggaggtagagaagaagaagcagaaaaaggagaagcgcgagactgggaaggcgatggtcccccatagttctatgttcatcttttccacaaccaatcctattcgcagagcctgccactatatcgtgaacctcagatattttgaaatgtgcatactcctcgtgatcgccgcttcttccatcgccctggccgcagaggatccagtcctcacaaatagcgagaggaacaaggtattgcgctattttgattacgtgttcaccggggtcttcacattcgagatggtgatcaaaatgattgaccaaggtcttatccttcaggatggctcttatttccgcgatctctggaacattttggactttgtggtggtggtgggcgctttagtcgctttcgccctcgccaacgccttggggacaaacaagggaagagacatcaaaaccataaaaagtttgcgtgttctgcgggtcttgcgacccctcaagaccatcaagaggctccctaagctgaaagcggtgttcgattgcgttgtgactagccttaaaaatgttttcaatatcctcatagtctacaagctgttcatgtttatatttgctgtgatcgctgtgcaactttttaaaggaaagtttttctattgtactgactctagcaaggacactgagaaggagtgtatcggcaactacgttgatcacgagaagaacaagatggaggtcaaagggcgagaatggaaacgccatgaattccattacgacaatattatatgggcgcttctgaccctgttcacagtttccactggggagggctggccacaggtgttacagcatagtgtcgatgtgactgaggaagaccgcggaccttccaggagcaaccgtatggagatgtcaattttctacgtcgtgtattttgtcgttttccccttttttttcgttaacatctttgtggctctgatcattataacgttccaggagcagggcgacaagatgatggaggagtgcagtctggaaaagaacgaacgggcttgtatcgatttcgccatcagcgctaagccactgactaggtacatgcctcagaaccgtcatacctttcagtaccgagtgtggcacttcgtggtgtctccaagtttcgaatacaccataatggcaatgatcgctctcaacaccgttgttttgatgatgaagtattattccgcaccctgtacttatgagttagctctaaaatatctaaatattgccttcacaatggttttttccctggagtgcgtgctgaaggtgattgccttcggcttcctgaattacttccgtgatacttggaacatttttgatttcattactgtgattggctctatcacagagatcatccttaccgacagcaagttggttaatacatcaggattcaacatgagctttctgaaattgttccgggcagctagactaatcaaattgctccgtcaggggtacaccatccggattctgttatggacctttgttcagagctttaaggccctgccttacgtgtgtctcttgatcgccatgttattcttcatttacgccattatcggcatgcaggttttcggcaatatcaagctagatgaagagagccatattaaccgccacaacaacttcaggtcattttttgggtccctgatgcttttgtttcgctcagccaccggggaggcttggcaggaaataatgcttagctgcctcggcgagaaaggttgcgagccagataccacggctcctagtgggcagaacgagaacgagcgatgcggtacagaccttgcctacgtgtatttcgtttcctttattttcttctgcagtttcctgatgctcaacctttttgtggccgtgatcatggacaatttcgaatacctgacacgggactcaagcatactgggccctcatcacttagacgagtttgtgcgtgtctgggcagagtatgacagagccgcttgcggccgaatacactacacagaaatgtacgaaatgttaaccctgatgagccccccactgggactgggtaagcgctgcccctcaaaggtcgcctataaacgcctggtgctcatgaacatgcccgtggccgaggacatgaccgtgcacttcacatccactctgatggcattaatacgtacagctctggatattaaaatcgctaagggaggagctgacagacaacagttagactcggaacttcagaaggagaccctggctatatggcctcatctaagccagaagatgctggatttgctggtccctatgccgaaagccagcgatctgacggttggcaagatttatgctgcaatgatgataatggattactacaagcagtctaaagtgaaaaaacagcgccagcagcttgaagagcaaaagaacgctcctatgttccaaagaatggagccatcctccttgcctcaagaaatcatcgcaaacgctaaagcgctgccatacctgcagcaggacccagtgagcggtctgtccggtcgaagcggttatccttccatgtcccccctaagccctcaggacatttttcagttagcttgcatggacccagctgacgatggccagtttcaggaacggcaatctctggagccggaggtatccgagctgaaaagcgtgcagccgtcaaatcacggtatttacctgcctagtgacacacaggagcatgcagggagcggccgagccagtagtatgccaaggttaacagtagacccccaagttgtcaccgacccatctagtatgcgccgttccttcagcactatcagagacaagcgttccaactcgtcctggctcgaagagttttcaatggagagatctagcgaaaacacctacaaatccagacggcgatcgtatcatagttccctgaggctctccgcccacagactgaattcagattccggccataagtctgacacacaccgctcaggcggtcgggagcggggacgctccaaggagcggaagcatctcctgagccccgatgtgtctaggtgtaatagtgaggagcggggaacccaggcagactgggagtcccccgagcgacgacagagtaggtctcccagcgaaggaagatctcagacacctaacagacagggaacgggtagtctgtctgagagttccatacctagtgtctccgacactagcacccccagaagatcaaggcggcagctgccgcctgtacccccaaagcctcgaccgcttttgtcctacagttctctcatacgccatgccggttcaataagcccacctgcagacggctccgaggagggatcaccacttacaagtcaggcactggaatccaacaacgcttgcctgactgaatcctctaatagtccccatccccaacagtcccagcatgcctcgccccaaagatatatctctgagccatacctggcccttcatgaggacagccatgcctccgattgtggagaggaggaaaccttaacatttgaagccgctgtcgccacctcacttggtcggtccaatacgatagggtccgccccacccttaaggcactcctggcaaatgccaaacggacattaccgcaggcgcaggcggggagggcctggccctggcatgatgtgcggcgcagtcaacaatctgctgagcgacactgaagaagacgataaatgcta

SEQ ID NO: 216660 - DNA, 5633 bp, Artificial Sequence
  Description of Artificial Sequence: Synthetic coding sequence
atgcttgctgaggaaaataaaaatgctgggacatcagccctcgaggtgctccggagggccaccatcaagagaagcaggactgaagccatgacccgcgactcgagtgatgagcactgcgtagatatatcaagcgtggggacgcctctcgcccgtgccagtatcaagtctgccaaggtggatggggtgtcatatttccgccacaaggagaggctcttgcggatttccatcaggcacatggttaagagtcaggtgttctattggattgtcctgtctctcgtggcccttaataccgcttgtgtggcaatcgtccatcacaatcaacctcagtggttgactcacctcctctattacgcagaattcctttttcttggcctgttcctgctggagatgtctctaaagatgtatggtatgggaccaagattgtactttcactcctcttttaattgcttcgattttggggtgactgtcggcagtatcttcgaggtcgtgtgggctatttttaggcccggaacatctttcggcattagtgtcctcagagccctgcggctactgcgaattttcaagataacgaaatattgggcttccctccgcaatcttgtggtctctcttatgagtagcatgaaatcaatcatttctctgttgttcttgctcttcttgttcattgtggtctttgccctcctgggaatgcaacttttcggaggcagatttaattttaacgatgggaccccgtccgccaacttcgacacttttcccgctgcaattatgactgtgtttcagatcctcacaggagaggactggaatgaggtgatgtataacggcattagaagtcagggcggagtgagctcaggcatgtggtcagccatttactttatagtcctgactttgtttggaaactacacccttcttaacgtgtttcttgccattgctgtggataacctggccaatgctcaggagttaaccaaggatgaacaagaagaagaagaggcatttaatcagaagcacgccctccaaaaagcaaaagaggtgtcacccatgtccgctcccaatatgcccagcatcgagagggacagacgtcgccgacaccatatgagcatgtgggaacctcggtcctctcacttacgggagagacgtcgacggcatcatatgtccgtctgggagcaaaggacaagccagctgcgaaagcacatgcaaatgtcgtcacaggaggccctgaatcgcgaagaggctccaaccatgaaccccctcaacccccttaatccgcttagctctttgaacccactaaatgcccatcccagcctgtaccggcgtcctcgggcaatcgagggccttgcgctgggccttgcattggagaagtttgaagaagagcgcatttcacgagggggttcactgaagggcgatggcggagacaggtcaagcgcgctggacaatcagagaacccccctgtcactcgggcagcgcgaacccccttggctcgctagaccctgccatggtaattgcgaccccacccaacaggaggcaggtggaggagaagccgttgtgacatttgaggatagggctagacacaggcaaagccagcgcaggtctaggcaccgccgtgtccgcaccgagggtaaagagtctagctcggcctctaggtctcggtcagcaagtcaggaaagaagcctcgacgaggctatgccaactgagggggagaaagaccacgagctgcgaggcaatcacggtgccaaggagcctacaatacaagaggagagagcgcaggatttgcggagaaccaatagtttgatggtgtcccgagggtccggacttgcgggtggcctggacgaggccgacactcccctcgtccttccgcaccctgagttggaggtgggcaagcacgtggttctgaccgaacaagagcctgaaggctcatccgaacaggccttgttgggaaacgtgcagctggatatgggcagagtaatctcccaatccgagcccgatttatcctgtatcaccgccaataccgacaaggcgaccaccgagtccacttctgtgacagtggcgattcccgacgtcgaccctcttgttgactctaccgtcgtgcacatcagtaacaagacagatggcgaggccagtcctttaaaagaggccgagatccgggaggatgaagaagaagttgagaaaaaaaagcagaagaaggagaagagggagacgggcaaagcaatggtcccccattcgtctatgttcatattctcaacaactaaccccatacgcagggcatgccactacatcgtgaacttacggtatttcgagatgtgcattctgttggtcattgctgcatcttctatagccctggcagcggaggaccctgtcctgactaattcagaaagaaacaaagtgttgagatactttgactacgtcttcacaggcgtattcactttcgagatggtcattaagatgatagatcagggcctaatcctacaggatggcagttactttcgcgatctttggaacattttggatttcgtcgtagtggtgggtgcccttgtggcctttgctctagccatgtcccttgaaaccaataaaggaagagacatcaaaacaatcaagagcctgcgggtgctccgcgtacttagacccctgaaaaccattaagcgcctacctaagctgaaagcggtctttgactgcgtggtgacgtctctgaagaatgtgttcaacattcttatcgtttataagctgttcatgttcatctttgctgtgattgccgtgcagctatttaagggcaagtttttctattgcaccgacagtagtaaggataccgagaaagagtgcatcggcaactatgtagaccatgaaaagaataaaatggaagtaaagggcagggaatggaagaggcacgagttccactatgacaacataatttgggcactgctcaccctgtttaccgttagcaccggagaaggttggcctcaagtgttgcagcacagcgtggatgtgactgaggaagaccgtgggccttccaggtccaaccggatggagatgtccattttctatgtggtgtattttgtcgttttcccctttttcttcgtgaatatctttgtggcccttatcattatcacttttcaggagcagggcgataagatgatggaagagtgttccttggagaaaaacgagcgcgcttgtattgattttgccattagtgcgaaacctctgacaagatacatgcctcagaataggcatacattccagtatagagtgtggcacttcgtcgtcagtccatccttcgagtacaccatcatggcaatgatcgcactgaacactgtggtcctgatgatgaaatactactcggcaccttgcacatacgagctagccctgaaatatctaaacattgcgttcaccatggtgttctctctcgagtgcgtactgaaggtcatcgcatttgggtttctgaattacttcagagacacctggaatatttttgacttcatcacggttatcggcagcattactgagatcatacttaccgatagcaaactggtgaatacatctgggtttaacatgagtttccttaagctgtttagagctgcccgtctaattaaactgctgcgtcaaggctataccatccgcatcctcctgtggacatttgtccagagcttcaaggcactgccctatgtctgcctgctcatcgcaatgctgtttttcatctatgctattatcgggatgcaggtcttcggaaatataaagctggacgaagagagccacataaaccggcacaacaattttcggtccttcttcgggagtttgatgctactgtttcgttctgccacaggggaagcctggcaggagatcatgctctcatgtctgggcgagaaaggatgtgagcccgacacgacagccccatcaggtcagaacgagaatgagcgatgtggcacggatctcgcttatgtttatttcgtctcatttatcttcttctgcagttttctgatgctgaacttgtttgttgcagtgataatggataactttgagtacttgacaagagactccagtatattaggaccacatcaccttgatgagtttgtccgcgtgtgggccgaatacgatagagcagcttgcggacggatccactatacggagatgtatgagatgctcactctgatgtctcctcctctaggactcggaaagcgctgcccgagcaaggtagcatacaaaaggctcgtgctcatgaacatgcctgtggcagaggatatgacagtgcattttacatccacgctgatggccctgatccggacggccctcgacatcaagatcgccaaaggcggtgctgaccggcagcaactggattctgagctacagaaagaaacactcgccatatggcctcatctctcccagaagatgctggacctacttgtgcccatgcccaaagcctcagatctcacagttgggaaaatctatgctgcaatgatgattatggactattataagcagagcaaagttaagaaacagcgacaacagcttgaagaacagaagaatgcaccaatgttccagcggatggaaccatctagcctgccccaggagattatcgcaaatgctaaagccctcccttacctgcagcaggaccctgtgagcgggctatccggacgcagtggttatccttcaatgtctcccctgtctcctcaggatatttttcaactggcttgcatggacccagctgacgatgggcagtttcaagaacgacagtcacttgtcgtgactgatccgagttccatgcgtcggagcttctctaccatacgcgataaacgctcaaacagtagttggttagaagagttttccatggagcgatcttcagaaaatacctacaagagccgcaggaggtcttaccactctagcctccgattgtctgctcatagattgaactctgactcgggacataagagcgatacccacagatcagggggtcgcgaacggggaaggtccaaagagaggaagcatctcctatcaccagacgttagtcggtgtaacagcgaggagcggggtacacaggccgactgggagtcccccgagcgccgacaaagtaggagtccctctgagggccgatcacagacaccaaatcgacaggggacgggttcactgagcgagtcatccattccgtctgtgtccgacaccagcacaccacgccgttcccggcgtcaacttccgccagtcccgccaaaaccacgcccacttctgtcatactccagtctgatcagacatgcaggaagcatctccccccctgctgatggcagtgaagaagggagtccactaacttctcaagcccttgagtccaataatgcctgtctcacagaatcttcaaatagccctcacccacagcagtctcagcacgcctcacctcagcggtatatctcagaaccctatctagctctgcacgaggacagccacgcatctgactgtggtgaggaggaaacactcacatttgaagccgctgtcgcaacatctttaggtcgttccaatactatcggttcagctcctcccttaagacactcttggcaaatgccgaacgggcactataggagacggaggcgtggcggtcccggtcccggaatgatgtgcggggcagtcaacaacctcctgagcgatacagaggaagacgataaatgcta

SEQ ID NO: 216661 - DNA, 6812 bp, Artificial Sequence
  Description of Artificial Sequence: Synthetic coding sequence
atggcccgattcggcgaggctgtggtagctcgacctgggagtggcgacggggactccgaccagagtcgaaaccggcaaggtacgcctgtgccggcttcgggtcaggccgctgcatataaacaaacaaaagcacaaagggctcggacaatggccttatacaatcctattcccgtgagacagaactgtttcaccgtgaataggtccctgttcatattcggagaagataatatcgtgaggaagtatgctaagaaactgatagactggcccccattcgagtacatgatcctggccactataatcgccaattgcatcgtgctcgcgttggagcaacacctgccagaggatgacaagaccccgatgtccagaaggcttgagaaaacagagccctatttcataggcatcttttgttttgaggcgggaattaagatagtggccctgggattcattttccataaagggtcatatctcaggaacggctggaatgtgatggatttcattgttgtgctaagcggaatcttagccacagctggcacacattttaacacgcacgtggacctccggacactgagagctgtgagagttctccgacccctcaagctggtctctggcattccatccctccaaatagtcttgaagagtattatgaaggcaatggtacctcttttacagatcgggttactgctcttcttcgctatcctgatgttcgcaataatagggttggagttctattccggcaagcttcacagagcgtgctttatgaataattccggtattctggaggggtttgatcctcctcacccctgcggcgtgcaaggctgccccgctgggtatgagtgcaaggattggattggccctaacgacgggataacccaattcgacaacatcctttttgctgttctcaccgtatttcagtgtatcaccatggaagggtggactacagttctgtataacactaacgacgccctcggagctacctggaactggctgtatttcattcctctgatcatcatcggcagcttctttgtgctaaaccttgtgctcggcgttctcagcggagagttcgcaaaggaaagggagcgtgttgagaatcggagagcatttatgaagctacgacggcaacagcagatagaacgggaattaaacggatacagagcttggattgacaaggctgaagaagtcatgctggccgaagaaaacaagaatgcaggtacgagtgccctggaggttctccgacgagcaacgatcaagagatcaaggaccgaagccatgacaagagacagcagcgacgaacattgtgtcgatatatccagtgtcggcacacccctcgcccgagccagcattaaaagtgctaaggtggatggagtgagttacttccggcataaagagagattgctgcggatttccattcgacacatggtcaagtcgcaagtgttctattggattgtcctaagcctggttgctctgaacacggcatgcgtggctattgtacaccacaatcaaccccagtggttaactcaccttctttactacgcggaatttctcttccttggcctgtttctgctagagatgtcactcaagatgtacgggatggggcctcgactttatttccatagctcttttaattgctttgattttggcgtcaccgtgggatcaatatttgaagtagtgtgggctatctttcggccaggaaccagctttggaattagcgtgctaagagctctgaggcttctccggattttcaagataacaaaatattgggcaagccttaggaatttggtggtgagcttgatgagttccatgaagagtatcattagcttgttgttcctcctcttccttttcatcgtcgttttcgccctgctgggaatgcagctgttcgggggtagattcaacttcaatgatggaacgcccagcgccaattttgacacattcccggctgcaataatgacagtgtttcaaatactgaccggagaagattggaacgaggttatgtacaatgggatccggtcccaaggtggggtgtcttctgggatgtggagtgctatctattttatagtcttgactctgttcggcaactatacgctgttaaatgtgttccttgcaattgcagttgacaacttggcaaacgctcaggaactgaccaaagacgaacaagaagaagaagaagctttcaaccagaaacatgcgctgcagaaggccaaagaagtgagccccatgagcgccccaaatatgccctcaatcgagcgtgatcggagacggagacatcatatgtctatgtgggagcccagaagttctcatcttcgtgagcggcgtcgtcggcatcatatgtcggtatgggaacagcgcacttcccagctcagaaagcacatgcagatgagctcacaagaggcattgaacagggaggaagctccaacaatgaatcctctgaaccccctgaatcctctgagctccctcaatccactgaacgctcacccatctctgtaccggagacccagagccatcgagggactggcacttggtttggccctcgagaaattcgaagaagagaggatcagtaggggcggatctctgaaaggggacggaggcgatcggtcatccgcgcttgacaaccaaagaactccccttagccttggccagagggagcccccatggctagccaggccctgccacgggaactgcgatcctactcagcaggaagctggcggaggggaggccgttgtgacctttgaggacagagcccgacaccgtcagtctcagcgtagaagccggcatcgccgtgtccgtaccgagggaaaggagagttcctcagcctctcgcagcaggtccgcatcacaggaacgcagtctagacgaagccatgcctaccgagggggagaaagatcatgaactgcgaggcaaccatggggctaaagagcctactatccaggaagaaagagcccaggatctccggagaaccaactcgcttatggtgagcagggggtctggcctggctggtggcctcgatgaagctgatacccctctggtgctgcctcacccagaattagaagtgggtaagcatgttgtgctgaccgagcaggagccagaggggtcatcggaacaggccctcctgggcaacgtacagctggacatgggacgggtgatatcccagtcagagcccgacctatcctgcataaccgctaatacagacaaggcgactaccgagtctaccagcgtcacagtggcgatacctgatgttgaccccctagtggattccacagtggttcatattagcaataaaactgatggcgaggcctctccgctaaaagaggccgaaatccgagaagacgaagaagaagtggagaaaaagaaacaaaaaaaggagaaaagggagaccggtaaggcaatggtgccacactcaagtatgtttatcttctccacaacaaaccctattaggcgagcatgtcactatatagtgaacctgcgctattttgagatgtgtattttgctggtaatcgcggcatcatccattgccctcgctgcagaggaccctgtgctgaccaactccgagaggaataaggtactgcgatattttgactacgttttcaccggtgtcttcacttttgagatggtgatcaaaatgatcgatcaggggctgatcttgcaggatggctcttacttcagggatttgtggaacattctcgactttgtagttgttgtcggcgcactagtggcctttgccttggccaatgcactgggcaccaacaagggcagagacatcaaaactatcaagtctcttcgggtgttacgagtgctccgtcctcttaagacaataaagaggctgcccaagctgaaggccgtcttcgattgtgtcgtgacctccctgaaaaacgttttcaacatcctgattgtttacaagctttttatgtttatcttcgccgttatcgcggtccagctgttcaagggaaagtttttttattgtacagattctagtaaagacacagagaaagaatgtattggcaactatgtggatcacgagaaaaataagatggaagtgaaaggaagggaatggaagcgccacgagtttcactacgataacatcatctgggccctcctgacactgttcaccgtgtccactggggaggggtggccacaggtgcttcagcatagcgtggacgttaccgaggaggaccggggaccctcacgttccaataggatggagatgagtatcttttacgtggtctactttgtggtctttccattttttttcgttaatatcttcgtggctcttatcattatcacctttcaagaacagggcgataaaatgatggaagaatgctctcttgagaagaatgagagggcgtgtatcgattttgcaattagcgccaaaccacttacacgctatatgccccagaataggcacactttccagtacagggtgtggcattttgtggtttctcctagtttcgagtatacaatcatggccatgatagctctgaacaccgtggtgctgatgatgaagtattacagcgcgccttgcacctatgagctggcattgaaatatctgaatatagcatttaccatggtgttcagcctggagtgcgttctaaaggttatcgccttcggatttcttaactactttagagatacctggaacattttcgattttatcactgtgatcgggtccatcaccgagatcatcctgactgatagtaagctggtaaacaccagcggcttcaatatgagttttctgaaactcttcagagccgctcgacttatcaaattgctccgccagggatacacaatcagaattctactgtggacatttgtgcagagctttaaagctcttccttatgtgtgcctgctgatcgccatgttgtttttcatttacgctattatcggcatgcaagtcttcggcaatataaaactcgatgaggaaagtcacattaatcgccacaacaattttcgctcattctttggttcgctgatgctgcttttccgctcagccaccggggaggcttggcaggaaatcatgctgtcttgtctgggcgaaaagggctgcgagcccgacactaccgctccctccgggcagaacgagaacgagagatgcggcaccgaccttgcatatgtctacttcgtgagctttatattcttttgctcattccttatgctgaatctttttgtggccgtgataatggacaacttcgaataccttactcgggatagtagtatcctggggcctcatcacctggatgagttcgtgcgcgtctgggcagaatatgatagagctgcttgcggacggatccactatacggagatgtacgaaatgctcacactgatgtccccgccactgggattagggaaacggtgccctagtaaagtagcttacaagagattggttctcatgaatatgcccgttgctgaggacatgacagtgcatttcaccagcaccctgatggctctgatacggacggcactggacatcaagatcgctaagggtggtgcagaccgccaacaactcgattctgagctccaaaaggagaccctcgccatttggccccacttgtcacagaaaatgctggacctcttggtcccgatgccgaaggcttctgatctgacagtcggtaagatttatgctgcaatgatgattatggattactataagcaaagcaaggtgaagaaacagagacagcaactggaggagcagaagaatgctccaatgttccagagaatggaaccttcttccctaccgcaggaaattatagccaatgctaaagcgctcccatacctgcagcaggaccctgtctcaggtctctcaggaagatctggttatcccagcatgagccccctttcaccccaggatatcttccaactggcgtgtatggatccggctgatgacggacaattccaggagagacagtctctagtggttacagacccttcgtctatgcgtcggtccttttccacaatccgggacaaacgaagtaatagcagttggcttgaagaattctccatggagaggtcttccgaaaatacttacaaaagccgcaggagatcttaccactcgagccttcggctgagcgcccatcgattaaatagtgattccggccacaaatctgacacccaccgtagcgggggaagagagcgcggacggtctaaggagcgtaagcacctcctgtctcctgatgtttctcgttgtaatagcgaagagcggggaacacaagccgattgggaatcccccgagagaaggcagagtagatcaccctctgaaggaaggtctcagacacccaataggcagggcaccggcagcttgagcgagagtagcatcccatctgtcagcgacacgtccactccaagaaggtcaaggcggcaactcccgccagtccctcccaagccccgtccccttcttagttattcttccttgattcggcacgccggaagtatctctccccctgctgatggtagcgaggaagggtcccccctcacatcccaggctttagagtctaacaatgcgtgcctgacagaaagttctaattcgccgcaccctcaacagtcgcagcatgcgagccctcaaaggtatatcagcgaaccctatctcgcactacacgaggatagtcatgctagtgattgcggggaagaggagactctaactttcgaggccgcagtggcaacaagtttgggccgatctaacactattggttctgcccctccacttcggcacagttggcagatgccaaatggacattatcgacgcaggcggagagggggacctggccctggaatgatgtgtggggctgtgaataatttgctcagcgatacggaagaagatgataaatgtta

SEQ ID NO: 216662 - DNA, 6941 bp, Artificial Sequence
  Description of Artificial Sequence: Synthetic coding sequence
atggcccgtttcggggaagccgtggtggcaagacccggaagcggagacggcgactctgatcagtccagaaacagacagggaacgccagtccctgcaagcggccaggcggcagcttacaagcagactaaagcacagagagccagaacgatggccctgtataatcctatcccggtgcgacagaattgcttcacagtgaatcgtagtttgttcatcttcggagaagacaacattgtgagaaagtatgcaaagaagttaatagattggccccctttcgaatacatgatcctagctaccattatagccaactgtatcgtgctcgctctggagcagcacctgccagaggacgataaaacacctatgagcaggagacttgagaagacagagccttattttatcggcatcttttgctttgaggcaggcattaagatcgtggccctcggtttcatctttcacaagggatcatacttgagaaacggctggaacgttatggacttcatcgtcgtgctgagtggaattctggccactgccggaacccactttaatacccacgttgacctgcgcacccttcgggcagttcgtgttctgcgaccactcaagttggtgagcgggatcccgtcgcttcaaattgtactgaaaagtataatgaaagcaatggtgccactcctgcagatcggccttcttctgttctttgccatcctcatgtttgcaatcataggcctggagttctattctggcaagctacatcgcgcttgctttatgaataacagcggcatcctggagggattcgatcctccacacccttgcggcgttcaaggctgtcccgcaggctatgaatgcaaggattggattgggccaaatgacggaattacacagttcgacaatatcctcttcgccgttctcacagtgttccaatgtatcactatggagggctggacaactgtactgtataacacaaacgacgccctgggagctacttggaactggttgtacttcatccccctgatcatcataggctcatttttcgtcctcaatttagtcctgggggtgctctcaggcgagtttgccaaggaacgggagcgcgttgagaacagaagggcttttatgaaactaagaagacaacagcagattgagcgagagctcaatgggtacagagcgtggattgacaaggccgaggaggtgatgctggccgaagagaacaagaacgccggaacctctgccctggaggtgctcaggcgggcaacgataaagagatcaaggactgaggccatgacccgagactcatccgacgagcactgcgttgatatcagctccgtgggcacaccgttagcccgtgcttccatcaagagcgccaaagtggacggggtctcctatttccgccacaaagagaggttgctacgcatcagtattcgccatatggtgaaatcacaggtattctactggattgtgttatcactggtggctctgaatacggcctgtgtcgccattgtgcaccataatcaacctcagtggctgacccacctgctgtactatgccgagtttttgtttctcggactcttcttacttgagatgtccctaaagatgtatggcatgggtccacggttgtactttcacagtagcttcaactgttttgactttggtgtgaccgtgggctccatctttgaagtggtgtgggccatcttccgccctgggacgtcattcggaatttctgtgctccgcgcattgagactgctccgcattttcaagattactaagtattgggcgagcctcaggaatctagtcgtatccctgatgtcaagtatgaagagtataatctctctcctgtttctcctgttcctcttcattgtcgtgttcgcactgttgggcatgcaattatttggaggccgatttaatttcaacgacggcacgccttcggccaattttgatacgtttcctgccgcaattatgacggtattccagattctcacaggcgaggactggaacgaggtcatgtacaacggaattcggtctcagggcggagtctcgtcaggcatgtggagcgcgatctatttcatcgtcctaacgctgttcgggaactataccctgctgaacgtgtttctcgccatcgcagtggataacctggcaaacgctcaggagcttactaaagatgagcaggaggaagaagaagcgtttaaccagaaacatgccctacagaaggcaaaggaggtgtcccctatgtcagctcctaatatgccaagcatcgagagggaccggaggagacgccaccacatgtctatgtgggaacctaggagcagccatctgagagaacggagaaggcgccatcatatgtcagtttgggagcaacggactagtcagctacggaagcatatgcaaatgagcagccaggaggctctaaatagagaggaggcgccaactatgaaccccctgaatcccctgaatcccctgtcttccctcaaccccctcaatgcccatccgtccctctacaggcgccctagagccatcgaaggtctcgccctgggcctcgcactggagaagtttgaggaggagagaatttctcggggtggatccttaaagggcgatggcggagatagatcctcggcccttgacaaccagagaacaccccttagcttgggccagagagaaccgccttggctggcccgtccctgtcatggtaactgtgacccgacgcagcaagaagctgggggtggcgaggctgtcgtgaccttcgaagaccgcgctagacatagacagtcccagaggcgtagccgtcaccgtcgcgtccgaaccgaggggaaggaatcctccagcgcttccaggtcaaggtccgcttcacaggagcgaagtttagacgaagcaatgcccacagaaggcgaaaaggatcacgagttgcgagggaaccacggggcaaaagaacctaccattcaggaggaaagagcacaggatctgcgtagaaccaacagtttaatggtgtcaaggggtagcggcttagccggaggccttgacgaagccgacacaccgttggtgcttccacatcccgagcttgaggtaggcaagcacgtggtcctaactgagcaggagccggaaggatcatcagaacaagccctgctcggaaatgtgcagcttgatatgggcagggtgatctcgcagagtgaaccagatttatcttgtataactgctaacacggacaaggcaacaacagagagcaccagtgtgacagtcgccatcccggacgtggatcccttggtggactctactgtagtgcacataagcaacaagacagacggggaggcaagcccactgaaggaggccgaaatccgggaggatgaagaagaagtcgagaaaaagaagcaaaagaaagaaaaacgagaaacaggaaaagcaatggttcctcactcttctatgtttatattctctaccacgaaccccattcggagagcctgtcactatatcgtgaatctgcgctacttcgagatgtgtattctactcgtgatcgccgcatcctctatcgctttagctgcggaagatcccgtgcttaccaactctgaaagaaataaggttctgaggtactttgactacgtcttcaccggggttttcacgtttgagatggtgattaagatgattgatcaggggctgattcttcaggatggcagttactttagggatttgtggaatattctggattttgtggtggtggtgggagctcttgttgcgtttgcgctggccaacgcacttgggacaaataagggcagggacatcaaaacaatcaaatccctgagggtcctgagggtgctgcggcctctgaaaaccattaagcgtctgcccaagctgaaggccgtgttcgactgtgtggtaacaagtctaaagaatgtgtttaatattctgatcgtctacaagcttttcatgtttatattcgctgtcattgctgttcaattgttcaagggaaagttcttctattgtacagattccagcaaggacacagagaaagagtgcatcggaaattatgtggaccacgagaagaacaagatggaagtgaagggtcgcgagtggaaacgccacgaatttcattatgataatataatttgggccctgttgaccctattcaccgtctccactggagagggctggcctcaagtcctgcagcattccgttgacgtgaccgaggaggaccgcggaccatcccgctctaaccgcatggaaatgtctatcttttatgtcgtgtatttcgtagtgtttccattcttctttgtaaacatcttcgtggccctgatcatcatcacctttcaggagcagggtgataagatgatggaggagtgttcccttgagaaaaatgaaagggcctgcattgatttcgcaatcagcgcaaaaccgctgacccgctacatgcctcagaatcggcacacatttcagtatcgcgtctggcacttcgtcgtatcgcctagttttgaatacaccattatggcgatgattgccctgaatacggtcgtcctgatgatgaagtattattcagcaccctgtacgtatgagctagctttgaagtatctgaacatcgcttttacgatggtgttttcgctcgagtgcgtgctgaaggtgattgcattcggcttcttgaattattttagagatacgtggaacatcttcgatttcattacagtaatcggctcaattactgagatcatcctcaccgattcaaaactggtgaacaccagcggcttcaacatgagttttctaaaattgttccgggctgctagactgattaaacttctgcggcagggctacaccattagaattctgctatggacctttgtgcagtcattcaaagcccttccttatgtttgcttactgattgctatgctcttctttatttacgcaatcataggcatgcaggttttcggaaatatcaaactggacgaagagtcccatattaacaggcacaacaacttcaggagtttctttggatccctcatgttgctttttaggtccgccacgggcgaagcttggcaggagataatgctctcgtgcctcggagaaaaagggtgtgagcctgataccaccgccccaagcgggcagaatgagaatgaaagatgtggcaccgatctcgcatacgtgtacttcgtcagcttcatattcttctgttccttcctgatgctgaatctgtttgtcgctgtgatcatggacaattttgagtatctcacgagggactcttctattctcggtcctcaccatctggatgagtttgttcgcgtctgggctgaatacgatagagcggcttgtgggaggattcactacacagaaatgtacgaaatgctaactctcatgtcaccgcctctcggtttgggaaagaggtgcccgagcaaagtggcttataaaaggctggttttgatgaatatgcctgtggcggaagacatgaccgtccactttacaagcacattgatggccctaattcggaccgcattagatatcaaaattgcgaagggaggagccgatagacagcagctcgattccgagctccagaaagagacgttagctatttggccacacctgagccagaagatgctagacctgctggtgccaatgccaaaagcttccgacttgaccgtgggaaagatctatgctgccatgatgattatggattattataagcaaagtaaggtaaagaaacagcggcagcagctggaagagcaaaaaaacgcccctatgtttcagcggatggagccaagcagcctgccccaggagattattgccaacgctaaagctcttccgtaccttcagcaggatcccgtgtcaggattaagtgggaggtctggctatccgtctatgtctcctttatccccccaggatatttttcagctggcctgcatggatccggcagatgacgggcagttccaggagcgccagtccctcgagccggaggtgagcgaacttaagagtgtccagccatcaaatcacggaatctacctgccctcagacacccaggagcacgcaggatcaggcagagcttctagtatgccccgtctcacggtcgaccctcaggtggtcaccgacccctcttcgatgcgacgatccttcagtacgatccgcgacaaaagatctaacagttcttggctagaggagtttagtatggagcgatctagcgaaaatacctataaatctaggcgacggtcttatcacagctcgctccggctttcggctcaccgactaaattctgactccggtcataagagcgacacacacagatctggtggacgggagcggggtcgctccaaagagcggaaacatctgcttagccctgacgtatccaggtgtaactcagaggagagaggtacacaggcagattgggaaagccctgagcggaggcagagccggtccccctcagaaggaagatcacagaccccgaacagacaaggaacaggatccctgagcgaaagttctattccctctgtgagtgatactagtaccccaagacgatctcgcaggcagctgcctcctgtccccccaaaaccgaggcccctccttagctattcttcgctgattagacacgccggtagcatctcacctcccgctgatggctccgaagagggctctcccctgacttcacaggctctcgaaagcaacaacgcgtgtctgacagaaagtagcaactctcctcatccccagcagagccagcatgctagccctcagcgatacatctccgaaccatatctggctctgcatgaggattcacacgcttctgattgcggggaagaggagactttaaccttcgaagctgccgtcgcgacttcactcggacggtctaatacaatagggagtgccccaccccttcgacacagctggcagatgcctaacgggcattacagacggaggcgccgtgggggtcctggaccaggaatgatgtgcggagccgttaataacctattaagcgacacggaagaagatgacaagtgtta

SEQ ID NO: 216663 - DNA, 1317 bp, Artificial Sequence
  Description of Artificial Sequence: Synthetic coding sequence
atggccaggttcggtgaagcagtggtcgccaggccaggctctggggatggagacagtgaccaaagtcggaacagacaaggtacccccgtgccggcatccggccaagctgccgcttataaacagactaaagctcagcgggctcggaccatggccctttataacccaataccagtgaggcagaactgcttcaccgttaataggtccctcttcattttcggagaggacaacattgtgagaaagtatgcgaaaaaattgatagactggccccctttcgagtacatgatcctcgccaccatcatcgccaactgtatagtgctcgcgcttgagcagcacttgcctgaggacgataaaaccccgatgtccagacgcctggaaaagacagagccgtacttcattggcattttctgttttgaggcaggcattaaaattgtggcactgggatttattttccataagggaagctatttgcggaacggttggaacgtgatggactttatcgtcgtactcagtggtatccttgcaactgccggtacccatttcaatacgcacgtggacttgagaactctgagggcagttagagttctgcggccactcaagttggtgtctgggatcccgtcgctgcagatcgtgcttaaatctatcatgaaggccatggttccgctgctgcagatcgggttgttgctatttttcgctatcctgatgtttgccatcatcggactggaattttactcaggaaagctccacagagcgtgcttcatgaacaattccggaatactggagggctttgatccacctcatccttgcggagtacaaggatgcccagcgggatacgaatgtaaggactggattggtcccaacgatggaattacccagtttgataacattctgttcgctgttctcacagttttccagtgcatcactatggaggggtggaccactgtcctgtacaatacaaatgatgccctcggagccacgtggaactggctgtattttattcccctgatcatcatcgggtcattttttgtgttaaaccttgtgctgggtgttctgtcaggcgagtttgccaaggagcgcgagcgggtggaaaacaggcgagctttcatgaaactgaggagacagcagcagatcgaacgagaactgaatggctatcgtgcatggatcgataaggccgaagaggtgatgctggctgaggaaaataaaaacgcagggaccagcgccctagaggtgctgaggagagccacaataaagcgcagccgcaccgaagctatgacacgcgacagtagcgacgaacattgtgttgacatatcatctgtctag

SEQ ID NO: 216664 - DNA, 6755 bp, Artificial Sequence
  Description of Artificial Sequence: Synthetic coding sequence
atggctcggttcggtgaagccgtcgtggccagacccggaagcggagatggcgattctgaccaatcacggaataggcaggggacgcctgtgccggcttctgggcaggctgcggcttacaaacagaccaaggcccagcgagcaagaaccatggctctgtacaaccctatcccggtgaggcaaaattgttttactgtaaaccgctcactctttatcttcggagaggacaacatcgtcagaaagtatgccaagaagctgatcgactggcccccattcgaatatatgatattggctaccattattgcaaattgcattgtcctagccctggaacagcatttgcccgaagacgacaagactccaatgtcccggcgtctggagaagactgaaccatactttatagggatattttgctttgaggcgggtattaagatagtagccctcggattcattttccacaaggggtcctacttacgaaacggatggaacgtcatggactttatcgtagtgctgtcgggcatcctggcaaccgccggaacacactttaacactcacgttgacctgaggacactgcgggctgtcagagttctgagaccactgaaattggttagcggcatacctagtctccagatcgtcctgaaaagcattatgaaggccatggtgcccctcctgcagattggccttctgttgttctttgcaattctgatgtttgctattattggcctcgaattctactctggaaaactgcaccgcgcatgctttatgaataacagcggtatactggagggttttgaccccccacatccttgtggcgtgcaggggtgtcctgctggatacgagtgcaaagattggatcggtcctaacgacgggatcacccagttcgacaatatcctgtttgctgtacttaccgtctttcagtgcattacgatggagggatggacgaccgtcctgtacaacaccaatgatgcgctgggggcaacatggaattggctctactttatcccccttatcatcatcggcagtttcttcgtactcaatcttgttctcggagtgctctcgggtgagttcgccaaagaacgggagagggtggagaaccgccgagcatttatgaagttgcgtcggcagcagcagatcgagagagagctcaatgggtatcgcgcatggattgacaaggccgaagaggtgatgttggcggaagaaaacaagaatgctgggacaagtgccctcgaggtgctacggcgagcaaccatcaagcgctcaagaactgaagcaatgacaagggactccagcgatgagcattgcgtggacatctcttccgtgggaactccccttgcgagggcaagcatcaaaagcgcgaaagtcgacggcgtgagttactttaggcacaaggaaagattattgcgcataagtatcagacacatggtgaaaagccaggtgttttattggatcgttctgagcctggttgcccttaataccgcctgcgtggctatcgtgcaccataaccagccccaatggctcacgcatctgttatattatgctgagtttctgtttctcggactgttcctgctcgagatgagtcttaaaatgtacggcatgggaccccgtctgtactttcactccagctttaactgcttcgatttcggagttactgttgggtccattttcgaggtggtttgggccatctttaggccaggcacttccttcggcatctctgttctgcgcgcattgcggctgctgaggatctttaagattacgaagtactgggcctctctgcggaacctggtggtatcactgatgtcttcaatgaagagtatcatttctttacttttcctgctcttcctctttatagttgtgtttgccttgttgggtatgcagctgttcggtgggaggtttaacttcaatgacgggaccccctcagccaatttcgacacctttcccgctgcaatcatgaccgtttttcagatcttgaccggagaggattggaatgaagtcatgtataacggtatccggtcacagggcggtgtgtccagcggaatgtggagcgccatatacttcatagtgctaacgctttttggcaactataccttgctaaacgtgtttctggcgattgccgtggacaacctggcgaacgcccaggaacttactaaggatgagcaggaggaagaagaggcgttcaaccaaaagcatgctctgcaaaaggccaaggaagtgagcccaatgtccgccccaaacatgccaagcatagaacgtgaaaggcgaagacggcaccacatgagcgtctgggagcagcggactagtcagctgaggaagcatatgcagatgtctagccaggaagcactgaaccgcgaagaggctccgacaatgaacccactcaatcctctcaaccccctgagtagcctgaaccctcttaacgcacatccttccctctatagacgccctagagctattgagggcctggccctgggcttagccttggagaaatttgaggaggaaaggatcagcaggggcggatctctgaaaggtgatgggggtgaccgatcctcagctctggataaccagcgaactcctttgagtctcggtcagagggagcctccctggctggctcggccatgccatgggaattgtgatcctacccagcaagaggcaggcggtggagaggccgtggtgacatttgaagacagagcaagacataggcagagtcagcggaggagcaggcataggagagtcaggacagaagggaaggaaagttcctcagcttcccgatctagaagcgcaagtcaggaacgttcactggacgaggccatgccaacggagggcgaaaaagaccatgagttgcggggaaaccacggggctaaagaaccaactatacaagaggaacgagcacaggatttgcgcagaaccaatagcctcatggtttccagggggagtggcctggccggaggactggacgaagcggatacacctctggttctgccacatcccgagctcgaagttggaaagcacgtagtgctgaccgagcaggaacctgagggcagctctgagcaagcacttcttggtaacgtgcagctggatatgggcagagtcataagccaaagtgaacctgatctgtcttgcatcaccgctaatactgacaaggcaacaaccgagagtactagcgtgaccgtggcaatacctgatgtggaccctctcgtcgatagtactgttgttcacatcagtaacaaaaccgatggtgaagcgtctccgctgaaagaagcagagatcagggaagatgaggaggaagtcgagaaaaagaagcaaaagaaagaaaaacgcgagacgggcaaagcaatggtaccgcactccagcatgtttatattctcaaccaccaaccccattcgcagagcctgtcactatatcgtgaatctacgatattttgaaatgtgcattctcctcgtgatcgcagcgtcctcaattgcactggctgctgaagatcctgtcctaaccaattccgaacgcaataaagtcttaaggtacttcgattacgtcttcactggagtctttacatttgagatggtaattaagatgattgatcaagggctgattctccaggatggatcctatttcagagacctgtggaatatcctggatttcgtggtggtagtcggagcgctagtagcattcgcgctcgccaatgcactaggaactaataaaggacgggacataaagacaatcaaatctctcagggtcttacgagtgttacggcctctgaaaacaatcaaacggcttccgaaattgaaagccgtctttgactgcgtcgtgacgtccctgaagaacgtatttaacatactgatagtctacaagctgttcatgttcatcttcgccgtgattgccgtccagctgtttaagggaaaattcttctattgcactgactcctctaaagatactgagaaggaatgcatcggcaattacgtggatcacgagaaaaacaaaatggaggtaaagggcagagaatggaagcggcacgaattccactatgacaatatcatatgggctttactcaccttgttcacagtcagcaccggcgaagggtggccccaggtgttgcagcactccgtggatgtcaccgaggaggaccgagggccatctcgtagtaatcggatggagatgtctatattctacgtcgtgtactttgtcgtgtttcccttttttttcgtgaatatctttgttgcactcatcatcatcacctttcaggagcaaggggacaagatgatggaggagtgcagcctggaaaaaaacgagagggcttgcatcgacttcgctatttctgcaaaacctctgacgaggtatatgccgcagaacaggcacacctttcaatatagggtgtggcattttgttgtgtctccatctttcgaatatacgattatggcaatgatcgctctgaacacagttgtgctgatgatgaagtattattctgcaccctgcacatacgaacttgccctgaagtacttgaacatcgcttttacaatggtgtttagcctcgaatgcgttctaaaggtaatcgcgttcgggttcctcaattacttccgagatacttggaacatctttgatttcataacagtgatcggatccattacagagatcatcctcactgactcaaaactggtcaacacatctgggtttaacatgtcattccttaaactgtttcgagccgcacggctcattaaactgctgaggcagggttataccatcaggatcctcctctggacatttgtccagagctttaaggcactgccatatgtctgtctgctgatcgctatgctatttttcatctacgccattatcggtatgcaggtttttggcaatattaaactggacgaagagagtcatatcaacaggcacaataacttccggtcatttttcggaagcctcatgctcctgttcaggagtgccactggagaagcctggcaagagatcatgcttagctgtttgggcgaaaaaggctgtgaacccgacacaactgccccatccgggcagaatgagaatgaacgctgtggcaccgatttggcttatgtgtattttgtgtccttcatattcttctgctctttcctgatgctcaacctttttgttgctgtgataatggacaattttgaatatctaacccgggattctagtatcctgggcccacaccacttagatgagtttgtacgtgtgtgggccgagtacgaccgtgcagcctgtgggagaattcattacactgaaatgtatgagatgttgacactaatgagccctcctttagggctgggaaagagatgcccaagtaaggtggcttataagcggcttgtcctaatgaatatgcctgtggcggaagacatgactgtacacttcacgagtaccttgatggctttgattcgcacagccctggatataaaaattgccaaaggtggtgccgacagacagcagttagactccgagcttcagaaggagactcttgccatctggccgcatctgtctcagaagatgctcgatttgctggtacccatgcctaaagcctcggatctgacggtcggcaagatctatgcagcaatgatgatcatggattactataagcaatctaaggtaaagaaacagcggcagcagctggaggaacaaaaaaacgccccaatgttccagaggatggaaccatcttccctgccacaggagataatagccaacgccaaggcactgccatatctgcagcaggaccctgtgagtggactgtccggacggtccggatatccaagtatgtcccccctcagtccgcaagacatcttccaactggcttgcatggatcctgcagacgacggtcaatttcaggaaaggcagagtttagtggttaccgaccctagctcaatgcgcagatcttttagcactatccgggacaagaggagcaattctagctggctcgaggaattcagcatggaacgcagcagtgagaacacttacaagagtcgtcggaggtcttatcacagtagcttgagactgtcggctcataggttaaattcagacagcgggcacaagtctgatacccatagatctggcggaagggagcgcggacgttcaaaagagcgaaaacacctgctttctcccgatgttagcagatgcaattccgaggaaagagggacccaagctgattgggaaagcccagaaagacgccaatctcgaagccctagcgagggcagatcacagaccccgaatcgtcagggaaccggatccctgtccgagagttctatccctagtgttagtgatacatccacacctcgcaggtccaggaggcagctgccccctgtgccccctaagcctcggccacttcttagctactcatcgctgatccggcacgccggtagcataagcccacctgcagacgggtccgaggagggttctcccctcacttcacaggccttagagagcaataatgcttgcttaactgaatcttcaaacagtcctcatcctcaacagtcccagcacgcctctccccaaagatatatttctgagccgtacctcgcactgcacgaagactcccacgcaagcgattgtggcgaagaggagactctcacatttgaagccgctgtcgcaacctccctggggcgatccaataccatcggaagcgctccacctctccggcacagctggcagatgccaaatggccactatcgacggagacggagaggtgggccagggccaggaatgatgtgcggcgctgtgaacaacctcttgtccgataccgaggaagatgacaagtgtta

SEQ ID NO: 216665 - DNA, 7061 bp, Artificial Sequence
  Description of Artificial Sequence: Synthetic coding sequence
atgactgagggtgcacgagccgctgacgaggttcgggtaccacttggtgcacctccaccaggcccagccgctcttgtgggcgcatcccctgaatccccaggcgcaccaggcagagaagccgagcgcggttctgaactgggagtttcccctagcgagtcgcctgccgcagaacgcggagcagagctgggtgcagatgaggaacagcgtgttccatatcccgcacttgccgctacagtctttttctgtttgggtcagacgacacggccacggtcttggtgcctgcggctcgtctgcaacccctggttcgagcacgtgagcatgctcgtgatcatgctcaactgcgtgactctggggatgtttaggccttgtgaggatgtggagtgcggcagtgagagatgtaatattttggaagcatttgacgcttttattttcgcattttttgctgtggagatggtgatcaaaatggttgcattaggcctgtttggccaaaagtgctaccttggcgatacctggaaccgcctggatttttttatagtcgttgccggaatgatggagtactctttggacggacataacgtgagcttatccgcgatccgtaccgtgcgagtgctgcgacctctgagggccatcaaccgggtaccatccatgcgcatcctcgtgacactgctgttggacacactgcccatgctcgggaacgtgcttctgctgtgcttcttcgtgttcttcatcttcggcatagtaggcgtccagttgtgggctgggttactcaggaatcgatgttttctcgactcagcttttgtgaggaataataatttaacatttctgaggccatattatcaaacagaggagggcgaagagaatccctttatctgcagcagccgaagggacaacggcatgcagaaatgcagccatataccgggtaggcgcgaactccgtatgccgtgcactctgggctgggaggcctacacccagccacaggcagaaggggttggagcagccaggaatgcctgcatcaactggaatcagtactataatgtctgccgttccggagattcgaacccacataatggggcaattaacttcgacaacatcggctatgcttggattgccatctttcaagtgatcacacttgaaggatgggtggatatcatgtactacgtgatggatgctcatagtttctacaactttatttacttcatcctgctaattattgtcggatcatttttcatgataaatctctgtcttgtggtgatcgcgacccagttttccgagacaaagcagagggaatcccagctcatgagggagcagcgtgcacgtcacctgagtaatgattccaccctagcatcattctctgagccagggagctgctatgaggagctcttgaaatatgtaggacacattttccgcaaagtcaagagaagatccttgcgcctttatgcacgctggcaatctcgatggagaaaaaaggttgatccaagtgccgtgcaaggccagggaccaggccatagacagcggagagccggtcgacacacagcttctgtacatcacctcgtgtaccaccatcatcaccaccaccatcatcactatcactttagtcacggcagtcctcgaaggccgggacctgagccgggagcctgcgatactcggttagtgcgcgcaggagctccacctagcccgccaagccctggccgtggtcccccagatgctgagagcgtccatagcatttaccatgctgattgccatatcgaggggccacaggaacgggctcgggttgcacatgcagcagccacggcagctgcctccctccgcctggccaccgggttggggacgatgaactacccaacaatccttccaagcggggtaggttctgggaaggggtcgacatccccaggtcccaaaggcaaatgggctggagggccaccaggcaccggtggccatgggcctttgagcctgaatagcccagatccatacgaaaaaattccgcacgttgtgggggaacatggcttagggcaagcccctgggcacctctcaggcctgtcagtgccatgccctcttccatctccgccagccggtacacttacgtgtgaattaaagagttgtccttattgcacaagagcgttggaggatccagaaggtgagctcagtggctctgaatccggcgacagcgatggaagaggagtgtatgagttcacgcaggacgtgcgccatggggacagatgggacccgactaggccgcctagggcgacggatacacctgggcctggccctggcagcccccagcgtcgggctcagcagcgggcagcgccaggtgaaccgggatggatgggcaggctgtgggtgacattcagcggcaaactcagacgcatcgtagattctaaatacttctcacgagggatcatgatggcaatactcgtaaacactctttctatgggcgttgagtaccacgaacaaccggaggaactgacaaatgctctggagatatcgaatattgtgttcacctcgatgtttgctctggagatgttactgaaacttctggcctgcggtccactgggctacatccggaacccctacaatatctttgatgggatcatcgttgttatttcagtttgggagatcgtgggacaggccgacggaggactgtcagtattacggacgtttcggctgctcagagttctgaaactcgtccggtttctccccgcacttcgaagacaactggttgttctggtgaagacgatggataatgtcgcaaccttctgcactctgttgatgctcttcatcttcatattctctatcctgggaatgcacctcttcggttgtaagttctcattgaaaaccgatacaggcgacaccgttccggaccgtaagaattttgatagtcttctgtgggccatcgttactgttttccagatcctgacacaggaggactggaacgtggtgctttataatggtatggcgagtaccagctcttgggccgcactgtattttgtcgccctgatgacttttgggaattatgtactgttcaacctactggttgcaattctggtggagggtttccaggctgaaggggacgcgaaccggagtgataccgacgaggataagacctccgtgcactttgaggaagactttcataagctgagggagctccagacaacagaactgaaaatgtgctcccttgccgtgaccccaaatgggcacttggagggcagaggcagcctatcacccccacttattatgtgtacagcagccactccaatgcccaccccgaaaagctcccccttcctcgacgcagccccatccttgccggattcccgcaggggttcatcatctagcggcgacccacctctgggggaccagaagccccctgcgtctctgaggtctagcccttgtgccccatggggacccagtggagcatggtcaagtcgccgatcgtcctggagctctctgggccgtgccccttccctcaaaagacgcggacagtgtggagaaagggaatccctgctcagcggggaaggaaagggtagtactgatgacgaggctgaagatgggagagctgctccaggcccaagggcaacccccttgcgaagggctgaatccttggatcccaggcccttgagacccgcagcattaccaccaacaaagtgccgggacagagacggccaggtggtagctctgccctctgattttttcctaaggattgacagtcaccgagaagatgctgctgagctggacgacgattccgaggactcatgttgcctgcggctgcacaaggttctggaaccatataagcctcagtggtgcagaagccgggaggcctgggctttatacctgttcagtccacaaaaccgatttagggtcagctgtcaaaaagtgataacgcacaagatgttcgaccacgtcgttttggtctttatcttcctaaattgtgtgacaatcgccctcgagcgtcctgatatagatcccggtagcactgagcgggtgtttttaagtgtgtccaactacatctttaccgctatcttcgtcgctgaaatgatggtcaaagtggtggccttgggacttctttctggtgaacatgcttaccttcagtctagctggaatctgcttgatggcctgctggttctggtttctctggtggatattgttgtcgcgatggcttcagcagggggtgccaagattctcggggtgctcagagttctgcgactgctgcggactcttcgacctttgcgtgtcatttcaagagccccagggctgaaactcgttgtagaaacactcatcagcagcttgaggcctattggaaacatcgtactcatctgttgtgccttctttatcatcttcggcattcttggagtgcaactgtttaagggaaagttctattattgtgagggacctgatactcgaaacatctccactaaagcccagtgcagggccgcacattacaggtgggtccggaggaagtacaattttgataacctaggtcaggcgttaatgagtttattcgtgttaagctccaaggatggctgggttaacataatgtacgacggtctggatgccgtcggtgttgatcagcagccagtgcagaatcataacccttggatgctgctgtatttcatttccttcctcctgatcgtttccttttttgtactcaacatgtttgtcggtgttgtggtggagaatttccataagtgtcgtcaacaccaggaagctgaggaagctagaaggcgcgaagaaaaacgccttcgccgtttggagaggcgtagacgttccacattcccatcacccgaagcccagcgacggccttactacgcggattatagcccaactagacggagtatccacagtttatgcacttcacattatctcgacttgtttataacattcattatctgcgtaaatgtcatcactatgtcgatggagcactacaatcagccgaagtctttagacgaagccctcaagtactgcaattacgtgttcactattgtgtttgtcttcgaggccgctctgaaactcgtcgcctttggatttcgccgttttttcaaagataggtggaatcagctcgacctggcaatcgtgctcctatcgttgatgggcatcacactcgaggagatcgagatgagcgcagctctccctattaatccaacaatcatccggatcatgcgcgtgcttcggatcgcacgtgtccttaagctcctgaagatggctaccggcatgcgcgctctgctggacaccgtcgtgcaggccttgcctcaggtgggaaatcttggactgttgttcatgctgctcttctttatctatgcggcactcggcgtagagctatttggccgactggaatgtagcgaagacaacccatgtgaaggtttgagtcgacatgcgactttttctaacttcgggatggctttccttaccttgttccgggtgagcacaggggataattggaatggaataatgaaagataccctgagggagtgtagcagagaagataaacactgtctttcatatctccccgctctgtctcccgtgtacttcgtcacatttgtgctggtggcacagttcgtcttggtgaacgtcgttgtcgccgtgctaatgaaacacctggaagagtccaacaaggaggcccgagaagacgccgaactggacgcggaaattgagctcgagatggctcaaggccctggctcagctcgacgtgtggatgcagatcggccacccctacctcaggagtccccaggtgccagagacgctccaaacctggtcgctcggaaggtgtctgtgtctcgcatgttatcacttccgaatgattcgtacatgttccggccagttgtgcccgctagcgcacctcatcctcgccctcttcaggaagtggagatggaaacgtacggcgcaggcacaccactgggttctgtggcatcagtgcattctccacccgctgagtcttgcgcaagtttgcagattcctctagctgtgagcagcccagccagatcaggagagcctcttcacgctttgtccccaaggggtactgcacgcagcccatctctcagtcgcctactatgtaggcaggaagccgtacacactgattcactggaagggaagattgattcccccagagacacgctggatcccgctgagcctggggagaaaacacccgtgcgccctgtgactcagggcggttcgttacagagtccacctcgcagtcctagacccgctagcgtcagaactaggaagcacaccttcggacagcgttgtgtcagctcgcgcccagccgctccagggggagaggaggccgaagcttcagaccctgccgacgaggaagtatcccatatcacctcttctgcttgcccgtggcagcccactgctgagccacacggtcccgaagcatctcccgtagccggaggcgaacgcgaccttcgcagactctacagtgtggacgcacaaggcttccttgacaagcccggtagggcagacgaacagtggcgacctagcgctgagctgggcagcggagagccaggcgaagccaaggcctgggggccagaagctgaacccgctttaggagccagacgcaagaagaaaatgtccccaccctgcatctccgtggagcccccagcagaggatgagggaagcgcccgtcccagcgctgcagaaggaggaagtacaacgctccggaggcgtactccctcctgtgaggccaccccacaccgggatagtctggagcctactgaaggttcgggggctggcggtgatccggcagctaaaggggaacgctggggccaggctagttgccgggcagaacaccttactgtgccctcgtttgctttcgagcccttagacttaggtgtgccgagcggtgatcctttcctggacggcagtcactcagtcacaccggagagccgagcgagctcatccggtgccatcgtgccactcgaacctcccgagtctgagccccctatgcccgttggagatccaccagagaagcggagaggcctgtaccttacagtgccccagtgcccccttgagaaacccggatctccttccgcaaccccagcaccgggaggaggggctgatgacccagtgta

SEQ ID NO: 216666 - DNA, 7043 bp, Artificial Sequence
  Description of Artificial Sequence: Synthetic coding sequence
atgaccgaaggtgccagggccgctgatgaggtgcgtgtgccgctgggcgctccgcctccgggtcccgcagcactagtaggcgcatccccggagagcccaggagcccctgggagagaagccgaacgagggtccgaactgggcgtgagccccagcgagtcgccagccgcagagcggggagcagagctgggggctgacgaggaacagcgcgtgccttatcccgctctagccgcaacagtctttttctgcctcgggcaaaccacacgaccacgctcttggtgcctccgcctcgtttgtaacccctggtttgaacacgtctctatgctggtgatcatgctgaattgcgtgactctgggcatgttcaggccctgcgaggacgttgagtgtgggtcagagaggtgtaatatactggaagccttcgacgctttcatttttgcattctttgccgtcgaaatggtaattaaaatggttgccctaggcctttttggtcagaagtgctacttgggtgatacttggaaccgtctggacttttttattgtggtcgccggtatgatggaatattcgctcgacggacataatgtatctctgtcggctatccggacagtacgcgtgctgcgtcctctccgcgcaatcaacagggttccttccatgaggatcctggtcactctcttgctggacaccttaccaatgcttggtaatgttttgttactctgcttctttgtattttttatctttggcatcgttggcgtgcagttatgggccggactcctaagaaacagatgtttcctcgactccgctttcgtgcgaaataataacttgacgtttctgcgcccatactaccaaacggaggagggcgaggagaatccgtttatatgcagcagtcgcagagataatggtatgcaaaagtgctcgcacattcctgggaggagggaattgcgaatgccttgcacccttggttgggaggcctatacacagccacaagccgagggagtcggggcagctcgtaatgcctgtatcaattggaatcagtactacaacgtctgtagatccggggacagcaacccccacaacggcgcaattaacttcgacaatatcggatacgcctggattgctatatttcaggtgataactcttgagggatgggttgatattatgtattacgtgatggatgctcacagtttttataactttatctattttattctgctgatcatcgtggggtccttctttatgatcaatctttgtttagtggtcatcgcgacccaattcagcgagaccaagcagagggagagccagctgatgagagaacagcgcgctcggcacttgtctaatgattctaccctagcctctttttccgagcccggtagttgttacgaggaactgttgaagtacgtcggacacatattccggaaagtaaaaagaagaagtctgagactctacgctcgatggcagtcccgctggcgtaaaaaggtagatccaagcgccgtccagggacagggccctgggcatcggcagaggcgagcgggtagacacactgccagtgtgcatcaccttgtgtaccatcatcaccatcaccatcaccaccattaccatttcagccacggcagtcctagaagacccggtccggaaccaggagcctgcgataccaggctggtgagggccggagcacccccttcacccccaagccccggacggggacctccagacgccgaaagcgtccacagcatctatcacgcagactgccacatcgaggggcctcaggaacgggcacgggtggctcacgccgctgcaaccgctgccgcaagtctgcgactagcgacaggccttggcacaatgaattatcctacaatcctgccgtctggtgtgggaagcggcaaaggttccacctcaccgggtccgaagggaaagtgggcaggcggtccgccagggaccggaggacatggcccacttagcctgaattctccggatccttatgagaagatccctcacgtagtcggagagcacggactgggccaggctcccggacacctgagtggactctcagtgccttgtccactgccttcccctcctgccggtaccctgacctgtgagctcaaatcgtgcccttactgcacccgcgctcttgaagatcccgaaggtgagctgtccggttccgagtctggggactcagatggcaggggggtgtatgaattcacccaagacgtgaggcacggagaccggtgggaccccacccggccacccagggcaactgatactcccggacccggtccaggcagcccccagaggcgggctcagcagagggccgctccaggagagcctggttggatgggccgtttgtgggtcacattttcagggaaactgcggagaatcgtggactcaaaatatttttcacgcggaattatgatggccattctggtcaacacccttagcatgggagtggagtatcacgaacagcccgaggagttgacaaacgccttggagatctccaacattgtgttcacttctatgttcgcgttagaaatgctcctgaagctgctcgcgtgcgggccattgggatatattagaaacccctataacattttcgacggcatcatcgtggtgatttcagtgtgggagatcgtgggacaggctgacgggggactgtctgttctgaggacattccggctgcttcgtgtcctgaaactggtccggtttttacctgccctccgcagacagcttgtggtgttggttaaaacaatggacaacgtagcgaccttctgcacactgctgatgctgttcatctttatattctcaatcctcggcatgcacctcttcggatgcaagttttccctaaagacagacacgggcgacaccgtcccagacaggaaaaattttgacagtcttctctgggccatagtgactgttttccagatacttacacaggaggattggaacgtggtactttataatggcatggcctcaacaagctcctgggcagccctctatttcgtcgcactaatgactttcgggaactatgtcctgttcaacctgctggtcgcgattctagtggaaggctttcaggctgagggggacgccaatcgttcagacaccgacgaagataaaacttcggttcacttcgaggaggatttccacaaacttcgggagcttcaaactactgaactcaagatgtgctctttagcggtaactcctaatggacacctagagggtcggggttcactgtcaccaccactgattatgtgcaccgctgctactcctatgccaacacctaaaagtagcccgtttctcgacgctgcaccctcactgcccgattctcgacgcggatcctctagctcaggagaccccccactaggcgatcagaagccgccagcgtctcttagaagcagtccctgcgccccatggggtcctagcggcgcttggagcagtcgcaggtcctcctggagctccctgggccgagctcccagtcttaagagacgcggtcaatgcggagaaagagagtctttgctgtccggggaaggcaagggaagcaccgatgacgaagccgaagatgggagggcagcaccaggcccacgggctactcccctgcggcgtgctgagtccttagaccctcggccattacgcccagccgcacttccacccaccaaatgtcgcgatagagacggccaggtcgtcgccctgccatccgatttcttccttaggatcgacagtcaccgtgaggatgccgcagaactcgatgacgacagcgaggactcttgttgtcttcgcctgcacaaggtactcgagccttataaaccccagtggtgtagatctcgcgaagcctgggcattgtatcttttctccccacagaaccggtttcgggtctcttgccaaaaggtcattacacataagatgtttgaccatgtggtgttagtgtttatctttctcaattgcgtcaccatcgcgttagagcggccagatattgatccaggcagtaccgagcgggtattccttagcgttagcaattacatttttactgcgatttttgttgccgaaatgatggtaaaggtggttgccctcggcctcctgtcgggtgaacacgcgtatcttcagagttcttggaacctgctggacggcctgttggtgctggtgagtctcgtcgatattgtcgtagctatggcatccgcgggaggagctaagatactaggggtgctgagagtgctgagacttctgcgcacccttcgccctctgagagtaatatccagggccccaggtttgaagctagttgtggaaactcttatctcgtccctgagacctattggtaatattgttttaatctgttgcgccttctttatcattttcggaattttaggggtacagctttttaagggcaagttctactactgcgaagggcctgatacacgaaatatttctaccaaggcccagtgccgtgcggctcactaccgatgggtgaggcgcaaatataacttcgacaacctgggccaggcactgatgtcattgttcgtgctgtccagtaaggatggctgggtgaatatcatgtacgatggtctggacgcagtaggggtcgatcagcagccggtccaaaatcataacccctggatgctgctgtactttatctcctttttactcattgtgtctttctttgtccttaatatgttcgttggtgtggtggtggagaatttccacaaatgcagacagcatcaggaggccgaggaggcacggcgacgcgaagaaaagcgattgcggagattggaacgacgccgaaggaaagcacagcgccgtccatactacgccgactatagtccaacccgtaggagtatccatagtttatgtacttcacattacttggacctgtttatcactttcattatttgcgtcaacgtaatcacaatgtccatggaacactacaatcaacctaaaagtctcgatgaggccctgaagtactgtaattacgtattcaccattgtgtttgtattcgaggctgctctgaagttggtggccttcggcttccggagatttttcaaagaccggtggaatcagttggatttggccattgtgctgctcagcctgatggggatcacccttgaggagatcgagatgtctgccgctcttcctataaaccccacaatcatacgaattatgcgtgtgctgaggattgctagagtattaaaacttctgaaaatggccaccggcatgcgcgcactcctggacaccgttgtgcaagcccttcctcaggtgggcaatctagggctgctgtttatgttgcttttttttatctacgccgctctcggggtggaattgttcggtcggctcgaatgctctgaagataacccatgcgagggcctttccagacacgccaccttttctaatttcggcatggcctttcttaccctgtttagagtgtcaaccggcgacaattggaacgggattatgaaggatactctcagggaatgttcccgagaggataaacactgcctttcttatcttcctgctcttagtcccgtttatttcgtaaccttcgtgctagtcgctcagttcgtcttggtgaacgtggttgttgccgtgctgatgaagcacctcgaagaaagcaacaaagaggccagagaggatgcagagctggacgccgagatcgagttggagatggcccagggccctggatccgcacgccgtgtggacgctgaccgacccccacttccacaggaaagcccaggcgcacgcgacgctccaaatttggttgcaagaaaagtgtcggtgagccgcatgctgtcactcccaaacgacagctacatgttcaggcctgtggtgcctgccagtgccccacacccacgaccattgcaagaggtggagatggagacctacggagccggaacccccctggggtccgttgctagcgtgcatagtcctcccgcagaaagctgcgcatctctgcagatcccgctagccgtctcctcccctgccaggtctggcgaacctcttcacgctctgtccccacggggaactgcccgttcaccgagcctgtccagactcctgtgtcgccaggaagcggtgcatacagattccctggagggaaagattgattcgccgagagataccttggatcccgctgagccgggtgaaaaaaccccagtgcggcctgttactcagggtggctccctgcagagcccacccaggtccccgcgaccagcgagcgtgagaaccagaaagcacacttttggacagagatgcgtgtcatcccgcccagctgccccaggcggtgaagaagccgaagcatctgatccggctgatgaagaagtgagccatataacctcgtccgcttgtccctggcagcccaccgccgagccccacggcccagaagcctcccccgtggcaggtggggagcgcgatcttcgccgattgtactcggtggacgcccaagggtttctggacaagcccggtagagccgatgagcagtggagaccatctgccgagctaggctctggggaacctggtgaagccaaagcatgggggcctgaggcggagcctgctctgggggcaaggagaaagaaaaaaatgtctcccccttgcatctccgttgaacctccagcggaagatgagggttcagcgcgtcccagtgctgcggaaggaggaagtacgaccttaaggcgaagaacaccgtcttgtgaagcaactcctcacagggattcactggagccaactgaaggaagtggagcaggaggcgatcccgctgcaaagggggagaggtggggccaggcatcttgtcgggcagagcatctcacagtgccatcatttgcatttgaaccactagacctgggtgtcccgtcaggtgatcccttcctcgacggtagccatagtgtgacccccgagtctcgcgcaagctctagtggcgctattgtgcctcttgagccacccgagagcgagccaccaatgccagtgggcgatccgccagaaaaaagacggggtctgtacctgaccgtccctcagtgcccccttgaaaagcctggctccccgagcgctactccagctcctggaggtggcgctgatgacccagtgta

SEQ ID NO: 216667 - DNA, 6689 bp, Artificial Sequence
  Description of Artificial Sequence: Synthetic coding sequence
atggctgagtcggctagccctcccagttcctctgccgctgcgcctgcagccgagcctggggtgactactgagcagccgggaccacggagcccgccttctagtccgccaggccttgaagaaccacttgacggagccgacccccacgtgcctcatccagacttggccccaattgccttcttctgcctgcgccaaacgacatcacctaggaactggtgcatcaaaatggcgaccggcccttggtggtggtgtttgtgtatgctcgtaatccttctcaactgtgtaaccctgggcatgtatcaaccgtgcgatgatatggattgcctctctgatcggtgtaagatcctacaggtgttcgacgacttcatctttattttttttgcaatggaaatggttctgaagatggtagcgctcggcattttcggcaaaaagtgttacctaggagatacctggaatagactggacttcttcattgttatggctggtatggtcgagtatagcctggacctgcaaaatatcaacctcagcgccattcggaccgttagggtgctgaggcccctcaaagccataaacagagtcccctcaatgcgcatcctagtaaatctgctgctagataccttgccaatgctggggaatgtgctcctgctctgctttttcgtatttttcatcttcggaataattggcgtccaactgtgggcgggattactgagaaataggtgcttcctcgaggaaaatttcaccatccagggtgatgtcgcactccctccctactatcagcctgaggaggacgatgagatgccttttatctgctctctctccggggacaatggcatcatggggtgtcacgagattccacccttaaaagagcagggacgcgaatgttgtctgtctaaagatgatgtgtacgatttcggggcaggaaggcaggacctaaacgcctccggtctgtgtgtgaactggaacagatattacaacgtttgcaggactggtagcgccaacccacacaaaggagctatcaactttgataatataggatacgcctggattgtgattttccaagtcattactctggagggctgggttgagatcatgtactacgttatggacgctcacagtttctataacttcatctatttcatcctcctgattatagtgggaagctttttcatgattaacctctgtctggtggtgattgctacccagttcagtgagaccaaacaaagggagcatcggttaatgctggagcagagacagcggtatctgtccagtagcaccgtggccagttacgccgaacctggcgattgctacgaagagatattccagtatgtttgtcacatactgcggaaagcgaagcgccgagcacttgggctgtatcaagccctgcagtctcggaggcaggcactagggcctgaggccccagctcctgcgaagcctggcccacatgccaaagagccacgccactaccatggtaaaacaaaaggccagggagatgaaggacgacatcttggttccaggcactgtcagaccttgcatgggcctgcttccccaggcaacgaccactctgggcgtggaaagcctggccctagggaactttgtccgcagcactctccacttgatgccactccccatacgcttgtgcaacctatccctgcgaccctcgcgagcgatcccgcttcctgcccatgttgtcaacatgaagacggcaggaggcccagcggtcttggtagcaccgacagcgggcaagaaggatctggcagcgggagcagtgcgggtggggaggatgaggctgatggcgatggagcccgatcctcggaggatggagctagtagtgaactgggcaaggaagaagaagaggaggaacaggccgatggagcagtatggctatgcggcgatgtatggcgggagacgagggccaagttgcgcggaattgtggatagcaagtatttcaaccgcggtataatgatggccatactagtgaataccgtgtctatggggatcgaacaccacgagcaggctaacgaactcactaacattttagagatctgtaatgtggtgtttacatctatgtttgctcttgagatgatactcaaactggctgctttcggcctttttgactacctgcggaacccatacaatatcttcgattccatcattgttatcatcagtatctgggagatcgtcggccaagcagatggtggactgtccgtgctgaggacattccgacttcttcgcgtgttaaaactggtgcggtttatgccagcattaagacgacagttggttgttctgatgaaaacgatggataacgttgccacattttgtatgctgttgatgttgtttatattcatcttttcgatactaggcatgcatatcttcgggtgcaagttctcactgcggacagacactggtgacacggttccagaccgtaagaatttcgatagcttgctttgggcaattgtgactgtatttcaaatcctgacccaggaagattggaacgttgttctatataatggtatggccagcacctccccttgggcatctctgtatttcgtggcactcatgacatttggaaactatgtcctgtttaacctgttggtagcaatccttgtcgagggtttccaggccgaaggggacgccaataggtcctactctgacgaggaccagtctagcagtaatatagaggagttcgacaagctgcaggagggactagatagcagcggcgatccaaaactttgtcctatcccaatgacccctaacggccatctggacccttcacttcctctgggagggcacctcggcccagccggagccgcaggccctgctccaagattgtcacttcagccagacccgatgctggtggccctgggcagccggaaatcatccgttatgtctctaggacgaatgtcgtatgatcagcgcagcctgagcagcagcagatcatcctattatggaccgtggggccgaagcgccgcatgggcctctcgtcgttctagctggaactcactgaaacataagcccccttccgctgaacatgaatcactcctcagcgctgaacgtggtggtggcgctcgcgtgtgcgaagtggcggctgacgaaggccctccccgtgccgcaccgctccacacgccacatgcccaccatattcaccacggccctcacctggcccaccgtcaccgtcaccacaggcgtactctttcactcgataacagggacagtgtggaccttgccgagctcgttccagccgtcggggcacatccccgagcagcctggcgcgcagccggacctgcccctggacacgaggactgcaatggcaggatgcccagtatcgccaaagatgtcttcacaaagatgggggatagaggagacagaggggaggacgaagaagagatcgattacactctctgtttcagagtgagaaagatgatagatgtgtacaaaccagactggtgtgaggtacgagaagactggagtgtttatctattctctccagaaaatcggtttagagtgttatgccagaccatcatcgcccacaagttgtttgattatgttgtgctcgcttttattttcctcaactgtatcactatagcgttagagaggcctcagatagaagccggtagcaccgaaaggatattcttgactgtctccaattatatttttactgcaattttcgtgggggagatgaccctcaaggtcgtctcgctaggtctgtactttggcgaacaggcatacctgagaagctcgtggaatgtgctggacggctttctggtgtttgtttccatcattgacatcgtagtctctctggcaagcgctgggggagccaaaatcctgggtgttctcagggtgttgcgtctactccgtaccttacgacctctaagagtcattagcagggccccaggcctgaaactcgtggtggagacgctgatcagctccctgaagcctatcggaaatatagttcttatatgttgtgctttcttcattatctttgggatcctgggggttcagcttttcaaagggaaattctatcactgtctgggggtggacaccagaaacataacaaaccggagtgactgcatggccgctaattatagatgggtacaccacaagtacaacttcgataacctggggcaggccttaatgtccttatttgttctcgctagcaaagacgggtgggttaacatcatgtataatggcttggatgctgtggcagtcgatcagcagccagttacaaaccataacccctggatgctgctgtactttatttctttcctcttgattgtttcttttttcgtccttaatatgttcgtgggcgtggtggtggagaacttccataaatgccgacagcatcaggaagcagaagaagctcgccgtcgcgaagaaaagagactgcgcaggctcgaaaagaaaagaaggaaggcacaaaggttgccttactatgcaacctactgccatacgaggctcctaatccactctatgtgcaccagccattacctcgacatcttcattactttcatcatttgcctgaatgtggtgacgatgtcgttagaacattataaccagcctacaagcctcgagacagccctcaagtattgcaactacatgttcactaccgtgttcgtactggaagccgttctgaagttggtagctttcgggctccgaagattcttcaaggaccgatggaaccagctggatcttgcaattgtcctcctctccgtgatgggtataaccttggaagagatcgagatcaatgcggcattgccgatcaaccccaccattatcagaataatgagagtcctgagaatagccagggtgttgaagttactgaagatggctaccgggatgcgcgctctcctagacaccgttgtacaagccctaccacaggttgggaacctgggcctgctctttatgctgttattttttatctatgccgcactgggggtggaactcttcgggaagcttgtgtgtaacgacgagaatccatgtgaaggaatgagtcgccacgccacatttgagaactttggcatggcctttctgaccctcttccaggtgtcaacaggggataattggaatgggatcatgaaagacacacttcgggattgcactcatgacgagcgcagttgcttatcctcgctgcagttcgtgtccccattgtactttgtgtcatttgtgttgacagcgcaattcgtcctgataaatgtggtggtggccgtcctgatgaagcaccttgacgattccaataaggaggctcaggaagacgcagagatggacgccgaactcgagctggaaatggcacacggtctggggccaggcccaaggttgcctacgggatctccaggcgctcccggacggggtcctggaggggctgggggtggcggagataccgagggcggattgtgtagacggtgttactctccagcacaggaaaatctctggttggacagcgtttcactcatcatcaaggactctctggagggggaattgaccatcatcgacaacttgtcaggcagtatcttccatcactatagctctccggcaggttgtaaaaagtgccaccacgataagcaagaggttcagcttgctgagaccgaggcctttagcctgaactctgatcgctcaagctccatcctgctcggcgacgatctcagtctggaggacccgactgcatgcccacctgggcgaaaagactcaaagggcgagcttgacccaccggaacctatgcgcgtgggggatctgggcgaatgcttcttccctttaagctctactgctgtgtcacctgatcctgagaattttttatgcgaaatggaagagatccccttcaatcccgtgagaagctggctgaaacacgactcgtcgcaggcccctccaagcccattctcaccagacgcatcctctccactgctgcccatgcctgccgagttctttcatccagctgtttccgcttctcagaaaggaccagagaagggcacaggcaccggaactttaccgaagatcgccctgcaaggcagctgggccagcctacggtcaccacgagtcaattgtaccctcctcaggcaggccacggggagtgatacttcactagacgcttcgccctcaagctccgctggctcactacagactactttggaagactccttaacactctctgacagccccaggagggccctcgggccacctgctccggcacccggacctagggccggacttagtcccgcagcccgtaggcggctgagcctgcgagggcgaggtctctttagtttgaggggtcttcgtgcgcaccagagaagccactcctcggggggatctactagcccagggtgcacacaccacgattctatggacccatccgacgaggaggggcgaggaggcgctgggggaggcggagccggatccgagcacagtgaaactctgagctctctctctctaaccagccttttctgcccccctccgccacctccagctcccggattgactccagctagaaagttttcctccacttcaagcttggccgctcctggacgcccacatgctgcagccctggcccacggcctggctcggagtcccagctgggcagcggaccgcagcaaagatccaccgggtagagccccactccctatggggctcgggccactggctcccccaccgcaacctctgccaggggagctcgaacccggagacgcagcgtccaaacggaagagata

SEQ ID NO: 216668 - DNA, 6566 bp, Artificial Sequence
  Description of Artificial Sequence: Synthetic coding sequence
atggccgagtcagcgtctccacccagctcatccgcggctgcccctgcagccgaaccgggagtcactacggagcagccaggacctagatcccctccctcctcaccccctggtttggaagagcccttggatggcgctgatccacatgtgcctcaccctgacttggcccctatagcctttttctgcctgcgacaaacaactagcccaaggaactggtgcattaagatggctactggtccttggtggtggtgtctgtgtatgctagtaatcctgctgaattgcgtcactctgggcatgtatcagccctgtgatgatatggattgcctttcagatcgctgcaagatcttgcaagtatttgatgacttcattttcatcttcttcgctatggagatggttctcaagatggtagctttaggcatcttcggaaaaaaatgctacctgggtgacacctggaatagattggacttctttattgtgatggcagggatggttgagtactctctagacctgcagaatatcaatctgtcagccatccgcactgtgcgggtccttcggcctctgaaggcaattaaccgggtgccaagcatgagaatactcgtcaacctgcttctggataccctgcctatgcttggaaatgtgctgctcttgtgcttcttcgtgttttttatattcggaatcatcggcgtacaactctgggccggactcctgcgtaatcggtgttttctggaggaaaattttaccatccagggtgatgtcgccctgcccccttattaccagcctgaagaggatgacgagatgccctttatatgctccctgagcggagacaacggaatcatgggctgtcacgagattccgcctctcaaggaacaagggcgtgaatgttgcctttctaaggacgatgtgtacgacttcggagccggtcgccaggacctgaatgcttccgggctctgcgtgaattggaaccggtactacaatgtatgtagaactggctccgccaaccctcataaaggagccattaactttgataatataggatacgcctggatcgtgatcttccaggtgattactctcgaaggttgggtggagatcatgtattacgtcatggacgcacactcattttacaactttatctactttattctccttatcattgttggttcatttttcatgatcaacctgtgtttagtagtcattgccacccagttctcagagaccaagcagcgcgagcaccggctgatgttggagcagaggcagcggtacctttcttcgtctactgtagctagctacgcggagcctggcgattgttatgaggagatcttccaatatgtctgtcatatcctgcggaaagctaagcgaagagcgcttggtctgtatcaggctctgcagagtcggagacaggctctgggacccgaagctccggcacctgccaagcccggaccccacgccaaggagccccgtcattaccaattgtgcccccaacattcgccactagatgccacaccacacaccctcgtccagccaatacctgctaccctcgccagcgatcccgctagctgcccctgttgccagcacgaagacggacgcagacccagtgggctcggaagcacggacagcggtcaggagggatctggttcaggcagctctgccggtggcgaagatgaagccgatggtgacggggcaaggagttccgaggacggagccagctccgaactgggtaaagaggaggaagaggaagaacaagcggatggcgctgtttggttgtgcggcgatgtgtggcgagagaccagggctaaactgagggggatagtcgattccaaatactttaacagggggataatgatggcgatcttagtgaacaccgtgagcatgggcatcgagcaccatgagcaggctacagaactgacaaatatcctcgagatatgtaatgtcgtattcacctctatgtttgctctggaaatgatcctcaaactggccgcatttggcctgttcgattatttgcgcaacccttacaatatctttgactccataattgtgatcatcagtatctgggaaattgttgggcaagcagacggcggtttaagcgtcttacgtacctttagactactgagggtcttgaagttggtgaggtttatgccagctctgaggcgccagctagtggtgctgatgaagaccatggacaatgtggctaccttctgcatgctcctgatgctgtttattttcatattttcaatccttggaatgcatatcttcgggtgtaaattctccctcagaactgacaccggtgataccgtacctgaccgcaaaaacttcgattcactcctatgggccattgtgacagtgttccagatccttactcaggaagactggaatgtggtcctgtataatggtatggctagtaccagcccctgggcctcgctgtactttgttgctcttatgactttcggtaactatgttctatttaacctgttggttgctattctcgtggaaggctttcaagccgaaggggatgccaaccgcagttatagtgatgaggatcagtcaagttctaatattgaggagtttgacaagctgcaagagggcctcgattcctccggcgacccaaagttatgcccaatacccatgacacccaacggacatcttgatccctctctgccattgggaggccacctgggccctgccggagctgcaggacctgcgcctagactgtccctacagcccgacccaatgttggtggctctgggatctagaaagtcatcggttatgagcttggggaggatgtcgtacgatcagagatccttgagttcatccagatcctcctactatggcccatgggggaggtccgctgcatgggccagcaggcgcagtagctggaatagcttaaaacataagcctcccagcgccgagcatgaaagcctgcttagcgccgagagagggggtggagccagggtgtgcgaagtcgccgctgatgaaggtccccctcgcgcagcaccacttcataccccgcacgcacatcatatccatcacggccctcatttagcccaccgacatagacatcaccgcagaaccctctcgttagataatcgggacagcgtggacctggcagaactggtgcccgctgtaggcgcacaccctcgggctgcatggcgcgctgctgggcctgcccctgggcacgaagattgtaacgggcgtatgccatcaatagctaaggacgttttcacgaagatgggagatcgaggtgaccgcggtgaagatgaagaagagatcgattacacactgtgtttcagggtaaggaagatgatcgacgtctacaagcctgactggtgtgaagtccgtgaagattggtccgtgtatcttttttcccctgagaatcgcttccgagtgctgtgtcaaaccatcattgcgcataaattgtttgattatgtggtgctagccttcatctttctgaactgtatcaccatcgcactcgagaggccacagattgaggccggatcgacagagaggatcttcctcacggtctctaattacatcttcaccgcaattttcgtcggggagatgaccctaaaagtagtgtcgctggggctgtattttggagaacaggcatacctgaggtcttcttggaacgttcttgatgggttcctcgtcttcgtgtcaatcatcgatattgtggttagcctggctagtgccggaggcgcaaagatcctgggggtgcttagggttcttcggttgctcagaactctgcgacctctcagagttatcagccgcgctcctggactcaaactggtagtggaaacactgatctcttccctcaagcccattggcaacatcgtgctcatctgctgtgcgtttttcatcatcttcggaatcctcggagtccagctgtttaaagggaaattctaccactgtcttggagtcgatacgagaaacataaccaaccgaagcgactgtatggccgcaaattataggtgggtgcatcacaaatataactttgacaacctgggtcaggcgctgatgtctttgtttgtgctggcctcgaaagacggctgggtgaacattatgtacaacggacttgacgctgtggccgtggatcagcagcccgtcaccaaccacaatccctggatgctgctgtatttcatctcctttctactgatagtgagcttttttgtcctgaacatgttcgtcggcgtcgtggttgaaaatttccacaagtgtcggcagcatcaggaggccgaggaggcacggcgacgagaggaaaagagacttagacgcctagaaaagaagcgacggaaggctcaaagactcccttattacgccacctactgccatacacgcctgctgatacacagcatgtgtacctcgcattaccttgacatttttataacatttataatttgtctcaacgtcgtgacaatgagtctggagcactacaaccaaccgacaagcctcgagactgcactgaaatattgcaattacatgtttaccaccgtcttcgtgttggaggctgttctcaaattggtcgcttttggcctgcgacgcttcttcaaagaccgctggaaccagctcgacctggccattgtactcctcagtgtgatgggtataacccttgaagagattgaaatcaatgccgctcttccgatcaatccaacaatcattcggattatgcgcgtgctaagaattgctagagtgctgaagttacttaaaatggccaccggcatgagggctctcctggacaccgtggtccaggccctgccgcaggtcgggaatctcggcctgctgtttatgctcctcttctttatctacgcagccctaggcgttgaattgtttggcaagctagtgtgtaatgatgagaatccctgtgaaggcatgtccagacatgccacattcgaaaacttcggcatggctttcttgacgttattccaggtgagcaccggagacaattggaacggcattatgaaggatactctgagagactgcacgcacgacgaaaggtcgtgcttatcttccctgcagtttgtgtctcctctgtacttcgtcagctttgtcctgaccgctcaatttgtgctgatcaacgtcgtagtagctgtgttaatgaaacacctggacgactcaaataaggaggctcaggaggacgccgagatggacgccgaactggagttagaaatggcccacgggcttggtcctgggcctcggctgcctaccggctctccaggggctccaggcagaggcccaggtggggcaggcggaggcggagacacagaaggtggactgtgtagacggtgctatagccctgcgcaggagaatctgtggctcgatagcgtgtcactgataataaaggatagcctagagggggagctgactattatagacaacctgagtggtagcatttttcaccactatagctctcccgcaggatgcaagaagtgtcaccacgacaaacaggaggtgcagcttgctgaaactgaggcgttttctctcaactctgaccgctcaagttcaattttacttggggacgacctttcactggaggacccgacggcatgtccaccaggacggaaagactcgaagggagagctggaccccccagaacccatgcgggtcggggatcttggagaatgcttttttcccctctctagtaccgctgtttccccggaccccgaaaattttctatgtgaaatggaggagattccgtttaatccggttcggtcttggctgaagcatgattcatcacaggccccacctagcccctttagtcccgatgcgagcagtccgctcctccccatgcccgcagaattttttcacccagccgtctccgccagccagaaaggcccagagaagggcaccggtacaggaacgctcccgaagattgctctgcagggctcttgggcgtccctccggagtcccagggtgaattgtacacttctgagacaggcaacaggcagcgataccagtctggacgctagtccctcatcatcagctggctcattacagaccacattggaggactctttgacactatcagattctccccgacgggctcttgggcctccggcacccgctccaggacctagagctggactatccccagctgccaggagacgtctgagcctgcgcggtcgaggcttgttttcactcagggggttgcgggcacaccagcgctcacactccagcggaggttcaacttcacctgggtgcactcaccacgactctatggatccatcagacgaagagggcagaggaggagccggaggcggaggagccggatcagaacatagcgagacactgtcgagcctgagcctgacttccttattctgcccccctccgcctccgcctgcccctggtctcacacccgctaggaagttctcttctaccagctcactcgccgcaccaggtcgccctcatgcggctgccctggcccacggcctggcacggagtcccagttgggcagcagacagatcgaaggaccctcctggcagggcccctctgccaatgggcctaggccctctcgcccctccaccccagccgctgccgggagaactcgagccgggagacgctgcgagcaaaagaaagagata

SEQ ID NO: 216669 - DNA, 6050 bp, Artificial Sequence
  Description of Artificial Sequence: Synthetic coding sequence
atggcggagagtgcttcacctccgtcaagtagtgctgctgccccagcagccgagccaggagttacgaccgagcaaccgggaccacggagtccccctagctctccaccaggcctggaagagcctctggacggggctgacccccatgttcctcaccccgacctagcccctatcgccttcttctgtcttagacagaccacctcccctcgaaactggtgtataaagatggtgtgcaacccttggtttgagtgcgtcagtatgctggtgatcctcctgaattgcgtgaccctaggtatgtaccagccctgtgatgatatggactgtctgtccgatcggtgtaagatactacaagtgtttgatgattttatattcatcttttttgccatggaaatggtgctaaaaatggtggcccttgggatttttggaaagaagtgttacttaggcgatacgtggaacaggctggattttttcattgtaatggccggaatggtagagtactcgctggatctgcaaaatattaatctgtctgccatcaggaccgttagggtgctgagaccactcaaagccatcaaccgggtacctagcatgcgtatactggttaatctgctcttagatacgttgcccatgctgggaaatgtgctgttactctgcttttttgtgttcttcatcttcggtattatcggtgtgcaactgtgggccggactgttgcgaaatcggtgcttcctagaggaaaactttacaattcagggggacgtcgccctgccgccttactatcaacctgaggaagatgatgagatgccattcatttgttcactctctggtgataatggcattatgggctgtcacgagatccccccattaaaagagcaggggcgtgaatgctgtttatccaaagacgatgtgtacgattttggcgctggccgtcaggatcttaatgcatctgggttgtgcgtcaactggaaccgatactacaatgtgtgcagaaccggctcagcaaacccccacaaaggagctatcaacttcgacaatattggatacgcatggatcgtgatcttccaggtgatcactttagaagggtgggttgagatcatgtactacgtcatggacgcgcattccttctataatttcatatatttcatcctgctgatcatcgttggttcattcttcatgatcaatctctgcctcgtggtcattgcaacacagttcagcgagacgaagcagcgagagcataggctgatgttggagcaaagacagagatatctttcatccagtactgtagcttcctatgccgaaccaggcgattgttacgaggagatctttcaatacgtctgccacattctgcgaaaagccaagagacgggcactgggactttaccaagcactccaaagtcggcgtcaggccctcgggccagaagcccctgctcctgctaagcctggccctcatgcgaaagagcctagacattaccacggaaaaaccaaaggacagggtgacgagggacgccacttaggcagtagacattgtcagacactacatgggccagccagccccggaaatgaccatagcggtagggaactctgcccacagcattcacccttggacgctactccacacaccctggtgcaacccatcccagctacactcgcgtcagatcctgccagctgcccttgctgtcaacatgaagatgggagaaggcccagtggcctgggcagcactgatagtggacaggaagggagtggttctgggagctccgccggaggcgaagacgaggccgacggcgatggggctaggtctagcgaagatggcgcatcttctgaattgggaaaggaggaggaggaggaggaacaggccgacggagctgtatggctctgcggcgatgtctggagagagacaagagccaagctgcgaggtatcgtagatagcaaatacttcaatcgcggaattatgatggcaatactggtaaataccgtgagcatgggcatcgagcatcacgagcaacccgaagaactcacaaacatcctggagatttgcaacgttgtgttcacatccatgtttgcgcttgagatgatcctgaaactcgctgccttcggccttttcgattacctgagaaatccgtacaatatcttcgacagtataatcgtgataatctctatttgggaaatcgtgggacaggcagacggagggctatccgtcctgaggacttttcgtttgctgcgggtgctcaaattggtccggttcatgcctgccctgaggagacagctggtggtgctgatgaaaacgatggacaacgtcgccaccttctgcatgctcctgatgttattcatctttatcttcagtatcctgggaatgcacattttcgggtgtaagttctcactccgcaccgataccggtgacactgtaccagatagaaaaaattttgatagtctgttgtgggccatcgtaactgtgttccaaattttaacacaagaagactggaacgtggtgctgtacaacggcatggcatcaacatccccatgggccagtctttatttcgtcgctcttatgacgtttgggaactacgtgctgttcaacctactggtggctatcctagtcgagggctttcaggccgagggcgatgcaaataggtcctacagcgatgaagaccagagtagcagcaatatagaggagtttgacaaattacaagaaggcctggactcgtccggagatcctaaactttgccctattcctatgacgcccaatggccacctggatccctcgttgccgctgggcggacacttaggacccgctggagcagcaggcccagcgcctcggctctcactgcagcccgaccccatgctcgtggccctaggaagtcggaaatcatcagtgatgtctctgggcagaatgagttacgatcagcggtctctgtcaagctctaggtcttcctactatgggccatggggcagatctgcagcttgggcaagccgtaggagcagctggaactctctgaagcacaaaccccctagcgctgaacacgagtctctgttgtccgctgaacgaggaggcggtgcaagggtatgcgaagtggccgcagacgaaggtccaccacgcgctgcgcctctccatactccccatgcccatcatattcatcatggtccccacctggcacatcgacatcgacaccatcgcaggaccctgtctctcgacaatagagactctgtcgaccttgctgaattagtgcctgccgtcggcgctcatccaagagctgcatggagagccgcaggacccgcacccggtcacgaggactgcaatggccgtatgccaagtatcgccaaggacgtcttcacaaagatgggagacagaggcgatcgaggggaagatgaagaagaaattgattatacattatgtttcagggtcaggaagatgattgatgtgtacaaacctgactggtgcgaggtcagggaagactggagcgtttacttgttttcccctgagaatcgatttcgggtcctgtgtcagactattatagctcataagctgtttgattacgtcgttttagcgttcattttcctgaattgtatcactatcgccttagaaaggcctcagatcgaggccggatccacagaacgcatttttctgacagttagtaactacatcttcacagctattttcgttggtgaaatgacactgaaggtggtcagtctgggcctgtatttcggtgagcaggcatacctgcggagctcttggaacgtcctggatggctttctagtgtttgtgtcaattatcgacattgtggtgtctttagcttctgccggaggtgccaagattctcggcgtgcttcgggtgcttagactactgcggactttgcggccattacgagtgatttcccgggctcctggcctgaaactcgttgtggagacactgatctcctctcttaaacccattgggaatattgtcttaatatgctgcgcttttttcattatctttggcattctgggtgtccagctgtttaagggcaagttctaccactgcctcggggttgacactaggaatatcacaaatagaagcgactgtatggccgctaattacagatgggtccatcacaagtacaacttcgacaacttaggacaggccctgatgagcctgttcgtcctcgctagcaaggacggctgggtaaacataatgtataatggcttggatgcagttgccgtcgaccagcaacccgtcaccaatcacaatccttggatgctgttgtattttatcagtttcctgctgattgtgtccttcttcgtgctgaatatgttcgttggagtggttgtggaaaattttcacaaatgccgacagcaccaggaggcagaagaagctcgcaggcgagaggaaaagagattgagacggcttgagaaaaagcgtaggaaagcccagagactgccctattacgccacgtactgccataccaggctgttgatacactccatgtgcacatctcattacctcgacattttcataaccttcattatttgcctgaacgtagtaacaatgagccttgagcattacaaccagccgacaagcctcgaaacagcactgaaatattgtaattatatgtttactactgtgttcgtacttgaggccgtgctgaaactcgtggctttcggcctgagacggttcttcaaggaccgatggaaccagctcgatttggcaatagttcttctgagtgtgatgggtatcacccttgaggagattgaaatcaatgctgctctgcctatcaatccaacaatcataagaatcatgcgggtgctccgtattgccagggttcttaaattgctcaagatggcaaccgggatgagggccctgttggacaccgtagtgcaagccttgccacaggtgggcaacctgggcctgttgtttatgttgctgttctttatttacgctgcgctgggggtggaactgttcggcaaacttgtttgcaatgacgagaatccctgtgaggggatgtccagacatgccacctttgagaatttcggtatggccttcctcacactgttccaggtttctacaggagacaactggaatggtatcatgaaggataccttaagggactgtacccacgacgagcggagctgcctgagctcccttcagtttgtgtcgcccctgtatttcgtgtcttttgtcctgacagctcaattcgtgcttataaatgtggtcgtagcagttctcatgaagcacctagacgatagcaacaaagaggcccaagaagacgcagaaatggacgctgagctcgaactggaaatggcacatggactgggccctggtcccaggttgccaactggcagtcccggagcgccaggtcgaggaccagggggagcaggaggtggtggagataccgagggtggcttatgccgacgctgctattctccagcccaagaaaacttatggctagacagtgtaagtcttattattaaggactctttggagggtgagctcaccatcatcgacaacctgagtggaagcatcttccaccactacagctcaccagctggctgcaagaaatgtcatcacgacaaacaggaggttcagttggcggagaccgaggctttcagtctgaactcagaccgcagttcgtcaatcctgctgggagacgacctgagccttgaggacccaaccgcctgcccaccaggacggaaggactccaagggggagttagacccacccgagccaatgcgcgttggtgatctgggggagtgctttttcccactatcctcaaccgccgtgagtcccgatcccgaaaacttcctctgtgagatggaggaaatcccatttaaccccgtgcgcagttggctgaagcacgactcctctcaagctccgcctagccccttttcccctgatgcctctagcccactgctacccatgccggctgagtttttccaccctgcggtgtccgctagtcagaagggcccagagaaagggaccggcaccggcacattgcccaagatagccctccaggggtcctgggcttccctacgaagccccagggtcaactgcacacttcttcggcaggttccgaccccgccaagaccata

SEQ ID NO: 216670 - DNA, 6671 bp, Artificial Sequence
  Description of Artificial Sequence: Synthetic coding sequence
atggcggagtctgccagccccccaagctccagtgccgctgctccggcagcagaaccaggagtgacaacagagcagcccggaccgcgaagtccaccaagctcccctcccggactggaggagcctttggatggcgctgatccacatgtaccacatccggacttagcccctatcgcatttttttgcctccggcaaacaacgagtccacgcaattggtgcataaagatggtgtgtaacccctggtttgaatgtgtgtctatgctagtcatcctgctcaattgtgtaaccctaggcatgtaccagccatgtgacgatatggattgcctctccgatagatgtaaaattctacaggtcttcgacgactttatcttcatcttttttgcgatggagatggtgctcaagatggtagcacttggcatatttggcaagaagtgctatcttggagacacctggaacaggctcgatttctttattgtaatggcgggaatggtggagtacagcctcgacctgcagaacataaacctctctgccatccggacagtcagggttcttcgtcccctcaaagcaatcaatcgagtgccttccatgcggatactggtgaaccttctgctggacacccttcccatgctcggcaatgtgctactactttgcttcttcgtgttcttcatatttggcattattggcgtacagctttgggctggcttgctcaggaatagatgcttcctggaagaaaacttcaccatccagggggacgtggccctgccaccgtactatcaacccgaagaagacgacgaaatgcctttcatctgctcgctgtcaggagataacggtattatgggctgccacgaaatacccccactgaaagaacagggacgagagtgctgcctcagtaaggatgacgtgtatgatttcggggctggacgacaggaccttaacgcttccggcttgtgcgtaaattggaacaggtactataatgtctgccgtacagggtccgccaatccacacaagggcgctataaattttgataacatcgggtacgcttggatcgtcatctttcaagtaattacccttgagggctgggtcgagataatgtattatgtaatggatgcacatagcttctacaactttatctatttcatcttgctgattattgttgggtctttcttcatgatcaatttatgcttggtggttatcgccacacagtttagcgaaaccaaacagcgggagcacagactcatgctcgagcagagacagagatacctctctagctccacagtggcctcatacgcagaaccaggcgactgttatgaagaaatcttccagtacgtgtgccatatcctccggaaggccaagcgacgagccttgggtctgtaccaagcattacagagtaggaggcaggccctggggcctgaagccccagcgcctgccaaacccggaccacatgccaaggagcctcgtcactatcacggaaaaacaaaggggcaaggtgatgagggcagacatcttggcagcaggcactgtcaaacactgcatgggccagcttcgcccggaaacgaccactcgggtagggagctgtgcccgcagcacagtccgctggacgccacacctcatacactggtgcaacccattccagccactcttgcctcagatcccgcttcttgcccctgctgccaacatgaggatggccgacgccctagcgggttagggtctactgatagcggacaggagggcagtggctcaggaagtagcgccggtggagaggacgaggcagacggcgacggcgcaagaagttccgaagacggcgctagttcagagctcggaaaggaggaagaagaggaggaacaagcagacggggctgtatggctgtgcggggatgtatggcgggaaacccgagccaaactgaggggaattgtcgattctaagtatttcaatagaggaattatgatggctatactggtgaacaccgtgtctatgggcattgagcaccacgaacaaccagaggagttaactaatatccttgaaatatgtaacgtggtcttcactagtatgttcgcgcttgaaatgatcttaaagctggctgcattcggactgtttgattaccttcggaacccctataatatattcgattccatcatcgttatcatcagcatctgggagattgtgggacaggccgatggaggtttgagcgttctccgaacgtttagattactcagggtgctgaagcttgtccgcttcatgcccgctctgagaagacagttggtggtgctgatgaaaactatggataatgtggctacgttttgtatgctcctgatgctcttcatcttcattttttccattctggggatgcacatcttcggctgcaagttcagtctcaggacggacaccggagacaccgtccccgacagaaagaacttcgactccctgctatgggctattgtgaccgttttccagatcctcactcaggaagattggaacgtcgtcttatataacggcatggccagtacctcaccttgggctagcctttatttcgttgcacttatgaccttcggtaattatgtgctttttaatttgcttgtcgccatcttagtcgaaggctttcaagccgagggcgatgcaaaccggtcctatagtgatgaagatcagtcctcttccaacattgaggaatttgacaagcttcaggaagggctggattcctctggagatcctaagctatgccccattcctatgacacctaatggtcatctggacccatcccttcctctggggggacacttggggccagcaggtgctgccggacccgcaccacggctttcactgcagccggatccaatgttggtggctctgggaagccgcaaaagcagcgtgatgtcactgggccgtatgtcctacgatcagagatccctgagttccagccggagttcctactatggcccttggggcaggagtgcagcgtgggcaagtcgtcggtcttcctggaattccctgaaacacaaaccaccctccgcggaacacgaatccctcttgtccgccgaacgcggagggggagcgagggtgtgcgaagtggccgctgacgaagggcctccgagagccgcaccattgcataccccacacgcccaccatatccatcatgggccacacctggcgcacagacaccgccaccatcggcgaaccttgagcctagacaacagagattccgtggatctcgccgagctggtgcccgctgtgggggctcaccccagagccgcatggagggcagccggtcctgctccaggccatgaggattgcaacggtagaatgccttcgatcgcaaaggacgtgttcacaaagatgggggacaggggcgatcggggtgaagacgaagaagagatcgattacaccctctgttttcgcgtacggaagatgatcgacgtctataaacctgactggtgcgaggttcgcgaagactggtccgtctatcttttctcccccgagaataggtttagggttctgtgccaaacgatcattgctcataagcttttcgactacgttgtgctggcatttatcttccttaactgcattacaatagcactggagcggccacagatcgaagccggaagcacagagcgcattttccttactgtatcaaactatatcttcaccgctattttcgtgggcgaaatgactcttaaggtggtctctctggggctctattttggcgagcaggcatacctgaggtcttcttggaacgtactggacggctttctagtgttcgtgtccatcatcgacatcgtagtctcactggcatcagccggtggggctaagatactgggtgtgctccgtgtgctccggttattgcggacccttcggccactgagggtgattagccgggctccgggattgaaacttgtcgtcgaaacactgatatcctccctcaaaccgattggcaatatcgtgttgatttgttgtgcattcttcatcatcttcggaatccttggagttcagctgtttaaggggaagttttaccactgtttgggagtcgataccagaaacattaccaaccggtctgactgtatggctgcaaactacagatgggtgcaccataagtacaactttgataatctgggccaggcacttatgagcttgtttgtgctagcttcaaaagatggttgggtgaatatcatgtacaatggcctggatgcagtggcagtcgaccaacagccagtgactaatcacaacccctggatgcttctctattttatcagtttcttgctgattgtttcctttttcgtgctcaatatgttcgtcggggtggtcgtggagaatttccataagtgccgacagcatcaggaggctgaggaagccagaaggcgtgaggaaaaacggctacgaaggctggagaagaaaagaagaaaggcacagagactgccatattacgcaacatactgtcacacacgcttgctgattcattcaatgtgcacaagccactacctcgacatcttcattacattcatcatctgtctcaatgtggttacaatgagcctcgagcactacaatcagcccaccagccttgagacagcgctgaagtattgcaactatatgttcacgaccgtcttcgtcctggaagctgtgctgaaactagtggcctttggcctgcggcgattcttcaaagatcgttggaatcaacttgatctggctatcgtcctgctttctgtgatgggtataacgctcgaagagatcgaaataaatgcagccctgccaataaaccccacgatcattaggattatgcgagttctgagaatcgctcgggtgttaaaattgttgaagatggctacagggatgagggcactgctggacaccgtggtgcaggccctgccacaggtggggaacttgggcctactgtttatgctcctgttctttatctacgctgctctcggcgtggagctctttggtaagttagtttgcaacgatgagaacccgtgcgaagggatgtcacggcacgctacctttgaaaatttcgggatggcttttttgacattgttccaggtgagcactggagacaattggaatggcatcatgaaggacacattacgtgattgcacacatgatgagcgatcatgcctgtcatcactgcagttcgtctctccgttatactttgtgtcgttcgtcctgacagcccaatttgtactcatcaatgtggtggtggctgtgcttatgaaacacttggatgattctaataaggaagcacaggaagatgctgagatggacgccgagctggagttagagatggcacacggtctggggcctggaccacgactgccgactgggtcccccggagctcctggcagaggcccaggtggagctgggggaggcggtgacactgaaggcggactgtgcagaagatgttacagccccgctcaggagaatctgtggcttgattcagtgtcactaatcattaaggactccctagagggagaattaaccatcattgataatctgtcggggtccatcttccaccactattcatccccagcgggatgtaagaagtgccatcacgataagcaggaagtgcaactcgccgaaacggaggcattcagcctcaactccgacaggtcctccagcattttgctgggcgatgatctcagcctcgaggaccccacggcatgccctcctggcagaaaagattcgaagggagagctggacccccctgaaccaatgcgggttggggatctgggggagtgcttctttcccctttcttccacggcagtctcacccgatcctgaaaacttcctgtgcgagatggaggaaataccattcaatcccgtacgatcctggctgaagcatgatagtagccaggcgcctccaagtccttttagtcccgacgccagtagcccactgctcccaatgcccgcagagtttttccacccggctgtgtcagcttcccaaaagggccctgagaaaggtacgggcaccggtacattaccaaaaatcgcccttcagggcagctgggctagcctcagaagtcctagagtcaactgtacattgctaaggcaggccaccggttcagacaccagcctcgacgcaagcccatcaagctctgcaggtagcttgcaaaccacgcttgaagattctctcaccctgagcgatagccccagacgagcccttggccctccagcacctgcacccggtccacgcgctggactcagtccagctgctcgcagacgattgtcactaagaggtagaggactgttctccctaagaggacttcgtgcacatcagcggtcacactcatcggggggttccaccagtccgggatgtactcaccatgactccatggatcctagcgatgaggaaggcagaggcggtgccggagggggaggcgcagggtccgagcatagcgaaacacttagcagcctgagcctcacctctctgttctgcccgcctccccctcctcctgcacccggactgacacccgcaagaaagttctctagcacctcttcccttgcagcaccaggcagaccccacgcggcagcacttgctcacggacttgctcgaagcccatcctgggcagcagatcgcagtaaggaccctccgggtagagccccattgcccatggggctggggcctctggctccaccccctcagcccctgcccggtgagctcgaacctggggatgccgcaagcaagaggaagaggta

SEQ ID NO: 216671 - DNA, 6566 bp, Artificial Sequence
  Description of Artificial Sequence: Synthetic coding sequence
atggccgagagtgcctctccccctagtagtagtgcagcggcacccgcagccgaacctggggttacaaccgagcagcccggaccacggtctccaccttctagtccacccggattggaggaaccacttgacggcgctgacccacacgtaccccaccctgacctagccccaattgcttttttctgtctacgtcagaccacctctcccaggaattggtgtatcaagatggtctgtaacccctggttcgagtgcgttagcatgctggtcattcttctcaattgcgtgacattgggcatgtaccagccgtgtgacgacatggattgcctgtccgatcgctgtaaaattcttcaggtgtttgatgattttatcttcatcttctttgccatggagatggttcttaaaatggttgctctgggcatctttggaaagaagtgctatctgggggatacctggaatcggctagatttttttatcgtgatggcaggaatggtcgagtactccctggaccttcagaatattaacttgtcagccatccgaacagtgagagttctgcggcctctgaaagccattaaccgagtccccagcatgcggattctagttaaccttctccttgatactctgcctatgctgggcaatgtgctgctgctgtgcttctttgtattcttcatctttggcatcattggtgtgcagttatgggccggtctgttgcggaacagatgtttcctggaggagaatttcaccattcagggtgacgtggcactcccaccttattaccagccggaagaagacgacgaaatgcctttcatatgctcactttctggcgacaacggtatcatggggtgccacgagattcccccactgaaagaacaaggccgagagtgttgcttaagtaaggatgatgtctatgattttggcgcaggcaggcaggacctcaacgcctcagggttatgtgtgaattggaaccgatattataacgtctgcaggaccggtagcgctaatcctcacaaaggagcgatcaatttcgacaacattggctatgcctggatcgttatttttcaggtaatcacgctagagggctgggttgaaataatgtattatgtaatggatgctcactccttttataatttcatttattttattctgttgataatcgtaggatcctttttcatgatcaacttgtgcctggttgttattgcgactcagttctccgagacaaaacagagggagcatagactaatgcttgagcagcggcagcgctacctgtcctcgtctacagtggcatcctacgcagaacctggagattgttacgaagagatattccagtacgtctgccacatactccgcaaggctaaacgacgagctcttggtctctatcaagcccttcaatcccggcgacaggctctgggccctgaggcacctgctccggcaaaacccggaccccatgcaaaggagcctaggcactaccagctgtgtcctcagcattctccattggacgctacaccccataccctggttcagccaattcccgcaaccctggctagcgacccagcttcctgcccctgttgtcagcacgaggacggtagacggccaagcggtttaggaagcacagattcaggacaggaggggtcaggcagtggcagttctgccggaggcgaggacgaggccgatggggacggtgccagaagctcagaagacggcgcatccagcgaactgggtaaagaggaagaagaggaagagcaggccgatggcgcagtctggttgtgtggcgacgtgtggagggagacgcgggcaaagctgagggggattgttgatagcaagtactttaaccggggtataatgatggcgattctggtgaatactgtatctatgggaattgaacaccatgagcagcctgaggagttgacaaatatacttgagatctgcaacgtggtatttactagtatgtttgctctggaaatgattttgaagctcgccgctttcggcttgtttgactacctacggaatccatacaacatctttgactccattatagttattatttctatctgggaaatcgtgggtcaggcagacggaggcctctcggtcctaagaacatttcgcctccttagagttctcaagcttgtgcggtttatgcccgctttacgcagacagctcgtggtgttaatgaaaaccatggataacgttgctaccttctgtatgctactgatgttgtttatctttattttctcaattctggggatgcacatctttgggtgtaagttctctctgcgaaccgacactggggacactgtccccgacaggaagaacttcgacagtttgctgtgggcaattgtaaccgttttccagattcttacccaggaggattggaatgtggtcttgtacaacggcatggcctcaacaagcccctgggcgagtctgtactttgtagcgcttatgacattcgggaactacgtgctgttcaatctgctcgtggccatactggttgaagggtttcaggcagagggtgatgccaatcggtcttacagtgacgaggaccaaagttcctctaatattgaggaatttgacaagctccaagaaggtctggactcatccggggaccctaaactgtgtcctatacccatgacgcctaatggccacctggatccaagtctgccgctgggagggcacctcggccctgctggagccgctggccctgctccaagattatctctccagccagatccaatgctagtggccttggggtctaggaagtcaagcgtgatgtcacttggaaggatgtcatacgaccagagatccctgtcatcgagcaggagcagctactacggcccttggggcagatccgccgcttgggctagccgcagaagctcttggaactcactgaagcacaaaccccctagtgccgagcacgagagcctcctgtcagccgaaaggggtggcggagcaagggtatgtgaagtcgcggctgatgaaggcccaccgagggccgcaccgcttcacacacctcatgcccatcacatccaccatggccctcatctggcccatcggcataggcaccacaggcggactctgtcactggataatagagactcagtcgacttggcggaactggtgcccgctgtcggtgctcacccccgagctgcatggagggccgcaggcccagctccaggccacgaggattgtaacgggaggatgccttcaattgccaaagatgttttcactaagatgggggacaggggcgatcgcggtgaggacgaagaggaaatcgattacacgctatgctttagggttcgcaagatgatagatgtatataaaccggactggtgcgaggtacgcgaagactggtcagtgtacctgttttctccagaaaataggttccgggtcctctgtcagacaatcattgcacataagcttttcgattacgtggtactcgcttttatcttcctgaattgtatcacgattgccctggagcgcccacagatagaggcgggttctactgaacgcatttttttaacagtgtcgaattacatttttaccgctatcttcgtgggtgagatgaccttgaaggtagtgagcctgggattatattttggcgaacaggcctacttgagatcttcctggaacgtgctggatggctttctggtgtttgtgtcgataatcgatatcgtggtctccctggcgtcagcaggcggtgccaaaattctaggggtgctgcgtgtactgcgattgctgcggaccctgcgccctctccgcgtaatatcccgggctccaggcctgaaactggttgttgaaaccttaatttcaagcttaaaaccaatcgggaatatagtgctgatatgttgtgctttttttattatcttcggtattcttggtgtgcagctctttaagggcaaattctaccattgtctaggagtggacacccggaatattactaaccgctctgattgcatggcggcaaactatcgctgggtgcaccataagtataacttcgataatttgggccaggccctcatgagcctcttcgtgctggccagtaaggatggatgggtgaacattatgtataacggactcgatgcggtagccgtagaccaacaaccagtgacaaatcataatccctggatgttactgtatttcatatcatttttgcttattgtctcgtttttcgtgcttaatatgttcgtgggggttgtagtcgagaatttccacaagtgccgacagcaccaagaggccgaagaagcaagaaggcgggaggagaagcgcctgaggaggctcgagaagaaacggaggaaagctcagcgtctgccatactacgccacctattgtcatactcggctgttaattcattccatgtgcacaagtcattatctcgatatcttcatcacttttattatttgcctcaacgtggttaccatgtcacttgaacactataatcagcccacttcactcgaaaccgctctaaaatactgtaattacatgttcacgactgttttcgtgctggaggcggtactcaagctggtcgcctttggccttcggagatttttcaaggatagatggaaccagctggatttggcaattgtgctgttgtctgtgatgggaatcacactcgaggaaattgagataaacgccgcactacctattaatcctactatcatccgcattatgagagtgctgcgcatcgctcgtgtgcttaagttgcttaaaatggccacaggaatgcgcgctctgctcgacacggtcgttcaggcattgccacaagtgggaaatcttgggctcctattcatgctgttgtttttcatctatgccgctctcggcgtcgagctgttcgggaaactggtgtgtaatgatgaaaatccttgtgagggaatgagcagacacgctacctttgaaaacttcggcatggctttcctcactctgtttcaggtctcaacaggagacaactggaacggcatcatgaaggacacacttcgtgattgtacccacgatgagcgctcctgtctatccagtttgcagtttgtgagcccgctctattttgtatcgtttgttctgactgcccagtttgtgcttattaacgtggtagtagcggtattaatgaagcatctggacgatagcaacaaggaggctcaagaagatgccgagatggacgctgagcttgagctcgagatggcccacggcctgggcccaggccctaggctgcctactggctctcctggcgcaccaggcaggggccctggcggtgccggtggcggtggcgacactgagggaggactttgtaggagatgttactcaccggcacaggagaatctgtggttggatagcgtgtctttgataattaaggacagcctggaaggggaactcacgattattgacaacctgagtggatctatctttcaccattatagttcccccgcagggtgtaagaaatgccaccatgataagcaggaagttcagctggcagaaaccgaagcattttctctcaacagtgaccgatcctcgtccatattactgggcgacgacctatccttagaggatcctaccgcttgtccaccaggcaggaaggactcgaagggcgagctcgatcctcctgagccaatgcgggtcggtgatcttggcgagtgcttctttcccctgagctctacagccgtgtctcccgatcccgaaaactttttgtgtgaaatggaagaaatccccttcaaccctgtgagatcctggcttaaacatgattctagccaggccccaccatccccattcagcccggatgcaagctcaccactccttcccatgcctgctgagttctttcaccccgctgtttccgctagccagaagggcccagagaaaggcacaggcaccgggactctgcccaaaattgctttgcagggaagctgggcctccctgaggtcacctcgcgtgaactgtacactcctccgccaagctacaggttccgatactagcttggatgccagtccatctagtagtgcaggaagcctgcagactacactagaggatagcctcacgttgtcagacagcccgaggagggcactggggccaccagccccagcccctggaccaagagctggattgtcccccgctgcgcgtcgtcggctctccttgagggggagggggctgtttagcctgagggggttaagggcccaccagagaagtcactcctccggaggtagtacatcaccaggctgcacgcaccatgactccatggatccttctgatgaggaaggcagaggcggagctggtggcggaggcgcaggctcagaacactctgagacgctcagttctctgagcctcaccagtctcttttgtccccctccacccccacccgcaccagggctgacgcctgctaggaaattctccagtactagcagcctggctgccccagggcgaccccacgctgccgcactggctcatgggctggcaagaagtccttcttgggctgccgacaggtctaaagatccaccgggacgggctcccctgcctatgggcctcgggcctctggcccctccgcctcagcctctgcctggagaattggagccgggtgacgctgctagcaagagaaaaaggta

SEQ ID NO: 216672 - DNA, 5945 bp, Artificial Sequence
  Description of Artificial Sequence: Synthetic coding sequence
atggcggagagcgcctcaccgcctagttcatcagctgcggctcccgcagcggaaccaggcgtgaccactgagcaacccggtcctaggagcccacctagctcaccacccggattggaagaacccttggacggggctgatccacatgtaccccatccagatctggccccaatagcgttcttctgcttaagacagaccacgtccccacgtaattggtgcattaagatggtctgcaatccgtggtttgaatgtgtctcaatgcttgtgatactgctcaattgcgtaacactcggcatgtatcagccctgcgacgatatggactgtctgtctgaccgatgcaaaattctccaggtctttgacgatttcatatttatttttttcgcaatggagatggtgttaaaaatggtggcacttggaatctttggtaagaaatgttatctcggagatacatggaatcggctggattttttcattgtaatggcaggtatggttgaatattccctggacctgcagaatattaatctctctgctatccggactgtccgggtgttacgcccactgaaagctatcaacagagtgcccagcatgcgaatcctagtcaacctcctgctggacaccctgcctatgttggggaacgttctgctactctgttttttcgtatttttcatatttggcatcattggcgtgcagctctgggccggattgttgcgtaatcggtgttttttagaggaaaacttcaccattcagggagatgtcgcacttcccccatattatcagcctgaggaggatgatgagatgccatttatttgctcactttctggtgataacgggattatgggctgtcacgaaattccaccgctgaaggagcagggtcgggaatgttgtctttccaaagacgatgtatatgactttggcgcaggacgccaagatctgaacgccagcggactctgtgtgaattggaatcgctattacaacgtctgcaggaccggctcagctaatccacacaaaggagccattaacttcgacaatatcggctacgcttggattgtgatcttccaagtgattaccctcgagggatgggtggaaattatgtattatgttatggatgctcacagcttctacaattttatatacttcatcctccttattattgtcgggagtttctttatgatcaatctgtgcctggtggtgatcgcaacgcagttctccgagacaaaacagcgggagcacaggcttatgctcgagcagcgtcagagatatctgagctcatctactgtggctagttacgcggagcccggagattgttatgaagagatctttcagtacgtttgtcatattttgcgaaaggcaaaacgacgcgctctcggcctataccaagccctgcaatctcgtagacaggctctaggaccagaggccccagcccctgccaagccagggccacatgccaaggaacctcgtcactaccaactgtgtccccagcactccccattagatgctacaccccataccctagtacagccaatcccggcaacgctggcgtccgatccagcctcgtgtccctgctgtcagcacgaagatggccgaagaccctccggactcggcagcacagatagcgggcaggagggcagcgggagcggatcaagcgccggaggggaagacgaagctgacggtgacggagcgagatctagtgaggatggcgctagctccgagttggggaaggaggaggaggaggaagagcaggctgacggggctgtgtggctttgcggtgacgtttggagggagaccagagccaaactacgtggcatcgtggactccaagtacttcaaccgtggcatcatgatggcgattttagtgaacaccgtgagcatggggatagaacatcatgagcaacctgaggagttgacaaatatattggaaatctgcaacgtcgtgttcaccagtatgttcgccttggagatgatactgaagttagcagcctttggcctatttgattaccttcgaaatccctacaacatctttgacagtatcattgtgattatctccatctgggaaattgtggggcaggcggatggcggactcagcgtgttaaggaccttcagattgctacgcgtcttgaaactagtgcgcttcatgcccgcactgagaaggcagttagtcgttctcatgaagacgatggacaacgtggctactttctgtatgctattaatgctgtttattttcattttttccatcctcggcatgcatattttcggatgcaaattcagtcttcggaccgatactggagacaccgtgcccgatcgcaaaaatttcgactccctcctttgggccatcgtgaccgtgttccagatcctgactcaggaagactggaacgtcgttttgtacaacggtatggcgtcaacctccccatgggcaagtctatattttgtcgccctgatgacattcggcaactacgtgctcttcaacctactcgtggccattctggtggagggcttccaggcagaaggcgacgcgaaccgctcttactctgacgaagatcagagtagctccaatatagaggaattcgacaaattgcaggaagggctggactcctctggcgatcccaagctgtgccctatcccaatgacgcccaatgggcaccttgatccttccctaccattgggcggacacctggggcctgcgggagccgcaggaccagcccctaggcttagtttacagcctgatcccatgttggtggcactcggctccaggaaatcaagtgtgatgtctctggggaggatgagttacgatcagcgctccttgtcctcctcccgaagtagttactatggaccttggggaaggtctgctgcctgggcctcacggcgttcctcttggaattctctgaaacacaagcccccttccgccgaacacgagtcactcctatccgccgaaaggggaggcggtgcacgcgtgtgtgaagttgccgcagacgagggacccccacgggctgcaccactgcacaccccacacgcacaccacatccaccatgggccacacctcgcccacagacaccgccaccatcggagaacactgagcctcgataatcgggatagcgtggatctcgcagagctagttcctgctgtgggcgctcatcctagggcagcctggagagccgcaggtcccgcacccggacacgaggattgtaatggacgtatgccttcaatagctaaagacgtgttcacaaaaatgggcgatagaggcgaccgcggagaggacgaggaagagatcgactatacgctgtgcttcagggtgcgcaagatgatagatgtgtataagcccgactggtgtgaggtgagagaggactggtcggtgtatctcttcagcccagaaaaccggttccgggtgctgtgtcagacgatcattgcccacaagctgttcgattatgtcgtgcttgcctttatcttcttgaattgcattaccatagcgctggagcgtccccagatcgaagccggtagcacagagaggatctttctgactgtatccaattacatcttcacagcaatcttcgtgggggaaatgacgttaaaggtggtctccctgggtctctattttggggagcaggcttatctcaggtcttcttggaatgttcttgatggttttctggtgttcgtgagcattattgacatcgtagtgtccttggcctcggctggaggggctaagatcctcggagtgctccgggtacttcgactgcttcgtaccctcaggcctttgcgtgtgatcagtcgggcaccagggctgaaactcgtcgtggaaactctgatctcttccctgaaacctataggcaacattgttctaatttgttgtgctttcttcatcatttttggtatcttaggcgtccagctcttcaaaggcaagttctatcattgcctgggagtggacacgagaaatattactaatcgctctgactgcatggcggctaactatagatgggtccatcacaagtacaacttcgataatctgggtcaggcattgatgtcgttatttgtgctggcctcaaaggacggatgggtaaacatcatgtacaacggtctggatgcagttgctgtggatcagcagccagttaccaaccataatccctggatgctcctctattttatctccttcctgttgatcgtcagcttctttgttctgaacatgtttgtgggagtggttgtcgagaacttccacaagtgtagacagcatcaggaggccgaagaggcccgacgcagggaggagaagcggttgcgcaggcttgagaaaaagcgaagaaaggcccagcgactgccatactacgcaacgtactgccacacccgactgctgatacatagcatgtgcacctcccattatctcgacatctttattactttcatcatctgcctcaacgtggtcacaatgagcctggagcactataaccagccaacgagtctggaaacagccctcaaatattgtaattatatgttcaccacagtgttcgtgctggaggcagtgctgaaactggtggcgttcgggctgcgcagattcttcaaggatcggtggaatcaactcgacctcgctatagtcttattgtcagtgatgggaatcacattggaagagattgaaattaacgccgctttgcctatcaaccccaccatcattcggattatgagagtgcttcggatcgcccgtgtcctgaagctgctcaaaatggccaccgggatgcgcgctctgttagataccgtcgttcaggccctgccccaagtggggaacctaggtctcctcttcatgctgttattctttatttacgcagctctgggcgtggaattattcggaaagttagtctgcaacgacgaaaacccctgtgaaggcatgtcccggcatgctaccttcgagaactttggcatggcattcctcacgctttttcaggtgtcaactggtgacaactggaatggcatcatgaaggatacgttgcgtgattgcactcatgacgaaagatcttgcttaagcagtctgcagttcgtgtctccattatattttgtctctttcgtacttacggcccaattcgtcctgatcaacgtagttgttgctgtcctcatgaaacatctggacgacagcaataaggaggcccaggaggatgcggaaatggacgcagaattggaactggaaatggcccatggcctcgggccaggccctcggctgcctacaggatctccaggagcgcctggaagaggtccaggcggagctggaggcggaggagacaccgagggtggcctgtgtcgcaggtgctatagccccgcacaggaaaatctttggctcgatagcgtgagcctgattattaaagactctctagagggggaactcactataatcgataatctcagtggatcaatctttcatcattatagctctcccgctggttgcaagaagtgtcaccatgacaagcaggaggtgcaactggctgaaactgaagcattcagtctgaattcggatagaagcagtagtatcttgttaggagatgacctgtctcttgaggacccaaccgcctgccctccagggagaaaggactccaagggagaactggacccacctgagcctatgagggtgggagatctgggagagtgtttttttcctctttcatctactgccgtatctcccgaccccgaaaatttcttgtgcgagatggaagagatcccgttcaatccagtgaggtcttggttgaagcacgattcctcccaggcccctccatcacctttcagtccggacgcaagttctccgttactgcccatgcccgcagagttttttcatccagccgtgtctgcctcccagaaaggacccgagaagggaaccggcactggcactttgccaaagattgcactgcagggcagttgggctagcctcagatcaccgcgtgtcaactgcactctgcttcggcaggttcctaccccacctcgaccata

SEQ ID NO: 216673 - DNA, 1041 bp, Artificial Sequence
  Description of Artificial Sequence: Synthetic coding sequence
atgatggacaagttccggatgattttccagtttctgcagtctaaccaggaaagtttcatgaatggcatctgcggaatcatggccctcgcttccgcacagatgtattctgcatttgatttcaattgtccttgcttgccaggatataacgccgcatacagcgctggcatcctcctcgccccacctcttgtgttgtttctcctgggactggtgatgaataacaatgtctccatgctagctgaggagtggaagcggccactgggacgaagggccaaagaccctgcggtgctccgctacatgttctgctccatggcccaaagagcactgattgcccctgtggtgtgggtggctgtaacattattggatggaaagtgctttttgtgtgctttttgcacagccgtgcctgtatcagcgctggggaatggttcactggcccctggcctacccgctcccgagttagcgagattattggcgagagtgccctgtccggagatttacgacggggattggctgttggcccgagaagtggcagtccgctacttgcgatgtatttcccaggccttaggatggtcattcgtcttgctgaccacacttctggcattcgtcgttagaagcgtcaggccctgttttacccaggctgcttttctgaaatccaaatactggtcccattacatcgacatagaaagaaaattgtttgacgaaacgtgtacagagcacgccaaggccttcgctaaggtctgcatacaacaatttttcgaggctatgaaccacgacttggagcttgggcacacccatgggaccctcgcgaccgccccagcctcagctgctgccccaacaactcctgacggggctgaagaggagagagaaaagctgcgtggcataaccgaccagggtacaatgaaccgcctgctcacgagctggcataaatgtaagcctcccctgcgtctgggccaggaagagccacccttgatgggcaacggatgggcaggtggcggacctcggccacctcgcaaagaggtggccacctattttagcaaagtgtag

SEQ ID NO: 216674 - DNA, 972 bp, Artificial Sequence
  Description of Artificial Sequence: Synthetic coding sequence
atggcggctttgatcgctgagaactttaggttcctttccctgtttttcaaatcaaaggacgtgatgattttcaacggtctcgtggcgctaggtactgtcggtagccaggagctgttttctgtggtggcctttcattgtccgtgttcgcctgccaggaattacctttacggtctggccgcaatcggtgtgccagcactggtgctcttcattattggtattatcctgaacaatcatacatggaacctcgtggccgagtgtcaacaccgtaggaccaagaattgtagcgctgcacccaccttcctcctgctgagctctatcctgggcagagccgctgtggcccctgttacatggtcagtgatctctctgcttagaggcgaagcctacgtctgcgctttgagtgagttcgtcgaccccagctccctcacagcacgggaagagcactttccatccgctcacgctactgaaatactcgccagattcccctgcaaggaaaacccggataacctctcagactttcgggaggaggtctctagaagactaagatacgagagccagctgttcggatggctgctgatcggcgttgtggctatcctcgtgttcctcaccaagtgcttaaagcactattgttcaccattgtcgtataggcaggaggcctactgggcacagtacagagccaatgaggatcagctcttccagcgtactgccgaggtgcactcacgcgtgctcgcggctaataatgtgcggcgattctttggatttgttgctctaaataaggatgatgaggaactgatcgcgaatttcccagttgagggaacccaaccacgccctcaatggaatgccatcacaggtgtgtatttatatagagaaaatcaggggctgcctctttacagccgtctccacaaatgggcacaaggcctggccggaaatggggctgcacccgataatgtggagatggctcttctgccttcctag

SEQ ID NO: 216675 - DNA, 972 bp, Artificial Sequence
  Description of Artificial Sequence: Synthetic coding sequence
atggctgccctcatcgctgaaaactttcggttcctgtcgcttttctttaagagtaaagatgtgatgatctttaatggcctggtggccctgggcactgtgggatcacaggagttgttttccgtcgtggcttttcattgtccttgttctcctgcgaggaattacttatatggcctagcagcgatcggtgttcccgcacttgtactttttataattggaattattctaaataaccatacttggaatctagtcgccgagtgccagcatagaagaacaaagaattgctccgcggctcctacctttctgttgctgtcatcaatattagggcgagctgcagtggccccagttacttggagcgtaatttccctcctgagaggagaggcatacgtgtgcgccctgagtgagtttgtggatcccagtagcctgactgccagagaagagcattttcctagtgcacacgcgacggagatcctggctcgattcccatgcaaggaaaatccagataacctgagcgatttcagagaggaagtatctaggcgcctgcgctacgaaagccagctgtttggttggttacttatcggcgtggtggctatccttgtttttttgaccaaatgtttaaaacactactgcagcccactgagctaccgacaggaggcctactgggcccaataccgggcaaacgaagatcagctgttccagcggacagccgaagtccactcccgcgtcttggcggcaaacaatgtcagaagattctttggattcgtagcgttgaataaggacgatgaggagcttattgctaattttccggtcgagggaacccagcccagaccccagtggaacgccatcaccggagtgtacctgtaccgtgaaaaccagggactgccattatatagtcgccttcacaaatgggcccaagggctggccggaaatggcgcagctcccgacaacgtagagatggctcttcttcccagctag

SEQ ID NO: 216676 - DNA, 657 bp, Artificial Sequence
  Description of Artificial Sequence: Synthetic coding sequence
atggctgccctgatcgcagagaacttccgtttcctcagcctgttcttcaaatcaaaagacgtgatgatctttaatggcctggtagctctcggtacggttggcagtcaggagctctttagtgtggtggccttccactgcccctgtagtcctgctcgtaactatctgtacgggttggctgccattggcgtgcctgcactggtgctgtttatcatcggaatcatattgaacaaccatacttggaaccttgtcgccgagtgtcagcataggagaacgaagaactgctccgccgctccaacttttctgttgctgagttcaatcttagggagagccgcagtcgccccagtcacctggtccgttatctcattattgcgaggcgaagcttacgtgtgtgcactgtccgagttcgtcgatccaagcagcctaacggctagagaggagcactttccgtctgcacacgcaacagaaattttggcaagattcccgtgcaaagagaaccctgacaacttgtctgacttcagggaagaggtgagccgacgcttgaggtatgaatcgcaggtacgcagctgcgctaagggaagctcttcctccctggttgttgctggggagcgcagcggagacggtctcgtgctgaaactgggcttagttctgaggggatag

SEQ ID NO: 216677 - DNA, 891 bp, Artificial Sequence
  Description of Artificial Sequence: Synthetic coding sequence
atggagagtatggccgtggctacagatggaggtgaacgtccaggcgtgcccgctgggtctggcctgtcagcatcccaacgcagggctgagttacgtcggcgtaagcttctgatgaactccgaacagcgtataaatcgtattatgggatttcacaggccagggtcaggagcggaagaggaatcacagactaaaagtaagcagcaggattctgataaactgaatagcctctctgtgccttccgtgagcaagcgagtggtattgggcgacagcgtttctaccggcaccaccgatcagcagggcggtgttgctgaggtgaaaggtactcagttgggcgacaaacttgactcctttataaaaccgcctgaatgtagctccgatgtgaaccttgaacttagacagagaaaccgcggagacctgaccgccgactccgtacaacggggtagcaggcatggcttggaacagtatctatctaggtttgaggaggccatgaaactccgaaaacagcttattagcgagaagccatctcaggaggacggcaacactactgaggaattcgattcctttagaattttcagattagtgggctgtgctctgcttgcgttgggtgtgcgagcatttgtttgcaaatatctctccatcttcgcgccttttctgactctccagctcgcttatatgggactctataagtacttccccaagagcgaaaaaaaaatcaagaccaccgtcctgaccgctgccctgctgctctcgggcattcccgctgaagtgatcaatcgatcaatggacacctactccaagatgggggaggtcttcacggacctgtgtgtttactttttcaccttcatcttttgtcacgagctgctcgactactgggggagcgaagttccctag

SEQ ID NO: 216678 - DNA, 1113 bp, Artificial Sequence
  Description of Artificial Sequence: Synthetic coding sequence
atgctgggagctgtggaaggcccaagatggaagcaggccgaagacattcgggatatctacgattttagggatgtattaggaaccggagccttctctgaggtgatcctggccgaagacaagcgaacgcagaagctcgtggcaatcaaatgcattgccaaggaagctttggagggcaaggaaggcagcatggaaaatgagattgctgtcctgcataagatcaaacacccgaacatcgtggctctcgacgacatctatgaatccggaggacatctgtacctcatcatgcaattagtgtccgggggagagttgttcgatcggatagtcgaaaaagggttttataccgagagggacgcctcgaggttgatttttcaggtgctcgacgccgttaagtatttgcatgacctagggattgtacatcgggacctcaaaccagagaacctcctctattattctcttgatgaggactccaagatcatgatctcagattttgggctgtcaaaaatggaggacccaggatccgtgcttagcacagcgtgcggcacaccaggctacgtggcacccgaagtgctagcccagaaaccatattctaaggctgtggattgctggtctattggcgttattgcatatattctgctctgtgggtacccgcctttttatgatgaaaatgacgcaaagctgttcgaacaaattctgaaagcagagtacgaattcgatagcccctactgggatgatattagtgactctgctaaagacttcatccgccacctgatggagaaggaccccgagaaacggtttacttgcgaacaagcgttgcagcatccctggatcgccggagatacagccctcgacaagaatattcaccaaagcgtctcagagcaaatcaagaagaacttcgcgaagtcgaaatggaaacaggctttcaacgccacagcagtggtgcgacacatgagaaaattacaactcggtacctctcaagaaggacagggacagacagcctcccacggggaactgttaacccccgttgcaggtggccctgctgccggatgttgctgccgcgattgttgcgtggaacctgggaccgagttgagcccaacacttccccatcaactatag

SEQ ID NO: 216679 - DNA, 1437 bp, Artificial Sequence
  Description of Artificial Sequence: Synthetic coding sequence
atggcaaccatcacatgcactcgctttacggaggaataccagctgtttgaagagctggggaagggggcattttccgttgtcagacgctgtgtgaaagtgctcgccggacaggagtacgccgcaaaaatcataaataccaaaaaacttagcgccagagatcatcagaaattggagcgcgaggcccgaatatgccgactcctcaaacacccaaacattgtgcggcttcacgattcgatttccgaggagggccaccactacttgatcttcgacctggtcactggaggagagttgttcgaagacatcgtagcacgggagtattactcggaggctgacgcctctcattgtattcaacagatactcgaggccgtactgcattgccatcaaatgggtgtggtgcaccgcgatttgaaaccagaaaacctgttgctggcaagtaagctgaagggagctgctgtgaaactcgccgattttgggttggccatagaagtagagggggagcagcaggcttggtttggcttcgccggtaccccgggatacctcagtccggaggtcttacgaaaggatccatacggaaaacccgtcgatttgtgggcttgcggtgtgatactctatatattgctcgtgggctatcctccattctgggatgaggaccagcatcgcctgtatcagcagatcaaggcaggcgcttatgatttcccctcccctgagtgggatactgtgacgccggaagccaaagatctcatcaacaagatgttgaccataaaccctagtaagcgaataactgcggcagaggccctgaaacatccttggattagtcataggagtacagtggcctcctgtatgcaccgccaagagacggttgactgcctcaagaaattcaatgcaaggaggaaactcaagggggctatcttaaccacaatgctcgctacccggaactttagcggtggtaagtcgggtggtaacaagaagtcagacggtgttaaagagtcatcagaatcaaccaacacgactatagaggacgaggatacaaaagttaggaagcaggaaataatcaaggtaacagagcagctcatcgaggctatttctaatggagattttgaatcctacacgaagatgtgcgatccaggcatgacagcattcgaacccgaggccctcggtaatctggttgaaggactggacttccatcgattttatttcgaaaacttgtggagcaggaatagcaagcccgtccacactaccatcttaaaccctcacatacacctgatgggcgacgagtccgcttgcattgcttatattaggatcacccagtatctcgacgcagggggaattccaaggacggcccagtctgaagaaaccagggtgtggcaccggcgagatgggaaatggcaaatcgtccactttcaccgctccggcgctcctagcgtgctgccacactag

SEQ ID NO: 216680 - DNA, 1470 bp, Artificial Sequence
  Description of Artificial Sequence: Synthetic coding sequence
atggccaccattacgtgcacaaggtttacagaagagtaccagctttttgaggagttaggtaaaggggctttttctgttgtgcggcgatgtgtgaaagtactcgccggacaggaatacgctgccaagattattaataccaagaagctgtcagctagagaccaccaaaaattggagagggaggcacgaatctgccgtctgcttaagcatccgaatatcgtgcgtctgcacgactctatatctgaagaaggacaccattatctgatatttgacctcgtaaccggtggtgaactgttcgaggacattgtggcaagggagtattactctgaagccgatgcatcccactgcatccagcagatcctggaagcagtgctccactgtcatcaaatgggcgtggtgcacagggacctgaagccggagaatctcctgcttgcttctaaactgaaaggagccgcagtcaaactggctgatttcggactcgccattgaagtggagggagagcagcaggcttggttcggcttcgcaggaactcccggatacctgtcgcccgaggttttgcggaaggacccgtatgggaaacccgttgatctgtgggcctgtggcgtgatcttatacatcctgctggtggggtatcctccgttttgggatgaagaccagcatcggctttaccagcagataaaagcaggggcatacgacttcccctccccagaatgggacacagtcactcccgaggcaaaagaccttataaacaagatgctcacgattaacccctccaagcggatcacagcggcagaggctctcaaacacccctggatcagccaccgtagcacagtggcctcatgtatgcaccggcaggagaccgtggactgcctgaaaaagttcaacgcgagacgcaagctgaagggagcgatattgactactatgcttgcaacgaggaacttctctggcggtaagtctggcggaaacaagaaatcagatggagtaaagaaaagaaagagtagcagctctgtgcagctgatggagagctcagagagtactaacacaacgattgaagacgaggacacaaaggtgcgcaagcaggaaataataaaagtgaccgagcagcttattgaagccatctcaaatggagatttcgaatcctatacaaaaatgtgcgacccaggcatgacagcttttgaacccgaagccctgggcaacttggtggagggcctggatttccaccgcttctatttcgagaacttatggtcgaggaatagcaaacccgtccacacaaccattctcaacccacacatccatctgatgggggacgagagcgcctgtatcgcttacataagaataacgcagtatctggacgccggagggattccgcgaacagcccagtcagaggaaacccgagtatggcatagacgcgatggaaaatggcagatcgtccacttccatcggtctggtgctccttcagtgctgcctcactag

SEQ ID NO: 216681 - DNA, 276 bp, Artificial Sequence
  Description of Artificial Sequence: Synthetic coding sequence
atggcaaccattacttgtacacgattcaccgaagaataccagctctttgaggagttaggaaaaggcgcattttccgtggtgcgtcggtgcgtcaaagtactggctggacaggagtacgccgctaagataattaacacaaaaaagctgagtgccagggaccaccagaagctggagcgcgaagcaagaatttgccgcttgctcaagcaccctaacatcgttagactccatgactccatctcagaagagggacatcactacctaattttcgacctgtag

SEQ ID NO: 216682 - DNA, 1554 bp, Artificial Sequence
  Description of Artificial Sequence: Synthetic coding sequence
atggccacaaccgtgacatgcacgcgattcaccgacgagtatcagctgtacgaagacattggaaaaggggcttttagtgtggtccgcagatgcgtgaagctttgtaccgggcacgagtacgctgccaagattatcaacaccaaaaagctgagtgctcgggatcatcaaaagctagagcgcgaagccagaatttgtcgtttactgaaacacagcaatatcgtgcggttgcacgactccatttctgaagaaggttttcactacttagtgtttgacctggttactgggggagaactgtttgaggacatcgttgccagggagtattactcggaagcagatgcctcacactgcatacagcagattcttgaagctgtcttgcactgccatcagatgggggttgttcatcgggatctgaaacccgaaaacttgctgttggccagtaagtgcaaaggtgccgcagtgaagctagcagattttggactagccattgaggtgcagggcgatcagcaggcttggttcggattcgccggtactcccggatacctgtcccctgaggtcctgcgtaaggaagcatacgggaaaccagttgacatttgggcctgcggagttatcctctatatactgctggtgggatacccccctttttgggatgaagatcagcacaagctgtatcagcagatcaaagccggagcttacgactttccgtcacctgagtgggataccgtgactcctgaggctaagaatctgataaaccagatgctgacaatcaatcccgcaaaaagaataaccgcccatgaagccctcaagcacccttgggtttgtcagagaagcactgtggcatccatgatgcataggcaggaaaccgtagagtgcttgaaaaaattcaacgcaaggagaaagttgaaaggcgctatcttgacaacgatgctggccactcggaacttctccgctaaaagcctgctcaacaagaaggctgacggtgtgaaacctcagactaattccacaaagaactcagcagcagcaacaagccccaaagggactctgccccctgccgctctggaaccacagaccactgtgatccacaacccagtagatggcattaaagagagtagtgactctgcaaacacaacgatagaagatgaagacgcaaaggccagaaagcaggagattatcaagacgacagaacagctgattgaagccgtgaataacggggactttgaggcctacgccaagatatgcgaccccggactgacatccttcgaacccgaggcccttgggaatctggtggagggaatggactttcacaggttctacttcgaaaacctcctagccaaaaattcaaagcctatccatactaccatcttgaatccacacgtacacgttatcggagaggatgctgcatgcatcgcttatatccgattaactcagtacatcgatgggcagggaaggcctcgcacaagccagtctgaagagaccagggtgtggcaccggagagatgggaaatggcagaatgtccacttccactgctccggcgcaccagtcgctccgctccagtag

SEQ ID NO: 216683 - DNA, 1350 bp, Artificial Sequence
  Description of Artificial Sequence: Synthetic coding sequence
atggccaccacagttacatgcactagattcaccgatgagtaccaattgtacgaggatatcggcaagggcgcattctctgtcgtacgtaggtgcgtgaagctgtgcaccggacacgaatatgcggcaaaaatcataaataccaagaagctgtccgcccgagatcatcagaaactcgagcgcgaggcacggatttgcagactgcttaaacatagcaatattgtaagactgcacgactccatttccgaggagggatttcactatctggtcttcgaccttgtcactggtggagagctctttgaagacattgtggctagagaatactactccgaagctgatgcatcccactgtattcagcagatcctcgaagccgttctgcattgccatcaaatgggcgtggtgcacagagacctgaagcccgaaaatttgttattagcctccaaatgcaaaggtgccgctgtgaaactagcggattttggcctggcaattgaggttcaaggggaccagcaggcgtggtttggttttgcaggtactccaggatacttgtcacccgaagtcctgcgcaaagaggcctatggcaagccagtggatatatgggcatgtggagtcattctgtatatcttgctcgtgggctaccctcctttctgggacgaagaccagcacaagctgtaccaacagatcaaagctggcgcatacgactttccctctcctgaatgggacactgttaccccagaggccaagaatctcataaatcagatgctgacaattaacccagctaaacggatcaccgcccacgaagcactaaagcacccttgggtttgtcaacgctcaactgttgcgagtatgatgcaccgtcaagagaccgtcgagtgcctaaaaaaattcaatgcccgtaggaagctcaagggggctatccttacaaccatgttggctactagaaatttcagcgccagaaaacaagaaatcattaagacaactgagcagttgatagaggcagtaaataacggtgactttgaagcgtacgcgaagatttgcgaccctggtcttacctcctttgaaccagaggcactaggaaaccttgtcgaggggatggatttccacagattttatttcgagaatctgttggccaagaatagcaaaccgatacacaccacaatcttaaaccctcacgtgcatgtcattggggaggacgcagcctgcatcgcatacatccggctgacacagtacattgatggtcagggcaggccaagaacttcccaaagtgaggaaactcgggtttggcatagaagagatgggaaatggcagaacgtgcacttccattgctccggcgcacctgtcgccccacttcagtag

SEQ ID NO: 216684 - DNA, 1479 bp, Artificial Sequence
  Description of Artificial Sequence: Synthetic coding sequence
atggcaaccactgttacatgcacaaggttcacagacgagtaccagctgtatgaggacattggaaaaggagcatttagtgtggtacgacggtgtgtgaagctttgtactggccacgagtatgccgcaaagataatcaatactaaaaagctgagtgcccgagatcaccagaaactcgaacgagaagccagaatttgcagactgctgaaacatagcaatatcgtgcgtctgcatgattccatttcagaggagggctttcattatctggtcttcgacttggtgaccgggggtgaactgttcgaagacatcgtagcccgagagtactactcagaagccgatgctagtcattgcattcaacagatacttgaggccgtgctgcattgtcatcaaatgggcgtggttcacagggacttaaagcccgaaaacttattgctggcctcaaaatgcaagggagcagctgtgaagctagccgactttggcctcgctatcgaggtacagggtgaccagcaggcatggtttggctttgccggaacacccggttatctatctcctgaggtgttgcgaaaagaggcctacggcaagcccgtggatatttgggcatgtggagtaattctctacatcctccttgtgggctatcctcccttttgggacgaggatcagcacaaactgtaccagcagattaaggccggagcttatgattttccatcccctgagtgggacactgtgacccctgaggcaaaaaaccttattaaccagatgctaaccatcaatcctgctaagcgaatcactgctcatgaggctctgaagcacccctgggtttgccagagatctaccgtcgcttctatgatgcacagacaggagacagttgagtgcctaaaaaaatttaacgccaggagaaagctgaaaggcgcaatcttgacgacgatgctggcaacacgcaatttctccgttgggcgtcaaaccacggcccctgccacaatgagtactgcagcgtcaggaaccacaatgggtcttgtcgaacaagccaagagtttactgaacaaaaaagcggacggagtcaaggagcctcagactacagttatccacaatcctgttgacggcatcaaggaaagctctgattccgccaataccaccattgaggacgaagacgccaaagcaagaaagcaggaaatcatcaaaacaactgaacagctcatcgaggccgtgaataacggagattttgaggcatacgctttctactttgagaatttgctggcgaagaacagcaagcccatccacacaacaatcctaaacccacacgtgcatgtgatcggagaggacgccgcttgtatcgcatacattcgtctgactcagtacatcgacggacagggtaggccaagaactagccagtccgaggaaaccagagtctggcacaggagagatggcaagtggcagaacgtgcattttcactgctcaggggctcctgtcgcccctctacagtag

SEQ ID NO: 216685 - DNA, 1629 bp, Artificial Sequence
  Description of Artificial Sequence: Synthetic coding sequence
atggcgacgaccgtgacctgcacaagattcactgacgagtatcaattgtacgaagatattggaaaaggagctttttcagttgttaggagatgtgtgaagttatgcaccggtcacgagtacgcagccaaaatcatcaatacgaagaagctgagtgcacgcgatcatcagaaactagagcgagaggcaaggatttgcaggctgctaaaacattccaatatcgtacggttgcatgatagcatcagcgaagagggatttcattatcttgtgtttgacttggtgacaggcggtgaactgtttgaggatatcgtggcacgggaatattacagcgaggccgacgcctcccattgtatacaacagatcctcgaagcagtgctccactgccaccagatgggcgtagttcatcgcgatttgaagcctgagaacctgctcctcgcatcgaaatgcaagggcgctgcggtaaagctggccgactttgggctcgctatcgaggtgcaaggggaccagcaggcctggtttggcttcgcagggacacctggctatctgtcaccggaagtcctgaggaaagaggcctacggaaaacctgtggacatatgggcttgtggcgtcattttgtacattctcctggtcggctacccccctttctgggacgaagatcagcacaagctgtatcagcagattaaagccggagcctacgacttcccctctccggaatgggacacagttaccccagaggctaagaatctgataaatcagatgttgaccattaaccctgctaagcgcataacggcccatgaggcattaaaacatccctgggtctgccagaggtccaccgtggctagcatgatgcataggcaggagacggttgagtgtctgaaaaagtttaacgctcgacgcaaactgaagggcgctatcctgaccactatgcttgccacccgcaatttcagcgtcggccgtcaaactacagcacctgccaccatgtccactgccgctagtggaacaacgatggggcttgtggaacaagctaagagcctacttaataagaaagccgacggtgtgaagcctcagactaacagtaccaaaaacagtgccgctgcaaccagccccaaggggaccctgcccccagctgccctggaaccacaaacaactgtgatccataatcccgtagacggaattaaggagtctagcgacagcgctaatacgacaatcgaggacgaagacgctaaggccaggaagcaggagatcattaaaacaacggagcagctgatcgaagctgttaataatggggattttgaggcctacgccaagatctgtgacccaggcctgacctctttcgaacccgaggcactgggtaacctggtcgaagggatggactttcacagattttacttcgaaaacttgctggcaaagaactctaagccaattcatactactattttaaacccccacgttcacgtaatcggggaagacgccgcttgtatcgcttatattcggcttacccagtacattgacggccaagggaggcctagaaccagtcaaagtgaggagacacgggtttggcatcgccgagatggcaagtggcagaacgtccactttcattgctccggcgcaccagtagccccactccagtag

SEQ ID NO: 216686 - DNA, 1440 bp, Artificial Sequence
  Description of Artificial Sequence: Synthetic coding sequence
atggctaccacagtgacttgtacgcggtttaccgacgagtatcagttgtatgaggacatcggcaagggggcatttagtgtggtacgaaggtgcgtgaagttgtgcaccggccacgaatacgccgcaaagatcattaacactaagaagctcagtgctagggaccatcaaaagctcgagagggaagctcgaatttgcagactgttgaaacactcaaatatcgttaggctccacgacagcattagtgaggagggttttcattacctggttttcgatcttgtgactggcggagaactgttcgaggacatcgtagctagggaatactacagcgaagcggatgcatctcattgtattcagcagattctagaggccgtattgcattgccaccagatgggagtcgtccaccgagatctcaagccggaaaacttacttctggcatccaagtgcaagggtgctgctgtgaagctggccgacttcgggttagccatcgaagtgcagggcgatcaacaggcctggttcggcttcgctggcacacctggatatctgtccccagaggtgctgaggaaggaagcctacggtaagccagtagatatctgggcatgcggagtcatcttgtatatcttgctggtagggtacccccctttttgggatgaagaccagcacaagctatatcaacaaatcaaagcaggggcttacgactttccatctccagaatgggataccgtgactcctgaggccaaaaacctgattaaccagatgctgacaattaatcccgcaaagcggattacagcacatgaagcccttaaacatccatgggtgtgccagcgctccacagtggccagcatgatgcatcgccaagaaacagtggaatgtctgaagaagtttaacgccagacgtaaactgaagggagccatcctgacaaccatgctcgccacccggaactttagcgcggcaaaatctttactgaataaaaaagccgacggcgtcaaggaatcttcagattctgcgaatactaccatcgaggacgaagacgccaaggcgaggaagcaggagatcatcaagacaaccgagcaactgatagaagcggttaataatggtgactttgaggcatacgcaaaaatttgtgaccccggactgacaagctttgagccagaagcactgggaaatcttgtggaaggaatggactttcatagattctattttgaaaatctgctcgctaagaacagcaagcctattcacacaacaattctcaaccctcacgtccacgtaatcggggaagacgcagcctgtatcgcctacattcgcctgactcagtacattgacggtcaaggccgaccacggacctcccagtctgaagaaacacgggtgtggcacagaagagatgggaaatggcagaatgtgcactttcactgctccggtgcgccagtagcacctctgcagtag

SEQ ID NO: 216687 - DNA, 1512 bp, Artificial Sequence
  Description of Artificial Sequence: Synthetic coding sequence
atggctactacagttacctgcacaaggttcacagatgaatatcagctgtatgaggatatcggtaagggcgcattctcagtagtgcgaagatgtgttaagttatgcacaggccacgagtatgcagctaagattatcaataccaagaaactgagtgcgagggatcaccagaaattggagagggaagccagaatctgccgactgctgaaacacagtaacatcgtccgcttgcatgactctatttcagaagaggggttccactacctggtattcgacctggtgacaggcggtgaactgtttgaagacatagtagcccgagaatactactcagaggcggatgcctctcattgtattcagcagatacttgaagctgtgctccactgccatcagatgggagttgtgcatagagacttgaagcccgaaaatttgctcctggcctccaagtgtaagggtgctgcagtgaaactggctgacttcggcctggcgatcgaggtgcaaggtgaccagcaggcctggtttggatttgcaggcactcctggttatctctctccggaagtgctacgtaaagaagcctatggcaaaccggtcgatatttgggcatgcggggtgatcctgtatatccttctcgtgggttacccccctttttgggacgaggaccaacacaagctgtatcagcagatcaaagccggagcatacgacttcccctcccccgagtgggacaccgtcacgcctgaggccaagaacttgatcaaccagatgcttactattaaccctgctaaacgaattaccgcgcacgaggcactgaagcatccttgggtgtgtcagaggtcaactgttgcttctatgatgcatcggcaagaaacggtggaatgcctcaagaagtttaacgccaggagaaagctaaagggtgccatactgactactatgctggctaccagaaacttctccgctgccaaatcacttcttaataaaaaagccgatggggtaaagccccaaactaattctaccaagaacagtgcggctgctacttcacctaagggcaccctcccacccgctgcacttgaatcttctgattccgctaatacgacaatcgaggacgaagacgcaaaagccaggaagcaggagattatcaaaacaactgagcaactcattgaagccgtgaacaatggcgatttcgaggcctatgccaagatttgtgaccccggactgactagctttgagccggaagccctgggtaacttagtggaagggatggacttccacaggttttactttgagaacctgctcgccaagaacagcaaacctattcacacaacaattttgaacccacacgtacatgtgataggggaagacgccgcttgcatagcttacattcggttgacacaatacatcgatggccaaggccgtccgcgaaccagccagtctgaggagaccagggtctggcaccgtcgggatggtaagtggcaaaatgttcactttcattgttccggcgctcccgtggctcctctgcagtag

SEQ ID NO: 216688 - DNA, 1557 bp, Artificial Sequence
  Description of Artificial Sequence: Synthetic coding sequence
atggcaacgacagttacctgcactcgctttacggacgaataccagttatatgaggacatcggaaagggtgcattcagtgttgtccgaaggtgcgtgaaattatgcacagggcatgaatatgccgctaagattattaacaccaagaaactcagcgctcgcgatcaccagaagctcgagcgagaagcccgtatttgtaggcttcttaaacacagcaatatcgttaggctgcacgactccatttccgaggaagggtttcattacctcgtttttgacttggtgaccggaggcgagctgtttgaggatattgtggccagggaatactacagcgaggctgatgcgtcccactgcatccagcagatcctggaggcggtgttgcattgtcaccagatgggagtggttcacagggacctgaaacctgaaaatctccttctggcgtctaagtgtaagggcgctgccgttaaattggccgattttggtcttgccattgaagtgcaaggtgatcagcaggcctggtttggctttgccggaacccccggttacctgtcccctgaagtcctgcggaaagaggcctacggtaagccggtggacatttgggcttgtggagtcattctgtatattttacttgttggctacccacctttctgggatgaggaccaacataaactgtatcagcaaattaaagccggagcgtatgatttcccctcccctgagtgggatactgtgacccccgaagccaaaaacttaatcaaccagatgttgactatcaatcccgctaagcgaattacggctcatgaggccctgaagcatccatgggtgtgccagcgttcaacagtggctagtatgatgcatagacaagaaactgtggaatgcttaaagaagtttaatgctcgtcgcaaactgaagggcgcaatattgacaaccatgctggcaacacgtaacttcagcgctgctaaatccttactgaataaaaaagccgacggcgtgaaacctcagactaactctacaaaaaatagcgccgcagccacatccccaaagggcaccctgccacctgctgctctggaaccacagactacagtgatacacaatccagttgacggtataaaggaatctagcgattcagcaaatacaacaatcgaggatgaggacgcgaaggctaggaaacaggagatcataaaaaccacagagcaactaatcgaggctgtgaacaacggagacttcgaggcctatgccaagatctgtgatccaggacttacatcttttgagcctgaggccctgggaaacctagtagaagggatggattttcaccggttttacttcgagaacctccttgcaaaaaactcaaaaccaattcacacgaccatattgaatcctcacgtgcacgtgattggtgaggacgcggcttgcatcgcctacattcggctcacccagtatatcgatggacaggggaggcctcggaccagtcagtccgaggagactcgcgtctggcatcgtcgggacggtaaatggcaaaatgtacattttcactgtagcggagccccagttgccccattgcagtag

SEQ ID NO: 216689 - DNA, 2001 bp, Artificial Sequence
  Description of Artificial Sequence: Synthetic coding sequence
atggccacgaccgtgacgtgcactagattcactgatgagtaccagctgtatgaagatatcggaaaaggagcattttccgtggtccgacggtgcgtcaaactatgtacgggccacgaatatgcagccaagataattaataccaaaaaactctcggcgagggatcaccagaagttggaacgggaagcccgtatatgccgactgttgaagcacagcaacatagtccgcctccacgattctatttcagaggaagggttccattatctcgtgtttgacctcgtgaccggcggagagttatttgaggacattgtggctcgtgagtactactcagaggctgacgcgtcgcactgtatccaacagattcttgaggcagtgctgcattgtcaccagatgggggtggtacatagggacttgaagcccgaaaacctgttattagcgtcaaagtgcaagggcgctgctgtcaaactcgctgattttgggcttgctatcgaagtgcagggcgatcagcaggcctggttcggctttgctggaacgcctggatacttatcccctgaggttttgagaaaggaggcttatggaaaacctgttgatatctgggcttgtggcgttatattgtacatcctgctcgttggatatcccccattctgggacgaggatcagcataaattatatcagcagattaaagctggggcttatgacttccctagccccgagtgggataccgtaactcccgaggctaagaacctgatcaaccaaatgctcactatcaatccagccaagaggatcactgcgcacgaggcattgaaacacccttgggtttgtcagagaagtaccgttgcctctatgatgcacagacaagaaaccgtggagtgtctaaaaaaatttaatgccagaaggaagctcaaaggtgcaatcctgactaccatgctggccacccgtaacttctctgtgggccgtcagacaacggccccagcaaccatgtcaacggctgctagtggcacaaccatgggtctggtagagcaggcgaagagcctgttgaataagaaagccgatggggtgaaaccacagactaacagtacgaaaaactcagcagcggctacatccccaaagggtaccctccccccagcggctcttgagcctcaaaccaccgtaattcacaatccggtagatgggatcaaggaatcaagcgacagcgcaaacacgactattgaggatgaggacgctaaagctccccgagtccccgacatcctttctagtgtacgtagaggatcaggagcaccggaggcggagggcccacttccctgcccaagtcctgccccattctctcctcttcccgcaccatcgcctagaatctctgatattctgaactctgtgcgcaggggatccgggaccccggaggcagaaggccctctgtcagccggaccgccaccttgtttgtctccggctctcctgggtcccctttcgtccccatcgcccaggattagcgacatattaaatagtgtgcggcgtgggagcgggacccccgaggccgagggtccatcacccgtggggcctccgccttgtccaagccctacgatccctgggcctcttcctaccccctcaagaaaacaggagattattaagactactgagcaacttatagaggccgtcaacaatggcgactttgaagcatacgctaaaatctgtgatccagggctgacatcgtttgaaccagaggccctcggcaacctcgtcgaaggcatggatttccaccgcttttacttcgagaacttgctggccaaaaactccaagcccatccacacaacaatcctaaacccgcacgtgcacgtcataggggaagacgccgcttgtattgcatatataaggctaactcagtacatcgatgggcagggcaggcctaggacttcacagtctgaagaaacaagagtatggcatagaagggacggaaaatggcagaacgtgcattttcactgcagcggagcccctgtcgcgcctctccagtag

SEQ ID NO: 216690 - DNA, 1629 bp, Artificial Sequence
  Description of Artificial Sequence: Synthetic coding sequence
atggccacaacagtcacatgcacacgctttactgacgagtatcagctctatgaggacatcggcaaaggagccttctccgttgtgaggcggtgtgtgaagctctgtacagggcacgagtacgctgctaagatcataaacactaagaaactcagcgcacgagaccaccagaagctagaacgtgaggccagaatttgtcggctccttaagcatagcaacatcgttagactacacgactccatcagtgaagagggcttccattacctagtgttcgacctggtgaccggcggtgagctcttcgaggacatcgtggctcgagagtattacagtgaggccgacgctagccattgtatccagcagattctagaagcagtgctgcactgccatcaaatgggcgtagtgcatcgggatctgaagcctgaaaatttactgctcgctagcaagtgcaaaggcgctgcagtgaagctcgcggactttgggcttgccattgaagtgcagggggatcagcaggcttggttcggcttcgcagggaccccgggatatctgagccccgaagtgctgagaaaggaggcttacgggaaacccgttgacatctgggcatgtggtgtgattctttatatcctgctggtgggttaccctccattctgggatgaggatcagcataagctgtaccagcagatcaaagctggggcatatgacttcccaagccccgagtgggacacagtaacccccgaagccaaaaacctcattaaccaaatgctgaccatcaatcctgccaaacggattacggctcatgaagcactcaagcatccatgggtctgccagcgaagtacagttgctagcatgatgcataggcaggaaactgtggagtgcctgaagaagttcaatgcgaggagaaagctgaagggggcaattctgaccacaatgctggctaccagaaactttagcgtaggcagacagactactgcaccagccaccatgtctaccgccgcatcagggacaacaatggggcttgtagaacaggccaagagcctcctcaacaaaaaggcggacggtgtcaaaccccaaaccaactcaactaaaaatagtgcggctgctacgtcacccaaaggaactctccctcctgcggcactggagccacagactacagtgattcataatccagtcgacggcattaaggagtcatctgacagcgcaaacaccaccatagaggacgaagatgccaaagcacgcaagcaagaaattattaagactacggagcagttgatcgaggctgtaaacaacggagattttgaggcgtatgctaaaatctgtgaccctggtctcacttcttttgaaccagaggcgttggggaaccttgtggagggcatggatttccataggttttacttcgagaacctcctcgccaaaaactcaaagcctatccacactaccattctgaatccccacgttcacgtcatcggggaggatgcagcatgcattgcatatattagactgacacaatatattgacggacaggggcgtcccagaacttcccagtctgaagagactcgcgtgtggcatcgccgagatggaaagtggcaaaacgtccactttcattgcagcggcgctcccgtggcccctcttcagtag

SEQ ID NO: 216691 - DNA, 1557 bp, Artificial Sequence
  Description of Artificial Sequence: Synthetic coding sequence
atggctactaccgtaacgtgcacccggttcaccgatgagtatcaactttatgaggatattgggaagggtgccttttcagttgtccgaagatgcgtaaaactatgtaccgggcacgagtacgccgctaagatcattaatacaaagaagttgtcagcgagggatcatcagaagcttgagagagaagcgaggatttgtcgactcctaaagcatagcaacatcgtccgcctgcatgacagtatttcagaggaaggtttccactatctagtgttcgatctagtaactgggggagaactcttcgaagatattgtcgctcgcgaatactacagcgaagccgacgccagccattgcattcagcagattttggaggctgtccttcactgccatcagatgggggtcgtgcacagagatcttaagcctgaaaacctccttctcgcatcaaagtgcaagggtgccgctgttaagctggcagacttcggactagctatcgaggtgcagggtgaccagcaggcttggtttggttttgctggcacccccggatacttatcccctgaagtgctgaggaaagaggcatacggaaagccagtggatatttgggcatgcggagttatcctatacattctgttggtcggctatccaccattctgggatgaggatcagcataaactctatcagcaaatcaaagcaggagcctacgatttcccaagcccagagtgggacactgtcacacctgaagctaagaatctcattaatcaaatgctgaccataaatccagccaagaggatcaccgcccacgaggctctgaaacatccttgggtgtgtcagcggtcaactgtcgcgtccatgatgcaccggcaggaaacagtggagtgtttaaagaagttcaatgccaggcgcaagttgaaaggcgctatcttaacaaccatgctcgctacaagaaattttagcgccgcaaagagcctcctcaacaagaaagccgatggggtgaaaccacagacgaacagtactaaaaactctgctgccgctactagtcctaagggaacgcttccacctgccgctttggaacctcagactaccgtgatacataacccagtggatgggattaaagagagctcagactccgctaataccacgatcgaggatgaggacgcaaaagctagaaaacaagagattataaaaacaactgagcaacttatagaggcagtgaacaatggagatttcgaggcttatgctaagatttgcgatcccggtctgacatcctttgaacctgaagcattagggaacctggtagaggggatggattttcacagattttactttgagaatcttttggcaaaaaactccaagccaattcacaccaccatacttaatccccacgtgcacgtgattggagaggacgcagcctgtatagcttatatcagattaacccagtatatcgacggccaagggaggcctcgtacatctcaaagtgaggaaactagggtctggcataggagggacggaaaatggcagaacgtgcacttccactgctcaggcgctccggtggctcctttacagtag

SEQ ID NO: 216692 - DNA, 918 bp, Artificial Sequence
  Description of Artificial Sequence: Synthetic coding sequence
atgggtgtcgtgcatagggacctgaagcccgaaaacctgctcctcgcatccaaatgcaagggagccgctgtgaaactggcagattttggcttggcgattgaagtgcagggtgaccagcaggcgtggttcggtttcgccggtacacctggttatctctctccagaggtgcttcgcaaggaagcttatggtaagccagtggacatctgggcttgtggagtgattctgtatattctgctcgtgggctatcccccattctgggatgaggatcagcataaactataccagcagatcaaggccggagcttacgattttccctcacccgaatgggacaccgttacccctgaagccaagaatttaatcaatcaaatgttgaccattaacccagccaagcggatcactgcccatgaagccctgaaacacccatgggtatgtcagcgttccactgtcgcctcaatgatgcatcgccaggagacagtggaatgcttgaagaaatttaatgcgaggaggaaactcaaaggagccatcttgacaaccatgctggcaacaaggaatttcagcgtcgggaggcagacaaccgccccagctacaatgagcaccgccgcttcgggcaccacgatgggattggtggagcaagccaaatccctgcttaacaagaaagctgatggcgtcaaaccccagaccaatagcaccaagaacagtgctgccgcaacttcacccaaagggaccttacctcccgctgcactggaaccccaaacaactgtgatccacaatccggtagatggcatcaaggagtcttccgacagcgcgaacactaccattgaggacgaggacgccaaagctcgaaagcaggagattattaagacaacggagcaattgatcgaggctgtgaataacggggatttcgaagcatatgcttag

SEQ ID NO: 216693 - DNA, 1437 bp, Artificial Sequence
  Description of Artificial Sequence: Synthetic coding sequence
atggcttctacaacgacatgtacgcgtttcacagatgagtatcagctcttcgaggaattgggcaaaggagccttctcggtggttaggcgctgcatgaagataccaactggtcaggaatacgctgccaaaatcattaacacaaagaaactgagcgcccgtgatcatcagaaactggaacgagaggcgcgaatctgtcggctgctaaaacatcccaacatcgtccgattgcatgacagtatcagcgaggagggatttcattatttagtgttcgatctggttaccgggggagaactgtttgaggacatagtggcgcgtgaatattactcagaggccgacgcttcccactgtattcagcagatcttggagtccgtgaaccactgccacctaaatggtatcgtgcatagggatctgaagcccgaaaatcttcttctcgccagcaaatcgaagggtgcagccgtgaaattggcagacttcggcctggctatagaggttcagggcgatcagcaggcatggtttggtttcgctgggacaccaggctatctctcacctgaagtactgaggaaagacccctacgggaaacctgttgacatgtgggcctgcggtgttatactctatatcttgcttgttggctatccccctttctgggatgaggatcagcaccgtctttatcaacagatcaaagctggcgcttacgatttcccatcgccggaatgggacacagtgacaccggaggcaaaggacttgatcaataagatgctcaccatcaacccggctaagaggatcacagcctcagaggccttgaagcacccctggatctgccagaggtccaccgtagccagcatgatgcaccgacaggagaccgttgactgtctgaaaaagttcaatgcaagacgaaagttgaagggagcaattctcacaaccatgttagccactcgaaatttcagcgccgctaagagcctgcttaagaagccggacggagtcaaggagtcaaccgagagctccaatacaacaattgaagatgaggacgtgaaggcccgaaaacaggaaattataaaggtcaccgaacagctcattgaagccattaacaatggcgattttgaggcctacaccaaaatctgtgatcccggactcaccgcattcgaacccgaggccctgggcaacctggtggaagggatggattttcacaggttttatttcgagaacgcgttgtcgaagtccaacaaacccattcacactatcatcctcaatccgcacgtgcacctggtcggagatgatgcagcttgtatcgcatacatacgccttacacagtacatggatggtagcggcatgcccaagaccatgcaatccgaggaaactcgagtgtggcacaggagagatggcaaatggcagaacgtccatttccaccggagcggatcccctactgtgcccatcaaatag

SEQ ID NO: 216694 - DNA, 1500 bp, Artificial Sequence
  Description of Artificial Sequence: Synthetic coding sequence
atggccagcactactacttgcacacgctttacagatgaatatcagcttttcgaagagctggggaaaggggctttcagcgtcgtaaggcgctgtatgaagatacctaccggacaagagtacgcagccaaaattatcaacacaaagaagctcagcgcgagagaccatcagaagttggagagggaggctagaatatgccggctgctgaagcacccgaatatcgtgaggctgcacgacagcatctctgaggaaggattccactacctagtctttgacctggtaacaggcggtgagctattcgaggatattgtggcaagagaatattactctgaggccgacgcttctcactgtattcagcaaatactcgaaagcgtaaaccattgccacttgaatgggatagtgcacagagacttaaagcccgagaacctactactggccagtaagagtaagggcgcagcagtgaagttagcagacttcggcctggctattgaggtccagggggatcagcaggcgtggtttgggttcgccggaacaccaggctacctcagccccgaggttctgaggaaggacccgtatggaaagccagtcgatatgtgggcttgtggtgtgattctgtatatcctgcttgtggggtatccccctttttgggatgaggaccagcatagactctaccagcagatcaaagccggagcttacgacttcccctcgccagaatgggacacagtgacgcctgaagccaaggacctgatcaataagatgctgactattaacccagctaagcgaatcactgcaagtgaggccctgaagcatccttggatttgccagcgctccactgtcgctagtatgatgcaccggcaggagacagtggattgcctcaaaaagttcaacgcgcgaagaaagttaaagggcgctattttgactacaatgctggctactaggaatttcagtgccgcaaagtcactcctgaaaaaacccgacggggtgaaagagtccacagaaagcagcaatacaacaatcgaggacgaagacgtgaaggctagaaagcaggaaataattaaggtcactgagcagctgattgaggcgattaacaacggcgatttcgaggcatacacgaagatctgcgatccaggcctgaccgctttcgaacccgaagcgctcgggaatttggttgaaggcatggactttcacagattttattttgaaaacgctttgagcaagtcgaacaagcctattcatacaataattctcaatccccatgtgcacctggttggagacgacgcggcatgcattgcttatatccggctgacccagtacatggatggatccggaatgccaaaaacgatgcaatcagaagaaacaagggtttggcaccggagggacggcaagtggcagaacgttcactttcatcgttctggctcccccacagtgcccatcaaacccccttgtatccctaacggcaaggagaacttctccggcggaacctctctgtggcaaaacatctag

SEQ ID NO: 216695 - DNA, 1437 bp, Artificial Sequence
  Description of Artificial Sequence: Synthetic coding sequence
atggcctctacgacgacctgtacaagatttaccgacgaataccagctgttcgaggagctgggtaaaggcgctttcagcgttgtgagaaggtgcatgaagattccgaccggtcaggaatacgctgccaaaatcatcaatacaaaaaaactcagtgcccgagatcaccagaagctggagagagaggccagaatctgccgtcttctcaagcaccccaatatcgtaaggctacacgatagcatctccgaagagggttttcactacctggtatttgatcttgtgaccggtggtgagttgttcgaagatatcgtcgcgagggagtactattcagaagccgatgcaagccattgtatacaacagatccttgagagtgtcaaccattgtcatttgaatgggatagtgcacagagatttgaaacccgagaatcttcttctggcaagtaaaagcaaaggagccgcagtcaaactggccgatttcggcttggctatcgaggtccagggggaccagcaggcgtggttcggtttcgccggtaccccaggatacctgtctcccgaggtcctacggaaagacccttacgggaaaccagtcgacatgtgggcgtgtggagtaatcctgtacatcttactagttggatatccgccattttgggacgaggaccagcatcgactgtaccagcaaataaaggccggtgcttacgacttccccagtccggaatgggacactgtgacgccggaggccaaagacctaatcaacaagatgcttactatcaacccggctaagaggataacggccagtgaggccctgaagcacccatggatttgtcagaggtctaccgtggcgtcaatgatgcacaggcaagaaactgtggattgcctgaagaaatttaacgccagaagaaagctgaagggcgcaattctcaccaccatgctcgctaccaggaacttttcggccgcaaaatccctgcttaagaagcctgacggcgtgaaagaaagtactgagagcagtaataccaccattgaggatgaagacgtcaaggcccgaaaacaggaaatcatcaaagtcaccgaacagttgatagaagctatcaataacggggactttgaggcgtatacaaaaatctgtgatcctggactgactgcattcgaaccagaggccctgggcaatctggtagaggggatggatttccacaggttttattttgagaatgcgctttcgaaaagcaataaaccaattcacacgatcatcctcaaccctcacgtccacctggtcggcgatgatgcagcttgtatagcttatattcgtctgacacagtacatggacgggagtggtatgccaaaaaccatgcagagcgaagagacacgggtatggcatcgcagagatggcaaatggcagaacgtgcactttcacaggtccggatcacccaccgttcccatcaagtag

SEQ ID NO: 216696 - DNA, 1479 bp, Artificial Sequence
  Description of Artificial Sequence: Synthetic coding sequence
atggccagcactaccacatgcactcggtttacggatgaataccagctgtttgaagagttgggtaaaggcgctttcagcgtggtccgcagatgcatgaaaattccaaccgggcaggaatatgccgcaaagatcattaacacgaaaaagctaagcgcacgggaccaccagaaactcgaaagggaagcgcgaatctgtcgcctgttaaaacacccaaacatcgttcgccttcacgactctatttcagaagaaggatttcattatctagtgttcgatctcgtgacagggggtgaattgtttgaagatattgtggccagggagtactacagcgaagctgatgcatctcattgcatacagcagattttggaaagcgtgaatcattgccacctcaacggcattgtgcacagggacctgaaaccggaaaacctgctgctggcttccaaatctaagggggcagcagtgaaactcgctgatttcggactggctatcgaagtccagggcgaccagcaggcctggtttggattcgccggaacacctggttatctcagccctgaggtgttgcggaaagacccctatggcaagcctgttgatatgtgggcctgcggggtgatattgtacatcctgctcgtgggttatcccccattttgggacgaggatcaacacagactgtaccagcaaattaaggctggtgcatatgactttccctcaccagaatgggataccgtcacccccgaagctaaagatcttataaataaaatgctgactatcaatccagcaaaacgcataaccgcttctgaagcactcaagcatccctggatttgccagagaagcacagttgcctctatgatgcatcggcaggagacagtggactgcctgaaaaagtttaatgccaggcgcaaactcaaaggtgcgattctgactacgatgctggctacaaggaattttagcgctgctaaatcactgttgaagaaacccgatggcgtgaaagagccacaaaccaccgtaatccacaacccggatggcaataaagaaagcacggagtcttcaaataccacaattgaggacgaggacgtgaaggctaggaagcaggagatcataaaagttactgaacagttgattgaggcgattaataatggtgacttcgaggcttatactaagatctgcgatccaggacttaccgcgttcgaacctgaagcgcttggaaatttagtcgaaggaatggatttccatcgcttttactttgaaaacgccctttcgaagtccaataagccaatacacaccatcatcctgaatccacacgtgcacctggtgggagacgacgccgcttgtattgcatatatccgcctgacccagtacatggacggctccgggatgccgaaaaccatgcagagcgaggagacgcgtgtctggcaccgtagagatggcaaatggcagaatgtgcactttcaccggagcggctctccaaccgttcctatcaagtag

SEQ ID NO: 216697 - DNA, 1533 bp, Artificial Sequence
  Description of Artificial Sequence: Synthetic coding sequence
atggcaagcaccacgacttgtactaggttcaccgacgaataccagctgttcgaggaactgggcaaaggtgcattttctgtggtacggaggtgtatgaaaatccctaccggccaagagtatgctgcgaagatcatcaacactaagaagctgtccgcacgcgatcaccaaaagctggagcgcgaggccaggatttgtcgactgctgaagcaccccaatatcgttaggctgcacgatagcatcagcgaagagggttttcactatctcgtatttgatttagtcaccggtggtgaattattcgaggatattgtggcccgtgaatattactctgaggcagacgcctcgcactgcatccagcagatcctcgaatcagtgaaccactgccatcttaatggaattgtgcacagggatctgaaacccgagaacttactcttggcatccaagtccaaaggagcagccgtcaaattagctgattttggacttgccatcgaggttcaaggagatcaacaggcttggttcggcttcgccggaaccccaggctatctgtcacctgaagtgctgaggaaagacccctatgggaagcccgtggatatgtgggcctgtggggtcatcctgtacattctcctagttggttacccgcctttctgggacgaggaccagcatagactgtaccaacagattaaggctggggcatacgactttccgagccccgaatgggacactgtgaccccagaggccaaagacctgattaataagatgttgaccatcaatccggcaaaaagaataactgccagtgaagccctgaagcacccctggatttgtcagcggtcaacagttgcttccatgatgcatagacaggaaaccgtcgattgtctgaagaaatttaacgcaagacgaaagttaaagggtgctattttaaccacaatgcttgctactcgaaattttagcgccgcaaagagcctcctgaagaagcctgacggagttaaaaaaaggaagagtagtagctctgtgcagatgatggaaagcaccgaatccagtaacacaactatcgaagacgaagatgttaaagcgcgtaaacaggaaattattaaggtgacagagcagttaatcgaggctataaataacggtgactttgaagcttataccaagatttgtgatcccggactaactgcctttgagccagaggccctgggaaatcttgtggaaggcatggacttccacagattctactttgagaacgcgctcagcaaaagtaacaagcctatccatactattatcctcaatccacacgtgcatctggtgggagatgacgcagcctgtattgcatacattagactcacacagtacatggacggatccggaatgccgaagactatgcagtctgaagaaacccgtgtttggcatcggagggacggaaagtggcagaatgtgcatttccaccgctcagggagccccaccgtgccaatcaagccgccatgtattcccaatggaaaagagaacttctccggcggaaccagtttgtggcaaaatatctag

SEQ ID NO: 216698 - DNA, 1542 bp, Artificial Sequence
  Description of Artificial Sequence: Synthetic coding sequence
atggcctctacaacgacctgtacccgcttcacagacgaatatcagctctttgaggagctcggtaaaggagcgttctcagttgtgcggaggtgtatgaaaatacccactggccaggagtacgcggcaaaaatcataaacaccaagaagttaagtgcccgagatcatcaaaagttagaacgggaagccagaatttgccgcttgctcaaacaccctaacattgtccggctccatgactctatcagcgaagaaggcttccactatcttgtgttcgatctggtgaccggaggagagctctttgaggatatcgttgccagggagtattatagcgaagcagacgcctcgcactgtatccaacagatactcgaatccgtcaatcattgccacttaaatgggatcgtccacagggacctgaagccagaaaacctgctcctggcgtccaagtcgaaaggtgctgccgtaaagctggccgatttcggcctcgcgattgaggttcagggagatcagcaagcatggtttggcttcgccggtaccccgggatacctgtcacccgaggtcctgaggaaggacccttatggcaagcccgtcgatatgtgggcctgtggcgtaatactttatatcttactggtgggatacccccctttttgggatgaggaccagcacagactgtatcagcagatcaaggctggggcttacgacttcccatccccagaatgggacaccgtaaccccggaggcaaaagatctaattaacaagatgctgacaataaatccggcaaaacggattacagcttctgaagccctgaagcatccctggatttgccagagaagcacagtggctagcatgatgcaccggcaagaaaccgtggactgcttaaaaaagtttaatgcacgccgtaaacttaaaggcgctattctcaccacaatgctggcaactcggaacttcagcgcagcaaagtcgctcctaaaaaagcctgatggagtcaaagagccacagacgacagtgattcacaatcctgatggtaacaaggaatccacggaatcatcaaataccaccatcgaggacgaagacgtaaaggctaggaagcaagagatcatcaaagtcacagaacagctcatagaagcgatcaacaacggcgacttcgaggcttatacaaagatctgcgatcccggactgactgcattcgaacctgaggccctgggaaatctcgtcgagggaatggatttccacaggttttatttcgaaaatgcgctgtcgaagagcaacaaacctatccatacaatcattctaaacccacatgtgcacctcgtgggcgatgacgccgcttgtatcgcatatattcgtttgacacaatatatggacggatctggcatgcccaagacaatgcagtctgaagagacacgggtgtggcacagacgggatgggaagtggcaaaacgtccattttcatcgcagcggctccccgacagtacccattaagccaccatgtattcccaacggaaaggagaatttcagcggagggacctctctgtggcagaacatctag

SEQ ID NO: 216699 - DNA, 1560 bp, Artificial Sequence
  Description of Artificial Sequence: Synthetic coding sequence
atggcttccacgaccacgtgcacacggttcacggatgagtatcagctgttcgaagagttgggcaaaggcgcttttagcgtcgtgaggcgctgcatgaagattccaaccggccaggagtatgcagctaaaattatcaacactaaaaagctctccgccagggaccaccaaaaattagaacgagaggcaagaatttgccgacttctgaaacatccaaacatagtaaggttacatgactctatctccgaagagggctttcattatttagtctttgatttagtaaccggcggagaacttttcgaggacattgttgccagggaatactactcagaagcggatgcctcacactgcatccaacagattttggaaagcgtgaatcactgccacctcaacggtattgtccaccgcgacttgaaacctgagaacctgctgcttgcatcaaagtccaagggggctgccgtgaagttggcagacttcggactggccatcgaagtacagggtgaccagcaggcgtggttcggttttgcaggcactccaggctatctaagccccgaagtgcttcggaaggatccttacggcaagccggtggatatgtgggcatgcggagtgatactttatattttgctggtaggctacccaccgttctgggatgaggaccagcaccggctgtaccagcaaatcaaagctggggcttacgattttcccagtccggagtgggatactgtgaccccagaggcgaaggaccttattaataaaatgctgaccatcaacccagccaaaagaattaccgcgtctgaggccctgaagcacccgtggatatgtcagaggtctacagtggcatctatgatgcaccgtcaggagacagtagactgtctaaagaagtttaacgctaggcggaagttaaaaggggctatactcacaacaatgctggccaccaggaatttcagcgctgcgaaatcccttctgaaaaagcctgatggtgtgaagattaacaataaagcgaatgtggttacaagccccaaggaaaatattcccacacccgctttggaaagtactgagtcttcgaacaccaccatcgaggacgaggacgtaaaggcgaggaagcaagagattattaaggtgaccgagcagcttattgaagctattaacaacggtgacttcgaagcctatacaaagatatgcgacccaggactgactgcatttgaaccagaggcgctaggaaacctggtggagggaatggatttccaccgcttttattttgaaaacgccctgtcaaaatccaacaagcctatacatacaataattctaaatcctcacgtgcatctcgtcggcgacgacgcggcatgcattgcttacatcaggttaacgcagtatatggacggtagcggcatgccaaagaccatgcagtcagaggagaccagggtgtggcaccgtcgagacggaaagtggcagaacgtgcactttcatcgaagcgggtctcctaccgtgcccatcaaacccccttgcattcccaacggaaaggagaatttctccggcggtacaagcctgtggcagaatatttag

SEQ ID NO: 216700 - DNA, 1575 bp, Artificial Sequence
  Description of Artificial Sequence: Synthetic coding sequence
atggcctcgacgaccacctgcacgcggtttactgatgagtatcagttgttcgaggaactggggaaaggggctttttcagtggtgagaaggtgtatgaaaatccctaccggccaggagtacgcggctaagatcatcaatacaaaaaaactatccgccagggatcaccagaaactcgagcgcgaggccagaatttgtaggctgctgaagcacccgaatatcgtgcgcttgcacgattccatctccgaggaggggtttcactatctggtctttgacctggttactggaggggaactgtttgaggacattgttgcgagggaatactactctgaggctgatgcttcgcattgcattcaacagatactcgagagcgtcaatcactgtcacttgaatggcatcgtgcatcgggatcttaaaccagaaaacctgctgttagcttccaaaagcaagggcgcagctgtgaagttggctgactttggcttggctatcgaagtgcaaggggatcagcaggcgtggttcgggttcgccggtacacccggttatttatcgcccgaggtgctaaggaaggacccctacggaaaaccagtggacatgtgggcctgcggcgtgattctgtacatcctgcttgttgggtatccccctttctgggacgaagatcaacataggctgtatcagcaaatcaaggcaggtgcctatgattttccctctccagaatgggacacagttacgccagaggcgaaggacctgatcaataaaatgctgactattaacccagccaagcgcatcactgccagcgaggctcttaagcatccctggatttgccagaggagtactgtggctagtatgatgcatcggcaagaaaccgtagactgcctgaagaagttcaacgctcgccgaaagctgaagggcgcaatcctgacaacaatgctggctactcggaacttttctgctgccaaatccctccttaaaaagccagacggagtcaagaaacgaaaatctagtagcagtgtgcaaatgatggagcctcaaacgacagtcatccacaatccggacggaaataaagagtctacagaatcctctaacacaactatagaagacgaggacgttaaggcccgaaagcaagagatcatcaaggtgaccgaacaacttatagaagcaatcaataatggggattttgaggcctacaccaagatctgcgacccgggactcacagctttcgaacctgaggcgcttgggaatctggtcgagggcatggactttcataggttctatttcgagaacgccctgagcaagtcaaataaacccattcataccattatcctcaatccacatgtccatctggtcggagatgacgccgcatgtatcgcctacatacgactgacgcaatacatggatggaagtggcatgcccaagactatgcagagcgaagaaacccgagtctggcaccgaagggacggtaaatggcagaacgtacactttcataggagcggatctccaactgtgcctataaagccaccttgcatacccaacggcaaggaaaacttttcaggcggaacctctctctggcagaatatatag

SEQ ID NO: 216701 - DNA, 1470 bp, Artificial Sequence
  Description of Artificial Sequence: Synthetic coding sequence
atggcttctaccaccacgtgcactcggttcacggacgagtatcagcttttcgaagagctggggaagggtgcatttagtgtggtgcggaggtgcatgaaaattcctactgggcaggaatatgctgcaaagatcataaacaccaaaaagctgagcgcaagagatcatcaaaaactcgaaagagaggcaagaatctgtagattattgaagcaccccaatatagttcggctgcatgactcaatttctgaggagggtttccattacctcgtgtttgatctggtgactggcggtgagttattcgaggatatagtcgccagggagtactacagcgaggcagacgcgtcccactgcatccaacagatactagagtctgtgaaccactgtcatctgaacggcatagtccaccgagatcttaaaccggagaatttactgcttgcaagcaaaagcaagggcgcagccgtgaagcttgccgattttggtctcgctatcgaggtgcagggcgatcagcaggcctggttcggattcgcaggcaccccagggtatctgtcacctgaggtcctgcggaaagacccctatgggaagcctgtcgatatgtgggcttgcggggtgatcttatatatcctcctggtgggatacccacctttctgggacgaagaccagcatagattgtaccagcagatcaaagccggagcctacgactttccatctcccgaatgggatacagttacaccggaggctaaagacttgattaataaaatgttaactatcaacccagccaagcgaattactgctagcgaagccctaaagcacccctggatctgccaaaggtcaactgtggcgagcatgatgcacaggcaggagaccgtggattgcctgaagaagttcaacgccagacgcaaacttaagggagccatcctgaccactatgcttgctacccgcaacttcagcgccgctaagtccctcctgaaaaaacccgatggagtcaaaaaaaggaaaagctcctcctcagtgcagatgatggagagcaccgaatctagtaacaccaccatcgaagacgaggacgtcaaagctaggaagcaagagatcatcaaagttaccgagcagctgattgaggctatcaataacggcgacttcgaggcctatactaagatctgcgatccagggctcaccgccttcgaaccagaggccttaggaaatctggttgaggggatggatttccatcggttttattttgagaatgccctgtcaaaatcaaataaacccattcacactatcatccttaacccccatgtacatcttgtcggcgatgacgctgcctgcatcgcttacataagactcactcagtatatggacggaagcgggatgcctaagaccatgcagagtgaggagacccgtgtgtggcaccgacgtgacggaaagtggcaaaatgtgcactttcaccggagcggcagccccaccgttcccattaaatag

SEQ ID NO: 216702 - DNA, 549 bp, Artificial Sequence
  Description of Artificial Sequence: Synthetic coding sequence
tgacgcaaactcaagggtgcaattctcactaccatgctcgctaccagaaacttctctgccgctaaatctctgctaaaaaaaccagatggtgttaaggaatccacagaaagcagcaataccactattgaggatgaggacgtgaaagccaggaaacaggaaatcatcaaggtgactgaacagctgattgaggctattaacaatggggattttgaagcatacacaaagatttgtgatccaggcctcacggcgttcgagccagaggccctggggaacctggtggaagggatggatttccaccgattttattttgaaaacgctctgtcaaaatctaacaagccaatccacactattatcctgaaccctcacgttcacctggtgggcgatgacgctgcatgtattgcctacataaggctcacacagtacatggatggctcaggcatgcctaaaaccatgcaatccgaggaaactcgcgtgtggcacagacgcgatgggaagtggcagaatgtacactttcatcgtagcggtagcccaacggtacctatcaaatag

SEQ ID NO: 216703 - DNA, 1437 bp, Artificial Sequence
  Description of Artificial Sequence: Synthetic coding sequence
atggctagcaccacaacgtgcactaggtttaccgatgagtaccaactattcgaggaattagggaagggagccttttccgtggttagacggtgtatgaagatacctacagggcaagagtacgccgcaaagatcatcaatactaaaaaactctcagcaagagaccaccagaagctcgaacgcgaggccaggatctgtcggttattaaaacacccgaacatcgttcgcctccatgacagcatctcagaggaaggatttcactatctcgtgttcgacctggtgacaggaggagaactgtttgaagacatcgtcgcacgggaatattattccgaagctgacgcatctcattgcatacagcagatcttggaatctgtgaaccactgtcaccttaatggaatagtccatagagatctcaaaccagaaaatttactgctggcctcaaaatccaagggagcagccgtgaagctggcagacttcggcctagctattgaagtccagggcgaccagcaggcttggttcggctttgccggaacaccgggatatcttagccccgaggtcttacgtaaggacccatacgggaaacctgtcgatatgtgggcctgcggagtcatcctgtatatattattggtagggtatcctcctttctgggacgaggaccagcaccgactgtaccaacagataaaagctggggcttacgacttccctagtccagagtgggataccgtgacaccagaggctaaggatctcatcaacaagatgctgacaataaaccccgctaagcgcatcacggcctccgaggccctcaaacatccatggatctgccagcgctcaacagtggccagcatgatgcaccgacaagagacggtagattgtctcaagaagttcaacgctcgaaggaagctgaagggcgctatccttacaacaatgctggcaacacgaaacttttcggctgcaaagtccttgttgaaaaagcccgacggcgtgaaagagagtactgagtcaagcaacactaccatagaagatgaggatgtcaaagctcgtaaacaggagatcatcaaagtgaccgagcagttgatcgaggctattaataacggcgacttcgaggcatacacaaagatctgcgatcccggtctgaccgcctttgagcccgaggcactgggcaatttggttgagggcatggactttcaccggttttactttgaaaacgccctgagtaagtccaataagccaatccataccatcattttgaacccccacgtgcacctggtcggggacgatgccgcttgtattgcctatataagattaacacagtacatggacggtagcggtatgccgaaaaccatgcagagtgaggaaaccagagtctggcatcgacgagatggaaaatggcaaaatgttcactttcatcgctccggcagtccaacagtgcctattaattag

SEQ ID NO: 216704 - DNA, 1590 bp, Artificial Sequence
  Description of Artificial Sequence: Synthetic coding sequence
atggccaccaccgctacttgcaccagatttaccgacgactaccaacttttcgaggagctgggcaagggcgcattctctgttgtgcgtaggtgcgtgaaaaaaacctcgactcaagagtacgccgctaagattattaatactaaaaagttatcagccagagatcaccaaaaattggaaagggaggcccgtatctgcagactgctgaaacatcccaatatcgtgaggcttcatgactctatcagtgaagagggctttcactacttggtctttgacctggttacaggaggagaactgtttgaggatattgtggctcgcgaatactacagtgaggcagacgcctcgcactgtatccaccaaattctcgaaagtgtcaatcatatccatcagcatgatattgtgcacagagatctcaaacctgaaaatctgctcctggctagcaagtgcaagggtgccgcagtcaagctagcagactttggactggccatagaggtgcaaggtgaacagcaagcctggtttgggttcgcgggaacccccggataccttagcccagaagtgttgcgtaaggatccctatgggaaacctgtggacatttgggcatgtggggtgatcctctatatcctgctcgtgggctacccacccttctgggatgaagaccaacacaaattatatcagcaaattaaggccggagcatacgacttcccttccccagaatgggacacagtgacacccgaggctaaaaacttgataaatcagatgctaacaatcaatcctgcgaagcgcataaccgcggaccaggccttaaagcacccctgggtctgccagcgatcaacggtcgcttctatgatgcaccggcaagagactgttgagtgcttgcgcaaattcaatgccaggaggaagttgaagggagcaatccttacaacgatgctcgtgtccagaaatttttctgccgctaaaagcttgttaaataagaagtccgacgggggagtcaagaaacgcaagagtagttcgtccgtgcatctgatgccccagtctaacaataaaaacagcttggtgtccccggcacaagagcccgcaccccttcagaccgctatggaaccacagacaactgtggtgcacaacgcgaccgatggtatcaaaggttctaccgaatcatgcaacactaccactgaggatgaagacctgaaagtgaggaagcaggaaatcatcaagatcaccgagcagttgattgaagctatcaataacggggactttgaagcctacacgaaaatctgcgatccaggcttaacttctttcgaacccgaggccctgggcaatcttgtggaaggaatggactttcataagttttacttcgaaaacttactcagcaagaactcaaaaccgatacatactactattctgaaccctcacgtgcacgttatcggagaggatgccgcatgtatcgcctatatccggctcactcagtatattgacggtcaggggcgtcccagaacaagtcaatcggaggagactagggtgtggcatcgcagggacggaaagtggctcaatgtccattaccactgttccggggctcccgctgcaccattgcagtag

SEQ ID NO: 216705 - DNA, 1584 bp, Artificial Sequence
  Description of Artificial Sequence: Synthetic coding sequence
atggccacaacagcgacctgcacacgctttactgatgactaccagttatttgaagagctgggtaagggcgcattcagcgtggtgcggaggtgcgttaagaaaacctccactcaggagtatgctgccaaaataataaacactaaaaagcttagtgcacgggatcatcagaagctagagagggaggctcggatctgtagactcctgaagcatcccaacatcgtccgcttacatgacagtattagtgaagaagggtttcattacttggtgtttgacctggtcaccggaggcgaattatttgaagatattgttgctagggagtactacagcgaggccgacgcgtcccactgtattcatcagattttggaatctgtgaatcacattcatcaacacgatattgtgcatagggatttgaaacccgagaacctgctgctcgcatccaagtgcaagggggcagcggtaaaactggctgacttcgggttagccatagaagtccagggagaacaacaggcttggttcgggtttgctggaacgccaggctaccttagccccgaggtactcaggaaggacccctacggcaaaccagtggacatttgggcgtgtggggttatattatatatccttctggtcggctatcctccattttgggatgaagaccagcacaagctgtaccagcagataaaagcgggagcgtatgactttccaagtccagagtgggacacggtcactcctgaggccaagaacctgatcaaccagatgttgactatcaacccagcaaagaggattacggcagaccaagcccttaagcacccctgggtgtgccagcgatccacagtggcaagcatgatgcacagacaagaaaccgtcgagtgcttgagaaagttcaacgctcggagaaaactgaaaggcgcaattcttacgactatgctggtttcccgcaacttctcagtgggaagacaaagctccgcccctgcctcacctgctgctagtgccgcaggcttagccggacaagcggcaaaaagcctcctgaataagaagtccgatgggggagtcaaaaaaagaaaaagtagtagctccgtgcatctaatggaaccacaaaccactgtcgtccacaatgccaccgacggcatcaaaggctcaacagaatcatgcaatacgactactgaggatgaagatctgaaagtgcgaaaacaggaaattattaagatcactgaacagttgatcgaggcaatcaacaatggggattttgaggcgtatactaaaatctgtgaccccggtttgacatcctttgaaccagaagctttgggtaatctggtcgagggaatggacttccataagttctacttcgaaaatctcttgtccaagaatagcaaacctattcatacaaccatcctgaaccctcacgtacacgtgattggtgaagacgccgcttgcatcgcctacatccggctgacccagtacatcgacggacagggcaggccccgaacttctcagagtgaggaaacccgcgtgtggcatagacgcgatggcaaatggctgaacgtgcactaccattgcagcggggctccagctgctccgttgcagtag

SEQ ID NO: 216706 - DNA, 1671 bp, Artificial Sequence
  Description of Artificial Sequence: Synthetic coding sequence
atggcgactacagctacctgcacacggtttacagacgactatcaattgtttgaggaactgggcaaaggtgctttcagcgtcgtgcgcaggtgtgtgaagaagacctctacccaagagtacgcagcgaaaatcataaatacgaaaaaactctctgctcgagaccaccagaaattggagagggaggccagaatttgcagacttctcaagcatcctaacatcgttcgactgcatgactccatctcagaagagggcttccactacctcgtgttcgatttagttaccggaggagaactctttgaggacatagtggccagagaatactattccgaagccgatgcctcccactgtatacatcagatacttgagagcgtgaaccacatacaccagcacgacatagtgcaccgggaccttaagccggaaaatctactgcttgcctctaagtgtaagggcgcagctgtgaaactcgccgatttcgggctcgcaatcgaagtgcagggcgagcaacaggcctggtttggctttgccggaaccccaggctacctttctccagaggtgctgcgcaaagacccatacggaaaaccagtagatatctgggcatgcggtgtgatcctgtacatcctgctcgtcgggtatccacccttttgggatgaggatcagcataaactctatcagcagattaaagcaggcgcttatgacttcccttcgccggagtgggacacagtcacacccgaagccaaaaatttgatcaaccagatgttgacgatcaatccagccaagagaattactgcagaccaggctctgaaacacccttgggtatgtcagagaagcactgtggccagtatgatgcacagacaggaaacagtggaatgcctgcgaaaattcaatgcaagacgcaaattgaagggagccatattgactaccatgctggtgtcgagaaatttttcggcggctaaaagccttctcaacaaaaagtccgacgggggtgtgaagccccagtcaaacaataaaaactcattggttagccccgcacaggagcctgctccactccaaactgcaatggaaccccagaccaccgtcgtccataacgccaccgatggtatcaagggaagcacagaaagttgtaataccaccacagaagacgaagacctgaaagccgctcctcttcggacaggcaatggatcttctgttcctgagggcaggtcttccagagaccggacagccccatctgccggaatgcagcctcagcctagtctgtgctcctccgccatgcgcaagcaggagatcattaagatcacagaacagttaattgaagccatcaataatggcgacttcgaggcttatactaaaatctgcgatccaggactgacaagcttcgagcccgaggctctggggaatctcgtggagggtatggacttccacaaattctattttgaaaacctgttgtccaagaactccaagcctattcatactactatactgaatccccacgtgcacgtaattggtgaagatgccgcatgcatagcctacatccgcctcacacagtatatcgacggacagggcagacctcggacatctcagagtgaggaaacccgagtgtggcataggcgggacgggaagtggcttaacgtgcactaccattgcagcggcgcacctgcagctccactccagtag

SEQ ID NO: 216707 - DNA, 1488 bp, Artificial Sequence
  Description of Artificial Sequence: Synthetic coding sequence
atggctacaactgcgacgtgcacgcgctttaccgatgactaccagctgtttgaggaattagggaagggcgcattttccgtcgtgaggaggtgcgtaaagaagacaagcacccaggaatacgcggctaaaataataaatacaaaaaagctgtccgcgagagatcaccagaagctagagagggaggccagaatctgcaggctgctgaagcacccaaacatcgttaggcttcacgattccattagtgaagagggattccactacctagtgttcgacctcgtcaccggaggcgagctgttcgaggacatcgtggccagagagtattactccgaagctgatgcctcccattgtatccaccagatcctggaatccgttaatcacatacatcagcatgatatcgtccacagagatctcaagcccgaaaacctgttacttgcatcaaaatgcaaaggtgctgctgtgaagctcgcagacttcggtctggcgatagaggtccaaggcgaacagcaagcatggtttggattcgcaggaacacccggatatctctcccctgaggttctccgaaaggacccttatggcaagcctgtggatatatgggcttgtggcgttatactttatatcctcctggtagggtaccctcctttttgggacgaagaccaacacaagctttaccagcagattaaggctggggcttacgacttccctagcccagaatgggacaccgtgacccccgaagcgaagaatcttatcaatcaaatgctaacaattaatcctgccaagaggatcacagccgatcaagcacttaagcatccctgggtttgtcagagatctacagtggcttccatgatgcacagacaggagactgtggaatgcctgagaaagttcaatgcacgaagaaagctgaagggtgcaatactgaccacaatgctagtaagtagaaacttttctgccgctaaatcacttctaaacaagaaatctgatgggggagttaaggagccgcagacaactgtggtgcataatgcaactgacggtataaagggatccaccgagtcatgcaacactaccaccgaggacgaggatttgaaggtgagaaaacaggaaattattaagattacggaacagcttattgaagccataaacaatggagactttgaagcttacacaaaaatttgtgatcctggcctgaccagcttcgagccagaagcgctggggaacctggtggaagggatggactttcacaaattctacttcgagaatttactgtctaagaacagcaaaccgatccacacgacaatcttaaatccccacgtgcacgtcattggcgaggatgctgcatgcattgcttatattaggttgacccagtacattgacgggcagggtcgtcctcgaacctcccagtccgaggagacgcgcgtctggcaccgcagagacgggaagtggctgaacgtgcactaccattgcagtggggctccggctgccccattacagtag

SEQ ID NO: 216708 - DNA, 1551 bp, Artificial Sequence
  Description of Artificial Sequence: Synthetic coding sequence
atggccaccacggctacctgtacccgttttacggatgattatcaactgtttgaggaattgggcaagggagccttttcagtcgtccgtcgatgcgttaagaagactagtactcaggaatacgctgcgaagattatcaacacgaagaagctatccgctcgagatcatcagaaactggagcgggaagccagaatatgccggctgctgaagcacccaaatatcgtaagacttcatgattcgatctcggaagaaggctttcactatcttgtgttcgacttggtgacaggaggggagctctttgaggatatcgtggccagggagtactattctgaagcggacgcgtcccactgcattcatcagatcttagagtccgtgaatcacatccatcagcatgacatcgtccatcgggacctgaagcccgaaaatctgctgttggctagcaaatgtaaaggcgctgccgtgaaactcgccgacttcggacttgcaattgaggttcagggcgagcaacaagcttggttcggcttcgctggaacacctggatatctgtcgcccgaggtgctgcgcaaggatccttatggaaaacctgtggatatttgggcctgcggggttattctctatattcttctggtgggttacccacccttttgggatgaggaccagcacaagctgtatcagcagatcaaggcaggagcctatgatttccccagccctgagtgggacaccgttacacctgaggctaagaacttgattaaccagatgctgacaattaacccagcgaaaaggattactgccgatcaggctctgaagcatccttgggtttgtcagcgatccacggtcgcttctatgatgcatcggcaggaaaccgtagagtgtttgcgcaaatttaatgcaaggcgaaaacttaaaggagccatcttaacaacgatgctggtctccagaaactttagcgtcgggcgacagtcttcggcaccagcatctcccgctgcttctgcggctggtctggccggtcaggccgctaaaagtctgttgaacaagaagtccgatggcggagttaaggaaccacagactacagtggtccataatgccacagacggtattaagggtagtaccgagagctgtaatacgaccacagaagatgaagacttgaaggtccggaaacaagagattatcaagatcacggagcagctgatagaggccatcaataatggcgacttcgaggcctacactaaaatctgcgatccaggattgacatccttcgaacctgaggcactgggcaacctggttgaaggtatggatttccacaagttctatttcgagaatctgctctccaagaattctaaacccatccacaccactatcctgaatccacacgtgcatgtcatcggtgaagatgccgcatgtatcgcctacatcagactcacccagtacatcgatgggcaaggtcgccctcgaacatctcagtctgaagagacccgggtctggcatagaagggatgggaagtggctgaatgtccactaccactgttctggtgcgcctgccgcacccctccagtag

SEQ ID NO: 216709 - DNA, 1602 bp, Artificial Sequence
  Description of Artificial Sequence: Synthetic coding sequence
atggcaacaaccgccacatgtacaagatttacagatgattaccagctcttcgaagagttgggcaagggcgctttctctgttgtgcggagatgtgtcaaaaagacatctacgcaggagtacgcagcaaaaattatcaatactaaaaaattgtcagcaagagaccaccagaagctggaaagggaggcccgtatctgcagactgcttaaacatcctaacatcgttagactccatgactcaatatccgaggaaggattccactatctggtatttgatctggtgacagggggtgagctgtttgaagacatcgtagcccgtgaatactacagtgaggccgatgccagccactgtatccaccaaatcttagagtcagtgaaccatatccaccaacacgatatcgtgcacagagatctgaagccagagaaccttttgttggcaagcaaatgtaaaggtgcagcagttaaactggctgattttggactggcaattgaggtccagggggagcagcaggcttggttcggtttcgccggaaccccaggctacctcagtcctgaagtcctcaggaaagacccgtacggaaaaccagtggacatatgggcctgcggggtaattctctatatcttgctggtgggctacccgcctttctgggacgaggaccagcacaaactataccagcagatcaaggccggagcttacgatttccccagcccggagtgggacaccgtgactccagaggcaaagaacctcattaatcaaatgcttaccatcaaccccgctaagaggatcacggccgatcaggctctcaaacatccgtgggtatgccagagatccaccgtggccagcatgatgcaccgccaggagactgttgaatgccttagaaaattcaacgcacgccgaaagttaaaaggagcaattctgacaaccatgctcgtgtcaaggaacttttccgcagccaaatcacttctgaataaaaagtctgatggcggtgtgaaagagccccagactacagtcgttcataatgccactgacggcatcaaagggtcgacagaatcttgtaatactacaactgaagacgaagatctcaaagctgcccctctgaggactgggaatggctcctctgtgccggaggggagatcctctcgagaccgcactgcgccatctgcgggtatgcaaccacagccaagcctgtgtagttcagcaatgagaaagcaagaaatcatcaagattacagagcagcttattgaggccattaataacggggactttgaagcatataccaagatctgtgacccaggactcactagctttgaacctgaggcgctcgggaacctggtggaaggtatggacttccacaaattttacttcgaaaatctgctgtctaaaaatagcaaaccaattcataccaccattttgaacccgcatgtgcacgtgattggggaagatgccgcatgcatcgcatacatccgcctcacccaatacattgacgggcaaggacggcctcggacatcacagtctgaagaaacacgggtgtggcacaggagagacggtaagtggctgaatgttcactatcactgcagcggcgcaccggctgctccgcttcaatag

SEQ ID NO: 216710 - DNA, 1677 bp, Artificial Sequence
  Description of Artificial Sequence: Synthetic coding sequence
atggcaaccacagcaacttgcaccagattcactgatgattatcagctctttgaggagctaggcaagggagcgttctcagttgtgaggcgctgtgtcaagaaaacatcaacccaagaatacgcagccaaaattataaacaccaaaaaactgtcagcccgagaccatcagaagctcgaaagggaggccaggatttgcagactactgaaacaccccaatattgtgcggttgcacgattccatatctgaggagggtttccattacctcgtctttgacttggtgacaggcggagagttgtttgaagacattgtcgccagggaatattattcagaggctgatgcgagccattgcatccaccagatactggagtcagtgaaccacatccaccagcatgatattgtccatagagatctgaaacccgagaatctgctactggcttcgaagtgtaagggtgcagccgtcaaactagctgacttcgggctcgctatcgaagtacagggggagcagcaggcctggtttggcttcgctggaacacccggatacttatctcccgaggttctcaggaaggacccttacggcaaacctgtagatatctgggcctgtggggttatcctctacattctcctggttgggtatccccctttttgggacgaagaccagcacaaattgtaccagcaaatcaaagccggagcatacgattttcccagcccagaatgggacactgtgacacctgaggcaaagaacctgattaatcagatgctgacaataaatccagcaaagagaatcactgctgatcaggcactgaaacacccatgggtttgccagcggtccaccgtcgcatccatgatgcaccgtcaggaaaccgtcgaatgcctgagaaagtttaatgctcgcaggaagctgaaaggggcaattctgaccaccatgctggtgagtcgcaattttagcgctgccaagtccctgctgaataaaaaaagtgacggcggagtcaagaaacgaaaatctagcagcagcgtacacctgatgccacaatcaaataacaagaattctctggtttccccagctcaggaacccgctccactgcaaacagctatggaaccacaaaccaccgtggtgcacaacgcgacagatggcatcaaagggtctacagaaagctgcaacaccaccaccgaggacgaggacttgaaaggatcagtaccagaaggccgaagtagccgggaccggacagcaccgagcgcaggcatgcaaccccagccatcactgtgctcttcagcaatgcgtaaacaagaaatcattaaaattacagagcaattaatcgaagcaattaataatggtgacttcgaggcatataccaagatctgcgacccaggcctgacatccttcgaaccagaagcccttggcaacctggttgagggaatggactttcataaattttattttgaaaatttgctctcaaaaaattctaagccgatacacaccaccatccttaatcctcatgttcatgttatcggagaagatgccgcttgcattgcatacatccgtttaacacaatacatcgacgggcaggggaggcctcgcacttcccaaagcgaagagaccagggtgtggcaccgacgggacggaaaatggctgaacgtgcattatcactgttcaggggcacccgctgccccactccagtag

SEQ ID NO: 216711 - DNA, 1767 bp, Artificial Sequence
  Description of Artificial Sequence: Synthetic coding sequence
atggccaccaccgccacatgtacacgctttaccgacgattaccaattgttcgaagaattgggtaaaggcgctttcagcgttgtgcgtagatgcgtgaagaaaaccagcacgcaagaatatgctgcaaagatcatcaataccaagaagctgtccgcgagggatcaccagaagctagagcgcgaggctagaatatgcagactcttaaagcatcccaacatcgtaaggttacatgacagtatcagtgaggaaggctttcactacttggtcttcgacttggttaccggcggtgaactcttcgaagatattgtggctcgcgaatactactctgaggccgacgccagccactgcatccatcagatcctggagtctgtcaaccatatccaccagcatgacatcgtgcacagggacttaaaacctgaaaatctactgctggccagcaaatgtaagggagcagcagtcaaactggccgactttggcctggccattgaagtccagggcgagcagcaggcctggtttggttttgccggtactccaggctatctctcccccgaggtgctgcgcaaggacccctatggtaaacccgtagatatatgggcctgtggtgtcattctgtacattctgctggtgggctaccctcccttttgggatgaagaccagcataaactttaccagcagataaaagctggggcatatgatttccccagccccgagtgggataccgtgacccctgaagcgaaaaaccttattaatcaaatgctcaccattaacccagcaaaacgtataaccgcagatcaggcattaaaacatccttgggtctgtcaacgatccacagtagcttctatgatgcacaggcaggaaaccgtggaatgcctccgaaaattcaacgctcggcgaaagctgaaaggggctatcttaactacaatgctggtgtcacggaatttttcggtcggccgtcagtcctcagcccctgctagtcccgctgcatccgcggctggactggccggacaagctgccaaatcactgctaaataagaagagcgacgggggtgtaaagaagagaaaatcctcctcaagcgtgcatctcatgccccagagcaacaacaaaaattctcttgtgagccccgctcaggagccagctcctctacagactgcgatggaaccccagaccaccgtcgttcacaacgcaaccgatggcatcaagggcagtacagaatcctgcaacaccacgaccgaggacgaagatcttaaggcggctcctctcagaaccggaaacgggtccagcgtgcctgagggcagaagctcccgggatagaaccgccccatcagctggcatgcagccgcaaccgagtctctgttcatctgctatgcgtaaacaggaaatcatcaaaataacagagcagctcatagaagccatcaataacggggattttgaggcatacactaaaatctgtgaccccggtctcactagtttcgagccagaggccctgggaaatctggtagaaggcatggactttcataaattctactttgagaaccttctgtctaaaaactcaaaaccaatccataccaccattctcaacccgcacgttcatgtcataggggaggacgcggcttgtatcgcctatattagacttacacaatatatcgacggacagggcagaccgaggactagccagtcggaggaaaccagagtctggcatcggcgtgacggcaagtggctaaatgttcactatcactgttcaggggcaccagcagcacctttacagtag

SEQ ID NO: 216712 - DNA, 1362 bp, Artificial Sequence
  Description of Artificial Sequence: Synthetic coding sequence
cggctacttaagcaccctaatatcgtcagactgcacgatagcatctctgaggaggggtttcactacctggttttcgacctcgtcaccggcggtgagttgtttgaagatatagtggccagagaatattatagtgaggccgacgcctctcactgtatccaccagattctggaatccgtcaaccacattcatcaacatgacattgtccaccgggacttaaagccagagaaccttctgctggcctctaagtgtaagggcgcagccgtaaaactggctgattttgggttggctattgaggtgcagggggagcagcaggcctggttcggatttgccggaactccagggtatctctcccctgaggttctcaggaaggacccttacggaaaacccgtggacatttgggcctgcggcgtgatcctttacattttgttagtcggatacccgcctttctgggatgaggaccagcataaactgtatcagcagattaaagcgggagcttacgacttcccaagtcctgagtgggataccgtcacacctgaggccaaaaacctgatcaaccagatgttgactattaacccggctaaacgtatcaccgctgatcaggccctaaagcatccttgggtgtgtcagaggagcaccgttgcaagtatgatgcacaggcaggaaaccgtggagtgcctgcgtaagttcaacgcgcgaagaaagctgaagggtgccattctcaccaccatgttggtatcacgcaacttctctgccgctaaaagcctgctgaataagaaatcagatgggggagtaaagccccaaagcaacaataagaatagtctcgtgtcacccgctcaggagcccgcacccctgcaaacggcaatggaaccccagactacagttgtgcacaatgctactgacggaatcaaaggaagcactgaatcttgtaataccacaacagaagacgaagacctgaaggtgcgcaaacaagagatcattaaaatcaccgaacagctaattgaggcgattaacaacggggactttgaggcctacactaagatctgtgaccccggactgaccagctttgaacctgaagctctgggtaaccttgtcgaaggaatggattttcacaagttctattttgaaaacctgttaagtaagaattccaagccaatccacacaaccatcttaaatccccacgtacacgtgattggcgaggatgctgcttgtatcgcctatatcaggctcacccagtatatagacgggcagggcagacctcgcacttctcaaagtgaggagacgagggtatggcacaggcgggacggtaaatggctgaacgttcactaccattgcagcggtgcacccgctgctccattgcaatag

SEQ ID NO: 216713 - DNA, 1008 bp, Artificial Sequence
  Description of Artificial Sequence: Synthetic coding sequence
tgatatcagcagatcaaggctggtgcctacgacttcccttcgcccgagtgggacaccgtgactccagaggctaagaatctcatcaaccagatgcttaccattaacccagctaaaaggataacggcagaccaggcgctaaaacatccatgggtgtgtcagagaagtacggtggcctccatgatgcacagacaggaaaccgtggaatgtctccggaaatttaatgctagacgaaagttaaaaggcgcaatcctcaccacgatgctcgtgagcagaaacttctcggccgcaaaatcacttctgaacaaaaaatccgacggcggtgtgaaaccccagagcaataataaaaactccctggtgtccccagcccaagaaccggcaccactgcagactgccatggagcctcagactacggtggtccacaatgccaccgatggtataaagggttctactgaatcttgtaacaccacaaccgaggatgaggatttaaaggctgcacccttgcgcacagggaatggcagcagtgtcccagaaggacgatcctcccgggacagaacagctccatccgcagggatgcaacctcaaccatccctttgttcttcggcaatgcgaaagcaagaaattattaagattacagagcagttgatagaggctatcaataatggagactttgaagcttacactaagatctgtgacccaggtttaactagcttcgagcccgaagccctgggtaatctcgtggaaggcatggactttcataaattttatttcgagaacctgttgagcaagaattctaagcccattcatactacaattctcaatcctcacgtgcacgtcataggtgaagacgctgcctgcatcgcctacattcggttgacgcaatacatcgacggtcaaggcaggccacgcaccagtcagagcgaggaaactcgcgtttggcacaggcgggacggaaaatggctcaacgtgcattaccactgctccggcgcacccgctgcgcctctgcagtag

SEQ ID NO: 216714 - DNA, 543 bp, Artificial Sequence
  Description of Artificial Sequence: Synthetic coding sequence
atggctacaaccgcaacctgcacacgatttacggacgattaccaacttttcgaagaattagggaagggcgcattttccgtggtgcgccgttgcgtgaagaagacctcaacccaggagtatgctgctaaaatcattaacaccaagaagctgtccgccagagatcaccaaaaacttgaacgggaagcaagaatatgtagactactcaaacacccaaacattgcgaccattcacggcggaatccacgatgctagctctggcgactgtggcgtttttgcccaagtgcagtgtcccgaaaaaaccgaaggctgtcacccccacgatcatgcttgtctccaggaactcctttcatgccagaagcccattgaacaggaggtgggctggcgttgtcaggcaactgagcagcagcagaagcagtcaaggaaaccttctccgagagcccgagccctggccgatggacatggagccaccaatcactgcggtacacagcggtaccgctgggaccagggtctgcacagggaactccagcatcatcaccggaggtag

SEQ ID NO: 216715 - DNA, 240 bp, Artificial Sequence
  Description of Artificial Sequence: Synthetic coding sequence
atgagtgaaatcctgccgtatagcgaagataagatggggaggttcggcgctgatcccgagggtagcgacctttccttcagttgtcggctgcaagacactaattctttcttcgccggtaatcaggcaaaacggcctcccaaactcggccagatcggacgcgctaagagggtcgtgatcgaggacgaccggattgacgatgttctgaagggaatgggcgagaaaccacccagcggtgtctag

SEQ ID NO: 216716 - DNA, 1422 bp, Artificial Sequence
  Description of Artificial Sequence: Synthetic coding sequence
atgttgaaggtcaccgtgcccagctgcagcgcatcttcttgctcttcagttacggcaagcgcagcccctgggactgcttccctggtaccggattactggattgatggctccaatcgagacgctttgtcagacttttttgaggttgagagcgaactggggaggggggctacatctatcgtgtaccggtgtaagcagaaagggacccagaaaccctatgctttgaaggtgctgaaaaaaactgtcgataagaaaattgtccgaactgaaatcggcgttctgcttcggctctcccaccccaacatcatcaaactgaaggaaattttcgaaaccccaactgagatctcacttgtgctggagcttgtaaccggaggggagctgtttgaccggatcgtggagaaggggtactactctgaacgcgatgctgccgacgctgtgaagcagatactagaggccgtagcgtacctccatgaaaacggcatcgtgcacagggatttgaaaccagaaaacttgctttacgcaactcccgcacccgatgccccactgaaaattgccgattttggactgagcaaaatagtggagcaccaggttctgatgaagacggtttgcggaactcctggatattgtgcccctgagatcttaagaggttgtgcttacggacctgaggttgatatgtggtccgttggtattattacttacattctcctgtgtggattcgaacccttctacgacgagagaggggaccagtttatgttccgtaggatcctgaattgtgaatattactttattagcccttggtgggatgaggttagtttgaacgctaaagatttggtgaggaaactgatcgtgttagatccaaagaagcggctgaccacctttcaggctcttcaacatccttgggtcactgggaaggccgctaacttcgtgcacatggacacggctcaaaaaaagcttcaggagttcaatgcaagaagaaagcttaaagccgcagtaaaggcggtggtggcaagttctcggctcggttcggctagttctagccacggcagcatccaggagagccacaaggccagccgggaccctagccccatacaggacggcaacgaggacatgaaggccattccagagggagagaagattcagggagacggagcccaggctgcagtcaaaggggctcaggctgagctcatgaaagtgcaggccttagaaaaagtcaagggtgctgatatcaacgcagaggaggcccctaaaatggtgccgaaagccgttgaggacggaataaaagtcgcagatctggagctggaagaaggactggcggaggagaaattgaagaccgtcgaagaagctgctgcaccgcgagagggacagggttcctctgcagtgggtttcgaagtgcctcaacaggacgtgatcttgccagagtattag

SEQ ID NO: 216717 - DNA, 429 bp, Artificial Sequence
  Description of Artificial Sequence: Synthetic coding sequence
atgttgaaggtgactgtcccttcttgttctgcaagttcatgctcttctgtcacagcctccgccgcaccaggtactgcatccctggttccggattattggatcgacggctcaaacagagatgccctaagcgatttttttgaggtcgagtctgaactcggacgcggagccacttccatagtgtacaggtgtaaacagaaaggcacacagaaaccatatgccctgaaagttctgaagaagaccgttgacaagaaaatcgtccgaacagagataggagtcctgctgcgactgagccatcccaatatcattaagttgaaggaaatctttgaaacccctactgagatctccttagttcttgagttggtgaccgggggtgagctgttcgatagaatcgttgaaaaaggatactactcggagcgagatgccgcttag

SEQ ID NO: 216718 - DNA, 1422 bp, Artificial Sequence
  Description of Artificial Sequence: Synthetic coding sequence
atgctgaaggtgacagtgccatcatgctcagcctcctcgtgcagttccgtgacagccagcgcagccccaggcaccgcttctcttgttcccgactactggatcgatggtagcaacagggatgccctgtctgacttcttcgaggtggaatcagagcttggccgaggggctaccagcatcgtataccggtgcaagcaaaagggcacccaaaagccatacgcactgaaagtcttaaagaagactgtcgacaagaaaatagtgcggaccgagattggagttttgttaaggttgtcccaccccaatattatcaagttgaaagagatcttcgaaaccccaacagagatctcactggtgctcgagcttgtgacgggcggagagctgtttgatcgtattgtggaaaaggggtactactctgagcgggatgctgccgacgccgttaagcagatccttgaagccgtagcgtaccttcacgagaatggcatcgtgcaccgagacctgaaacctgaaaatttgctctatgccacccctgcacccgatgccccacttaaaatcgctgactttggactctccaagatcgtggagcatcaggtgctaatgaaaaccgtttgtgggacacccggatattgcgcccctgaaatcttacgtggctgtgcctacggacctgaggtggacatgtggagcgtgggtataattacatatatcctcctgtgcgggtttgaacctttttatgacgaacgtggggaccagttcatgttcaggaggattctgaattgcgagtattatttcatcagtccttggtgggacgaagttagtttgaacgctaaggacctggtgagaaaactgatagtgctggacccgaaaaagcggttgactacattccaggctcttcagcacccctgggtgacaggcaaggccgcaaactttgtacatatggatactgctcagaagaagctccaagaatttaatgcacggaggaagctcaaggccgctgtgaaggctgttgttgcctcgagtcggttggggagtgcttctagcagtcacggaagcatacaggaatcccacaaggcctcaagggaccctagtccgattcaggatgggaatgaagacatgaaagctatcccggagggggaaaagatacagggcgatggtgcacaggccgctgtcaaaggcgcacaggctgagctgatgaaggttcaggctctggagaaagtaaagggagccgatattaatgcagaagaggctccaaagatggtcccgaaagcggtcgaagacggaattaaagtggcagacctggaacttgaagaaggacttgcagaagagaagctcaagaccgtagaggaggccgctgcaccacgggagggacagggtagttctgcggtagggttcgaggtaccccagcaggatgttattcttcctgagtactag

SEQ ID NO: 216719 - DNA, 2766 bp, Artificial Sequence
  Description of Artificial Sequence: Synthetic coding sequence
atggccgacgacgacgtgctattcgaggatgtctacgagctgtgtgaagttatagggaagggaccattttcggtggtacgtcgctgcataaaccgcgaaactggccagcaattcgcagtgaagattgtggatgtcgccaagtttacatcctccccaggcctgtcaacagaagatttaaagcgggaagcctcaatttgccacatgctgaaacacccacacattgttgagttactggagacctactcatctgacggtatgctttatatggtgtttgaattcatggacggcgcagatctgtgtttcgagatcgtgaaaagggccgacgccggatttgtgtatagtgaggccgtagcctctcactacatgcgtcaaatcctcgaagcccttcgatactgccacgacaacaatatcattcaccgcgatgtaaagccgcattgcgtcctgctagcctcaaaggagaattcagcacccgtcaagctcggaggatttggggtggccatacagcttggggagagcggtctcgtcgctggcggaagagtcggcaccccacacttcatggcacccgaggtggtcaaacgggagccctatggcaaacccgtggacgtatggggctgcggagtcatcctattcatcctcctgagtgggtgtctgcctttttacggtactaaagagcggctttttgaaggaattattaaggggaaatacaaaatgaacccccgacagtggtcccatatcagtgagtctgcgaaagacctcgtgaggagaatgctgatgctggatcccgcagaacgcattaccgtttacgaagctctcaaccacccatggcttaaggagcgtgaccggtatgcctacaagatccatctgccagagactgtagaacagcttaggaaatttaatgcaagaaggaagctcaaaggcgcagtactggctgctgtcagctctcataaattcaattcattctatggcgatcctcccgaggaattgcccgattttagcgaggatcccacaagcagtgtgctactgattgtgtcacgtgcggtgagccaggttttagattccctggaggagatccatgcactcactgactgctccgaaaaggacctggattttctccatagtgtttttcaagaccagcatcttcacaccctgctggatctttatgacaagatcaacacaaagtcatccccgcagatccggaatcccccttccgacgcagtgcagcgcgcaaaggaggttctcgaggaaatctcctgttatcctgaaaataacgacgcaaaggagctcaaacgcatcttgacccagccccatttcatggctctgttgcagactcacgatgtggtggctcatgaagtctacagcgacgaggcactgcgggtgactcctccacccacttcaccttatctcaacggcgattctccagagtccgctaatggcgatatggacatggaaaatgtgacaagagtcaggctcgtccagtttcaaaagaacacagatgaaccaatgggaattaccctaaaaatgaacgagctgaatcactgtattgtcgcccgtattatgcacgggggaatgatccataggcagggcaccctgcacgtaggagacgagatccgggaaattaatggcatatctgttgctaatcaaactgtcgagcagctccaaaaaatgcttcgcgaaatgcgcggaagcatcaccttcaagattgtgccatcctacaggacacagtcatcatcttgtgagcgcgatagcccaagcactagtcgacagagcccagccaacgggcactcctccactaataattcggtaagcgatctcccatctaccacccagcccaaagggcgacaaatttacgttcgggcacagttcgagtacgaccctgcgaaagatgatctaatcccatgtaaagaagccggaattcgcttccgggtgggtgacattatccagatcattagcaaggacgaccacaattggtggcaaggcaaactcgaaaactctaagaatggaaccgccggactgatcccaagtcccgagctccaggagtggcgggtcgcttgtattgccatggagaagaccaagcaggaacagcaggcaagttgcacctggtttggtaaaaagaagaagcagtataaggataagtatttggccaagcacaatgctgacctggttacatacgaagaggttgtgaaacttcccgcatttaagaggaaaacactcgtgctgctgggtgcacacggtgttggcaggagacacatcaagaacactcttattacaaaacaccctgatcggttcgcctacccgatcccgcataccacaaggccacccaagaaggacgaagaaaatggcaaaaactactacttcgtcagccacgaccagatgatgcaggatatctctaacaatgaatatctcgagtacggttcccatgaggatgcgatgtacggaaccaagctggagaccattcgcaaaatccacgaacaggggttgattgctatcttggatgttgaacctcaggcattgaaagtgttgagaaccgcagagttcgcaccattcgtggtgttcattgccgcaccaacaatcacccccggtctgaatgaggatgagtccttacagcgtcttcagaaagagagtgatattcttcagagaacttatgcacattatttcgatctgactattattaacaacgagatcgacgagactatcagacatttagaggaagctgttgagctcgtgtgtactgcaccgcagtgggtccccgtgtcatgggtctactag

SEQ ID NO: 216720 - DNA, 2730 bp, Artificial Sequence
  Description of Artificial Sequence: Synthetic coding sequence
atggctgacgacgacgtgctgttcgaagacgtttacgagctgtgtgaggtaattggaaaggggcctttttcggtggtgagacgctgtatcaatagagagacaggtcagcaattcgccgttaaaattgtggatgtggcaaagtttacctctagcccaggcttatcaacagaggatctgaagagggaggcctctatttgccacatgctcaagcacccccatatcgtggagttactggagacttattccagcgatggtatgctttacatggtgttcgaattcatggacggggctgacctctgcttcgaaatcgtcaagcgcgctgacgccggatttgtatattctgaggctgttgccagccattacatgcgccaaatcttagaagcattgagatattgccacgataataatataatccaccgcgacgtaaaacctcactgtgttctcttagcgtcgaaggagaactcggcccctgttaagttggggggattcggtgttgctatccagctgggagaatcaggcctggtggccggagggagggtaggcactccacacttcatggctcctgaggttgtcaaacgcgaaccttatgggaaaccggtggacgtatggggctgcggggtgatccttttcatcctcctgagcggctgtttgccgttctatggaaccaaggagcgcctctttgaaggtatcattaaaggtaagtataaaatgaacccaaggcagtggagccacataagtgaatctgctaaggatctcgtgcgccgtatgttaatgctagatcctgccgagcggattacagtgtacgaagcgctcaatcacccctggctcaaggaacgtgacagatatgcctataaaatacacctgccagaaacagtcgaacagctgcgcaagttcaatgccagaaggaaactgaaaggagccgtcctggccgctgtgagtagccacaaatttaactcgttctacggcgaccccccagaggaattgcctgatttctctgaggatcctacaagtagtgtccttctgattgtgtcacgcgcagtttcccaggtactggatagcttggaggaaatccatgctctgactgactgcagcgaaaaggatctcgatttcctgcacagtgtcttccaagaccagcatctgcatacactgttggatctctatgataaaatcaacacgaagtcctccccccaaatccgtaatcccccttctgatgctgtccagagagcaaaggaggttctcgaggagatctcatgctacccagaaaataacgatgctaaggaactgaagaggattctgacacagcctcacttcatggctctgctgcagactcacgacgtagttgctcacgaagtgtactccgacgaggccttgagagtcacaccccctcccacctcaccgtacttgaatggagactctcccgaaagcgccaatggcgatatggacatggagaacgtgactagagtccgactggtgcaattccagaaaaatacagacgagcccatgggcatcacgttgaaaatgaacgaactgaaccactgcatcgtcgcccgtataatgcacggcggaatgatccatcggcagggtacactgcacgtcggtgacgagatcagagaaataaacgggatctcagtcgctaaccagactgtggaacagctgcagaaaatgctgcgagagatgcggggatccattacatttaaaatcgttccaagctaccgtacccagtcctcctcctgcgaaagggatagtccctcgacgagtagacagagccctgccaatggtcatagctctacaaacaactcagtctcaatctacgttcgtgctcagtttgagtatgatccagctaaggacgatctcattccttgtaaggaggctggaatccggtttcgggtaggcgacatcatacagatcatctctaaggacgatcataactggtggcagggaaaactggaaaactccaaaaacgggacagcaggcctgattccctctccggaactgcaagaatggcgcgtagcctgcattgcaatggagaagacaaaacaagagcagcaggcctcctgcacatggtttgggaaaaagaagaagcagtacaaagacaaatacctggcaaagcataacgccgatctggttacatatgaagaggtggtgaagctgcctgcatttaagcggaagacccttgtgctgttaggggcacatggcgtgggacgacgccatattaaaaacacacttattacaaaacaccccgacaggttcgcataccctatcccgcataccactcgacccccaaaaaaggacgaggagaatgggaagaattattacttcgtgagccacgaccagatgatgcaagatatttcgaataatgagtacctggagtacggaagccatgaggacgccatgtacggaacaaaacttgagacaattcgtaaaattcatgaacaaggcctgatcgccatcctagatgtagagcctcaggccctgaaggtgctcagaacggccgaatttgcccctttcgtagtatttatcgcagcaccgacgatcacgcctggacttaatgaagacgagtcgctccagaggctccagaaagaatctgatatcttgcagaggacatacgcccactacttcgacctgaccatcattaataatgagatcgacgaaacgatccgccatctggaggaagctgtcgagctggtgtgtacagcaccccagtgggttccggtgagctgggtgtattag

SEQ ID NO: 216721 - DNA, 1773 bp, Artificial Sequence
  Description of Artificial Sequence: Synthetic coding sequence
atggccgatgatgatgtgctgtttgaggacgtgtacgagctgtgtgaggtgatcggcaaaggacctttttctgtggtacggagatgcataaatcgggagacaggacagcagtttgcagtgaagatcgttgatgttgcgaagttcacatcaagccctggcctctccacggaagacctgaagcgcgaagcctctatctgtcatatgctgaagcacccccatattgtcgaactgcttgaaacttattcctctgatgggatgttatacatggtatttgagttcatggacggcgcagatttatgctttgaaattgtgaagagagcggatgcagggtttgtctatagcgaagccgtggcgagccactacatgagacagatattagaggcacttaggtactgccacgataataatattattcaccgtgacgttaagccccattgcgtgttgctggcaagcaaggagaacagcgcccctgtcaaactagggggatttggcgtggccatccagctgggagagtccggcctcgtggctggaggtcgagtgggcacaccccacttcatggcgcctgaagtcgtgaagcgggagccctatggcaaaccagtggacgtgtgggggtgcggcgtgatactgtttatattgctttcagggtgcctgcctttctacgggactaaggagaggctgtttgaaggaatcatcaaggggaaatataaaatgaatccgagacaatggagccacatatctgagtctgccaaggatctagtgcggaggatgttaatgctggaccccgctgaacgcatcaccgtatatgaggccctcaatcatccatggctcaaggagagggatcgctacgcttacaagattcacctgcccgaaactgtagaacagttacgtaagttcaacgccaggcgcaaactcaaaggtgccgtgcttgccgcagtttctagtcacaagttcaactccttctacggcgatcctccagaggaactgccagacttttctgaagaccctacttcgtcaggactgctggctgctgagagggccgttagtcaggttctggattctctggaggaaatccatgccctaactgactgctctgaaaaggatcttgatttccttcatagcgtgtttcaggaccagcacctgcacacattattagacttatacgataagatcaacactaaatcctcaccacagatcaggaatccaccatccgacgcagtccagcgtgcaaaggaagtgctggaagaaatcagttgttaccccgaaaataatgatgcaaaggagctgaaacggatcctgacacagccccacttcatggcactactgcaaactcacgacgttgttgcgcatgaggtgtactcagacgaggcactcagggtaactccaccaccgacttctccttatttgaatggagattctccggagtccgcaaatggcgacatggacatggaaaacgtcacacgggttcgcctcgtgcaattccagaaaaataccgatgagcctatgggcattacactgaagatgaatgagctcaatcactgcatcgtggccaggattatgcacgggggaatgatccacagacaggggaccctgcatgtaggcgatgagatcagagagatcaatgggataagcgtggccaatcaaactgtagaacagctgcagaagatgctgagagagatgagggggtcaattaccttcaaaatagtccctagttaccgcacacaatcatcctcttgcgaagtcatgacattgaccaatcaccctcatctgttgtag

SEQ ID NO: 216722 - DNA, 2730 bp, Artificial Sequence
  Description of Artificial Sequence: Synthetic coding sequence
atggcggacgacgatgtgctattcgaagatgtgtatgagctgtgtgaggtgattggcaaggggccattctcagtagtcagacgatgtattaaccgggagactggccagcaattcgccgtgaagatagtagatgtggcaaagttcacttcaagtccaggactgtccaccgaggatttgaaacgggaagcctctatttgccatatgcttaagcatccccacatcgttgagttgctggagacttatagtagtgacgggatgctgtacatggtcttcgagttcatggacggagccgacctatgcttcgaaattgtcaagcgggctgatgcaggctttgtgtattccgaagccgtcgcaagccattatatgagacaaatactggaagccctgcggtactgccacgacaacaacatcattcatcgggatgttaagccacactgcgtgctgctcgcatcaaaagaaaatagtgccccagtaaagctgggcggatttggagttgctatacaactgggcgagagcggcttagtcgctggcggacgcgtggggacacctcattttatggcccctgaggttgtgaagcgggaaccttatggtaagcccgttgacgtgtggggatgtggagtgattctgtttattctcctaagcggctgcttacccttctatgggacgaaggaaaggctgtttgaaggcataataaaaggaaaatataagatgaacccacgccagtggtctcacatctccgaatccgccaaagacttagtgaggaggatgctgatgcttgatcccgctgagaggatcaccgtctatgaggctctgaatcatccttggctcaaagagcgagaccgctacgcatataaaattcatcttcccgaaaccgtggaacagctgagaaagttcaatgcccgtcgtaaacttaaaggagctgtactcgcagctgtctcatcacacaaattcaatagcttctacggcgatcccccagaggaattaccagattttagcgaggaccctacctcctccggcctgttggctgcggagagggcagtatcccaggtgctggattcacttgaagaaatccacgccctcaccgattgtagtgagaaggacctcgatttcctccattcagtgtttcaggatcagcatctgcataccctgctggacttatatgacaaaataaacaccaagtcaagccctcagatcaggaacccgccttccgacgccgtgcaaagggccaaggaggttttggaagaaatctcctgttaccccgaaaataatgacgcgaaagagctgaaacgcatcctgacccagccacatttcatggccctgctgcaaactcatgacgtggtggctcacgaggtgtactccgatgaagcattacgcgtaacgccccctccaacctctccctatctgaatggcgacagcccggaaagtgccaacggcgatatggacatggaaaatgttactcgggttcggttagtccagttccaaaagaacacggacgaacctatgggaataacactaaaaatgaacgagctcaaccactgcatagtcgcccgtatcatgcacggcggtatgattcacaggcaggggacgctgcacgtgggagatgagatccgggagataaacggaatcagtgtggctaatcaaactgttgaacagctgcagaagatgctgcgggagatgcgtgggtcaataacatttaagattgtaccatcttacagaacacagagtagcagctgcgaaagggattctcccagtacaagccggcaaagcccagcaaacggacactcttcaacgaataatagcgtgtccatttatgtgagagcccagttcgaatacgatcccgctaaggacgatctcataccctgtaaagaagctggtatccggttccgagtaggagacataattcaaatcatctccaaagatgaccacaactggtggcaaggaaagctggagaattcaaagaatggaaccgcaggactgattccctccccagagctgcaggaatggcgggtggcttgcatagccatggagaaaaccaagcaggagcagcaagcttcctgcacctggttcggaaaaaaaaaaaagcagtataaggataaatacttggctaagcacaatgcagacttagtgacctacgaagaggtggtcaaactaccggctttcaagagaaagaccctggttctgttgggcgcacacggagtcggacggagacatattaagaacacactgataaccaaacacccggatcgctttgcatatcccatcccacacacaacgagaccacctaaaaaggatgaagagaacggcaaaaattattatttcgtgtcccatgatcagatgatgcaggatatttccaacaacgagtatctggagtacggctctcatgaagacgctatgtacgggaccaagcttgaaaccataaggaagatacacgagcagggcttaatcgcgatactcgacgttgagccacaggccctgaaggtcttgagaacagctgagtttgctccattcgtcgtctttatcgctgcacctacaataacaccgggtctgaacgaggatgaatccctgcagcggctgcaaaaggagagcgacatacttcagcggacgtatgcccattatttcgacctcaccatcattaataatgagatagatgaaacaatccggcacttggaggaagccgtcgaacttgtgtgtacagcaccgcagtgggtaccagtgagttgggtgtactag

SEQ ID NO: 216723 - DNA, 2781 bp, Artificial Sequence
  Description of Artificial Sequence: Synthetic coding sequence
atggcagatgacgatgtcttgttcgaggatgtgtatgagctctgtgaagtgatcggaaagggcccattctccgtcgtgcggcgttgcataaaccgggagacaggccagcaattcgccgtgaaaatagtggacgttgctaaattcacctcatcacctggcctctcaacagaggatctgaagcgggaggcctctatctgccacatgctgaaacatccccatattgtggagcttctggaaacctattcgtccgacggcatgctgtacatggttttcgaattcatggatggcgcagacctgtgtttcgaaattgttaaaagggcggatgccggattcgtgtactcggaggctgtggccagccactatatgcggcagatactggaagcacttcgctactgccacgataataacatcattcatcgggacgtcaaaccccactgcgtgctcctcgcctctaaggaaaattccgcgccagtgaaactgggtggctttggagtcgccatccagttgggggagtccggcctggtggctgggggacgtgttgggactcctcactttatggcacccgaggttgtaaagcgagaaccatatgggaaacccgttgatgtctgggggtgtggcgtcatcctgtttatcctcttgtcgggttgcctccccttttacgggacaaaggaaagactatttgagggtattatcaaggggaagtataagatgaaccccaggcagtggtctcacatttccgagagtgccaaagatctggttaggagaatgttgatgctggacccagctgagcgcataacggtttacgaggccttgaaccatccctggctcaaagaacgcgaccggtacgcctacaagatccatctcccagagactgtggagcaacttcgcaagttcaatgcgcgaaggaaactcaagggagctgtgcttgcagcggtttcaagccacaagtttaacagcttctacggagaccccccagaagaactgcccgacttcagcgaggacccaacgtccagcggtctgctcgctgccgaacgcgcagtgtcacaagttctggactcactcgaggagatccacgccttaaccgattgttcagaaaaagatctggattttctacacagtgtgttccaggaccagcacctccataccctcctggatctgtacgataagattaacaccaagagcagcccacagataagaaatcccccatccgacgctgtgcagcgggcaaaggaagtccttgaagagattagctgctatcccgaaaacaatgatgccaaagaactgaaacgaattcttactcagcctcatttcatggccctgctacagacccacgacgtagtagcacatgaggtgtactcagacgaagcacttcgggtcacacctcctcctacatccccttatctcaacggcgacagccctgaaagcgctaatggcgacatggacatggagaatgtgactcgtgttcgcctggtgcaatttcagaagaatacagatgaacccatgggcatcacactgaaaatgaacgagctcaatcactgcatcgttgcccgaatcatgcatggaggcatgatccatcgccaaggaacgctgcacgtgggcgatgaaatccgggagattaatggcataagcgtagccaatcagaccgtggaacagctgcagaagatgctgcgcgagatgcgcggaagcataacattcaaaattgtgccaagctaccgtacacagtcatcttcgtgcgagagggattctccctccacatccaggcaatcaccagcaaatggacattcttccacgaataatagtgtgtctgacttgccaagcacaacacagccaaagggacggcagatctatgtccgggctcaatttgagtatgatcccgcaaaagatgatctgattccttgtaaggaagctggcatcaggttccgggtgggggatatcatccagattatcagcaaggatgaccacaactggtggcagggcaagttagagaatagtaaaaacggtacagctggcctgattccgtcccccgagttgcaggaatggagggtagcttgcattgccatggaaaagactaagcaggaacagcaagctagttgcacgtggtttgggaagaagaaaaaacagtataaggataaatacttggctaagcacaacgcggtattcgatcagctcgacctcgtgacatatgaggaagtggtaaagcttcccgcattcaagcggaaaaccctagtgctgttgggagctcatggggtggggcgtcgccacatcaagaataccttgataaccaaacaccctgacagatttgcatacccaatcccccataccacccgccctccgaaaaaagacgaggagaacggaaaaaattactacttcgtaagtcacgaccaaatgatgcaggacatatccaataacgaataccttgagtatgggagtcatgaggatgcaatgtacggtaccaagctggaaacgatcagaaaaattcacgaacaggggctgatcgctattctcgatgttgaaccacaggctctcaaggttctccggactgctgaatttgctcccttcgtggtctttattgctgcacccacaataacacccggactcaatgaggacgagtctctgcaaaggctgcagaaagagagcgacatcctgcaacgtacttatgcccactacttcgacctcacgatcatcaataacgaaattgatgagaccattcgccacctagaggaggctgtagagctggtttgcacagccccacagtgggtgcctgtgtcgtgggtttactag

SEQ ID NO: 216724 - DNA, 2766 bp, Artificial Sequence
  Description of Artificial Sequence: Synthetic coding sequence
atggccgacgatgacgtcctgttcgaggatgtttacgagctgtgcgaggtgatcggaaagggtcccttttctgttgttcggagatgcatcaaccgtgagaccggccagcaattcgccgtgaagattgtggacgtagccaaattcacctccagtcctggactgagcaccgaggacctgaagcgtgaagcctctatatgtcatatgctgaagcatccacacattgtcgaactgctggagacttattcctctgacgggatgctctatatggtgtttgagttcatggacggggcagatctatgcttcgaaattgtaaagagagccgatgcagggttcgtgtacagcgaagccgtggcttcccattatatgagacaaatcctggaagccctcagatactgccacgacaataatatcatccatcgagacgtgaagccgcactgtgtgctactggcaagcaaagaaaatagcgcccctgttaagctagggggtttcggtgtcgctattcagctgggcgaaagcgggctggttgctgggggacgggttgggactccacactttatggctcccgaagttgttaagcgggagccttacgggaaacctgtcgacgtttggggctgcggagtgatcctgttcattctccttagcggctgcttgccgttctacgggacaaaggaacggctctttgagggcattataaagggaaaatataaaatgaacccgcgtcagtggagccacatatcagagtctgccaaggacctcgtgcgtaggatgctgatgttagaccctgccgaaaggatcacggtctacgaggccctaaaccacccttggctcaaggaaagagatcgttatgcctacaaaatccatttacccgagaccgtcgaacagctgagaaagtttaacgctcggagaaaactgaagggcgcagttctcgctgccgtcagctcacacaagttcaacagtttttatggggaccctcccgaggaattgcccgacttctcggaagatcctacctcctccgggcttctagctgctgagcgcgctgtatcgcaggtactggactcactcgaagaaatacatgccttgacagattgctctgaaaaggaccttgacttcctgcactccgtctttcaagaccaacacctccacaccctgttggatctgtacgataaaatcaataccaaatcctctccacagattcgcaaccctccatcagatgcggtacaacgcgcaaaagaagtcctggaagaaatatcatgctatccagaaaataatgacgcaaaggagctgaaaagaatactcacccaaccccacttcatggccctgcttcagacccatgatgttgtggctcacgaggtgtactccgacgaagccctgagagtgacacccccacccaccagcccctatttgaatggcgacagtccagagtctgcaaacggggacatggacatggaaaacgttaccagggtcaggttggtgcagtttcagaagaacacagatgagccaatgggcattactctgaagatgaatgagctgaaccattgcatagtggctcgcatcatgcatgggggtatgattcataggcagggaactctccatgttggcgacgagatccgcgaaatcaatggaatatcagttgccaatcagaccgtggaacagcttcagaagatgctgagggagatgcgtggatctattaccttcaagattgttccatcctaccggacgcagtcctcatcgtgcgaacgagatagtccttctaccagccgacagagccctgctaacggtcactctagcaccaataacagtgtctccgatttgccgagcaccactcagcccaaaggaaggcagatttacgtcagagcccagtttgagtacgatcccgcaaaggacgaccttattccatgtaaagaagccggtatccgctttagggtgggcgacatcatccagatcattagcaaggatgatcataattggtggcaagggaaactggaaaactcgaagaatggtaccgcaggattgataccatcccccgagctccaagagtggcgggtcgcttgcatcgcaatggagaaaaccaaacaggaacagcaggcttcctgcacttggtttggcaaaaaaaaaaaacagtacaaagataagtatttggcgaaacacaacgccgacctagtgacctatgaggaagtggtaaagctgccggcttttaaacgtaaaacactggtcttgctgggcgcacacggggtgggaagaagacatataaagaatactcttatcaccaagcaccctgataggtttgcatatcccattccccacaccaccaggcctcctaagaaagacgaagaaaatgggaagaactattatttcgtgtctcatgaccagatgatgcaggatatctctaacaacgagtatctcgaatacgggtctcatgaagacgccatgtatggtacaaagctggaaacgattcgcaagatccatgaacagggcctgatagccatcttagacgtggagcctcaggcgctcaaggtcctgaggactgccgaattcgccccttttgtggtgttcatcgctgccccaaccatcacaccgggattaaacgaggacgagtcgctgcagcgcctccagaaggagtccgatatactccagcggacctatgcccactactttgacctgacaattatcaataacgaaattgatgaaacaatacgacacttggaggaggccgtggaacttgtgtgtacagcccctcagtgggttccggtgagctgggtgtattag

SEQ ID NO: 216725 - DNA, 1146 bp, Artificial Sequence
  Description of Artificial Sequence: Synthetic coding sequence
gacgaaattagagaaatcaatggcatttctgtggcaaatcagacagttgaacagctgcaaaagatgctccgagaaatgcgcggatcaatcactttcaaaatcgtcccaagctacaggacacagtcgagttcatgtgagcgcgactccccctcgacctctcgacagtcaccagcaaacggccactcaagcacaaataactcagtgtctatttatgttagggctcagttcgagtacgatcccgctaaggatgaccttatcccttgtaaggaagccggtatcaggttcagggtgggtgacatcatccaaattataagcaaagatgatcacaactggtggcagggcaaactcgagaattcaaagaacgggactgctgggctgatcccctcccccgaattgcaggagtggagagtagcgtgtattgctatggagaagaccaagcaggagcagcaggcttcctgtacctggttcggcaagaagaaaaagcaatacaaggacaagtatctggctaagcacaacgccgtttttgaccagctggacctcgttacttacgaagaggtcgttaagctgcccgctttcaagcgcaaaacccttgtcctactgggtgctcatggagtgggcagaaggcatattaagaacacgctcatcacaaagcaccctgatcgttttgcatatcctatccctcacaccaccagaccaccaaaaaaagatgaggaaaatgggaagaattactactttgtgtcacacgatcagatgatgcaggatatcagtaataatgagtatcttgaatacggatcacacgaggatgctatgtacggtacaaaactggaaactattagaaagattcatgagcaaggccttattgccatcctcgacgtcgagccacaggcccttaaggtcttgcgcaccgctgagttcgccccatttgtggtgttcatagccgctcctactattacccctggcctgaatgaagatgagtctctgcagcgtctgcaaaaagaatctgatatccttcagcgtacctacgcccattactttgacctcacaatcatcaacaacgagatcgatgagacaatccgtcacctggaggaagcagtagaactcgtctgcaccgccccacagtgggtgccagtatcgtgggtttactag

SEQ ID NO: 216726 - DNA, 1557 bp, Artificial Sequence
  Description of Artificial Sequence: Synthetic coding sequence
ttatatgacaagatcaacactaagagcagtccccaaatacggaatccaccaagcgatgccgtgcagcgtgccaaagaggtgctcgaggagatctcttgctacccggagaacaacgacgccaaggagctgaagagaattctgacgcagccccactttatggcactcctacagactcacgatgttgtcgcacacgaagtctattcagatgaagcgctgcgggtaacgcccccacccactagtccatatctgaacggtgattctcccgagtcagccaacggggacatggatatggaaaatgtgacaagagtcagactggtacaattccagaaaaataccgatgagccgatgggcataactttaaagatgaatgaactgaaccattgtattgtggccagaattatgcatggagggatgattcacagacagggaactttgcatgtgggcgacgaaatcagggaaattaacggtatctccgtggctaatcaaacggtggaacagcttcagaagatgctccgggaaatgagaggcagcatcacatttaagattgtcccttcttatcgaacccagagtagttcctgcgaggatctgccgagtacaactcagccaaaagggcgtcagatctacgttcgagcacagtttgaatacgatcccgcaaaagacgacctgattccgtgcaaggaagccggaatccgctttcgggtcggcgacattattcagataataagtaaggatgatcacaactggtggcagggcaagctcgagaattccaaaaatggcacggccggtttaataccttctcctgaactgcaggagtggagagtggcatgtatcgccatggagaaaaccaaacaggagcagcaggcatcctgcacgtggtttgggaagaagaaaaagcaatataaggataaatatctggctaaacataacgcggttttcgatcaactcgatcttgtcacttatgaggaggtggtgaagctaccagcatttaaacggaagacattggtgctgctgggagcgcatggcgtgggtagaagacacatcaagaacaccttgatcacaaagcacccagacagatttgcttaccctatcccccacacaactcgccctcctaagaaagatgaagagaacggtaagaactactatttcgtctcccacgatcagatgatgcaagatatctctaataacgaatacctggaatatggaagtcatgaggatgcaatgtatggtacaaagctcgagacaattcgcaagatacacgaacagggtctgatcgccattctcgacgtggagcctcaggccttgaaagtccttcggaccgcagaattcgcgccattcgtggtgttcattgcggcacctactatcacccctggtctgaacgaggatgagtccctacagcgccttcagaaagagagtgacatcctgcagagaacctacgcccattatttcgacttgaccataatcaacaacgaaattgatgagaccatccgccatctggaggaagccgtggaactggtttgtacggcgcctcagtgggtacctgtgagctgggtctattag

SEQ ID NO: 216727 - DNA, 2694 bp, Artificial Sequence
  Description of Artificial Sequence: Synthetic coding sequence
atggccgacgacgacgttctcttcgaagacgtgtacgagttatgtgaggttatcgggaagggccctttcagtgtggtgcgcagatgcattaaccgggagactggacagcaatttgctgttaagatagtggacgttgccaagtttacttccagtccgggactctccacagaagatcttaaaagggaagcttccatttgtcacatgctcaaacatccccacattgtcgaacttctggaaacatacagttcggatggaatgttgtatatggttttcgagtttatggatggagctgacctgtgcttcgagatagtgaagagggccgatgcgggtttcgtttacagcgaggctgtagcatctcattatatgagacagatcctcgaggctttgagatattgccatgacaacaacattatccatagggacgtcaaaccacactgcgtcttactagccagcaaggagaactctgctccggtaaagttgggaggattcggtgtggccattcagctcggagagtcgggattagtcgccggtgggagagtggggacgcctcacttcatggcccctgaagtggtaaaaagagagccctacgggaaaccggttgacgtttggggctgcggcgtcattctcttcatccttctgtcagggtgtctgcccttttatggaacaaaggaacgactgttcgagggcatcatcaagggtaaatataagatgaaccctcgacagtggagtcacattagcgaatccgccaaggaccttgtccggcgaatgcttatgcttgatcctgccgagcgaatcacggtttacgaagcgttgaaccacccctggctcaaagaaagagatcggtacgcctacaagattcacctacccgagacggtggagcaactgcggaaatttaatgcaagaagaaagcttaagggggcagtgctggccgcagtcagtagtcacaaatttaattctttttacggagacccgccagaagaactgccagattttagcgaagacccaactagctcgggggcagtttctcaggtcctggacagtcttgaagagatacacgcactgactgactgtagtgaaaaggatttggatttcttgcatagcgtgtttcaggatcaacatctgcataccttactggacctgtatgacaaaattaacactaagtcttctccccagataaggaaccccccatccgacgcagtccagagagccaaagaggtgcttgaggaaattagctgttacccagaaaataatgacgcgaaggagttaaagagaatcttaactcaaccacatttcatggcactcctacaaacccacgacgtcgtcgcgcatgaagtgtacagtgacgaggcgctgcgggtcaccccaccaccgacaagtccctatctgaacggtgacagtccagagtccgccaatggggatatggacatggagaacgtcactcgagtgcggttggtgcagttccaaaaaaatacggatgagcccatggggattaccctgaagatgaacgagctgaaccactgcatcgtcgcaagaatcatgcacgggggaatgattcaccgacagggtactttacacgtaggcgacgagatccgggaaattaacggcatctccgtcgccaatcagacggttgagcagttgcagaagatgctgagggagatgcgcggttctattacatttaaaattgtgcccagctatcgcacccagagctctagctgcgaggacctcccgagtaccactcagcccaagggtaggcagatttacgtacgggcacagttcgagtacgacccagccaaggatgacctgataccttgcaaggaagccggtatccggtttcgtgttggtgacatcatccaaatcatctcaaaagacgatcacaactggtggcaggggaaattagagaattcaaaaaacggaaccgctggcctgatccctagccctgagctgcaggagtggagagtcgcctgcattgctatggagaaaacgaagcaagagcaacaagcttcttgtacctggtttggaaaaaagaaaaaacaatacaaggacaaatatctcgccaagcacaatgcagtgttcgaccagttagatcttgtcacatacgaggaggttgtgaagttgccggcatttaaacgaaaaacactggtgttgctcggtgcccatggcgtgggcaggaggcatatcaagaatactctgatcacaaagcatccagatcgttttgcctatcctataccacacaccactagaccacctaagaaggacgaagagaatggaaaaaactactattttgtctcccacgaccagatgatgcaggacatcagtaataatgagtacctggagtatgggtcacacgaggacgcaatgtacgggaccaagttggagacaatccgcaaaattcatgagcagggcctgatcgcaatcctggacgtcgagccgcaggcactcaaagtgctgagaacggcagaatttgcaccctttgttgtgtttattgccgcacctaccattacaccgggtttaaacgaggacgaatctcttcagagactgcagaaagagagcgacatattgcaacgaacgtacgcccactacttcgaccttaccatcatcaacaacgagattgacgaaacaatccgtcaccttgaagaagcagtcgaactggtctgcacagctccacagtgggtccccgtgagctgggtttactag

SEQ ID NO: 216728 - DNA, 2697 bp, Artificial Sequence
  Description of Artificial Sequence: Synthetic coding sequence
atggcggacgacgacgtgctgtttgaggatgtgtacgagctctgtgaggttatcggcaagggtcccttcagtgtggtcaggcgatgtattaatcgagagacgggccaacaatttgctgttaaaattgtggacgttgccaagttcacttcatctccaggcctgagcacggaagatctgaagagagaggccagcatctgccatatgttaaagcatccacatatagttgagttgctcgagacctactcatcagatgggatgctgtatatggtcttcgagttcatggacggggctgatctctgttttgagatcgtgaagagagctgacgcgggatttgtctactccgaggccgtagcaagccactacatgcgccagatactagaggccttgcgctattgccatgataataacatcatccacagggacgtgaaacctcactgtgtcctgctagcgtcaaaagagaactcagcccctgtgaagctcggcggttttggggtggcgattcagctgggggagtctgggttggtggcaggcggacgggtggggacaccgcacttcatggctcctgaggtggtgaagagagaaccgtatggtaagccagtcgatgtgtggggctgcggtgtgatccttttcatcctgctcagtggctgcctgcctttttacgggacaaaagaacgccttttcgagggaattattaaaggcaagtacaagatgaaccccagacagtggtcgcacatcagtgagtctgcaaaagatctggtccgcaggatgctgatgctagacccagctgaacggatcaccgtgtatgaggcgctcaatcacccctggctaaaggaacgggataggtacgcctacaaaattcatctgcctgagacagtagagcagctgaggaagttcaacgccaggaggaagctgaagggggctgtgttggcagctgtttcctcccataaattcaattccttctacggggacccaccggaagaacttcccgacttcagcgaagatcctacctcctcagggctgctagccgcagaacgagcagtgtctcaagttctagattccttagaggaaatccatgctctgactgactgttctgagaaggatcttgatttcctgcatagcgtttttcaggaccagcatctccacacgctgctggacctatatgataagataaacacgaagtcatcaccacagattagaaacccaccgtcagatgcagtgcagcgtgccaaagaggtgttagaggagatttcatgctacccagagaataatgacgcaaaggaacttaaacgcatcctcacacagcctcactttatggccctgctgcagacccatgatgtggtggctcacgaagtttatagtgatgaggccctcagagtgacaccacctccaacttcaccatatctgaacggggatagtcccgagtccgccaatggcgatatggacatggagaacgtgacgcgggttcgtctggttcagttccagaaaaacaccgacgaacctatggggatcaccttgaaaatgaacgaacttaaccactgcatcgtagctaggattatgcacgggggaatgatacataggcaagggacattgcatgtgggggacgaaatccgggaaattaacggaatcagcgttgcaaatcagactgtcgagcagttgcagaagatgttgcgggagatgagaggctccattacattcaaaatcgtcccaagttacaggacacagtcttcgtcatgtgaagatttaccctcaaccacccagcctaaagggaggcagatctatgtgcgtgcgcagtttgaatacgaccccgctaaagatgacttgataccttgcaaagaagctggcatccgcttccgggtcggggacataatccaaataataagcaaggacgatcataattggtggcagggcaagctcgagaatagcaaaaacggcacggcaggtctgatcccctccccagagttacaggaatggcgggtggcttgcatcgcgatggagaagactaagcaggagcagcaggcaagttgtacttggttcggcaagaagaaaaagcagtataaggataagtacctcgctaagcataacgccgatctcgtgacctatgaagaggtagttaaactgccagcattcaagcgcaagactcttgtgctcctgggggcacatggagtgggtcgcagacacattaaaaatacattgattaccaaacatcccgaccgattcgcatacccaatacctcacacaacccggccacccaaaaaagatgaggaaaacggcaaaaactactactttgtgagccatgaccagatgatgcaggatatttccaacaacgagtacttagagtacgggtcccatgaggatgcaatgtacgggactaagctggaaacaatcaggaagattcacgagcagggcctgatcgccatcctggatgtggagccacaggcactgaaggtccttcgaacagccgagttcgctccgttcgtcgtgttcatcgctgcgccaacaattacaccaggcttgaacgaggatgaatcacttcaaaggcttcagaaggagagtgatatcctgcaaaggacttacgcccactactttgatctcaccataattaataacgagatcgatgagacaatccggcatttagaggaagcagtggagctggtgtgcacagcgcctcagtgggtgcccgtctcttgggtttactag

SEQ ID NO: 216729 - DNA, 3237 bp, Artificial Sequence
  Description of Artificial Sequence: Synthetic coding sequence
atggcattttacagttgctgttgggttctcttggcactgacttggcacacatccgcatacggccctgatcaaagagcccagaagaaaggtgacattatcttgggtggactgttccctatccactttggggtagcagctaaagaccaggacctgaagtcgagacccgagtcagtggagtgtataagatataattttagaggattccgctggctgcaagccatgatcttcgctatcgaagagatcaactcatccccagcgttactgcccaacctgactctcggctatcggatcttcgatacctgtaataccgtatcgaaggctctggaagccacattgtccttcgtggcacaaaacaagattgactctctgaatctggatgaattttgtaactgctccgaacacatcccctcaactatcgcagtcgtgggggcaaccgggtcaggcgtgtccaccgcggtggctaacctgcttggactcttttatattcctcaggtgtcctacgcttccagcagcaggctgctgagcaacaagaatcagttcaagagcttcctccgaacaatccctaatgatgagcaccaggccacagccatggccgacataatcgaatactttcgttggaactgggtgggcaccatagctgctgatgatgattatggaaggccaggcatcgaaaagttccgagaggaggcagaggagcgcgacatatgcatcgacttcagcgagctcatcagccagtattcagatgaggaggaaattcagcacgtggtggaggtgattcagaatagtacggccaaggtcatcgtggttttctcctcggggccagatttggagcctctgatcaaagagatcgtcagacgcaatatcactggaaagatatggctggccagtgaggcttgggctagctccagcctcatcgccatgccccagtacttccacgtggtcggaggaaccatcgggttcgcacttaaagccggacagattcctggttttcgcgagttcctaaagaaagttcacccacggaaatccgtgcataatggctttgccaaagagttctgggaagagacgtttaactgtcatcttcaggaaggggcaaaaggcccattgccggtggacacatttttaagaggacatgaagagagcggggaccgctttagtaacagttcgacagcattcagaccgttgtgcaccggagatgagaatatatcaagcgtggaaacaccatatatcgactacacacatctgaggatttcgtacaacgtatatctggctgtgtattctattgcccatgcactccaagatatctacacatgtctcccgggaaggggactgttcactaacggctcctgtgcggacattaagaaggtggaagcctggcaggtgctgaagcatctccgtcacctcaacttcacaaacaatatgggcgagcaggtcacctttgatgaatgcggcgatcttgtgggcaattatagtatcattaactggcatctttcgcccgaggacggttccatcgtcttcaaagaagtcgggtattacaatgtttatgccaaaaaaggcgagaggttgtttatcaacgaagagaaaattctttggagcggcttcagcagagaggtgcccttttcgaattgttctagggattgtctagccggtacacgcaagggcatcatcgagggtgaacccacatgttgttttgaatgcgtcgaatgtccggacggcgagtattccgatgagactgacgcttctgcatgcaataagtgccctgatgacttctggagtaacgagaaccacacatcttgtatcgcaaaggaaattgagttcctctcctggactgagccgttcggtatcgctctgaccctgttcgcggttctgggaatttttttaacagcttttgtgctcggcgtgtttataaagttccggaacacacctattgtgaaggccaccaatcgcgaattatcttacctgctgctcttttctctcctatgttgcttctcatcatccctcttcttcattggggaaccccaggattggacttgtagactcagacaacctgccttcggaatctcgtttgtgctttgcatcagctgtattttagtcaaaacaaacagggtgctgctggttttcgaggccaaaatcccgacttcgtttcatcggaagtggtggggactaaatctccagttccttctggtgttcctctgcacattcatgcagattgtgatctgtgtgatctggttatatacagccccaccatcctcctaccgaaatcaggagctcgaagatgagatcatctttattacatgtcatgaaggcagcctgatggccctaggctttctgattggctatacctgccttctggctgccatctgtttctttttcgctttcaagtcccgcaaacttcctgaaaattttaacgaagccaagtttattaccttttccatgcttatcttttttattgtctggatatctttcattcctgcttacgcatccacctacggcaaattcgtctccgctgtcgaagtcatcgctatcctggctgcctcctttgggctgttggcctgcatatttttcaacaagatttacattatcttgtttaagccttccaggaataccattgaagaggtaagatgttctacggctgcccatgcttttaaagtggctgcaagggccaccctgagacgatctaatgtgagtcggaaacgcagttcctctttgggcggttccaccgggtctactcctagtagctctattagctcgaaatcgaactcggaagaccctttccctcaaccagagcgccaaaaacagcagcagcccctcgccctgacccagcaggagcagcagcagcagcctctaactctgcctcaacagcaacggagtcaacaacagcctagatgtaagcagaaagtcattttcggctccggcaccgttaccttcagcctgagttttgacgaaccgcaaaagaatgctatggctcatcggaacagcacacaccagaacagtctggaagcacagaaatcttcagacactctgacccgccacgagccgcttctgcctctgcagtgtggggagacagacctggacctcaccgtacaggagactggcctacagggccctgtgggtggagatcagagaccagaggtggaagacccagaagaactttctccagccctggtagtgtcctcttcccagtctttcgtgattagcggtggcggaagcaccgttacagagaacgtcgtgaatagttag

SEQ ID NO: 216730 - DNA, 3237 bp, Artificial Sequence
  Description of Artificial Sequence: Synthetic coding sequence
atggcgttttactcatgttgttgggtgctcctggcgctgacctggcacacctccgcctacggtccagaccagagagcccagaagaagggggatatcatcctcggcggactgttcccgattcacttcggcgtcgcggcaaaagatcaggacctgaaatctagaccggaatctgtcgaatgtattcggtataacttccgaggctttaggtggctgcaggcgatgatctttgctattgaagagatcaacagctcacccgctctactgcccaacctgacattgggctaccggattttcgatacatgcaatactgtgagcaaagcgttggaagctactctgtcatttgtggcccaaaataaaatcgatagtctgaacttagacgaattctgcaattgctcagagcacattccaagcactattgccgtggttggggctactggaagcggagtgtctactgcagtggccaacctgctgggcctgttctacatccctcaggtctcttacgctagtagcagccgccttctttctaataaaaatcagttcaaaagctttctaaggaccattcccaatgacgagcatcaggctaccgcaatggcagatatcatcgaatattttaggtggaactgggttggaaccatcgctgcagacgacgactatggcaggccgggtatcgaaaaattccgcgaggaggcagaagagcgagatatttgcattgattttagcgaactgattagccagtatagcgatgaagaagagatacagcacgtggtcgaggtaattcaaaattctacagcaaaagtcatagtggtctttagctccggtcctgatttagaacccctgattaaggaaattgtccgccgaaacattactggtaagatttggctggcttcagaggcttgggcctcatcctccttgattgccatgccacagtatttccatgtggtcggcggaaccatcggcttcgctctcaaagcaggtcagatcccaggattcagagagttcctcaagaaggtgcacccccgaaaatccgtccataacgggttcgctaaagagttttgggaggagacttttaattgccatcttcaggagggagcgaaggggccactacccgtcgacactttcctgagaggccacgaggagagcggagatagattttccaactcaagcaccgccttccgcccactctgtaccggtgacgaaaatatcagcagcgtggagacaccatacattgattacacccatctgaggattagctacaacgtttatcttgcagtgtattccatcgctcacgctttgcaagatatttatacctgtctccctggccgaggcctctttaccaacggaagctgcgccgatatcaaaaaggttgaggcatggcaagtgctgaaacacctgaggcacttaaatttcactaataacatgggcgagcaagtcactttcgacgaatgtggcgacctagtaggaaattattcaatcataaactggcacctctcaccagaagacggtagtattgtgttcaaggaggtgggatactacaacgtgtatgccaagaaaggagaacgcctgttcatcaacgaggaaaagatcctctggtccgggttctctagggaggtaccatttagcaattgtagcagggactgccttgccggaacgcgtaagggtatcattgagggagaaccaacctgctgtttcgaatgtgtcgagtgtccagacggcgagtactctgatgaaaccgatgcatccgcctgtaataaatgccctgacgacttctggtctaatgagaaccacacgtcctgcatagccaaggaaattgaatttctttcctggactgaaccgtttggtattgccttgactctcttcgccgtgttgggcatttttcttactgcgtttgtgttgggagtgttcatcaaattcagaaatacccccattgtgaaagctaccaatcgtgaactgtcctatcttctgctgttctccctgttatgctgcttctcttcatcccttttcttcatcggggagcctcaggactggacatgcagattgcggcagcccgcttttgggattagcttcgtgctgtgtatcagctgtattctcgtgaaaacaaaccgggttctcctggtattcgaggctaagattccaacttcgttccacagaaagtggtggggtcttaatctgcagtttctgctggtctttctctgcacttttatgcaaatcgtaatatgcgtcatctggctgtatacagcacctccatcctcctatcggaatcaggaactggaggacgagatcatctttatcacctgtcacgaggggtctctgatggcactggggttcctcataggctacacgtgcctcctggccgctatctgctttttttttgctttcaagagtaggaagctgcccgaaaactttaacgaggccaaatttattacgtttagtatgctgatcttcttcattgtgtggatcagcttcatccctgcttacgcctccacctacggcaagttcgtctccgccgtcgaggtgatcgccatattggccgcaagcttcggcctgctggcgtgcatctttttcaataagatttatatcatcctgttcaaaccatcccggaatactatcgaggaggtgcggtgttccaccgccgctcatgctttcaaggtggccgctagagccacactgcggcgtagcaacgtcagtaggaagagaagtagttcgctgggaggttccacaggatctaccccatctagctcaatcagttctaagagcaattctgaagacccattcccccagccggagcgccagaagcagcagcagcccctcgcactgacacagcaagagcagcagcagcagcccctcaccctgccccagcaacagcgttctcagcaacagcctaggtgtaagcagaaggtgatcttcggctctggcacagtgaccttctcgctgagcttcgacgagcctcagaagaacgcaatggctcaccggaactcaacccaccagaattccctcgaggcccagaagtcttccgacacactgacacgacatgagccactcctacctctgcagtgtggggaaactgacctggacctgactgtacaggaaaccggactccaaggtcccgtcggcggtgaccaacgacctgaagtcgaagatcctgaagagctcagccctgccttggtcgtctcctcttctcaaagttttgtcattagtggaggaggatcaaccgtgacagagaacgtggtcaactcttag

SEQ ID NO: 216731 - DNA, 3267 bp, Artificial Sequence
  Description of Artificial Sequence: Synthetic coding sequence
atggccttctattcctgttgctgggtgctcctcgcgttaacatggcacaccagcgcgtacggcccagatcagcgcgctcagaagaagggcgatattattctggggggactctttccgatacacttcggcgtggccgctaaggatcaggacctcaaaagtagacctgaatccgtagaatgtataaggtacaattttcggggtttcagatggctgcaagcgatgatcttcgccatcgaggaaatcaactcatcccccgctctcctgcctaatctcaccttggggtatcggatcttcgacacatgcaatactgtgagtaaagctttggaagcgacgctatcatttgtggcccagaataagattgattcattaaatctcgatgaattctgtaattgcagcgaacatataccctcaactatcgccgtagtaggggctacagggtctggagtctcaaccgctgtagcaaatttgttgggactcttctacataccccaggtctcctacgcttcttcctcaaggttgctgagcaataaaaatcagttcaaatctttccttcgcacaattccgaatgatgagcaccaggccaccgccatggccgatatcatagagtacttccgctggaattgggtcggcactatcgcagcagacgacgattacggtaggccaggaatcgagaagttccgcgaagaggccgaggaacgcgacatatgcatagacttcagcgaattgataagtcagtattcggacgaagaagagatccagcatgtagtagaagtgattcaaaacagtaccgcaaaggtgattgtggttttttcttctgggccagacttagagccactcatcaaggagattgttcggaggaacatcaccggcaagatctggctggcctctgaggcatgggccagctcatcccttatcgccatgccacaatacttccatgtcgtaggaggtaccatagggtttgctttgaaggcgggacagatcccaggcttccgagagttcttaaaaaaagtccatcccaggaagtctgtgcataacggattcgccaaggaattctgggaagagacatttaactgccacctgcaagaaggtgccaagggacctctgccagtcgatactttcctacgcggacacgaagagtcaggcgacaggttctctaattcctccactgctttccgacctctatgtactggcgatgagaacatctcaagcgtggagactccttacatcgattacacccacctgcgcatctcatacaacgtttatctggcagtgtattcaatcgcccacgcactccaggatatctacacttgtcttcctggacgcggtctgttcacaaacggaagctgtgcggatattaagaaggttgaggcctggcaggtgctgaaacacttgcgccacctcaacttcaccaacaatatgggcgagcaggtcacttttgacgagtgtggggacctggtcggaaactattctatcatcaactggcacctcagccctgaggatggaagtatcgtgttcaaggaagtcgggtactacaatgtgtacgcaaagaaaggagaaagacttttcatcaatgaggagaagatcctttggtccggattcagccgggagcctttaaccttcgttttgagtgtgctgcaggtgcctttttccaattgcagtagggactgccttgcgggtactaggaaggggattatcgagggtgaaccgacatgttgtttcgagtgcgttgagtgtcccgacggagaatactctgacgaaaccgacgcctctgcatgcaacaaatgccctgatgatttttggtcaaacgagaaccatacctcctgcatagcaaaagagatcgaattcctgtcctggaccgagccattcgggattgcactgactctcttcgccgtgctcgggatcttccttaccgcctttgtcctgggggtttttattaaattccgaaacactccaatcgtgaaagcaacaaatcgtgagctgtcttatctcctgttattttctttgttatgctgctttagcagctcactattttttattggagagcctcaggactggacctgtagattaaggcagccagctttcggaatttcctttgtactgtgcatctcctgcatcctggttaaaacaaatagggtgctgctggtgtttgaagccaaaattcccacctcatttcaccggaagtggtggggcttgaatctccaatttcttctggttttcctctgcacgttcatgcagatcgtaatctgtgtgatctggctgtacactgcccctccgagtagttaccggaatcaagagcttgaggacgagatcatttttatcacatgtcacgagggatccctgatggccctgggctttctaattggctacacttgtctccttgcggctatttgttttttctttgcctttaaatccaggaaacttcccgaaaatttcaacgaagccaaatttataacattcagcatgttgatattctttattgtctggatcagttttataccagcctatgcctcaacctacggtaagttcgtctccgctgtcgaagttatcgcaatcctcgcggctagctttggactgcttgcttgtatcttctttaacaaaatttacattattctgttcaaaccgtctcgcaacacaattgaagaagtacgctgcagcacagcagcccacgccttcaaggtggcagcacgcgcaacactgcgcaggtcaaacgtctctcggaaaagaagcagcagcctcggaggttctaccggatcaaccccttccagcagcatcagctcaaagagcaactctgaggatccttttcctcagccggaacgccaaaagcagcagcagcctctggcattgacccagcaggagcaacagcagcaaccactcaccctgccccagcaacagaggtcccagcagcagcctcgctgtaagcagaaggtgatctttggctcaggcacggttacgttctctctgtcatttgatgagccccagaaaaatgccatggcccatcgcaattctacccatcagaacagcctggaggcgcagaaatcatccgacactctgactagacacgaacctcttctgcctttgcaatgtggcgagacagatcttgatctcacggtgcaggagacggggctgcagggcccagtggggggagaccaaagacctgaggttgaagacccagaagaactgtcccccgctttggtggtctctagcagccagtcctttgtgattagcggaggaggcagcactgtgacggagaacgtagtgaactcatag

SEQ ID NO: 216732 - DNA, 978 bp, Artificial Sequence
  Description of Artificial Sequence: Synthetic coding sequence
atggcccgacctgtgtcagacaggactcccgctccactgctgctgggaggcccagcagggactccccctggtggtggcgctctgctgggcctcaggtccttactgcagggaaccagcaaacccaaagagccagcctcttgcctgctgaaggaaaaggaaaggaaggccgcactgcctgccgctactactccagggcctggacttgagacagcgggacctgctgacgccccagcaggtgccgtcgtgggaggtggtagtccccgagggaggcctgggccagtgccagcccctggcctgcttgcaccactgctgtgggagcgcacactgcctttcggcgacgtggagtacgtcgatctcgatgcgtttctgctggaacacggactgccccctagccctcctccccctgggggaccttctccagagccttctccggcacggacccctgcaccgtcacccggaccagggtcttgcggatccgcatcacctagaagctcaccaggccacgctccagcgcgtgcagcattggggaccgcttctggacatagggccggactgacaagtcgggacacaccttcaccggtggatcccgacactgtagaagtccttatgacatttgagcccgatccagctgacctggcgctgtccagcatcccaggccatgaaacattcgaccccagaagacaccggttctcggaagaggagttaaaaccccagcctattatgaaaaaagcgaggaaaattcaggtaccggaggaacagaaggacgagaaatattggagcagacgctacaaaaataatgaggccgctaagcgatcccgagatgcccgtcggctcaaggagaatcagatttctgtccgagccgcttttttggagaaagagaacgcattgttgcgccaggaggtagtcgccgtaaggcaggagctttctcattatcgtgcagtgctgtcaagatatcaggctcagcacggggctctatag

SEQ ID NO: 216733 - DNA, 969 bp, Artificial Sequence
  Description of Artificial Sequence: Synthetic coding sequence
tcacagaggggtaaagggacgtgtcccggatcacaccgcaaccatgcttcctctctgcccagccacgggctggtgtcaattcagggcatctcagcaccagcgggacaatggcctgcccctcccccatggtcacaagaagggatgcagtgtcacagggacctagcactgtcacaggctttatgggggtggcagctttcaaagcagtctggatgggctcatccgagcctccctcatagccccctgccatccactgtccattcctgctcctgggcgccaccccacctccagcgacatctgccattagcaactgtctctccaggtactacacaacttacccaggggccagccggtcggacccttggccagacccaggcaagctgccccgagcccagacctagcatggacgccgtggacgccacaatggagaagctgagagctcagtgtctgagcagaggggctagtgggattcagggactggccagattctttcgacaacttgaccgcgatggaagtaggagtcttgatgccgatgagttcagacagggactggccaagctcgggctcgttctcgaccaagccgaggctgagggagtgtgtaggaagtgggatcgaaatggatcaggcactttggacctggaggagtttctgcgggctctgcggcctccgatgtctcaagcacgtgaggcggtcattgcagctgcctttgcaaagctagacaggtccggagatggagtagttaccgttgacgacctcaggggagtgtattcaggaagggcacatcctaaggttcggtctggagaatggacggaagacgaggtgcttcgaagattccttgacaactttgattcgtcagaaaaggacggacaggtaactctggccgaatttcaggactattattcaggggtatcagcatctatgaacacggacgaggagtttgtggcaatgatgacatcagcttggcaactctag

SEQ ID NO: 216734 - DNA, 489 bp, Artificial Sequence
  Description of Artificial Sequence: Synthetic coding sequence
atggacgccgtggacgccaccatggagaaacttcgcgctcagtgtctctccaggggtgcctccggaatacagggactggcgaggttctttagacaattagacagagacggttcccggtcacttgacgcagacgagttccgtcagggacttgccaagcttggcctcgtgctggaccaggcagaagctgagggggtgtgccgcaagtgggacagaaatggtagcggcaccctcgacctggaagagtttctcagagccctcagaccacctatgagccaggcaagggaagcagtgatcgcggctgcctttgcaaagctcgatagaagtggagatggagttgtcaccgtggatgatctgaggggagtgtacagcggcagggcccatcctaaggttacattggccgagttccaggattattatagcggcgtgtctgccagcatgaatacggatgaagagttcgtggccatgatgactagtgcctggcagctgtag

SEQ ID NO: 216735 - DNA, 882 bp, Artificial Sequence
  Description of Artificial Sequence: Synthetic coding sequence
ctgattaacattctttaccgggctgtgattagcgaccccgagcaaaacctcgctatagagcaaaaggagagcgaccatatcctacccgactccaaaatgacacccctaagattcagaaaaaggacactgcacgaaactaagattaggacccacagtaccttgacggagaatgtgctgagccataagctccagtttgatgggaggatcgtatcccgcacaaatgtactgccatttatacagaagagtatctacagccaccagtgtggaaggagaaaagggaaacagtaccgactcggggatttctacgtgggagcaacgttgacgttcctatcctctgaccacctgtccctgcctgagtctataaaggaaaatacactcctgaaactgcgcattaccaatattgaccagatcgctctggactctctgaagacggcatccatggagcaagaggacgatatcataattcaggagacaaacgatagattagtgttcaaggccattcaagatgtactcaaggaaaaactgcacaagcggggtgtaaggatactaactggtctggggaagtatttccagcagctcgacaaagagggcaatggccttcttgacaaggccgatttcaaacaagcccttaaagtcttccatcttgaagtgtctgagaaggattttgagtcggcctggttaatcctgaatgataacggcaacggaaaggtagactacggtgaattcaaacggggaatcataggcgagatgaacgagtataggaaatcttacgtaagaaaggcattcatgaagctcgatttcaacaaatccggtagcgtacccatcatcaatatcaggaaatgctactgcgcgaagaaacacagccaggtgataagcggttag

SEQ ID NO: 216736 - DNA, 1149 bp, Artificial Sequence
  Description of Artificial Sequence: Synthetic coding sequence
atgattgatcacctctcccgcgcagtgataagtgatcccgagcagaacttggccatcgagcaaaaagagagcgatcacatcctgcccgactccaaaatgacgcctttaagatttcggaagaggacactgcacgagacaaagattcggacacactccaccctcacagagaacgtcttgtcacacaaattgcagttcgacggtagaattgtgagccggaacggtcgagatgcttgcagggagctgatcggattcttctttacccatgatcagtccctgacaatctacgagtatcgccaattcggaaagaaccgcacgaacgtcttgccatttatccagaagtctatctattctcaccaatgtggcagacgaaagggaaaacaatacaggctgggcgacttctacgtgggggctaccctgacatttctgtcgtctgaccatctctcactccccgagagcatcaaagagaacaccttgttgaagcttcggatcaccaatatagatcagattgcgctggatagtctgaagaccgccagcatggagcaagaggatgatattatcatacaggagaccaacgaccggctggtgttcaaggctattcaggacgtgctgaaggaaaaactgcacaagcgcggtgtgagaattctgacaggtttaggaaagtattttcaacagctggacaaggaaggcaatggtcttctggacaaagcagactttaagcaggccttgaaggtatttcacttggaagtgagtgagaaagactttgagtcagcttggcttattctgaacgataatgggaacggaaaggtcgactacggtgaattcaagcggggaatcatcggcgaaatgaatgagtatagaaaatcttatgtgaggaaagcatttatgaagctcgattttaacaagtctggatccgttcctattattaacattagaaaatgctattgtgctaaaaaacatagccaagttatatccgggcattcgaccgaggaggaaatcaagtctagctttctcgaaacacttaaagtggcatgttcgaaatccgacgaagtgtcttacggcgaattcgaggattattatgaggggctgagcattggaattgtggacgatgaggatttcgtgaatatccttaggacaccttggggcatttag

SEQ ID NO: 216737 - DNA, 1674 bp, Artificial Sequence
  Description of Artificial Sequence: Synthetic coding sequence
atggggaatagcttttgctacaccgccgtgtactgtatgatcaacactgggacccagatggatttggaagtgaaaggggtggccgcaacgtctaggtcccagattcagccattctttggcagaaaaaaacctttgcagcagaggtggacttccgagtcgtggacaaatcagaacagctgtcctccagtcgttccacgcttggatctgggttcgctggttgactccgacgacgaagataacttcagttacataccactgagtaccgcgaatttgccaaattcgtcaagtactctaggatgggtcacaccctgtcaaactccctacacgcaatatcatctgaacaagctcgaccaaaacatcatccccgagaacctcccagccccaaccgacaagtgcaaactcaagtaccagcagtgtaaaacagagattaaagagggctacaagcagtattcccagcgtaacgcagagaacacgaaatctaacgtcacgcataaacaatcacccagaaacaaaatcgatgagaagtgcgtccaagacgaagaggccaataccgatgacctgacaactctagatcgcaaagcaatcctgcaacagggctatgcggacaactcatgtgacaagcagcaaagggccagaaagctggacgctgagatcgtcgctgctgaaaagaagaagcagatagttgctgagcaggtgatgatcgaccatctatccagggctgtcatttctgaccctgaacagaatctggccatagagcagaaagaaagtgatcacattttgccagacagtaaaatgaccccacttaggttcagaaaacgcactctgcatgagactaaaatcagaacgcactctacactaaccgagaacgtgctttcacacaagctgcagttcgatggcaggattgtgtccaggaacgggagggatgcttgcagggagctaataggctttttctttactcacgaccagtctctcacaatctatgaataccggcaatttggaaagaataggactaatgtcctaccgttcatccagaaatctatctattcccatcagtgcgggcgtagaaagggcaagcagtacagactgggcgatttctacgtgggcgcaacccttacatttctgagctccgatcatttatctctccccgaaagtattaaggaaaacaccctcctcaagctgagaattactaatatcgaccagattgcactggattcattgaaaacagcatcgatggaacaagaagatgatataatcatacaggagactaatgaccggctggtctttaaggccatccaggatgtactcaaggaaaagctgcacaagcggggagtgcggatcttgaccggactgggaaaatattttcaacaacttgataaggagggcaacgggctcttggacaaagctgacttcaagcaagcactgaaggtattccatctggaggtgtcagagaaggactttgagtccgcttggctcatcctgaatgacaacgggaatgggaaagtggactacggtgaattcaaacggggaatcatcggtgaaatgaatgagtatagaaagtcttatgtccggaaagcgttcatgaaattagatttcaacaaatctggatccgtgcctattatcaacatccgcaaatgttattgcgctaaaaagcattctcaggtcatctctggctag

SEQ ID NO: 216738 - DNA, 615 bp, Artificial Sequence
  Description of Artificial Sequence: Synthetic coding sequence
atggaacaggaggatgacattataattcaggagacaaacgacaggttggtcttcaaggctatccaggacgtactcaaggagaaacttcacaaaagaggggtccgcatcctgaccggtctgggcaagtatttccagcagttagacaaggagggcaacggcctgctggacaaagccgacttcaagcaagcacttaaggtgttccacctggaggtgtctgagaaggattttgagtccgcctggctgatactgaatgacaatgggaacggcaaagtagactatggcgagtttaagagagggataataggcgagatgaacgagtaccgaaagtcctatgtccgcaaagcattcatgaaactggactttaacaaatccggctctgtcccaataatcaatatcaggaagtgttactgcgcaaagaagcattctcaggtgatcagcggccactcaactgaggaagagatcaaatcgtccttcctcgaaacactgaaagtggcgtgcagtaaaagcgatgaagtttcgtatggagagttcgaggactactatgaagggctgtccatcggaatcgtcgacgatgaggattttgtgaacatcctgcgcactccttggggcatttag

SEQ ID NO: 216739 - DNA, 3009 bp, Artificial Sequence
  Description of Artificial Sequence: Synthetic coding sequence
atggccgcacacgagtgggattggttccagagggaagagcttataggccaaatctcggatattagggtgcagaacctgcaagtcgaaagggagaatgtccaaaagcgaacctttacacggtggatcaatctacacctcgagaaatgcaaccctcctctcgaggtgaaggacctctttgtggatatccaagatgggaaaattctcatggccctcctggaggtcctgtctggaagaaacttgcttcacgaatataagagcagttcccatcgcatatttagattgaataacatagccaaagcgcttaagtttcttgaggacagcaacgtcaagttagtctcaatcgacgctgccgaaatagctgatggaaatccaagcctggttctcggtctcatctggaacattattttattttttcagattaaggaactgactggcaacctctcccgcaactctccaagctcttctttaagtcctgggtctggcggtaccgattctgactcttcatttccacctacgcctacagcagagcgctccgtggcaatcagcgtgaaggaccagcgcaaagcaatcaaggcactgcttgcttgggtgcagagaaagactcgcaagtacggcgttgcggtccaggacttcgcgggtagttggcggtccgggcttgcctttctcgccgtcattaaggctatcgatcctagtctggtggacatgaaacaggcactcgagaactcgactagagaaaaccttgagaaagcattttctattgcgcaggatgcactgcacattccacggttgcttgaacctgaggatatcatggtggatactcccgatgaacagtctataatgacatatgtcgcccagttcctggagcgttttcctgaactggaagctgaagatatctttgacagcgacaaggaagtcccaattgagtctaccttcgtgaggattaaagagacaccgtctgaacaggagagcaaggtgttcgtgctcacagaaaacggcgagcgaacatacaccgtcaaccacgaaacatcccacccccctcctagcaaggtgtttgtctgcgacaagccggagtccatgaaggagttcagactggacggcgtttcttcgcacgctctctctgattcctccaccgaattcatgcatcaaatcatcgaccaggtcttgcagggaggcccagggaaaacctcggatatttctgagccgtctccagagagttctattctcagctccaggaaagaaaatggcaggtccaattccttgccaatcaaaaagacagtgcattttgaggctgacacatataaggacccgttctgctcaaaaaacctctcgttatgcttcgaaggcagtcccagagtggcaaaggagagcttgaggcaggacggacacgtgcttgcagtggaggtggccgaagagaaagagcaaaagcaggaatcttcaaagatacctgagagcagctcagacaaagtcgcgggagacatcttcctggtggaaggtacaaacaataactcccagagttcatcctgtaacggcgctctggagtccaccgctcggcacgacgaggagagccacagtctctctcccccaggcgagaacacagtgatggccgatagttttcaaatcaaagtgaacctgatgactgtggaagccctcgaggagggggactatttcgaggccattccactgaaagcctccaaattcaactccgatctcatcgacttcgcgtccacgtcccaagcctttaataaggtcccctcgccacacgagactaaacctgacgaagacgccgaggcattcgagaaccacgccgagaaactaggcaaacgttccatcaagagcgctcataagaaaaaagatagccccgagccccaggtgaaaatggacaagcatgagccccatcaggacagcggagaagaggctgagggatgcccatcagccccagaagagactccagttgataaaaagcccgaggtgcacgaaaaagcaaaaaggaagtcaactaggccccattacgaagaagagggtgaggacgacgatctccaaggtgttggcgaggaactgtcgtctagtcctcctagttcatgtgtgtccttagagaccctgggaagtcactctgaagagggacttgattttaagccctccccgccattgtcaaaggtgtcagtgataccccatgatttgttctatttccctcattacgaggtcccactcgccgctgtgctggaggcatacgttgaagatcctgaagacctgaaaaacgaggagatggatctggaggaaccggagggctacatgccagacctggatagtagagaggaggaggcagatggctctcaatcgagcagttccagcagcgttcctggcgagagcttacccagcgcaagtgaccaggttctgtacctcagtagagggggtgttggcaccacacccgcatcggagcctgcccctctcgcacctcatgaggaccaccaacaaagggaaaccaaagagaatgatcccatggactcacatcagtcccaggagtcacctaatctggaaaatatcgctaaccccttggaggagaatgtgacaaaggaatcaattagctctaagaagaaagaaaagaggaaacacgtagaccacgttgagagctccttgtttgtggctccaggatcagtccagagttcagacgatctggaggaagacagcagtgattattctattccttctcggactagccactcagattctagcatttacctgaggcgccatacccatcgtagcagtgagtccgatcactttagctacgtgcagctgagaaatgccgctgatttggatgatagaagaaataggattctgaccagaaaagccaactctagcggggaggcaatgtcactgggctctcattcaccccagtctgatagccttacacagctggtacaacagcctgatatgatgtatttcatactctttctgtggttgctggtatactgcttgcttctgtttccccagctagatgttagccgattatag

SEQ ID NO: 216740 - DNA, 450 bp, Artificial Sequence
  Description of Artificial Sequence: Synthetic coding sequence
atggctgaccaactgaccgaagagcagatcgccgagtttaaagaagccttttctctatttgacaaggacggggatgggacgattaccactaaagagctggggacagtgatgcggtcactgggtcagaatccaacggaggccgaactgcaagacatgattaacgaagtggatgccgacgggaacggaactattgactttcctgagtttctgacgatgatggcgaggaagatgaaggacaccgacagtgaggaagaaatccgggaggcctttcgggtgttcgacaaagacgggaatggttacatctctgccgctgagctgcgacacgtcatgaccaatcttggggagaaactcacggatgaagaggtcgacgagatgattagagaagctgacattgacggcgacgggcaggtgaattacgaagagtttgtacaaatgatgaccgcaaagtag

SEQ ID NO: 216741 - DNA, 450 bp, Artificial Sequence
  Description of Artificial Sequence: Synthetic coding sequence
atggctgaccagctgacagaagagcagatcgccgagtttaaagaggctttctctcttttcgataaagatggggatggaactattacaacgaaggagctcggcaccgttatgcggagcctgggccaaaatcccaccgaagctgagcttcaggatatgataaacgaagtggacgctgatggcaatggcacaatcgacttcccagaatttctaacgatgatggctcgaaagatgaaggatactgactcagaggaggaaatacgagaagcatttcgggttttcgacaaggatggcaacggctacatcagcgccgcagagctgagacacgtgatgactaacctgggagaaaagctcaccgacgaagaggtagatgaaatgatcagagaggccgatattgacggagatggacaggtcaactacgaggaatttgtgcagatgatgacagcgaaatag

SEQ ID NO: 216742 - DNA, 450 bp, Artificial Sequence
  Description of Artificial Sequence: Synthetic coding sequence
atggctgaccagcttactgaggaacagattgcggaatttaaagaggctttcagtctgtttgacaaagatggagatggcacaatcaccacaaaagagctaggaaccgtgatgcgctcccttggtcagaatccaaccgaagccgagctacaggatatgataaatgaggtggatgctgacgggaatggtaccatagacttccctgagtttttaacaatgatggccagaaagatgaaggacactgacagcgaggaggaaattcgagaggcatttagggtattcgacaaggatggaaatggttatataagcgccgctgagttgcggcatgtgatgacaaatcttggcgagaaactcactgacgaagaggtggacgaaatgatacgtgaagccgacatagatggtgacggccaagttaattacgaggagtttgtgcagatgatgaccgcgaaatag

SEQ ID NO: 216743 - DNA, 450 bp, Artificial Sequence
  Description of Artificial Sequence: Synthetic coding sequence
atggcagaccagctgacagaggagcagatcgcggaattcaaagaagcctttagtctttttgataaggacggcgacggaaccattacaaccaaggaattgggcaccgtcatgcgaagccttggccaaaaccccaccgaagctgaactgcaggatatgatcaacgaggtggatgccgacggtaacggcactatcgactttccagagtttttgacgatgatggcccgaaaaatgaaagacaccgacagcgaggaggaaatcagagaagccttcagagtgtttgataaggacggaaacggctacatttccgccgcagagctgcgccatgtgatgacaaatctgggagaaaaactgacagacgaggaggtagatgaaatgatccgcgaagcggatatcgatggcgacggccaagttaattacgaagaatttgtgcagatgatgactgccaaatag

SEQ ID NO: 216744 - DNA, 5022 bp, Artificial Sequence
  Description of Artificial Sequence: Synthetic coding sequence
atgtggcgggctgaggggaagtggctacccaaaacctcacggaagtctgtgtcccaaagcgtcttttgtgggacgtctacatactgcgtgcttaacactgtaccaccaattgaggacgatcacggaaacagcaacagcagtcatgtgaagatcttcctaccaaaaaagctgctggaatgcttgccaaagtgttcttctctcccgaaagagcggcatcgctggaacacaaatgaggaaattgccgcttatctgatcacatttgagaagcacgaagaatggctgaccacgtcacctaagacccgcccacagaacggtagcatgatcttatacaacagaaagaaagtaaagtacaggaaggacgggtactgttggaagaagagaaaagatggaaagacaacccgcgaggaccacatgaagctcaaagttcagggagtggagtgcctgtacggatgctacgtgcactcctctattattcctacttttcatcggagatgctattggctcctgcagaatccggacatcgtactcgttcattatctcaacgtcccagccattgaagattgcggcaaaccctgtggaccgatattgtgttctattaacacagacaagaaggaatgggccaagtggacaaaggaggaactaattgggcagttaaagcccatgttccacggaatcaaatggacctgctctaacggtaatagctcatcggggttcagcgttgaacagctagtgcagcagatcctggactcccatcaaacgaagccacagccccgaactcataactgcttatgtacggggtcactgggggcagggggaagcgtgcatcataaatgcaactctgctaagcatcggatcatcagccctaaggtcgagccccgaaccggtggatatggatcccactcggaggtgcagcataacgatgtctccgaaggcaagcatgaacatagccatagcaagggctctagtcgggagaagcggaacggaaaggtcgccaaacccgttctcttgcaccagagctcaacagaggtctcctccacaaatcaggttgaggtacctgatacaacacagagcagtccagtgtcgattagttctggcctcaactcagatcctgacatggtggatagtcctgtggtgaccggcgtgagcggaatggcagtggcttcagtgatgggaagcctgtcacaatccgccaccgtatttatgtccgaggtgaccaatgaggcggtgtacactatgagtcccacggcagggcctaaccatcatctgctgagccccgatgcctctcagggcctcgttctggcagtcagcagtgacggtcacaaattcgctttccccacaaccggcagctcggagagcctgagcatgttacccaccaatgtaagtgaagaactggtgctgtcaaccacattggatggcggtcgaaaaatccccgagaccacaatgaatttcgatccagactgcttcctgaacaaccccaaacaggggcagacttacggcggaggagggctcaaggccgaaatggtatcttcgaacattcgacactctcccccaggggagagatctttttccttcaccaccgtcctgactaaggagattaagaccgaagatacgagttttgagcagcaaatggccaaggaggcttatagtagcagcgcggctgcagtagccgcatcgagcctcactttgactgccggaagcagtctgctgccatccggaggcggactgtccccttccacaactctagagcagatggactttagcgcgatcgattccaacaaggactacacaagttcattctcccagaccggccactcccctcacatccaccaaaccccttccccgagcttttttctgcaggacgcctcgaagccactaccggtggaacagaatacccattctagcctttcagacagtggaggaacttttgtgatgcccacggttaagaccgaggcctccagtcagacgtcctcatgctcgggccacgtggagacccggatcgagtcgacctcctccttacacttgatgcagttccaggccaattttcaggccatgaccgcagagggggaagtgactatggagacttcccaggccgctgaagggtcagaggtgctcctcaaaagtggagaactgcaagcatgttcaagcgaacactatctgcaacccgagaccaatggcgttataaggtcggcaggcggagtgcctatcctgccgggaaacgtggttcagggcctgtacccagttgctcaaccatctctcggcaacgcctccaacatggaattgtctttggaccatttcgacatatcattcagcaaccagttttctgacctcattaatgacttcatctcagtcgagggaggttcctccacgatctacggtcaccagcttgtgtccggtgacagtacggcactctcccagagcgaggatggtgcacgcgctcctttcactcaggctgaaatgtgcctcccctgttgcagccctcagcagggctccctacagctctcgtcttccgaaggcggtgcttcaacaatggcttatatgcacgtggccgaggtggtgagcgctgctagtgcccaggggacattaggaatgctacagcagagtggacgagtttttatggtgacagattactctcctgagtggagctacccagagggcggagtcaaggtcttgattaccgggccatggcaagaggcctccaataactactcatgtctgtttgaccagatctccgtgcctgctagtctgattcaaccaggagttctgcggtgttattgtcctgcccacgataccggcttggtcaccttgcaggtagctttcaataatcagattatttcgaacagtgtggtattcgaatacaaagcaagggctctaccgaccctgccgagcagccagcatgattggctgtcccttgatgataatcagttccgtatgagcatcctggagcgacttgaacagatggagagaaggatggcagagatgactggaagccaacagcataagcaggcttccggtggcggtagtagtggtggcggatcaggtagcggcaacggcggaagtcaggcccagtgtgcctctggcacgggagcgttaggaagctgtttcgagtccagagtggttgtggtgtgtgaaaaaatgatgagtagagcttgttgggcaaagtcaaaacacctgatccactctaagacattccgaggcatgacactgctccacttagcagccgcacaaggatacgctactctgatccaaacacttatcaagtggcgaaccaaacacgcggactccatcgacctggaactggaagtcgatccactgaatgtagaccactttagctgcacaccactgatgtgggcgtgcgctcttggtcacctggaggccgcagtcgtcctgtacaagtgggaccggagagccatttccatacctgactcccttggtcgcctacctctgggaatagctcgttcgcgcggtcatgtgaagttggcagaatgtttagagcacctccagagggatgaacaggcccagctgggacagaacccgaggattcattgtcctgctagtgaagaaccaagcacagaatcttggatggcccaatggcactccgaagccataagctcccctgagattcccaagggagtaaccgtcatagcatccaccaatcctgagttgagaagacctaggtccgagccctccaactactactcttcggaatcacataaggattatcctgcccctaaaaagcataaactgaacccagaatacttccagaccagacaggaaaaacttctcccaacagccctgtctttagaggagcccaatattcggaagcagtccccaagctcgaaacagtcagtacccgagactctatctccttccgaaggcgtgcgtgatttctcaagagagctgagccccccaacaccggaaactgctgcctttcaggccagtggatcacaacctgtgggcaagtggaactccaaagacctttacatcggggtgagcacggtacaggtgacaggcaatcctaaagggacatctgttggcaaggaggcagcacctagccaagtccggcctcgagaacccatgtccgttctgatgatggcaaaccgagaggtagtgaatacagaactgggaagctatagggatagtgctgaaaatgaggagtgcggtcagccaatggacgacattcaggtgaacatgatgacactggccgaacatatcattgaagccacacccgatcgtatcaagcaggagaactttgtacccatggagtcctctgggctggaaagaacagatcccgctacgatttcctcaactatgagttggctagcctcgtatctggctgacgcagactgtctgccatcagcagctcaaattagatccgcctataacgaacccctcactccatcttctaatacttctttatccccggtgggctccccagtgtccgaaattgcatttgagaaaccaaacctgccttccgccgcagattggtcagaatttctcagcgcaagtacgtcagagaaggttgaaaatgagtttgcacagctaaccctgagcgatcatgaacagagagagctctatgaggccgctaggctagttcagacagcctttcggaaatataagggccgtccccttagagagcaacaggaagttgcagccgcagtaattcaaagatgttacagaaaatacaaacagtatgctctgtacaagaagatgactcaagccgcaattctgatccagtccaaatttagaagttattatgagcagaagaagttccagcaaagcagacgagctgcggtgcttatccaaaagtactacaggagctacaaaaagtgcggcaagaggcgacaggctaggaggacggcagtgatcgtgcagcagaagctccgttcttccttgctgaccaagaaacaggatcaggcggctcgaaaaatcatgaggtttctgaggcgctgcaggcattctcctttagttgatcatcgcctatataaaagaagcgaacgcattgaaaagggccagggaacctat

SEQ ID NO: 216745 - DNA, 1911 bp, Artificial Sequence
  Description of Artificial Sequence: Synthetic coding sequence
atgatgtcccgcgcatgctgggctaaatccaaacaccttatccactccaagaccttccggggaatgacgctcctacaccttgccgcagcccaggggtacgccaccctgattcagactctgataaagtggagaacgaaacatgccgattcaatcgacctcgaacttgaagtggatccgctcaatgtggaccatttcagttgtacacccttgatgtgggcttgcgcactgggtcacttggaggccgcagttgtgctgtataaatgggaccgacgtgctatctctattcctgatagtcttggacgattgcccctgggcatcgctcgctccaggggacacgtgaaactcgcagaatgtctcgaacatctgcagcgcgacgagcaagcccagttgggacagaatccaagaatccactgccctgcttcagaagaacctagtacagaaagctggatggcgcagtggcacagcgaagcaatctcctcaccggaaattccaaaaggcgtaaccgtgattgcttcaaccaatccagagctccggaggcccaggagcgagccatccaattactactctagcgaaagccacaaggactatcccgcaccaaagaagcataagctaaatcccgaatactttcagacacgtcaggaaaaactgctccctacagctctgtccctcgaggagccaaatatccggaaacaatcccccagctccaaacagagcgtgcccgagactctgagtccctctgaaggcgtgagggatttcagtcgcgaactgagccctcccacacccgagactgcagcctttcaagcttccggatcccagcccgtgggcaagtggaatagcaaagatctgtatatcggcgtgtcaacagtacaggtgaccggaaacccaaaagggacttcagtgggcaaggaagcggcacctagccaggtgcggcctagagaaccaatgagtgtgctgatgatggccaatagagaggtagtaaataccgagttgggaagctaccgcgatagcgcagaaaacgaagaatgtgggcaacctatggacgacatccaagtcaacatgatgacattggcagaacatatcattgaggctaccccagaccgcatcaagcaggagaacttcgttcctatggaaagctcagggctggaacgaactgacccagccacaattagctcaactatgagctggcttgcttcctatctggcggacgcagattgtctccctagtgccgctcaaataaggtccgcttacaatgaaccgctcacccctagtagcaatacaagcctgagtcccgtgggcagtcccgtcagtgagatcgcttttgagaagcccaatcttccaagcgctgccgattggagcgagtttctgtctgcttctacctccgaaaaagtggagaacgagtttgcgcagctcacgctgtcagatcacgaacagcgggagctgtacgaggctgctcgcttggtccagactgccttcaggaaatataagggaaggcctctgcgcgagcaacaggaagtagccgcagccgtaatacaacgatgttatagaaaatacaagcaggggaaaaacatttgcctgaaatatgccctgtataaaaagatgacacaggccgctatcctgattcagtccaaattccgtagctattacgagcaaaagaagttccagcagtccagacgcgctgccgtccttatccagaagtattataggagctataagaaatgtggcaagagacgccaagcacgacgcaccgccgtgatcgttcagcagaagctgcgaagtagcctgttaacaaagaaacaggatcaggctgcccgtaagattatgaggttccttcggagatgtcgccatcgtgttaaagagctcaaaaaagcaaaagaactcgaagatatccagcagcacccccttgccatgtag

SEQ ID NO: 216746 - DNA, 2151 bp, Artificial Sequence
  Description of Artificial Sequence: Synthetic coding sequence
atggcttgtccagtctccccagaccacaagcaggaaggagcgcacgatacggggcttgtcacgctgcaggtggcctttaataaccaaatcatttccaattccgttgtttttgagtacaaggctagagctcttcccaccctgccatccagccagcatgattggctctctctcgacgacaatcagtttagaatgagcatattggagaggctggagcagatggagcggaggatggcagaaatgacagggagccagcagcataagcaggccagtgggggtgggtcaagcgggggtggatccggcagcggtaacggcggtagccaggctcaatgcgcgtccgggacaggggctctcggatcctgtttcgagtcgcgtgtggtcgtcgtgtgcgaaaaaatgatgagccgcgcttgctgggcaaagtccaagcacctgatccactcaaagacattcaggggcatgactctcctacacctggcagctgcacagggatatgctactctcattcagactctgattaagtggaggaccaaacatgccgattccatagacttggagcttgaggtggacccactgaacgtggaccacttctcctgtaccccattgatgtgggcctgcgcattagggcatctcgaagcagctgtcgtactctataaatgggataggcgagctatttccataccggattcactggggagacttcctctgggcatcgcacggtcgaggggccacgtgaaattagccgaatgtctcgagcacctccaacgcgacgagcaggcccagttgggacagaatcccagaattcactgccccgctagtgaagaaccttctactgagtcctggatggcccagtggcacagtgaggctatctcttctcccgaaataccaaagggcgttaccgtgatagcatctacaaaccctgagctgagaagacctagatcagagccgtccaattactacagctcagagtcacataaggattatccggctcctaaaaagcacaagctgaatcccgaatattttcaaacgcggcaggaaaaattactcccgactgcactttccttggaggagccaaacatccggaagcaatcaccaagctcgaagcagagtgtaccggagacactatcaccgtctgaaggtgtgagagatttctcccgtgagctgagccctccaacccctgagaccgctgctttccaggcaagtggctcacagcctgtggggaagtggaattcgaaggacctgtacattggcgtgtcaaccgtgcaggtgactggtaaccccaagggaactagtgtggggaaagaggccgcaccaagccaggtgcgaccgagggagccaatgagtgtgctgatgatggctaaccgggaagtagtgaacacagaactcggatcatacagagactcagccgagaacgaggagtgtgggcaacccatggatgacatccaggttaatatgatgaccctcgccgagcacattatagaagccacattatcctccactatgtcctggctggccagttatctggctgatgccgactgcctaccctcggcagcccagataagatcagcctacaacgaacctcttaccccgagctctaacacaagcctgagccccgtcggctcacccgtctcggagattgcctttgagaaagttgaaaacgaattcgcccagctgaccctgtctgatcacgagcaaagagaactatacgaagctgccagattagtgcagaccgctttccggaagtataaggggagacctttacgagaacaacaggaggtagccgctgctgtcatacagaggtgctaccgcaaatataagcagtatgcactgtacaagaaaatgacacaggccgcaattcttatccagagcaagttcaggagttactatgagcagaagaaatttcagcagtctcgacgggctgcagtccttatccagaagtactaccgcagctataaaaaatgcggaaagcgccgacaagccagacggactgccgtgattgtgcaacaaaaactgcgcagctccctcttaacaaagaaacaggatcaagctgctcgtaaaatcatgagatttctccgcagatgtaggcaccgagtcaaggaactcaaaaaggcaaaagaattagaagatatccagcaacacccgcttgctatgtag

SEQ ID NO: 216747 - DNA, 4980 bp, Artificial Sequence
  Description of Artificial Sequence: Synthetic coding sequence
atgtggcgggcagaagggaaatggctccctaagacttcacgtaagtcagttagtcagtcggtgttttgtggcacttccacttattgcgtgctgaacacagtgccacctatcgaagacgaccacgggaatagtaactcttcccacgtcaaaatcttcctgccaaaaaagctgcttgagtgcctcccaaagtgttcatctcttccaaaagaacgccaccggtggaatacgaacgaggagatcgcagcctatttaatcacctttgaaaaacacgaagagtggttaactaccagcccaaaaaccagaccccaaaacggaagcatgatactgtacaaccgaaaaaaggttaagtatagaaaagacggttactgctggaaaaaaaggaaagatggtaaaacaacaagggaagatcacatgaagctgaaggtccagggggtcgagtgcctctacggctgttacgtgcacagcagcatcattccaaccttccacagacgctgctactggctgctgcaaaacccagatatcgtgctcgttcattacttgaacgttcccgcaattgaagactgtggcaagccctgtggacctatcctctgctcaataaataccgacaaaaaggagtgggccaaatggactaaagaggagctcatcggacaattgaagccaatgttccacgggattaagtggacatgttccaacggaaattcctcctcaggcttctcggttgagcaactggttcagcaaatcttggactcgcatcaaactaagcctcaaccaaggacgcacaactgcctttgcactggatccctgggagcaggaggttctgtgcaccacaagtgtaactctgccaagcaccgaatcatatctccaaaggtggagccgagaaccgggggatatgggagtcacagcgaagttcagcacaacgacgtaagcgagggcaagcacgagcatagccactccaaaggaagttcaagggaaaaaagaaacggtaaggtggcaaaacctgtccttcttcaccagtcctccacagaagtgagctccacgaatcaagtggaagtgcccgatacaacccaaagctccccagtgagtatctctagcggactcaacagcgatccagacatggtagatagccctgttgttactggagtgtcaggtatggcggtagcgagcgtgatgggtagcctaagccagagtgccacagtatttatgagtgaagttacgaacgaagccgtgtacaccatgtcccctactgcagggccaaatcatcatctgctctcccctgatgcctcccagggtctggtgctggctgtgagctccgacggccataaatttgcttttcccacgaccgggtccagcgaaagcttgagcatgctccccacaaatgtgtccgaggagcttgtgctgtcaaccacactggacggagggaggaagatccctgagaccactatgaatttcgaccctgactgcttcctgaacaatcctaaacagggtcagacatacggtggcggtggtctgaaagctgaaatggtatcgagtaacatccgtcattcaccaccaggagagcggagtttttccttcactaccgtgctcacgaaagaaatcaagactgaggatacaagctttgagcaacagatggccaaagaggcatactcaagcagcgctgccgctgtggccgcttctagtctgactctcaccgccggatcgtctttgctaccctcgggaggagggctttctccgtcaactacactagaacagatggacttctctgcgattgatagtaataaggactacacaagcagcttttctcagactggacactctccccatatccaccagacccctagcccctcctttttcctgcaggatgcaagcaagcccctgcccgttgagcagaacacacactccagtctgagcgactcaggtgggaccttcgttatgcccacagtgaaaaccgaggcttcatctcaaacttccagttgtagcggccatgtcgaaacccgtattgaatctacgtcatccctacacctaatgcagttccaggccaatttccaagctatgactgcggagggcgaggttacaatggagacctcacaagcggctgagggatctgaagttctgttaaagtcaggcgaactgcaggcctgcagttctgagcactacctgcagcctgaaacgaatggtgtaatcaggtcagctgggggtgtccctattctgccaggaaacgtcgttcagggcttataccccgtcgcacagccatccctgggcaatgcatctaatatggagctgagccttgaccattttgacattagtttctctaatcagttctccgatttaattaacgacttcatcagtgtggagggtgggagtagtactatttacggccatcagcttgttagcggagattctaccgcactctcacagagcgaagatggcgcaagagccccattcactcaggccgagatgtgtctgccctgctgcagcccgcaacaggggtcacttcaactgtcttctagcgaagggggagccagcacaatggcatatatgcacgttgccgaggtcgttagcgccgcttctgcccaagggactctcgggatgctgcagcagagcggacgggtgttcatggtcactgattacagccctgaatggagctacccagaaggtggagtcaaggtcctaatcaccggcccatggcaggaagccagcaacaactacagctgccttttcgaccagatttcagttccagcttcactcatacagcctggagtactgcgctgctactgtcctgcacacgacacaggactggtgacccttcaggtggcatttaacaatcagatcatttccaattcagtagtttttgaatacaaagctagagccctgcccaccctgccgagctcgcaacacgattggttaagcctcgacgataatcagttcaggatgagcatcctcgaacgtcttgagcagatggagagacggatggctgagatgactggctcacaacagcacaagcaggcaagtggtggaggttcctccgggggtgggtcaggatcaggtaacggcggttctcaggcccagtgtgcctccggtaccggggcactcgggtcatgttttgaatctcgggtagtagtcgtctgcgagaagatgatgtcccgagcttgctgggctaagtccaaacaccttattcacagcaagacattccggggtatgacactgctgcacctggctgctgctcaagggtatgcaacactaattcagacgctgattaagtggaggaccaaacacgccgactcaatcgatcttgaattggaggtggaccctcttaatgttgaccacttcagttgcactcccctgatgtgggcctgcgcgctcggacatctggaagctgctgtggtcttgtacaagtgggatcgacgagctattagcatccccgatagcttgggacggctgccactaggaattgcccgttctcgaggtcacgtcaagttagcagagtgcctcgagcatcttcagcgcgatgagcaggcccagctcggccagaaccctcggatccattgccctgctagtgaggagccttctacagagagttggatggcacagtggcacagcgaagccatcagctctccagagattccaaagggtgtgacagtgatcgccagtacgaatcccgaattacgacggccacgctctgaaccaagcaattactatagctctgagtcccataaggattatcccgcacctaagaaacataaactaaaccctgaatatttccagacccgccaagagaagcttctccctactgcgctgtctttggaggaacccaatatcaggaagcagtctccatcatctaagcagtcagtgcccgaaacactgtccccgtcagaaggagtccgcgacttctcgagggagctctcccccccaactcctgagacagccgcattccaggcgtctgggagccagcctgtgggcaaatggaactcaaaggacctgtatatcggagtgagcactgtgcaagtaacaggcaatcccaaaggaacaagtgtgggcaaggaagctgctccttcccaggtacggcctagagagcccatgagcgttctcatgatggccaacagagaagttgtcaacacagagctcggttcttatcgagactctgccgaaaacgaggagtgtggccaaccaatggatgatattcaggtgaacatgatgaccttggcagagcatatcatcgaggctaccccagacagaattaaacaggagaatttcgtacccatggaatcttcaggacttgagagaactgatccagcaacaattagctctactatgtcatggctggcttcctaccttgctgatgctgattgcctaccgagcgccgctcagatacggcttagcccggtgggatctcctgtttccgagatcgctttcgagaagcctaacctgcctagcgcggctgattggtctgaatttctgagcgcatccacctcggaaaaggtggaaaatgagttcgctcagctcacactcagcgatcatgagcagagggaactgtatgaggctgcccgactggtccagactgctttcagaaaatataaaggacgacctctgcgagaacagcaggaggtggccgctgcagtgatccagagatgttacaggaaatacaaacagtacgccctgtacaagaagatgactcaggcagctattctaatacagtccaagttcaggagttattatgagcagaaaaagtttcagcaaagccggcgtgctgctgtcctgatccagaaatattatcggagctacaaaaagtgcgggaaaaggagacaagcacgacggaccgccgtaatcgttcagcagaaattgagaagctctctgctgacaaaaaagcaagaccaggcagctagaaaaatcatgcgcttcctcaggcgttgcagacaccgcgttaaggagctcaagaaagcaaaggaactggaagacattcagcagcatcctctggctatgtag

SEQ ID NO: 216748 - DNA, 243 bp, Artificial Sequence
  Description of Artificial Sequence: Synthetic coding sequence
atgtggcgagccgagggtaaatggttgccaaagaccagccgcaagagcgtgtctcagtcagtgttttgtggcactagcacctactgcgtgcttaacaccgtgccaccaattgaggacgatcatggaaactcaaactcttcacacgtgaaaatttttctgcctaagaaactactggagtgtctccccaagtgtagctcgcttcctaaggagcggcataggtggaacacaaacgaacgttcttag

SEQ ID NO: 216749 - DNA, 306 bp, Artificial Sequence
  Description of Artificial Sequence: Synthetic coding sequence
atgtggagggcggagggcaagtggctgccaaagaccagccgaaaaagcgtgtcccagtctgtgttctgtggaacttccacatattgtgtgctaaatacagtccctcccattgaagacgaccacggcaattccaatagctcgcatgtcaagatctttctccctaagaagctgctggaatgccttcccaaatgtagtagcctccctaaagaaagacatagatggaataccaatgaggcactgaccacgcatcttttcatgggcgctgccaagaaacgggacccacagtcctggagccatgaaggctag

SEQ ID NO: 216750 - DNA, 3609 bp, Artificial Sequence
  Description of Artificial Sequence: Synthetic coding sequence
atgaacaccaaggacacgaccgaagtggccgagaattctcatcatcttaagatcttcctgcccaagaaacttctggaatgcctcccgaggtgtccactgctgccaccagaaagactgcggtggaacacaaatgaagaaattgccagctatctcattacatttgaaaaacatgatgaatggctgtcctgtgctcctaaaactaggccgcagaatggtagcataatcctgtataaccggaaaaaggtgaagtaccggaaagatggttatctctggaagaagcggaaggatgggaaaacaacccgtgaagaccacatgaagctgaaggttcaaggtatggagtgtctgtacgggtgctatgtgcatagctctattgtccccacgtttcacagacggtgctattggctcctccagaatccagatatcgtcttagtgcattatttaaacgtgccggctctggaagactgcggcaagggctgttctccaatcttctgttctatatcatccgaccggagagagtggctgaagtggtcacgggaagagcttctaggtcaactgaaacccatgttccacggcataaaatggtcctgcgggaatgggacagaggagttcagcgtggaacaccttgtacagcaaatcctggatacccatccgaccaaacccgctccacggacacacgcctgtctctgcagcggaggcctgggctccgggtcacttacgcacaagtgttccagtacaaagcaccgcatcatcagcccgaaggttgaacctagagctttaaccctcacgagtatacctcacgcacaccctcccgagccacctcccttgatagcccctctccctcctgaactcccaaaagcccacacaagtccatcctccagctcatcctcatcatcctctggcttcgcagaacctctggagatcagaccttcccctccaacctccaggggcggatccagtcgaggaggaaccgcaatcctcctgctgactggactagagcagagagctgggggactgaccccaacccgacacttagctccccaggctgacccgagaccttcgatgtctctggctgtggtggtgggcaccgagccctccgctcctcctgctccaccatcacctgcatttgacccagatcggtttctcaactctccccagcggggtcagacctatgggggaggacagggagtctcaccagattttcctgaagcggaggccgcacataccccatgctccgccctggaaccagctgccgctcttgaaccacaggccgcagccaggggacctcctccacaatccgtggctggcggacggcgtgggaattgcttttttattcaggacgatgattcaggagaggaactgaagggccacggagccgcacctcctattccttcgccgcctcccagtcctcccccttcccccgcacccctagagccaagctccagggttggccgaggcgaggccttattcgggggtccagtgggcgcaagcgagcttgaacccttctccctcagctctttccccgacttaatgggcgagttgatttcagatgaggctccaagtatccctgccccaactcctcagctgtcccccgctctatccactatcacagacttttcacctgagtggtcttatccagaaggtggcgttaaagtgctcattaccggcccatggacagaggctgctgaacattacagctgtgtgttcgatcacatcgcagtgccagccagtctggttcagcccggtgtgctgcggtgctactgccctgcccacgaagtcggactggttagtttgcaggttgcgggacgcgaagggccacttagcgccagtgtgcttttcgaataccgtgccaggcgctttctgtctctccccagcacccagctcgattggctgagccttgatgacaatcaatttcgaatgtctattctggagcgcctcgagcaaatggagaaaaggatggcggaaattgctgccgcagggcaggtaccctgccagggcccagatgcaccaccagtgcaagacgaagggcaagggcctggctttgaggctcgcgtggtagttctggtggagagtatgatcccacgctcgacatggaaggggcctgaacgtctggctcatgggtccccgttcaggggaatgtctctgcttcacctggctgccgcacaagggtacgcaaggctcattgaaactttatcccagtggcgctctgtcgaaactggcagtctggacctagaacaggaagtggatccattgaatgtggatcatttctcatgtaccccactcatgtgggcctgcgcactgggccacctcgaggccgctgtgctgctattccgttggaacaggcaggccctgagtattcccgactcgttgggcaggctccccctctctgtggcccatagtcgcggacacgttcgtctggccagatgccttgaggaactccagcgtcaagagcccagtgttgagccacccttcgccctgagcccacccagctcatcacccgacaccggactgagcagtgtttctagtcctagcgagctttctgatgggaccttttccgtcactagtgcctacagctcggcccctgatggttctccaccccctgcacccttgcctgccagtgagatgacgatggaagacatggccccaggtcaactctctagcggggtcccagaggcgccattgctgttgatggattacgaggccactaacagcaagggtcccctttcatccctgcccgctttgccacccgcttctgacgacggcgctgcccctgaagatgcagactcaccccaagctgtggacgtgatccccgttgatatgatttccctagctaagcagattatcgaagcaactcctgaacgtatcaaaagggaggatttcgtgggtttacctgaggctggtgcgtcaatgagagagcggacaggcgcagtggggcttagcgagaccatgtcttggttggcctcctacttggaaaatgttgatcacttcccttcttctacacccccatccgaactcccctttgagcggggaagattagcagtaccatcagcccctagctgggcagagtttctgtctgctagcacttccggcaagatggagtccgatttcgcattgctgacattatccgatcatgagcagagggaactttacgaagccgcaagagtgatacagactgccttcagaaagtataaagggaggcggctgaaggagcaacaggaagtggccgctgctgtaattcagcgctgttaccggaagtataagcaacttacttggatcgctttaaaattcgcgttgtataagaagatgacgcaagcagccatcctgatacagtctaaattccggtcatactacgagcagaagaggtttcagcagtcacggagagccgcagttctgatccagcaacattaccggagttaccggaggcggcctggacctccacatagaacttccgccacgctccctgctaggaataagggcagctttctcactaagaaacaggaccaggcggctcgcaagataatgaggttccttcgtaggtgtcgtcatcggatgagagagttgaagcagaaccaagagctagagggccttccccagccagggttggccacatag

SEQ ID NO: 216751 - DNA, 3588 bp, Artificial Sequence
  Description of Artificial Sequence: Synthetic coding sequence
atgaatacgaaggacactacggaggtggcggagaatagccatcacctcaagatttttctaccaaagaagctgctggaatgtctgcccaggtgtcccctgctcccacccgagcgccttagatggaatactaatgaggagatcgcatcctatctgatcacatttgaaaagcacgacgagtggctgagctgcgcacccaagaccagaccacaaaatggaagtataattttatataatcgaaaaaaagtaaagtataggaaggacgggtatctgtggaaaaaacggaaggatgggaagaccacccgcgaggaccacatgaaattgaaggtgcagggaatggaatgcctttatgggtgttatgtccatagttccatagtgcctacgttccaccgacggtgttactggcttctccagaacccagacatcgtgttggtccattacctgaacgtgcctgccctggaagattgcggcaaagggtgctctcctattttctgcagcattagcagtgatagaagagagtggctcaaatggtctagagaagaattgcttgggcagttaaaaccaatgttccatggcataaagtggagttgtggcaacggtacagaggagttcagcgtggagcatctggtgcagcagatcctggatacgcacccaactaaacctgccccacggactcatgcttgtctgtgctctgggggtctaggcagcgggagcctgactcacaaatgttcatcaactaagcaccggatcatctcgcctaaggtcgagccaagggcattaacgttaacgagcataccgcacgcccatcccccagaaccgccaccccttatcgcaccccttcccccagagctacccaaggctcatacaagtccgtcctcctcttcatcttcctcgagttctggcttcgcggaacccttggagattcgtccatcacctcctacatctagaggcggaagctcgcgtggtgggaccgctattctgttgctcactgggctggaacaacgggcaggcggtctcacgccaacacgccacctggcaccccaggcagatcccaggccatccatgtccctagctgtcgtggtcggcaccgagccatccgcccctccagccccaccttctcctgcctttgatcctgaccgctttctgaactccccccaacgtgggcagacttatgggggtggacagggggtatcacccgactttccggaggcggaagccgctcacaccccatgcagtgccctagagcctgcagcagccctagagccgcaggcggcagctagagggcctccaccccaaagcgtggcgggaggcaggcggggaaattgttttttcatacaggacgatgacagtggcgaggaattaaaggggcacggggcagcacccccaattccctcccctcctccttcaccccctccatctcctgccccactggaaccctcctcacgagtagggaggggggaggccttatttggtgggccagttggcgcatctgaactcgagccattctctctctctagctttcccgatttaatgggagagctgatttctgatgaagcaccgagcattcccgctcccaccccacaactgtcgccagcattgtccactatcacagatttctctccggagtggagttacccggaaggcggagtgaaggtgcttatcactgggccatggaccgaagccgcagagcattactcttgtgtcttcgaccacatagccgtgcctgcctcattggtgcaacccggtgtccttagatgctactgtccggcacacgaggtgggccttgtgtcgctgcaggtggccggacgagagggaccgctgtcagccagcgtactatttgagtaccgggcacgcagattcctgagcctgccaagcacacaattggattggcttagcctggatgacaatcagttcagaatgtcaattctcgagaggctcgaacaaatggaaaagcgtatggcagaaatcgctgccgctggccaggttccatgtcagggccctgacgctccaccagtgcaggatgaggggcagggaccagggtttgaggccagggtggttgtgctagtggagtccatgatcccaagatcaacgtggaaagggcctgaacggttagcgcatggatctccatttcgagggatgtctctgcttcatcttgcagccgcacagggttatgctcggctgatcgagacgttgagccagtggcgtagcgtagagaccggttcacttgatcttgaacaggaggttgaccctctgaatgttgatcacttttcctgtactcccctcatgtgggcctgtgccctaggacatctggaagccgcagtgctgctgtttcgatggaatcgccaggctctcagcatccctgattccctgggaagacttcctctgtcagtggcccacagccggggacacgttcggctcgccaggtgcttagaagaactgcaacggcaggaacccagtgtcgagcctcccttcgcattgtcccctcccagtagcagcccggataccggattgtcatcagtgagcagtccctctgaactgagcgacggcaccttttccgtcacctccgcttatagttctgcccctgacgggtcacctcctccggcacccctgccggcaagtgaaatgacaatggaagatatggctccaggtcagttgtcatccggggtaccagaggctccgctcctactgatggactacgaggcgacgaattctaagggtcccttgtcctcccttcctgccctgccaccagctagcgatgacggtgcggctccagaggatgccgattctcctcaggccgtcgatgttattccggttgatatgatttctttagcaaaacagatcatagaggcaacccctgagcgaattaaaagggaggattttgtgggcctcccggaagccggagcttcaatgagggagcgaaccggagccgttggactatccgagactatgtcttggctggcttcctacctggagaacgtggatcatttcccatctagcactcccccatcagaactcccattcgagagagggcgtctcgccgtgccttcagcaccaagctgggcagagtttttaagcgcatcgaccagtggaaagatggagtcagactttgcgctgctgaccctctccgatcacgaacagcgagagctgtatgaggctgctagggtaatccaaacagcatttaggaagtacaagggacgtaggcttaaggagcagcaagaggtcgccgctgccgtcatccagcgctgttaccgcaaatataaacagttcgcactgtacaagaagatgactcaagccgcaattctgattcagagcaagttcaggtcctattatgaacagaaacgcttccagcagtcccgccgtgctgcagtgctgattcagcaacactataggtcttacaggcgtcggccaggacctccccatagaactagtgcaactctccccgctaggaacaagggaagttttctgaccaaaaagcaggaccaggccgctagaaagataatgcggttcctccggcgatgcaggcacagaatgagagagctaaagcaaaaccaagaactagagggcctgccccaaccaggcctggcgacttag

SEQ ID NO: 216752 - DNA, 3606 bp, Artificial Sequence
  Description of Artificial Sequence: Synthetic coding sequence
atggggacagattcaccatctccgaggcccttacgcccaggtgtgacattacctccaggagcattaacgatgaataccaaggatactactgaggtggcagaaaattctcaccaccttaaaatcttcctgccgaaaaaacttttggagtgcctcccccgatgccccctgttgcctcctgagcggctacgttggaataccaacgaggagattgcctcatatctgattacatttgaaaagcacgacgaatggctgagttgcgctccgaagactagaccccagaacggatctatcatactctacaatcgtaagaaagtgaaatatagaaaagatgggtacctgtggaaaaaacgcaaggacggcaaaactacgcgggaagatcatatgaaactcaaggtgcagggcatggaaaatcccgacatagtcctggtgcattatctcaacgtgcctgcactcgaagattgcggcaaaggttgctctccgatcttctgctcaatctccagcgatcgcagagaatggttgaaatggagccgcgaggagttgctggggcagttgaagccaatgttccatgggataaagtggtcctgcgggaatggcacggaagagttctctgtagaacacctggtgcaacagatacttgatactcacccaactaagccggcacccaggacacacgcctgtctctgctccgggggactcggatccggttccctgactcacaagtgctcatcaaccaagcaccgcatcatctcacccaaggtagaacccagggctcttaccctgactagtatccctcacgcccacccacctgagccaccccctctcatagcgcctttgcctcctgagttaccaaaagctcatacatctccctcctcttctagtagttcctcatctagcggctttgctgagccactggagatacggccatctccgccaacttcacgaggtggctctagcaggggcggaacagcaatattgctcctcactgggttagaacaacgcgctgggggactcacgcctaccagacacctggctccccaggccgacccaagacctagcatgtcccttgccgtagtggtgggcacggagccatctgcacctcctgctcccccttcccctgcttttgacccagataggtttcttaattctcctcagaggggccagacctatggcggaggccagggagtgagccctgactttcccgaggccgaggctgcacatacaccatgctcagctctggagcccgctgctgcactggaaccccaggcggctgcgaggggtcctccacctcaaagtgtggccggagggaggcggggaaactgtttctttatccaggacgatgactccggcgaagagttaaaaggacacggcgcagccccacccattccctccccaccaccatctccaccgccatcaccagcaccgctggagccttcgtcacgcgtcgggaggggagaggccttattcggcggacctgtgggcgcttctgagctcgagccattcagtttgagttcattccccgatttgatgggtgaactcatcagcgacgaggccccaagtatcccagcccctactccccagctgagtcctgctctgtccacaattaccgatttttctcctgagtggtcctacccagagggaggagtaaaagtgctgatcaccggcccttggaccgaggcagcggagcactactcatgcgtttttgatcacatcgccgtccccgcaagcctggtccagcctggcgtgttgcggtgctattgtccagcacatgaagttggattggtctctctgcaagtcgccggacgcgaggggccactatcagccagcgtgctctttgaatatcgcgctaggaggttcctgagcctgccgagcacacagctcgattggcttagtctggacgataaccagtttaggatgtccatcctcgagcgtctggagcaaatggaaaagagaatggctgagattgccgctgctggtcaggtgccttgtcagggtcccgatgcacctcctgtccaagatgagggccagggaccaggttttgaagccagagtggtggtcctggtcgaaagcatgatacctcggtcaacctggaaaggaccggaaaggctagctcacggctcccccttccgagggatgagtcttttgcatttagctgctgctcaagggtatgccaggcttattgaaaccctgagtcagtggcgcagtgtggagacaggctctctggatctcgaacaagaggtagaccccctgaacgtagatcactttagctgcacacccttaatgtgggcctgcgctctcggccacctagaagctgcggttctgctgttccgttggaacagacaggccttgagcatcccagattctctcggcagactccctctctctgtggcacatagcaggggccacgtcaggctggccagatgcctggaagaactgcagaggcaggagcctagcgtggaacccccattcgccctttcccctccgtccagttcccctgacactgggctttccagtgtgagttccccttccgagttgtctgatggcaccttctctgtgacgtcagcatacagcagtgctcccgacggatcccctcctcctgcaccactgccggcatcagagatgaccatggaggatatggctcccggacagctgtcgagcggggttcctgaggcgcctctgctgctcatggattacgaggccacgaattcgaaagggcctctgtctagcctgcctgctcttccacctgcaagcgatgatggggctgctcccgaagatgctgactcaccacaggcggtggacgtcatccccgttgatatgatatcccttgcgaaacagattattgaggcaacccccgaaagaatcaaaagagaagacttcgtgggccttcctgaggctggggcaagtatgcgggaacggactggagccgttggcttgtcggaaaccatgagttggctagcctcatacctggagaacgtcgatcacttcccaagtagtacgcctccctccgaacttcctttcgaacggggaaggctggcagtgccaagcgcaccaagctgggctgagtttctctcagctagcaccagcggtaagatggagagcgattttgcgctcttaaccttatccgatcacgaacaacgagaactttatgaggccgctagggtaatccagactgcctttcggaagtataaaggcaggagactaaaagaacaacaggaagtggctgccgcagtgattcagagatgctatagaaagtataaacagctgacgtggatcgcacttaagtttgcgctttacaagaagatgacacaggcagcgatactcattcagtctaaattcaggagctactatgagcagaagcggttccagcaaagccggcgagctgcagtgctaatccagcaacactatagaagctatagacggcgtcctggaccaccgcatcggacctccgctactctacctgcgcgtaacaaaggaagttttctcactaagaagcaagaccaggcagcaagaaagatcatgcgttttctgcgtagatgtaggcatcggatgagagagctgaagcagaatcaggagctggagggcctacctcaaccagggctcgccacatag

SEQ ID NO: 216753 - DNA, 3594 bp, Artificial Sequence
  Description of Artificial Sequence: Synthetic coding sequence
atggcagccgctgcggtgacccgcggaacaccaggcgagaattcccaccacttgaagattttcctgccaaagaaactgcttgagtgcctgccaagatgccctcttctccctccagaaaggctcaggtggaacacaaacgaggaaattgcctcctatcttataacctttgaaaagcacgatgaatggctctcctgtgctcctaaaactcgtcctcaaaacggaagcattatcctgtacaatcgcaaaaaggtgaagtataggaaggacggctatctgtggaagaaacgaaaagatggaaagaccacacgagaagaccatatgaaattaaaggttcagggtatggagtgcctctatggctgctacgtccacagtagtatcgtccccacttttcaccgacggtgctattggctcttgcagaatcccgatatcgtgctcgtgcattacttgaatgtccccgcactcgaagactgcggcaaggggtgtagtcctatattctgtagcatcagttctgacaggcgcgagtggttaaagtggagcagagaggaactgcttggccagctgaagccgatgttccatgggataaaatggtcgtgtgggaatggtacggaagagttttccgtggagcatctggtccaacaaatccttgacacgcaccctacaaagccggcaccccgtactcacgcttgtttatgctcagggggactggggtcaggttccctgacacacaagtgttcaagtaccaagcatcgcataatatcacccaaggtcgaaccgagggccttgactctgacttcgattccccacgcgcaccctccagagcctccccctctcattgcaccactgccgccagagcttccaaaggcccatacaagtccgagctcgtcttccagtagttcttcatcagggtttgccgaacctctggaaatccgaccaagcccccctacatctcgcggaggcagctctcggggagggacagcaatcttgctcttgactgggttagagcagcgtgctgggggtctgacacccacacgccatctggccccacaggctgacccccgtccttctatgtcattggccgttgtggtgggtacggaaccctctgctccacctgcaccaccatctccagctttcgatcctgacagattcctgaacagccctcagagaggccaaacctacggtgggggacaaggtgtttctccagattttccagaagccgaggccgctcacaccccatgctccgccttagagcctgctgccgctttggagccacaggcagccgcaaggggtcctccacctcagtcagttgctgggggacgaagaggcaattgtttcttcattcaggacgacgactctggcgaagagctgaagggccacggcgcagcaccaccaataccttcacctccgccatcacctccaccctcccctgctcctctcgagcctagttctagggtgggcagaggtgaggccctcttcggcggaccagtgggtgcgtccgagcttgagccgttctcactgagctctttccccgatctcatgggcgagctgatttccgatgaggcgccaagtatcccagctccaacccctcagctcagccccgctctgagcacaattacggacttctccccggagtggagttaccctgaagggggagttaaggttcttataacaggaccttggaccgaggccgctgagcactacagttgcgtcttcgatcacattgcagtacccgcatccctggtgcagcctggagtcttgagatgttattgtccagcccatgaggtgggactcgtgagcctgcaggtagctggtagagagggtccattgtcggcctcagtccttttcgaataccgcgcacggcgtttccttagcttgccgtctacacagcttgactggttgtcactggatgataaccaattcagaatgagcatcctggaacggctggaacagatggaaaagcgcatggctgaaatagccgctgcagggcaggtcccttgccagggcccagacgccccacctgtgcaggacgaaggccagggcccaggatttgaagctcgggttgtcgtgctcgtggagtctatgatcccaagaagcacatggaagggacctgagcgcttggctcacggttcaccctttaggggaatgtcattgctccatctggctgcagcacagggatatgcaagactcattgagactctgtcccagtggaggtcagtcgagacgggctccctggatctggagcaggaggtggaccccctgaatgttgaccacttttcatgtactcccctgatgtgggcctgcgccttgggtcacctagaggccgcagtccttttattccggtggaacaggcaggctcttagcattcctgactctctgggtagactgccgttaagcgtggcacactcacgaggtcatgtgcggctcgcaagatgcttagaagagctgcagaggcaggagccttctgtagaaccgccattcgccttgtcaccaccctcttccagccctgacacgggcctgtcgagcgtgtcctctccgtccgagctgtctgacggcaccttcagtgtgaccagcgcatattcctccgcccctgatggctctccacctcctgctccactccccgcaagcgaaatgaccatggaggacatggcccctggacagctgtcctcaggcgttccagaagctccacttttgctgatggactatgaagccacaaactcaaagggccctctgagcagtttacctgctctccccccagcgagcgacgatggcgctgcaccggaggacgccgattcaccccaggcagtggacgtgattccagtggatatgataagcctggctaagcaaatcatcgaagcaactcctgaaagaattaagagagaagactttgtcggcctgccagaggcaggagccagcatgcgagaacgcacaggtgccgtgggactgtcagagacgatgagctggttggccagctatctggaaaatgtcgaccactttccaagcagcacacctccaagcgaattaccattcgagcggggtcgattggcagtccctagcgcacctagttgggcagaatttctgtcagcctccaccagtggaaagatggagtccgatttcgcactattaactctctccgaccacgaacagcgcgagctctacgaagccgcaagagtaattcaaacagcttttagaaaatataaaggcaggcgacttaaagagcagcaggaggtggctgcagccgttattcaacggtgctatcggaagtacaaacagttcgccttgtacaagaaaatgacgcaagccgcaatcctgattcaatctaagtttcgctcctactatgagcaaaagcgattccaacagagtagacgagctgccgtcctgatccagcaacactatcggagctaccggaggcgccctggcccacctcaccggacttcagcaacgctccctgctaggaataagggatctttcctcactaagaaacaggaccaggcggcacgcaaaattatgcggttcttacggcgatgccggcatcgaatgcgggagctgaagcaaaatcaggaactggagggattgccacaacctggtttagctacatag

SEQ ID NO: 216754 - DNA, 3726 bp, Artificial Sequence
  Description of Artificial Sequence: Synthetic coding sequence
atggggacagactccccatccccacggcctctaagaccaggggtgacattgcctcctggagcccttacgatgaatactaaggacactacagaggtcgcagaaaactctcaccatcttaagattttcctgccaaaaaagcttttagaatgtttgccccgatgccctctacttccaccagagcgacttcgttggaatacaaacgaagagatcgcttcctacctgatcacctttgaaaagcacgacgagtggctctcatgcgcccctaagacgcgcccacaaaatggcagcataatcctgtacaaccgcaagaaggtgaaatatagaaaagatggctatctctggaagaaacggaaagatggtaagacaaccagagaggaccacatgaagctgaaggtgcagggcatggaatgtctatacggctgctacgtgcactcatctattgttcctactttccatcgtcggtgttactggctgctccagaatccagacattgtgttagttcattacttgaacgttcctgcgctggaagattgcggtaagggatgctcccccatcttttgcagcatttcgtccgataggcgggagtggctcaagtggtctcgtgaggaactgctaggccaattgaagcccatgttccatggcatcaagtggagttgcggaaatgggacagaggaattcagtgtggagcacctagtgcagcagatcttggatacccacccaacaaaacccgcaccacgaacccacgcatgcctctgctcaggtggactcggatcaggttcactaacccataagtgcagcagcacgaagcaccgaatcatctcccctaaagtagaaccgagagctctgaccttgacttccataccacatgcccatccacccgaacccccaccactaatcgccccactcccacccgaactaccgaaagcgcatacaagtcctagctctagcagctcgtcctcctcctctggttttgcagagcctctagaaattcggccatccccacctacctctcgcggaggtagtagccggggtggtactgctatccttctcctgaccggccttgagcagagggccggaggactgacccctaccagacacctagccccacaggctgaccctagaccatccatgagccttgcagtggtcgtggggactgagccttcggccccacctgctcctccttcccctgctttcgatcctgacaggtttctcaattcgccccagagaggtcagacgtacggagggggtcaaggggttagccctgattttcccgaggccgaggccgctcatactccttgctccgctctggaacccgcagctgccctagaaccccaggctgcagctagaggcccaccccctcaaagtgtggcaggcggacgacggggaaattgcttctttatacaggatgatgactctggcgaggagttgaagggccatggggctgctccccctatcccctcccctccaccgagtcctcccccttcccctgcccctctcgagccttcctcacgcgtaggtagaggagaggccctgttcggtggacccgtgggcgcaagcgaattagaaccgttttcactgtcaagcttccctgacctcatgggtgagctgatttccgacgaagccccttctatacctgcccctactcctcagttgtcgccggcactgagtacaattacagatttcagtccagagtggtcctatccagagggtggcgtgaaggtgctcatcacggggccatggaccgaggccgctgaacactactcttgtgtattcgatcatattgctgtgccagcgagtctggtgcagcctggcgtcttaagatgttattgtccggctcacgaggtaggtctggtcagccttcaggtagctggtcgggaaggccctctgtcagccagcgtgttgttcgagtacagggcacgtcgctttctgtcactgccctctacacagctggattggctctcactcgatgacaaccagtttcgcatgtctattcttgaacgattggaacagatggagaaaaggatggccgagatagccgcagccggacaggtaccatgccagggccctgacgcgccacccgtgcaggatgagggtcagggacctggttttgaagccagagtggttgtgctggtcgaatcaatgattccaaggagtacatggaagggtccagagagacttgcccatggctcaccttttcgaggcatgtccctgttacacctggcagcagcccaaggatatgctcgactcattgagactctgtcgcagtggaggtcagtagagacggggtcactggacttggagcaggaggttgacccacttaatgtcgatcatttctcttgtacgcctctcatgtgggcttgtgccctcggccatctcgaggcagcagttctcctgttccgttggaataggcaggcactcagtatccctgacagcttggggcgtcttcccttatcagtggcacattccaggggacacgtcaggcttgcaagatgcctcgaggagctgcagcggcaggaaccatcggttgaacctccttttgcattaagcccaccatcttcttcccctgacacggggttgtcttcagttagttctccctccgaactgagtgatggcactttttccgtgacttctgcttatagctctgcacctgatggctcaccaccaccagccccactccccgcttccgaaatgacaatggaggatatggccccaggacagctgtccagcggtgtgccagaggcaccactgctgctgatggactacgaagccactaactcaaaggggccactaagcagcttgcctgctctgcctccagcctctgatgatggggctgcaccagaggacgcggacagtccccaggcggtggatgtcatacctgtcgatatgatatctctggcaaagcaaatcatcgaagcaacacctgagaggattaaaagagaagacttcgtgggactccctgaagccggagcatccatgcgcgagagaaccggcgcagtcggcctcagcgagacaatgagctggctggcatcctacctggagaatgtggatcatttcccctcttctacacccccttccgagttgccctttgagcggggtaggttggcggtgccttccgccccaagttgggcagaattcctttccgcaagcaccagcggcaagatggagtccgactttgcacttctcacgttgagcgaccatgagcagcgcgaactctatgaggctgctcgtgttattcaaaccgcttttcgaaaatacaaaggaaggaggcttaaagagcagcaggaggtggccgctgcagtaattcagcgctgctatagaaagtacaagcaacttacttggatcgcactcaaattcgcactttacaagaagatgacccaggccgcaattctgatccaatccaagtttaggtcatactatgaacaaaaaagatttcagcagagcaggcgtgcggctgttctcatacagcaacactaccgctcttacagacgccgacccggaccaccgcacagaacctctgccacacttcctgcccgtaataaactgttgtcacaccaggaagccggtccaggctcccctgaggatcatgaaattcctgccgctctgccaacccaggacgagggaaccgaagctgagcccggtgctggccgtgcttctccagctgggaccggacatatgacctggcctccaccttttagtccaccgtggggtcgcctggtccaaagctag

SEQ ID NO: 216755 - DNA, 4470 bp, Artificial Sequence
  Description of Artificial Sequence: Synthetic coding sequence
atgggtgatgcagcggaccctagagaaatgcggaaaacgtttatagtgcccgcaattaaaccattcgatcactatgatttctcaagggccaagatcgcctgcaatcttgcttggctggttgctaaggcttttggcacagagaatgtaccagaggagcttcaggaaccattttacacggatcaatacgaccaggagcatattaaaccaccagtggttaacctactgttgtccgcagaactttattgcagagctgggtctctgattctgaagtccgacgcggcaaaaccgctcctggggcacgatgccgttatccaggcattagcccaaaagggtctctacgttacagatcaggagaaactggtcacagaacgcgacctgcacaagaagcctattcagatgtcagcccatctggcaatgatcgatacccttatgatggcatatacagtcgagatggtcagcatcgaaaaggtcatcgcttgcgcgcagcaatactctgcctttttccaggcaaccgacctgccatacgacatcgaggatgccgtaatgtattggatcaacaaagtcaacgagcatctcaaggacatcatggagcaagaacagaagctaaaggaacaccacacagtcgaggcaccaggtgggcagaagtcaccttcaaagtggttctggaaactggttcctgctcggtacaggaaggaacagactctgctaaagcagctgccctgtatacccctggtcgagaatctgctaaaagatggcactgacggatgcgccctggcagccctgattcacttctactgccccgatgtagtgaggttggaggatatttgtctgaaggaaactatgagtctggccgatagcttgtataatctacagttgatccaagaattttgccaggaatacttaaaccaatgttgtcacttcaccctggaggacatgttgtacgccgcatcgagcatcaaaagtaattacttagtgtttatggctgagttattttggtggttcgaggtcgttaaaccaagctttgttcagccacgggtggtgaggccacagggagccgaaccagtgaaggatatgccatcgatccccgtactgaatgctgccaaaaggaatgttctcgatagcagctccgatttcccatcctccggcgaaggagccacatttacacagtctcaccaccacctgccatcaagatacagtcggccacaggctcacagttcagcttcaggcggaatccgacggtcttcctctatgtcttacgtggatggtttcatagggacctggccaaaggaaaaaaggtcttctgtgcacggggtgtctttcgacatctctttcgataaggaggacagcgtgcaacggtctacacccaatagaggcatcactaggagtatttctaacgaaggactgactctcaataatagccacgtctcaaaacatattcgaaagaatctgagctttaagccgatcaatggagaagaggaagccgaaagcatcgaggaggaattgaacatcgattcacattctgacttaaaatcgtgcgtccctctcaatacaaacgagctcaactccaatgagaacattcattataaactccctaacggcgcactgcaaaaccggatcctgctggacgagttcggcaaccagattgagacaccttccattgaagaagccctgcagattatccatgatactgagaaatcccctcatacgccgcaacctgaccaaattgcaaacggtttttttctccactcccaagagatgtctattttgaattcaaacatcaaactcaatcaatcatcccccgacaatgtgacagatactaagggagccctgagcccgataacggataacaccgaggtcgacaccggcattcacgtgccatctgaagacatcccagaaaccatggacgaggactcatccctgcgagattatactgtgagtcttgatagtgacatggatgacgcttccaaatttctccaggactacgacattcggaccggcaacaccagggaggcactgtctccgtgtccctctactgtgtcgaccaagagccaacctggttcctccgcttccagcagttcaggggtaaaaatgactagttttgccgagcaaaagttccgaaaactaaatcacaccgatggaaaatcctccggatcctcttcgcagaaaactacccccgaagggagtgaactgaatatccctcacgtagtcgcttgggcccagatcccagaggaaactggcctccctcagggaagagacaccacccaacttctggcaagtgaaatggtgcatctacgaatgaagctcgaggaaaagcggcgagccattgaggctcagaagaaaaaaatggaggctgcgttcacaaaacaaagacagaaaatggggagaactgcattccttacggtggtcaagaaaaaaggcgatggaatcagcccactgcgagaggaagccgcaggagccgaggatgagaaagtctataccgatcgggctaaggagaaggagagccaaaagacagacggacagcggtcaaagtcattagcagacatcaaggagtccatggagaaccctcaggcaaagtggctgaaatcccctaccactcccatcgaccctgagaagcagtggaatctcgccagcccaagcgaagagacattgaacgaaggtgagatccttgagtatactaaatccatcgagaagctgaattcttccctgcatttcctgcagcaggagatgcagcgactgagtctgcagcaggagatgctgatgcagatgagagaacagcagtcttgggtgatctcccctccacagcctagcccacagaagcagatcagagattttaagcccagcaaacaagccggactgagtagcgccattgcccctttttcctcagactccccaagaccaactcacccaagccctcagtcctcaaatcgaaaaagcgcctcgtttagcgtgaagtcacagagaacacccagaccgaatgagctgaagataactccactgaaccgaaccctaactcctccgaggagtgtggattctctccccagattgcggcgattctctccaagccaagtgcccatacaaactcggtccttcgtgtgttttggagacgacggtgaaccacaattgaaggagagcaagcccaaggaagaggtaaaaaaagaagaactcgaatctaagggaactctagaacaacggggacacaatcctgaagagaaagaaattaagccattcgagtcaacagtatctgaagtgttgagtctccctgtcacagaaacagtatgtctcacaccaaacgaggatcagttgaatcagcccacagagccccctcccaagccggtgtttccaccaaccgcccctaaaaatgttaacttgatcgaagtgagtctgagtgatttgaaaccgccagagaaggccgacgtcccggttgagaaatacgacggggaatcagataaggaacagtttgacgacgatcagaaagtttgctgcgggttcttcttcaaagatgaccaaaaagccgagaacgacatggcaatgaagcgtgcagccttgcttgaaaaaagactgcggagggagaaagagactcaactccgcaagcagcaattggaggctgaaatggagcacaagaaggaggagacacgtagaaagactgaggaagagcggcagaagaaagaggatgaacgcgctaggagagagtttattcggcaggaatatatgcgcaggaagcagctcaagttgatggaggacatggatacagtcatcaagcctaggccacaagtcgtgaaacagaagaagcaacggccaaagagcatccacagagatcatatcgagtctcctaagacccccatcaagggcccaccagtctcttctttgagcttggcaagcctcaatacaggcgataacgaaagtgtccactcgggtaagagaacccctcgttcagagagtgttgagggcttcctctctccctctcgttgcggttccagaaacggcgagaaggactgggagaacgccagtacaacctcctccgtggcatcaggaaccgagtataccggtcctaaattatataaagagcctagcgcaaagtccaataaacacataattcagaacgcccttgcacattgctgtctagcaggaaaggtcaatgagggccaaaagaagaagatactcgaagaaatggagaagtccgacgccaataatttcttaatccttttccgggattcgggatgccagttccggagcttatatacctactgtcctgagacggaagagattaataagctgacagggataggtcctaagtcaatcaccaagaagatgatagagggattatataagtataactctgatcggaaacagttttctcatatccccgcaaagacactgagcgcttctgtcgacgcaattactattcattcccacctgtggcagacgaagcggcctgtcacaccaaaaaaactgctgcctactaaggcttag

SEQ ID NO: 216756 - DNA, 4437 bp, Artificial Sequence
  Description of Artificial Sequence: Synthetic coding sequence
atgggcgatgctgccgacccgagagagatgaggaaaacattcatcgtccccgcaattaaacctttcgatcactacgacttctcacgagcaaagattgcttgcaacttggcttggctcgtggccaaggccttcggtacagagaacgtgcccgaggaactgcaggagccattttacactgaccaatacgatcaagagcacattaaacccccagtggtgaatttactgctgagtgctgagctgtattgtagggcgggaagcctgattcttaaaagcgatgccgcaaagccgctgcttggccatgatgccgttatacaggctctagcccagaaggggctgtatgtgaccgaccaggaaaagctggtcaccgagcgggatctgcataaaaaacctatccagatgagcgcacatctggcgatgatcgacactctgatgatggcctatacagtcgagatggtcagcattgagaaggttatcgcgtgcgcacagcagtattctgctttctttcaggccacagacctgccctacgatattgaggatgcggtgatgtactggataaataaggtgaatgagcacttgaaggatattatggagcaagagcagaagctcaaggagcaccacaccgtggaggctcccggtggccagaaggctcggtaccgaaaagagcaaaccctgttgaagcagctcccttgtatcccccttgtggaaaatctgctgaaagatggtacagacggctgcgctcttgcggctctcattcatttctactgtcccgatgtggttaggcttgaagatatttgtctcaaggagacgatgagcctcgccgacagcctgtacaacctgcagctcattcaggaattctgtcaggagtacctcaaccagtgttgccacttcacccttgaggatatgttgtatgcagcctccagtatcaaatctaactatctggtgttcatggccgaattgttttggtggttcgaggtggtgaagccttcatttgtccagccaagggtcgtgaggccacaaggcgcagaacctgtgaaagatatgccaagtatccctgtcctcaatgctgctaagagaaacgtgctggattcaagtagcgacttccccagctctggcgagggcgcaacctttactcagagccatcatcacttgcccagccgctacagtcgaccacaagcacatagctctgctagtggagggattcggagatctagtagtatgtcttacgtggacggctttattggaacgtggcccaaggaaaaacgatccagcgtccacggagtctcatttgacatcagctttgataaagaggactctgttcagcgttccacccctaacaggggaatcacacgaagcatttcaaacgagggtcttactttgaacaacagccacgtgtcaaagcatatccggaagaatctaagtttcaagcccatcaatggtgaggaagaagccgaatctattgaggaggagcttaacatcgattctcatagtgatcttaaatcctgtgttcccttgaatactaatgaactgaacagcaatgagaatatacactacaagctgcctaacggcgctctccagaacagaattttactggatgaatttggcaaccagatagagaccccttcaatcgaggaagccttgcaaattattcacgacactgagaaaagtcctcacacgccccagcctgaccagattgccaatggattttttctgcattcccaggagatgtccatccttaatagcaatatcaaactcaaccagagttcccctgataacgtcaccgacacaaagggtgcgctctcccccattacagacaacacagaagtcgacacaggaatccacgtccctagtgaggacatccctgagaccatggatgaagatagctctctgcgcgactacaccgtgtcactcgactctgatatggatgatgcatccaaattcctgcaggattacgatatccggaccggcaatacgcgcgaggccctctctccatgtccttctacagttagtaccaagtcacaacctggcagcagtgccagcagcagtagtggagtgaaaatgacttcctttgctgagcagaagtttcgaaaacttaatcacacggacggaaagtcatccggttccagttcccagaagacaacacctgaagggagcgagcttaacatcccgcatgtcgtggcctgggcccagatccccgaagagactggcttgcctcaggggcgagatactacacagttgctggcctctgagatggtgcacctgcggatgaaattagaagaaaagcggagggccatcgaggcccagaaaaagaaaatggaagccgctttcacgaagcagaggcaaaaaatggggaggacagcattcctgactgtcgtcaaaaagaaaggggacggcatctctccactaagggaggaggcagcaggtgctgaggacgaaaaggtctacaccgatagggccaaggaaaaggagagccaaaagacagatggacaacgatccaaatccctggctgatatcaaggagagcatggaaaatccacaggccaagtggttaaaatctcctactacccccattgatccggaaaagcagtggaatctggcaagcccatctgaagagaccctgaatgaaggcgagatactggaatacactaaaagcattgaaaagctgaacagctccctccactttctgcagcaggagatgcagagactgagcctgcagcaggagatgttaatgcagatgcgagagcagcagagctgggtgatctcccccccacaaccatctcctcaaaaacaaattcgtgattttaagcccagcaagcaggctggtttgagcagcgccattgccccttttagcagcgattccccacgacccacccacccctcaccccaaagctcgaacaggaagagcgctagcttctcagtcaagtcacagaggactccaagaccgaacgagctgaagatcacgccattgaatagaacattaactcctccaagatctgtggattcactgcccagactcagacgtttttctccatctcaagttcccattcagacgcggtcttttgtctgtttcggtgatgatggagaacctcagttaaaggagagcaaacccaaagaggaagtcaagaaagaggaattagaatccaagggaacgcttgagcagcgcggacataatccagaggaaaaagaaattaaaccctttgagtctacggtgagcgaggttctatctctgcctgtcacggagacggtgtgcctgacccccaacgaagatcagctcaaccagccaaccgagcctccccctaaacccgtcttccctccaaccgccccaaagaatgtgaacctcattgaggtgagccttagcgacctcaagccccctgagaaagccgatgtgccagtggaaaaatacgacggagagagcgataaggaacagttcgatgatgaccagaaggtttgctgcggcttctttttcaaggacgatcaaaaggcagagaacgacatggcgatgaagagagctgcccttctcgagaagagattgcgtcgggaaaaggaaacacaactgcgtaagcagcagctggaggcagaaatggagcacaagaaagaagagaccagacgcaagacggaggaggaaagacaaaagaaggaggatgaacgggcaaggagagagttcataaggcaggaatacatgcgtcgaaagcagttgaagctgatggaggacatggataccgtgattaagcctcggccacaggtcgtgaagcaaaaaaaacagaggccaaaaagcatccaccgcgatcacatcgaatcaccaaagaccccaatcaagggcccacccgtatcctctctgagtctggcttcattgaacacaggtgacaatgagtcagtgcacagcggcaaacgtaccccacgcagcgagtcagtggaaggtttcctaagtccgtcacggtgtggttcgcgcaacggagaaaaagattgggaaaatgcctcaactacaagtagcgtcgcgtctggtactgaatacacaggccctaagctgtataaggaaccctcggcgaaatccaacaaacacatcattcagaatgccctcgcacactgctgcctggccggaaaggtcaatgaaggtcagaagaagaaaatactggaggagatggagaaatccgatgctaacaacttcctaattctgttccgagactctggttgtcagtttcgctccctatacacttattgtcccgagaccgaggaaattaataaacttacgggtatcgggcctaagtcaatcacaaagaagatgatcgaggggctctataaatacaactccgataggaaacagttctcccatatccctgccaagactctgagcgcctcagtggatgcgataactattcattcacacttatggcaaactaaaaggcctgtgactcccaagaaactccttcccactaaagcttag

SEQ ID NO: 216757 - DNA, 4389 bp, Artificial Sequence
  Description of Artificial Sequence: Synthetic coding sequence
atgggggacgccgctgatccacgcgagatgaggaagaccttcatcgtgcctgcaattaagccgttcgaccattatgatttctcccgggcaaaaattgcctgtaatctggcctggctggtcgcaaaggcattcggcacagagaacgtccctgaagagctccaagaacccttctacaccgatcagtatgatcaggagcacataaagcctcccgtggtgaacctgctcctgtccgctgagctctattgccgggcagggtccctgatccttaaatccgacgccgcaaagcctctcctcggccatgatgccgtcatacaggccctagctcagaagggactttacgtcacggaccaggaaaagttggtaactgaaagagatttacacaagaagccaattcaaatgtcggcccatctggctatgattgacaccctaatgatggcgtacaccgtggaaatggtgtcaattgagaaagtgattgcatgtgctcagcaatacagtgcatttttccaggcgactgatcttccatacgacattgaggatgccgtgatgtattggattaacaaagtaaacgaacacctgaaagacattatggaacaggagcagaagctgaaagagcatcacactgtcgaggcacctggcggacagaaggctagatatagaaaagaacagaccttactcaaacaactcccctgcattcctctcgtcgaaaacctgctgaaggacgggacggatggttgcgctctggccgcactcatccacttctactgcccagacgtggtccgtctcgaggatatttgcctgaaggagaccatgtctctggctgacagtctctacaacctgcagctgattcaggaattttgtcaggagtacctaaaccagtgctgtcatttcacactggaagatatgctgtacgctgcctcctccatcaagtctaattacctcgtcttcatggctgaactattctggtggttcgaggtagttaaaccatcatttgtgcagccgagggtcgtgcgccctcagggtgcggagcccgtgaaggatatgccctccatccctgttctaaacgcagccaaaagaaatgtactcgatagttcgtcagacttcccttcacggtactcaaggccacaggcgcactcgtctgccagtggcggtattaggcgctcctctagcatgtcctacgtggacgggttcatcgggacttggccaaaggagaagaggagttccgtccatggggtcagtttcgacattagctttgacaaagaggacagcgttcagcgctccaccccgaaccgagggataactaggagtattagcaacgaggggttgacactgaacaactcccatgtttctaagcacatccgaaaaaatttatcattcaagccaatcaatggtgaggaggaggccgagtcaattgaggaggagctaaatattgatagccattcagatctgaagagctgcgtgcctctgaacaccaacgagctcaatagcaatgagaacatccattacaagcttccaaacggagccctgcagaaccgtattctgctggatgagttcggcaaccaaattgaaacaccatccattgaagaagctttgcagattattcacgataccgaaaaatctccacacaccccacagccagaccagatcgcgaatggattctttctgcacagccaagagatgtcgatactgaatagcaatatcaagttgaaccaatcctcccctgataacgtaacagatacaaagggagcgttgagccccattactgacaacacagaggttgataccgggatccacgtgccatcagaagacattccggaaacaatggacgaggattctagtctgcgtgactatactgtttcgctggacagcgacatggacgatgcctccaaattcctccaagattatgatatcagaactggtaatacacgggaagctctgagcccttgcccgtcaactgtgtctaccaagtcacagcccggaagctcagcatcgagctcctccggagtgaaaatgacttcttttgcagaacagaagttccgaaagctgaatcacacagacgggaagtccagcgggtcctctagccaaaaaaccacacccgagggttcagaactcaacatccctcacgttgtggcttgggcccagattcctgaggaaacagggctaccccagggacgggacactacccagctgctggcctctgagatggttcacctgagaatgaaactcgaagaaaaaagacgggcaattgaagctcagaagaagaagatggaggcagcctttaccaagcagcgtcagaaaatgggtcggacagcctttctcactgtcgtcaaaaaaaagggcgatgggatttctcctttgcgcgaggaggcagcgggagcagaagacgagaaggtctataccgatcgtgccaaggaaaaggaaagtcagaagactgatggccagcgctccaaatcactcgctgatattaaagaaagcatggaaaacccacaagcaaagtggctgaagtctccaactaccccaatagaccccgagaaacagtggaatcttgctagcccaagtgaggagacacttaacgagggcgagatccttgaatataccaagagcatcgaaaagctgaactcctcacttcactttctgcagcaggagatgcagcgactgtccttgcagcaggagatgttgatgcaaatgagagagcagcaaagctgggtgatatcaccccctcagccctcaccacagaaacaaattagagacttcaaacctagcaagcaggcagggctatcatcggcgattgcccctttctcatctgacagccctcgccctacccatccgtcaccccagagcagtaacaggaagtccgcttctttttccgttaagagtcagaggactcctcgcccaaacgaacttaagataacgccattaaatcgaacgctcacaccacccagaagcgtcgattcattgcccagactgcggaggttcagcccctcacaggtcccgatccagacccgcagcttcgtgtgttttggcgacgacggcgagcctcagttgaaggagtcgaagcccaaggaggaagtcaagaaagaagagctggaaagcaagggtacactggagcagaggggtcacaatccggaggagaaggaaattaagccgtttgagtctactgtgtcagaagttttgagcctgcctgtcacagaaacagtgtgtttgactcctaatgaggaccaactcaatcagcccacagagccaccaccaaagcccgttttcccacccaccgcccctaagaacgtgaacctgatcgaagtcagcctgtctgacctgaagccgccagaaaaagcggacgtgcctgtggagaaatacgacggagagagcgacaaggagcaatttgatgacgaccagaaggtgtgttgtgggttttttttcaaggatgaccagaaggctgaaaatgatatggcaatgaagcgggctgccctgctggagaaacgacttcgacgagagaaggagacacagctcagaaagcaacagctggaggcggagatggagcacaaaaaggaggagacccgaaggaagactgaggaggaacgccaaaaaaaagaggatgaacgcgcacggcgtgagttcataaggcaggagtatatgcggaggaaacagctgaaactcatggaggatatggatacagtgattaagccacgtccacaagtcgtaaaacagaagaagcagcggcctaaatctatccaccgcgaccatatcgaaagccctaagacacctatcaagggtcctcctgtgtcatctctgagcctcgctagtttgaatacgggagataacgagagtgtccacagcgggaagcgcacacccaggtcagaaagtgttgagggattcctctcgcctagtagatgcggttcccgaaacggcgagaaagattgggaaaacgccagtactacctcctcagttgcctccggcacagaatacacaggcccaaaactgtacaaggagccttccgctaaaagcaataagcatatcatccagaacgctttggcccactgttgtctcgccggaaaggtgaacgagggccagaaaaaaaagattctcgaggaaatggaaaagagtgatgccaataacttcctgatactcttccgcgactcaggatgccagtttaggtctctctatacatactgtcctgaaactgaagaaatcaataagctcactggaattggacctaagagcatcactaaaaaaatgatcgagggactgtacaagtacaacagcgaccgaaagcaattttcccacattccagccaaaacattgagcgctagcgtcgacgcgataacgatccactcacacttatggcagaccaagaggcccgtgaccccaaaaaagctgttgcctacaaaagcttag

SEQ ID NO: 216758 - DNA, 450 bp, Artificial Sequence
  Description of Artificial Sequence: Synthetic coding sequence
atggccgaccagctcaccgaagaacaggtgacagaatttaaagaggctttcagcctgttcgacaaggacggcgatggatgcattaccaccagagagcttgggacagtgatgcgtagcttaggacagaatcccactgaggccgagctgcgagatatgatgagcgaaatcgatcgtgacggcaatgggacagtggatttccccgaattcttggggatgatggcccgtaagatgaaagatacagataacgaggaggagattagggaagctttcagagtgttcgacaaagacggtaatggattcgtttcggctgccgaactgcgacatgtcatgacaaggctgggagaaaaactctccgatgaggaggtggacgaaatgatcagagcagctgacactgatggggatggccaggttaattatgaagaattcgtgcgcgtgctggtgtctaagtag

SEQ ID NO: 216759 - DNA, 546 bp, Artificial Sequence
  Description of Artificial Sequence: Synthetic coding sequence
atggggctgcaacaagagatttcactccagccatggtgccaccaccctgccgaaagttgtcagaccaccactgacatgacagagcgcctgagcgcggagcaaattaaggagtacaagggtgtgttcgagatgtttgacgaggagggcaatggggaagtgaaaaccggggagctggagtggttaatgagtcttcttgggattaatcccaccaagtctgaactcgcttctatggcgaaggatgtcgacagggataacaagggcttctttaattgtgatgggttcctcgcactaatgggagtgtaccatgagaaagctcagaaccaggagagcgaacttcgggcagcattccgggtattcgataaagagggaaagggctacattgattggaatacccttaaatatgtgttgatgaatgcaggtgaacccctgaacgaagtggaagcagaacagatgatgaaggaggccgataaggacggcgaccgtaccattgactacgaagaattcgttgctatgatgaccggcgagagctttaagctaatccaatag

SEQ ID NO: 216760 - DNA, 495 bp, Artificial Sequence
  Description of Artificial Sequence: Synthetic coding sequence
atgggccttcagcaagagataagcctaacagagagactttcggctgagcagatcaaagagtacaaaggcgtgtttgaaatgttcgacgaggaagggaacggcgaggtgaagacgggagaactcgaatggctaatgtcactcctcggcattaatccgaccaagtcggaactggctagcatggccaaagatgtggaccgagacaataaaggattctttaactgtgacggtttcttggcgctgatgggagtgtaccacgaaaaagcccagaaccaggagtcggagctgagagccgcttttagagtttttgataaagagggtaaaggctatatagactggaatacgttgaaatatgtcctgatgaacgccggagagcccctgaacgaagtggaggcagaacaaatgatgaaggaggcggacaaggacggcgacagaaccatcgactacgaggagtttgtggctatgatgaccggagaaagctttaaactaattcagtag

SEQ ID NO: 216761 - DNA, 1779 bp, Artificial Sequence
  Description of Artificial Sequence: Synthetic coding sequence
atggagggcaaatggcttctttgcatgcttctcgtgttagggacagccattgtggaggcccacgatggccatgatgacgatgtgatcgacatcgaggatgacctggatgatgttatcgaggaagttgaggacagcaagccagacactaccgccccaccgtcctctccgaaggtcacatataaagctcccgttccaacaggtgaggtatatttcgccgacagctttgacaggggaactctgagtgggtggatcctgtccaaggctaaaaaggacgatacagacgatgagatcgccaagtacgatggcaagtgggaggtggaagagatgaaggagagtaagctcccaggagataaaggtctcgtgttgatgagcagggcaaaacaccacgccatatcagccaagctaaacaagccattcttattcgacacaaagccattgatcgtgcagtatgaagtcaacttccagaacggaattgaatgcggcggagcctatgtaaagctcctctccaagacacccgagctgaacctcgaccagttccacgataagaccccgtatacaattatgttcgggccagataaatgcggggaggattacaaactacatttcatattcagacacaaaaaccctaagaccgggatttatgaagaaaagcacgcaaaacgacctgacgccgatctaaaaacctacttcacagacaagaaaacccacctttacaccctgattctcaacccggacaactcctttgaaatcttagtcgaccagagtgtggttaatagcggcaatttgttgaacgacatgacacctcctgtgaacccatctcgagaaattgaggatcctgaggaccggaaacccgaggattgggacgaaagacccaaaatcccagatccagaggctgttaaacccgatgactgggatgaggacgcaccggctaaaatcccagacgaggaagccaccaaacccgaaggctggctggacgatgagcccgaatatgtaccggacccggacgctgaaaagcccgaggattgggatgaggatatggacggtgagtgggaggcccctcagatagcaaacccccgatgcgagtctgccccaggatgtggggtctggcaaagacctgtgatcgacaaccccaattacaaggggaagtggaaaccgccaatgattgacaatcctagctaccaggggatctggaagccaagaaagatccccaaccccgatttttttgaagacctggagcccttccgtatgacacccttctcggcaatcggactggaactgtggagcatgacgagtgacatctttttcgacaactttataatctgcgccgatcgcaggatcgtggacgactgggccaatgacggttggggcctcaaaaaggctgcagacggtgccgcagagcctggagtagtgggacagatgattgaggcagcagaagagagaccatggctctgggtggtttatatcctcacggtggccctgcccgtgtttctcgtaatcctgttttgctgctccggtaagaagcagactagtggcatggagtacaagaagactgacgctccacaaccagacgtgaaggaagaagaagaggagaaggaagaggagaaggataagggggatgaggaagaggagggggaggagaagcttgaagagaagcagaagtctgacgcagaggaggacggtggaacagtctcacaggaggaggaggacagaaagccaaaggcagaagaagatgaaatattaaacagatcaccccgtaaccggaaaccgagaagagagtag

SEQ ID NO: 216762 - DNA, 852 bp, Artificial Sequence
  Description of Artificial Sequence: Synthetic coding sequence
atgctcctagtcttggggacggccatcgttgaggctcatgacggacatgacgacgatgtaatcgacatcgaggatgacctggacgatgttatcgaagaggtagaagattctaaacccgacacgactgcacccccatctagtcctaaggtgacttacaaagccccagtgcctaccggggaggtctactttgcagattccttcgacagaggtaccctgtcgggctggatcctgagcaaggccaagaaggacgacacggacgacgagatagcaaagtacgatggcaagtgggaggtcgaggaaatgaaggagtccaaactgcctggtgacaaggggctcgtgctgatgagtcgggcaaagcaccacgccatcagtgcaaaactcaacaagcccttcttgttcgacaccaagccacttattgtgcagtacgaggtaaacttccagaacggaattgagtgcgggggagcatacaactgttttctgaaacaccagaactccacctgggaccagttccacgacaagacaccctacacaattatgtttgggccagataagtgcggagaggattacaagcttcactttatctttaggcataagaatcctaaaaccgggatctatgaagaaaagcacgcgaagcgtccggatgctgatctcaagacatactttaccgacaagaaaactcatttatacactttgattttgaacccggacaactcatttgagatacttgttgaccagagcgttccccctgtcaacccatccagagagatcgaagatccggaagatcgaaagcccgaagactgggacgagagacctaagattcccgatcctgaagcagtgaaaccagacgattag

SEQ ID NO: 216763 - DNA, 984 bp, Artificial Sequence
  Description of Artificial Sequence: Synthetic coding sequence
atggaaggcaaatggcttttgtgtatgctcctggttctcggtacagccattgtcgaggctcacgacgggcatgatgacgatgtgatcgacatcgaagacgacctcgacgacgttatcgaagaagtcgaggaaatgaaggaaagcaagcttcctggcgataaggggctcgtgcttatgtctcgagcaaagcatcacgctatttctgcaaagctaaacaagcctttcctgttcgacaccaaaccactgattgtccagtacgaagttaacttccagaacggtattgagtgcgggggagcctacgtcaagctccttagtaaaacccccgagttaaacttggatcagtttcatgataaaactccctacaccattatgttcgggccagataaatgtggagaggactataagctgcactttattttcagacacaagaatccgaaaaccggaatctatgaagaaaagcatgcaaagaggcctgatgcagacctcaaaacatattttacagataagaagacacatctctacacgctcatcttgaaccctgataattcttttgagatcctggtggatcagtcagtggttaacagcggcaatcttctgaatgacatgacaccgccagtgaatccttcccgagagatagaagatccagaagaccgcaagcctgaggattgggatgagaggcccaaaatacctgaccccgaggccgtgaaacccgatgattgggatgaggacgccccagctaaaatccccgatgaggaggcaacgaaaccggaggggtggctggacgacgaacccgagtatgttcctgaccccgacgctgagaaacctgaagattgggatgaggacatggatggggagtgggaggctcctcagattgctaaccctcggtgcgagtcagctcccggatgcggcgtctggcagagaccagtggttgatatccagaagacctccagacatcaccatcaacaggctccagtcgagcactag

SEQ ID NO: 216764 - DNA, 1884 bp, Artificial Sequence
  Description of Artificial Sequence: Synthetic coding sequence
atggcggacaggaggacacccacacccttcgccggatgccgtctgccacggcagagacgcgcaagggatgcaagccaagtttcagctcctggtaccaggagaatcatggaaggcaagtggctcctgtgtatgctgctcgtgttgggaacagccatagttgaagcccatgacggccatgacgacgatgtgatagacatcgaggatgacctggatgacgtcattgaggaggtagaagacagcaagcccgacactaccgctccacctagcagcccaaaagtgacctacaaggcgccagtgcccacaggcgaggtgtatttcgcagattcctttgaccgagggactctgtccgggtggatactatcaaaggccaaaaaggatgacaccgacgatgaaatagctaagtatgatgggaagtgggaagtggaggagatgaaagagtccaaactgccaggcgataagggactcgtgttgatgtctcgggcaaagcaccatgccatcagcgcaaaactgaacaagcctttcctttttgacactaagccactgattgtacagtacgaagttaacttccagaatggcatcgagtgcggcggagcctacgtcaagctgctgagtaaaacacctgaactaaaccttgatcaattccatgacaagaccccctacacaattatgttcgggcctgataaatgtggggaggactataagttgcacttcattttccgtcacaagaaccccaaaacgggaatatatgaggagaagcacgcaaaacggccagatgccgacctgaaaacatattttaccgacaaaaagacacacctttacacccttatcctaaatccagacaatagctttgaaatccttgtagaccaatccgttgtaaattctggcaacttgttgaatgatatgacacctccggtgaatccctctcgtgaaatcgaggacccagaggaccgcaaaccagaggactgggacgaacgtcccaagatcccggatcctgaggccgtgaagcccgacgactgggacgaggacgcgcctgcgaagattccagatgaagaggcaaccaagcccgaggggtggctggacgatgaacccgagtatgtgcccgaccctgatgctgagaagcccgaggactgggacgaggacatggacggtgaatgggaggctccccagattgccaacccacgctgcgagtccgccccaggctgtggcgtgtggcagcgcccagtgatcgacaatccaaactacaaggggaaatggaagcctcccatgatcgacaatcccagctaccagggcatctggaagcccaggaagattcccaacccagactttttcgaggacctggaaccctttcgtatgacacccttctctgctatcgggctggaactgtggagcatgacaagcgacattttctttgataattttatcatctgcgccgatcgcagaattgtcgacgattgggccaacgacggttgggggctcaaaaaggcagcagatggggcagctgaaccgggagtggtgggccagatgattgaggctgccgaggaacgcccatggctttgggttgtgtatatcctcaccgttgcactgcccgtcttccttgtgatactattttgttgctccgggaaaaagcagactagcgggatggaatacaagaaaacagatgcaccacaaccagacgtaaaggaagaagaagaggagaaagaagaagagaaggataagggagatgaggaggaagaaggagaggagaagttggaggagaagcagaaaagcgatgctgaagaggacggaggtacagtttcccaggaggaggaggacagaaagcccaaggccgaagaggatgaaattctgaatcggtcaccacgaaatcgaaaacctcgtcgggagtag

SEQ ID NO: 216765 - DNA, 1779 bp, Artificial Sequence
  Description of Artificial Sequence: Synthetic coding sequence
atggagggcaagtggttgctctgcatgctgctagtgctgggcacagcaatcgtggaggcgcacgacgggcacgacgacgatgtgatcgacatcgaagatgatttagatgacgtgatcgaggaggtggaagattccaagcccgatacaactgccccaccttcgagtccaaaggtaacctacaaggcaccagtgcctactggcgaagtctactttgctgacagcttcgatagaggaaccctaagcgggtggatactgagcaaggcgaaaaaagatgataccgacgacgaaattgccaaatacgacggaaaatgggaggtggaagaaatgaaagagtctaagttgccaggagataaaggactggtcctgatgtcccgcgcaaaacatcatgcaatcagcgcgaagttgaacaagccctttctcttcgatactaagccacttatcgtgcaatatgaagtaaactttcagaacggcatagaatgtggcggtgcttacgttaaattgctatccaagacccccgaattaaatctcgaccagttccacgataaaactccttataccattatgtttggcccagacaaatgcggtgaagattacaagctacacttcatatttcgacataaaaatccaaaaaccggcatctacgaagagaaacatgctaagcgtccagatgctgacttgaaaacctattttaccgacaaaaagacacacctctatacactcatacttaaccctgacaactctttcgagatccttgtggatcaatcagtggttaattctggtaatctcctaaacgacatgacccccccagtgaatccaagtcgggaaatcgaggaccctgaggaccggaagccagaggattgggacgagagaccgaaaatcccagatcctgaggccgtgaagcctgacgactgggatgaagacgcgccagcaaaaattccagatgaagaggcaactaaacctgaaggttggttagacgacgagccagagtacgtacccgatccagacgcagagaaacctgaggactgggatgaggacatggacggggagtgggaagcacctcagattgccaaccctcgatgtgaaagtgcaccagggtgcggagtttggcaacgccctgttattgacaatccaaactataagggcaaatggaagccccctatgatcgataacccaagctatcaggggatttggaagccgcgaaagatacctaatccagatttcttcgaggatctggaaccatttcggatgactccgttctcagccatcggcctggaactatggtcaatgactagtgatattttttttgacaacttcatcatctgtgccgatcgcaggattgtggatgactgggccaatgacggctggggtctgaagaaggccgctgatggcgcagctgaaccgggtgtcgtaggccagatgatcgaggcggctgaggaacggccatggctgtgggtggtttatatcttaacagtggctttacccgtgtttctggtgattttgttttgctgtagcggcaaaaagcagacgagcggcatggagtacaagaaaaccgatgcaccccagccagacgtaaaggaggaggaagaggagaaagaagaggagaaagacaagggcgacgaagaggaagagggtgaagaaaagttggaggagaagcaaaagagcgatgccgaggaggacggtggcacagtttcccaggaagaggaggataggaagccaaaggctgaagaagacgagatattaaataggtcacctcgcaacaggaagcctcgacgtgaatag

SEQ ID NO: 216766 - DNA, 405 bp, Artificial Sequence
  Description of Artificial Sequence: Synthetic coding sequence
atggaaggtaagtggctattgtgcatgctactggtcctggggacagctattgtggaagcccatgatggacatgatgacgatgttatcgacatagaggacgacctggacgacgttattgaagaggtggaggactcaaagcctgacacaactgccccaccgtcaagcccgaaagtcacctataaggccccagttcccaccggtgaggtatatttcgctgattccttcgatcgcggtacgctctcaggctggattctcagtaaagccaagaaggacgacacagatgatgaaattgccaaatacgacgggaagtgggaggtggaggaaatgaaagagtccaaactaccgggagacaaggggctggtgctgatgagtcgggctaaacaccacgccattagcgctaagtag

SEQ ID NO: 216767 - DNA, 507 bp, Artificial Sequence
  Description of Artificial Sequence: Synthetic coding sequence
atggaggggaaatggctgttgtgtatgctcttagtactcggcacggcaatcgtggaggcccacgacggccatgatgacgacgtcatcgacatcgaagacgacttggacgacgtgatcgaggaagtagaggactcgaagcccgacacaacggcgccaccgtcatctccaaaggtgacatacaaggctcccgttcccacaggtgaggtgtatttcgccgattcttttgatagggggaccctcagtggctggatcctctcaaaagccaaaaaagacgataccgatgacgagatagctaagtatgacggaaagtgggaggtggaagagatgaaagaaagcaagctgcctggcgacaagggcctcgtgctgatgagtcgcgctaagcaccatgcgatttcagctaaactaaataagcctttcttattcgatactaagccacttatcgtgcagtacgaggtcaacttccaaaacgggatcgaatgcggtggcgcttacgttaagttgctttag

SEQ ID NO: 216768 - DNA, 1779 bp, Artificial Sequence
  Description of Artificial Sequence: Synthetic coding sequence
atggagggtaagtggctgctctgcatgctgctcgttctggggactgccatcgtggaagcacatgacggccacgatgatgacgtaattgatattgaagatgatttggacgatgtgattgaggaagtggaagattcgaagcccgataccactgcgccaccatcctctccaaaggttacatataaggcaccagtcccgaccggcgaggtatactttgcggatagcttcgatcggggaactctgagtggatggatcttatccaaggctaaaaaggacgacaccgacgatgaaatcgccaaatacgacggcaaatgggaggttgaggagatgaaagagagtaagctccctggtgacaaaggactggttctgatgtccagggccaaacaccatgccataagtgctaagttaaataaaccatttctctttgacacgaagccgttgattgtacagtatgaggtcaatttccagaacgggatagagtgcgggggagcctatgtgaagctgctgtcaaagaccccagagctcaatctcgatcaattccatgataaaacaccttatacaatcatgttcggacctgataaatgcggagaagattataaactacactttatcttccggcataaaaaccccaaaactggaatctacgaggagaaacatgctaagcgtcccgatgccgaccttaagacctatttcactgataagaaaacacatctgtataccctcatcttaaaccccgataatagctttgaaatacttgtcgatcagagcgtcgtcaattcaggcaacctgctgaatgacatgactccccctgtgaatccaagccgcgaaattgaagaccccgaggatcgaaaacccgaggattgggacgagcgaccaaaaattcctgatcctgaggcggtgaagcccgatgattgggacgaggatgcccctgctaagatcccagatgaggaggccacaaaacccgagggatggctggatgacgagcctgagtatgtcccagatcctgatgctgagaagcctgaggactgggatgaggacatggatggggaatgggaggcaccccagattgcgaatccacggtgcgagagcgcccctggatgtggggtttggcagagaccagtaatagataatccaaactacaagggcaagtggaagcctcccatgatcgataacccaagctaccaagggatctggaagccgaggaagattcccaacccagactttttcgaggatctcgagccgtttcgcatgacccccttctcagccatcggacttgaactgtggtctatgacgtctgatatctttttcgataactttattatttgcgccgaccggaggatcgtggacgactgggccaacgacgggtggggcttaaagaaggcagctgatggtgcagctgagccaggagtggttggacaaatgattgaagccgcagaagaaagaccttggctttgggtcgtctatattctcaccgtagctcttccagtcttcttagtgattctgttttgttgctccggtaaaaaacaaacatccggaatggaatataaaaagactgacgcccctcagccagacgtgaaagaagaggaagaggaaaaggaggaggaaaaagataaaggagatgaggaagaggagggagaagaaaaacttgaagaaaaacagaagagcgatgctgaggaggacggcggtacggtgtcacaagaggaagaggacagaaaacccaaggcagaggaagacgagatcctcaatcgaagtcctaggaatcggaagcccaggagagagtag

SEQ ID NO: 216769 - DNA, 240 bp, Artificial Sequence
  Description of Artificial Sequence: Synthetic coding sequence
atggaggggaagtggcttctctgtatgctcctggtgcttggtaccgccattgtagaagctcatgacggtcacgatgacgacgtgatcgacatcgaggatgatctcgatgatgtcatcgaggaggttgaagactctaaaccggatactacagctccacctagtagtcccaaggtgacatacaaagctcctgtccctactggagaagtctattttgccgactcctttgacaggggaacctag

SEQ ID NO: 216770 - DNA, 99 bp, Artificial Sequence
  Description of Artificial Sequence: Synthetic coding sequence
atggaggggaagtggctgctgtgtatgctgttggtgttgggcacggccattgtggaggcccacgacggacacgatgacgatgtgatagacatagaatag

SEQ ID NO: 216771 - DNA, 1455 bp, Artificial Sequence
  Description of Artificial Sequence: Synthetic coding sequence
atgaaggaatccaagctacccggagataagggactggttctgatgagcagggcaaaacaccatgcaattagcgccaagttgaataagcctttcttgtttgacaccaaacccttgatcgtgcagtacgaagttaattttcagaatggaatcgagtgcggaggagcatacgtgaaactgctgtcgaaaactcctgagttgaatctcgaccagtttcatgacaagaccccatacacgatcatgttcgggcctgataaatgcggggaagactacaagctgcatttcatattcaggcataaaaatcctaagacaggcatttatgaagagaagcatgcaaagcgtccggacgcagaccttaaaacctactttaccgacaagaagacgcacttatacacgctgatcctgaacccagacaactcatttgaaatccttgttgatcagagcgtcgtgaactcaggtaatcttctgaacgacatgacgccccctgtgaaccccagccgcgagattgaggacccagaggaccgcaagccagaagactgggatgagcgccctaaaattcccgacccagaggccgttaaaccggacgactgggacgaagatgccccagctaaaattcctgacgaggaggccactaaacccgagggctggctggacgatgaaccagaatatgtccccgaccccgacgccgagaaacccgaggactgggacgaagacatggatggcgagtgggaagcgccacagattgcaaatccgagatgcgagagcgcccctgggtgtggggtctggcagcggccagtgattgataacccgaactacaaaggaaagtggaagccccctatgatcgacaacccatcctaccaaggaatctggaaaccacgtaaaatccccaaccctgacttttttgaggacttggaaccctttagaatgacgcctttttcagcaattgggctggaactgtggtcaatgacctcagatatattttttgataacttcataatttgcgcggaccggaggatagtggatgactgggcgaatgacggctggggcctcaaaaaggcagcagacggggctgccgagccgggagtggtaggccagatgattgaggccgctgaagaaagaccctggctttgggtggtgtatatcctgacagtcgctctgcctgtgtttctggtgatccttttctgttgttccggcaagaaacagacaagcggaatggagtataagaagacggatgccccacagccagacgtcaaagaagaagaagaagagaaagaagaggaaaaagacaagggtgatgaggaggaggaaggagaagagaaacttgaggaaaagcagaaaagtgacgccgaggaggatggcggaacagtgtctcaggaggaagaggaccggaaacctaaagctgaggaggatgagatcctcaatagatcaccgagaaaccgcaagccccgaagagagtag

SEQ ID NO: 216772 - DNA, 324 bp, Artificial Sequence
  Description of Artificial Sequence: Synthetic coding sequence
atggagggaaaatggctactgtgtatgctcttagtcctggggacagctattgtggaggctcatgatgggcacgatgatgatgtgatcgacatcgaggacgatctggatgacgtaatagaagaagtagaggacagcaagcccgacactacagcccctccctccagtcccaaagtgacctataaggcaccagtccccactggagaagtctactttgctgatagttttgacaggggtacccttagcggctggattcttagcaaggctaagaaggacgacactgatgatgagattgctaagtatgatggcaagtgggaagtggaatag

SEQ ID NO: 216773 - DNA, 435 bp, Artificial Sequence
  Description of Artificial Sequence: Synthetic coding sequence
atggaagggaaatggctcctgtgcatgctgttggttcttggaacagcaatcgtggaagcacacgatggccacgacgacgacgtgatcgatatcgaagatgacttggacgacgtaatagaggaagtggaggactccaagcctgacacaactgcccctccatcctctcctaaggtgacatataaggctcctgtgcctaccggcgaagtgtactttgcggactcctttgaccggggtactttgagcggctggattctgagcaaggccaagaaggatgatacggacgacgaaattgctaaatacgacggcaagtgggaagtggaagagatgaaggagtcaaagcttcctggggacaagggcctggtcctgatgtcgagggccaagcatcacgccatttcagccaagctgaataagccttttctgttcgatactaagtag

SEQ ID NO: 216774 - DNA, 420 bp, Artificial Sequence
  Description of Artificial Sequence: Synthetic coding sequence
atgagagccggaaggggagcaacacctgccagggaactgtttagggatgccgctttccccgcagcagattcaagcctgttttgtgatctgagcacgcctttggcccagttcagagaggatattacctggcgcaggcctcaggaaatctgcgccactcctcgcctgtttcccgatgatccacgtgaaggtcaggttaagcaaggtctattgggcgattgttggttcctgtgtgcttgcgccgctctgcagaagtcccgtcatctcctggatcaggtctcctgtcctgtgcagctccccgctgactggacctgcaaagtgcaacccgtgtggcttgagtttccatgtctgcccatttcttgtagattgcgagtctcttctgacacttctcctgactctgcaacatggggctcttggaagtag

SEQ ID NO: 216775 - DNA, 417 bp, Artificial Sequence
  Description of Artificial Sequence: Synthetic coding sequence
atgcgggctggcagaggggctactcctgctcgggagctgttcagagacgctgctttccctgctgccgattcctcgctgttttgcgacctgtcaacaccactagcccagtttcgggaagacataacctggcgcagacctcaagtgcctgaaggcggtagatcacaggacgctccaccactgctgctgcaagaacccctgctgagctgcgttccgcaccggtacgcgcaggaagtttcccggctgtgcctccttcccgctgggacatacaaagtcgtgccttctacatatctccctgatacagaaggagcgtttacagttacgatcgccacccggatcgacaggcccagtatccacagccaagaaatgctgggacaatttttacaggaggtgagcattatggcagtcatgaaaacatag

SEQ ID NO: 216776 - DNA, 1554 bp, Artificial Sequence
  Description of Artificial Sequence: Synthetic coding sequence
atgcgggcaggccgaggcgcaacacctgctagggagctgtttcgggatgctgcttttcctgccgcagactcttcactgttttgtgatctgtctacgccattagctcagtttcgagaagacatcacgtggcggaggcctcaggagatttgtgccacccctcgtctgtttccggacgacccaagggagggccaggtcaagcagggactgctgggagactgctggtttctgtgcgcatgcgctgcccttcagaagtcccggcacctgttggatcaggtgataccgcctggccagccgtcttgggccgatcaggagtataggggaagcttcacttgccgtatttggcagttcggaagatgggtggaggtgactacagatgatcgcctcccgtgcctcgccggaaggctctgctttagtagatgccagcgcgaggatgtgttttggctgcctttgcttgagaaggtgtacgcaaaagtgcacggcagttacgagcacctgtgggccggtcaggtggccgacgctctggtcgacttgactggaggcttggcggaacgatggaacctcaagggagttgccggtagcggaggacagcaggatcgccctggacgatgggaacataggacctgccggcagcttctgcacttaaaagatcagtgcttgattagttgttgcgtactgtccccgagggcaggcgctagagagctgggcgagtttcatgcattcattgtaagcgatcttagggaactgcaggggcaggctggccagtgtattctgcttcttaggatacagaatccgtggggacgacgatgctggcaaggtctgtggagagagggcggagagggctggtcgcaagttgacgctgcggtagcatccgaattactgagccagctgcaagaaggcgaattttgggtggaagaagaggaattcctacgagagtttgacgagctcacagtcggctacccagttaccgaagccggtcacctgcagtcactctataccgaaaggctcctgtgccatactcgcgctctacccggtgcatgggtaaaaggacagagtgctggcggttgccggaacaacagtggtttcccatccaatcctaagttctggctgagggtcagcgaacccagtgaggtttacattgctgtgttgcagcggagccgcttacatgcagcagattgggcagggcgagccagggctcttgttggtgactctcacaccagttggtcccccgcttccatcccaggcaaacactaccaggcggtcggtctccacctgtggaaagtgcccgaggggggacggagccaggacgctccaccactcctgctgcaagaacccctattgagctgtgtgcctcacagatacgcccaggaagtctcaagactctgcctgctgccggcagggacttacaaggtggtcccttccacttatctgcccgatactgagggcgctttcactgtgacgatagcaacacgaattgacagaccatcgatccactctcaggaaatgctcggccagtttttgcaggaggtatccatcatggcggtgatgaagacctag

SEQ ID NO: 216777 - DNA, 1335 bp, Artificial Sequence
  Description of Artificial Sequence: Synthetic coding sequence
atgcgggctggcaggggcgctacaccagccagagagctgtttagagatgctgcattcccagcagcagacagttcacttttctgtgatctgagtacccctctcgctcagttccgtgaggatataacttggcgacgcccacaggagatctgtgcaactcccagactgttcccagacgacccacgggaaggacaggtcaagcaaggactgctgggagattgctggttcctctgtgcctgcgctgctctgcagaaatccagacatctgctcgaccaggtgattccccctggtcaaccgtcctgggcagatcaggagtacagggggagcttcacctgtcgcatctggcagtttggccgttgggtggaagtgactacagatgatagattgccttgcctagccggacgcttatgtttctcccgctgccagagggaggatgtgttttggttacccctccttgaaaaagtgtacgctaaggtccacgggagctacgaacatctgtgggccggacaagttgcggatgccttagtggacctaacgggtggactggccgaaaggtggaatctaaaaggcgtggctggatctggaggccagcaagacagacctggtcggtgggaacaccgcacttgcaggcagcttcttcacctgaaagaccagtgcttgatctcttgttgtgtgctgtccccccgtgctggcgcaagggaactcggagagttccatgcctttatcgtcagtgatctgcgtgagctgcagggacaagctggacagtgtattttgctgctcagaattcaaaatccctggggtcgcagatgctggcagggactgtggcgggaaggtggcgaaggctggtcacaggtggacgccgcagtcgccagcgaactcctgtctcagctgcaggagggcgagttttgggtggaggaagaagagtttcttcgtgaattcgatgagctaactgtaggctaccccgtaacagaggccggacacctccagtctctatatactgaaagactgctatgtcataccagggctctccccggtgcatgggtcaaaggacagagcgccggtgggtgccgcaataattcagggtttccatcgaatcctaaattttggctcagagtctcagagccctccgaggtatacattgccgtgttacagagatcccgtctgcacgcagccgattgggccggacgcgcacgagccctcgttggggactcccacacctcatggagccctgcatctatacccggaaaacactatcaggctgtgggcttgcatctgtggaaaggcgtgacactcggcacaaccctttttccggtgcctagctggatgtggcccacatag

SEQ ID NO: 216778 - DNA, 2019 bp, Artificial Sequence
  Description of Artificial Sequence: Synthetic coding sequence
atgagggctggaagaggcgctactcctgcgagggagctgtttagagatgcagcctttcccgcagcagactcctctctgttctgtgatctgtccacccccctcgcacagtttagagaggatattacctggcgtcggccacaggaaatttgtgcaacccccagactcttcccagatgatcctagggaaggccaagtcaagcagggcttattgggcgactgctggttcctttgtgcttgcgctgctctgcagaagtcgagacacttgctggatcaagttatccctccaggtcagcccagttgggcagatcaggagtaccgagggagctttacatgcagaatctggcagtttggccgatgggtggaagtcactaccgacgaccgcctcccttgtctggcgggaagattgtgttttagcagatgccagcgagaagacgtgttttggcttcccctcctggagaaagtgtatgccaaagttcacggatcatacgagcacctgtgggccggacaagtggccgatgctttggttgatctgaccggtggactcgctgagcggtggaacctcaagggcgtggccggttccggaggccagcaggacagaccagggaggtgggagcatcgcacttgccgccaacttctccacctgaaagatcagtgtcttatcagttgttgcgtgctatctccaagagcaggtgctagagaactgggagaatttcatgccttcatcgtctcagatctcagagaactccaggggcaagccggacagtgtattctgctgctgaggattcagaacccatgggggaggcgttgttggcaagggctttggagagagggcggtgaggggtggagccaagttgacgctgctgtggcatccgagctcttgtctcaactgcaggaaggtgagttttgggttgaagaagaggaattcctgagggaatttgatgagctgactgttggctacccagtgactgaggcaggtcatcttcaaagcctgtacaccgaacggctgttgtgccatacccgtgcgcttcccggagcctgggtgaaggggcagtctgccggaggctgtcgcaataacagcggctttccctctaatcctaaattttggctgagggtcagcgaaccaagtgaggtctatattgccgtcttgcagcggtcccggctgcacgcagctgactgggccggaagagccagggcattggtgggggatagccatacttcatggtctccagcatcaattccgggtaagcattaccaggcagtgggcctgcacttgtggaaagtcgaaaagagacgcgtcaacctcccaagagtgttgagcatgcctcccgtggctggcaccgcttgccatgcctacgaccgtgaggtgcacttgcgatgcgagctgagccccggatattacctggcagtacctagcacctttttgaaagatgccccaggagaattcctgctgagggtgtttagtaccggtagagtttccctgagcgccatccgcgcagtggctaaaaataccactcctggggctgcactgcctgcgggtgagtggggcacagtgcagctccggggttcttggagggttggccaaactgccggaggatcacgcaatttcgcatcttaccccacaaatccttgtttccccttctcagtgcctgagggaccaggaccacgctgcgtccgcataaccctgcatcagcactgcaggccttcggacacggagtttcatcctatcggattccacatattccaagtacctgagggaggccgttctcaagacgctccccctctgctgctgcaggaacccttgttatcctgtgtgccccatcggtatgcccaggaggtgtccagactgtgcctgctgcccgctggtacatacaaagtggtacctagcacttatttaccggacaccgagggagcctttacagtcaccatagcaacacggatcgacaggccctctattcattcccaggagatgctggggcaatttttgcaagaagtcagcataatggccgttatgaagacttag

SEQ ID NO: 216779 - DNA, 2220 bp, Artificial Sequence
  Description of Artificial Sequence: Synthetic coding sequence
atgttgtacagtcccggaccgagcttacccgaatccgcagagtcattggacggctcgcaggaggataagcctcggggttcttgcgccgagcctacattcactgacacaggcatggtcgctcatattaataactcccggttaaaggctaaaggtgttggccagcatgacaatgctcagaatttcgggaaccagagttttgaagagctgagggccgcttgtctccgaaaaggtgagctgttcgaggatcctctcttccccgctgaacctagctcactggggtttaaggatctgggacctaactcgaagaacgtgcagaacataagttggcaacggcctaaggatatcataaataatccactgtttattatggacgggattagtcctactgatatctgccagggaatcctgggtgattgctggttgctggccgcaatcgggtcactgactacttgccccaagcttttataccgcgtggtcccgagaggacagtcttttaagaagaattatgccggtatatttcacttccaaatatggcagttcgggcagtgggtcaacgttgtagtggacgatcggcttcccaccaaaaacgacaaactggttttcgtacatagtacagagcggtccgaattttggtcggccctgctggagaaggcctacgccaagctgtccgggagctacgaggcattgtcggggggttcaaccatggagggactggaagacttcaccggcggtgtggcccagagcttccaactccagcggccaccccagaatttgctgcgccttctgcggaaagctgtggagaggtcctccctaatgggatgctcaatagaggtgactagtgattcggaacttgagtctatgaccgataagatgctggtgaggggtcatgcctactccgtaaccggcctccaggacgtgcactacaggggcaagatggaaactctcatccgggtccgcaatccttggggaagaatcgagtggaatggagcttggtctgattcagctagggagtgggaggaggtggcgtctgacatccagatgcagctgctgcataagaccgaggatggagagttctggatgagttatcaggatttccttaacaattttactttgcttgagatttgtaatttgacacctgatacactatccggtgactataaatcttattggcacaccacattctatgaaggcagctggcgcagaggaagctccgccggtggctgccgaaaccacccaggcacattttggaccaacccgcagttcaaaattagcctgccggaaggagacgaccccgaagatgatgccgagggcaatgttgtcgtgtgtacttgtctggtggctctgatgcagaaaaactggaggcacgctagacagcagggcgcacagctgcagactatcggatttgtgctgtacgctgtgcccaaagagtttcaaaatatccaagacgtgcacctaaaaaaagagtttttcactaagtatcaagaccacggttttagcgagatttttacaaattctagagaagtcagctctcaactgcgcttgcctcccggtgagtacataattataccaagtacgtttgaacctcaccgggacgctgactttcttctgagagtcttcaccgaaaagcacagcgaaagctgggagctggacgaggtgaattacgccgaacaactgcaggaagagaaggtctccgaggatgacatggaccaggattttttgcacctgtttaagattgtcgcaggagaagggaaagaaataggcgtctacgagttacagcggttgctgaacagaatggcaataaagttcaagtcattcaagacaaaaggcttcggccttgatgcctgcagatgtatgataaatttaatggacaaagatggatcgggaaaactcggcctgctggagtttaaaatcctatggaaaaaactgaaaaaatggatggatatattcagagagtgcgaccaggaccattcaggcacactgaactcatatgagatgcggctagtcattgagaaagcaggcattaaactgaataataaggttatgcaggttttggttgctcggtatgcggacgacgatcttattattgattttgacagcttcatcagctgttttttacggcttaagacaatgttcaccttctttttgacaatggacccaaagaatacaggccacatctgtctctctctggagcagtggcttcaaatgactatgtggggttag

SEQ ID NO: 216780 - DNA, 2220 bp, Artificial Sequence
  Description of Artificial Sequence: Synthetic coding sequence
atgctttattcaccaggaccaagcctgcccgagtcagctgaatcattagacggttcccaagaggataaaccacgtggttcctgtgctgagcctacctttaccgatacaggaatggtagctcatattaataatagccgtctgaaagccaagggcgtgggacaacacgacaacgcccagaactttggcaatcagtctttcgaggagctgcgcgcagcctgcctgagaaaaggtgagttatttgaagacccactcttcccagccgaaccgagttcactgggctttaaggatctgggaccgaattcgaaaaatgtacaaaacatctcttggcaaagacccaaagacatcatcaataatcctctctttatcatggacgggatcagccctacggacatttgtcaagggatcttaggagattgttggcttttggcagcaattggatcactgaccacctgtcctaaacttctttatagagtcgttcccagaggtcaatcattcaaaaaaaactatgccggaatctttcatttccaaatctggcagttcggccagtgggtgaatgttgttgtcgatgatagactgcccaccaaaaacgataagctggtcttcgtgcattccacagagaggtccgagttctggtccgctctgctggaaaaggcctatgcgaagctgagtggcagctatgaagctctgtctggagggtctacaatggaaggtctggaggactttaccgggggagttgctcagagctttcaactccagcgtccccctcagaacctgttgcggctccttcggaaggccgtggagagaagctctctgatgggctgctcaatcgaggtaaccagcgactcagaactcgagtcaatgactgacaagatgcttgttcgaggccatgcctattctgtcaccggcttacaggacgtgcattacagaggtaagatggaaactcttatccgcgtgcggaatccatggggacggatagagtggaatggagcctggtccgacagcgccagggaatgggaggaggtcgcttccgacattcagatgcagctcttgcataagaccgaggacggggaattttggatgtcttaccaagactttctgaacaacttcactctgctggaaatttgcaatctgacccccgatacattgtctggagactataaaagttactggcacaccaccttttacgagggtagttggcggagagggagcagcgctgggggttgtcgaaatcatcctggtacgttctggaccaaccctcagttcaagatctcactgccggagggtgacgatcccgaggacgacgctgaggggaatgtggtcgtgtgcacctgccttgtcgctcttatgcagaaaaattggagacatgcccgacagcaaggcgcacagttacagacaatcgggttcgttctgtatgcggtggccagcccattccagaatattcaggacgtgcatcttaagaaagaattcttcaccaaatatcaagatcacggattctctgagatctttaccaattctcgcgaagtctcctctcaactgcgactgccaccaggcgaatatattattataccctctaccttcgagcctcacagagatgctgacttcctgttaagggtgttcacagaaaagcactctgaatcatgggagctcgatgaagtcaattatgccgaacagttgcaagaagaaaaagtctctgaagacgacatggatcaggattttctccacttgtttaaaatcgttgccggagagggcaaagagatcggcgtctacgaactacagaggctccttaaccgtatggccataaagttcaaaagcttcaaaacaaagggtttcggtctggacgcctgccggtgcatgattaatctgatggataaggatggaagcggaaaactgggacttttagagttcaaaattctgtggaaaaagctgaagaagtggatggatatatttagggagtgcgaccaggaccactcaggcacgctcaattcttacgagatgcggctggtgattgagaaagccggtatcaagctgaacaacaaggtaatgcaggtgcttgtggcaagatacgccgatgacgacctcatcatcgacttcgactccttcattagttgttttttgaggttgaaaaccatgttcacttttttcctcaccatggaccccaagaacacagggcacatctgtctgtcactggagcagtggttacagatgaccatgtggggttag

SEQ ID NO: 216781 - DNA, 2160 bp, Artificial Sequence
  Description of Artificial Sequence: Synthetic coding sequence
atggccagcagtagcgggagggtcaccattcagctagtagatgaagaggcgggtgtgggagccggtaggctccagctctttcggggtcagtcatatgaggcgatccgagccgcatgcctggatagtgggatccttttccgggatccgtacttcccagccggacctgacgctctgggctatgaccagctcggtccagactcagagaaggctaagggagtgaaatggatgcggcctcatgaattttgcgcagaacccaaattcatctgcgaggacatgtcacgcaccgacgtgtgtcagggaagcctcggtaactgctggttcctggctgcggctgcgagtctgacactttatcccaggcttctgagaagggtggtgcccccaggccaggattttcaacatggatatgcaggagtgttccacttccagctgtggcagtttggcaggtggatggatgtagttgtggacgaccgccttcctgtaagggaaggcaaattgatgttcgtgcgatcagagcagcggaacgagttttgggcgcctttgctcgaaaaggcttatgccaagctgcacggctcctacgaggtgatgcgagggggtcatatgaatgaggcatttgtggacttcaccggaggagtcggcgaggtgctgtatctgaggcagaattctatgggccttttctccgctctaaggcatgcgctcgccaaagagagcctagtaggagcaacagcactgtccgatcgaggagagtatcgcacagaagaaggtctagttaagggacatgcatacagcattacaggaactcacaaagtatttctgggcttcactaaagtgcgactgctcaggctcaggaacccctggggatgtgtggagtggaccggagcctggtctgactcatgtcccaggtgggacacccttcctaccgaatgtcgagatgcactcctcgtgaaaaaggaggatggcgaattttggatggagcttcgcgatttcctgctccacttcgatacggtgcagatttgctcattgtcccccgaggtcctcggaccatcccctgaaggcggagggtggcacgtccataccttccaggggagatgggtgagagggttcaacagcggagggtcccagcctaatgctgagactttttggacaaatccccagttccggctgacacttcttgaacctgatgaagaagacgacgaggacgaagaaggtccgtgggggggttggggagccgcaggggctagaggcccagccagggggggtagaacacctaagtgcacagtcctgttgtcccttattcagcggaaccgccgacggcttagagcgaaaggactgacttacctgaccgtcggattccacgtcttccagatccccgaggagcttctgggcctgtgggactctccaaggtcgcacgccctcctgccgcgactactgcgtgccgacaggtccccactgtctgcaagaagggacgtgacacgcagatgctgcctgcggcctggccattacctggtggtcccttctacagcccatgccggagacgaggctgattttacactgcgcgtattctctgagcgacgccatacggctgttgaaatcgacgatgttatcagtgcagatctccagagccttcaaggcccttacttgcccctggaactgggactggaacaactctttcaggaactggctggagaggaggaggaactgaacgccagtcaactgcaggccctgctctccatcgcattggagccagcaagagctcacacttctaccccgcgtgagatcggattgcgcacctgtgaacagctgcttcagtgttttggtcatggtcagtctcttgcactgcaccactttcaacaactctggggctacctcctggagtggcaggccatctttaacaaattcgatgaagacacaagcggtaccatgaattcgtacgagctaaggctggccctgaacgccgctggctttcacctcaacaatcagctgacccaaaccctcacatctagataccgggattccagattgagagtcgacttcgagagattcgttagctgcgtggctcacctgacttgcatcttctgtcactgctctcagcatcttgatgggggagagggcgtaatctgcctgacacacagacaatggatggaagtagcgaccttttcatag

SEQ ID NO: 216782 - DNA, 2448 bp, Artificial Sequence
  Description of Artificial Sequence: Synthetic coding sequence
atgcccaccgttattagcgcctccgttgctcctaggacagctgccgagccccgatctcccggtcctgtacctcaccctgcacaaagtaaggctaccgaagccggaggcggaaatcctagcggcatatactccgccataatctccagaaacttccccatcatcggggtgaaggagaaaaccttcgagcagctccacaagaagtgtctggagaagaaggtgctttatgtggaccctgaatttccccctgacgagacatccctgttctacagtcaaaagttccctatccagtttgtgtggaagcgccctcctgaaatttgcgagaaccctcgattcatcattgacggagctaaccggactgacatttgccagggcgaactgggcgactgctggtttttggccgcaattgcatgccttacactcaatcaacatctgctcttcagggtaatcccccacgaccaatcctttatcgaaaactacgctggtatcttccatttccagttttggaggtacggcgagtgggtcgacgttgtgattgacgattgtctacccacatataataatcagttagtcttcaccaagagcaaccatcggaatgagttctggagcgcactgctggagaaggcttacgccaaactccatggatcatatgaggcactcaagggtggtaatacaactgaggcaatggaagactttacagggggtgttgcagaatttttcgagattcgggatgctccgtcggatatgtataagatcatgaagaaggccattgagcgcggatcacttatgggttgcagcatcgacgatggcaccaatatgacctatggaacctcgccatctggattgaatatgggcgagctgattgctaggatggttcgcaacatggacaactcactgctccaggactccgacttagatcctagagggtccgacgaaaggccaacccgcaccatcattcccgtgcagtatgaaacgaggatggcttgtggcctggtcagaggccatgcatacagcgtgaccgggcttgatgaggttccatttaaaggcgagaaagtgaagctggtcagactgcgaaatccttggggacaagttgaatggaacggctcttggagcgacaggtggaaggactggagttttgttgacaaggacgaaaaagccagactgcagcaccaggtaaccgaggatggtgaattctggatgagctacgaggatttcatatatcactttaccaagctagagatatgtaatttgacggccgatgccttgcagtccgataaactgcagacttggacggtgtccgtgaatgaaggaaggtgggtccgcggatgtagcgccggagggtgtcgcaacttcccagatacgttttggacgaacccacagtatcggttaaaactgctggaggaggacgacgatcctgatgacagtgaggtaatttgttccttcttagtagccttgatgcagaaaaaccggagaaaggacagaaagctgggagcgtccttgttcaccattggcttcgccatctatgaggttccccaccagatgcatggcaacaagcagcatctgcagaaggactttttcctctataatgcctctaaggcgaggtccaaaacctatatcaatatgcgagaagtgtcccagcgttttcggctgcccccttcggagtatgtgatcgtgccttccacttacgaaccacaccaggagggtgaatttatattgcgggtgttctccgagaagcggaatctctctgaggaggtggagaacactatcagcgtcgaccggcctgttcctattatttttgttagcgatcgtgccaattccaataaggagctcggcgtggaccaggagagtgaagaaggcaagggcaagacctctcctgataagcaaaaacagtccccacaaccacagccaggctcttccgatcaggagtctgaagaacagcagcagtttcgcaatatcttcaagcagatcgctggtgacgacatggagatctgtgccgacgagctgaagaaggtgctcaacacagtggtgaataagcacaaagacctaaagacccacgggttcactttagagagctgtagatcgatgatagcattaatggacactgatggctccggcaaactgaatcttcaggaattccaccatctgtggaacaaaatcaaagcttggcaaaagatttttaagcactacgacactgatcagtctggaacaattaactcttacgaaatgcgcaatgccgtgaacgacgctggattccacctcaataatcagctctacgatatcatcaccatgaggtacgccgataaacatatgaacattgatttcgatagtttcatttgctgttttgtgagactggaggggatgttccgtgcatttcacgcttttgataaggacggtgacggtattatcaaactcaacgtgctcgagtggttgcagctgaccatgtatgcttag

SEQ ID NO: 216783 - DNA, 930 bp, Artificial Sequence
  Description of Artificial Sequence: Synthetic coding sequence
atgcacggtaacaagcagcatctgcagaaggatttctttctgtacaacgctagcaaagctagaagcaaaacttacataaacatgagagaagtatcccaaaggtttaggttgcctccttcagagtatgtgatcgtgcccagtacatacgagccacaccaagagggggagttcattcttagagtcttctccgaaaaacgcaatctgagtgaggaagtggaaaacactatttctgtcgacagacccgtccggaaggagacctataagcccatcattttcgtgtctgacagagcaaactctaacaaggagttgggagtcgatcaggaaagcgaagagggcaaggggaagactagccctgacaaacagaaacagtctccccagcctcagccagggagctctgaccaggagagcgaggagcagcagcaatttcgcaacatatttaaacagatcgcgggtgatgacatggagatctgtgccgatgagctcaagaaagtgttaaacaccgtggtcaacaaacataaagatctcaaaacccacgggtttacgctcgaatcctgtaggtcaatgatcgctctcatggacactgacggcagcggcaaattaaaccttcaagaattccatcatctgtggaacaaaatcaaggcttggcagaaaatcttcaagcattacgacactgatcagagcggcacaatcaattcttacgagatgcgcaacgctgtgaatgacgctggattccacctgaataatcagttatatgatattatcacaatgcggtatgccgacaaacacatgaatatcgacttcgattccttcatttgttgtttcgtgagactggaggggatgtttcgggcatttcacgctttcgataaggacggagacggcataatcaaactaaatgtgcttgaatggctccagctgaccatgtacgcatag

SEQ ID NO: 216784 - DNA, 471 bp, Artificial Sequence
  Description of Artificial Sequence: Synthetic coding sequence
atggagatttgcgccgacgagttgaagaaggtccttaacacagtcgtcaataagcacaaggacctgaagacccacgggttcaccctggaatcatgtagatctatgatcgcgctgatggacactgatggatcagggaagctaaaccttcaagagttccaccatctatggaataagattaaagcatggcagaagatcttcaaacattacgacacggaccaatccgggactattaattcatacgagatgcgcaacgccgttaacgatgctggctttcatttaaacaatcagctgtacgacatcataactatgcggtacgcagataagcatatgaacattgactttgattcattcatctgttgcttcgtgagactggaaggaatgtttcgagctttccacgcgtttgataaagacggagacggaatcatcaagctaaacgtgctggaatggctacagttgacaatgtatgcctag

SEQ ID NO: 216785 - DNA, 2190 bp, Artificial Sequence
  Description of Artificial Sequence: Synthetic coding sequence
atgccaacggtcatctctgcctctgtcgctcctagaactgccgcagagccgaggagtcccggtcccgtgccccaccccgcacagagtaaggctactgaagccggaggaggcaatccaagcggcatatacagcgctataatcagccggaacttccccattattggcgtgaaggagaagacattcgaacaactccacaaaaagtgtttagaaaagaaggtgctctacgtcgacccggaattcccgcctgacgaaacttcgctcttctattcacaaaagttccccatccagtttgtctggaagcgcccaccggaaatttgtgaaaatcccaggttcataatcgatggagctaatagaacggatatctgccaaggagaactcggcgactgctggtttctggctgccatcgcctgtttgactttgaaccagcacctcctttttagagtgatcccccacgaccagagtttcatagaaaattacgccggtatctttcattttcaattctggcgctacggggagtgggtcgatgtagtgattgacgattgcttgcctacctataataatcagctggtgtttaccaaaagcaaccatcgtaatgaattctggtcggcgttgttagagaaggcttatgccaaacttcacggctcctatgaggcgttgaagggcggtaacactaccgaagccatggaggactttaccgggggagtggccgagtttttcgaaataagagatgcaccctccgacatgtataagataatgaagaaggctatcgaacgcggatccctcatgggctgctctattgacactatcatacctgtccagtacgaaacccgaatggcttgcggcctcgtaagaggtcacgcttattccgtaacaggcctcgacgaagttccattcaagggcgaaaaggtgaagttagtgcgactgaggaacccatggggacaggttgaatggaatggatcatggtcagacagatggaaggattggtccttcgtggacaaggacgagaaggccaggctgcaacaccaagtgacggaagacggagaattctggatgtcttatgaagatttcatttaccattttacaaaattagaaatttgcaacctcacggcagacgcactccagtctgataagctccagacctggacagtgtctgtaaatgagggcaggtgggtgcgaggttgcagcgccggaggctgcagaaacttcccagataccttctggactaatcctcaatatagactaaagctgcttgaggaagacgacgacccggatgattccgaggttatttgctctttcttggtagcgcttatgcaaaagaacaggcggaaagatagaaaattgggcgcttcgttgttcactattggatttgccatttatgaggtgccgaaggagatgcacgggaacaagcagcacttgcagaaggacttcttcctttacaacgcgtcaaaagctcgctcaaagacttacataaacatgcgtgaggtcagtcagcgattccggctccccccatctgagtatgttatagtgccttccacttatgagccacatcaagagggcgaatttatcctccgggtattttccgagaagcgaaatctctctgaggaggtggagaataccattagcgttgaccgtccagtcccgcagccgggaagttccgaccaagagagtgaggaacagcagcaattccgcaacatattcaagcagattgcgggagatgacatggagatctgtgcggacgagctgaagaaagtgctgaataccgtggtcaacaagcacaaggacctgaagacgcacggcttcactcttgaatcttgtaggtctatgatcgcactgatggatacggacggctccggaaaactcaaccttcaagagttccaccacttgtggaataagatcaaggcgtggcaaaagatcttcaagcattacgacacagaccagtccggcacaatcaatagttacgaaatgagaaatgccgtgaacgacgcgggatttcacctgaataaccaattgtatgacattataaccatgcgatacgcagacaagcacatgaatattgacttcgactcatttatctgctgtttcgtcagactggagggcatgttcagagcttttcacgcttttgacaaggatggggatggaatcatcaagctgaacgtgctcgaatggttgcagcttacaatgtatgcctag

SEQ ID NO: 216786 - DNA, 2187 bp, Artificial Sequence
  Description of Artificial Sequence: Synthetic coding sequence
atgtcttggcagatctccctaaagacccagaccacacagcagaaaaacgagatatgtgagaacccacggttcatcatagacggagcaaatcgaacggatatttgccagggcgagttaggagattgctggtttctggctgccattgcgtgtctgaccctgaatcaacacctcttgttcagagtcattccacacgaccagagttttatagagaactacgcagggattttccactttcagttctggagatacggcgagtgggtcgatgtggttatcgacgactgtctcccaacttacaacaaccagctggtgtttacaaagagcaatcataggaacgaattctggagcgccctactcgagaaggcatacgcgaagctgcatgggtcttatgaagctctgaagggtggcaacactactgaagccatggaagactttacaggcggtgttgctgaattctttgagatccgcgacgccccaagcgacatgtacaaaatcatgaagaaagcaattgagcggggttctctgatgggctgctccatagatgacgggactaatatgacatacgggacaagcccctcaggcctgaacatgggagaattgattgcgcgaatggtccgcaacatggacaactcactgctccaggacagcgatctggatccgaggggatcagacgaacgacctacacgaactatcatccctgtgcaatatgaaacacgtatggcttgcggactggtccgcggtcatgcttattccgtgaccggactggatgaggtaccctttaagggcgaaaaggtcaaattagtgaggctgcggaatccatgggggcaggtagagtggaatgggtcctggtctgacagatggaaggactggtcgtttgtggacaaggatgagaaggccaggctgcagcaccaggtgactgaggatggggagttttggatgtcctatgaagactttatctatcattttactaagctcgagatctgcaacctgacggccgatgcacttcagtccgataaactccagacttggaccgtttccgttaatgagggaagatgggttagaggttgctctgcagggggatgtcggaacttccccgacactttttggacaaacccccagtaccgcctgaagctgcttgaagaagatgacgacccggatgattcagaagtgatatgttctttcctggttgctctgatgcagaaaaatcgcagaaaagacaggaagcttggggcaagtctgtttactatcggctttgctatctatgaggtgcccaaggaaatgcatggaaacaagcagcacctacagaaggacttcttcttgtacaacgctagcaaggccagaagcaagacttacattaatatgcgggaagtgagccaacggtttagactgccaccatctgagtatgtgatcgttccctctacatacgagccacatcaggaaggcgagtttatacttagagtgttcagcgagaagaggaatctctctgaggaagtagaaaatacgatcagtgtggaccgccctgtgccgatcattttcgtgtcagaccgagctaacagcaacaaggagcttggcgtggatcaggagtccgaagagggcaaggggaaaacgtcccccgataaacaaaagcagagtcctcaaccccagcccggttcctccgaccaggagtcagaagagcagcagcagtttcgcaatatctttaaacagattgccggagatgacatggaaatatgcgcggatgaattgaaaaaggtccttaataccgttgtcaacaagcacaaggacctaaaaacccatgggttcactctcgagtcctgcaggagcatgatcgcccttatggatacagatggcagcggcaagctgaacctccaggaatttcatcacctgtggaacaagatcaaagcatggcaaaagatctttaaacattacgatacagaccagagtgggaccattaactcctacgaaatgcgcaacgccgtaaacgacgcaggctttcacttaaataaccagctttatgacattatcaccatgaggtatgctgataaacacatgaatatcgattttgatagcttcatttgctgctttgtgcggctagaaggaatgttcagagcttttcacgcattcgacaaagacggggatggcatcatcaagctgaatgtactcgagtggctgcaacttacgatgtacgcctag

SEQ ID NO: 216787 - DNA, 2448 bp, Artificial Sequence
  Description of Artificial Sequence: Synthetic coding sequence
atgccaacagttatctctgctagcgtggctccaaggacagcggcagaaccaagatcaccaggtcctgtgccacaccccgctcagagcaaagctactgaagccggagggggtaacccgtcaggaatatatagtgcaattatatcccggaatttcccaatcatcggtgtgaaggagaagacattcgaacagctgcacaagaagtgccttgaaaagaaagttctgtatgtggacccggagtttccgccagatgagacttctctgttctattcgcagaaatttcccattcagttcgtgtggaagcgacccccagagatttgtgagaacccaagattcattatcgatggagctaacagaacagacatttgtcaaggtgagttgggagactgttggttcctggccgctatagcatgtttgaccctgaatcagcacctcttgttccgagttattcctcatgatcagagtttcatcgagaactatgcaggcattttccactttcagttttggcgctatggcgaatgggtggacgtggtgattgatgactgtttgcccacctataataaccagctcgtctttacgaagagtaaccataggaacgaattctggtctgccctgttggagaaggcatatgccaagctgcacggaagctacgaggcgcttaaaggaggtaatacaaccgaggcaatggaggactttactgggggagtagcggaattttttgagataagggatgctccgtcagacatgtacaagattatgaagaaggcaatagaacggggatcgctcatgggatgcagcatcgatgacggcacaaacatgacatacggaacatctcctagcgggttaaacatgggagagttaatagctcggatggttcgaaacatggacaacagcctgctgcaggacagcgacttagacccaagaggtagcgacgagaggccaacccgcacaattattcccgtgcagtatgagacaagaatggcttgtggactcgttaggggacacgcctactccgttaccgggctcgacgaagtccccttcaaaggagagaaggtaaaactagtgagactgcgcaatccatggggacaggtagagtggaatggaagctggtcagaccgatggaaggactggtcttttgttgataaagacgagaaggcacggctgcaacaccaagtgacagaggacggcgaattctggatgtcttatgaggattttatctaccattttacaaaactagagatctgcaatctgacggcggacgccctgcagagtgataagcttcagacttggactgtgagcgttaatgagggcagatgggtccgcggatgttcagccggtggttgcaggaactttccagacaccttttggaccaatccccaatacagactcaagctgcttgaggaagacgatgaccccgacgactctgaggtgatctgttcctttttagtcgctcttatgcaaaaaaacagaaggaaggacagaaagctaggtgccagcctgttcactattgggtttgcaatttacgaagtacccaaagagatgcatgggaacaaacagcacctgcagaaggatttctttttatataatgcctctaaagccaggtccaaaacgtatataaatatgcgcgaagtgtcccagcggttccgtctgccgccaagtgagtatgtgatcgtgcccagtacctacgaaccccaccaggagggagagttcattctccgggttttctctgaaaagcgcaaccttagtgaggaggttgagaacaccatctcagttgatcggcctgtcccaatcatattcgtttctgatagggccaacagcaataaagagctcggtgtcgatcaggagtcagaagaaggaaagggaaagacctctcctgataaacagaagcaatcaccacagccacagcctggcagtagtgatcaggaaagcgaggagcagcaacagttcaggaacatcttcaaacagatcgcaggcgacgatatggagatttgcgccgatgaactgaaaaaggtactgaacactgttgttaataagcataaggacctcaaaactcacggctttaccctggagagttgccgcagtatgattgctctaatggataccgatggcagtggtaagctgaatcttcaggagtttcatcacctttggaacaaaatcaaagcatggcaaaagattttcaaacactacgatacagaccaatccggcaccatcaattcctacgagatgcgtaatgccgtcaacgacgccggttttcacctgaataaccaactgtacgacattataacaatgagatatgcagataaacacatgaatatagattttgacagttttatctgttgttttgtgcgtttagaaggaatgtttcgggctttccacgcatttgacaaggatggagatggaatcatcaagttgaacgtactggagtggctacagctgactatgtacgcttag

SEQ ID NO: 216788 - DNA, 2466 bp, Artificial Sequence
  Description of Artificial Sequence: Synthetic coding sequence
atgcctactgtaataagcgcatcagtggcgccaagaacagctgcggagcccaggtctccaggccctgtccctcaccctgcccaatcaaaggctaccgaggcgggtggaggaaacccatccggtatttacagcgctattattagccgcaacttccccattattggtgtcaaagagaaaacatttgaacagcttcacaaaaaatgcctggaaaagaaagttctatatgtggatcccgagttcccccctgatgagacatccttgttttattcgcaaaagtttccgatccagttcgtgtggaaacgacccccagagatatgcgaaaacccaaggttcatcattgatggggcaaaccggacagatatttgtcaaggagagctcggcgactgttggtttctagccgcaatcgcctgcttaaccttgaatcaacacctgttgttccgagttatcccgcacgaccagtcttttatcgaaaattacgccggaatatttcattttcagttctggaggtatggcgaatgggtggatgtggtcatcgacgattgcctgcccacctataacaaccagcttgtcttcaccaaatccaaccatcggaacgagttctggtctgccctactggagaaggcttatgccaagctgcatggatcctatgaagctctgaagggcggaaacactacggaagctatggaagatttcaccggcggagtcgccgaatttttcgagattagggacgcgccatcggacatgtacaaaattatgaagaaggcaatcgagcgtggcagcttgatgggttgttctatcgacgacggtacaaatatgacttacgggactagtccgtcaggacttaacatgggcgaacttattgcacgtatggtgcgcaatatggacaatagtctactgcaggacagcgatctcgacccccgtggcagtgacgagagacctacgagaacaataattccggttcagtacgagacgagaatggcgtgtggccttgtgaggggccacgcttatagtgtcactggcttggacgaggtgccgtttaagggcgagaaggtgaaactggtgcggctgcggaacccatggggacaagtggaatggaacggttcatggtctgataggtggaaggattggtcattcgtggataaggacgagaaggcccgacttcagcaccaggtgaccgaggacggcgaattttggatgagttacgaggacttcatttatcattttaccaagcttgagatctgcaacctgactgccgatgctttgcagtccgataagctgcagacctggactgtcagcgtgaatgaggggaggtgggtgaggggctgcagcgccggtggctgtcgaaactttcctgatactttctggaccaatccccagtacagactgaagttgttggaggaggatgatgatccggacgatagcgaggtgatctgcagcttccttgttgccttaatgcagaagaacaggcggaaagatcgcaaactgggggcttccctcttcacaattgggtttgccatctacgaggtgccaaaggagatgcacgggaacaaacaacacctgcagaaggacttttttctgtataacgcctccaaggcacgctctaagacttacattaatatgagagaggtgtcccagaggtttaggcttccgccaagcgaatacgtgattgtcccttctacttacgagccccaccaggaaggagagttcatcctgagggtattcagcgaaaagaggaatttaagcgaagaggtcgaaaacactatctctgtggaccggccagttaagaagaaaaagactaagccgattatcttcgtaagcgatagagctaactctaataaggaactgggggtggatcaggagtcagaagaaggcaaaggcaagacgagcccagataagcaaaagcagagcccacagccgcagcctgggtcctccgatcaagaaagcgaggagcagcagcaatttcgcaatatctttaaacaaatcgccggagacgatatggaaatctgtgcagatgaattgaagaaggtactcaacaccgttgtgaacaagcataaagatctcaaaactcatggttttaccttggagtcatgccgcagcatgatcgcactgatggacaccgacgggagtggtaagctcaacctccaggagttccaccacctgtggaacaaaattaaagcctggcagaaaattttcaagcattacgatactgaccagtccgggaccatcaacagttatgaaatgaggaatgcagtaaatgacgcgggattccacctaaataaccagttatatgacattattactatgagatacgctgacaagcacatgaatatcgattttgactctttcatttgctgctttgtacggttggaggggatgttccgcgctttccacgcttttgacaaggatggagacggcatcattaagctgaacgttttggaatggctgcagttaaccatgtacgcgtag

SEQ ID NO: 216789 - DNA, 930 bp, Artificial Sequence
  Description of Artificial Sequence: Synthetic coding sequence
atgcacgggaataaacagcaccttcaaaaggacttcttcctgtataatgcctccaaagccaggtccaaaacctacatcaacatgcgcgaggtctctcaacgctttcggctaccgccaagtgaatacgtgattgtgccttcaacttatgaaccccatcaggaaggggaatttatcctccgcgtatttagtgagaagaggaacctgtccgaggaggtcgagaacactatttctgttgacaggcctgttaagaaaaaaaaaaccaaacccatcatcttcgtctcggatagagctaactccaataaagagctgggtgtagaccaagagagtgaggagggaaaggggaaaacaagtcccgataaacagaagcaaagcccgcaacctcagccgggttcatcggatcaggagtcggaagagcaacagcaatttcgaaatatatttaaacagattgcaggagacgacatggaaatctgcgccgacgagcttaaaaaggtacttaatactgtagtgaataaacataaggacctcaagactcacggttttaccttggagtcttgccggagcatgattgcccttatggacacagacgggagtggtaaacttaacctccaggaattccatcatctttggaataagataaaagcctggcagaagatatttaagcactacgacacagaccaatccggaaccattaattcatacgaaatgaggaacgctgtaaatgatgctggctttcacctgaataatcagctatacgacatcatcaccatgcgttatgccgataaacatatgaacattgactttgatagtttcatctgctgttttgttagactcgaggggatgttcagggccttccacgccttcgataaagacggggacggcataataaagctcaatgtcctggagtggttacagctgacgatgtatgcttag

SEQ ID NO: 216790 - DNA, 471 bp, Artificial Sequence
  Description of Artificial Sequence: Synthetic coding sequence
atggagatttgtgcggacgagctgaaaaaagtgctgaacacggtagtcaacaagcataaagatctgaagacccatggttttaccctggagtcttgtcggtccatgattgctcttatggacaccgacggatccggcaagctcaacctgcaagagttccaccatctatggaacaaaattaaagcctggcagaagatatttaagcactacgacactgatcagtccggaaccatcaattcatacgagatgaggaacgctgtgaatgatgctgggtttcatttgaacaaccagctttacgacatcattaccatgcggtacgccgacaagcatatgaacattgacttcgatagctttatttgttgctttgtccgcctcgagggcatgttcagagcctttcatgcctttgataaggacggcgatggcatcatcaaacttaatgtgcttgagtggctccagttgaccatgtacgcctag

SEQ ID NO: 216791 - DNA, 1923 bp, Artificial Sequence
  Description of Artificial Sequence: Synthetic coding sequence
atgttttcctgtgtgaaaccatatgaagatcaaaattatagtgcactgaggagggactgccggaggcgtaaggtcttgtttgaggatccacttttccccgctacggacgattctctctattacaaaggaacgccaggaccggcagttaggtggaaacggcctaaggggatttgcgaagacccgaggttgttcgtggatggcataagttcacacgacctgcaccaaggacaggttggtaactgctggttcgtggcagcatgctcaagcctggctagccgggaatccctctggcaaaaggtgattcctgattggaaggagcaggagtgggaccccgaaaagcctaacgcctacgctggtatctttcactttcatttttggcggttcggtgagtgggtggacgtggtgattgacgatcggctccctaccgttaacaaccagctgatatactgccattctaattcaagaaacgagttttggtgtgcactcgttgagaaggcttatgcgaaactggcgggatgttaccaagccctggatggcggaaatacagccgatgctttggtagattttaccggtggcgtgagtgaacctattgatctgaccgaaggggactttgcaaacgacgaaacaaaaagaaatcagcttttcgaacggatgttgaaggtgcacagcaggggaggactgatatccgcttctatcaaggcagtcactgccgctgatatggaagccaggctcgcctgtggactcgtgaaaggacacgcatatgccgtcacggacgtgcgaaaagtgcggctgggacatggactgttagcattcttcaaatcagagaagctagatatgatccgattacggaatccttggggcgagagggagtggaacgggccttggtcagacacttctgaggaatggcaaaaggtgagcaagtccgagcgtgagaagatgggggtcactgtgcaggacgatggagaattttggatgactttcgaagacgtgtgcaggtactttaccgacatcataaagtgtagggtgataaatacaagccatctgagcatacacaagacatgggaggaagccaggctgcatggggcttggacactgcatgaagaccctaggcagaacagaggcggtggctgcatcaaccacaaggacacattttttcagaatccccagtatatattcgaagtaaagaagcctgaggacgaagtgcttatttgtatccagcagcgccctaagcgcagcacaagaagagaaggtaagggagagaacttggcaatcggctttgatatttataaagtggaagaaaacaggcagtaccgcatgcactcactccagcataaggcggcaagttcaatctatatcaattcccgcagcgtgttccttaggactgatcagcctgaaggtcgatatgtgattataccaaccaccttcgagccaggtcacacaggagaatttctgctaagggtattcactgacgtcccaagcaattgtagagaactccgactcgatgagccaccccacacatgctggtcatcactgtgtggctatccccagctcgtgacgcaggttcacgttctgggcgctgcgggactcaaggactcccccactggtgctaacagctacgtgattattaagtgcgaaggggataaagtgcgcagcgcagttcagaaggggaccagtacccccgagtacaatgttaaggggatcttctaccggaaaaagctgtcgcaacctatcactgtgcaagtgtggaaccaccgagttctcaaagatgagttccttgggcaggtgcatcttaaggccgatccagacaacctgcaggcacttcataccctccatctgcgcgacagaaacagcaggcaacccagcaatctccccggtaccgtcgccgttcacatcctgagttctacatccttgatggcggtttag

SEQ ID NO: 216792 - DNA, 2043 bp, Artificial Sequence
  Description of Artificial Sequence: Synthetic coding sequence
atgtcttgtacggggaccccatcgtgtatctacctcctctctgcactgagcttacaggacctggtactggattgggaacctcggggagtgccacctccactgcccggtgcagccgcaacgatgttcagctgtgtgaagccatatgaagatcagaactactccgccctgcgaagagactgcagacgcagaaaggttctatttgaggatccgctttttccagcaacggacgactcactttactacaagggcaccccaggccctgctgtgcgctggaaacggcctaaagggatttgcgaggacccacgcctgttcgtggacgggatatcatctcacgacctgcatcaggggcaggtgggaaactgttggttcgtggccgcttgtagtagcctggcttcccgggaatccctttggcagaaggtgatccccgattggaaggagcaggagtgggatcctgagaagccaaacgcctacgccggtatattccatttccacttttggcggtttggagaatgggttgacgtagtcattgatgatcggctgccgacggtcaacaatcagctgatatattgccactctaactcgagaaacgagttctggtgtgccttggtggagaaggcctacgctaagttggctgggtgttatcaagctttagacggcggtaacactgcggacgctctcgtcgatttcacaggcggagttagcgaaccaatcgacctgaccgaaggggacttcgctaatgatgaaaccaagagaaatcaactatttgagcgaatgctcaaggtccacagtcgcggtgggctcatcagcgcaagcatcaaggcagtgacagctgctgacatggaggcgcgattagcatgtggccttgttaagggacacgcctacgccgtgacggatgttcgtaaagtccggctcggtcacggtttgctggcattctttaagtcagaaaaacttgatatgatccgccttcgcaacccctggggtgaaagggagtggaacggcccatggtccgacactagcgaggagtggcagaaagtctccaagagcgaacgtgaaaagatgggcgttactgtccaggacgatggggagttctggatgacctttgaggacgtttgtaggtacttcacagatatcattaagtgccgggtgatcaatacctcgcatctgtcaattcataagacctgggaggaggcaaggctgcacggggcatggacattgcacgaagaccccaggcaaaatagaggcggtgggtgcatcaaccataaagacacatttttccagaatcctcagtacatttttgaggtgaaaaaacccgaagatgaggtgttgatctgtatccagcaacgtcccaaaagatccacgcggagggaagggaaaggggaaaatcttgccatcgggttcgacatctacaaagtggaggaaaatcgtcaatacaggatgcatagcttacagcataaggctgccagcagcatttacataaatagcaggtccgttttcctccgaacagatcaacccgaagggaggtacgttatcatcccgaccaccttcgagcctggacacactggtgaattccttctgagagtgttcaccgatgtacctagcaattgtcgggagttgcgattagacgaacccccacatacctgttggagtagcttgtgcgggtacccccagttagtcactcaggttcacgtcctgggggctgccggtctgaaggacagtcccaccggagctaattcctacgttataatcaaatgtgagggcgacaaagtcagaagcgccgtccaaaaaggaacctctactcctgaatataacgttaaagggattttttacaggaagaagcttagtcaacccattactgtgcaggtttggaatcacagagtgctcaaagacgagttcctcgggcaggtccacttgaaggctgaccccgataacctgcaggcattacatactctccaccttcgggatagaaatagtcggcagccatccaatctccctgggaccgtggctgtgcatattctgagctccaccagcctaatggccgtgtag

SEQ ID NO: 216793 - DNA, 294 bp, Artificial Sequence
  Description of Artificial Sequence: Synthetic coding sequence
atgttctcctgcgtgaaaccgtacgaagaccagaattactcggcgcttcgtcgggactgtcgtcggaggaaggtcctcttcgaggaccccctgttcccggctacagatgatagcttatactataaggggacccccggaccagcggtgaggtggaagagacctaaagggatctgcgaagatccaagactgttcgtagacggaatatctagccatgacttgcatcagggtcaagttggaaattgctggttcgtggcagcctgttcctctctagccagcagagagtctctctggtag

SEQ ID NO: 216794 - DNA, 1923 bp, Artificial Sequence
  Description of Artificial Sequence: Synthetic coding sequence
atgttttcttgtgtcaagccctacgaagatcagaactactctgccttgagacgcgactgccggcgtagaaaagtgctattcgaggaccctctctttcccgcaacagacgactccctgtactacaaaggcacccccggtccggctgtgaggtggaagaggcccaagggaatctgtgaggacccacggctctttgtggacggaatctcctcacacgacctacatcaggggcaggtgggaaactgttggttcgtggccgcttgctcttcattggcaagcagggaaagtctctggcagaaggttattccagactggaaggaacaagagtgggatccagagaaacccaatgcatacgccggaatctttcatttccatttttggcggtttggggagtgggtcgatgtcgtcatcgacgacagactgcccaccgtgaacaatcagctgatctattgccatagtaacagcagaaacgaattttggtgcgccctagtagaaaaggcctacgctaagttggcaggttgttatcaagccctggatggcggtaacacagccgatgcgcttgtcgactttacaggaggggtgtcagagcctattgatctgactgagggcgactttgccaacgatgaaacaaagcgcaaccagttattcgaaagaatgctcaaagtgcactcccggggtggactgatctctgcaagtatcaaagctgtgacagccgcagacatggaagctcggctggcttgcggtttggtgaaggggcacgcttatgctgttacggacgtccgcaaggtccgactcgggcatggactgctggcgtttttcaagtccgaaaaactcgacatgatccggctgagaaacccgtggggggaaagggagtggaacggtccttggtctgatacctccgaggagtggcagaaggtttcaaaaagtgaacgggagaaaatgggtgtaacggttcaagacgacggcgagttctggatgacgttcgaggacgtgtgtcgctatttcaccgacataattaaatgccgggttatcaacacaagccatctgagtattcataaaacatgggaggaagcccgtttacacggggcttggaccctccacgaagatcccaggcagaatcgcggaggcggatgcatcaaccacaaggatacctttttccaaaatccacaatacatattcgaggtcaaaaagcccgaagacgaggtactgatatgcatccagcagaggcccaagcggagcacgcggcgtgaggggaaaggtgagaatctcgccattgggttcgacatctataaggtcgaggaaaataggcagtaccgcatgcactctctgcaacataaagccgcatcctctatttacatcaattccaggtccgtctttctgagaactgatcagcccgagggtaggtatgtcatcattccaacaacttttgagcctgggcacaccggagaattcctgctgcgggtgttcactgatgtaccttctaattgccgggaactgagactggacgagccccctcacacatgctggagctctctttgcgggtaccctcaactggttacccaggtccatgtgttgggagccgctggactgaaggatagcccaaccggagccaactcttatgttatcattaaatgtgagggagataaggttcgctctgcggttcagaagggaacctctacacccgagtataatgtgaagggcattttctatcgcaagaagctgagtcagcccataactgtgcaggtttggaaccatcgtgttttaaaagacgaattcctcggacaggtccacctcaaggcagatcctgataatctgcaggctctccataccctccacctgagagataggaacagtcggcaaccaagcaacctccctggcactgtcgccgtacacatcctttcctccacttctcttatggccgtttag

SEQ ID NO: 216795 - DNA, 1674 bp, Artificial Sequence
  Description of Artificial Sequence: Synthetic coding sequence
atgtttagctgcgtgaaaccatacgaagatcagaactattcggccctgcgcagggattgtaggagaaggaaggttctgtttgaggacccactgttccccgcaaccgacgactccttgtactacaaaggaaccccgggtcctgcggtccggtggaagagaccaaagtacagcgggcattctctagctcctcatagaccaggatggggggacgctcgtcgcatggagaatgttccgaggcccggatctagtggttgtcctagctcatccctgcgtgcacgcgatttgggaatttgtgaagatccacggctcttcgtggatggaataagtagccacgatttacatcagggccaggtggggaactgctggttcgtggccgcatgcagttcgctagccagcagagagagtctgtggcagaaagtaattccagattggaaagagcaggagtgggacccggagaagccaaatgcctacgccggtatcttccactttcatttttggcggttcggtgagtgggtcgacgtcgtgatcgacgatagactgcccaccgttaataatcagctcatctactgtcactccaattcccggaacgagttctggtgtgcacttgtggaaaaggcctacgcaaagctggcagggtgttatcaggctttggacggagggaataccgctgatgcactggttgatttcacgggtggtgtctctgagccaattgacctcacagagggggactttgccaacgatgagacaaagagaaaccagctcttcgagcgtatgctgaaggtacatagtagaggcggactgataagcgcaagcattaaggccgtgaccgccgctgacatggaggcccgtttggcttgcgggctagttaaaggccacgcttacgccgtgacagatgtaaggaaggtgcggctgggacacggtttgctggctttttttaagtctgaaaagctcgacatgattcgcctccgcaacccttggggggaacgtgagtggaacggcccttggtcagacacctccgaggaatggcagaaggtctcaaaaagtgaacgggagaaaatgggcgtgacggtccaggatgatggtgagttttggatgaccttcgaggatgtgtgtcgctactttactgacatcatcaagtgcagagttatcaacactagccacctgtctatccacaagacctgggaagaagccagattgcatggggcttggaccttgcatgaggatccccgtcagaatcggggtggcggttgcatcaaccataaagatacattctttcaaaatcctcagtacatctttgaggtcaagaaacctgaagacgaggtgctgatctgcattcagcaacgcccaaagaggagcacgagaagagaaggcaagggcgaaaacttagctatcggattcgatatctacaaagttgaggaaaaccgtcaatacaggatgcatagccttcaacataaggctgcgagctccatctatattaattctaggtccgtcttcctgagaaccgatcagcctgagggtagatacgtaattattcccacaaccttcgaacccggacatactggggaatttttgctgcgggtgttcaccgatgttccatccaactgccgcgagctgagactcgatgagccacctcatacttgctggtcctcactgtgcggatatccacagtggtag

SEQ ID NO: 216796 - DNA, 2442 bp, Artificial Sequence
  Description of Artificial Sequence: Synthetic coding sequence
atggatgccactgccttggagagggatgccgttcagttcgctcgcctcgccgttcagcgggatcacgagggaaggtacagtgaagctgtcttctattataaagaagccgcacaggctcttatctatgccgagatggctggatcttcattagaaaatattcaggaaaagattaccgaatacctggagagggtccaagctttgcactctgccgttcagagcaagagtgctgacccgctcaagtccaaacatcaacttgacttggaaagggcccatttcctcgtgacacaggcctttgacgaggacgaaaaggaaaatgtcgaagatgctattgagctgtatactgaggccgtagacctgtgcctaaaaacttcatatgaaacagctgacaaggtcctgcagaacaagctgaaacagttggccaggcaggcccttgacagggcagaagccctcagtgagcccctcactaagccagtaggtaagatctctagcacatctgtcaagcctaagccgccaccggtccgcgctcattttccactaggggctaacccgttcctcgaacgtcctcagagctttattagcccacaatcttgtgacgcacagggacagcgatacacagcagaggaaattgaagtgcttcggaccacatcgaagatcaatggaatcgaatacgtaccattcatgaacgtcgatctgagggaacgatttgcctaccccatgcctttctgcgatcgctggggcaagctgcccttgagtcccaagcagaagaccacgttctctaagtgggtcagacccgaggacttgactaacaaccctacaatgatttacaccgtcagctctttctcaattaagcagacgatcgttagcgattgcagttttgttgccagcctagccatcagcgcagcctacgaacgcaggttcaataaaaagttgatcactggcattatttatccccagaacaaggacggagagcctgaatacaacccatgtggcaagtatatggtcaagctccatctgaatggggttcctcgcaaggttatcatcgacgatcagctcccagtcgatcacaaaggtgagctgctgtgcagctacagtaacaataagtctgaactatgggtgtcactgatcgagaaggcttacatgaaggttatgggcggatatgattttcctgggagtaactctaatattgacctccatgccctcacaggttggatccccgaacggatcgccatgcactcggattcacagacatttagtaaagacaactcctttcggatgctgtatcagaggttccacaaaggggatgtcctgatcaccgcctcgacagggatgatgaccgaagctgagggggagaaatggggcctcgttcccactcacgcatatgccgttctggatatacgggagttcaaggggttgcgcttcattcagctgaaaaatccttggagccacctacggtggaagggcaggtattcggagaatgatgttaaaaactggactcctgagttgcaaaaatacttaaactttgatcctagaactgcccagaagatcgataatgggatattctggattagctgggatgatctgtgccaatactatgacgtgatctacctgtcatggaaccctggacttttcaaggagagtacatgcattcactctacatgggatgcaaaacaggggccagtgaaggatgcttactctctcgctaacaatccacagtataaactggaggtccagtgtcctcagggaggcgcagcagtgtgggtcctgctatctcgccacattaccgacaaggacgactttgcaaacaaccgcgagttcatcacaatggttgtgtataagacagacggaaagaaagtctactaccctgccgatccaccaccgtatattgatggaatcagaattaatagcccccattacttaaccaagatcaagctaaccacacctggtacccatactttcaccttagtggtcagtcagtacgagaagcagaacaccatccattacaccgttagggtctactctgcatgttcatttacgtttagcaagatacccagcccctatacgctgagcaaaaggatcaatggtaaatggagcggccagtcagccggaggttgtggcaactttcaggaaacccataagaacaacccaatatatcagttccacatcgagaagacagggcctctgttgattgaacttcggggacctcgccaatacagtgttggtttcgaagtagtcacggtgagcacccttggggaccctggtccacacggctttctccggaagtcctccggagattataggtgcgggttctgttacctcgaattagagaacatcccttccggcatctttaatatcatcccatccactttcctccctaaacaggaaggccctttcttcctggattttaactcgattatcccaatcaagataacccagctgcaatag

SEQ ID NO: 216797 - DNA, 2073 bp, Artificial Sequence
  Description of Artificial Sequence: Synthetic coding sequence
atgccatatctgtaccgggcacctggcccacaggcccatcctgtgcctaaagacgcaagaatcacgcattcaagtggacaatcctttgagcagatgagacaggaatgcctgcagcgcggaaccctcttcgaggatgctgatttccccgcttccaattcctctctcttctatagtgagaggccccagattccgttcgtttggaaaagaccaggcgagatcgtcaaaaatcctgaattcattctagggggagctacccgaacagacatttgccaaggcgagctgggcgactgttggttgctcgccgcaattgctagtctgacacttaatcagaaagcattggcccgagttattccccaggaccaaagcttcggcccaggctacgccggaattttccattttcaattctggcagcactccgagtggctggacgtggtaattgatgaccgattacccacgtttcgggataggttggtatttctgcacagcgccgaccataacgaattttggagtgcactgctcgaaaaagcctatgccaagttgaatggatcatatgaggcattgaagggagggtctgctatcgaggccatggaggacttcactggtggagtggcagagacctttcagactaaggaggcccctgagaatttctatgagatcttagaaaaggccctcaaacggggatctctgttaggatgctttatagacacgcggagtgcagcagagagcgaagccagaacacctttcggattaataaaggggcacgcatacagtgtgaccggtatcgatcaggtgagttttagaggtcagaggattgagctaatccgcattcgaaacccttggggtcaggtggagtggaacgggtcctggtctgacagttccccagagtggaggtcagtgggaccagccgagcagaaaagactctgccacaccgccttagatgatggcgagttctggatggctttcaaggacttcaaagcccattttgataaagtggagatctgtaatttgacccctgacgctcttgaagaggatgccattcataagtgggaggttactgtgcatcagggaagctgggtccgagggtctaccgctggaggctgcagaaactttttggacacattctggacgaatcctcagatcaaactgtccctgacagaaaaagatgaggggcaagaagaatgctcctttctggtagcgctgatgcagaaagacaggcgtaagctgaaacggttcggagctaatgtccttacaataggatatgccatctacgagtgtccggataaagacgaacacttaaataaagatttcttcaggtaccatgcttctagagcgaggagcaagacatttataaacctacgtgaggtcagcgatcggttcaagcttccaccaggagaatatatcctcataccgtctacctttgagcctcatcaggaagcagatttctgcctccggatcttcagcgaaaagaaagcgattacgcgggacatggacggaaatgttgacattgatttgcctgagccacccaaacccacacctcccgatcaagagaccgaagaagaacagaggttcagggcgctgttcgaacaggtggctggcgaagatatggaagtcacagcggaagagttagagtacgtcttgaacgctgtgttacagaagaaaaaggacatcaaatttaagaagctctcccttatcagctgtaaaaacattatctcgctgatggatacgtctggcaacggaaagctcgagttcgacgagttcaaagttttttgggataagcttaaacaatggataaacctgtttcttcgcttcgatgcagacaagtctggaaccatgtccacctacgagctgcggaccgcgctcaaagccgcagggtttcagctgtcatcccacctccttcagctgattgtgctccgctacgcagatgaggaattgcagctagatttcgatgactttttgaattgcttggtaaggctggaaaatgcatccagagtgttccaggccctgagcactaagaacaaagagttcatccacctaaacatcaatgagttcattcacctgaccatgaacatctag

SEQ ID NO: 216798 - DNA, 1995 bp, Artificial Sequence
  Description of Artificial Sequence: Synthetic coding sequence
atgccttatctttatagagcacctgggccacaggcccatcctgttccaaaggacgctcggattacccactcctctggccagagctttgaacagatgcggcaggagtgtttgcaacgtggaacgctgtttgaggacgcggatttcccagcatccaatagctcacttttttacagtgaaagacctcagatcccttttgtgtggaagaggccgggagagatcgtcaaaaacccggagtttattttaggtggagctacgaggacggatatctgccagggggagttgggcgattgttggctccttgccgcaattgcgagcttgacgctgaatcagaaggccctggcgcgtgttatccctcaagaccagtcattcggcccaggctacgcaggtattttccatttccaattctggcagcattccgagtggctcgatgttgtgattgacgatcgcctgccaacgttccgcgacagactggtgttccttcattcagcggatcataatgaattctggtcagctctgcttgaaaaagcctatgccaagctcaatggctcatacgaggccctcaaggggggatcagcaatagaggccatggaggactttaccggaggggtcgctgagacattccaaacgaaagaagcgccagagaatttttacgagattctggagaaagccctcaagaggggaagtctgctaggatgctttattgatacgcgtagtgcggctgagtcagaagcacgcaccccttttggcctaatcaaggggcacgcatatagtgtgacaggtatcgatcaggtgagtttcaggggacagagaatcgagttaatccggatacggaatccgtggggtcaggttgagtggaacggtagttggtccgacagaatggctttcaaggatttcaaagcccatttcgacaaagtcgagatttgcaatctgacaccagacgctctggaggaggatgctatacataagtgggaagttacagttcaccagggatcctgggtgcgcggatctacagcagggggatgtagaaatttcctggacacattctggactaacccccaaataaaactctctctgaccgagaaggatgaggggcaggaagaatgtagcttcctcgtggccctaatgcagaaggaccgcagaaagctgaagcgatttggcgctaacgtgctcacaatagggtacgctatctacgaatgcccggacaaggacgagcatttaaacaaggattttttcaggtaccatgcgagcagagcgaggtcaaaaacattcattaacctgcgggaagtgtccgacagatttaagctgccaccaggcgaatatattttaattcctagcacttttgaaccacatcaagaggcggacttctgtttgaggatcttcagcgagaagaaggctattacccgtgacatggacggaaatgtggatatagacctcccagaaccacctaagccaaccccccctgatcaggaaacggaggaggaacaacgattccgtgccctcttcgagcaggtcgccggagaggatatggaggttacagccgaagagcttgagtatgtcttaaatgccgtgcttcagaaaaaaaaggacattaagtttaaaaagctctccctgatcagttgcaaaaatattattagcctcatggacactagcggtaacgggaagctcgagttcgatgaattcaaggtgttttgggacaagttgaagcagtggattaacctgttcttgagattcgatgccgacaaatcaggcacaatgagcacctacgaattaagaacagccttgaaggcagcaggcttccagctgtctagccatttgctgcagctcattgtgctgcggtatgcagatgaggagctgcagctggactttgatgacttccttaactgcctagtgcggctcgagaacgcttcccgggtgtttcaagcactgagcaccaagaataaggaattcatccacctcaatatcaacgagtttatccatctgactatgaatatctag

SEQ ID NO: 216799 - DNA, 1884 bp, Artificial Sequence
  Description of Artificial Sequence: Synthetic coding sequence
atgccatacctttaccgcgctccaggtccacaggcccaccccgtcccaaaggatgccaggattacccacagctccggtcagtcctttgaacaaatgcggcaggagtgtctccagaggggtaccctctttgaggatgctgacttcccagcatcaaatagttccctcttctacagcgaacggcctcagattccattcgtctggaaacgacctggcttttggcaacattctgagtggctggatgtcgtcatcgatgaccgcctaccgacattcagggaccgtctggtcttccttcatagtgccgaccacaacgaattctggagcgcgttactggagaaagcttatgcaaaacttaatggaagctatgaggctttaaaggggggatcggccatcgaagccatggaggacttcaccggcggtgtagcagaaacgttccaaaccaaagaggccccagaaaacttctatgaaattctggagaaggccctcaagcgcggttcccttttgggttgtttcatagacacgcggagcgccgctgaatccgaggccagaacccctttcggtctgatcaagggccatgcatacagcgttacagggatcgatcaggtttctttcagggggcagaggatagaactgattcggatcagaaacccttgggggcaggttgagtggaatggcagctggtccgactcctctcctgagtggcggtcagtcgggcctgccgaacaaaagcgcctgtgtcacacagcattagacgatggagaattttggatggccttcaaagacttcaaagcccacttcgacaaggtcgagatttgcaatctgacccctgatgcccttgaggaagacgctattcataagtgggaagtcactgtgcaccagggatcttgggtgcggggttccacagctggagggtgccgcaactttctggacactttctggaccaacccgcaaatcaagctctcactaacagaaaaagatgaaggtcaggaagaatgctcctttctagtggctcttatgcagaaggatcggagaaaattgaaaagattcggtgctaacgtgctgaccataggctatgccatctatgagtgtccggataaagatgaacacctcaataaggattttttcaggtaccacgcatccagggccaggagcaagacttttattaacttaagggaggtgtccgataggttcaagttacccccaggtgagtatatcctgatcccttctacgtttgagccacaccaggaagccgatttctgtttgagaatattctccgaaaagaaagctatcactagagacatggatgggaacgtggacatcgatctcccagagcctccaaagccgactccgcctgaccaggagactgaggaggaacagcgctttagagcgctgttcgagcaggttgcaggggaggatatggaggtgactgctgaggagcttgaatacgtattaaatgccgtgctgcagaagaaaaaggatatcaaatttaaaaagctaagcctgatcagctgcaagaacattatttctctaatggataccagcgggaacggtaagctagaattcgacgagtttaaagtgttttgggacaagctgaaacagtggatcaatctcttcctgcggttcgacgccgataaatcaggtaccatgagcacatacgagttacgtactgcgctgaaggctgctggatttcaactgagctcccacttgctacagctgatagtcctgcgctacgcggatgaggaactccagctggactttgacgattttctcaactgcttagtgcgcttagagaatgctagtcgtgttttccaagcgctttccaccaaaaataaagagttcattcacctaaacatcaacgaattcattcacttgaccatgaacatttag

SEQ ID NO: 216800 - DNA, 807 bp, Artificial Sequence
  Description of Artificial Sequence: Synthetic coding sequence
atgttcctggtgaattccttcctgaaaggcggtgggggtggaggaggcggagggggaggactcggcggagggcttggaaatgtgctgggagggctgatttcgggcgctggcggaggcggaggtggcggtggcggaggtgggggaggcggagggggtggtggtggaggcactgcgatgaggatcctcggcggtgtcataagcgcaatcagtgaggccgcagcgcagtacaatcctgagcctccaccaccgagaactcattacagtaacatcgaggcaaatgagagcgaagaagtccgtcagttccgcaggctgtttgcccagcttgcgggtgatgatatggaggtaagcgccactgagctgatgaatattcttaacaaggtcgttacccgccaccctgatttgaagaccgacggctttgggatagatacttgcaggtcaatggtagcggtgatggattctgacacaacgggtaaactaggattcgaagagttcaagtacctttggaacaatataaagagatggcaagccatatacaagcagtttgatactgatcgctccgggacgatctgttctagcgaactccccggagccttcgaagcagcgggtttccacctgaatgagcacctttataacatgattatccgacgatacagtgatgagtctgggaacatggatttcgataacttcatttcttgtctagtgcgactcgatgcaatgtttagagcttttaaaagcctcgataaggatggaactggacagatccaggtgaatatccaggaatggctacagctgacgatgtatagctag

SEQ ID NO: 216801 - DNA, 2061 bp, Artificial Sequence
  Description of Artificial Sequence: Synthetic coding sequence
atgaacccgacggagaccaaggccgtgaaaacagaaccggagaaaaagtcgcaaagcacgaagttgtctgtggttcatgaaaaaaagtcccaagaggggaaacctaaagaacataccgagcctaagagtctacccaagcaagcttctgacaccggctctaacgatgcacacaacaaaaaagctgtctcacgcagcgctgaacagcaaccaagcgagaagagcactgaacctaaaactaagccacaggatatgataagtgcagggggagaaagtgtggctgggatcacagcgatttctgggaagccaggcgataagaaaaaggagaagaaatcccttacccccgctgtgcccgtggaatcgaagcctgacaagccctcaggaaagagcggtatggacgcagcgttggacgacctgattgatacgttaggtggacccgaggaaaccgaggaggagaatacgacctacacagggccagaggtctcagaccccatgagctccacctacattgaggaattgggcaagcgggaggtaacgattccccctaagtatagagaattgctggccaaaaaagagggcattaccggaccacccgcagattcgagcaaacccatcgggccagatgatgctattgatgctctgtcgagcgattttacctgtggcagtcccacggccgcaggcaaaaaaacagaaaaagaggaatcaaccgaggtcctcaaagcccaatctgccggtactgtgcgttcagccgctccaccacaggaaaagaagaggaaagtcgaaaaggatactatgtcagaccaggctctggaagccctgagcgcatctctgggcactcggcaagcagagccagaactcgacttgcgatctataaaagaagtggatgaggctaaggccaaagaggagaaactggaaaagtgcggcgaggacgacgaaaccatcccctccgagtatcgtctcaaaccagccaccgacaaggacggtaaaccccttcttcccgagccagaagaaaagcctaaaccaagatcagaaagcgaattaatcgacgaactgagcgaggacttcgataggtccgagtgcaaagagaagccctcaaaaccaaccgaaaaaactgaggaaagcaaagctgctgctcctgcacctgtcagtgaagccgtgtgtagaacttccatgtgctcaatccagtccgcccctcccgagcctgctactctcaagggaaccgttccagacgatgccgtcgaggcactggccgattctctgggcaagaaagaagccgacccagaggatgggaagcccgtgatggataaggtcaaagaaaaggcaaaggaggaggacagagaaaagctgggggagaaggaagaaactatcccccctgactacagattggaagaagtgaaagacaaggatgggaaaccactgttacctaaagagagcaaggagcagcttccccctatgtcggaggactttcttctcgacgccctgtctgaggacttcagcggtcctcaaaacgcctccagtcttaagttcgaggatgccaagctcgccgcagctattagcgaagttgtgtcacaaacacctgcttcaaccacccaggcaggtgcacctccccgagacaccagccagagcgataaagacttggacgacgcccttgataaactatcagactcgctcgggcagaggcagcccgatccagatgagaacaagcccatggaggataaggtcaaggagaaagccaaggctgaacacagagataaactgggcgagagggatgataccattccacccgaataccgacacctacttgacgacaacggccaggataagccagtgaagccgcctactaaaaaaagtgaggattccaaaaagccagcagatgaccaagatcccattgacgcgctgagcggggatctcgacagctgcccgagcaccacagaaacatcccaaaataccgctaaagacaagtgcaagaaggctgctagctccagcaaggcaccaaaaaacggcggaaaagcgaaggactcggcgaagaccaccgaagaaacctcaaaaccaaaggacgactag

SEQ ID NO: 216802 - DNA, 2271 bp, Artificial Sequence
  Description of Artificial Sequence: Synthetic coding sequence
atgtctcagccaggtcagaaacccgctgcatctcctaggccacgtcgcgctgccgctgcaagaaggacccacgagcacgtgtcagaaaaaacttctgaaagtcctagcaagccaggcgaaaaaaaagggagtgacgagaagaaggccgcttctttggggtcctcacagagctccaggacgtatgctggagggaccgcctcagcaactaaggttagtgcatcctcaggtgctacatctaagtcctcctccatgaaccctacagaaactaaagccgttaaaacagagcctgagaagaagtcacagtctaccaaattgtcagttgttcacgaaaagaagtcacaagaagggaagcctaaagaacatacggaacccaagagtctacccaagcaggctagtgatactggcagcaatgacgcacacaacaagaaagcggtttcacgatctgctgaacagcaaccgagtgagaaatccactgagccgaagaccaaacctcaggatatgatttccgccggaggcgagagcgtagctggaattaccgcgatcagcggtaagcccggagacaaaaaaaaagagaaaaagtccctgacaccagcagttcctgtcgagtccaagcccgataagccgtccggaaaaagcggaatggacgccgctctggacgatttaatcgacaccttgggcggtccagaggagactgaggaagagaacacaacatataccggccctgaggtgagtgatccaatgagttcaacctatatagaggagctgggtaaacgggaggtcaccatcccacccaaatatcgagagctgctggctaagcccattggccctgacgatgccatcgacgctctttctagcgattttacttgcgggtcccccactgcggctggtaagaagactgagaaagaagagtctaccgaggtgttgaaagcgcagtccgccggaacagtccgctcagccgctcctccacaggagaaaaaacgaaaggtggagaaagataccatgtccgaccaagcactcgaggcgctgagcgccagtctgggaacacgccaggcagaaccggagttggatctaagatcgattaaggaagtggacgaagcaaaggcaaaggaggagaagctggagaaatgtggggaggatgacgaaaccatcccatctgagtataggctgaaacctgccactgataaagatggcaaacccctccttccagagcccgaagaaaaacccaagccacgtagcgaatcggaactcattgatgaactgagcgaggactttgataggtcggaatgcaaggagaagccctccaaacctactgagaaaaccgaggagtcaaaagcagccgctcccgctccagtcagcgaggctgtctgtagaaccagcatgtgttctattcagagtgcaccaccagagcccgcaaccttgaagggcaccgtgcctgacgacgccgtagaagcgctggccgacagcctgggcaagaaggaggccgaccccgaggacggaaaaccagtcatggacaaggtgaaagagaaggcaaaggaggaggaccgagaaaaattaggtgagaaggaagagaccatccccccagactacagacttgaggaggtcaaagataaggatggcaaacccttactgcctaaagagtcaaaagagcagctaccccctatgtctgaggattttctactcgatgctctgtccgaagatttctccgggccacaaaatgcatccagcttgaaattcgaggacgccaagctcgccgcagctattagcgaagtagtttctcagactccagcctcaacgacccaggctggtgcaccccctcgcgatacctcacagtctgataaggacctcgatgatgctctcgataagctcagcgatagtttagggcaaaggcaacctgatccagacgagaataagcctatggaggataaagtgaaagagaaggctaaagcagaacatcgggataaactaggagaaagagacgacaccatccccccagagtacaggcacttactggacgataacggtcaggacaaacccgttaagccccctacaaaaaaaagcgaggactcaaaaaagccagccgatgatcaggatcccatcgatgctctctctggtgacctcgactcctgcccatctactaccgagacgtcccagaacactgcaaaggacaaatgcaagaaagccgcaagctctagcaaggctccaaagaacgggggaaaagcaaaggattccgctaagactacagaggagactagcaaaccaaaggacgattag

SEQ ID NO: 216803 - DNA, 2088 bp, Artificial Sequence
  Description of Artificial Sequence: Synthetic coding sequence
atgaatcctactgagaccaaagccatcccggtgtcccagcagatggagggtccccatctccccaataagaaaaaacacaaaaaacaagccgtgaagacggagcccgagaagaaaagccagtctacgaagctcagcgtcgtccatgagaagaagagtcaggaaggaaaaccaaaggagcataccgaaccgaaatccctgccaaagcaggctagcgatactggatcgaatgatgcgcacaacaagaaggccgtctccaggagtgccgagcaacagcctagcgaaaagagtactgagcctaaaacgaaaccacaggacatgatcagtgcgggtggggaaagtgttgccggtataacagcaattagcgggaaacctggtgataaaaagaaagagaaaaaaagtctgactccggcagttccagtggaaagcaaacctgacaaaccaagcgggaaatctggcatggatgctgcacttgacgatctaatcgacacattgggcggacccgaggagaccgaggaagaaaacactacatacacaggacccgaggtttcagatccaatgagctcaacctatatagaagagctgggcaagcgagaggttaccattccacccaaataccgcgagctgctggctaagccaatcggccctgatgatgctatagacgccctcagctcagatttcacttgtggctcccccactgccgcagggaaaaagacagagaaagaggagagcacagaagtacttaaagcgcagagtgccggaaccgtccgttcggccgcaccaccccaggagaaaaaaaggaaagtggagaaggataccatgtctgatcaggctctggaggccctgtcagcctcactgggcactagacaagcagagccggagctcgatttgcgctcaattaaggaggtcgatgaggccaaagctaaggaggaaaaactggaaaaatgtggcgaagatgacgaaaccattcccagcgagtatcggctgaaacccgctactgataaggacggtaagccgctgctcccggaacctgaggagaaacccaagcctcggtcagaatctgaacttatagacgagctgtccgaagactttgatcggagcgaatgtaaggaaaagccaagcaagcctacggaaaaaaccgaagaatctaaggcagcagcgccagccccagttagtgaggcagtgtgtcgcacatcaatgtgttcaattcaatccgctcctcccgaacctgcgacccttaagggcaccgtgccagatgatgccgtggaggccctcgcggatagtctcgggaaaaaggaagccgaccccgaggacggcaaacctgttatggacaaagtcaaggagaaagcaaaggaagaagatcgagagaagttgggcgagaaagaagagaccattcccccagactaccggcttgaagaggtcaaagataaggatggtaagcctttactacccaaggaaagcaaggagcaactgccacccatgtctgaagatttcctcctcgacgccctttcggaagacttctctgggcctcaaaacgctagcagcttgaagtttgaagatgccaaactggctgccgctatctcagaggtcgtctcccaaaccccagcctcaacaacccaggccggagcaccccctagagatacatcccagtctgacaaggatctggacgatgcacttgacaagttgtcagactctctggggcagcgtcaacctgatccagacgaaaacaagcccatggaggacaaagtgaaggagaaggctaaggcagagcatagggataagctcggggagcgcgacgatacaattccacccgagtaccggcatctgctcgatgataacggtcaagataagcccgtaaaaccccctaccaaaaagtccgaagactcaaagaaaccagccgatgatcaggatcccatagatgccctcagcggagatcttgacagctgtccttcgaccaccgaaaccagccagaataccgcaaaagataagtgcaaaaaagcagcatcctcctccaaggcccctaagaatgggggtaaagccaaagattcggccaaaaccacagaggaaacgagtaagcccaaggatgattag

SEQ ID NO: 216804 - DNA, 2127 bp, Artificial Sequence
  Description of Artificial Sequence: Synthetic coding sequence
atgaatccgacagaaacaaaggccatccccgtgagtcagcaaatggaaggaccacatcttcccaacaagaaaaagcacaagaagcaggcggtaaaaacggagcctgaaaagaaaagtcaaagtacaaagctgtccgtcgtccacgaaaaaaaaagccaagaagggaagccgaaagagcatacagaacctaaaagtctgccaaaacaggcctcagacactggaagcaacgacgctcataacaaaaaagccgtctctagatcagcagagcagcagccgagcgagaagtctaccgaaccgaaaaccaagccccaggacatgatcagtgccggtggagaaagcgttgctggaatcaccgcaatctctggaaaaccaggggacaagaagaaggaaaagaaaagcctgacaccggcagtcccggtggagtctaaacccgataaaccaagcggcaagagcgggatggacgcagccctcgacgatctcattgacacattggggggtccggaagaaacagaagaggaaaacaccacttacacggggcctgaggtcagtgacccaatgtcctccacttatattgaggagctcggcaaacgagaagtgactattccgccaaagtaccgggaattgcttgccaaaaaggaaggaatcactggaccacctgccgatagttcaaagcccatcggcccagacgacgccattgacgcactcagcagtgacttcacatgcgggtcacccaccgccgctggcaagaagaccgaaaaagaagagtccacggaggtactgaaagcccagtctgctggaacagtgcgctccgcagcacctccccaggagaaaaagcggaaggttgagaaggacactatgagtgaccaagctctagaagctctctcggcctcccttgggacacgtcaagccgagcccgagctggacctgcgaagtattaaggaggtggatgaagccaaggccaaagaagagaaactcgagaaatgcggcgaagatgacgaaacaattccctcagaataccgcctgaagcccgctacagacaaggatggaaagcccttgttgccagagcctgaggagaaaccaaagccacggagcgagtccgagctgatcgatgaactgagtgaggacttcgaccgatcagagtgtaaggaaaaaccaagtaaacccactgaaaaaactgaagagagtaaggcagctgctcctgcgccagtttctgaagctgtgtgtagaacctccatgtgttcaattcagtccgcccctcccgaaccagcgacactgaaaggaacagtgcccgacgacgcggtagaagccctggccgacagcctgggtaagaaagaggccgatcctgaagacggcaaaccagtgatggataaagtgaaagaaaaagcaaaggaggaggatcgggagaagctcggcgagaaagaagagacaattccccctgattaccgactcgaggaagtgaaggataaggacggtaagcctctgttgccgaaagaatccaaggagcaattgcccccaatgtccgaggatttcctgttagatgccctctccgaagattttagtgggcctcagaatgctagtagcttaaaattcgaagacgctaagctggccgctgccatttctgaggtagtcagccagacgccagccagtacgacccaggccggtgctcctccacgggatacaagtcagtcagataaagacttggacgacgccctcgacaaactgagcgacagtctggggcaaaggcagccggatccagatgagaacaaacctatggaagataaggtgaaggagaaggctaaggccgaacatagggacaaactgggtgaaagagatgacaccattccccctgagtaccgccatctcttggacgataatggccaagataagcctgtcaagccgcctaccaagaagtccgaagactctaagaagcccgcagatgatcaggacccaatcgacgccctgagtggtgatctcgatagttgcccctccactaccgaaaccagtcagaacaccgctaaggacaagtgtaaaaaggctgcttccagcagcaaggctcccaagaacggtggaaaggctaaagactctgcgaagaccactgaggaaacgtccaagccaaaggacgactag

SEQ ID NO: 216805 - DNA, 2319 bp, Artificial Sequence
  Description of Artificial Sequence: Synthetic coding sequence
atgtcccagccaggccaaaagccagcagccagcccacgaccacgacgtgcggctgcagccaggcggacccatgagcacgtgagcgagaagacaagcgaatcgcccagcaagcctggagagaaaaagggctccgacgagaaaaaggcggcaagcctcggtagctcgcaatcatcgcgcacttatgccggaggcacagcatctgctaccaaggtgtcagctagcagcggagcaacaagcaaatcaagctcgatgaatccaaccgagaccaaggctatccccgtcagccaacagatggaaggccctcatctgcccaataagaaaaagcataagaagcaggcggtgaaaaccgagcctgaaaagaaatcacaatccactaagccaaaatctctgcccaagcaggccagcgataccgggagcaacgatgctcataataagaaggccgtctcccgctcggccgagcaacaacctagcgaaaaatctacggaacccaaaactaagccccaagacatgatcagcgccggtggcgagtccgtagctggcatcacggcaatctcaggaaaacccggtgataaaaagaaagaaaaaaaaagtctgactccagctgtaccagtggaaagtaaaccagataaaccttcagggaaatccggcatggatgctgccctggatgacctcatcgacacactgggtggccctgaagaaacagaggaggaaaatacaacctatacagggccagaagttagtgatcccatgagtagcacgtatatcgaagagctgggaaagagagaagtgaccatccccccaaagtacagagaactccttgccaagaaggaaggcatcacgggaccgcctgccgattctagcaaaccaattgggcctgacgacgctattgatgcactatcaagcgacttcacatgtggttctcctactgcagccggaaagaagactgaaaaagaggagtctacagaggttttgaaagcacagagcgcgggaactgtaagaagcgcagcccctccccaagaaaaaaagcgtaaggttgagaaagatacaatgtcagatcaggcgctggaggcactgagcgccagcttaggcacccggcaagccgaacctgagctagacttgcgttccatcaaagaagtggacgaagccaaggctaaggaagaaaagcttgaaaagtgcggcgaggatgacgagacgattccatccgagtatcggttgaagcccgctactgataaagacggaaaaccactgttaccagaaccagaggagaaaccgaagcccaggagcgaatccgaactgatagatgagctgtcggaagattttgaccgtagcgagtgcaaagaaaagcctagtaagcccaccgaaaaaacggaagagtccaaggcagccgctcctgctccagtgtctgaggcagtctgtcggacgtcaatgtgctctatacaatctgctcctccagagcccgctacgttgaaaggaaccgtgccggacgacgcagttgaagccctggcagatagtctcggaaaaaaggaagccgaccccgaggatgggaagcctgtaatggacaaggtgaaagaaaaggccaaagaggaagaccgtgagaagctgggagagaaggaagagactatcccccctgactatagactggaggaggttaaagacaaagacggaaaacccctgcttccaaaggagtccaaagagcagcttcccccaatgtcagaagacttcctgctggatgcgctgagcgaggattttagtggaccacagaacgcgtcctctctgaagttcgaagatgctaagttggctgcagctatcagcgaggtggtgtcacagacccccgctagcacaactcaggctggcgcaccgccacgtgatacaagccagtctgacaaagatctagatgatgcgctggacaaacttagcgattcactgggccagcggcagcctgatcccgatgaaaataagccgatggaagacaaagtgaaggagaaggcaaaggccgagcaccgggataagctaggggagcgcgacgacaccatcccacccgaataccgccatctgctggacgacaacggacaagataaaccagtgaagcctcccacaaagaagtcggaggactccaagaagccagccgacgaccaggacccgattgatgccttgagcggcgatttggattcttgccccagtaccaccgaaacttcccagaacacggccaaagataagtgtaagaaggctgcatcttcgagtaaggccccaaaaaatgggggtaaagctaaagacagtgcaaaaaccacagaggaaaccagtaagccaaaggatgattag

SEQ ID NO: 216806 - DNA, 2376 bp, Artificial Sequence
  Description of Artificial Sequence: Synthetic coding sequence
atgtcgcagcctggccagaaaccagctgcctctccgcgtcctagaagagccgctgcagctaggagaacccacgaacacgttagcgagaagacctcagaaagcccaagcaaacctggcgagaaaaagggctcagacgaaaagaaggccgcatcacttggaagtagccagtccagtcggacttacgccggagggacagccagcgcaaccaaggtttcggctagttcaggggcaaccagcaagtcttcgtctatgaaccctactgagacaaaggcaattccggtttcccaacagatggaagggccacacctccccaataagaaaaagcacaagaagcaggccgtgaaaacagagcccgagaagaagagccaatcaaccaagttgtctgtggttcacgaaaagaagtcacaggaagggaaacctaaagagcataccgaacctaagtcgttgcccaagcaagcgtctgacactgggagtaacgacgcccacaacaaaaaggccgtaagcaggagtgccgaacagcagccaagcgaaaagtctactgagcccaaaacaaagccccaagacatgattagcgccggtggggagagcgtagccggaatcacagccatctctgggaagccaggtgacaagaaaaaagagaagaaatcgttaacacccgcagtcccggtggagagtaagccagataagccttcaggaaagtccggcatggatgctgcgcttgatgatcttatcgacacattgggcggtcccgaagaaaccgaggaggagaacaccacctatacagggccagaggtgagcgatccaatgtccagcacgtatattgaggagctgggaaagcgggaggtgactatccccccaaaatacagagagctgctggccaaaaaagaaggaattactggccctccagccgactcatcaaagcccataggacccgacgatgctatcgacgccctgtctagtgacttcacctgtggctccccaactgctgcgggaaagaagactgagaaagaggagtcaacagaagtcctgaaggcgcagtctgccggaaccgtgcgttctgctgctccaccccaagagaagaagcggaaggtcgaaaaagataccatgagcgatcaagctcttgaggctctgagtgcttctctggggacgcggcaggcagagccagagctcgacctaaggtctatcaaagaggtagatgaggctaaggccaaggaagaaaaactggaaaagtgcggcgaggacgatgagacaatcccaagcgaatacagactgaagccggctacagacaaagatggcaagcccttactgccggagcctgaggagaagccaaagcctcgcagcgagtccgaattaatagatgagttgagtgaggacttcgacaggtcagagtgcaaggagaagccatctaaaccaactgagaagaccgaggaaagtaaggccgcagccccagccccagtgtcggaggcagtttgtcgcacatcaatgtgttccattcaatctgcacctcccgaaccggcaaccctcaaaggcactgtgcctgacgatgccgtggaggcactggcggactccctcggcaaaaaagaggccgatccagaagacggaaagccggtgatggacaaggttaaggagaaggcaaaggaagaggaccgtgagaagcttggggaaaaggaggagaccattccacccgactatagactggaggaggtgaaggataaggatgggaagccattgctgcctaaagaaagcaaggagcagctgccaccgatgagtgaggatttcctgctggatgctctctccgaagacttctccggccctcagaacgcttccagcttgaaattcgaagatgcaaagctagcagcggcaattagcgaggtggtctcacagacacctgcttctacaacccaggccggagccccacccagggatacttctcagagcgacaaggatcttgatgatgcccttgataagctgtctgatagcctggggcagcgccaaccagaccctgatgaaaataagcctatggaggataaggtgaaagagaaagctaaggctgaacacagagataagctcggggaaagggatgacactataccacctgaataccgacatctgcttgatgacaacgggcaggacaaaccagtgaaaccccctactaagaagagtgaagactcaaaaaaaccagccgatgaccaggatcccattgacgccctgagcggagatctggattcatgtccgagtaccaccgaaacctctcaaaacactgcaaaggataaatgcaagaaagccgcttctagttcaaaggcacccaagaacgggggaaaggcaaaggattccgctaaaactactgaagaaacttcaaagccaaaggatgattag

SEQ ID NO: 216807 - DNA, 2265 bp, Artificial Sequence
  Description of Artificial Sequence: Synthetic coding sequence
atggctttcgcgagctggtggtataagactcatgtgtctgagaagaccagtgagtctcccagcaaacccggtgaaaagaaaggtagcgatgaaaaaaaagccgcttccttgggctcaagccaatcttcccgcacttatgcaggtggcactgcctccgccactaaagtctctgcttcctccggcgcaaccagcaaatcctcatctatgaaccctaccgaaaccaaagccgtcaagaccgagcctgagaagaagtcccagtccacaaagctgtccgtggttcacgaaaagaaatcacaggagggaaagcctaaagagcacacagaaccaaaatccctccctaaacaggcctccgatacgggaagcaatgacgcccataataagaaagcagtatctcgatccgccgaacaacagccgtccgagaaatccacagagcccaaaactaaaccgcaggatatgattagtgcaggcggtgagagcgtcgcgggtattaccgctattagcgggaaaccaggagataagaagaaggagaaaaagtcgctgacacccgcagttcctgtcgaaagtaagcccgacaagcctagcggcaaaagcggcatggatgccgctctcgacgatcttatagacacgttagggggacccgaggagacggaggaggaaaatacaacttacaccgggccagaagtgtccgaccctatgtcatcgacctacatagaggaactcgggaaaagggaagttactatacccccaaagtaccgggaactgcttgcaaaaaaagaggggattaccggcccaccagctgatagctccaaacctatcggacccgatgacgctattgacgctttaagtagtgatttcacttgcggctcaccaaccgctgctggcaaaaaaacggagaaggaggaatcaacagaggttctgaaagctcagtccgccggtacagttaggtcggcagcacctccacaggaaaaaaaacgaaaagttgaaaaggacaccatgtcagatcaggcacttgaggccctttctgcatccctcgggacccgccaggcggagcccgaattggacttgaggagtataaaagaggtggatgaggctaaggccaaggaggaaaagcttgagaagtgcggcgaggatgatgagacaatcccgtcagagtatcgactaaaacctgctacagataaggacgggaagcctttgctgcccgaacccgaagaaaagccaaagcccagaagcgagagcgagttgatcgacgaactgagcgaggatttcgataggtccgagtgcaaagaaaagccttctaagccaactgagaaaaccgaagaatctaaggccgctgcccctgcccctgttagcgaggccgtgtgtagaacaagcatgtgttctatccaatcagcaccaccggagcccgctactctgaaaggcaccgtgcctgatgacgccgtcgaggcacttgccgacagtttgggaaagaaggaggccgatcctgaggacggcaaacccgtgatggacaaagttaaggagaaggcaaaggaagaggatcgggagaaactcggggagaaggaggagactataccacctgactaccgtttggaagaggtgaaagataaggatgggaagccgctcttgcccaaagaatcgaaggaacagcttcctcccatgtccgaagattttcttctcgacgccctgtccgaagatttttccggcccacagaatgcttcatcgctgaagttcgaggacgccaagttggccgcagcgatcagtgaagtggtgtcacagacaccagcgtccactactcaggcaggagctccacctcgggacacatctcagtctgacaaggacctagatgatgcgctagacaagctgagtgactcattggggcagcgccagcctgatcctgatgagaacaaacctatggaggacaaagtgaaagaaaaagcaaaagcagagcaccgcgacaagcttggagaaagggatgatacaattccacccgaataccggcaccttctggacgataacggacaagacaaacccgtgaagccgcctacaaagaaatcagaggacagcaagaagcccgctgatgatcaggatcccattgatgctcttagtggtgatctcgactcttgcccctccactaccgaaaccagtcagaatacagctaaggacaagtgtaagaaagctgccagtagtagtaaggctcccaagaatggcggaaaagctaaggatagcgctaagacaacagaggaaacgtctaaaccgaaggacgattag

SEQ ID NO: 216808 - DNA, 2376 bp, Artificial Sequence
  Description of Artificial Sequence: Synthetic coding sequence
atgagccagcccggtcaaaagccggcagcttccccacgacccagacgcgcagctgcagccaggaggacacacgaacacgtctccgagaaaacatctgagtctcctagcaagccgggagaaaagaaagggagcgatgagaagaaggccgctagtctgggcagtagccagagttcacgaacatacgccggaggaaccgcctctgcaactaaagtgtcagccagttctggcgcaacgagtaaatctagctcgatgaaccccacggaaaccaaagccattccggtatcacagcaaatggaaggtcctcacctgccgaataagaaaaagcacaagaagcaggctgtcaagactgagcccgagaagaagagtcagtccaccaagctgagcgtggtccacgagaagaagtcacaggaaggaaaaccaaaggagcacaccgagcctaaaagtctgcctaagcaggcgtcggataccggatccaacgatgcccataacaagaaagccgtttccagatccgctgagcaacagccgtccgagaaatctaccgaacccaagactaagccgcaagatatgatttccgccggaggtgagagtgtcgctggcattaccgctatttctgggaaacccggagacaaaaaaaaggagaagaagagcctcactccagcagtacctgtggaaagcaagccggacaaacctagcggcaagtcaggaatggacgcagccctcgatgatctgatcgatacactagggggaccagaagagaccgaagaagagaacacaacctatacgggccctgaggtctcagatccaatgtcttcaacctatatagaggaattgggaaaaagggaagtcacaattccaccaaagtaccgggagctcctggctaagaaagagggtatcactggcccaccggctgatagcagcaagcctatcggacccgacgatgctattgacgccttaagcagtgattttacatgtgggtctccaactgccgcaggcaagaagaccgaaaaagaggagtcaaccgaggtgctgaaagcccagtccgccggtacagtccggagtgccgcaccccctcaggagaaaaagaggaaggttgaaaaggacactatgagcgaccaggccctcgaagctctgtccgcttccctcggaaccaggcaggccgagcccgagcttgatctgcggtctataaaagaagtggacgaggcaaaagcgaaagaggagaaattggagaagtgtggtgaagatgatgagaccatccctagtgagtaccggcttaaacctgcaacagacaaagacggaaaacccctgctcccggagcccgaggaaaagcctaagccacgcagcgagtcagagttgatagacgagctcagcgaggacttcgaccggtcagaatgtaaagaaaagccgtctaaacctactgaaaagacagaggagagcaaagccgctgcacctgccccagtgagtgaagctgtgtgtcgcacatcaatgtgtagcattcaaagtgcgcctccagaacccgctaccttaaaaggcacggtgcctgacgatgccgttgaggccctggctgacagtttgggaaaaaaagaagctgaccctgaagacggaaagcctgttatggacaaagtaaaggagaaggccaaagaggaggatcgggaaaagctgggagaaaaagaagagaccattcctccggattataggcttgaggaggtgaaagataaagatggaaagccactgttaccaaaggaatccaaagaacaattacccccaatgagcgaggatttcctccttgacgcgttgtctgaagacttcagtggacctcaaaacgcctcctctctgaaattcgaagatgccaagctggccgctgcaatttccgaagtggtatcccaaacccctgcctccaccacccaggccggagccccaccaagagatacatcacagtctgacaaagatctggacgatgctctggacaagctgtccgacagcctgggtcaaagacagccagatccagatgaaaataaaccaatggaggacaaagtaaaggagaaggccaaggccgaacatagagataaattaggagaacgcgacgataccattcccccagagtatcggcacctcctcgatgataatggacaagacaaacctgtgaaaccgccaaccaaaaaatcagaagattcgaagaagccagcagacgatcaggaccctattgatgctttatcaggggatctggacagttgtccctccaccactgaaacaagccaaaacacagctaaagataagtgcaaaaaggcggcaagcagctcaaaggcacctaaaaacgggggaaaggcaaaagatagcgcgaagaccacagaggagacaagtaaaccgaaagacgattag

SEQ ID NO: 216809 - DNA, 1929 bp, Artificial Sequence
  Description of Artificial Sequence: Synthetic coding sequence
atgaacccaaccgagacaaaagctatccccgtgagccagcagatggaaggccctcatctccccaacaagaaaaaacacaagaagcaagctgtgaaaactgagccggaaaagaaatcacagagtaccaagctctctgtggtgcacgagaaaaaatcccaggagggcaagcccaaggagcatacagaacccaaatcactccccaaacaggccagcgacacaggcagcaatgatgcccacaacaaaaaggcggtctctaggagtgctgagcagcaaccatctgagaaatcgaccgagcccaaaacaaaacctcaggacatgattagcgccggaggggagagcgtggctggcatcactgcgatctcgggcaaaccgggtgataagaagaaagaaaagaagagcctgacgccagcggtgcccgtagagagcaagcccgataagccatctgggaaaagcggcatggacgccgcactggatgatctgatcgatactcttgggggacctgaggaaaccgaggaggaaaataccacttatactggccctgaagtgtccgatcccatgagctccacgtatattgaagagctgggcaagagggaagttaccattccgccaaagtatcgggaactactggcaaagaaggagggcatcactggtccgccagcagatagtagtaaacccatcggtccagatgacgccattgatgcactctcttccgatttcacttgtggtagtccaacagccgctgggaagaaaacggaaaaagaggaatccaccgaggtcctcaaggcccagtcggcaggaaccgtccgaagtgcagccccacctcaggaaaagaagagaaaggttgagaaggacactatgtctgatcaggctctcgaggctctctccgcctctctgggtactagacaagcagagccggaacttgacctccgatctattaaggaggtggacgaggccaaggctaaagaagaaaagctggagaaatgcggagaggacgacgaaaccatcccgtccgagtaccggttgaagccagctaccgacaaggatggcaagccactactgcccgaacccgaagaaaagcccaaaccacgatcagagtccgaactgattgatgagcttagcgaggatttcgataggtctgaatgtaaggagaagcccagcaaacccaccgagaaaaccgaggaaagcaaagcggcagcccctgcccctgtctcggaggccgtctgcaggacatccatgtgtagtatccagtccgctccccctgagcctgctacactgaagggcaccgtccccgacgacgccgtcgaggctttggccgattcattaggtaagaaggaggccgaccccgaagacggcaagccagtgatggataaggtaaaggagaaggcgaaggaggaggatagggagaaactgggagagaaagaagagacaatcccaccagactaccggctcgaagaagttaaggacaaggacggcaaaccactcctgcccaaggagagcaaagagcaattgccaccaatgtccgaggacttcctcctcgacgctctgagtgaggacttcagtgggccacaaaacgcaagctccctcaagttcgaagacgcgaaattggcagccgctatctcggaagtagtgtcccaaacacccgcatcaaccacccaggccggagcacccccaagagacacttcccagagtgataaggatctggacgacgccctggacaagctgagcgatagcttagggcaacggcagcctgatcctgacgagaataagcctatggaggataaggtgaaagagaaggcaaaagccgagcacagggataagctcggagaaagagatgacactatccccccagagtaccgacatcttctggacgataatggacaagataaacctgtaaagccacctaccaaaaagagtgaggacagcaaatag

SEQ ID NO: 216810 - DNA, 2085 bp, Artificial Sequence
  Description of Artificial Sequence: Synthetic coding sequence
atggaaggtccacatcttcccaacaaaaagaaacacaaaaagcaagccgttaaaaccgagcctgagaagaagtcacagtctaccaaacttagcgtggtccacgaaaagaaatcacaggaaggtaaacctaaagagcacaccgagccaaaatcactgccaaagcaggcgagcgacacaggcagcaatgacgcccataacaagaaagcagtgtcgaggagcgctgagcaacagccttcagagaagtcaaccgagcccaaaaccaagccacaggatatgatttcagctggcggagagagcgtggctgggatcacagcgattagtggaaagcccggtgacaaaaagaaggaaaaaaaaagcctgactccggctgtaccagtggagagcaagcctgacaagccttccggaaaaagcggcatggacgcagcactggacgatcttattgacaccctgggcggaccggaggagacagaagaagaaaacacaacatacaccggaccagaggtctcggaccccatgtctagcacatatattgaggaactgggcaagcgggaggttacaattcctccaaaataccgagaactgctggccaaaaaagagggtataaccggtccccctgcggactctagcaagccgatcggcccagatgacgcgatcgacgctctatcttcggactttacatgtggttcacccacagcagccggtaaaaaaactgaaaaagaagaatctaccgaggtacttaaagctcaaagcgcagggaccgttagatcggccgcacctccccaagaaaaaaaacgcaaagtcgagaaagacacgatgagcgaccaggccctggaagcactgagtgcaagcttaggaactagacaggctgaacctgagctcgacctgagaagtatcaaggaagtcgacgaagcaaaggccaaagaagaaaaattggaaaaatgcggggaagacgacgaaactatcccaagtgagtatcgcctgaaaccggcaactgacaaggatggaaaacctttgctgcctgagccagaggagaagccaaagcctcgttctgagagcgaactcatcgatgaactcagcgaggatttcgacaggagcgagtgcaaagagaagccttccaagcctacagagaaaaccgaggagagcaaggccgctgccccagctcccgtgtcagaggcagtgtgtcgtacctccatgtgcagcatacagagcgcaccgcctgagccagccactctgaagggaacggtgcctgatgatgccgttgaagctttggccgatagcctcggcaagaaagaagccgacccagaggacggcaaaccagtgatggacaaagtcaaagagaaggccaaggaggaagacagggaaaagctgggtgaaaaagaagaaactattccaccggactaccgcctggaggaagttaaagacaaagacggtaagcccctgcttccgaaagagagcaaagagcagttgccaccaatgtcagaagactttctcttggacgcactgtctgaggatttcagcggaccacagaacgcttctagcctgaaatttgaggatgctaaattggccgcagccatttccgaagtggtgtctcagactcccgcaagcacaactcaagctggggcaccgccaagggatacttcccagtccgacaaagatctggacgacgccctagataagctgagtgactctttaggtcagagacagcccgacccagacgaaaacaaacctatggaagacaaggtgaaggagaaggctaaagccgagcacagagacaaattgggcgagagagacgacacaattcctccagaatatcgacatctactcgacgataatgggcaggataagcccgtaaagcctcctacaaagaagtcggaggactctaagaagcctgccgacgatcaggacccaattgacgccctctcaggtgacctggatagctgtccctctaccactgagacttcccagaatacagcgaaggataagtgtaaaaaggcagcttcatctagtaaagcacccaaaaacgggggtaaggcaaaggactccgctaaaactaccgaggagacttcgaagcccaaggacgattag

SEQ ID NO: 216811 - DNA, 2253 bp, Artificial Sequence
  Description of Artificial Sequence: Synthetic coding sequence
atgtcccaaccagggcagaagccggctgctagtcccaggccacgacgggctgccgcagccaggcgcacccatgagcacgtttcagagaaaacttctgagtcccctagcaaacctggcgagaagaagggaagcgatgagaagaaagccgctagcttgggtagtagccaatcctcacgcacctacgctggcggtacagccagtgctaccaaggtttccgcctcttcaggggctacaagtaagagtagctccatgaatcctacagaaaccaaagcggtaaagaccgaacccgaaaaaaaatctcagagtaccaagcccaagagcctgcctaagcaggcatctgataccgggagcaatgacgctcataataagaaagctgtcagcagatccgctgagcagcagccttcagaaaaatcaacagaacccaaaactaaaccccaagatatgatttcagctggtggagaaagcgttgctggtatcaccgcgatatcagggaagccaggtgacaaaaaaaaagaaaaaaagagcttaactcccgctgtgcccgtcgagtcaaagccggacaagccttcagggaaaagcggcatggatgccgctctcgacgatctcatcgacacccttgggggtcccgaggagacagaggaggagaacacgacttatacggggccagaagtgagcgaccccatgagctccacatatatcgaggaactgggaaaaagagaggtcaccatccccccaaaatatagagaattgctggccaaaaaagagggcattactggaccgccagccgatagtagtaagcccattgggcctgatgatgccatcgacgctctgagcagcgacttcacttgcggttctcccacagcggcaggcaagaaaacggaaaaggaagagtctaccgaagtactcaaggcccaatcagctggtactgtaagaagtgctgcccctccccaagagaaaaaacgtaaggtggaaaaggacactatgagcgatcaggcactcgaggctctctccgcttccctggggacccggcaagctgagcctgagcttgaccttcggagcatcaaggaagtggacgaggccaaagctaaagaagagaagttagaaaaatgcggagaggatgacgagactattcccagcgagtataggcttaaacccgcaacagataaggatggcaagcctcttctgcctgagcctgaggaaaagccaaagcctcgcagtgagagcgaactgattgatgaactgtcagaagattttgacagaagcgaatgcaaggaaaagccgtcaaaacccacagagaagacagaggaatcaaaggctgctgcccctgctcccgtgtctgaggctgtgtgtcgaacatctatgtgttcaatccagagtgctccccctgagcctgcaaccctgaagggaacggttcccgacgacgcagttgaggccttagcagattctctgggtaagaaagaggcagacccggaggatggaaagcccgtgatggacaaggtcaaggagaaggccaaggaagaagaccgcgaaaaactgggagagaaggaagagacaatcccccctgattaccggctggaggaagtgaaagacaaagatggtaaacccctcttaccaaaggaatccaaagaacaactacctcccatgtcagaagacttcttactggacgccctgtctgaggatttcagcggtccacagaacgccagcagtctgaaatttgaagatgccaagttggcggcagctatttctgaagtcgtgtcccagacccctgcctctaccacacaagctggggcaccccctagagatacaagccagagcgataaagatctcgacgatgcgctcgacaagctcagcgattcactgggccagcgccagccagaccccgatgagaacaagcctatggaggacaaggtcaaggaaaaggccaaagctgaacaccgcgataagctgggagaacgcgatgatactatccccccagaatacagacacttgctggacgacaatgggcaggataaacctgtgaaacctccgaccaagaagagcgaagatagtaagaaacctgcggatgatcaggacccaatagatgcccttagtggcgatctcgattcgtgtcccagtaccacagaaacgagccaaaacactgcaaaggacaaatgcaagaaggccgcaagcagcagtaaagctcctaaaaatggcggtaaggcgaaagactcagccaaaacaaccgaagagacatcaaaacctaaagatgactag

SEQ ID NO: 216812 - DNA, 1254 bp, Artificial Sequence
  Description of Artificial Sequence: Synthetic coding sequence
atgctgttaagcgtgcccttgttattagggctgctgggtttagctgtggcggaaccagcggtctatttcaaggagcagttcctggacggggacggctggacaagcaggtggatcgagtccaagcataaatccgacttcggaaaattcgtccttagtagtgggaagttctatggtgatgaagagaaagacaaggggctccaaacttctcaagacgccagattctacgcattgagcgcgagctttgaaccattttcaaataagggacagaccctggttgtgcagttcaccgttaagcacgagcaaaacattgattgcggaggaggttacgtgaagctgttccccaatagcctggatcagaccgacatgcatggagattcagaatataacatcatgtttggtcctgatatttgtgggccaggtacgaagaaggtccacgtgatcttcaattacaagggtaaaaatgtgctcatcaataaagatattaggtgtaaagacgacgaattcactcacctgtacacccttatcgtccgaccggataatacgtatgaagtcaagattgataattcacaagtcgagtcaggatctctcgaagacgactgggacttcttaccccctaaaaagatcaaagaccccgacgcttcaaagcccgaggattgggatgagcgggcaaagatcgacgacccaactgatagcaagccagaagactgggacaaaccagagcacattcctgatcccgacgctaagaaacccgaagactgggacgaggagatggacggcgaatgggaacccccagtgatccaaaatcctgaatacaagggagaatggaagccaagacagatcgacaaccctgactataagggtacctggatacacccagaaattgataatccagagtacagccccgacccctcgatctatgcttacgataattttggagtgctgggccttgatctctggcaggttaagtccgggaccatttttgataactttctgatcaccaatgacgaagcctacgctgaagagtttggtaatgaaacctggggcgtgaccaaggcagctgagaaacaaatgaaggacaaacaagatgaagaacagaggcttaaggaggaggaagaggacaagaaaagaaaggaggaagaggaggctgaagacaaggaggatgatgaggacaaggacgaggatgaggaggacgaagaggataaagaagaagacgaggaggaagacgtacctggccaagcaaaggatgaactgtag

SEQ ID NO: 216813 - DNA, 891 bp, Artificial Sequence
  Description of Artificial Sequence: Synthetic coding sequence
atgcacggcgattccgagtacaatattatgttcggccctgatatttgcggacctgggacaaaaaaagtccacgttatctttaactacaaaggtaaaaacgtactgatcaacaaagacatccggtgtaaagacgacgagttcacacacctgtatactctaattgtacgtcccgacaatacctacgaggtaaaaatcgacaactcgcaggtggaaagcggctcactggaggacgactgggactttctaccaccaaagaagattaaagacccagacgcaagcaagcctgaagactgggatgagcgggcaaaaatcgacgacccaactgatagtaaaccagaggactgggataagcccgaacacattccggaccctgacgctaagaaacccgaagattgggatgaagaaatggatggggagtgggaacctcccgtgatccagaacccagaatacaagggcgagtggaagccaaggcagattgacaaccccgattataaggggacttggatacatcccgaaattgacaatccagagtatagtcctgacccttctatttatgcatacgataatttcggggtgctgggtctggatctctggcaggttaaaagtgggactatatttgacaactttctgattaccaatgatgaggcttacgccgaagaattcggaaatgagacttggggtgtgaccaaggctgcagaaaaacagatgaaagacaagcaggacgaagaacagcgcttgaaggaagaggaagaagacaaaaagcgcaaagaagaagaggaagctgaagataaagaggatgatgaagacaaagacgaggatgaggaagatgaggaggataaagaagaagatgaggaagaggatgtgcctggacaagcaaaggacgagctgtag

SEQ ID NO: 216814 - DNA, 1155 bp, Artificial Sequence
  Description of Artificial Sequence: Synthetic coding sequence
atggctcgggctcttgttcagttgtgggccatctgcatgctcagagtagccctagccacagtgtactttcaggaagaatttctagacggagagcattggagaaaccgatggttgcagagtactaacgactctagattcgggcacttccgcttaagcagcgggaagttctatggtcacaaggagaaggataagggcctccagaccacgcagaacgggcgattttacgccatttccgctcgtttcaagcccttcagcaataagggcaaaactctagttatccagtacaccgtgaaacacgagcaaaagatggactgcggtggcggatacattaaggtgtttccggcagatattgaccagaagaatctgaatggaaagtctcagtactatattatgttcggaccagatatatgtggctttgatattaagaaagttcacgtaatacttcattttaagaataaataccacgagaacaagaagctgatccggtgtaaggtggatgggttcacccacctatacacgttgattttaagacccgatttgtcctatgacgtgaagatcgacggccagtcaatagagtcaggatctatcgaatatgattggaatctgacaagcttgaaaaaggagaccagcccagcagagtcgaaggactgggagcagactaaagataataaagcacaggattgggagaagcactttctggacgctagtacatccaagcagagcgactggaacggggaccttgacggcgattggcccgcaccgatgctgcagaagccgccttatcaggacggtctaaaacctgaaggcatacacaaggacgtttggctgcatcgtaaaatgaaaaatacagattacttaactcagtacgacctctccgagtttgaaaacatcggcgctattgggctcgagctctggcaggttcggtctggcaccatcttcgacaatttcttgatcacagatgatgaggagtacgcagataatttcggtaaagctacatggggagaaacaaaaggcccagagagggaaatggatgccatccaggcgaaggaggagatgaagaaggcaagagaggaggaggaggaagaattgctaagtggcaaaattaaccgccacgagcactactttaaccagtttcatcgcaggaacgaattatag

SEQ ID NO: 216815 - DNA, 1191 bp, Artificial Sequence
  Description of Artificial Sequence: Synthetic coding sequence
atgtcggctaccgaccggatgggaccacgcgcagttccgggtctgcggctggccctgcttctattattagtgcttggaactccaaagtctggtgtgcaggggcaggagggcctcgattttcctgagtacgatggtgttgaccgcgttattaatgttaacgctaagaattacaaaaatgtatttaaaaagtatgaagtccttgccctgttatatcatgagcctcccgaggatgacaaggcatcccagcgccagttcgaaatggaggaactcatactggagctggctgcccaggtcctggaggacaagggtgtcggcttcggcctggtggatagtgagaaggacgcagcagtggccaagaagctcgggctcactgaagtggattctatgtatgtatttaaaggagatgaagtgatagaatacgacggggagttctccgctgacacaatcgtcgagtttttgctcgatgttctggaggatcccgttgaactgattgaaggagaaagagagctgcaggccttcgagaatatagaggacgagatcaagctgattggttactttaagtccaaagacagtgagcattacaaagcattcgaggacgccgcagaggagttccatccctatataccattctttgcgacattcgacagtaaagtcgctaaaaagcttaccctgaaattgaacgaaattgatttctatgaggcttttatggaggagcccgtgactattcctgataaaccgaattccgaggaagagatcgtgaacttcgtggaggagcatcgcagatccaccctgaggaaactgaagccagagtcgatgtatgaaacctgggaagacgatatggacgggatacacatcgtggcgttcgccgaggaagccgacccagatggtttcgaatttctggagacgctcaaggccgtggcccaggataacaccgaaaatcctgacctctctataatatggatcgaccccgatgattttcctttacttgtgccctactgggaaaagacgtttgacatcgatctcagcgctccacagattggggtggtaaatgttaccgatgccgacagcgtctggatggagatggacgacgaggaggacctgccctctgcagaggagctagaggattggctagaggatgtgcttgaaggagagatcaatacagaagatgatgacgatgatgacgacgattag

SEQ ID NO: 216816 - DNA, 1173 bp, Artificial Sequence
  Description of Artificial Sequence: Synthetic coding sequence
atggggccaagggcagtacccggattgcggctggcactgctgctgttgttggtactgggcaccccaaagtctggcgtgcaaggacaagagggcctcgattttcctgaatatgatggggtcgaccgggtcattaatgtgaacgccaagaactataaaaacgtgtttaaaaaatacgaagtgctggccctactgtatcatgagccccctgaagacgacaaggcctcccagaggcagttcgagatggaggagctaatcctggagctcgccgctcaggtcctggaagataagggcgtcggttttggactggttgattctgagaaggacgcggcagtggctaaaaagctcgggctaacggaggttgatagcatgtacgtgtttaagggcgatgaggtcatagaatatgacggcgagttttccgccgacacaatcgtcgagtttcttctggacgtgttggaagatcctgtagagctgatcgagggggagagagagctccaggcatttgagaacatcgaggacgagattaagctgatcgggtactttaagtccaaggactctgagcactataaggccttcgaagatgccgctgaggaattccatccttacattcccttctttgccactttcgactccaaggtagccaaaaagttgacgttgaagttgaacgagatagacttttatgaggcatttatggaagaacctgtcaccatcccggacaaacccaatagtgaggaggagattgtaaattttgtggaggagcatagacggagtactctccgcaagctcaagcccgagtctatgtatgaaacctgggaagacgacatggacggtattcacatcgtcgcctttgccgaagaggccgatccagatgggtttgagtttctggagactctgaaggctgtggcgcaagataacaccgagaatcctgacctcagtataatctggatagatcctgacgacttcccattgctggtcccttactgggaaaaaacatttgacatcgatctgagcgcccctcaaatcggagtcgtcaacgtcactgatgcggacagcgtttggatggaaatggacgacgaggaggaccttccctctgcagaagaactggaggactggctagaagacgtgctggaaggagaaatcaataccgaggacgacgacgacgacgacgacgactag

SEQ ID NO: 216817 - DNA, 936 bp, Artificial Sequence
  Description of Artificial Sequence: Synthetic coding sequence
atgtccatgcaacgtactactagaatgtgtagtaggagcatgcgctgctggcattcctccaccatgaacccgcctaggatgactcgcccacacaaggataactcactcggcctgaccgaagtcgactccatgtatgtcttcaagggagatgaagtgattgagtatgatggcgagttttcggccgataccattgtagagtttcttctcgacgtgcttgaagatcccgtggagctcattgagggcgagagggagcttcaggcgtttgagaacatcgaggacgagataaagcttatagggtactttaagtccaaagacagcgagcattacaaggcttttgaggacgctgccgaagagtttcatccgtatattccattcttcgccactttcgactccaaagtcgccaaaaagctcaccctgaagttaaacgaaatcgatttctatgaagcctttatggaagagcctgtgacgataccggataagcccaacagtgaagaagaaatcgtgaatttcgtcgaagagcacaggaggtctaccctaaggaaattaaaaccagagtctatgtatgagacctgggaggatgatatggacggcatacatatagttgcttttgccgaggaagctgacccagacgggttcgagttcttagagactcttaaagccgtggcccaggataacactgaaaatcctgatctgtcaatcatttggatcgaccctgacgactttcctttactggtgccatattgggaaaagacctttgacatcgacctctctgcacctcagatcggagtcgtcaacgtaaccgatgctgactctgtctggatggaaatggatgacgaggaagatctgcccagtgccgaggagctcgaggactggctggaagatgtcctggaaggtgagatcaatacagaggacgatgatgacgacgacgatgattag

SEQ ID NO: 216818 - DNA, 1200 bp, Artificial Sequence
  Description of Artificial Sequence: Synthetic coding sequence
atgaagaggacccacctcttcatcgtggggatctattttctatcatcttgccgcgctgaagaaggacttaactttcctacgtatgatggcaaggacagagtggtctcgctctctgagaagaatttcaaacaggtactgaagaagtacgatctgctgtgtctctactaccatgaaccagtaagcagcgataaggtgacacagaagcagttccagttaaaggagatcgttttggagcttgtggctcaggttcttgaacataaagctatcggctttgtgatggtcgacgccaaaaaggaagccaaactcgccaagaagctcggtttcgacgaggagggttcactctatattctgaagggcgacaggactatcgagttcgacggcgaattcgccgctgatgtgctggtcgaatttctccttgacttaatcgaggatccagtcgagatcatctcctctaaactggaggttcaggcctttgagcggattgaagactacattaagctcataggcttcttcaaatctgaagacagcgaatactataaggcgttcgaggaggctgctgaacacttccagccttacatcaaattttttgctactttcgacaagggcgttgccaagaagttgtcactcaagatgaacgaagttgatttttacgaaccatttatggatgagcccatcgcaatccctaacaagccatacactgaagaagaactggtcgaattcgtgaaagaacaccaacgacctacactccggaggcttagacccgaagagatgtttgaaacatgggaagatgatctgaatggaatccacatagtggccttcgccgaaaagagcgaccctgacggctatgaatttctcgagatccttaagcaagttgcacgagacaataccgacaatccggacctttctatactgtggattgatcccgacgacttcccactgctagttgcttactgggaaaagacttttaaaatagacctgttcaggcctcaaatcggtgtcgtgaacgtcacagatgctgacagtgtgtggatggagatacccgatgacgacgatctgcctactgcagaggagttagaagactggatagaggacgtcttgtcaggcaagataaacactgaagacgacgacgaagatgatgatgatgacgataacagcgacgaggaagataacgacgacagcgacgatgacgatgatgagtag

SEQ ID NO: 216819 - DNA, 1062 bp, Artificial Sequence
  Description of Artificial Sequence: Synthetic coding sequence
atgaagcggacccacttgttcatagtcggaatttacttcctgagttcatgtagggctgaagaagggctgaactttcctacatacgatggcaaggacagggtggtttcactttctgagaaaaattttaaacaagtactcaaaaagtatgacctcctgtgtctgtattatcacgagccggtgtccagtgataaagtgacacagaagcagtttcagctgaaagagatcgtcctggaacttgtggcgcaggtcctggaacataaggccattggattcgtaatggtagacgcaaaaaaggaagccaagctggcgaaaaaactcggttttgacgaggagggctctctttacatcctaaagggcgatagaacaattgagttcgacggagagtttgcggcagatgtgcttgtggaatttctcctggacctcatcgaagaccccgtcgaaattatatcgagtaagctggaagtgcaggcatttgagagaatagaagattatattaagcttattgggtttttcaagtccgaggattccgaatattataaggcatttgaagaggctgccgagcatttccagccttacatcaaattctttgcaacatttgacaaaggggttgcgaagaaactgagcctgaagatgaacgaggttgacttttacgagccctttatggatgaaccgatcgccatcccaaataagccctacacagatgggtatgagtttctcgagatactgaagcaggtagctagagataacactgataaccccgatcttagcatcttgtggatcgacccagacgacttcccattactggtcgcatactgggagaagacatttaaaatcgatctgtttaggccccagataggagtcgtgaacgtgactgacgccgatagcgtgtggatggagattcccgatgatgacgatctgcctaccgcagaggagttggaggactggatcgaagatgttctgtccgggaaaataaatacagaggacgatgacgaggacgacgatgacgacgacaactcagatgaagaggacaacgatgacagtgacgacgacgatgatgagtag

SEQ ID NO: 216820 - DNA, 987 bp, Artificial Sequence
  Description of Artificial Sequence: Synthetic coding sequence
atgaagaggacccatcttttcattgtcggaatctatttcctcagttcttgtcgagccgaggagggattgaattttcccacttatgacggaaaagatagagtcgttagtctgagcgagaagaatttcaagcaggtccttaagaagtacgacctgctttgcctttattatcacgaacctgtctctagcgacaaagttactcagaaacagttccaactaaaggagattgtgctggaactcgtggcccaggtgttagaacacaaagcaatcggctttgtcatggtggacgccaaaaaagaggccaaactcgccaaaaaattggattacaaagcctttgaagaggccgctgagcattttcagccttatattaagttcttcgccaccttcgacaagggtgttgcaaagaagttgtccttgaagatgaacgaagtagatttttacgaacccttcatggacgaacctattgccattcccaacaagccttacacagaggaggaactcgtcgaattcgttaaggagcatcagagaccaacactgagacgtctgcggccagaagagatgtttgagacctgggaggatgatcttaatggtatccacattgtggcattcgctgaaaagtccgaccccgacggctacgaatttcttgaaatactgaagcaggtggctagggataataccgacaatcccgatttgagtatactgtggattgatccggacgattttcctttactagtcgcctactgggaaaaaacgtttaagatagatctttttagaccacaaatcggcgtcgtaaatgtgacagatgcggatagtgtatggatggagattccggacgacgacgatctgccaacagctgaggagttggaagactggatagaagacgtgttgtccgggaaaattaatacagaggatgacgacgaggatgatgacgacgatgataactccgatgaagaggataacgatgatagtgatgatgatgatgacgagtag

SEQ ID NO: 216821 - DNA, 948 bp, Artificial Sequence
  Description of Artificial Sequence: Synthetic coding sequence
atggacctgaggcaattcctaatgtgtttgtcactctgcacagcttttgccctgtccaagcctacagagaagaaggaccgggtgcatcatgagcctcagttaagcgataaagtgcataatgacgcgcagagcttcgattacgatcacgatgcattcttgggggcagaagaggctaaaacattcgatcagttgaccccggaagagagcaaagagagacttggtaagattgtgtctaaaatcgacggagacaaggatggattcgtgaccgtggacgaactcaaggactggatcaagtttgctcagaagagatggatctacgaagatgtcgaacgccagtggaagggacacgacttaaatgaggatggcttggtgagctgggaagagtacaaaaacgccacttacggatacgttctggatgatccggatccagatgacgggtttaactataagcagatgatggtccgcgatgagagacggttcaagatggctgataaggacggcgacttgattgcaactaaagaagaattcactgcatttctgcatcccgaagaatacgattacatgaaggatatcgtggtacaggaaacaatggaggatatcgataaaaacgctgatggattcatagacctggaggagtacatcggggacatgtacagccacgacgggaacactgatgaacctgaatgggtgaagaccgagcgggagcagttcgtagagtttagagataagaatcgagacggtaagatggacaaagaggaaaccaaggattggattctacccagcgactatgatcacgccgaggctgaggctcgccacctggtgtatgagagcgatcaaaacaaagatggcaaactgacaaaagaagagatagtcgacaagtacgatttgttcgttggcagccaagccactgacttcggtgaggctctagtacggcatgatgagttttag

SEQ ID NO: 216822 - DNA, 465 bp, Artificial Sequence
  Description of Artificial Sequence: Synthetic coding sequence
atggacctcaggcaatttttgatgtgtctgagcctttgtaccgcattcgctctttccaaaccaaccgaaaaaaaggatcgcgtgcaccatgagccacagctgtctgacaaggtgcataacgacgcccaatccttcgactacgatcatgatgcttttctaggtgccgaggaagcgaaaaccttcgatcagctgacaccagaggagtcaaaggagaggctcgggaaaatcgtgtcaaagattgacggggacaaagacggcttcgttacagtagatgagctcaaagactggatcctgccatctgattacgaccacgccgaagccgaagccaggcatttagtctacgagtctgatcagaataaggacggaaaacttacaaaggaggaaatcgtggacaaatatgacctgttcgtagggagccaagcaaccgattttggcgaagctttggtcaggcacgacgaattctag

SEQ ID NO: 216823 - DNA, 948 bp, Artificial Sequence
  Description of Artificial Sequence: Synthetic coding sequence
atggacctgaggcagttccttatgtgtctgtctctatgtaccgccttcgctctcagcaaaccgaccgagaaaaaggatagagtgcatcacgagcctcagcttagtgacaaggtgcataatgatgcacaaagcttcgactacgaccacgatgcttttctaggcgctgaagaagcaaaaacttttgaccagttaactccggaggagagcaaagaacgcctgggaatgattgttgataaaattgatgccgataaggacgggttcgtgaccgaaggagagctgaaaagctggatcaagcacgcacaaaaaaaatacatctatgacaatgtcgagaaccagtggcaggagtttgacatgaatcaagatggcctgatctcttgggacgagtatcgtaatgtgacctatgggacatacctagacgacccggacccggacgatggcttcaactacaaacagatgatggtacgcgacgagcggaggttcaaaatggcagataaagacggggacctgatcgccactaaggaggaatttacagctttcctgcaccctgaggaatacgactacatgaaagacatcgttgtccaggagactatggaagatattgacaaaaatgctgatggctttatcgacctggaggaatacattggggacatgtatagccacgatggtaataccgacgaacctgagtgggttaagacggagcgggaacagtttgtagaattcagagacaagaacagggatggaaagatggataaggaggagaccaaggactggatattaccaagcgattacgaccacgcagaagccgaagcgcgacaccttgtttacgagtcagatcagaacaaagacggcaagcttacgaaagaagagattgtggataaatacgatctttttgtcggttctcaggccaccgacttcggtgaggctcttgtccggcatgacgagttctag

SEQ ID NO: 216824 - DNA, 972 bp, Artificial Sequence
  Description of Artificial Sequence: Synthetic coding sequence
atgaaggaaactgatctgattataatggatttgcggcaatttttgatgtgcttgtcactgtgtaccgcctttgctctgagcaaaccaacagagaagaaggatagggttcaccatgagcctcagctctccgataaggtccataacgacgcccagagcttcgattatgaccacgatgcctttctgggtgcagaggaggctaagaccttcgatcagttgacacctgaggagtcaaaggagcggttaggaaaaattgtttccaagatcgacggcgacaaggatggattcgtaactgtggatgagctgaaggactggattaagtttgcgcagaaacgctggatctatgaagatgtcgaacgacagtggaaggggcacgatctgaatgaggatggactggtgagttgggaggagtacaaaaacgctacatacggatatgtcttagacgacccagatccagatgacggtttcaactacaaacagatgatggttcgggacgagcgtcgtttcaagatggccgacaaggatggtgaccttatcgcaacgaaagaagaatttaccgcgtttcttcaccctgaagaatatgactacatgaaggacatcgtggtgcaggagacaatggaggatatagacaaaaatgccgatggttttatcgatctggaagagtatataggggatatgtacagtcacgacgggaatactgatgagcctgagtgggtgaaaacagagcgcgagcagtttgttgagttcagagataagaatagggatggtaagatggacaaggaagagacaaaggattggattttgcccagcgattatgaccacgcagaggccgaggccaggcacttggtgtatgagagtgaccagaacaaagatgggaagctcactaaggaggagatcgtagacaaatatgacctttttgtgggctctcaggcgactgactttggcgaggctctcgtacggcatgacgaattttag

SEQ ID NO: 216825 - DNA, 444 bp, Artificial Sequence
  Description of Artificial Sequence: Synthetic coding sequence
tgaattgctacaaaggaggagttcaccgctttccttcaccccgaggagtacgattacatgaaggatatcgtcgtacaagaaacgatggaggacatagacaagaacgcagacggcttcatcgatctggaggagtatatcggcgacatgtactctcacgatggcaatacagatgagcccgagtgggtgaagacggagagggagcaattcgtcgagtttagagataagaacagagatggaaaaatggacaaagaggagaccaaggattggattctaccttcagattatgaccacgctgaggctgaggccaggcatttagtgtatgaatccgatcagaataaggacggcaaacttacaaaagaggaaattgtggataagtatgacctctttgttggaagccaggccaccgatttcggtgaggcactagtgcgccatgatgaattctag

SEQ ID NO: 216826 - DNA, 675 bp, Artificial Sequence
  Description of Artificial Sequence: Synthetic coding sequence
atggatctcaggcagtttcttatgtgcctatcactgtgtaccgccttcgctctttccaaacccacagagaaaaaagatagggtacaccacgagccacagctgagtgacaaggtgcataatgatgcccagagcttcgactacgaccacgacgccttccttggcgcagaggaggctaagacgttcgaccagctcaccccagaggagagcaaggagcggctcggcaagatagtctcaaagatcgatggtgataaagatgggttcgtaaccgtagatgaactcaaagattggatcaagttcgcccagaagcggtggatttatgaggatgtggagcgccagtggaaaggacatgatctgaatgaagatggcctagtatcatgggaagagtataagaatgccacatacgggtatgtgcttgacgatccagatcccgacgatggctttaattataaacaaatgatggtacgagacgaacggcgattcaaaatggctgacaaggatggcgaccttatcgccacgaaggaagaatttacagcatttctgcaccccgaagagtacgactacatgaaagatatagtagttcaggagaccatggaagacatcgacaagaacgcagatgggttcatcgaccttgaagagtacataggatggcaggcataccagggcggtgaccgctag

SEQ ID NO: 216827 - DNA, 444 bp, Artificial Sequence
  Description of Artificial Sequence: Synthetic coding sequence
atgaaagagaccgatctcattatcatggatctcagacaatttttgatgtgtctatctctgtgtaccgcgtttgccttgtccaagcccaccgaaaagaaagaccgcgtccaccacgagcctcagttgagcgacaaagtccataacgatgcacagtctttcgactatgaccacgacgcctttctgggagctgaggaggcaaagacctttgaccagttaaccccagaggagagtaaggagaggctggggaagattgtatcgaagatcgacggggataaggacggctttgttaccgtggatgagctgaaagattggattaagttcgcccaaaaacgatggatctatgaagatgtggagaggcagtggaaagggcacgacctgaatgaagacggattggtttcatgggaagagtataagaatgccacatatggatatgtgctcgagtag

SEQ ID NO: 216828 - DNA, 513 bp, Artificial Sequence
  Description of Artificial Sequence: Synthetic coding sequence
atggatctcaggcagttcctcatgtgcctcagtctgtgtactgcttttgcccttagcaagccgactgagaaaaaggatcgagtccatcacgaaccccaattaagcgacaaagtccacaacgatgctcagagcttcgactatgatcacgacgccttcctcggcgcagaggaggcgaagacattcgaccagttgactcccgaggagtcaaaagaacgcttggggatgatcgtagacaaaattgatgcagataaagacggttttgtcaccgaaggggagctcaaaagctggatcaaacacgctcagaaaaagtatatatatgacaacgtggagaaccagtggcaggagtttgacatgaatcaggatggcctgataagctgggacgagtaccggaatgtcacctacggcacctatttggatgacccagatcctgacgatggctttaattataaacagatgatggtgcgggatgaaaggcgatttaaaatggctgatcgcgctcgtgcagtgtgctag

SEQ ID NO: 216829 - DNA, 606 bp, Artificial Sequence
  Description of Artificial Sequence: Synthetic coding sequence
atggatctgcggcagttcctgatgtgcctctccttatgcaccgccttcgcgctatccaagcccaccgagaagaaagaccgtgtgcatcacgaacctcaattgtcagataaagtgcacaacgacgctcagtctttcgactatgatcacgacgccttcctcggggctgaagaggctaaaacattcgatcagctgacccccgaagagagcaaggagagattgggaatgattgtggacaagatcgatgccgataaggacggcttcgtgactgagggggaactgaagagctggatcaaacacgcacagaagaaatacatctatgacaatgtggagaaccaatggcaagaattcgacatgaaccaggacggactgataagttgggacgagtataggaacgtgacatatgggacctacctggacgatcccgaccccgacgacggctttaactacaaacaaatgatggtgagggacgaacgccgatttaaaatggcagacaaagatggtgatctcattgctactaaagaggagattgtggataaatacgacctatttgtcggcagccaggcaaccgattttggggaggccctggtgcgacacgacgaattctag

SEQ ID NO: 216830 - DNA, 798 bp, Artificial Sequence
  Description of Artificial Sequence: Synthetic coding sequence
atggacctgagacagtttcttatgtgtctgtccctttgcaccgcatttgccctgtccaagccaacagagaagaaggatcgtgtgcaccatgagccacagctctcagataaagttcacaacgacgcccaatccttcgactatgaccacgacgcatttttgggggcagaggaggcgaagacttttgatcagttgacgccggaagaatctaaggagcgccttggaaagattgtttcaaaaatcgacggtgacaaggacggattcgtgacagtcgacgagctcaaggattggattaagtttgcacagaagcgctggatctatgaagatgttgaaaggcagtggaagggccatgacttaaacgaagacggcttggtgtcctgggaagagtacaaaaacgcgacctatgggtatgttttggatgatccggatcccgatgacgggttcaactataaacagatgatggttagggatgagcgtagatttaagatggctgacaaagacggcgatttgatagccactaaggaggagtttaccgctttcctgcaccctgaggaatatgattacatgaaagacattgtagtgcaggaaaccatggaagacattgacaaaaacgctgacgggtttattgatctcgaggagtacataggtgatatgtactcccacgacgggaacaccgatgagtccgatcagaacaaggacgggaaacttaccaaggaagagattgtagataagtatgatctgtttgtcgggagtcaggcaacagactttggagaagctctggttcggcacgacgagttttag

SEQ ID NO: 216831 - DNA, 495 bp, Artificial Sequence
  Description of Artificial Sequence: Synthetic coding sequence
atgatggtgcgggatgagagaaggttcaagatggcagacaaagacggtgacctgatcgctactaaagaagagttcactgcatttctgcatcccgaggaatatgattacatgaaggacattgtggtgcaggagacgatggaagacattgataagaacgctgatggattcatagatttggaggagtatatcggagatatgtacagccacgacggaaatacggatgaacccgaatgggtaaagacggagcgagagcagtttgtcgagtttagagataaaaatagagacggcaaaatggacaaagaagagaccaaggactggatcctgccttcggattatgaccatgcagaggctgaagctaggcaccttgtatacgagagtgatcagaacaaagacgggaagctgaccaaagaagaaatcgtggacaaatacgatctcttcgtagggtcccaggcgaccgattttggggaagctctcgtccggcacgacgagttttag

SEQ ID NO: 216832 - DNA, 972 bp, Artificial Sequence
  Description of Artificial Sequence: Synthetic coding sequence
atgaaagagacagatcttattatcatggacctgcgtcagtttctcatgtgcttgagcctctgcaccgccttcgccctcagcaagcccacagaaaaaaaagatagagtgcatcatgaaccccagctcagcgataaggttcacaatgacgcccagagctttgactatgaccatgacgcttttctgggggcagaggaagccaaaacttttgatcagctgaccccagaggaatccaaggagaggctgggcatgattgtggacaaaattgacgccgacaaggacggattcgtaaccgagggcgagctaaagtcatggatcaagcacgctcaaaagaaatacatatacgataacgtggagaatcaatggcaagagtttgatatgaatcaggacggattgatttcgtgggatgagtacagaaacgtcacctacggcacatacctcgatgaccccgatcccgacgacgggttcaactataaacagatgatggtccgcgatgaaaggcgcttcaaaatggccgataaagatggagatctgatcgctaccaaggaagaattcaccgccttcctgcatcccgaggagtacgactatatgaaggatatagtggtccaggagactatggaggacattgacaagaatgcggatgggttcatagatctggaggaatacattggggacatgtactcacatgacggaaacacggacgagcccgaatgggtcaagacggagcgggagcagttcgttgagtttagagataagaaccgagacggcaagatggataaggaggaaaccaaagattggattctgcctagcgattacgaccacgccgaggccgaggccaggcatctcgtttatgagagcgatcagaacaaggacggaaagttgacaaaggaggagatcgtcgacaagtatgatctctttgtgggctcccaagccaccgacttcggcgaagctctggtgcgacatgatgaattttag

SEQ ID NO: 216833 - DNA, 1116 bp, Artificial Sequence
  Description of Artificial Sequence: Synthetic coding sequence
atggagcttgagctggacgccggtgatcaggacttgctggcatttctactggaggaatccggagatctgggcaccgcaccagatgaagcagtgcgcgcaccattggactgggctttacctctcagcgaggtcccaagcgactgggaagtggacgacctgctgtgcagcctactgtcacccccagcttcacttaatattctaagttcatcaaacccatgcttggtacatcatgaccatacctattctctaccaagagaaaccgtctcaatggatctggagtctgaatcttgtcgcaaagaggggacccagatgacaccacagcatatggaggagctcgctgagcaggagatagcgagacttgtcctgaccgacgaggagaagagtctcttagagaaggagggcctaatcctgcccgaaactctacccctaacgaagactgaagagcagatattgaagagggttcgtagaaagattaggaacaaacgctctgcgcaagagtcaagacggaagaaaaaagtctacgtcgggggacttgaatcgcgggtgcttaagtacactgcacagaacatggaactgcagaacaaggtgcagctgctggaagagcagaaccttagcttgcttgatcagctgagaaaactgcaggcaatggtgatcgaaatctctaacaagactagctcctcatctacttgcatccttgtactccttgttagcttttgtctcctgctcgtcccggcaatgtatagttcggacacaagaggcagtctacccgcagagcatggtgtcctctcgcgccaactgagagcgctcccatcagaggacccctatcagctcgagctgcccgcactccaatcagaagtgcccaaggactccacccatcagtggctggacggctctgactgcgtccttcaagctcctggtaacacctcttgtctgctgcactacatgcctcaagcccctagcgcagagcctcctctggaatggccctttccagacctgttttctgagcctctttgcagaggccctattctgcccttgcaggccaatctcaccagaaaaggcggttggttgccaaccgggagcccttcagtcatcctgcaagacagatattctgggtag

SEQ ID NO: 216834 - DNA, 1386 bp, Artificial Sequence
  Description of Artificial Sequence: Synthetic coding sequence
atgaacacggatcttgcagccggaaagatggcgtcagctgcgtgctcaatggaccctatcgattctttcgagttgctggacctcctctttgatagacaggatggcattctgcggcatgtggaactgggggaaggttgggggcacgtgaaggatcagcaggtgcttccaaatccagacagtgatgacttcttgtcatccatcttggggtcgggggatagcctgccctcttcccccctgtggtctcccgaaggatctgactccggcatctctgaagatctgccctctgaccctcaggacacacctcccagatctggccctgccacttcacccgcagggtgccacccggcacagcccggaaaaggcccttgtttaagttatcacccgggtaactcttgcagcacaaccactcccggaccagtcatccaagtacctgaggcatcagtcactatagatctggagatgtggtctcctggcggacgcatttgtgcggagaaaccagccgacccggtcgatttgtcaccccgatgtaatctgacagttaaggatcttttgctgagcggctctagcggcgacttgcaacaacaccatctaggggcatcctatctgctgaggccaggggcaggacattgccaggaactggtgctgacagaagacgagaagaaactgctggcaaaggaaggcattacattgccaacccagctgcccctgaccaaatacgaagaacgggtccttaagaagatcaggaggaagatcaggaacaagcagagcgctcaggagtcccgcaagaaaaagaaggaatacatcgacgggctggaaacccgaatgtctgcttgtaccgcgcagaaccaggaattgcaacgcaaagtcctgcacttagaaaaacagaatttgtcactgttagagcaactgaagaaattgcaggctatcgtcgttcagagcacctccaagagtgctcaaaccggtacgtgtgtagccgtgctgctgttgtctttcgccctcattattttgccatctattagcccctttggaccgaataagactgagagcccaggcgattttgcccctgtgcgcgtgtttagcaggactctgcacaacgacgccgcttcccgagtggccgctgacgcagttcccggatcagaggcccctggtcccaggcccgaagcagataccacacgagaggagtccccaggcagcccaggcgcagactgggggttccaagatacagccaatttaaccaatagcacagaagaacttgataacgctactctcgtcctgaggaatgcaaccgagggtctcgggcaggtcgcacttctggactgggtggctccaggcccaagcaccggcagcggtagggcaggattggaggcggcaggtgacgaattgtag

SEQ ID NO: 216835 - DNA, 900 bp, Artificial Sequence
  Description of Artificial Sequence: Synthetic coding sequence
atggcgagcgccgcatgttcaatggaccccatagacagcttcgagctgctggatctgctctttgatagacaggacggaattctccggcacgtggagctgggtgagggatggggccacgtgaaagatcaggtcctccccaatcctgatagcgatgattttctctcgtcgatcctggggtccggtgactcccttcccagctccccattatggtcccccgaagggtcagacagcgggatctccgaagacttacctagcgatccccaggatacaccacccaggtcagggcctgcaaccagcccagccggatgccatcctgcccagccaggcaaagggccatgcctttcttatcacccaggaaacagctgttcaaccacgacccccggacccgtaattcaacagcagcaccacctgggcgcaagctacctgcttagacccggtgcaggacactgtcaggaactcgtactgacagaggacgagaagaagttgctagccaaggaaggcataacgttaccaacccaattgcctttgacgaagtatgaggagagggtgcttaagaagattaggcgaaagattcgcaacaagcagtctgcccaggaatctcgcaagaagaaaaaggagtatatcgatggtttggagacacgaagttgctgttgtccactgcccagctctagctcaccaccctctgctctgctggcgccaacgaagcctagggcactggggaccttgaggctatacgaatgttcacctgaattgtgcaccactatgttgccacccgcatggctgctgatgctgtgtcaggctcccagaccccaggatccagatcctcgtctaacgcaaccagagaagtctttgcaagaagccccagggcaaacaggcgcaagcaggaccccgaggacatag

SEQ ID NO: 216836 - DNA, 1260 bp, Artificial Sequence
  Description of Artificial Sequence: Synthetic coding sequence
atgaataccgacctggctgctggcaaaatggctagcgccgcatgctcgatggacccgatcgactctttcgaactgctcgacctgctgttcgatcgccaggacgggattttgcgccacgttgaactgggagagggctgggggcacgttaaggaccagcaggtcctccccaacccagactccgatgattttctgagctcaatcctgggatcaggggattctctgccttcatcccctctgtggtctcccgagggctcagattcaggaatctcagaggatctgccaagcgatcctcaggatacacccccacggtccgggccagccacctcacctgccggttgccatccggctcaacccggtaagggtccatgtctctcatatcacccaggtaatagttgctccaccactacgcctggccctgtgatccaggtgcccgaggcatccgtgaccatagacctggagatgtggtctcccggaggcaggatatgtgccgagaagccagcagacccggtggacctgagcccaagatgtaatcttacagtgaaggatttgctcctgagcgggtcctcaggcgacctgcagcagcatcatctcggcgcaagctatctgttaagaccaggcgcaggccattgccaagagctggtgttaacagaagatgaaaagaagctgttggctaaggagggcattacccttcccactcaactccctctgaccaagtacgaggaacgtgtgctgaaaaaaattcggcgtaagattaggaataagcaatccgcccaagaaagccgtaagaagaaaaaggcgatcgtggttcaaagcaccagcaagtccgcccaaactgggacgtgcgtggcggttcttttactttcctttgccctcattatccttccttctatcagcccattcggaccgaacaagacagagagtcctggagactttgcaccggtacgcgtgttcagtagaacacttcacaacgacgccgcttcccgggtggctgccgatgccgtgccaggctccgaggccccaggtccccgaccagaggcagataccactagagaagaatcacccggaagtccaggagcagattggggcttccaggacacagctaacctgactaattctaccgaagagttggacaacgccacactggtcttgaggaatgccacggaggggcttgggcaggtggccctgttggactgggttgctcccggtcctagtaccggctccggccgtgctggcctggaggccgcaggtgacgagctgtag

SEQ ID NO: 216837 - DNA, 1188 bp, Artificial Sequence
  Description of Artificial Sequence: Synthetic coding sequence
atggatctggggatccctgacctactcgacgcttggttagaaccgccagaggacattttttcaacgggttccgtgctcgagttgggtctgcattgtcctccacccgaagttcctgtgacacgcctccaggagcaggggctccaaggctggaaatctgggggagatcgtggctgtggcctgcaggagtccgaaccagaggatttcctaaagctgtttatagaccctaatgaagtgtactgctcagaggcgtctcctggaagcgattccggcatatctgaggatccgtgtcaccccgacagcccacccgctccccgtgccacttcttcccctatgttgtacgaagttgtctatgaggcaggagctctcgagcgcatgcagggggaaaccgggcctaacgtgggcttgattagcatccagctcgatcagtggagtccagcatttatggtacctgactcctgcatggtaagcgaattgccattcgatgcgcacgcacatatcttgcctcgcgcaggaacagtggcccctgtgccttgtacaaccctcttgccatgtcagactctgttcctcaccgacgaggagaaacggctgttgggccaggagggggtgtctctgccctcacatctccccctaacaaaagcagaagagcgtgttttgaaaaaggtcagaagaaagatcagaaacaaacagtcagcacaggacagcagacgacggaagaaagagtatatagacgggctcgaaagcagagtggccgcttgctctgctcaaaatcaggagctgcaaaagaaagtccaggaactggagcggcacaatatcagcctggttgcgcagctgcgccagctccaaaccttgattgcccagacatccaacaaggccgctcagacctcgacctgtgtgctgatcctactatttagcctggctctgatcatcctgccatcgttttctccttttcaaagtaggcccgaggccggatccgaggactatcagccccacggggtgacatctcgcaatatcctgactcacaaggatgtgacagagaacctggagacccaggtggtcgaatcacgcctaagagaaccaccaggcgctaaggacgccaatggctctacaagaactcttctagaaaagatggggggtaaaccgaggcctagtggtcggatcaggagcgtgttgcacgccgacgaaatgtag

SEQ ID NO: 216838 - DNA, 1128 bp, Artificial Sequence
  Description of Artificial Sequence: Synthetic coding sequence
atggatctcgggattccggatctcctggacgcatggctcgagccacccgaggacatcttttccactggaagcgtccttgagctcggactgcactgtccgcctcctgaagtccctggattgcaggaaagtgagcctgaagattttcttaaattgtttatagaccctaacgaggtttactgcagcgaggcaagccctggaagtgattcaggaatcagtgaggatccttgccaccccgactcacctcccgctcccagagccacctcatcaccgatgctatacgaagtcgtgtacgaagctggcgctcttgagagaatgcaaggggagaccggaccaaatgtcggcttgatatccatccagcttgatcagtggtccccagccttcatggtgcctgactcatgcatggtctcggaactcccttttgacgctcacgcccacatacttcccagagctggcacggtggcccctgtcccctgtacgactctcttaccttgccagaccctcttcctcactgacgaggagaaacggctcctgggacaggagggagtcagccttcccagccacctgccactcacaaaggcggaagaaagggttttgaagaaggtccggaggaagattcggaacaagcagagcgcacaagatagtcgcagacgcaaaaaggagtatatcgacgggctcgagtccagggtggcagcctgtagcgctcagaatcaagaactgcagaaaaaagtccaggaactggagaggcataatatttccctggtcgcccagctgcgccagctgcagacgctcatcgctcagaccagcaacaaagctgcacagacaagtacgtgcgtcctgatactgttgttcagtctcgcgctgattatcctgccttctttctccccatttcagagccgcccagaagctggctcagaagattaccagcctcacggcgtgacgagtcgtaatatcttgactcataaagatgtcactgagaacctggagacacaggtggtggaatctcgactgagggaaccacctggggcaaaagatgccaatgggtctacgaggacacttctggaaaaaatgggtgggaaacctaggcccagcggccgaatccggtcggtcctccatgccgatgaaatgtag

SEQ ID NO: 216839 - DNA, 654 bp, Artificial Sequence
  Description of Artificial Sequence: Synthetic coding sequence
atggacctaggcataccagacctgcttgacgcctggctagaaccaccagaggatatcttcagtacgggcagtgtactggaactggggttacactgtccgcctcccgaggtcccagtgacgagacttcaagagcaaggactccaagggtggaagtctggaggcgatcgaggttgtggtttgcaggaaagtgagcccgaagactttctcaagctattcattgaccctaacgaggtgtattgctccgaagctagcccgggatctgattcagggatttccgaggatccctgccaccctgactctccacctgccccacgggctacttcatctccaatgctgtatgaagttgtgtacgaagccggtgccctggagcgaatgcagggcgaaacaggaccgaatgtgggccttatatcaatacaactagatcagtggtcacctgcttttatggtgccagattcatgcatggtttcagaattgccgtttgatgcccacgcccacatcttgcctcgagccggaacagttgctccggtgccttgcacaactcttctgccctgtcagaccctcttcctcacagatgaagagaaacgacttctcgggcaagagggcgtgagtctgcccagccacctgcccctgacaaaggtgacttgttttccttag

SEQ ID NO: 216840 - DNA, 1188 bp, Artificial Sequence
  Description of Artificial Sequence: Synthetic coding sequence
atggatttgggcatcccggacctattagatgcctggttggagcctcctgaggatatcttcagcacaggcagcgtactcgagctgggattgcactgtccacctcctgaggtccctgtcactaggctccaggaacagggactgcagggatggaagtccggaggcgatcggggatgtggtctgcaggagtccgaacccgaagacttcctcaaactctttatcgatcccaatgaggtgtactgctccgaggcttcccccggttcagacagcggaattagtgaggatccctgccaccctgattcgccaccagctcctcgcgctacctcctctcccatgctgtacgaagtggtatatgaggctggtgcactcgagagaatgcagggggagacgggcccaaacgttggcctcatctcgattcagttggaccaatggtcgccggcttttatggtgcccgactcttgcatggttagcgagttgccatttgatgcgcacgcccacattttaccaagggcaggaaccgtagcccctgtcccttgtacgacactgctaccctgtcagaccttgtttctcacagatgaagagaaacgcctgctgggccaggagggtgtttcactcccgtctcacctgcccttaactaaggcagaagaacgtgtgctgaagaaagtgcggcgtaaaattcgcaacaagcagagcgcccaggactcccgacgccgtaaaaaagagtatatcgacgggttagaatctagagtcgccgcttgttcggcccagaaccaggaattgcagaagaaggtgcaggaactggagcgacataatatctccttggtagctcaacttcgccagctgcagacgttgattgcgcaaacttctaacaaggccgcacagacaagtacctgtgttctgatccttctgtttagcctcgctctcataatcctccccagcttcagcccgttccaatcccggccagaggccggttcagaggactaccagccacatggtgttacatctcgaaatatactaacacacaaagacgtcaccgaaaacctggaaacacaggtagttgaaagtcgtctccgtgaaccgccaggagccaaggacgccaatggctctaccagaaccctgctggagaagatgggcggaaagcctcggcctagtggacgaatcagaagcgtgctgcacgctgatgagatgtag

SEQ ID NO: 216841 - DNA, 1188 bp, Artificial Sequence
  Description of Artificial Sequence: Synthetic coding sequence
atggatctgggtataccagacctgctagatgcctggctcgaacctccggaagacatcttcagcactggctctgtcttagagctcggcctgcattgtccccctcccgaagttcctgtgaccagactacaagagcagggcctccagggatggaagtccggtggagaccggggatgcggcctgcaagagtctgagcctgaagatttcttaaaactgttcatcgatccaaacgaggtctactgctccgaagcttcgccaggatccgattctggaatcagcgaagacccttgtcaccctgattcccccccagcccctcgcgctacttcatctcctatgctttatgaagttgtgtacgaagccggtgccctggagcgcatgcagggagagaccggacctaatgttggcctcatttccatacaactggatcagtggagtccggcattcatggttcccgattcctgcatggtcagtgagcttccctttgacgcccacgcacatatcctgccacgggcaggcaccgtggcacccgtgccgtgtacaactctactaccctgtcaaacactgttccttaccgatgaagagaagaggttgctgggtcaggaaggtgtgtcactgccatcccacttacccttgacaaaagcagaagaacgtgttcttaagaaagtgaggcggaagattagaaataaacagagtgcccaggacagtagacgcaggaaaaaggagtatattgacggcctggagagtcgggtggccgcttgttcggcacagaatcaggaattgcagaagaaagtgcaggaattagaaaggcacaacattagcctggtggcccagctacgccagctccagacacttatagcacagacttctaacaaggccgcacagacctctacgtgcgttctgattctgttgttctcactggcacttattatactcccttctttttccccattccagtccaggcctgaggctggcagcgaagactatcagcctcatggcgttaccagtaggaacatcctcactcataaggacgttacagaaaatcttgaaacccaggttgtcgagagtagactaagggagccgccaggagcgaaagacgccaacggaagcaccagaacactattggagaagatggggggtaagccccgtccatcaggtagaattaggtccgttttgcatgccgacgagatgtag

SEQ ID NO: 216842 - DNA, 747 bp, Artificial Sequence
  Description of Artificial Sequence: Synthetic coding sequence
atggtgcctgatagctgcatggtcagcgaactccccttcgacgcccatgcacatattctgcctcgtgcaggcactgtggctcctgtcccctgtaccactctcttgccttgtcagaccctattccttaccgatgaggagaagcgactactgggccaggagggagtttctctccctagtcatctgccactgactaaggctgaggagagagtcctcaaaaaggtgcggagaaaaatccgcaacaaacagagtgctcaggactctcgcaggagaaagaaggagtatattgatggcctggagtcaagggtggctgcctgctctgctcaaaatcaggaactgcaaaagaaagtgcaggagctggaacgccacaacatttcattggttgcccagctccgacaactgcagacactaatcgcccagaccagcaataaggctgcacagactagcacatgtgtgctgattctgcttttttccctagcgctaattattctaccaagctttagccccttccagtcccgtcctgaggctggcagcgaggattaccagccccacggcgtgacctcccgtaacattctgacccataaggacgtgactgaaaatttggaaacccaggtggttgaaagtcgcctccgggaacctcccggtgcgaaagacgctaacgggagtaccaggactcttctggaaaagatgggcggtaagccgagacccagcggtagaatcagatctgtgctccacgccgatgaaatgtag

SEQ ID NO: 216843 - DNA, 549 bp, Artificial Sequence
  Description of Artificial Sequence: Synthetic coding sequence
atggatttgggcatccctgacttattggacgcctggttggagccacctgaggacatatttagcacgggctcagtgcttgagctgggcttacattgtccaccacctgaggtaccagtcactcggctgcaggagcagggcctacaaggatggaagtcaggtggggatcggggttgtgggttgcaggaatcagaaccagaggactttttaaaactgtttatagatcccaatgaagtctattgtagtgaagccagtccaggatccgatagcgggatatccgaggatccatgtcatccagactcacccccagcccctcgggcaaccagctctcctatgctttatgaggtggtttatgaggccggagccttagaacgaatgcagggggagacaggtccaaatgtggggctcatatctatccagctggatcagtggagtcccgcattcatggtgcctgattcttgcatggtgagcgaactgccattcgacgcacatgcacatatcctgcccagagctggcacagtagctccagtgccctgcaccacgctggtatag

SEQ ID NO: 216844 - DNA, 687 bp, Artificial Sequence
  Description of Artificial Sequence: Synthetic coding sequence
atggatctgggcattccagacctcttggacgcatggctggagccaccagaggacatatttagcaccggtagcgtcctggagctcgggctgcactgtccgcctcctgaagtccctgggctccaggaatcagagcccgaggatttccttaaactatttattgatccaaatgaagtctactgctccgaggcatccccaggcagtgattccggcatttcggaagacccttgccacccagactcgcctcctgctccacgcgctacctcaagccctatgttatacgaagtcgtgtacgaggccggagctctggagcggatgcagggagagactggtccaaatgtggggctcatctctattcagctggatcagtggtcccctgcctttatggtgccagacagttgcatggtctccgaacttccctttgatgcacacgcgcacatccttccgagagcgggtaccgtcgctcctgtgccatgtaccaccctgctcccttgccagacgctgttccttactgatgaagagaagcgtctgctcggccaagagggggtgtccctcccctcccacctccccttgactaaagcagaggaaagggtgctgaaaaaagtgcgcaggaagatccggaataaacagtcagcccaagacagcagacgcaggaagaaagaatatatcgatggcctggaaagcagatag

SEQ ID NO: 216845 - DNA, 1047 bp, Artificial Sequence
  Description of Artificial Sequence: Synthetic coding sequence
atgtccaagtgcgcacgcaagaaatacattaagaccaaccctagacagatgaccatggagacagtggagagccagcacgatgggtctataacagcgagcctgaccgagtcaaagtcagcccacgtgcaaacgcagaccgggcagaactccataccagccctggctcaagtgtccgttgcaggatccggcactcgcaggggcagccctgcagtcaccctggtgcaattgcccagcggacagaccatccacgttcagggtgttatccaaacacctcagccatgggtcatacagagctctgaaatccataccgtacaggtggcagccatcgctgaaacggacgagagcgcagaaagtgagggcgtgatcgactcacacaaacgcagggaaatcctgtcgcgcagaccatcttacagaaagatcctgaatgaactgagcagcgatgtgcccggagtgccaaaaattgaagaagagaggagtgaagaagaaggaacaccgccttccattgccaccatggcggttcccacatccatctaccagacgtcaactggccagtacattgctatcgctcaggggggaactattcagatctccaatcctgggagcgacggtgtccagggacttcaggccctgactatgaccaactctggcgctccacccccaggagccaccattgtccagtatgctgctcaatccgcggatggcacccagcaattcttcgtccccggatcccaggtcgtagtccaggcggctacaggagacatgccaacttatcaaatacgagcacccactgcggctctcccgcagggggtggtcatggccgcatcacccggatctttgcactcacctcagcagttggctgaggaggcaactcgcaagcgggagctgagactcatgaagaaccgggaagcggcaagggaatgtagaagaaagaaaaaggaatacgtcaagtgcctggagaatagggtggcagtactagagaatcaaaataagacactgatcgaagagttgaaggccctcaaggatttgtactgtcataaggtagagtag

SEQ ID NO: 216846 - DNA, 900 bp, Artificial Sequence
  Description of Artificial Sequence: Synthetic coding sequence
atgagtaaatgcgcacgcaagaaatacatcaagaccaaccccaggcagatgactatggagacagtggagtctcaacacgacgggtcgattactgccagcctgacagaaagtaaatcagcacacgtgcagacacagacagggcaaaatagcatcccagctcttgcccaagtggctgctatcgctgagaccgacgagtcagccgaatcagagggagtcattgactctcacaagagacgtgaaatactctcacgacgcccatcttaccgtaaaatacttaatgaattatcaagtgacgtccccggtgttcccaagatcgaggaagaaaggagcgaagaagaggggacccctccgagtatcgccactatggcagtgcccacctccatctatcaaacttccacagggcaatatattgccatcgcgcagggcggaacaatccagatcagcaacccgggatctgatggcgtgcaaggtctgcaggcactcaccatgactaattcaggtgcccctcctccaggggctaccatcgttcagtacgcggctcagtccgccgatggaacccagcagttctttgttcctggcagccaggtggtcgtccaggccgcaacaggcgatatgcccacctatcagatcagagccccaaccgcggctctgccacagggcgtggtcatggcagcctcccctgggagcctgcattccccccaacagctggcggaggaagcaacccgcaaaagagagctgaggttgatgaaaaatagggaagcagctcgcgaatgcagacggaaaaagaaggagtacgtgaagtgtctggagaacagggtggccgtgttagagaaccagaacaagaccctaattgaggagttgaaggccctgaaggatctctactgtcataaggtggaatag

SEQ ID NO: 216847 - DNA, 738 bp, Artificial Sequence
  Description of Artificial Sequence: Synthetic coding sequence
atggtggcagccatcgccgaaacagatgaatccgcagagtctgaaggagtcattgactctcacaagaggcgcgagattctctctcggagaccatcatatcgcaagattttgaacgagctgtcttccgatgtgccaggcgtgccgaaaatagaggaggaacgctcagaagaagaaggaacccctccatcaattgctactatggctgtccctaccagcatttatcagacttctaccggtcagtacatcgcgatcgcacagggcggaactattcagatctccaatcccggatctgatggggtgcagggactccaagccctgaccatgacaaacagtggcgcacccccaccaggagccacaattgttcagtacgctgcccagtccgccgatggcacgcagcagttcttcgtgcctggttctcaggtcgtagtgcaggctgcaacgggggacatgcccacatatcagatcagagcccctaccgctgcactgcctcagggcgtcgtgatggccgcatctccagggagcctgcactctccacagcagctggctgaagaagccacaagaaagagggaactgcgcttaatgaaaaatcgcgaggccgcaaaagaatgtcgcaggagaaaaaaggaatatgtgaagtgtctcgagagccgtgtggccgtgctggaggtacagaacaaaaaattgattgaagaactggaaacattaaaggatatctgcagcccaaaaacagattactag

SEQ ID NO: 216848 - DNA, 288 bp, Artificial Sequence
  Description of Artificial Sequence: Synthetic coding sequence
atgcccacctaccagatccgcgctcccacagcagcactcccacagggtgtggttatggcagcctctcccggttctctccactctccacagcaactggctgaggaggctacccggaagcgcgaattacggctgatgaagaatagggaggccgcacgggagtgtaggaggaagaagaaagaatacgtaaagtgcctggagaatagagtcgcagtgctcgagaatcagaacaagacattgattgaagagcttaaagcacttaaggacctatattgtcacaaggtcgagtag

SEQ ID NO: 216849 - DNA, 903 bp, Artificial Sequence
  Description of Artificial Sequence: Synthetic coding sequence
atgtccaagtgtgcgaggaagaaatacattaagaccaaccccagacagatgacgatggaaaccgtggagagtcaacacgatggatcaatcacagcctcgcttaccgagtccaagtcagcccatgtccagacacagacaggacagaactccatccccgcactggctcaggtggcagccatcgcagaaactgatgaaagcgctgaatcagagggggtgatagattcccataaaagacgagaaatcctgagccggcgacctagttacaggaagatcctgaacgaactgagtagcgatgtgccaggcgtacctaaaatcgaggaagaaagaagtgaggaggagggaaccccgccatctattgccaccatggcagtcccgacttccatctatcaaacatctacagggcagtatattgcaattgcccagggaggtaccatccagatctcaaaccctgggtcagatggcgtacagggattacaagccctgactatgacgaattctggggctcctcctcctggagcaaccatcgtacagtacgccgcacagagtgccgacgggactcaacaattttttgttccaggctctcaggtcgtcgttcaggcggctactggtgatatgccgacctatcagatcagagcgccaactgccgcactcccgcagggcgtagtgatggccgctagccccggtagtctgcacagcccacagcagttggccgaggaggctacccgcaagagagaattgagactgatgaagaatagagaggccgctaaagagtgccggaggcggaagaaagagtatgttaaatgtctcgagtcacgggtggctgtgttggaagtgcagaataaaaagctcattgaagagctggagacactgaaggatatatgctcgccaaagaccgactactag

SEQ ID NO: 216850 - DNA, 666 bp, Artificial Sequence
  Description of Artificial Sequence: Synthetic coding sequence
atgactatggaaactgttgagtcgcagcatgacggttcgattaccgccagtctcacagaaagcaaatccgcccacgttcagacgcagacgggccaaaacagcattccggctctggcccaggtggccgcaatcgccgaaactgatgagtcggcagagagcgaaggtgtgatcgatagccataaacggagagagattctctccaggcgacctagttaccggaaaatccttaacgagctgtcctcggacgtgcccggagtgcccaagatcgaggaggagcggtctgaggaggaaggaacccccccatccattgccaccatggccgtacctaccagcatataccagacatctacaggccaatatactgcaaccggagacatgccgacttatcagatcagagctcctacggctgcccttcctcagggagtcgttatggccgctagccctggtagcttgcacagcccgcagcagctggcggaggaagctacccggaagcgtgagttgagactcatgaagaatagagaggctgccaaagagtgtcgtagacggaaaaaagaatacgtgaagtgcctcgaaagcagagtggccgttctcgaggtgcagaacaagaagctcatagaggagctggaaactctgaaagatatttgtagtccaaaaactgattactag

SEQ ID NO: 216851 - DNA, 747 bp, Artificial Sequence
  Description of Artificial Sequence: Synthetic coding sequence
atgagtaagtgtgcccgtaaaaagtatattaagactaacccccgacagatgactatggagacagttgagagccagcacgatggtagtattaccgcatcactcaccgagtccaagtcagcacatgttcagacgcaaaccgggcagaatagtatccccgctctagcgcaggtggccgctattgccgaaactgacgagtctgccgagtctgaaggggtgatcgactcccataagcgcagagagatactttcacgcagacccagttacagaaagatcctcaatgagttgtcttccgatgttccaggtgtgcctaaaatcgaggaggagaggagcgaggaggagggaactccgccatctattgcgaccatggcagtgcctacctctatttaccagacttctaccgggcaatacaacgaagaaaccgaactggcccctagccatatggccgctgctacaggagacatgccgacttaccagatccgcgcacccacagctgctctcccccagggagtcgtaatggctgcgtctcctggatccctgcattccccgcagcagttggctgaggaggccacaagaaagagagagttacgtctgatgaagaatagggaggccgcaagagagtgtcgtagaaagaagaaggagtacgtgaagtgtctggaaaatagggtggctgtgctggagaatcaaaataagacacttatcgaagagctcaaagcacttaaagacctttactgccacaaagtcgagtag

SEQ ID NO: 216852 - DNA, 327 bp, Artificial Sequence
  Description of Artificial Sequence: Synthetic coding sequence
atggctgtgactggggatgatacagccgctacaggggatatgccgacttatcaaattcgtgcaccaactgctgctttgccacagggggtggtgatggccgcaagcccagggagcctgcatagcccccagcaactcgcggaagaggccacccgtaagcgagagctccggctgatgaagaaccgcgaggctgctcgggagtgcaggcggaagaagaaggagtacgtcaagtgccttgagaatagagttgcagtgctcgagaatcagaataagacattgatagaggagttgaaagctttgaaagacctatattgtcacaaggtcgagtag

SEQ ID NO: 216853 - DNA, 813 bp, Artificial Sequence
  Description of Artificial Sequence: Synthetic coding sequence
atgtggtggcatcagcacaatctgtgctttcggaggccaatcgaagaagactatagttccggcgacgtggaagaaaaagtcgcggcaatagccgaaactgatgagtcggccgagagtgaaggggtcatcgatagccacaagcgtcgcgagatcctgtccaggaggccttcttataggaagattcttaacgagctcagctccgatgtgcccggagtgcctaaaatagaagaagagcgcagcgaggaggaaggaaccccccctagcatcgctaccatggctgtccctacctccatttatcagaccagcacaggccagtatatcgctatcgcccagggaggcaccatccaaatatcaaacccaggatcagacggtgtgcagggcctccaagctctgacaatgaccaatagcggtgccccaccgccaggtgccactattgtgcagtacgccgcacagtcagccgacggcacccagcagttttttgtgcccggtagccaggtggtagtgcaggctgctacaggggatatgccaacctatcaaattagggctccgaccgcagccttgcctcagggggtagtgatggccgcatcaccaggcagtctacatagtccccagcaacttgcggaggaagccacccgaaaaagggaactcaggctgatgaagaaccgcgaagcggctaaagaatgccgtcgcagaaaaaaagagtacgtgaagtgtttggagagccgagttgcggtgctggaggtgcagaataagaaactgattgaagaactcgaaactctgaaagacatttgttctccaaaaactgattattag

SEQ ID NO: 216854 - DNA, 999 bp, Artificial Sequence
  Description of Artificial Sequence: Synthetic coding sequence
atgactatggagaccgtggagtctcagcacgacggcagtatcaccgcgtctttgaccgaaagcaagagcgcgcacgtgcaaacacagacggggcagaattcaattccagcactagcgcaagtcagcgtcgcaggctcaggcacccgcaggggctcacctgctgttacgctcgtgcagctgccgtcaggtcaaaccatacacgtccagggtgtaattcagacccctcagccttgggtcatccagtccagcgagatccacaccgtgcaggtcgcagctatcgcggagacggatgagagcgcagaaagtgaaggcgtgatagactcacataagagacgtgaaatcttgtccagaagaccaagttaccggaaaattctaaatgagttgtcatctgatgttcccggagtccctaaaatcgaggaggagcgttcagaggaggaaggcacccccccaagcatcgctacaatggcggtgcctacatcaatatatcagacaagcaccggacagtatatcgcaatagctcagggaggcactatacagatcagtaaccctggtagtgatggtgtacaaggacttcaagccctcaccatgaccaactccggtgcaccaccacccggagcgactatcgtacagtacgcagcccaatctgctgatgggacacagcagttttttgtcccagggtcgcaggtggttgttcaggctgctacaggcgacatgcccacgtatcagatccgggctcccaccgccgctttaccacaaggtgtggttatggctgcatcacctggttccctgcacagtccccaacagctggccgaggaagctacgagaaagcgcgaactccggctcatgaagaaccgcgaggctgccagagaatgtcgcaggaagaaaaaagagtacgtgaagtgcctcgagaatagggttgccgtgctggaaaatcaaaataagacactgattgaggagctcaaggcccttaaagacttatattgccacaaagtggagtag

SEQ ID NO: 216855 - DNA, 1002 bp, Artificial Sequence
  Description of Artificial Sequence: Synthetic coding sequence
atgaccatggagaccgtagaaagccaacacgacggatctatcactgccagtctcaccgaaagtaaatcagcgcatgtgcagacacaaacaggacagaattccatccccgctctagcacaggtgagtgtggccggaagtggcactcgtcgaggttcaccggcagtgaccctggtccaactgccatccggccagacaatacacgtgcaaggagtcatacagaccccccagccttgggtgatccagagttctgagatacacacagtccaggtggcagcaatcgcggagaccgatgaaagtgctgagtcagaaggggtgatcgactcgcataagcgtagagagatcctgagtagacggccttcctaccgtaagattctgaacgaacttagctctgatgtacccggtgtgccaaagattgaggaggagcgctctgaagaggaagggactccacccagcatcgccactatggccgtgcccactagcatttaccaaacaagcaccggtcagtatattgcaattgcgcagggaggcacgattcaaatctctaacccgggttcagatggagtacaaggactgcaggccctcaccatgaccaactcaggcgctccaccccctggcgctactattgtgcaatatgccgcacagtcggctgacggcactcagcaattttttgtgccagggagccaggtggtcgtgcaagctgcaacaggcgacatgccaacatatcaaatcagggccccaaccgccgctctgccacaaggggtggtaatggcagccagcccgggatctctacatagcccgcaacagcttgcagaagaagccaccaggaaacgggaactccggctgatgaaaaaccgcgaagctgctaaagaatgtcgaaggcggaaaaaagagtacgtaaagtgcctggagtcccgcgtggcggtcctggaagttcagaataagaagctgatcgaagagctggaaacactcaaggacatttgctcccccaaaacagactattag

SEQ ID NO: 216856 - DNA, 414 bp, Artificial Sequence
  Description of Artificial Sequence: Synthetic coding sequence
atgactatggaaactgtcgagtcccagcacgatggtagtatcaccgccagcctgacagaaagcaagtctgcgcatgtgcagacccagaccggccagaattcaattcccgcattggcgcaggtagccgctattgctgagacagatgagtcagccgaatcagaaggggtgatcgattcccacaaaaggcgagagatactgtctcgccgaccatcctacaggaagatactaaatgaattatcaagtgatgtccccggtgtacccaagatcgaggaggaacgatcggaggaggagggcaccccccctagcatagcaacgatggccgtgcccacctccatctaccagacttctacaggacagtactccatgtacgctgcgattcggtacgataccgtgttggccctgtccctgctttag

SEQ ID NO: 216857 - DNA, 666 bp, Artificial Sequence
  Description of Artificial Sequence: Synthetic coding sequence
atgactatggagaccgtggagtctcagcatgacggaagcattacagcctctcttactgagtccaaatccgcgcatgttcagacgcagaccgggcagaactccatcccagccctggcacaggtagccgctattgcagagactgacgaatcggcagagtccgagggagtgatcgactcccacaagcgccgtgagatcctatccagaaggcctagttacagaaaaatcctcaatgaattgtcaagcgacgtcccgggtgtacccaaaattgaagaggagagatctgaagaggaaggcacacccccatccatagccacgatggcagtacctacctctatctaccaaacttcaacgggccagtacaccgcaacaggagatatgcccacctatcagattcgggcacctactgcagctctcccgcagggggtggttatggccgcttcacccggaagcctacattccccccagcagctcgcggaggaggccacccgcaaacgggaactgaggctgatgaaaaacagggaggccgctaaggaatgtcggcgaaggaaaaaggaatacgtcaaatgtttggagagccgggtggcggtattagaagtccagaacaaaaaactcatcgaggagctggagactctcaaggacatctgtagccctaagactgactattag

SEQ ID NO: 216858 - DNA, 711 bp, Artificial Sequence
  Description of Artificial Sequence: Synthetic coding sequence
atgtccaagtgtgccagaaagaaatacatcaaaaccaatccgcgacagatgactatggagaccgtggagtcgcaacatgatgggtctatcaccgccagtctaacagaatctaagtcagcccacgtccaaacgcagaccggacagaatagcatacccgctcttgctcaagtagccgcaatcgctgaaaccgatgagtctgccgagtcagaaggagtaattgattcccacaagcggagggaaatactgtctagacgtccctcttaccgaaaaattcttaacgagttatcatcagacgttcctggcgttcctaaaatcgaagaagagaggtcagaggaggagggcaccccaccgagcattgcaaccatggctgtcccaactagtatctatcagacctctacaggccagtacaccgccaccggcgacatgcctacataccaaattcgtgcccctaccgccgcactgcctcaaggtgtggtcatggcagcttcaccaggctctctccactctccccagcagctggccgaggaagccacaagaaagcgtgagctgagactgatgaaaaatagagaagctgctcgagaatgcaggagaaaaaagaaggagtacgtgaaatgccttgaaaatcgggtggcagttctagaaaatcagaataagaccctgatcgaggaacttaaagcattaaaagacctctattgtcataaagtagagtag

SEQ ID NO: 216859 - DNA, 849 bp, Artificial Sequence
  Description of Artificial Sequence: Synthetic coding sequence
atgtggtggcaccaacacaatctctgctttcgccgaccaattgaggaggattacagttccggagacgtggaggaaaaggtggccgctatcgccgaaactgatgaaagtgcagagtctgagggggttattgatagtcataagagacgggaaatcctgtcccgtagaccatcataccgcaagatcctgaacgagctctcctcggacgtgccaggagtgccaaagatcgaggaagaaaggagcgaggaggagggaacacccccttcgatcgctactatggcggtgccaacgagtatctaccagacgtccaccgggcagtacatagcaattgcacaggggggaaccatccaaatctctaaccctggtagcgacggggtccagggcctgcaggccctaaccatgacaaactctggggctccacccccaggcgctaccattgttcagtatgccgctcagtctgccgacgggacacagcagttctttgtcccaggctcccaggtggtagtacaggacgaagaaacggagctggctccaagccatatggctgctgctacaggggatatgcctacttaccagatccgagcacctacagccgctcttccacagggggtagtgatggcggctagtccgggatccttgcactctccgcagcaacttgctgaggaggcgaccagaaagagggagctgagactgatgaaaaaccgcgaggccgctaaggagtgcagaagacggaagaaggagtatgtaaaatgtctcgaaagcagggtggccgttctcgaagtccagaacaagaaactgattgaggaattagagactcttaaggacatttgctccccgaagacagactactag

SEQ ID NO: 216860 - DNA, 1086 bp, Artificial Sequence
  Description of Artificial Sequence: Synthetic coding sequence
atgtccaagtgtgccaggaagaagtatatcaagactaaccctagacagatgactatggagacggtggagtcgcaacacgatgggtccattaccgcttcacttacagagtctaagagcgcccacgttcagacacagaccggccaaaactccattccagccttagctcaagtgtcagtagcaggatctggaacaagaagaggaagcccagcagtgactcttgtgcagctgccgagcggacagaccattcacgtgcagggcgtaatccaaacgccacagccttgggtcatccagtcgtcagagatccatactgtgcaagtggccgctattgcggaaaccgatgagtctgctgagagcgaaggcgtgattgactcacacaaaaggcgagagattcttagtcgtaggcctagttaccgaaaaattctgaacgagctgtctagcgacgtgcctggtgtaccaaagatagaggaggaacgctccgaggaggaaggaactccaccttcgattgccacgatggcagttccaacaagtatttatcagaccagcacggggcagtacatagcaatcgcccagggcggtacgatccagattagcaaccccggttctgatggcgtacaggggctacaggctctaacaatgaccaactccggagcccctccgccaggcgctacaatagttcaatatgccgctcagagtgcggacggaactcagcagttcttcgtcccgggttcccaggtggtggtgcaggatgaagaaactgaattagccccatctcacatggctgccgctaccggcgatatgcctacctatcaaatccgggctcccactgcagccctgcctcagggtgtggtcatggcagcatcgcctggctccctgcactctcctcagcagctagcagaagaagccactcgcaaaagggagctgagactcatgaagaatcgtgaagcagcaaaagagtgccggcgacggaagaaggaatatgttaagtgtttggagagtcgcgtcgcagtgctagaggtacagaataagaagctcattgaagagctcgagacccttaaggatatttgcagccccaaaacagactactag

SEQ ID NO: 216861 - DNA, 474 bp, Artificial Sequence
  Description of Artificial Sequence: Synthetic coding sequence
atgagcaagtgtgccaggaaaaagtatataaaaacaaaccctcggcagatgacgatggagaccgttgagtcccagcatgacggtagcataacagcctcactgactgaaagtaagtcggctcacgttcagactcagaccggacagaactcaattccagcgctcgcacaggtcgccgcaatcgctgagactgatgagtcggcggaatctgaaggcgtgatcgactctcataagaggcgggaaatcttatcgcgcaggccctcctaccgaaagatcctcaacgagctgtctagtgacgtcccgggagtgcccaagatcgaggaggaaaggtccgaggaggaaggaacccctccttccattgctacaatggctgtgccaactagtatttatcagactagcacgggccagtacattgccatagctcaggggggaaccattcagatctctaatcctggctctgacggtgtccaagggtag

SEQ ID NO: 216862 - DNA, 1038 bp, Artificial Sequence
  Description of Artificial Sequence: Synthetic coding sequence
atgaccatggagacggtcgaatcgcagcacgacgggagcattaccgccagcctgactgaatctaaaagcgcccacgtccagactcagaccggccagaactctatcccagctctggcccaggtatcagtggctggtagcggaacaaggcgagggagccctgccgtgacactggtgcagctgccctccgggcagactattcatgtccaaggggtgatccagaccccacaaccctgggtcattcagtctagtgaaatccacacagttcaagtggctgcgatcgccgagactgatgagtccgcggaatctgaaggtgtgattgactctcacaaacgcagagagatactgagccgccgtccctcctatcgcaagatcctgaatgaacttagcagcgacgtcccgggagtgcccaagatcgaggaggagcggagcgaagaggagggtaccccacctagtattgccacgatggcagtgccaacttcaatttaccagacctccacaggtcaatatatagctatagcccaagggggtactatccagatttccaatcctgggtccgacggcgtccaaggcctgcaggccctaactatgaccaattcaggggcaccacctcccggagccacgattgtccaatacgcagcccagagcgcagatggaacccagcagtttttcgtgcccggatcccaggtcgttgtgcaggacgaagaaactgaactcgccccttcccatatggccgcagcaactggcgacatgccaacttaccagattcgcgctccgaccgctgcactaccacaaggggttgtgatggcggcaagtccaggcagcctgcatagccctcaacagctagccgaggaggcaacaagaaaaagagaactacggctgatgaagaaccgcgaagctgcaaaagaatgtcgtagacggaaaaaggagtacgtcaagtgcctcgaaagtcgtgtagcagtcttagaggtccaaaataagaagctgatcgaggagttggagaccttgaaggatatttgttcaccgaagactgattattag

SEQ ID NO: 216863 - DNA, 858 bp, Artificial Sequence
  Description of Artificial Sequence: Synthetic coding sequence
atgtctaaatgcgcccgtaagaagtacataaaaacgaatccaaggcagatgacaatggaaactgtggaaagccagcatgacggttcaattaccgccagtctcactgagtctaaaagcgcccacgtgcagacccaaaccggacagaatagtatcccagctctggcccaagtgagcgttgccggatctggcacaaggaggggcagcccagccgtgacactggtgcagttaccaagcggacaaactatccacgtgcaaggcgtgattcaaacaccccagccgtgggtgatacagtcgtcagagattcataccgtgcaagttgctgccatcgctgaaactgatgagagtgccgagtcggagggggtgatcgatagtcacaaaagaagagagattttgtctagacgtccaagttaccggaaaatcctgaacgagctttcgtctgatgtccccggagtgcctaaaattgaggaggaaaggtccgaggaggaaggcacgcctccttctattgcgactatggccgttcctacaagcatctaccagaccagcacagggcaatacactgcaaccggagacatgccaacttatcaaatcagggctcctaccgccgcactccctcaaggcgttgtgatggcagcctcaccgggaagcctgcactccccgcaacagttggctgaagaggccacacggaaacgagaacttcgtctgatgaagaatagagaggccgctagagagtgccgaagaaagaagaaggagtacgttaaatgcctggagaaccgtgtggccgtcttggagaaccagaacaagacacttattgaggagctcaaggccctgaaagatttatactgtcataaggtggagtag

SEQ ID NO: 216864 - DNA, 288 bp, Artificial Sequence
  Description of Artificial Sequence: Synthetic coding sequence
atgcccacctatcagattagggctccgacagccgctctgccccaaggagtggtcatggccgcaagtccgggaagcttgcattctccacagcagttggccgaggaggctactcgtaaacgcgaactaagacttatgaagaatcgcgaggccgctcgcgagtgccgcaggaagaagaaagagtatgtgaaatgccttgagaaccgagtggcagtgttagaaaaccaaaataagaccctgattgaagaactgaaagccctgaaagacctctattgtcacaaagtggaatag

SEQ ID NO: 216865 - DNA, 810 bp, Artificial Sequence
  Description of Artificial Sequence: Synthetic coding sequence
atgacaatggaaacagtcgaatcccaacatgatggatccattacagcaagcttgaccgaaagtaagagcgctcacgtgcaaacccagactggtcagaattccatacctgctctggctcaagtgagtgtcgcaggatcaggtactagacgaggttcacctgcagttacactggtccagttaccgtccggccagacaattcacgtccagggagtcatccagacaccccagccatgggttatccagagcagcgagattcatactgtccaggttgcagcgatagctgagaccgatgagagtgctgaaagcgagggcgtgatagattcccacaaacgacgcgaaattctgtctcgccgtcccagctataggaaaattctgaacgaattgtcctccgacgttccaggtgtcccaaagatcgaggaggagagaagcgaagaagagggcacccctcccagcatcgcgactatggccgttcccaccagtatctaccaaaccagcaccgggcagtatactgcaaccggagacatgccaacctaccaaattcgggcacccactgctgcattaccccagggagtggttatggccgcatcaccagggagcctgcactcccctcaacagttagccgaggaggcgacacgcaagcgggagctccgcctcatgaagaaccgggaggccgctagagagtgtagacggaagaagaaggaatacgttaaatgtctggagaatagggtggccgtattagagaaccagaataagaccttgatcgaagaattgaaagcccttaaggacctctactgccacaaagtggaatag

SEQ ID NO: 216866 - DNA, 585 bp, Artificial Sequence
  Description of Artificial Sequence: Synthetic coding sequence
atggtggctgctattgccgaaacagacgaatccgctgaatccgagggagtcatcgacagccacaaacgaagggaaatcctgagccgccgaccaagctatagaaaaatcctgaatgaactgagctcagacgtgccgggagtgcctaagatcgaggaagagcgctcggaagaagagggcacacctccttccatcgccaccatggctgttcccactagtatttaccaaactagcactggtcaatacaacgaagaaaccgagctcgccccaagtcacatggcggctgctacaggagatatgcccacctaccagatcagggcaccaacagccgctctcccccagggagttgtaatggctgccagcccgggtagtctccactcaccccagcagctcgccgaggaggccacaagaaagcgcgagctgagacttatgaagaatcgggaagctgctaaggagtgcagacgtaggaagaaggagtacgtgaaatgtttggagtcacgcgttgctgtactggaggttcagaataagaaattaattgaagagttggagacacttaaggatatttgttcccctaaaacagactactag

SEQ ID NO: 216867 - DNA, 363 bp, Artificial Sequence
  Description of Artificial Sequence: Synthetic coding sequence
atggcagtcacaggggatgatacagacgaggagaccgaactggcaccgtcccacatggccgcagcgacaggcgatatgccaacctatcagatccgagctccaaccgccgctctgccccagggcgtagtgatggccgcttccccaggctctctgcattccccccagcagctggcagaagaagcgactagaaagcgggaactccggctgatgaagaacagggaggccgcaagagagtgtcggaggaaaaagaaggagtatgtaaaatgcctagaaaatagagtcgctgtgctggaaaaccagaacaagacgttgatcgaagagttaaaggcactgaaggacctctactgtcacaaggtggagtag

SEQ ID NO: 216868 - DNA, 291 bp, Artificial Sequence
  Description of Artificial Sequence: Synthetic coding sequence
atgcctacttaccaaatcagagctccgaccgccgctctcccccaaggcgtcgtaatggccgcatcccctggctccctgcacagtcctcagcagttggcagaagaggccactcggaagcgggagcttaggctcatgaagaatagggaagctgcaaaggagtgtcgcaggaggaaaaaagagtacgtgaaatgcctagaatcaagggtggcggtcctggaggtgcaaaataaaaaattgattgaggaattggaaaccctgaaagatatttgtagccctaaaacagattattag

SEQ ID NO: 216869 - DNA, 339 bp, Artificial Sequence
  Description of Artificial Sequence: Synthetic coding sequence
atgaacaggacacaggaactgtccggacaactaagcgccgcaactggagacatgcccacgtaccagattcgagcaccgacagcagccctgccccaaggagttgttatggctgcgagccccggatcgttacacagcccacagcaattggctgaggaggcaactcggaaaagagaactccggttaatgaagaatagagaagctgccagagagtgccgccgtaaaaaaaaggagtatgtgaagtgtctggagaaccgcgtagcagtgcttgagaatcagaataaaactttgatagaggagttgaaagccctcaaggatttatattgccataaagtggagtag

SEQ ID NO: 216870 - DNA, 939 bp, Artificial Sequence
  Description of Artificial Sequence: Synthetic coding sequence
atgagcaagtgcgccagaaagaagtatatcaaaacgaatccacgccaaatgaccatggagactgtcgagtcgcaacacgacggttcaataactgcctctttgaccgaaagtaagtcagctcacgttcagacgcaaacagggcaaaattccatacccgctcttgcccaggttgccgcaatagcagagaccgacgagtcagcagagtccgagggcgtgatcgactcccacaaaaggcgggagatcttaagtcgcaggccgagttacagaaagatactaaatgagttatcatccgacgtcccaggcgtgcctaagattgaagaagagcgttctgaagaggaggggactcccccaagcatcgctactatggcggtgcccacctctatctaccagacctctacaggacagtacatcgccatcgcgcaggggggaaccatccaaataagcaatcccggttccgatggggtacagggattgcaggccttgacaatgaccaactctggcgctccacctcctggtgccaccattgtacaatacgcagctcagtcagccgacggtactcagcagttctttgtaccaggttcacaggtggtagtgcaagatgaagagaccgagttagctccctctcacatggccgctgccacaggggacatgcctacttaccagattagagccccaactgctgcactgccacaaggggtggtgatggctgcttcccctggcagcctgcattcgccacagcaattggcagaggaagcaactcgaaaacgcgaactgaggctgatgaagaaccgggaagctgccaaagaatgtcgtaggagaaagaaggagtacgtgaaatgtctggagtcacgggtggccgtgcttgaagttcagaacaaaaaactgattgaagagctggaaacgcttaaagatatttgctcccctaagaccgattactag

SEQ ID NO: 216871 - DNA, 660 bp, Artificial Sequence
  Description of Artificial Sequence: Synthetic coding sequence
atgtggtggcaccagcacaatctatgctttagaagaccgattgaagaagattacagttccggagacgtcgaggaaaaggtagctgcaattgcggaaaccgacgaatctgccgaaagcgagggggtgatcgattcacacaaacggagggagattcttagtcggcgtccgtcctaccgcaagatactcaacgagctctccagcgacgtacctggagtgccaaaaatcgaggaagaaagaagtgaggaggaaggcactcctccatccatcgctacaatggccgtgcctactagtatataccaaacctctacaggtcagtataatgaagaaactgaactcgcgccttcgcacatggctgcggctacaggggatatgcccacctaccagattcgcgctccaaccgctgcccttcctcagggggtcgtgatggccgcatcccccggaagcctgcactctccacagcagctcgccgaggaagctacccgtaagcgagagctgaggctgatgaagaatagggaggctgccaaggagtgcagacgtaggaagaaagaatacgtgaaatgtctggagtctagagtagccgtattagaggttcagaataagaaacttattgaggagctggagactctaaaggatatctgctccccaaagacggattattag

SEQ ID NO: 216872 - DNA, 366 bp, Artificial Sequence
  Description of Artificial Sequence: Synthetic coding sequence
atggcagtgactggcgacgacacggacgaagagactgagctggcaccatcacacatggctgccgctacaggggacatgccaacataccagatcagagcgccaactgcggcactacctcagggcgtggttatggccgcttctcccggaagcctccattccccgcaacagctggcagaggaggctacaaggaagagggaactgcgtctgatgaaaaatcgcgaggcggcaaaagagtgtcgcagaagaaaaaaagaatacgtcaagtgccttgaatccagggtggccgtgctcgaagtccagaacaagaaactaatcgaagagctggagacactcaaggatatatgcagtccaaaaactgattattag

SEQ ID NO: 216873 - DNA, 330 bp, Artificial Sequence
  Description of Artificial Sequence: Synthetic coding sequence
atggctgtcacaggcgacgacactgccgctaccggagatatgccaacctatcagatccgagcccctacagccgctctgccacagggcgtggtgatggccgcatcaccaggcagccttcatagtccccagcaattggccgaggaggccacccgtaagcgagaactccgactcatgaagaatcgcgaggcggcaaaggagtgccggcgtcgaaagaaagaatacgtcaagtgtctagagtctcgggtggctgtcctcgaagtgcagaataagaaattgatcgaagagttggagaccctgaaagatatttgcagcccaaaaacagactattag

SEQ ID NO: 216874 - DNA, 309 bp, Artificial Sequence
  Description of Artificial Sequence: Synthetic coding sequence
atggccgcagcgacaggggacatgcctacctatcagattcgcgctcctactgccgcattgcctcaaggagttgttatggcagctagccctggaagcctgcattctccccaacagctggccgaggaggcaaccaggaaacgggaattgcgtctcatgaagaaccgggaggccgctcgcgagtgcagacggaaaaaaaaggagtatgtaaagtgtctggagaacagagttgcagtgctcgaaaatcagaataagactctgatagaggaactgaaggctttgaaggatctctattgtcacaaggttgagtag

SEQ ID NO: 216875 - DNA, 414 bp, Artificial Sequence
  Description of Artificial Sequence: Synthetic coding sequence
atgactatggagaccgtggagtcgcagcacgacggttccatcactgcctctttgaccgaaagcaaatccgcgcacgtgcagacccagaccgggcagaactcaatccctgcactggcccaggtggctgccattgcggagacagacgaatcggcggagtcagagggagttatcgatagtcataaacgcagggagatcctgtccaggaggccaagctatagaaaaatactaaatgagctgagcagcgatgttccgggtgttcccaagatcgaagaggaaaggtctgaagaggaggggacaccaccatcaatagcaactatggccgtcccgacctctatctaccaaacctccacagggcaatacagcatgtatgctgccataaggtacgacacagtgctcgcactcagcctgctttag

SEQ ID NO: 216876 - DNA, 618 bp, Artificial Sequence
  Description of Artificial Sequence: Synthetic coding sequence
atgaccatggagacagtggagagtcaacacgatggaagtatcaccgcaagtctcacggaatctaaaagtgcccacgtccagacccagactggtcagaattccatacccgcactcgctcaggtggtggccatcgcccaggggggaacaattcagatcagcaatccagggagcgacggcgtgcagggccttcaggccctgactatgacaaactcaggcgcaccgcctcccggagcaacaatcgtacagtacgccgcacaaagcgcagacggcactcagcagtttttcgtgcccggttcacaggtggtcgtacaggcggcaacgggtgatatgccaacatatcagatcagggcgcctaccgcggctctgccccaaggggtggtgatggcagccagtcctggttcactccactctccccagcagttagccgaggaggccacacggaagcgagaattgcgactgatgaagaaccgcgaggcggctaaggaatgtaggagacgcaagaaagagtatgtgaaatgtctcgagtcccgggtggcagtattggaggttcagaataagaagctcatcgaagagctcgaaaccttgaaagacatttgcagcccaaagacagactattag

SEQ ID NO: 216877 - DNA, 813 bp, Artificial Sequence
  Description of Artificial Sequence: Synthetic coding sequence
atgaccatggagacagtcgagagtcaacacgatggctcgattaccgcatctctgaccgaatctaaaagcgctcacgttcagacccaaactggccaaaattcgattcctgccctggctcaagtgtctgttgcagggtcaggtacacggaggggttctccagccgttactcttgtccagctgccctctggccagacaattcatgtccaaggcgttatacagacgcctcagccttgggttatccagagtagtgaaatccatacagtgcaggtagcagctatcgccgagacagatgaaagcgctgagtcagaaggggttattgattcccacaaacggagggagatcctgtcccgcagaccgagctacagaaagattctgaatgaactgtcatctgacgtccctggcgtgccaaagattgaggaggaacgcagtgaagaagagggcaccccaccaagcatcgctaccatggcggtcccaacgtctatttatcagacctcaactgggcagtataccgctacaggagacatgcccacctatcagatcagggccccaacagctgcattgccccaaggagttgtcatggccgcttcacctgggtcacttcattctccgcagcagcttgcggaagaagccaccaggaaacgggagctccggcttatgaagaatagagaggctgccaaggaatgtcggcgaaggaagaaggaatacgttaaatgtttggaaagtcgagttgccgtgttggaagtgcagaacaagaaactcattgaggaacttgagaccttgaaagatatttgctcccctaaaactgactactag

SEQ ID NO: 216878 - DNA, 342 bp, Artificial Sequence
  Description of Artificial Sequence: Synthetic coding sequence
atgaataggacgcaggagctgagcggccagctctccgccgctaccggggacatgcctacttaccagatcagagcacccactgccgcactgccgcaaggagtcgtgatggccgcatcgcccggatcactccactcgccacaacagctggctgaagaagcaactcgaaaacgggagctcaggctcatgaagaatagggaggccgctaaggagtgccggagacgaaaaaaggaatatgtaaaatgtttagaatccagggtggctgtgttggaggttcaaaataagaagctcattgaagagctggagaccctgaaagatatatgttcaccaaaaactgattattag

SEQ ID NO: 216879 - DNA, 465 bp, Artificial Sequence
  Description of Artificial Sequence: Synthetic coding sequence
atgactatggagaccgttgagtctcagcatgatggcagcataacagcctccctcactgagtctaagtccgcccacgtgcaaacacagactggacagaacagcatcccagctctggcccaggtggatgaagaaaccgagctagcaccttcacatatggctgcagccacaggcgatatgcccacataccagataagggccccaacagctgcgctgccccaaggcgtcgtcatggcagcgtccccaggctcgctgcattcccctcagcagttagctgaggaggctacccggaagagagagttgcgactgatgaagaacagggaagctgcaaaggagtgccgtcgccgaaaaaaggaatacgtaaagtgcttggagagccgggtggcagtgttggaagttcaaaacaagaaactaatcgaagagctggagaccttgaaggatatttgctccccgaaaacagattattag

SEQ ID NO: 216880 - DNA, 339 bp, Artificial Sequence
  Description of Artificial Sequence: Synthetic coding sequence
atgagtgcggaggtacctgaggccgcatccgctgaggaacaaaaggagatggaagacaaggtgaccagtcccgagaaagctgaggaagctaagctgaaggctagatatccacatctgggtcagaagccgggaggttccgacttcctgcgaaagaggttacagaagggccagaaatatttcgactccggcgattacaacatggcaaaagccaagatgaaaaataagcagctacccacggccgctcctgataagacggaggtcaccggagaccacattcccacccctcaggacctcccccagaggaagccctctttggtcgcatccaagcttgctggctag

SEQ ID NO: 216881 - DNA, 1926 bp, Artificial Sequence
  Description of Artificial Sequence: Synthetic coding sequence
atgacggaaaagcctgaattccaatcgcaagtgtataattacgccaaagataacaacataaaacaggattccttcaaggaggaaaaccccatggagacctccgtctctgcaaatactgaccaacttggaaacgaatacttccggcagccccctcctcgcagtccccctctgatccattgttcaggagaaatgctgaaattcacagaaaagagtttggccaaatcgattgccaaagagtctgccctcaaccccagccagcctccctctttcctgtgtaagacagcagttcccagcaaggaaatacaaaactacggggaaattcccgagatgtccgtgtcatatgagaaagaggtaacagccgaaggagtagaacgcccagaaatagtgtctacgtggtcgagcgccggaatttcatggcgtagcgaggcatgtagggagaattgcgaaatgcctgactgggaacagagcgctgaatcattacagccagtacaagaggatatggcactaaacgaagtcctccaaaaactcaaacacactaacagaaagcaagaggtcaggatccaggagttacagtgttcgaatttgtaccttgagaagcgagtgaaagaactgcagatgaagattacaaagcagcaagtcttcatagatgtgattaataaattgaaagagaatgtggaggagcttatcgaagacaagtacaagattattctggaaaaaaatgataccaaaaagactctccagaatctcgaggaggttctcgcaaatactcagaagcacttgcaggagtcaaggaacgataaagagatgctccagctgcagttcaagaagataaaggctaattacgtgtgtctgcaagaacggtatatgacagagatgcagcaaaagaacaaaagtgtttctcagtacctcgagatggataaaaccctgagtaagaaggaggaggaggtggaacgcctccagcaacttaaaaaggagctggaaaaggcaactgcttctgctctcgatctgctgaagcgcgaaaaggaagcgcaggagcaagaatttttgagtctgcaggaggaattccagaaactggagaaagaaaatttggaggaaagacagaagctaaaatcacggctggagaagctgctgactcaggtgcgcaacctgcagttcatgagcgagaacgagcgaaccaagaatatcaaactgcagcagcagatcaacgaggtgaagaatgagaacgctaagctgaaacagcaggtggctagaagtgaagaacaaaattacgtacctaaattcgaaactgcccagctcaaagaccagctggaagaagtgctcaaatccgatataacgaaggacacaaagaccactcactcaaacctgctccctgattgctccccatgcgaggaacgtctcaatcctgcagatattaagagggcatcccagctcgctagtaagatgcatagtctattggcacttatggtagggctactgacctgccaggacatcattaattctgatgccgaacatttcaaagaatccgagaaggtgtcggatatcatgttgcagaaactgaaaagtctgcatctgaaaaagaagacacttgacaaggaggttatcgattgcgattcagacgaggccaagtcaattagggacgtcccaacgctccttggtgcaaagctagataaataccatagcctcaacgaggagctggattttcttgtcaccagctacgaagagatcatcgagtgcgcagaccagagactcgccatttcccattctcagattgcgcacctagaagagcgaaataagcacttggaagatctcatccgaaagccccgagaaaaggctaggaaacctaggtctaagtcattggagaaccatcccaagtccatgacaatgatgcctgccttattcaaagagaatcgaaacgatctcgattag

SEQ ID NO: 216882 - DNA, 2475 bp, Artificial Sequence
  Description of Artificial Sequence: Synthetic coding sequence
atgaataaggactaccagaaattctggagctcccctagtgaccctgtgcacttcgaagttgataccagccacgagaaggtggagtccatgagcgagtctgacactatgaatgtctccaacctgtctcaaggtgtaatgctctctcacagcccgatctgcatggaaaccacagggactacatgcgatctcccgcagaatgaaatcaaaaatttcgagcgggaaaacgagtatgaatcgaccttgtgcgaggatgcctacgggacgctggacaacctcctcaatgacaataatattgagaactatagcactaatgcactcattcagcctgttgacaccattagcattagttccctgagacagttcgagactgtttgcaagttccactgggtcgaggccttcgatgacgaaatgactgaaaaacccgaatttcaaagtcaggtctacaactacgcaaaggacaacaatatcaaacaggacagctttaaggaagagaatcctatggagactagtgtttctgccaacacggaccaattgggtaacgaatattttcggcagccgccaccaaggagtccacccctgatccactgctctggtgaaatgctaaagttcacagaaaagtccctagccaagagcattgcaaaggagtcggccctgaatccatcacaacccccaagtttcctgtgtaagaccgctgtgcctagtaaagagattcagaattacggagagattcctgaaatgtcagtatcttatgaaaaggaggtcacagccgaaggtgtcgaacgacctgagattgtttctacttggagctctgctgggataagttggcgtagcgaagcttgtagggaaaattgcgagatgcctgactgggaacagtctgcggaatcgctacagcccgtgcaggaggatatggccctcaatgaggtactgcagaaacttaaacacaccaaccgcaaacaggaagttaggatccaggaactccagtgttctaacttatacctggagaagagggttaaagagttgcagatgaaaattacaaaacagcaagtgttcatagacgtgatcaacaagctcaaagagaatgtcgaagaactaatcgaggataagtacaagattatcctcgagaagaatgacaccaaaaagaccttacagaatctggaagaggtgcttgccaacacacagaaacatctccaagagtcacgcaatgataaggagatgctgcagttgcagttcaaaaagattaaagctaactatgtgtgtctgcaggagcgatacatgactgagatgcagcagaagaacaagagcgtttctcagtacctagaaatggacaaaaccctatccaaaaaagaagaagaggtggagcggcttcaacaactgaaaaaggaacttgaaaaggcaacggccagcgccctagatttactaaagcgggaaaaggaggcacaggaacaggaattcctgagtctccaggaagagtttcaaaaattggagaaggaaaatttggaggaaaggcagaagctcaagagcagattagaaaagctgctgacccaggtgcgcaacctccagttcatgagcgagaacgagaggacaaaaaacatcaagctccagcaacagatcaacgaggttaagaatgagaacgcgaaactcaagcaacaagtggccagaagcgaggaacagaattatgtacctaagttcgagacggcccagctgaaggaccagcttgaagaagtgctaaaaagtgatattacaaaggatacaaagaccacacattccaacctgctgccggattgctccccttgcgaagaacggctgaaccccgcagatattaaaagggcaagccagttagcatctaagatgcactcccttctggcactcatggtgggactgcttacctgccaggacatcattaacagcgacgccgagcattttaaggaaagtgagaaagtgtctgacataatgctgcagaaactcaagtccctgcacctaaagaaaaaaacacttgataaggaacttttaaagcacaaggatcggattacaacgtttcgcgagctcatcgccaaggaaaaggcctttcaggatcacgccattaaagtgatcgactgcgattccgacgaagcaaaaagtatcagagatgtgcccactctgctgggagcaaaactcgacaaataccactcgttaaacgaggagctagactttctcgttacctcctatgaagaaatcattgaatgtgctgaccaacgcttggctatatctcacagtcaaatcgctcatttggaagagagaaataaacatctcgaggaccttattaggaagcctcgggaaaaggccagaaaaccaaggagcaaatctctggagaaccatcctaaatctatgaccatgttggcttataatctgtacatttttattggatatagactgggggctgttgcagacgcctgcaacccatctactttgggcggtagaggagggtggataacgtag

SEQ ID NO: 216883 - DNA, 2334 bp, Artificial Sequence
  Description of Artificial Sequence: Synthetic coding sequence
atgaacaaggattatcagaaattctggagcagtccatccgaccctgtgcacttcgaggtagatacatcacatgaaaaggtcgaaagtatgagtgaatccgataccatgaacgttagcaacctgtcccagggtgtgatgctcagccactcgcccatttgcatggaaacaaccgggaccacatgcgatttacctcagaacgaaataaagaacttcgagcgggagaacgaatatgagtccacactgtgcgaagatgcctacggtacacttgataatcttcttaacgacaacaatatcgagaactattccaccaatgccctgattcaacctgtggatacaatcagtatcagcagccttcgccagtttgagaccgtatgtaaattccattgggtggaagctttcgacgatgagatgacagaaaaacctgaattccagtcacaggtgtataactatgctaaggacaataacatcaaacaggactccttcaaagaagagaacccaatggagaccagtgtctctgcaaataccgaccaactcgggaatgaatatttcaggcagcccccaccccgaagcccgcctctgatccactgctcaggggaaatgctcaaatttaccgagaaaagtctggccaagagcatagcaaaggagagcgctcttaacccctcccagcccccttctttcctctgcaaaacagcagtcccgagcaaagagatacaaaactacggtgaaatacctgagatgtcagtgagttacgaaaaggaagtaacggcagagggcgtggaacgccctgaaattgtcagcacctggtcatctgcgggtatctcctggaggtcagaggcctgccgggagaactgcgagatgcccgattgggagcagagcgctgagtcattgcagccagtgcaggaagacatggcactcaacgaggtcctgcagaagcttaaacataccaaccggaagcaagaggtaagaatccaggaattgcagtgtagtaatctctacctcgagaagcgtgtgaaggaattgcagatgaagattacaaagcagcaggtttttattgatgttattaataagctgaaggagaacgttgaagagttgatcgaagacaagtataagattatcttagaaaagaacgatactaaaaagaccctgcaaaatcttgaggaggtattggctaatacacaaaaacacctacaggagtcaagaaacgacaaagagatgttacaacttcagttcaagaaaattaaagccaattatgtgtgcctacaggagaggtatatgacagaaatgcagcagaaaaataagagcgtgtcccagtacttggagatggacaaaacactttcgaaaaaggaagaggaggtagagagactacagcagctgaaaaaagagttggaaaaggccaccgcgagcgcgctggacctcctgaaaagggagaaggaggctcaagaacaggagtttctctctctgcaggaagagttccagaagctggagaaggagaatctggaggaaagacaaaaactcaaatcccgattagaaaagttactgactcaagtccggaacctgcaatttatgagcgaaaacgaacggaccaaaaacataaaattgcagcaacagattaatgaggtgaagaacgaaaatgcgaagcttaagcaacaggttgcacggtctgaggagcagaattacgtcccaaaattcgagaccgcccagctgaaggatcaacttgaagaagtgctgaaatcagatatcacaaaggatacaaagactacccacagcaacctactgcctgactgctctccgtgtgaagaacgtttaaacccagctgatatcaagcgcgcaagccagctcgcatcaaaaatgcattcgttgctggccctcatggttgggctgctcacatgtcaggatattataaattctgatgctgaacactttaaggagtccgagaaggtgtcagatatcatgcttcagaaactgaagtctctgcatctgaagaagaagacactcgacaaggaggtgattgactgtgatagcgatgaggcaaagtctattagggatgttcctacactgctcggcgctaaactggataaatatcattcccttaacgaggagctggatttcctggtgacctcctacgaggaaattattgagtgcgccgatcagaggcttgcaataagtcactcccagatagctcatctcgaagagcgaaataagcatttagaggatttgattagaaaacctagagagaaggctcgcaagcccaggtctaaaagcctcgaaaatcatcccaagagcatgacaatgatgcccgcactgtttaaggagaataggaacgacctcgactag

SEQ ID NO: 216884 - DNA, 2103 bp, Artificial Sequence
  Description of Artificial Sequence: Synthetic coding sequence
atgaacaaggattaccagaagttctggtcctctcccagcgatcctgtccactttgaggtggacacctcccacgagaaggtggaatccatgtccgagagcgacacaatgaatgtatctaacctgagccagggggtgatgttaagtcactcaccgatctgcatggagaccacgggcaccacatgtgatttgcctcagaacgagatcaaaaactttgaacgggaaaacgaatacgaatccactctttgtgaagacgcatacggcacactggataatttgttaaatgacaataatattgagaactacagcaccaatgccctgatacagcctgtcgacactatctccattagcagtctccgacaattcgagaccgtctgcaagtttcactgggtcgaggctttcgacgacgagatgacagagaagccagaattccaaagccaggtgtataactacgccaaggataacaatatcaagcaggactctttcaaagaagagaatcctatggagacctcagtgagcgcaaataccgaccaacttgggaatgaatactttcgacagcctcctccacgctcacccccactcatacactgcagtggggagatgctaaaatttaccgagaagtcactggccaagagtatcgccaaggaaagtgcccttaacccgagccagccacctagttttttatgtaaaactgctgttccctccaaagagatccaaaactacggggagatccctgagatgagcgtgtcttacgagaaagaggttacagccgagggagttgaaaggcccgaaatcgtgtccacatggtccagtgctgggatatcctggagaagtgaggcctgccgggagaactgcgagatgccagactgggagcagtctgcagagtcactccaacctgtccaagaagatatggcgctgaacgaagtactccaaaaattgaaacacacaaataggaagcaggaggtgcggatacaggaactccagtgttcaaatctgtacctcgaaaaacgggtcaaggagctccagatgaaaatcactaaacagcaggtgttcatcgacgtaatcaataaattgaaagagaacgtggaggagttgattgaggataaatacaagatcattctggaaaaaaatgacactaagaaaaccctccagaacctcgaagaagttctcgccaatacacagaaacacttacaggaatccagaaacgacaaggagatgctacagctccaattcaaaaagatcaaggcaaactacgtgtgcctccaagagaggtacatgacagaaatgcaacaaaagaacaagagcgtgtcacagtacttggaaatggataaaaccttgagcaagaaggaagaagaggtagagagactccaacaactgaagaaggagctggagaaagcaacagcctctgccttggacctgctgaagagggaaaaggaagctcaagaacaggagttcctgtccctgcaagaggagttccagaagttagagaaagagaacctcgaggagcggcaaaagctcaagtctcgcctcgagaagctcctaacccaggtgcgcaatctgcagttcatgagtgagaacgagagaaccaaaaacatcaagctgcagcagcagataaacgaagtgaaaaacgagaatgctaagctaaaacagcaagttgctagaagcgaggagcagaactatgtgcccaagttcgagacagcacagctcaaggatcagctggaagaagtactcaagtctgacataaccaaggacacaaaaactactcacagcaacctcctgcctgactgctccccatgcgaggaacgcctgaatcctgccgacattaagagagcttcccagttagcatccaagatgcactccttgctggccctaatggttgggctgctgacctgtcaagacattataaatagcgacgcagaacatttcaaagagtccgagaaggtatctgacatcatgctccagaaactgaaatcactgcacctaaagaagaagacactggacaaggagctgctgaagcataaggacagaattaccactttcagggaactgatcgctaaggaaaaggccttccaagatcatgccatcaaggtgtttcagggtgtctag

SEQ ID NO: 216885 - DNA, 2520 bp, Artificial Sequence
  Description of Artificial Sequence: Synthetic coding sequence
atgaataaagactaccagaagttttggagttctcccagtgatcccgtgcatttcgaggtggacacatcacatgaaaaagtcgaatccatgagtgagtcggacactatgaatgtcagcaaccttagtcagggagtgatgctcagtcactctccaatctgtatggagaccacaggcacgacctgcgatctgccccaaaacgagatcaagaatttcgaacgagaaaacgaatatgagtcaacgttatgtgaagacgcctacggaacactggacaacctgttgaatgataataatatcgagaattacagtactaacgccttgatacaaccagtggataccatctctatcagctcactcagacagttcgagaccgtctgtaagttccactgggtggaagccttcgatgacgagatgacagaaaaaccagaattccaaagccaggtgtataattatgcgaaagacaataacatcaaacaggattcttttaaggaggagaacccaatggaaacctccgtaagtgccaatactgatcagttggggaatgagtactttaggcagccacccccacgcagccctccactaatccactgctccggggagatgctgaagttcaccgaaaagtcacttgctaaatcgatcgcaaaggagagcgccctgaatccctcgcagcctccgtcattcctgtgtaagactgccgtccccagcaaagagattcagaactacggtgagatacccgaaatgagcgtgtcatacgagaaggaggttacagcggagggagtggagaggcctgagatcgtgagcacctggtcatcggccggaatatcctggaggtccgaggcttgcagagagaattgcgagatgccagattgggagcagtccgccgagtccctacaacctgtgcaggaagatatggcactaaatgaggtcctacagaaactcaaacataccaaccggaagcaagaggttcggattcaagagcttcagtgttctaatctctatctggaaaaacgtgtgaaggaactccagatgaaaataaccaaacagcaggtcttcatcgacgtcattaacaaactcaaagaaaacgtcgaggaattaatcgaagacaagtataaaatcatcctggaaaaaaatgacaccaagaagacgcttcagaacctggaggaggtgctggcaaatactcaaaagcatttacaagaatctaggaacgacaaggagatgctgcagttacagttcaaaaagatcaaggcaaattacgtctgtctccaggagagatatatgacagagatgcagcagaaaaataaatccgtaagtcagtacttagagatggacaaaaccttgagtaagaaggaggaggaggtagagcggttacagcagctcaaaaaagagctggagaaggcgactgctagtgcccttgacttgctcaagagagaaaaagaggcccaggaacaggagtttctttcattacaagaggaatttcagaaactcgagaaggagaacctggaagagagacagaaattgaagtctcgtcttgaaaagcttctaactcaagttaggaatctgcagtttatgtcagagaacgaaaggacaaagaatataaagctccagcagcagatcaacgaggtcaagaatgaaaacgccaagctgaaacagcaggtagccagatcagaagagcagaactacgtgccgaaattcgaaaccgcccagctgaaggatcaactggaggaagtgttaaaaagtgatattaccaaggacactaaaaccacccactccaatttgctgccggattgttccccctgtgaggagcgtctcaaccctgcggatatcaagcgagctagtcagctggccagcaagatgcacagcttgcttgccttgatggtgggccttctcacatgccaggacattatcaatagtgacgctgaacactttaaggagtctgaaaaagtatccgacattatgctgcagaaactgaaatccctccaccttaagaaaaagaccttagacaaggagttgctaaaacacaaagatcggataactactttccgggagttaatcgccaaggagaaagcttttcaggatcacgctatcaaagtgatagattgtgacagtgatgaagcgaagtcaattagggacgtccctacgcttttgggcgcaaaactggacaagtaccattccctgaatgaagagctcgactttcttatcactaaactgggacacttgctggagtcaaaagaaaatcattgcaaccgcctgatcgaggagaatgacaagtaccagcgccacctgggtaacctaataaagaaagttaccagttacgaggagattattgaatgtgctgaccagcgcctggcgatttctcacagccagattgcacacctggaagaaaggaacaaacatcttgaagatttgattcggaagccaagagagaaggccagaaagccccgaagcaaatcccttgaaaatcatcccaagagcatgactatgatgccagcgttatttaaggagaataggaacgacctggactag

SEQ ID NO: 216886 - DNA, 2112 bp, Artificial Sequence
  Description of Artificial Sequence: Synthetic coding sequence
atggcagatcgacgcaggcagagagcctcccaggatacggaggatgaagagtcaggagcctctggctcagatagcggcggatctcctctgcggggaggtgggtcttgctctgggtctgccggaggcggaggctcaggctctctgccatcccagaggggtggacggactggcgctctccatctcaggagagttgagtctggcggagcgaaaagcgctgaggagtccgagtgcgagagcgaagatggcattgaaggcgatgctgtcctttccgactatgagtccgcagaggattccgaaggggaggagggcgagtacagcgaggaggagaatagcaaagtcgagctgaagagtgaggctaatgacgccgttaattcatccactaaagaggaaaagggcgaggagaaacccgatactaagtccaccgttaccggtgagcgtcagtcaggggacggccaagagagcacagagcccgttgaaaataaggtaggcaaaaaagggccaaagcacctggacgacgatgaggaccgcaagaaccccgcatacattccccgtaagggtctgtttttcgagcacgacctgcgcggtcaaacacaagaagaggaggtcagacctaaggggaggcagcggaaactgtggaaagatgaaggccgatgggaacacgacaaattccgagaggatgagcaagccccaaaaagcaggcaggagctgattgccttgtatgggtacgatatccggagcgctcacaaccccgacgatattaagccccgtaggattcgaaagccaaggtatggttcaccccctcagagggacccaaattggaatggtgagagacttaataagtcgcatcgccaccagggccttggcggaaccctgccacctcgtacattcatcaaccgcaatgctgccggtaccggacgcatgtccgcccctcggaactatagtcgcagtgggggttttaaggagggacgtgccggtttcaggccggtggaagctgggggacagcacggcggtaggtccggcgaaacagtgaagcatgagatctcgtatcggagtcgcagactggagcaaaccagcgtgcgcgaccccagccccgaggcggacgctccagtgcttgggtccccggagaaagaagaggccgcttccgaacctcccgcagccgctcccgatgcagcccctccacctcctgaccggccaatcgaaaagaagtcctatagtcgtgctcgtcgcactaggacgaaggtgggcgacgcagtgaaactcgctgaagaagtgccaccccctcctgaaggtcttatcccagcccctccggtgcctgaaactacacccactcctcccactaagacgggtacttgggaagcccctgtggatagcagtacaagcggcttggagcaggacgtggcacagcttaatatcgcggagcagaattggtctccgggacagccttctttcttgcagccacgagaactaaggggcatgcccaatcatattcacatgggggctggcccaccgccacagttcaaccggatggaagaaatgggtgtgcagggcggtagagcgaagcggtattctagccagcggcagcggcctgttccagaacctcctgctccccctgtacacataagcatcatggagggtcattattatgacccactccagtttcagggtcctatctatacccacggagactcccctgccccattgcccccacagggaatgctcgtgcagcccggaatgaacttgccacacccaggcctacatccccatcaaacccctgcccctcttcccaacccagggttgtatccacctcctgtgtccatgtctccaggccagcccccaccccagcagctactcgctcctacgtattttagcgcccctggcgtgatgaacttcggaaacccatcctatccttatgcaccgggagctttgcccccacctcctcctccccatctgtatcccaatacccaggcgcctagccaagtttatggtggggtgacgtactacaatcccgctcaacagcaagtccagcccaaaccgtctcccccaaggcgaactccccagcctgtaactatcaagcctccgcctccggaagtcgtttctagagggagttcgtag

SEQ ID NO: 216887 - DNA, 2112 bp, Artificial Sequence
  Description of Artificial Sequence: Synthetic coding sequence
atggcagaccgacgaagacagagagccagtcaggatacagaggacgaggagagtggtgctagcggaagcgattccggcggaagccctcttcgtggaggtggcagctgttccggaagtgctggagggggaggctctgggtctttgcccagccaacggggaggcagaacaggggctctccacctccgccgtgtggagtctgggggagccaaatcagctgaggagagtgagtgcgagagtgaggacggaattgagggagatgcggttctgagtgactacgagtcagcagaagacagtgagggagaggaaggcgagtatagtgaagaggaaaacagtaaagtcgagctgaagagtgaagctaatgacgccgtcaactcctctacgaaagaggagaagggcgaggagaagcccgacactaaaagcacagtgaccggagagagacagagcggcgatggacaggaatcgaccgaacctgtggagaataaggtcgggaaaaaagggccaaagcatttagacgacgacgaagaccggaagaatcccgcttacatccctcgtaaggggctgtttttcgagcacgatctgcggggacagacacaagaagaagaggttaggcccaagggcagacagaggaaactgtggaaagatgaaggaagatgggaacatgacaagtttcgggaagatgaacaggctcccaagtctcggcaggaactcatcgctctttacggctacgacatcaggagtgcacacaaccccgacgacattaaacctcgaaggatccgcaagcccaggtacggctcgcctccacagcgcgatcctaattggaacggcgaacggcttaacaaatcacacagacaccaggggctggggggaacattaccaccacggaccttcataaacaggaatgccgcaggcacaggcaggatgtcagcccctcgcaattactctagatccggcggattcaaggagggacgagccggattccgccctgtggaggctggagggcaacatggcggacgatcaggtgagaccgttaaacacgagatcagttataggagtcgacggctggagcagacttctgtgcgagacccaagtccagaggctgacgccccagtcctgggatcgccggaaaaagaagaggcagcttctgagccacctgctgccgcaccagacgcggctccacccccaccagatcggccaatcgaaaaaaagtcttacagccgcgcaagacgcacacggaccaaggtcggagatgcggtcaagctggcggaggaagtgcccccaccccctgaggggctaattccggcaccccctgtacctgaaactacccctaccccacccacaaagacagggacttgggaggccccagtcgatagttccaccagcggcctggagcaggatgtggctcagctcaacattgctgagcagaactggagtccgggacaaccaagtttcttgcaacccagagaactgagagggatgccgaaccacatccatatgggtgcagggccaccccctcaattcaacagaatggaggaaatgggcgtgcagggcggtagagcgaagcggtactcttcgcagcgccaacgccctgtgcctgagcctcccgctccacccgtccacatcagcattatggaaggacattattatgacccgttacaatttcagggccctatctacacccacggagattcaccggctcctctaccccctcagggaatgctggtgcagccaggtatgaacttgccacatcccggtcttcacccacatcagacaccagcaccattacctaatccagggctgtacccccctcctgtctccatgagtcccggtcagccgcctccccagcagctgctggcacccacctatttctcagccccaggcgttatgaactttgggaatccaagctatccttatgccccaggagccttgccccctccaccccctcctcacttgtatcctaacacgcaggcgccatcacaggtctatgggggagtgacgtactataacccagcccagcagcaggttcaacctaagccatcccccccacggagaactcctcagcccgtgacaatcaagccaccaccccctgaggtggtgtccaggggcagctcttag

SEQ ID NO: 216888 - DNA, 1926 bp, Artificial Sequence
  Description of Artificial Sequence: Synthetic coding sequence
atggccgaccgtcgaagacagagggcttcccaggataccgaagatgaagagagcggcgcatctggttccgactctggtgggtctccattgagggggggtggttcatgtagcgggtctgcagggggagggggatccggctctttgccttcccagcgaggagggcgtaccggcgctcttcacctgcgccgagttgagtccggaggcgcaaagagtgccgaggaaagtgaatgcgaaagtgaagatggtatagagggggatgccgtcctttccgattatgaaagcgccgaggacagcgagggggaagagggcgaatactctgaagaggagaatagcaaggtggagcttaaaagtgaggcgaacgatgcagtgaatagctctaccaaggaggaaaaaggcgaagaaaaaccggacaccaaatctactgttactggggaacggcaaagcggggacggccaggagagcaccgagccagttgagaataaagtcggcaagaaaggccctaaacacctggatgacgatgaagatcgcaagaacccagcgtatattccgcgaaaaggactgttttttgaacatgatcttcggggacaaacacaggaagaagaggtacgacctaagggcaggcaacgcaagctctggaaagacgaaggcagatgggagcacgacaaatttcgggaggacgaacaagccccaaagtcacgccaggagcttatcgcactttacggctatgacatccggtccgcccacaacccggacgacatcaagccgaggcgaattagaaaacccaggtacgggtcacctccgcagagagaccccaattggaatggagagagactcaataagtcccaccgtcatcagggtctcgggggtacattgcccccaagaacattcataaaccgaaatgccgctggcacaggtcgcatgtctgctcctcgcaactattctagatccggaggctttaaggagggccgagcagggtttcgaccggtggaagccggtggacagcacggcggacgctcaggcgagacagtcaaacatgagatttcttaccgctctcgccgattggaacagacttccgtgcgagatccatcacctgaagcagacgccccagtgctgggtagcccggagaaagaagaggcggcaagcgagccgccagctgctgcgccagatgctgcaccccctcctcctgaccggccaatcgaaaagaaatcctactctcgtgctaggagaacaagaacaaaagtgggggacgctgtaaaactggccgaagaagtgccccctccccctgagggcttgatcccggctccccctgtacctgaaacaacccctacacccccaaccaagactggtacctgggaggccccagtcgattcctcaacaagcgggctcgagcaagacgtggcacagctgaatattgccgagcagaactggtccccagggcagccctcctttcttcagccacgcgaactccgcggaatgcctaatcatattcatatgggtgccggacctcctcctcaatttaatagaatggaggagatgggggtgcaagggggacgggctaagcgttattcttcccagaggcaaaggccagtgcctgagccccctgcccctcctgtgcatatcagtataatggaaggccactactacgatcccctgcaatttcaaggcccaatttacacgcacggagatagccctgcccctctgccaccacaaggcatgcttgtgcaaccagggatgaatctcccacaccctgggctgcacccccatcagacccctgcatgtcctgatagtcagaccctgcgacattgtgaatcatgtctctgctggagcacagtgttctcttgtaaagatttttccatgtgtgggggtgtcttctgttactgttttaagggatgccctttcgtgattagtattgttacttggcgttag

SEQ ID NO: 216889 - DNA, 543 bp, Artificial Sequence
  Description of Artificial Sequence: Synthetic coding sequence
atgcaagctgaagggcgaggcacaggtggatctaccggagacgccgacggcccaggcggacctggcattccagacggacccggaggtaatgccggtggccctggagaggcgggtgccaccggagggaggggcccacggggagctggcgcagccagagccagtggaccgggaggaggggctcctcgcggacctcacggcggtgcagcttcagggctcaatggctgctgtcggtgcggggctcgcggacccgagagccgtctactggaattctatctggccatgccatttgccacccctatggaagctgagctggcgcgtagatctctggcacaggatgctcctcctctccctgtgcctggggttctcttgaaagaatttacagtttccgggaacatcctgaccattcgactgacagccgctgaccaccgccagctgcagctgtccatttcttcttgtctacagcagctctcactcttgatgtggatcacccagtgttttctgcccgtctttctggcgcagcccccttctggacagcgtagatag

SEQ ID NO: 216890 - DNA, 570 bp, Artificial Sequence
  Description of Artificial Sequence: Synthetic coding sequence
atgaccgataaaacagagaaagtcgccgttgatccagaaacagtgttcaagcgtccaagagagtgtgacagcccaagttatcagaagcgccagaggatggcactcctcgcacgcaaacaaggcgctggcgatagtctcattgctgggtccgctatgtcaaaggctaagaaactcatgaccggccacgccattccaccatctcaactggattctcagatcgatgacttcaccggattcagtaaagatagaatgatgcagaagcctggtagcaacgcgcctgtcgggggaaatgttacttccagcttctctggtgatgatctggagtgtagagagacagccagctcccctaagtcccaaagagaaattaacgctgatattaaacgtaaactcgttaaggaattaaggtgtgttgggcagaaatatgaaaagatattcgaaatgctggaaggagtgcaggggccaaccgctgtgcgtaagaggttcttcgagagtattatcaaggaagcggctaggtgcatgcggcgagatttcgtgaagcatttgaaaaaaaagctgaagcgaatgatttag

SEQ ID NO: 216891 - DNA, 570 bp, Artificial Sequence
  Description of Artificial Sequence: Synthetic coding sequence
atgacagacaagacggaaaaggtggcagtcgacccagaaaccgtgttcaagcgacccagagaatgcgacagtcccagttaccagaagcggcagcggatggcacttttagcgagaaagcagggcgcaggcgacagtctgatcgccggatccgctatgtcaaaagagaagaagctgatgacaggacatgcgatccctcccagccagctagactcccagatcgacgacttcaccggattctccaaagaccgtatgatgcaaaaaccaggctccaacgccccagtcgggggaaacgtgacgagcagcttttcaggtgacgacttagagtgccgggagaccgcgtcaagcccgaagtcccagcaggagatcaatgccgatatcaaaaggaaactagtcaaggaactccggtgcgtgggccagaagtatgagaaaatctttgagatgttggagggggtacaagggcctaccgcagtgcgcaagcggttttttgaaagcatcatcaaggaggccgcaaggtgcatgcggagggattttgtgaagcacctgaagaagaagctcaagagaatgatctag

SEQ ID NO: 216892 - DNA, 570 bp, Artificial Sequence
  Description of Artificial Sequence: Synthetic coding sequence
atgactgacaaaaccgaaaaagtggctgtggaccccgaaaccgtgttcaagaggccaagagagtgtgatagcccttcctatcaaaaaaggcaaaggatggcccttttagcaagaaagcaaggtgccggagatagcctgatagctggcagcgctatgtctaaggagaaaaaattgatgactggacacgcaatcccaccttctcagctggacagccagattgacgacttcactggcttctcgaaagatcgcatgatgcagaagccgggtagcaacgccccagtgggaggaaacgttacgagcagcttctcaggcgatgacctcgaatgccgcgaaacagcatccagccctaagagtcagcaggaaatcaatgctgacatcaagcgaaaactggtaaaagaactgaggtgcgtcgggcagaaatacgagaaaatattcgagatgctggagggggtgcaggggccaaccgctgttcgtaaacgctttttcgagtctattattaaagaggccgctcgctgtatgcggagggatttcgtaaagcacctcaagaagaagctgaagcgcatgatctag

SEQ ID NO: 216893 - DNA, 570 bp, Artificial Sequence
  Description of Artificial Sequence: Synthetic coding sequence
atgactgataagaccgaaaaagtggctgtcgaccccgaaacggtgtttaagcgccctagggaatgtgactctccctcgtaccagaaaagacagcgtatggcactgctggcacggaaacagggcgctggagatagcctcatcgccggtagtgccatgtccaaagaaaaaaaacttatgactggccatgcaatcccacccagccagctcgattcccagatcgatgatttcaccgggttctctaaagatagaatgatgcagaaaccagggagcaatgcccctgtgggaggtaatgtcacatcttcgttcagcggggatgacctagaatgtagggagactgcttcctcccccaaatcccagcgcgaaataaacgcagatatcaagcgcaagctggtgaaagagctgcgatgcgtcgggcagaagtacgaaaagatttttgagatgcttgaaggtgtgcaaggccctactgctgtacggaaacggtttttcgagtccatcataaaggaagccgcaagatgtatgcgcagagacttcgttaaacaccttaagaaaaagctaaaacgcatgatatag

SEQ ID NO: 216894 - DNA, 570 bp, Artificial Sequence
  Description of Artificial Sequence: Synthetic coding sequence
atgaccgacaagactgagaaggtggccgtagatcctgagactgtgttcaagagacctcgtgagtgtgactcaccaagctaccagaaacgccagcgcatggcacttctggccaggaaacagggggctggggattccttgattgccggttccgcaatgtccaaagaaaagaaactgatgaccggccatgccattccaccgtctcagctggacagtcaaattgatgacttcaccgggtttagtaaagacagaatgatgcagaagcccggatccaacgcccctgttgggggaaacgtgactagcagctttagtggagacgacctggagtgtcgagaaacggcgtcgtctcctaaatcccagagagaaatcaacgcagacattaaacgaaagctagttaaggagcttcggtgcgttggacagaaatatgagaagatcttcgagatgttggaaggagtgcaagggcctactgccgtgcgcaaaagattctttgagagcatcatcaaagaggccgctcgatgtatgcggagggactttgtcaaacacctgaaaaagaaactgaaaaggatgatctag

SEQ ID NO: 216895 - DNA, 570 bp, Artificial Sequence
  Description of Artificial Sequence: Synthetic coding sequence
atgactgacaaaacagaaaaagtggccgtggatccagaaacagttttcaagcggccacgggagtgcgacagccccagctaccagaagagacaacggatggctctgctggccagaaagcaaggcgcaggtgactcgttgatcgctggtagtgcaatgtcaaaagaaaagaaactgatgactggacacgctatcccccctagtcagcttgacagtcagatcgacgacttcacagggttctctaaggaccgcatgatgcagaaacctggctccaacgccccagtgggtggaaacgtcacctcatcgttcagtggagacgatctcgagtgccgtgaaacagccagctctcctaaatcacagcaggagatcaatgctgacatcaagcgcaaactggtgaaagagttgaggtgtgttggccagaagtacgaaaagatttttgagatgctggagggcgtgcaaggtcctaccgctgtgcgcaagcgttttttcgagagcatcattaaggaggcagctaggtgcatgcgacgggactttgtgaagcacctgaagaagaagctgaaacggatgatatag

SEQ ID NO: 216896 - DNA, 570 bp, Artificial Sequence
  Description of Artificial Sequence: Synthetic coding sequence
atgaccgacaaaactgaaaaggtggcagtcgacccagaaacagtgtttaagaggccccgtgagtgcgatagtccatcgtaccaaaaacgtcagaggatggccctgttggcgcgaaaacagggggctggagattcgctaatcgccggatcagccatgagcaaagccaagaagctgatgaccggtcacgccatccctccgtctcagctcgactctcagatcgacgacttcaccggtttctccaaagaccgaatgatgcagaagccaggctctaacgcacccgtaggtggcaacgttactagtagtttcagtggagacgacctagagtgtcgcgaaacggcgtcatctcccaagtcccagcaggagataaatgcagatatcaagcgcaagctggtcaaggagcttagatgtgtcggacagaagtatgagaaaattttcgagatgctggagggagtgcagggacccactgctgtaagaaagcgcttctttgaaagtataattaaggaggcagcccgatgcatgaggcgggatttcgtcaaacacctaaagaaaaaactgaagcgaatgatttag

SEQ ID NO: 216897 - DNA, 570 bp, Artificial Sequence
  Description of Artificial Sequence: Synthetic coding sequence
atgacagataaaacagaaaaggtggcggttgacccagagactgtcttcaagagacccagagagtgcgacagcccctcttaccagaaacggcaaaggatggccctcttagcccgtaagcagggcgctggggatagcttaatagccggatccgccatgtccaaagctaagaaactgatgacaggtcatgcaatccccccttcacagctcgatagccagatagacgactttactggattctccaaggacaggatgatgcagaagccaggcagtaacgctcctgtagggggaaacgtaacatctagcttctccggggacgacctggagtgccgtgaaaccgcctcaagcccgaagtcgcagcaggagatcaacgccgatatcaagcgcaagctcgtgaaggagctgcgatgtgttggacaaaagtatgaaaaaatctttgagatgcttgagggtgtacagggccctaccgctgtgaggaagcgtttcttcgagagcataatcaaggaagctgctcgctgcatgagacgggatttcgtgaagcatttaaagaagaagctgaaaaggatgatctag

SEQ ID NO: 216898 - DNA, 570 bp, Artificial Sequence
  Description of Artificial Sequence: Synthetic coding sequence
atgacagataagaccgaaaaggtggcagtggatcccgagacagtgttcaagcggccacgcgagtgtgattctccgtcctaccaaaagaggcaaaggatggcgctgctcgcccgtaagcaaggcgctggagatagtctcattgcaggctccgcaatgtccaaagagaagaaacttatgacagggcatgctatcccaccaagtcaactcgattcccagatcgatgattttaccggattttccaaggacggaatgatgcaaaagcccggatccaatgcacctgtgggcggtaacgttacatctaacttctccggggacgatctggaatgtcgagggattgcatcctctcccaaatcacagcaagaaatcaacgctgacataaaatgtcaggtggtcaaagagattaggtgtctcggcagaaaatacgagaaaatctttgagatgctcgaaggcgtccaggggcctacagcagtcagaaagaggttctttgagtctatcattaaagaagctgcacgttgtatgcgcagggactttgtgaagcacctcaagaagaagcttaaacggatgatctag

SEQ ID NO: 216899 - DNA, 570 bp, Artificial Sequence
  Description of Artificial Sequence: Synthetic coding sequence
atgacagacaagaccgaaaaggttgcagtggacccagagacagtctttaaacgacccagggagtgtgattccccgtcatatcagaagcggcagcgcatggccctattggccagaaaacagggcgctggggactccctgattgctggatcagccatgagtaaggagaaaaaacttatgactggccatgcaataccaccttcacagctcgattcccagatagacgatttcaccgggtttagtaaggatgggatgatgcagaagccaggctcgaacgccccagtaggcggaaatgttacatccaacttctccggagacgacctagagtgccggggaatcgcttcatcacccaaatctcagcaggagatcaacgctgacattaagtgtcaggtggtgaaggaaatccgatgcctaggcaggaaatatgagaagattttcgagatgctagaaggcgtgcagggccctaccgctgtaagaaaacggttcttcgagagcattattaaagaagccgcaagatgcatgagacgggattttgttaagcatttaaagaaaaagctgaagaggatgatttag

SEQ ID NO: 216900 - DNA, 570 bp, Artificial Sequence
  Description of Artificial Sequence: Synthetic coding sequence
atgactgacaaaaccgagaaggttgcggtggatcctgagaccgtgtttaagcgccctcgggaatgtgactccccaagctaccagaagcgccaacgcatggctctgctcgcaaggaagcagggcgcaggggatagtctgatcgcaggatccgcgatgagcaaagcgaaaaaattaatgacgggacatgccatccctccttcccagctggactcccagattgacgatttcaccggcttttctaaggatagaatgatgcagaagcccggttcgaatgctcccgtgggaggcaatgtgaccagctcattctcaggagacgacctggagtgtcgcgaaactgcgtcctccccgaaatcacagcaagagattaatgctgatattaaacggaagctggtgaaggagttacggtgtgtcgggcagaaatacgaaaagatcttcgagatgctggagggcgtccagggccctacagcggttcggaagagattttttgagtctatcatcaaggaagctgcccgatgcatgcgcagagactttgtgaagcatttaaaaaaaaagctcaagcgaatgatctag

SEQ ID NO: 216901 - DNA, 570 bp, Artificial Sequence
  Description of Artificial Sequence: Synthetic coding sequence
atgaccgataagaccgagaaagtggccgtggacccagaaactgtattcaagagacctagggaatgcgacagccccagctatcagaagaggcagcgtatggcactgctggctaggaagcagggtgccggtgattccttgatagctggctctgctatgtctaaggccaagaagctgatgacagggcacgccattcctccgagtcagctcgacagccagattgatgactttacgggattctctaaagatagaatgatgcagaaaccaggcagtaacgcccctgtcggcggaaatgttacctcctcgtttagtggtgatgacctggagtgccgtgagacagctagtagtcctaagagccagcaagaaattaatgctgatataaagagaaaacttgtgaaagaattaaggtgtgtggggcagaaatatgagaagatatttgagatgctcgagggagtgcaggggcctaccgcagtgcgcaagagattttttgaatccattatcaaagaggccgctcgatgtatgaggcgggacttcgttaagcatcttaagaaaaaattaaagcgtatgatctag

SEQ ID NO: 216902 - DNA, 867 bp, Artificial Sequence
  Description of Artificial Sequence: Synthetic coding sequence
atgtcggctaccggcgatcggcatcccacccagggcgaccaggaagcgcctgtgagtcaagagggtgctcaggccgaggctgccggagcgggaaatcaggagggcggtgacagtggtccggatagcagcgatgtggtcccggctgccgaagtagtcggagtggctggtccggtggagggactgggggaggaggagggggaacaggccgctggtctggctgcggttccgcgagggggttccgccgaagaggattctgacatcggcccagccactgaagaagaggaagaggaggagggcaatgaggcggctaacttcgacttggcagttgtggccaggcggtatccagcatctggaatccacttcgtgttactggacatggtacactccctcttacatagactgagtcataacgaccacatcctgatcgagaaccgccagttatctcggctgatggtaggccctcatgcggctgcccgaaacctctggggaaacttgcccccacttttgctccctcagcgtcttggcgcaggggctgccgcacgggctggggagggcctgggcctaattcaggaagccgcaagcgtgcccgagccagctgtacctgctgacctggccgagatggctcgagagccggctgaggaggccgcagaggagaaactatctgaggaggccaccgaggaacccgacgctgaggaaccagccaccgaggaacccaccgcacaggaagctaccgcccctgaggaggtgaccaaatctcagccagaaaaatgggatgaggaggcccaggatgcagcaggggaggaggagaaggagcaggaaaaagagaaagatgcagaaaacaaggtgaaaaactccaaaggcacctag

SEQ ID NO: 216903 - DNA, 867 bp, Artificial Sequence
  Description of Artificial Sequence: Synthetic coding sequence
atgtccgctactggcgaccgccaccccacccagggagaccaggaagctcccgtctcccaggaaggcgctcaggccgaagccgcaggagcaggaaaccaggagggcggtgattccggtcctgatagctccgatgtagtacccgctgctgaggtggtgggggtcgccggtcccgttgaggggctgggtgaagaggagggcgagcaggcggcaggcctggcagcggtgccacggggagggagcgctgaggaagacagcgacattggacctgcaaccgaggaagaagaggaggaggagggcaatgaagccgcaaactttgaccttgctgtggtcgctcggcgataccccgcatcaggcatccattttgtgctcctcgacatggtgcattcgctcctccacaggctgtcgcacaatgatcacatccttatagaaaaccggcagctatcaaggctgatggtgggtccacacgctgccgctcgcaatttgtggggtaatctgccacccctactgctcccacagaggcttggcgcaggtgccgcagcaagagcgggtgagggacttggactgatccaggaggccgctagcgtgccggagccggcagtgccagcagatctggctgagatggcacgcgaacccgctgaagaagcagccgaggagaagctttccgaagaagccaccgaggagcctgacgccgaagaacctgcaacggaggagcctaccgcccaggaagcaaccgcccctgaagaagtgaccaagtcacagcctgaaaaatgggatgaagaggcccaagatgcagctggcgaggaagaaaaagagcaagagaaagagaaggacgcagagaacaaggtcaaaaattcgaaggggacctag

SEQ ID NO: 216904 - DNA, 867 bp, Artificial Sequence
  Description of Artificial Sequence: Synthetic coding sequence
atgtctgcgacaggtgatagacatcccacacagggagaccaggaagcgccagtgtcacaggaaggtgcccaggcagaggctgcaggggctgggaatcaggagggcggtgattctgggccagacagcagcgatgtcgtgcccgcagcagaagtggtgggagtggctggtccagtcgaaggtctaggcgaggaggagggggagcaggcagctgggctagctgcagttcctcggggaggttcagcggaggaggattcagatatcggaccggctaccgaggaggaggaggaagaggaaggtaatgaagccgcaaacttcgatctcgccgtggtagcacgcaggtatcctgctagcggtatccacttcgtgttgttggatatggtccacagcctgctgcacagactctctcataatgaccatatactgatcgagaatcgacagctatcgagactcatggtcggcccacatgcagctgcgagaaacctgtgggggaatctaccacctctgctgttgccccagcgactgggtgctggagccgcagctcgggctggcgagggcctcgggcttatacaggaggccgctagcgtgccagagcccgcagtacccgctgatctcgcagaaatggccagggagcccgcagaagaggctgcagaagaaaagcttagcgaggaagccacagaagagcctgacgctgaggagcctgccacagaagaaccaaccgctcaagaggcaacggcgccagaagaggtgaccaagagtcagcccgaaaaatgggatgaagaggcccaagatgctgctggtgaagaggagaaggagcaggaaaaagagaaagacgccgaaaataaggtcaaaaactctaagggaacatag

SEQ ID NO: 216905 - DNA, 867 bp, Artificial Sequence
  Description of Artificial Sequence: Synthetic coding sequence
atgagtgccactggcgaccggcatcctacccaaggagaccaggaagcacccgtgagccaggagggggcacaagctgaagctgctggcgctggaaatcaggagggaggggacagcggccctgattcttccgatgtggtgccagcagccgaagttgtgggagtggctggcccagtggaagggttaggagaagaagagggggagcaggctgcaggactggcggctgttcccaggggcggaagcgccgaagaagatagcgacatcggtccagcaactgaggaagaagaagaggaggagggcaacgaggccgctaacttcgaccttgccgtggtggctagacggtatccagccagcggcattcactttgtgctgctagatatggtgcattcgttacttcatagactgtctcacaacgaccacattttaatcgagaacagacaactctcacggctgatggtggggccacacgcagctgctaggaatctttgggggaacctcccaccgcttttgcttccgcagcgcttaggcgcaggagccgctgctagagccggtgaggggctcgggctgattcaagaggcggcatccgtgccggagccggcagtcccagctgacctggcagagatggccagggagcctgccgaagaagctgccgaggagaaactatctgaagaagcaactgaggaaccagacgccgaggagcctgccactgaagaacccacagcacaagaagcaacagcacctgaagaggttactaagtcccagccagagaagtgggacgaggaagctcaggatgcagccggtgaggaggaaaaagagcaagagaaagagaaggacgcggaaaataaagttaagaacagtaaaggcacctag

SEQ ID NO: 216906 - DNA, 867 bp, Artificial Sequence
  Description of Artificial Sequence: Synthetic coding sequence
atgtccgccacaggggatcgacatccgactcagggggaccaggaagcacccgtatcacaagagggggcacaagcggaggctgccggagctgggaatcaggaggggggagattcaggtccagactcgtcggatgtggttcctgcagctgaggtggtcggggtggccggtccagttgaggggctgggagaagaagagggagaacaggcggctggcttagctgctgtcccccgtgggggaagtgcggaggaggactccgatattggtcctgctaccgaggaggaagaggaagaagagggtaatgaagcagcaaacttcgacctggcagtcgtagccaggcgatatcctgcctccggcatccacttcgtgttgttagatatggtgcactcactcctccaccgcctcagtcacaacgatcatattctcattgagaaccgacaattgagtaggcttatggtaggacctcacgccgcagctagaaacctgtggggaaacctgcccccacttctgctgccacaaagactgggggcaggcgctgctgcaagagcaggagaaggccttggcctgattcaagaagctgccagcgtgcccgaacctgcagtgcctgcagacctcgccgaaatggcccgagagcccgcagaagaagcagcagaagagaaactaagcgaggaagccactgaggaaccagacgccgaagaaccagccactgaagaacctactgctcaggaggccaccgcacccgaggaagttaccaaaagtcaaccggaaaagtgggacgaggaagctcaggacgcagcaggtgaggaggagaaggagcaggaaaaagagaaggacgcagaaaacaaagttaaaaatagcaaggggacctag

SEQ ID NO: 216907 - DNA, 867 bp, Artificial Sequence
  Description of Artificial Sequence: Synthetic coding sequence
atgtcagcaactggggatcgccacccaactcagggcgatcaggaggctcctgtgtcacaggagggtgcccaggccgaggcagcaggtgcaggcaaccaggagggcggtgactcaggccctgatagcagtgacgttgtgccagctgcggaagttgtgggtgtggctgggccagtcgagggactcggagaggaggaaggcgagcaggccgctggactcgcagcagtgccgcgaggaggctctgctgaggaggactctgacatcggacccgcaacggaagaggaggaagaggaggaagggaatgaggctgctaactttgacctggccgttgtggctcgacgctatccagcaagcggcatccacttcgttttactggatatggtgcacagcctgcttcaccgcctgtctcataatgaccatatcctgattgagaatagacagttgtccagacttatggttggtccccatgccgctgcgaggaatctgtggggcaatctgcctccacttctgctcccccagaggctgggcgctggtgccgctgctagagccggtgaaggactcggtctgatccaggaagctgcgagcgtaccggagcccgcagtgcccgctgaccttgctgagatggccagggagccagcagaggaagctgccgaggagaagctgtcagaagaagccacagaagagccggatgcagaggaacctgctacagaggagccaactgcgcaggaggcgactgctcctgaggaggtgactaagtcccagcctgaaaaatgggacgaagaggctcaggacgctgcaggggaggaagaaaaggagcaggagaaagagaaggatgctgagaacaaagttaagaatagtaagggtacctag

SEQ ID NO: 216908 - DNA, 867 bp, Artificial Sequence
  Description of Artificial Sequence: Synthetic coding sequence
atgtcggctacaggtgatagacatccgacacagggggatcaagaggcccctgtctctcaggagggcgctcaggctgaagccgctggggctggcaatcaggagggaggagacagtggcccagacagctcagatgtggtaccagctgcagaagttgttggagtagccggtccagtggaggggcttggagaggaggagggagagcaggccgctggcctggccgcagtccctcggggtggctcagctgaggaagatagcgacattggcccagccacagaggaggaagaggaggaagaagggaacgaggccgctaacttcgacctggctgtggttgcacgtcgctaccccgcttccggaatccacttcgtcctgcttgacatggttcactcgttgctccaccgactttctcataatgaccacatactgatagagaaccgacagctgtctcggttgatggtgggccctcacgctgcagctcgcaacctgtggggcaaccttccccctctcttgctgcctcagaggctgggagccggagccgcagctagggctggagaggggttgggccttattcaagaggctgcctcggttcccgagccagccgtacctgctgacctagccgagatggcacgtgagccggctgaggaagcagccgaggaaaaactgtccgaagaggctactgaagaaccagatgccgaagagccagcaacagaggaacccaccgcgcaagaggctaccgccccagaggaggtgaccaagagccaacccgagaaatgggacgaagaggcccaggatgctgctggggaggaggagaaggaacaggagaaggaaaaagacgccgagaataaagtgaaaaattccaaaggcacctag

SEQ ID NO: 216909 - DNA, 867 bp, Artificial Sequence
  Description of Artificial Sequence: Synthetic coding sequence
atgtccgcaacaggcgaccgtcaccccactcaaggggatcaggaggcccctgtgagccaggagggggcacaagccgaagctgctggagcaggaaaccaagaggggggagactcaggaccagactcatccgatgtcgttcccgctgcggaggtcgtgggcgtcgcgggacccgttgagggattaggcgaggaggaaggtgagcaggcagccggattagcggcagtgcccaggggaggctctgcggaagaggactctgatatcggcccagcaaccgaggaggaagaagaggaagagggaaacgaagcggctaactttgatttggcagttgtggcacgccgttatcccgcaagcgggattcatttcgtactcctggatatggttcacagccttctgcacaggctttcacacaacgatcacattctgatagagaacagacaactgtcaagactaatggtgggaccccacgccgcagctcgaaatctgtgggggaatctcccccctctgttattgcctcaaaggctaggggctggcgcagcggctagggcgggagaaggcctgggactgattcaggaggcagcttctgtgccggaacccgcagtcccagccgatttggccgaaatggctagggagccagccgaggaagcagcagaggagaaactctccgaagaagcgaccgaggagcccgatgcagaagagcccgcaacagaggaacctaccgctcaggaggctaccgcacccgaggaagtaaccaagagccagcctgaaaagtgggatgaggaggctcaagacgctgccggagaggaagagaaggagcaagagaaggagaaggacgcagaaaataaggtcaagaactcaaaaggaacttag

SEQ ID NO: 216910 - DNA, 867 bp, Artificial Sequence
  Description of Artificial Sequence: Synthetic coding sequence
atgagtgccaccggggatagacacccaacccagggtgaccaggaggcccctgtgtcacaggaaggggctcaggccgaagcagctggcgctggcaatcaggagggtggagacagcggcccagattcaagcgacgtagtacctgccgcagaagtcgtcggagtggccggtcccgttgagggtttaggggaggaggagggcgagcaggcagccggactcgcagcagttccccgtggcggtagcgccgaggaagactctgacattgggcctgccaccgaggaggaggaggaggaagaggggaacgaggcggctaactttgacctagccgtagtggctcggaggtatcctgctagcggaatccacttcgtgctgctggacatggttcacagtctgcttcaccggctctctcacaacgatcacatcctgatcgaaaatagacagctttccagacttatggtcggtccccacgccgcagcacgaaacctctggggaaatctcccgccattactgctaccccagcgcctgggcgctggcgctgcagccagagccggtgagggcctcgggctgattcaggaagccgcttctgtgccggaacctgcagttcccgctgacctggctgaaatggcgagggagcctgccgaggaggcagcggaggagaaactgtccgaggaggctaccgaggagcccgacgcggaggagcctgctacagaagagccaactgctcaggaagcaacggcccctgaggaggtgacaaagagccaacctgagaagtgggatgaggaagcccaggacgccgcaggggaagaggagaaagaacaagaaaaggagaaagacgcagaaaacaaggttaagaatagtaagggcacatag

SEQ ID NO: 216911 - DNA, 867 bp, Artificial Sequence
  Description of Artificial Sequence: Synthetic coding sequence
atgagtgccaccggtgataggcatcccacacagggcgaccaggaagccccagtgtcccaggagggtgcccaggctgaggctgctggcgctggaaaccaggagggcggagatagtggacccgacagttccgatgtggtgcctgcggcagaggttgtcggggtggcgggtccagtggaaggcctgggagaggaggagggcgagcaagctgccggactggcggctgtgccccgaggcggtagtgctgaagaggatagtgacattgggcctgcaactgaggaagaagaagaagaggaggggaacgaggcagcaaacttcgatttggccgtggtcgccaggaggtatcctgccagcggtattcacttcgtcctgctggatatggtacacagcctattgcacaggctctcacataatgaccatatccttatagagaataggcaactgagcaggttaatggtggggcctcacgcagccgcacgaaatctctggggtaacttgccaccattactgctgccacagcgcctgggagccggtgccgcagcacgagctggagagggcttggggctcatccaggaggcagcctcggtacccgagccagccgtgccagctgatttggccgaaatggccagagagccagccgaggaggcggcagaagaaaagctttccgaggaggcgacagaggagcctgatgccgaggaaccagcaactgaggaacctacagcccaagaggccacagctcccgaagaagtgacgaagtcccaacccgagaaatgggacgaggaagcccaagatgccgctggggaagaggagaaggagcaggaaaaagaaaaggacgcagagaataaagtgaaaaacagcaagggcacctag

SEQ ID NO: 216912 - DNA, 867 bp, Artificial Sequence
  Description of Artificial Sequence: Synthetic coding sequence
atgtctgccaccggggataggcacccaacccagggcgaccaggaggctccagtttctcaggaaggagcccaggcggaggctgctggagccggaaatcaggagggtggagatagcgggcctgactcatccgatgtggtgcccgctgctgaagttgtgggggtggcagggcctgtcgaaggattgggggaagaggagggtgagcaagctgcagggctggccgctgtccctcggggtggctcagcagaggaagatagcgacatcggcccagccaccgaagaagaggaggaggaggaagggaatgaagccgcaaatttcgatctcgctgtggtggccagacgatatccagccagcggaatccacttcgtgctgctcgatatggttcactcactcttgcaccggctgtctcataatgaccatatcctcattgaaaacagacagctatcacgtttgatggtcggccctcacgccgcagctaggaatttgtggggtaacctacccccattgctgctcccacagcgactgggagccggtgccgcagccagagcaggagaaggcctcgggttgatccaggaggcagcaagcgtgcctgaaccggcagtgcctgccgacctcgccgaaatggcgagggaacccgctgaggaagccgctgaagagaagcttagtgaggaggctacagaagagccagacgctgaggagcccgcaacggaagagcctacagcacaggaggctactgcccctgaggaagtgaccaaatcccagcctgaaaagtgggatgaggaggcccaggacgcagcaggggaagaagaaaaggagcaggagaaggaaaaggacgcagaaaataaagtcaagaactccaagggtacatag

SEQ ID NO: 216913 - DNA, 867 bp, Artificial Sequence
  Description of Artificial Sequence: Synthetic coding sequence
atgtctgccactggcgatcggcacccaactcagggtgatcaggaagccccagtgtcccaggagggagcacaggctgaggcggcaggggcaggcaatcaggagggtggggacagcggaccagatagcagcgacgtcgtaccagccgctgaggtcgtaggcgtcgctggccctgttgagggtctcggagaggaggagggtgagcaggccgcagggttggccgcagtgcccagggggggatccgccgaggaggattccgatatcggccctgctacggaagaagaggaggaagaagagggcaacgaggccgcaaattttgaccttgcagtggtagccagaagataccctgcatcaggaattcactttgtcttgctggacatggtccactcccttctccacagattaagtcacaacgatcacatcctcattgaaaatcggcagctgagccggttgatggtgggccctcacgccgctgcgaggaacctgtggggtaacctgccgcctctgctcctgcctcaacgcctcggtgccggtgctgccgctagggcaggcgagggcttagggttaatccaggaagctgccagtgtcccagagcccgctgtgccagcagatctggcagagatggcacgtgagccggctgaagaggccgcagaagagaagctttccgaggaggcaacggaagagcctgatgcagaagagcctgccacggaagagccgacagcgcaagaagcaaccgccccagaggaagtcactaaaagccagcccgaaaagtgggatgaagaagcccaagatgctgctggagaagaagagaaagagcaagaaaaggaaaaagacgctgaaaacaaggttaagaatagcaagggaacttag

SEQ ID NO: 216914 - DNA, 867 bp, Artificial Sequence
  Description of Artificial Sequence: Synthetic coding sequence
atgtccgcgactggcgaccggcacccaacgcagggcgaccaagaggcgcctgtaagtcaggaaggcgcacaggctgaggccgcaggcgctggaaaccaagaaggcggtgactccggacccgattcatcagacgtggtgccagccgctgaggtcgtaggggtggcagggcctgtggagggcctgggtgaggaggaaggggaacaggccgcagggcttgcagctgtgcctcgcggtggcagcgcagaagaggacagtgatattggccctgccactgaagaggaagaggaggaagaaggcaatgaagcagcaaatttcgacttagccgtggttgccaggagataccccgcatcagggatccacttcgtgttgttggatatggtgcattctcttctccatagactgtctcacaatgatcatatattgatcgagaatcgacaactgtcaagattgatggtcgggccacatgcagctgccagaaacttgtggggaaatctgcccccattgttgcttccccagagactcggcgctggagctgcagcaagagccggagagggcttagggctgatccaagaggctgcttctgtccctgagcccgctgtgcccgctgatctggccgagatggcacgagaaccagctgaggaagcagctgaggaaaagctttccgaggaagcaaccgaagaaccagatgcagaggagcctgctaccgaggaaccgaccgcccaggaggccaccgctcctgaagaagtgacaaagagccagcccgagaagtgggacgaagaggcacaggacgccgctggcgaggaggagaaagagcaggaaaaagaaaaagacgctgagaacaaggtgaagaattctaagggtacgtag

SEQ ID NO: 216915 - DNA, 867 bp, Artificial Sequence
  Description of Artificial Sequence: Synthetic coding sequence
atgtctgctactggggaccgacaccctactcaaggcgaccaggaggcacccgtgtctcaggagggagcacaggcagaggcagccggagccggtaaccaagaggggggtgactcggggccagactcaagcgacgtagttcccgctgctgaagtagtcggtgttgcagggccagttgaaggtctgggagaggaggagggggaacaggcagctgggctggcggcagttccacgagggggatcagccgaggaagactctgacatcgggcctgctaccgaggaagaagaagaggaagaaggaaatgaagctgccaactttgacttagccgtagtggccagaagatatccagcttcaggaattcatttcgttcttctcgacatggtgcactcgctccttcaccgcctgagtcataacgatcatattttgatagaaaatcggcagctctctaggctgatggtgggaccccatgcagctgcccgtaacctttggggcaatttgcctccactgctgctgccacagaggctcggagctggagctgcggcacgtgcgggagagggactaggccttattcaggaggcagcttccgttccagaacccgcagtccccgcagacttggccgaaatggccagggagccagccgaggaggccgcagaagaaaagttgtcggaagaggcaaccgaggagcctgacgccgaagaaccagctaccgaggagccaactgcccaggaggccactgcacccgaggaggtgaccaagtcacagccagagaagtgggacgaggaggcccaagatgcagcaggcgaggaggaaaaagagcaggaaaaagaaaaagacgctgagaacaaggtcaaaaactctaagggcacatag

SEQ ID NO: 216916 - DNA, 900 bp, Artificial Sequence
  Description of Artificial Sequence: Synthetic coding sequence
atgagcgccactggcgaccgccatccaacacagggagatcaggaggcacctgtaagccaggaaggcgctcaggcggaggcagctggcgcaggaaaccaggagggaggcgattcagggcctgatagcagcgatatggtccctgccgctgaggtcgttggggttgctgggccagtagagggcctcggggaggaggagggggaacaggcggcagggctcgctgccgtgccccaggggggttctgccgaagaagactctgacatcgggccagccacggaggaagaagaggaagaggaagagggtaacgaagctgccaacttcgacctggctgtcgcaactagaaggtaccctgctgctggaatcgggtttgtattcctgtacctggtgcactcgctgctcagacggttgtaccacaacgaccatatccagatagccaataggcacctgagtcgactcatggtgggtcctcacgccgctgtaccgaacctgtgggacaatccccctcttctccttttatcccagaggctaggcgcaggcgctgctgcccctgagggcgaaggactaggtctcatccaggaagccgcttctgtgcaggaagcagcatcagtccctgagcccgctgtccccgcagatctggctgagatggccagggaaccagctgaagaggccgcagatgagaaacctccggaagaggccgctgaagagaagcttacggaggaggccacagaggaaccagccgcagaggagcccacttccgaagaggcagtggcacctgaggaggtgacaaaatcacaaccggaaaagtgggacgaggaggcccaggacgccgcaggtgaagaagaaaaagaacaagaaaaggagaaggacgtggaaaacaaggtgaaaaacagcaaggggacttag

SEQ ID NO: 216917 - DNA, 1419 bp, Artificial Sequence
  Description of Artificial Sequence: Synthetic coding sequence
atgaagtccatcttggacggcctggcagataccaccttcaggacaattaccacagatctcctttacgtaggcagtaacgatatccagtatgaggacatcaaaggagacatggcttctaaactagggtacttcccacagaagttccctttgacttcattccggggtagtccattccaagagaaaatgactgcaggggacaatccccagctcgtacccgcagaccaagtgaatattactgagttttataataagagcctatcatcatttaaggaaaacgaggagaacatccagtgtggagagaatttcatggacatcgagtgcttcatggttctaaatccctcccaacaattggctattgctgttttatctctgacacttgggaccttcacagtcctcgagaatctgctggtgctctgtgtcatcctgcacagcaggtcactgcggtgccggccatcctaccacttcattggctccctggccgtggcggacttgcttggcagtgtgatctttgtgtactcattcatcgacttccatgtgttccaccggaaagatagcagaaatgtgttcctgtttaaacttggtggcgtcaccgcatcatttaccgcatccgttggtagcctctttcttacggctatcgacagatacatatccattcaccggcctctggcctataaacggattgtcacccgaccaaaagctgtggtggccttctgcctcatgtggacaattgctatagtgatcgccgttttacccctgttgggttggaattgcgagaaattacagtccgtgtgtagtgacatcttcccacacatagatgagacatacctaatgttttggatcggcgtgaccagtgtgctccttctgtttattgtctatgcttatatgtacatcttgtggaaagcccacagtcacgcggtaagaatgatccagagaggtacacaaaagtccataatcatccatacctcagaagacgggaaggtgcaagttacaagaccagatcaggccagaatggacatcagacttgcgaagactctcgtactgatactggttgttctcatcatttgctggggccctcttttagccatcatggtctacgatgtgttcggcaagatgaataaactgataaagaccgtgtttgctttctgttcaatgctatgtctgctgaattcaactgttaatccaatcatctatgctctgcgcagcaaggatctcaggcatgcctttcgctcgatgtttccaagctgcgagggtacagcacaacccctggataatagtatgggagatagcgactgcctgcataaacacgccaataacgccgcatctgtgcatcgggcagcagagagctgtatcaagtccacagtgaagattgcaaaggtgacaatgtctgtgagtaccgacacctctgcggaagcgttgtag

SEQ ID NO: 216918 - DNA, 1419 bp, Artificial Sequence
  Description of Artificial Sequence: Synthetic coding sequence
atgaagtcgattctcgacggactcgcggatacaacatttcgcactattacgaccgatttgctctacgtaggttctaatgacattcagtatgaggacataaaaggcgatatggcctctaagctggggtatttccctcaaaaatttcctcttacctcatttcgagggagcccttttcaggagaaaatgaccgccggagataaccctcagctggtcccagccgatcaggtaaatatcacggagttttacaataaaagtctgagttcttttaaggagaacgaggagaacatccagtgcggagagaattttatggacatcgagtgcttcatggtattaaatccatcgcagcaattagctatcgccgtcctgtctctgacacttggaaccttcaccgtgctggagaacttgttggtactctgcgtgatcctccacagcagatcactgcgctgcaggccatcttaccacttcatcggctcacttgccgtggccgacctgctgggcagcgttatcttcgtatacagcttcatagactttcacgttttccatcggaaagacagtaggaatgtgttcttgtttaaacttggaggcgttaccgcatcatttacagcctctgttggatccctgtttctgaccgcaatcgaccgctatatctccattcaccgcccactcgcatataagaggatagtgactcgcccaaaggctgtagtggccttctgcctgatgtggaccatcgctattgtgatcgccgtacttccactgctcggatggaactgtgagaaactgcaatcagtgtgttccgacatcttcccacacattgacgagacttacctgatgttctggataggcgtgaccagcgtactcctgcttttcattgtgtatgcctatatgtatattctgtggaaggcacacagtcacgccgtgaggatgatccagaggggcacacaaaagagtatcatcattcacacatcggaggatggtaaagtccaagtcactcgtccggaccaggccaggatggacattcgccttgccaagacactagtgctgatcctagtcgtgcttatcatctgctggggaccccttctagcaatcatggtgtacgatgttttcgggaagatgaataaactcatcaagacggtttttgcgttctgttccatgttgtgtctgctgaatagtaccgttaatccaattatctacgctctgaggtctaaggatctgaggcatgcctttcgtagcatgttcccatcatgcgagggaactgctcagccactggataactccatgggggattctgattgcctgcataagcatgccaataatgccgctagtgtacaccgggctgcggaatcatgcatcaaatccaccgtgaaaattgccaaggtcacaatgtcagtgtctactgatacatccgccgaggctctctag

SEQ ID NO: 216919 - DNA, 1419 bp, Artificial Sequence
  Description of Artificial Sequence: Synthetic coding sequence
atgaaaagtatcttagatggcctggccgacacaacatttaggactattaccaccgaccttctgtacgtgggatccaatgatatccaatacgaggacatcaagggtgacatggctagtaagctgggttattttccacagaagttccctctgacgtctttccggggttcacctttccaggagaagatgacagctggggataatccacagctggttccagcagatcaggtgaatatcactgagttctataataaaagcctcagctctttcaaagaaaacgaggaaaacatccaatgtggggagaacttcatggatatcgagtgttttatggttctgaacccctcacaacagctagcaatcgcggttctttccctgaccctcgggacctttacagtgctggaaaatctgttggtgctctgtgtgatcctccactctcggtcccttcggtgtcggccaagctaccattttatcgggtcattagccgtggctgacctgttaggatcagtcattttcgtttactctttcatagattttcatgtgttccaccggaaagactccagaaatgtatttcttttcaaactgggcggtgtgaccgcttcctttacagcctcggtcggctctctctttttaacggctattgaccggtacatctctatccatcgcccattagcctacaagcgaattgtgacacgtcctaaagcagtggttgcattttgcctgatgtggaccatcgcgattgtgatcgctgtgctccctttgcttggctggaactgcgagaagcttcagtcagtgtgttctgacatctttccacacatagacgagacctacctgatgttctggataggcgtcacaagtgtcctactgctgtttatcgtttatgcttatatgtatattctctggaaagcacactcacatgcagtgcgaatgattcagagaggaacccagaaaagcattattatacacacaagcgaggacggcaaggtccaggtcaccaggccagatcaggcgcgaatggatattagactggcaaaaaccctcgtccttattcttgttgtgttgatcatttgttggggcccactgctggctattatggtgtacgacgtgttcggcaagatgaataaattgataaaaaccgtattcgccttttgcagtatgctttgtctgctgaacagcacagtcaaccccatcatctacgcgttaagaagcaaagatttgagacacgcctttaggagtatgtttcccagttgtgagggaaccgcacaacccctcgataacagtatgggtgacagtgactgtctgcataagcacgctaacaacgccgcttcagtgcacagggctgccgagagctgcatcaaatctaccgtaaagatcgcgaaggtaactatgtcagtgtccacagatacgtcggccgaagctctctag

SEQ ID NO: 216920 - DNA, 1320 bp, Artificial Sequence
  Description of Artificial Sequence: Synthetic coding sequence
atgaagtcaatacttgacgggctggccgacacgacctttagaacgatcacgaccgatctcctggggagtcctttccaagaaaagatgaccgccggagacaatccccagctggtcccagccgatcaggtgaatataactgaattttacaataagtcactgagttcattcaaagagaacgaggaaaatatacagtgtggcgagaacttcatggacatcgaatgttttatggttttgaacccatcccagcaattagccatcgccgtcctgtctctgaccctgggaacattcaccgtgctcgaaaacttgctggtgctgtgcgtcattctgcatagcaggtctctcagatgtcggccaagttaccatttcatcggatcactcgccgttgccgatctgctcgggagtgttatcttcgtgtatagctttatcgattttcacgtgttccacaggaaagactcaaggaacgtcttcctcttcaagttgggcggtgtaaccgcctccttcacagcgagcgtggggagtctgtttctgaccgctattgaccgatatatttccatccatcgcccactggcctataaaaggatcgtcacacgcccaaaggccgttgttgccttctgtctcatgtggactatagcaattgtgatcgctgttctgccactgcttgggtggaattgcgagaagcttcagagcgtctgcagtgatatattccctcacatcgatgagacttatctgatgttctggataggcgtcacaagcgttctgctgcttttcatcgtgtatgcgtacatgtacattctttggaaagcccacagccacgccgtccgtatgatccaacggggaacccagaagtccatcatcatccacacaagcgaagacggcaaagtccaggtcacacgaccagatcaggctcggatggacatcaggttggccaaaaccctggtgctgatccttgtggtgctcatcatatgctgggggccactgctggccatcatggtatacgacgtgtttggcaaaatgaacaaactaatcaaaaccgtatttgctttctgcagtatgctctgccttctgaacagcactgtgaatcccattatctacgctctgcgatctaaagacctgcgacacgctttcaggtctatgttcccctcatgcgaaggaaccgcacaacccttggacaacagcatgggtgatagcgactgcctgcataagcacgcaaacaacgcagctagtgtgcacagggccgctgagtcctgcatcaagagtactgtgaagattgccaaggtgacaatgagcgtaagtactgacacatccgccgaagccctttag

SEQ ID NO: 216921 - DNA, 1419 bp, Artificial Sequence
  Description of Artificial Sequence: Synthetic coding sequence
atgaagagcattctggacggtctggctgacactaccttcagaaccatcacgaccgacctgctttacgttgggagcaacgatatacagtacgaagatattaagggagacatggcctcaaaactcggttatttcccccagaagttccccctgacctcattccgcggaagtccgttccaggaaaagatgacagccggagataacccccagcttgtccctgcggatcaggtcaatatcacggaattttataataagagtttatctagttttaaagagaacgaagagaatatccaatgcggcgagaattttatggatattgagtgcttcatggtgctgaacccgagtcaacagttggctatcgcagtgcttagcctgactctgggtactttcacggtgctggaaaacctgctagtcctgtgtgtgattctccatagcagaagtctgcggtgcaggcccagctaccattttataggaagcttggctgttgcagacctgcttggctcagtcatcttcgtatactctttcatcgacttccacgtattccatcgcaaggacagtaggaacgtgttcctgtttaagctaggcggtgtcacagcgtcattcactgcgagcgtgggttctttattccttacggctatcgaccgctatatctcaatccatcgacctttggcctacaaacgcatagtaactcggcctaaagccgtggtagccttttgtttgatgtggacaattgctatcgtgattgctgtgcttcctctcctcggatggaattgcgaaaagctgcagtccgtgtgctcagatatctttccccacatcgacgagacctacctgatgttttggatcggagttacttccgtgctgctcctgtttattgtgtacgcctacatgtacatcttatggaaagcacactcacacgcagtgcgcatgatccagcggggaacccagaaaagcataattatccacacatccgaggatggcaaggtacaggtgacccggcctgatcaggctagaatggacatcaggctggctaaaacgctcgtgctcatcctcgttgttctgattatctgttggggccctttgctcgctatcatggtgtacgacgtcttcggaaaaatgaacaagcttattaaaactgtgttcgccttttgtagtatgctgtgcttgttaaacagcacagtcaatcccataatctacgcccttagaagcaaggatctgcgccatgcctttcgtagtatgtttccaagctgcgaaggaaccgctcagcctctggataatagcatgggcgacagcgactgtcttcacaagcacgcaaataacgctgctagtgttcaccgggctgcagagtcttgcattaagtcaaccgtcaagattgcaaaggttactatgagcgtctcaacagatacctcagccgaggctctgtag

SEQ ID NO: 216922 - DNA, 1419 bp, Artificial Sequence
  Description of Artificial Sequence: Synthetic coding sequence
atgaaatcaatcttggacggcctggccgacactactttcagaaccatcacaaccgatctcctctacgtcggctctaatgatatacagtacgaggatataaaaggagatatggcctcgaaactcggctacttcccccagaaatttccacttacaagctttcgtggtagcccatttcaggaaaaaatgaccgccggagacaacccgcagcttgtgccagcagatcaggtgaacatcacggaattctacaacaaaagcctctcttccttcaaggagaatgaggagaacatccagtgcggagagaacttcatggacattgaatgcttcatggtgctcaacccatcccaacagcttgctatcgccgtcctcagcttaacgctcggcaccttcactgtgctggaaaatctccttgtgttgtgcgtcatacttcattctaggtctctacggtgtaggcccagctaccatttcatcggctcccttgctgtggctgacttactcggctccgtcatctttgtgtacagtttcattgattttcatgttttccaccggaaggacagtagaaatgtgtttctctttaagctggggggtgtcactgccagtttcactgcaagtgtcgggtcactgttcctgactgccatagacaggtacatttctatccatcgaccattggcgtacaaacggatagtcaccaggcctaaggcggtcgttgccttttgtctgatgtggaccattgcgattgtcattgccgtgttgccactgctagggtggaattgcgaaaagctccagagtgtgtgcagtgacatattcccacacatcgatgaaacgtatttgatgttttggattggtgtaacatcagtgctcctgcttttcatcgtgtatgcttacatgtatatcttgtggaaggcccatagtcatgcggtgcgtatgatccagagagggactcaaaagtctataattatacatacaagtgaagatgggaaggtccaggtgaccagaccagaccaagctcgcatggacattaggctggctaaaactctggtcctgattctggtcgttctgattatctgctggggacccctgttggccattatggtgtacgacgtatttggaaaaatgaataaactaattaagaccgtgttcgctttctgcagtatgctttgtttgctaaattctactgttaaccctattatttacgccctgcgatccaaggacctgagacacgcctttcgatccatgtttccaagctgcgagggcacagcacagcctctagacaattccatgggtgatagtgattgtctccacaaacacgccaacaatgccgcttccgttcatcgcgctgccgagtcttgtatcaaatctactgtcaagattgccaaggtgacaatgagtgtgagcactgacacctcagctgaggcgctgtag

SEQ ID NO: 216923 - DNA, 1236 bp, Artificial Sequence
  Description of Artificial Sequence: Synthetic coding sequence
atggcccttcagattccccctagcgcaccctcgcctctgacctcttgcacctgggctcagatgactttcagcacgaaaacttctaaagagaatgaggagaatattcagtgtggcgagaacttcatggatattgagtgttttatggtcctgaatcccagtcaacagcttgctatagccgtcttgtccctcaccctggggacattcaccgtgttggagaatctgttggtactttgtgtgattttacatagcagatcattaagatgtagaccatcctaccacttcattggatccttggcagtagctgatctgcttgggtcagtgatattcgtgtactccttcattgactttcatgtattccataggaaggactcaaggaacgtttttctcttcaagttgggcggagtcaccgcgtccttcaccgcatccgtgggaagcctgttcctgaccgctattgatagatatatttccatccatcgtcccctggcatataagcggatcgttaccagaccaaaggcggtcgtcgctttctgcctgatgtggaccatcgcgatcgtgatcgcagtgcttccattgttgggctggaattgcgagaagctccagagtgtctgttctgatatatttccacacatcgatgagacgtatctaatgttctggattggagtcacttccgtcttactgctgtttatagtttatgcctatatgtacatcctgtggaaggcccactctcatgccgttcggatgatccagcgaggcacccagaaatccattatcattcacaccagtgaagacggcaaagttcaggtgactcggcctgaccaggctaggatggatattagactggcaaagaccctcgtgcttatcctggtggtgctgatcatttgttggggcccactcttagcaataatggtgtacgacgtatttggaaaaatgaataaactcattaagaccgtgttcgctttttgctctatgctgtgtctgctgaattcaaccgtgaaccctatcatttatgcacttagaagcaaagacctgagacacgcatttaggagcatgtttccttcttgcgaaggcactgcacagcccctggataacagcatgggcgattcagactgtctgcataagcacgctaacaacgccgctagtgtgcatcgcgctgctgagagttgcattaagagtactgtgaaaatcgctaaagtcactatgtccgtctccacggacactagcgcagaggctctctag

SEQ ID NO: 216924 - DNA, 1419 bp, Artificial Sequence
  Description of Artificial Sequence: Synthetic coding sequence
atgaagtccatcctggatggactggctgacaccacatttagaaccattaccaccgacctgctttatgttgggtcgaatgatattcagtacgaagacattaagggggacatggcttcaaagctgggttattttccccagaaattccccttaacaagctttcgcggttcacccttccaggaaaagatgactgcaggcgataacccccagctggtccctgccgaccaggtcaatatcaccgaattctacaacaagtcactcagtagcttcaaagaaaacgaagagaatatccagtgcggggagaatttcatggacatcgaatgcttcatggtgctcaacccttcgcagcaactggcaattgcggtgttatcactgacccttgggacctttacggtgctagaaaatttgctcgtgttgtgcgtgatcctgcatagtcggtccttgcgttgcaggccaagttatcacttcattggatcgctcgccgttgcagatctcctgggctctgtcatattcgtgtacagcttcattgacttccacgtatttcatcggaaggactcgcgcaacgtgttcctgttcaagctaggcggtgttaccgcatctttcacggcctccgtggggtccctctttctgaccgccattgatcgttacatctcaatccacaggcctctcgcatacaaacgcattgtgaccagaccgaaggccgtcgttgctttttgtctaatgtggaccatcgccattgttatcgctgttttgcctttactgggctggaattgcgaaaaactgcagtctgtgtgttcagatatctttcctcatattgacgaaacctatctcatgttttggatcggcgtaacaagtgttttactcttattcatcgtgtatgcctacatgtatatcttgtggaaagcgcactcacatgctgtcagaatgatccagcggggtacacagaaatccatcatcatccatacctctgaagatggtaaggtgcaagtgacacggcctgaccaagcgaggatggatattcgattggcgaagaccctggttctgatcttggtggtgctgatcatctgttggggcccactgctagccataatggtgtacgatgtgtttggaaaaatgaataagctaattaaaacagtgtttgcattttgtagcatgctgtgtctgttaaacagtacggtaaaccccataatatacgcattaaggagcaaagatctgaggcacgcttttaggtccatgtttccttcctgtgaagggacagctcagccactcgacaacagcatgggagactccgattgcctccacaagcacgcgaacaatgctgcctccgtgcatagagccgctgagtcctgcatcaagagcactgtcaagatcgctaaggtgacaatgtccgtgagtactgacactagtgcggaagccctgtag

SEQ ID NO: 216925 - DNA, 237 bp, Artificial Sequence
  Description of Artificial Sequence: Synthetic coding sequence
atgaagagtatactggatgggctagccgacaccacattccggacgatcacaaccgatttattatacgttggaagcaatgacatccagtacgaggacatcaagggtgatatggcttccaaattaggctactttcctcaaaagttccccctaacttcttttagaggaagtccttttcaggaaaaaatgaccgctggggataacccccagctcgtgcctgcagaccaggttaatatctag

SEQ ID NO: 216926 - DNA, 1083 bp, Artificial Sequence
  Description of Artificial Sequence: Synthetic coding sequence
atggaagagtgttgggtgacagagatagccaatggatctaaagatggacttgacagcaatcctatgaaagattacatgatccttagtggtcctcagaaaacagccgtggctgtgctctgtaccttactgggactgctttcggccctggaaaatgtggcagtattataccttatcctgagcagccatcagctgaggcggaaaccatcctacctcttcatcggcagcttagccggagccgactttctggcttctgtggtatttgcttgctccttcgtgaatttccacgtttttcatggagtagatagtaaagctgtgtttctgctgaaaattgggagcgttaccatgacattcaccgcatccgtggggtcgttactcctgaccgctatcgatcggtatttgtgtctccggtatccaccaagctataaagctctcctcacaagggggagagccctagtgacgctgggcatcatgtgggtgctgtctgccttagtgtcatatctccccctcatgggatggacttgttgcccacgcccatgttctgaattattccctttgatccccaacgactatctcctctcctggttgctgttcatagccttcctgttcagcggaataatctacacctacggacacgtgctgtggaaggctcaccagcacgttgcaagtctgtcaggacatcaagatcgccaagtgccaggcatggctcggatgagacttgatgtgcggctcgctaaaacgcttgggctggtgctggcagttctcctcatttgttggtttccagtactggctctgatggcccatagcctcgcaactacactatctgaccaggtgaagaaagctttcgctttctgttccatgctgtgcctgatcaattccatggtgaatcccgtgatctatgctttacgtagtggggaaatacggtcatcagctcaccactgcctggcccactggaaaaaatgtgtccgtggtttaggctccgaggcaaaggaggaagctcccagatcttctgtgacagagaccgaggccgatggcaagataacaccttggccggactcccgcgatctggatctaagtgactgttag

SEQ ID NO: 216927 - DNA, 1083 bp, Artificial Sequence
  Description of Artificial Sequence: Synthetic coding sequence
atggaggagtgttgggtgacggagatcgcaaacggaagcaaagacggcctggactctaatccaatgaaggattatatgatattgagtgggcctcaaaaaacagctgtcgctgtcctgtgtacactattaggacttctgtccgcactggagaatgtggctgtgctgtacctcatattgagctctcaccagctgcggagaaaacctagttatctgttcatcgggtccttggcgggagcagacttcctcgccagtgtggtctttgcatgttctttcgtgaattttcacgtgttccacggcgttgattctaaggcagtattcttactgaagatcgggagtgtgacaatgacattcactgccagcgtaggaagccttctcttaaccgcaatcgatcggtacctgtgcctgcgttacccacctagctacaaagctttactgacccgcggtagggcactcgtgacactcggcatcatgtgggttctttctgctctggtctcctacttgcccctcatggggtggacatgctgccctaggccatgttcagagctatttcccctcatacccaatgactatctgctgtcttggctcctgttcatcgcctttcttttttccggcataatatacacctatgggcacgtgctttggaaggcccatcagcatgttgcgtcactgagcggccaccaggatcgacaggtgcctggaatggcacgcatgcggctggatgtgcgcctcgcgaagaccctgggccttgtactcgccgtcctccttatttgttggtttccggtcctggctctgatggcccacagtctcgcgacaaccctgtcagaccaagtgaagaaggcattcgctttctgctccatgctctgcctgatcaattctatggtgaaccccgtgatctacgctctgcggagtggagagatcagaagcagtgcacaccactgcctcgcccactggaaaaagtgtgtcagaggcttggggtcagaggctaaagaggaggcacccaggagttcggtaaccgaaaccgaagcagacggaaaaatcactccctggcctgacagcagagatctggacctgtctgattgctag

SEQ ID NO: 216928 - DNA, 837 bp, Artificial Sequence
  Description of Artificial Sequence: Synthetic coding sequence
atggacagtatgcccgaacccgctagtcggtgcctgcttctgctgccgcttctgctgctgctccttttgctactgcccgcaccagaactcggcccatcccaggccggagccgaagaaaatgattgggttcgcctccccagtaaatgcgaagtatgcaaatacgttgccgttgagctgaagtcggctttcgaggaaaccggaaaaactaaggaggtcatcggtactgggtatggcatcctggaccagaaagcatctggagtcaagtacacaaaatctgacctcaggcttatagaagtgactgagactatttgcaaaaggctcctcgattactcgctgcacaaggaacgcactggttccaaccgctttgctaaaggcatgtcagagacctttgagaccttgcataatctggttcacaagggggtcaaggtggtgatggacatcccctatgagctctggaatgagacctcggcagaggtggccgatctgaaaaagcaatgtgatgttcttgtggaggagttcgaagaggtcattgaagactggtaccgcaaccatcaagaagaggaccttactgagttcctctgtgcgaatcacgtgctcaagggtaaggatacctcatgcctggctgaacagtggagcggcaagaaaggagacaccgccgctctggggggtaaaaagtctaagaaaaagtccagcagagcaaaggcagctggaggtaggagctcctcttcaaagcagcgtaaagagttgggtggcttagaaggagaccccagccctgaggaagatgaagggatccagaaagctagtccactaacacacagtccaccagatgaactttag

SEQ ID NO: 216929 - DNA, 165 bp, Artificial Sequence
  Description of Artificial Sequence: Synthetic coding sequence
atggacagcatgcctgagcccgcaagcaggtgcctgctcctgctcccactgctcttgttgctcctcctcctcctgcccgctccggagctagggccatcccaagccggagccgaggaaaacgattgggtgcgcctcccttccaagtgcgagggaacttgcgggtag

SEQ ID NO: 216930 - DNA, 747 bp, Artificial Sequence
  Description of Artificial Sequence: Synthetic coding sequence
atgggccctgttagactcggcatccttttgtttctgtttctcgcagtgcacgaagcttgggcaggaatgcttaaggaagaggatgacgacactgagaggcttcccagcaagtgcgaggtgtgtaaattgctcagcactgagttgcaggccgaactgtctcggaccggccgttctagagaggtgctggaactgggccaggtcctcgatacaggcaagaggaagcggcatgtgccttattctgtgtcagaaactaggctggaggaagccttagagaatttgtgtgaaagaatccttgactattccgtccatgccgaacgaaaagggtcgctcagatatgccaagggtcagagtcagactatggctacactgaagggcttggttcagaagggggtgaaagttgatctgggtatccctctggaattgtgggacgaaccctctgtggaggttacatatctgaagaaacagtgtgaaaccatgctggaggagttcgaggatattgtgggcgactggtactttcaccaccaggaacagccgctgcagaatttcctatgcgagggtcatgtattgccggcagctgaaacagcatgcctgcaggagacctggactggcaaagaaattacagatggggaggagaagacagaaggcgaagaagagcaggaagaagaagaagaagaggaggaagaagaaggcggtgataaaatgacgaagaccggttcacaccccaaactggacagggaggatctgtag

SEQ ID NO: 216931 - DNA, 798 bp, Artificial Sequence
  Description of Artificial Sequence: Synthetic coding sequence
atgcgcgaagaaatgtccctgggctgccaggaggcttttgagatctttaagcgggatcatgcagactccgttaccatcgatgacaacaaacagatcctgaaacagaggttcagcgaagcaaaggcacttggagagtctataaacgaggctcgcagcaaaataggacacctcaaggaggagattacccagcgtcatatccaacaggtagcactcggcatttctgaaaacatggcagttccactcatgcctgaccagcaagaggagaaactgcgaagtcaactggaagaagaaaaacgtaggtacaagacaatgttcacacggctcaaagccctgaaggttgagatagaacaccttcagctcctcatggataaggccaaagtcaaattgcagaaagaattcgaggtctggtgggccgaggaggcaacgaatctgcaggtgaatagtccggctgtaaactccctggaccacaccaagccctttctgcagacaagtgactctcagcatgagtggtctcagctgctgagtaacaagtcttctggtgggtgggaggttcaggatcagggcacaggcaggttcgacgtatgtgacgtgaatgcgagaaagatcttgccaagtccctgcccttccccgcatagccaaaagcagtccagtacctccacgccattagaggatagtattcccaagcggcctgtgtctagcattccactaactggagattcacagaccgactctgatattatagcgtttattaaagccagacagtcgatccttcagaagcaatgcctggggtcgaactag

SEQ ID NO: 216932 - DNA, 1185 bp, Artificial Sequence
  Description of Artificial Sequence: Synthetic coding sequence
atggctaacatgcaaggacttgttgaacgactcgagcgggcagttagcagactggaatctctgtctgctgaaagtcatcgtcctcctggcaattgcggcgaggtgaacggcgttatcgctggcgtggccccatcggtggaagcattcgacaaattgatggactcaatggtggccgagttcctgaagaacagtcgaatccttgcaggtgacgtggaaactcacgccgagatggtgcacagcgcctttcaggcacagagggccttcctcctgatggcttcacagtaccagcagccccacgagaatgatgtggccgctcttcttaagcctatttcagagaagatccaggaaatacagacctttcgggagagaaatcggggaagcaacatgtttaatcacctctcggctgtgagcgagagcatccctgctctcggttggattgccgtcagccctaaaccgcctcctctcccgccacctggacctccccctttattcgagaatgaaggaaaaaaagaggagtcgtccccctctagaagcgctctgtttgcccagctgaaccagggcgaagcaattacgaagggcctaagacacgtcacggatgaccagaagacctacaagaatcctagtttgcgcgctcagggagggcaaacacagagcccaaccaagtcgcacacaccctcacccacaagtccaaaaagctatccatcacagaagcacgcacctgtcttagagctcgagggcaagaagtggagagtcgagtatcaagaggatcgcaatgatctggtcatctctgaaacagagctgaaacaggtcgcttatatcttcaaatgcgagaaatctacaattcaaatcaaaggcaaagtgaattccattatcattgacaactgcaaaaaactgggactggtattcgacaatgtcgtgggaatcgtggaagtgataaacagccaggatattcagatacaggttatgggacgggtccctacaattagtattaacaagactgagggctgccacatatacttgtccgaagatgctctggattgcgaaatagtgtcagccaaatcatctgagatgaacattcttataccgcaggacggcgactatagggagtttcccatcccagagcaattcaagacagcctgggatggttcaaaactcatcaccgaaccagccgagatcatggcgtag

SEQ ID NO: 216933 - DNA, 597 bp, Artificial Sequence
  Description of Artificial Sequence: Synthetic coding sequence
atgaaactgtattccctgtcagttctttataaaggcgaggctaaagttgtccttctgaaggcagcatacgatgttagtagtttctcctttttccagcgctcaagcgttcaggagttcatgacctttacctcacagttaatcgttgaacgttcctcgaaggggactcgcgcatcggtgaaggagcaggattacctatgtcatgtgtacgtccgcaacgattccctggctggcgttgtgatcgctgacaatgagtacccatcgagggtcgcgttcacacttctggagaaagtgctggatgagttcagtaaacaggtggaccggatagattggccggtcgggtctcctgctacaatccattacccagctctggatgggcatctgagccggtaccagaacccaagagaggccgaccctatgaccaaagtgcaagccgagcttgacgagactaagattatactccacaataccatggagtcactgctggaacgtggcgaaaaactggatgacttggtctccaaatctgaggtgctcggtacacagtcgaaagctttctataaaaccgcgagaaagcaaaattcatgttgcgcgatcatgtag

SEQ ID NO: 216934 - DNA, 3036 bp, Artificial Sequence
  Description of Artificial Sequence: Synthetic coding sequence
atgcagaagccctctggacttaagcccccaggccgtgggggtaaacactcatctcccatgggacgcacatccaccggtagcgctagctcttcagcagccgtggcggcatcatctaaagaagggagcccactgcacaaacagagtagcgggccaagtagcagcccagcagctgccgcagcccctgagaaacctgggccaaaggcagccgaggtcggcgatgacttcctgggggatttcgtggtaggtgagagagtgtgggtgaatggggttaagccaggtgtggtccagtatctaggagaaacacagttcgccccaggccagtgggccggagttgttctggatgaccctgtgggcaagaacgatggcgcagtggggggagttagatacttcgaatgccccgcactgcaggggattttcacgcggccatctaaacttacacgtcagcccacagccgaaggatccggatctgacgcacattccgttgaatcgctgactgcccagaacctgtcactgcactctggcactgccacaccccctctgacgagccgagtcattccacttagggagagtgtcctgaactcatccgttaagacaggcaatgagtccgggagcaacctgtccgacagtggatccgtgaagaggggcgagaaggatctcaggctgggggatagagtcttagtcgggggaaccaaaaccggagtggtcaggtatgtcggtgaaacagacttcgccaagggggagtggtgtggcgttgagctcgatgagcccctgggtaaaaatgatggagccgttgctggtacccgctactttcagtgcccccctaagttcgggttattcgcccctattcacaaggtaatcagaatcggctttccttctaccagtcccgcaaaagccaagaaaactaagcgtatggccatgggggtgtccgctctgacccatagccctagctcctcttcaattagtagtgtgtcttcggtggcatcaagcgttggcggtcgtccatctaggtccgggttgctgacagagactagctctcggtatgcccgaaagattagtggcacaaccgctctgcaggaagcactgaaagaaaagcagcaacacatcgaacagttactcgccgaacgggatctggaaagggccgaagttgctaaggcaacttcccatatctgcgaagtggagaaagaaatcgccctactgaaggctcagcacgagcagtacgttgcagaggccgaagagaaacttcagcgagccagattactcgttgaatccgtgaggaaggaaaaagtggacctctcgaatcaacttgaagaggagcgcagaaaggtggaagatttacaatttcgggtggaagaggaatctataaccaaaggcgatctcgagcttactaccgtcgcagagaaaagcagggtgctccaattggaggaagagctcactttgagacggggagagatagaagaactgcagcagtgtcttttgcactctggccctccccctcctgaccacccagatgctgccgaaatactaaggctacgcgagagattgctgtctgcatctaaggaacatcagcgcgagagcggagtgctcagggacaagtatgaaaaggccctgaaggcataccaggcagaggtagataagctgagggccgctaatgaaaagtatgctcaggaggtggccggacttaaggacaaagtgcagcaggctacctctgaaaatatgggactcatggataactggaagagtaaactggacagcttggcaagcgaccatcagaagagcctggaagacctgaaggctaccctgaacagtggtcccggtgctcagcaaaaggaaattggtgagctgaaagccgtgatggagggaattaagatggaacatcaactcgagctgggcaatctgcaggctaagcacgatttggaaactgcaatgcatgttaaagagaaggaggcccttcgcgaaaaactacaggaggcgcaggaggagctggcaggactccagcgtcactggagagcacaactggaagtccaggcctcacaacaccggctagagctccaggaggcccaagaccagaggcgcgacgctgaactaagggtgcacgaactcgagaaactggacgtcgaataccgtggtcaggctcaagcaatagaattcctaaaagagcaaatttctttggccgagaaaaagatgctcgactatgagaggctgcagagggcagaggcccaggggaagcaggaggtggaatccctaagagagaagctcttggtagcagagaaccggctgcaggctgtcgaggcactgtgtagcagccagcatacccacatgatagagagtaacgatatatcagaagagacaattaggacaaaggagaccgtggaaggcctgcaagataagctgaacaagagggacaaagaggttaccgcacttacatcacagaccgaaatgcttcgagcacaggtgtctgcgcttgaatcaaaatgtaaaagtggagagaagaaggttgatgctttgcttaaagagaaaaggcgccttgaggctgagctggaaactgtgtcccgtaagactcatgatgccagtggccagctggtgcttatcagtcaggagctcttacgaaaggaacggtctttgaacgaactgagagtcctgcttctggaagccaatcgccacagccccggacccgagcgagacttgtctcgcgaggtgcataaggctgagtggaggataaaagaacaaaagctaaaagacgatattcgcggactgcgagaaaaactcacgggcctggataaggaaaaaagtctctcggaccagagaagatactctcttatagaccgttcgtcagccccagaattgctccggttacagcaccagcttatgagtacagaggacgcgctccgtgatgcactcgatcaggctcagcaggtcgagaagctgatggaagctatgagatcttgtccggataaggctcagacgattggcaattcagggagtgccaacggaatccatcagcaggataaggcacaaaagcaagaagacaaacactag

SEQ ID NO: 216935 - DNA, 3141 bp, Artificial Sequence
  Description of Artificial Sequence: Synthetic coding sequence
atgcagaagccttccggcctgaagccccctggtcggggtgggaagcacagcagccctatgggtagaacctccacaggctctgcctcgagctcggccgctgtggctgcatccagtaaagaaggatcaccactgcacaaacagagcagcgggcctagcagtagcccagctgctgccgcagcaccagagaagccaggccctaaagcagccgaggtgggcgacgatttcctgggagacttcgtggtgggggaaagggtctgggtcaatggagttaaaccaggggtggtccagtacctcggggaaactcagtttgccccaggtcagtgggccggagtggtgctcgacgatcccgtcgggaagaacgacggtgctgtggggggagtccgctatttcgagtgccctgccctccagggcatcttcacccgcccatcaaaactgactagacaaccaactgccgaaggtagcggttcagatgcccacagcgtagaaagtctcacggctcagaacttgtccctacacagcggaactgctacgccacccttgacctctagagtgattccccttagagagtctgtgttgaattcaagtgtgaaaacgggcaacgagtccgggagcaacctgtctgactcaggatcagttaaacgcggtgagaaagatctccggctcggagacagagtgctggtcggtggtactaagaccggggtcgtcagatacgtgggcgaaactgattttgccaagggggagtggtgcggcgtagagttagacgagcccctgggaaagaacgatggggctgtcgccggaaccagatactttcagtgcccccctaaattcggcctctttgccccaattcacaaagttatccggatcggcttcccttcgacgtctccagccaaggctaagaaaacaaaaaggatggcgatgggagtatctgctttaacgcactccccctcttcctcgagcatcagcagcgtgagcagtgtggcttcctcagttgggggaaggccttcccgctcaggactgctgactgagacatccagcaggtacgctagaaagatctccggcaccactgcacttcaggaggccctgaaagaaaagcagcagcacatcgaacagctgcttgcggaaagagacctcgaaagggcggaagtggcaaaggcaacctcacatatctgcgaggtggaaaaagagatagcccttcttaaggcccaacacgagcaatacgtcgcggaggccgaagaaaagctgcagcgtgctcggcttctagtcgaaagcgtacggaaggagaaagtcgacctgtcgaatcagctggaggaggagcgacgcaaagtggaggatttgcaattccgcgtggaggaggagtcaataaccaaaggggatctggagactcagacccagctggaacatgcaagaatcggcgaactggaacagagtttgctactggaaaaggcacaagctgaacggttactccgagaattagctgataatagactgacaaccgtggctgagaagagcagagttctgcaattggaggaagagctaacccttagaaggggtgaaatcgaagagctacagcaatgccttctgcattccggtccacccccacccgaccacccagatgcagcagagattctacggctcagggagaggctgctctcagcctccaaggagcaccaaagagaatcaggcgtgttacgagacaagtatgaaaaagcactaaaagcttaccaggctgaggtggataaactccgagccgcaaacgaaaagtatgcacaggaggtcgcgggtttgaaagacaaagtccagcaggccacctccgagaatatgggcctaatggataattggaagtccaagctggattcattagcatccgatcaccaaaagtcattggaagatctcaaagccactcttaactcaggtccaggagcacagcagaaagagattggcgagctgaaggccgttatggaaggaatcaagatggagcaccagctcgagcttgggaacttgcaggccaaacatgacttagagacagcaatgcacgtcaaagaaaaggaagccctacgggagaagctgcaggaagcgcaggaagagctcgctggtttgcagcggcattggcgggcacaactcgaggtgcaggcttcccagcatcgattagaactgcaggaagcacaggaccaacggagggacgccgagttacgcgttcatgaactggagaaactcgatgtcgagtaccggggacaggctcaggctatcgagtttctgaaggaacagatctcccttgcagagaagaagatgctggattatgagcgattacagagggcagaggcgcaggggaagcaggaggtggagtcactgagagagaaactgttggtggcagagaatcgccttcaggctgttgaggcgctctgttcatcccagcacacccatatgatcgagagcaatgacatctccgaggagactattagaaccaaagaaacagttgagggcctgcaagacaagctgaacaaaagggacaaagaggttacagcactgacgtctcagaccgagatgttgcgggcacaagtgagcgcgttggagtcaaagtgcaagagtggtgaaaaaaaagtggacgctctcctgaaggagaaacgcaggttggaagctgagcttgagacagtttcaagaaaaactcatgatgcgtctggccaacttgtactcatctcccaggagttgcttcgaaaagaaaggagccttaatgagttgcgagtactactactagaggctaaccggcactctcctggaccggaacgcgacctctctagggaggtgcacaaggcggaatggaggatcaaggaacaaaaattgaaggacgacattcgagggttgcgggaaaagttgactggactggacaaggagaaaagtctgtccgaccaaagaagatattcactcatcgacaggtccagcgctcccgagctgctccgcctacagcatcagttgatgagtaccgaggacgcactgcgcgatgcattggaccaagcccaacaagttgagaagctgatggaagccatgcgctcttgccctgataaagctcagactataggaaacagtggctcagccaacggaattcatcagcaggataaagctcagaaacaggaagataagcattag

SEQ ID NO: 216936 - DNA, 153 bp, Artificial Sequence
  Description of Artificial Sequence: Synthetic coding sequence
ttagaagaagaaagaagaaaggtggaagatcttcagttccgcgtagaggaggaatcgatcactaagggagatttggaggccgaggatcatctgagtccagagccctccatgctcactaccgtggctgagaagtcccgcgttctccagctgtag

SEQ ID NO: 216937 - DNA, 3141 bp, Artificial Sequence
  Description of Artificial Sequence: Synthetic coding sequence
atgcagaagcccagtgggctaaaacctcctggcagagggggtaaacacagttctccaatgggccgtacatcaacaggcagtgctagtagctcggccgctgtcgcagcctccagcaaggagggctccccactgcataagcagtctagtggaccttcaagttcccccgctgcggcagctgcccctgagaaaccaggccctaaagctgcagaagtgggggatgacttcctaggcgacttcgtggtcggagagagggtttgggtcaatggcgtcaagcctggcgttgtccaatacttgggggagacacagtttgccccaggccaatgggccggtgtggtcctcgacgatcccgtgggtaaaaatgatggggctgtggggggtgtgcgctactttgaatgtcccgctttgcaaggaatttttacccggccaagtaagcttacacggcaacccacagctgagggcagtggaagcgacgctcattcagtcgagtcactgactgcccagaatctgagtctccactcaggaacagcaacccctcccctgaccagccgcgtgatccctctgcgcgagtccgtgctgaactctagtgtcaagacaggtaatgagagcgggagcaacctgtccgattctggttccgtcaaacgcggtgagaaggacctgcgacttggagatcgggtcctcgtgggcggaactaagacaggagtcgtgcggtacgtcggcgagactgacttcgcaaaaggcgagtggtgcggggtggagcttgatgagccactggggaagaacgatggcgcagtagccggaacacgatattttcaatgtccacccaagtttggcttatttgccccaatccacaaggtgatacgcatcggattccccagcacaagtccagcaaaggccaaaaaaaccaaaagaatggccatgggcgtgtccgctttaactcacagtccatcaagtagcagcataagctctgtgagcagcgtggcctccagtgtggggggacgaccctcacggagcgggctacttaccgaaacttcctcccgctacgcacgcaaaatctcagggaccactgcactgcaggaagcactgaaggagaagcagcagcatatcgagcagctgctcgccgagagggacctagagcgagctgaggtagcgaaagccaccagtcatatttgtgaagtggaaaaagagatcgcactgctaaaggcacagcatgagcaatacgtggctgaagccgaagagaaattgcagcgggcacgtctactggttgaatctgtgagaaaggagaaagtcgatttgagcaatcagttggaagaagaaagacgtaaagttgaagatctgcagtttcgcgtcgaagaggagagtattacaaagggcgatttagagacacagactcagctggaacacgcaagaattggtgaattagaacagtctctgctgttggagaaggctcaggctgagcgactgctccgggagttggctgataaccggctgacgacagtggccgagaaatccagggttcttcagctggaggaggaactgacgctgcgacggggtgagattgaggagctgcaacagtgcctacttcactcaggacctcctcccccagatcacccagacgccgcagagatcttacgccttagggaaagacttctgtctgcctctaaagagcatcagcgggagagcggggtactcagggataaatatgagaaggcactcaaggcataccaggccgaggttgacaagctccgggcagcaaatgagaagtacgcgcaagaggtagcagggctgaaagacaaagttcagcaggcgacgtctgaaaatatggggttaatggataattggaaaagcaagttagactcactggcctctgaccatcagaagtctttggaggatctgaaggccaccttgaattccgggcctggggctcagcaaaaggaaattggcgaactcaaggccgtgatggaaggcatcaagatggagcatcagctcgaattgggcaatctgcaggccaagcacgaccttgaaacagctatgcatgtaaaggaaaaggaagctctccgtgaaaagcttcaggaggcccaggaggagctagcgggacttcaaaggcattggagggcccaactagaggtccaggcctcccagcataggttagaactgcaggaggctcaggaccagagaagggatgccgagctgcgcgtgcatgagctcgaaaagttggatgtggagtaccggggtcaagctcaggccatcgagtttctgaaagagcagatttcccttgccgagaaaaaaatgctcgattacgaacgccttcagagggcggaagcccaaggcaagcaggaggtggaatccctgagggagaagctccttgtggcggaaaacaggctgcaggccgttgaggccctctgctcatcccagcacacccacatgatagagtctaatgacatctccgaagagaccattagaacaaaagagaccgttgaaggccttcaggataagttgaacaaacgcgacaaagaggttactgctctgacaagccagaccgagatgctccgggcacaggtgtctgccctcgagtctaagtgcaagagcggcgagaagaaagtggacgcgctcctgaaggaaaagaggcggttggaagccgaactggaaacggtgtccagaaaaacacatgacgctagcgggcagctcgtgctgatatctcaggagctgctacgcaaagaacggtcactgaacgagttaagggtgctgctcctggaggccaataggcacagtccgggacctgaacgggacctgagccgtgaggtgcataaggccgaatggcggattaaagagcagaagctgaaagatgatatcaggggcttacgggagaagttgaccggcctcgataaagagaagagtctcagcgatcagcgcaggtatagcctcattgaccgaagtagcgcccctgagctgctgcggctccagcaccagttgatgagcaccgaagatgccctccgtgatgccctggatcaggcacagcaggttgaaaagttgatggaggctatgaggtcctgcccagataaagctcagactattgggaactcgggctccgctaatggcattcaccagcaagataaagctcagaaacaggagaacactcattag

SEQ ID NO: 216938 - DNA, 4827 bp, Artificial Sequence
  Description of Artificial Sequence: Synthetic coding sequence
atgtacagcgcacacaggccactgatgcctgcctccagcgctgccagtcgcggacttggaatgtttgtgtggaccaacgtcgagccgaggagcgtggccgtcttcccatggcacagcctggtgccctttctagccccttctcagcccgacccatcagttcagccctccgaggcacagcagcctgccagccaccccgtggcaagcaaccagtccaaggaacctgcagagtccgccgctgtcgcacacgaacgccctccgggtggcacgggcagcgctgaccccgagcgcccaccaggggctacctgtcctgagtccccaggtccaggccctccgcaccctcttggtgtcgtcgagagtggaaagggaccccctcccacaaccgaggaagaggcctccggccctcccggagaacccagacttgacagtgagaccgagagcgaccatgacgacgctttcttatcaatcatgagccctgaaatccaactaccgctgcctccgggaaaaagaaggacccagtccctctccgctctccccaaggagcgtgatagttcttcggagaaggatggacgcagccctaataaaagggaaaaagatcatattaggagaccgatgaatgcgttcatgatttttagcaaacgacaccgggctctggtccatcagcgccacccaaatcaggataataggaccgtgtcaaagatcctcggcgagtggtggtatgcactaggccctaaggagaagcagaaatatcatgatcttgctttccaagtgaaagaggcgcattttaaagcccacccagactggaagtggtgtaacaaagatagaaagaagtcatcatctgaagccaagccgacaagcttggggcttgcaggaggccataaggagacacgcgaaaggtcgatgtccgagaccggcacggctgcggctcctggagtgagcagcgagcttttgtcagttgccgctcaaacattactttcttccgacacaaaagcaccaggatcaagctcatgcggggctgagcggctgcacactgtgggcggacccggatccgcacgcccaagagccttctcccactccggggtacactccttggatggcggagaggttgacagccaagccctgcaggagctaacacaaatggtaagtgggccagctagctattcaggcccaaagccctccactcaatacggagcacctgggccatttgccgctcccggagaaggcggagctctcgccgctacgggcagaccacccctgctccctaccagagcttcccgatcccagagagctgcgagtgaggacatgacatcagatgaggagcgaatggtcatatgcgaggaggaaggagatgacgatgtgatagccgacgacgggtttggcacaactgacattgatttgaagtgcaaagagagagtgaccgattccgagagtggtgatagctcaggcgaagatcccgagggcaacaagggtttcggaagaaaggttttcagcccagtgattcgcagttcatttactcattgtagacccccactcgatcctgaaccccctggcccaccggaccccccagtcgccttcggaaaaggttatggctcagctccctcctcatctgcaagtagcccggcaagcagcagcgcgtcggctgccacaagcttctctctggggtctggtaccttcaaagcgcaggagtccggtcaaggaagcactgctggtcccctcagacctcctccccctggtgcgggtggcccagccaccccatccaaggctacgaggttcctccctatggatcccgctaccttccggcgaaaaaggccggaatccgtgggaggactggagcccccaggcccttccgtgatcgctgcccctccgtccggcggtggaaatatcctgcagacactggtgctccctcctaacaaagaagagcaggaaggaggcggtgcccgtgtcccatcagctcccgcaccaagtctggcgtacggcgctcccgctgcgcctctgtcccgcccagcagccacaatggtgaccaacgttgtcagacccgtgagttccacaccggtccctatcgcctctaaacctttcccgacaagtggccgtgcggaggcttctccaaatgacaccgccggagccagaaccgaaatgggcaccggttccagagttcccggaggaagtccattgggtgtgtccttggtttattcagataagaagtctgcagctgcaactagccctgcccctcacttagtggctggccctctgctgggtacagtgggcaaagcgcctgccacagtcactaacttgctcgttggtaccccaggatacggcgcaccagctcctccagcagtgcagtttattgcacagggcgctcctggaggtgggacaactgcaggaagcggagcaggggcaggcagtggacccaatggtccagtgccactgggcattctgcaaccgggtgcattgggcaaggccggaggcataactcaagtccagtacattctgcctaccttgccccaacagctacaggtggccccagccccagcacctgcaccgggtaccaaggccgctgcaccttcagggccagcacctactacgtcaatccgtttcacgcttcctccagggacctctacaaatggcaaggtcctcgctgccaccgccccaacaccaggcattcccattttgcagagcgtgccaagcgcccctccaccaaaggcacagtcggtgagtccagtccaagcccctcctcctggcggtagcgcccagctgcttccagggaaagtgttagtgcctctcgcggctccaagcatgtcagttcgcggagggggtgcgggtcagccgctccctttggttagccccccattctcagtgccggttcaaaacggtgctcagccaccatccaagatcattcaattgacaccagtgcctgtgagcactccatctggtttggtcccacctctgagccctgccacattgccgggacctaccagtcaacctcagaaagtgttgctgccttcttcaactcgaattacctacgtgcagtccgccggagggcacgctctgccacttgggacaagtcctgccagctcccaggccggaaccgtcaccagttacgggccaacaagctctgtggctcttggcttcacctccttgggacccagcggcccagccttcgtgcaaccacttctgagcgccggacaggcccctctcctggctcccggacaagttggagtcagccctgtgccatccccacaattgccacccgcttgtgcagctcccggtggacccgtgataactgccttctacagcgggagcccggcacctaccagctccgccccactggctcagcccagtcaagcaccaccctccctggtgtacacggtggcaaccagcactaccccccctgccgctaccattttgccaaagggaccgcctgctcctgcaactgccaccccagctccgaccagcccatttcctagcgccactgcagggtccatgacatacagtctagtcgcccctaaagcacaacgcccaagccctaaggcaccccagaaggtgaaagctgccatagcctctatcccagtgggttcctttgaagccggagccagcgggagaccaggcccagcccctagacaaccacttgagcctgggcctgtgagggaacctaccgctcccgaatctgaactggaaggccagccaacccctccagctccaccaccattgcctgagacgtggactccaaccgcacggtcgtcccctcccctgccccctccagcggaagagagaacgtcagcgaagggtccggagaccatggccagcaagttccccagcagctccagcgattggcgcgtccctggtcagggccttgagaatagaggagaacctccaacacccccttccccggcaccagctccagcagttgcccctgggggatcaagcgagtcaagttctggacgtgccgctggggacacaccagaaaggaaggaagccgcaggtacgggcaagaaagtgaaagtacgcccacccccactgaagaaaacatttgattccgtggacaaccgcgtgctgagtgaggtggacttcgaagagcgctttgcagagctccccgaatttagacccgaagaggtcctgccctcacccaccctgcagagtctagccactagccctagagcaatccttggtagctaccgaaagaagcgtaagaattccaccgacctggatagcgccccagaagacccaaccagtccaaaacgtaagatgcggagaaggtccagctgtagtagtgagccgaacacccctaaaagcgccaagtgcgaaggtgatatatttaccttcgatagaacaggaacggaggccgaagacgtgctgggggagttggaatacgataaagtgccctacagttccctgcgtagaactttagatcagcggagagctctcgtgatgcagctgtttcaggatcacggattctttccctccgctcaagcgacagctgcctttcaagctcgttatgccgacattttcccttccaaggtgtgccttcagctgaagataagagaagtgaggcagaagatcatgcaagccgcaacaccaaccgagcagcccccaggtgcggaggctccacttcctgtgcccccacctactggcacggcagccgcaccagccccaacgcctagcccagcagggggtcctgacccaacctccccatcaagtgatagtggcaccgctcaggccgcacctccgttgccccctcctcccgagagcggaccaggccagccgggatgggagggagctccccagcccagccccccacccccagggccaagcactgccgctacaggtcgctag

SEQ ID NO: 216939 - DNA, 1002 bp, Artificial Sequence
  Description of Artificial Sequence: Synthetic coding sequence
atgtacacagctattccgcagtcgggctctcccttccccggatccgtacaggaccctgggctgcacgtctggcgggtggaaaagctgaaaccagtgcccgtggctcaagaaaaccaaggggtcttcttttctggcgacagttatctcgtgttacataatggtcccgaggaagtatcccatctgcatctgtggatcggacagcagagcagccgggatgaacaaggtgcatgtgcagttctggcggtacatttgaacaccctcctaggcgaacgccctgtgcagcatcgggaggtgcaaggcaatgagtcagatctcttcatgagctattttccgaggggtctcaaatatcaggaaggtggtgtcgagtcagcgttccataagacatccacaggtgcacccgcagctattaagaaactgtatcaggtgaagggcaagaaaaacatccgagccactgagcgggctctgaattgggacagcttcaacacgggggattgcttcatactcgatcttgggcagaacattttcgcttggtgtggaggcaagagtaacatactggagcggaacaaggcacgcgatctggccctagcaatcagggacagtgagagacagggcaaggctcaagttctcggtcctaagccagcacttaaggaaggcaatcccgaagaggatctcactgctgataaagccaatgcccaggccgcagccctctacaaagtgagtgacgcaactggacagatgaatcttactaaggttgcagactcctcaccctttgccctggaactgttgattagcgatgactgtttcgtactggacaacgggttgtgtggaaaaatatacatatggaaagggaggaaagccaacgagaaagagcgacaggccgcacttcaagtggcagagggcttcatctctcgaatgcaatacgcgcctaatacacaggttgaaatactaccccaggggcacgagtcaccgattttcaaacagttttttaaggattggaaatag

SEQ ID NO: 216940 - DNA, 861 bp, Artificial Sequence
  Description of Artificial Sequence: Synthetic coding sequence
atggcagacttcgatgaccgggtctcggatgaggagaaagtgcggatcgctgccaaatttatcacacacgcaccgcctggggaattcaatgaagtgtttaacgatgtgcgcctgttgctgaacaacgacaaccttctgagggagggcgcagcccatgccttcgcacaatataacatggatcaatttacgcccgttaagattgagggatatgaggatcaagtcctcatcacggagcacggcgacttagggaacagcagatttctggatccaaggaataagatttcctttaagtttgatcatttgaggaaagaagctagcgatccgcagcctgaggaagctgacggcggacttaagtcctggcgcgaatcatgtgatagtgctctgagggcttacgtcaaggatcattactcgaatggtttctgcactgtgtatgctaagactatcgacgggcagcaaaccatcatagcctgcattgagagccaccagttccaaccaaaaaatttctggaatggtcggtggagatcagaatggaagtttacgataaccccacccacagctcaggtggtgggtgtcctgaaaatacaggtgcattactacgaagatgggaatgtgcagctcgtctcgcataaggatgtacaggattcactgaccgtatctaatgaagcacagactgccaaggagttcattaaaataatagagaacgccgagaatgaatatcaaactgcaattagcgaaaactaccaaaccatgagcgataccacgtttaaggccctcaggcggcagctaccagttacccggactaagatcgattggaacaagatcctgtcctataaaattggcaaggagatgcagaacgcatag

SEQ ID NO: 216941 - DNA, 861 bp, Artificial Sequence
  Description of Artificial Sequence: Synthetic coding sequence
atggctgatctggaggaacagctcagcgatgaagagaaagtgcgtattgcggcaaaatttattattcatgcacctcctggagagttcaacgaagtgtttaacgacgttcggttactgctcaataatgataatctgctgagagaaggtgccgcacatgcctttgcccaatataacctggatcagtttacgccagtgaagatcgagggatatgaggaccaggtcttaataacagagcacggagatctgggaaacggcaagtttctcgaccctaaaaatcgtatctgcttcaaatttgaccacctgagaaaagaggccactgaccctagaccgtgcgaggttgagaatgctgttgaaagctggaggacatctgtggagactgccctaagagcctatgtcaaggagcactatccgaacggggtttgtaccgtatacggcaaaaagattgacggacagcagaccattatcgcttgtattgaatcacaccaattccaggccaagaatttttggaacgggagatggcgcagcgagtggaagttcacaatcaccccgtccacgacgcaagtggtgggtatcctgaaaattcaggtgcactactatgaggatgggaacgtgcagctggtgtcgcataaggacattcaggacagcctcaccgtctccaacgaagtgcagaccgccaaagaattcattaaaattgtggaagccgcagagaatgaatatcaaaccgccattagcgagaactatcagacaatgtcagataccacctttaaggccctccgcaggcagctgcctgtgacaagaacaaaaatcgactggaataagattctgagctacaaaatcgggaaagaaatgcagaatgcctag

SEQ ID NO: 216942 - DNA, 519 bp, Artificial Sequence
  Description of Artificial Sequence: Synthetic coding sequence
atggccgacctggaggagcagctgtcggatgaagaaaaggtgaggattgccgctaagtttataatacatgcccctcccggtgagttcaacgaggttttcaacgatgtgagattgctgctcaacaatgacaacctgctgagggagggagctgcacacgcctttgctcagtacaacctggaccagttcactccagtcaaaatcgaggggtatgaggatcaggtcctaattaccgaacacggtgacttgggaaatggtaagtttttggatccaaagaatcggatatgtttcaaattcgaccatctgcgaaaggaagctactgaccccagaccctgcgaagtcgagaatgccgttgaatcttggcggaccagtgtggagactgccctgcgggcttacgtcaaagaacactatcctaacggagtgtgtaccgagtggagtctcgaggtgcgcatggaagtttacaaccactcttttaaccattcatcagggtggcacctcgagaatagcggcagcctcttgtag

SEQ ID NO: 216943 - DNA, 900 bp, Artificial Sequence
  Description of Artificial Sequence: Synthetic coding sequence
atgacgctgagtgtcctgagcaggaaagataaggagcgggtgataagaagattgctgctccaggcacctccaggagaattcgtgaacgcattcgacgacctgtgtctgctcatccgggatgaaaagttgatgcaccaccagggagagtgcgccggacaccagcactgtcagaaatattctgtgcctctgtgtatcgatgggaatcctgttcttctgagtcatcataatgtgatgggggattaccgattttttgaccatcagagcaagctttcttttaagtacgatttactccagaatcagttgaaagatatacagtcacacggcatcattcaaaacgaagcagaatatttgcgtgtggtcctcctttgtgccttgaaactgtatgtcaacgaccattaccccaagggaaactgcaacatgttaaggaagacggtgaaatccaaagagtacctgatcgcctgcatcgaggaccataattatgagaccggcgaatgttggaatgggctgtggaagtcgaagtggatttttcaggttaatccattcctgacgcaggttacaggacgaatattcgttcaggcacattttttcagatgcgtgaatctacacatcgagatcagtaaggatctgaaggaatccctagaaatcgtcaaccaggctcagctcgcattgtctttcgcccgattagtggaagagcaggagaacaaattccaggcggcagttctcgaggagctccaagagttaagcaacgaggctctccgaaaaattctgagacgggatttgcctgtgacccggaccctgatcgactggcacagaatccttagcgatctgaatctggtcatgtaccccaaactcggctatgtaatctattccaggagcgttctgtgcaactggattatttag

SEQ ID NO: 216944 - DNA, 834 bp, Artificial Sequence
  Description of Artificial Sequence: Synthetic coding sequence
atgtcagatcagcagctggattgcgccctggacctgatgcggcgtctgcccccacagcagatcgagaagaatctgtctgatcttattgacctagtcccctcactttgcgaagacctgttgtcctctgttgaccagccactgaaaatagctagagacaaggtggtgggaaaagattatcttctgtgtgattataacagggatggggactcctacagatcaccatggtccaacaaatatgatccaccgctcgaggacggcgcaatgccaagcgctaggctgaggaaactggaggtggaggccaataacgcctttgaccagtacagggacctgtactttgaagggggagtgagttccgtgtatttgtgggatctagaccacggtttcgccggagttatactgatcaaaaaggcaggcgatggtagcaaaaaaattaaggggtgttgggacagcatccacgtggtcgaggttcaggaaaaaagcagtggcagaaccgctcactacaaactgacttccaccgtgatgctctggctgcagacaaataagagtggcagtgggacaatgaatcttggaggctccctgactaggcagatggagaaagatgagaccgtaagtgactgctcacctcatattgccaacatcggcagattggtggaggacatggaaaacaagatccgcagcactttgaacgagatctatttcggaaagacaaaagatatagtgaatgggttgcggtccatagatgcgattcccgataatcagaaatttaaacagctgcagagagaactgagtcaggttctgacacagaggcaaatttatatccaaccagataactag

SEQ ID NO: 216945 - DNA, 783 bp, Artificial Sequence
  Description of Artificial Sequence: Synthetic coding sequence
atgccacgccagttccaggacaccggcttttctcgacccggattgggtcaaccgagacgctgcgaccctgagcctcggaagtcagatcagcaactcgattgtgccctggatctgatgcgacggctgccacctcagcaaattgaaaaaaatctatctgacctcatcgatttggttccctctctttgtgaggatcttcttagttccgtggaccagcctttgaagatcgcaagggacaaggtagtcgggaaggactaccttctttgtgattataatagagacggagatagttaccggagcccctggagcaacaaatacgaccccccattggaggacggagcaatgccttctgccagactgcggaagctggaagtggaagcgaacaacgcttttgatcagtatagagacctctacttcgaagggggagtaagctctgtttacctttgggatctcgaccacggcttcgctggcgtgatactcatcaaaaaggcaggcgacggctccaagaagatcaaaggatgctgggactctatccacgtggtggaagtacaggagaagagctctggtcgcaccgcgcactataaattgacatccaccgtgatgctgtggttgcagaccaataagtcggggagcggaacaatgaacctcggcggatcactgaccaggcaaatggagaaggatgagacagtgtctgactgtagcccccacatcgccaacattggccgtttggtggaggtgtgtgccgatttctgtaggcaaattaagacgaggtcctccgaggagtag

SEQ ID NO: 216946 - DNA, 834 bp, Artificial Sequence
  Description of Artificial Sequence: Synthetic coding sequence
atgtcagaccagcagctagactgtgctctggacctgatgcgacggctgccgcctcagcagatcgaaaagaatctgagcgacctgatagatctggtgccttccctctgcgaagatctgctgtcttcagtggaccagccactcaagatcgcccgagataaggtcgttggtaaggactacctcctttgcgactacaatcgagacggcgattcctatcgttccccttggtccaacaagtatgatcccccattagaagatggagctatgccatctgcccgactgcgcaagctagaagtagaagcgaataatgcatttgatcagtaccgtgacctgtacttcgagggaggcgtgagtagcgtgtacttgtgggacctggatcatggcttcgctggcgtcattctgattaaaaaagccggagatggatccaagaagattaagggctgttgggacagcattcatgtggtggaagtccaagaaaagtcaagcgggaggacggctcactacaaattgacctccactgttatgctgtggctgcagacaaataaaagcggctccggcaccatgaaccttggtggttccctcacccgacagatggaaaaggatgagactgtctcagattgcagtccccatattgctaacatcggcaggctggttgaggacatggagaacaaaatccgttctacccttaatgagatatatttcggcaagaccaaagacatcgtgaacggcctacgatctatcgatgctatcccagacaaccagaagttcaagcagctccagagagagctgagccaagtgctgacgcagcggcagatttacatccaacctgacaactag

SEQ ID NO: 216947 - DNA, 783 bp, Artificial Sequence
  Description of Artificial Sequence: Synthetic coding sequence
atgcggagactgccccctcaacagatcgagaaaaatctgagcgacctaattgatctggtgccctcactctgcgaggatttactgtcctctgtggatcagccactaaagatcgctagagataaggtggtgggaaaagactatttgctttgtgactataaccgagatggggactcttacagaagtccctggtccaacaaatatgatcccccacttgaggatggcgcaatgccttctgccaggctgagaaaattggaagtcgaagcgaacaacgccttcgaccagtacagggatctttatttcgaggggggagtttcatctgtgtacctgtgggacctcgatcacggttttgcaggagtcattctgatcaaaaaggctggtgacgggtccaaaaagattaagggctgttgggatagtattcatgttgtggaagtgcaggagaaatccagtggtaggaccgcacattataaactgaccagcaccgtgatgctgtggctgcagactaacaagtccgggagcggaaccatgaaccttggtggttcccttactcggcaaatggaaaaggatgagaccgtctcagactgttccccgcatattgctaatatagggcgactggtggaagatatggagaataaaattagaagcactctgaatgagatatattttggcaaaaccaaggatattgtgaatggtcttagatcggttcagacatttgccgataaatcgaaacaggaggctttgaagaatgacttggtagaagccctcaagcgcaagcagcagtgctag

SEQ ID NO: 216948 - DNA, 1005 bp, Artificial Sequence
  Description of Artificial Sequence: Synthetic coding sequence
atgggagggcctcaggataaagatgagaggaccatcgctctggtgcggccttggccttggggacatcaggccctggatcccgcatacggtttagataccatgcatccttcccgcagatcattacccttcccactaaactgccagctggcacgtgtcggcacagcagattacggctcccccagcgatcagtccgatcagcaactcgactgcgccctggaccttatgcgccgtttgccccctcaacagatcgagaaaaacttgtcagatctgattgacctggtgccctctctgtgtgaagacctcttaagttctgtggatcagcccctgaagattgctcgcgacaaggtggtaggcaaagattatctgctgtgtgattataatcgtgacggcgactcctaccgcagtccttggtctaataagtacgacccacccctcgaggacggcgctatgccctccgcccgactgcggaaattggaagtggaggccaacaatgcttttgatcaataccgcgatctttacttcgagggaggtgtcagcagtgtctacctgtgggatctcgaccatggtttcgcaggcgtcatcttgattaagaaggcgggagacggctccaaaaaaattaagggctgctgggacagtatccatgtggtggaagttcaggagaagagttccggacgcacagcccactacaagctaacttccaccgtcatgctctggcttcagactaataaatcaggtagcggtacaatgaatctgggaggatctctcacgcggcagatggagaaggacgagaccgtgtcggactgttctccacacatagctaatatagggagactcgtggaggatatggaaaataagattcggagcaccctgaacgagatttactttggtaagacaaaagacatcgtaaacggtctgagatctgtacagacctttgcagacaagtccaagcaggaagcattaaagaatgacctcgtggaggccctcaaaagaaagcaacagtgttag

SEQ ID NO: 216949 - DNA, 819 bp, Artificial Sequence
  Description of Artificial Sequence: Synthetic coding sequence
atgtccgaccagcaactcgattgcgcactcgatctgatgagacgactgccgcctcagcagatagagaagaatctgagtgacctgatcgatcttgtgccaagcttgtgcgaggacctgttgtcatccgtcgaccagccactaaagattgccagagataaggtggtgggcaaagactacctactatgtgattacaatcgggacggcgactcatatcggtcaccctggagcaataagtacgatccccctttggaggacggggctatgccctcagctcggctgcgcaagcttgaggtggaggccaacaacgcctttgaccaataccgagatctgtactttgaagggggtgtatcaagtgtttatctgtgggatctcgaccacggtttcgccggagtcatcctcatcaaaaaggctggggacggcagtaagaaaattaaaggttgctgggacagcatacacgtcgtggaagtgcaggaaaagtcatcgggtcgcaccgcccactacaagctaacttccacagtgatgttatggctccaaactaacaagtcaggtagcggtactatgaacctgggtggttcactgacccgccagatggagaaggatgaaaccgtgtccgattgcagtccccacatcgctaacatcgggcgactggtggaagacatggaaaacaagatccggtcaacgctgaacgagatttattttggtaaaactaaagacatcgtgaatgggttacggtctgtccaaaccttcgccgacaagtccaagcaggaagccctgaagaacgacctggtggaagccctgaaaagaaagcagcaatgttag

SEQ ID NO: 216950 - DNA, 621 bp, Artificial Sequence
  Description of Artificial Sequence: Synthetic coding sequence
atgcgaagactgccccctcagcagattgaaaagaacctatctgatctcatcgatctggtgcccagcctgtgcgaggatctgctatcatctgtggaccaacccttaaaaattgcaagggacaaggtagttgggaaggattacctgctgtgcgattataatcgcgacggagattcctacagatcaccatggtccaataaatatgacccccctctggaagacggtgcaatgcctagtgctaggctcaggaagctcgaggtcgaggccaacaacgctttcgaccaatacagggacctgtattttgaaggaggggtctcatcagtttatctctgggatctcgatcatggattcgccggagtgatcctgattaagaaagcgggagatgggagcaaaaaaatcaagggatgctgggactccatacatgtggtggaagtacaggagaaaagctcggggcgtacagctcactacaagctgacctccacggtaatgctatggctgcagaccaacaagtccggcagcgggactatgaatctgggcggaagtctcacaaggcagatggagaaggacgagaccgtaagcgactgttctccccatatcgctaacatcggacggctggtggaatag

SEQ ID NO: 216951 - DNA, 906 bp, Artificial Sequence
  Description of Artificial Sequence: Synthetic coding sequence
atgcatcccagtcggagatccctgccttttccccttaactgccagctggcaagggtcggtaccgctgactacgggtcaccaagtgatcagtctgatcagcaactggactgcgctctcgatctgatgcgaagactcccccctcagcagatcgaaaaaaatcttagcgatctgattgacctggtgccttcattgtgcgaggaccttctcagtagcgtggatcaacctctgaaaattgccagggataaagtcgtgggcaaggattatcttttgtgtgattataatagggatggggactcttacaggagtccttggtctaataagtatgaccctcctttggaagacggggcaatgccctccgcccgtttaaggaagctcgaagtggaggcaaacaatgcttttgatcagtatagagatctttacttcgaaggcggagtgtctagcgtgtatctttgggacctcgatcatgggttcgccggagtgattctcatcaaaaaagcgggtgacggctcaaagaagattaagggctgctgggactccattcacgtcgtggaggtgcaggaaaagtcttctggtaggactgcacattacaagttgacttcgacggtcatgctgtggctgcagaccaacaaatcaggtagcggtactatgaacttgggtggcagtttgacaagacagatggagaaagacgagacagtgtcggattgtagtccgcatatcgctaacatcggccgactggtggaagatatggaaaataaaatcaggagtacactcaacgagatctactttggaaagactaaggacatagttaacgggttaagatctgtgcagacattcgccgataagtccaagcaagaagctctcaagaacgatcttgtagaagccctgaagcgaaagcagcagtgctag

SEQ ID NO: 216952 - DNA, 366 bp, Artificial Sequence
  Description of Artificial Sequence: Synthetic coding sequence
atgctaaaggtgccatccctgtgtgaggacctgctgagcagcgtggaccagccacttaagattgctagggacaaggtggtcggcaaagattacttattgtgcgattacaatagagacggtgactcttaccgcagcccctggtccaacaagtacgaccctccattagaggacggggcaatgccctctgcacggctcaggaagttagaggtcgaagcgaacaatgcgtttgatcagtaccgagatctctactttgagggtggcgtgtcgagcgtgtacttgtgggatcttgaccatggtttcgcaggagtcattctgattaaaaaggctggcgacggcagtaaaaaaatcaaggggtgctgggactag

SEQ ID NO: 216953 - DNA, 1047 bp, Artificial Sequence
  Description of Artificial Sequence: Synthetic coding sequence
atgtacactgccatcccacagagtggttcacccttccctgggagcgtgcaggacccaggcctgcacgtatggcgcgtggaaaaactgaaacccgttcctgtggcgcaggaaaaccaaggagtgtttttctcgggagatagctatctggtgttgcataacggacccgaagaggtctcgcacctacacctgtggatcgggcagcagtcaagcagagatgagcagggcgcttgcgctgttctggccgttcacctgaatacattgcttggggaaagaccagtgcagcaccgcgaagtacaagggaacgagtcggacctgttcatgtcatactttcctcgaggcctgaagtatcaagaagggggagttgagagcgcctttcacaagacctcgacaggagcacctgccgcaatcaagaaactataccaggtgaaaggcaagaaaaatatacgggcaacagaacgggcactgaattgggactctttcaacacaggagactgtttcatattagatcttggccaaaatatcttcgcatggtgcgggggtaaatcaaacatcttggagcggaataaagcccgagatctcgctttggctatccgtgatagcgagagacaggggaaggctcaggttgaaattgtgacagatggggaagaacctgctgaaatgatccaggtcctgggccctaaaccggcattgaaggaagggaatcctgaagaggacctgacggctgataaagcgaatgcccaggcagccgctttgtacaaggtttccgacgcgacaggccaaatgaatctgacaaaggtggcagattcctcaccattcgctttggagctcctcatctcagatgattgtttcgtcttggataacggtttgtgtggcaaaatctacatctggaagggccgtaaggcaaacgagaaggagcggcaggccgctctccaagttgccgagggctttatctctcgaatgcaatacgctcccaacacccaggtggaaatcctaccccaggggcatgaaagccccatcttcaaacagttcttcaaggactggaagtag

SEQ ID NO: 216954 - DNA, 657 bp, Artificial Sequence
  Description of Artificial Sequence: Synthetic coding sequence
atgtatacagccataccacagagcggctcccctttcccgggatcggtgcaggaccctggcctccatgtatggcgggtggaaaagctgaagcccgtgcccgtggcccaagaaaaccaaggtgtgttcttttctggtgatagttatctggtgttgcataacggcccagaagaggtttcccacctccacctctggataggacagcagagtagccgtgacgagcagggcgcatgtgcagtgctggcagtccacctgaacaccctgctgggagagcggccagtgcaacacagagaagtgcagggcaacgaatcagacctgttcatgtcttatttcccaaggggactgaagtaccaagagggcggtgtggagagtgcctttcataagacgtccacgggagctccagcggcaataaaaaaactgtaccaagtcaaggggaagaagaatattagagccacagaacgtgccctgaattgggattccttcaataccggggattgtttcattttagatctcggtcagaacatcttcgcttggtgtggaggaaaatcaaatattctcgagcggaacaaagcaagagatctcgccctggccatcagagatagcgaacgacagggcaaggcccaggtcgaaatcgttacagacggcgaagagccagcttag

SEQ ID NO: 216955 - DNA, 1047 bp, Artificial Sequence
  Description of Artificial Sequence: Synthetic coding sequence
atgtatacggccatcccccaatcaggaagcccattccctggttctgtgcaggatcccggacttcacgtctggcgggtggagaaactgaaacccgtgcctgtggcacaggagaaccaaggtgtgttttttagtggtgacagttaccttgtgctgcataatggacctgaggaggtgtctcatctacacttatggattggccagcagtcatcgcgggacgagcaaggggcatgcgctgtcttagcagtccatctcaataccctgctgggcgagagaccagtccagcacagggaagtgcagggtaacgaatctgatctatttatgtcttatttcccaagaggtcttaagtaccaagaagggggtgtcgaatctgcattccataagactagtacaggcgcacccgcagccatcaaaaaattgtaccaggtgaaaggaaagaagaatatccgcgcaaccgagcgtgcattgaattgggattcattcaatacaggggattgtttcattctggacctcggacagaacatttttgcttggtgcgggggaaagagcaacatcctcgaaaggaacaaagccagggacttggccctcgctatccgcgattccgagaggcagggcaaagcccaggtcgaaatcgtgactgatggagaggagccggctgagatgattcaagtcctggggcctaagcctgctctgaaagaggggaatccagaggaggatctgacagctgacaaggcaaatgctcaggcagcagccctgtacaaggtgtctgatgcaaccgggcagatgaacttgacaaaggtggccgactcatcaccattcgccctagagctgctaatctctgatgactgttttgtgctggataatggtctgtgcggcaagatctacatatggaagggtagaaaggccaacgagaaagagcgtcaggccgcactgcaggtcgctgaggggttcatcagtaggatgcagtacgcgcctaacacccaggtcgaaattttacctcagggccatgagagtccgatattcaaacagttttttaaagactggaaatag

SEQ ID NO: 216956 - DNA, 1047 bp, Artificial Sequence
  Description of Artificial Sequence: Synthetic coding sequence
atgtacaccgcgatcccacagtctggatcgccgttcccaggttccgtacaggatcccggactccacgtgtggagagtggagaaactgaagcctgtgccagttgcgcaggaaaatcagggcgtgttcttttctggtgattcttacctggtgctgcataatgggccagaggaggtttcccacctacacttgtggattggtcagcaaagttctagagacgagcagggagcttgtgctgtgctggccgtccacctgaacaccctgctcggcgagagacctgttcagcaccgtgaagtgcaaggcaatgagtccgatctgttcatgtcatacttccctcgtggtctgaaatatcaggaagggggtgtcgagtccgccttccacaagaccagcaccggcgctcccgcagcaatcaagaaactgtaccaagttaagggaaagaaaaacattcgagctaccgaacgtgcattaaattgggactctttcaatacaggagactgctttatcctggacctgggacagaatatattcgcgtggtgcggcggaaagtccaacattctggagcggaataaagcgagagaccttgctttagctatacgggacagcgaacgtcaaggcaaagcgcaggtcgagatcgttaccgacggggaagaaccggcagaaatgattcaagtcctgggacctaaacctgcgctgaaagagggaaaccccgaggaggacctgactgcagacaaggccaacgcccaagcggcagcactgtataaggtgagcgacgctacgggacagatgaatctcacaaaagtggccgactccagccctttcgctcttgaactattgatatcagacgactgtttcgtcctggataatgggctatgtgggaagatctatatatggaaagggagaaaggctaacgagaaagagcggcaggccgcactccaagtggcggaggggttcatttcgaggatgcagtacgcacctaacacacaggtggaaatactgccgcaggggcatgaatcccccattttcaaacagtttttcaaggactggaagtag

SEQ ID NO: 216957 - DNA, 762 bp, Artificial Sequence
  Description of Artificial Sequence: Synthetic coding sequence
atgtatacggcaatcccccaatccggaagcccattccccggtagcgttcaggatcctggcctgcatgtgtggagagttgagaagctgaagccagtgcctgtcgcgcaagagaatcagggtgtgttttttagcggggacagctacctggttctgcataatggtcccgaggaggtctcccacctgcacttatggattgggcagcagagtagccgtgacgagcaaggcgcttgtgcggtcctggcggtccatctgaacacgttgctgggagagagaccagttcagcaccgggaagttcaaggtaatgaatccgacctgttcatgtcctacttcccacgcggactcaaataccaggagggtggcgtggaatcggcttttcataagacctctacaggtgcgccagcagcgatcaagaaactctaccaggtgaaaggaaaaaagaatatacgcgctactgagcgcgctcttaattgggactcctttaataccggtgattgctttattctggacctgggccaaaacatatttgcctggtgcgggggaaagagtaatatcctcgaacgaaataaggctagggatctcgctctggctattagggactccgaaagacaggggaaggcccaagtggaaattgtgacagacggggaagagccagccgagatgatccaggtgctgggtcccaaacctgcattgaaagaggggaacccagaggaggacctcactgctgataaggccaatgcgcaggcggcagcgctgtataaatag

SEQ ID NO: 216958 - DNA, 762 bp, Artificial Sequence
  Description of Artificial Sequence: Synthetic coding sequence
atgtataccgcaatcccgcagagcgggagcccctttccgggttcagtgcaagaccctgggcttcatgtttggcgcgtcgaaaaactcaagcctgtgcctgtagctcaggagaaccagggcgtgttctttagtggtgattcttatctggtgctgcacaatgggcctgaagaggtctctcatctgcacctctggattggccagcagagttctcgggacgagcagggcgcttgcgctgttctcgcagttcatttgaatacgctcctcggcgaaaggccagtccaacatcgcgaagttcagggcaacgagtccgacctgttcatgagttactttcctcggggtctcaagtatcaggagggcggagtggaaagtgcctttcacaagacctccactggcgctccagccgctatcaagaagctgtatcaggtaaagggcaagaaaaacattagggctaccgaacgtgccctcaattgggattcgttcaacaccggcgactgctttattctggacctaggtcaaaatatctttgcgtggtgtggaggaaagtcgaacattctggaaaggaacaaggccagggacctggcccttgctatccgagacagcgagcgccagggcaaggcccaggtggagattgttaccgatggagaggagcctgccgagatgatccaggtcctcggacctaagccggcattgaaagagggcaaccctgaggaagatttgaccgccgacaaggccaatgcacaagccgctgccctgtataagtag

SEQ ID NO: 216959 - DNA, 762 bp, Artificial Sequence
  Description of Artificial Sequence: Synthetic coding sequence
atgtacacggccatcccacaaagcggttcccccttccccggttcagtgcaggacccaggcctgcatgtttggcgcgtagagaagctgaaaccagtcccagtggctcaggaaaatcagggcgtgtttttttctggagactcgtatctggtgctgcacaatgggcctgaagaagtcagccacctgcacctgtggatcggccagcagagttcaagagacgaacaaggcgcttgcgctgttctggccgtgcatcttaacaccttgctgggggagcggccagttcaacatcgggaagtgcaggggaacgaaagcgatctcttcatgtcctattttcccaggggcctcaaataccaggagggtggggtagaatccgctttccacaaaacgagcactggagcgccagccgcaatcaaaaagttgtaccaggtcaaaggtaaaaagaatatacgcgctaccgagcgggcactgaactgggatagttttaatactggggactgttttatacttgatttagggcagaatatatttgcatggtgtgggggtaagtctaacattctcgagcggaataaagcacgagacctcgcactggctatcagggactcggagcgccagggcaaggcgcaggtcgaaatcgtgaccgacggagaggaacccgctgaaatgatccaggtcctgggccctaagccggctctgaaagaggggaatcccgaggaggaccttaccgcagacaaagcaaatgcccaggctgccgcactgtacaaatag

SEQ ID NO: 216960 - DNA, 984 bp, Artificial Sequence
  Description of Artificial Sequence: Synthetic coding sequence
atgtatacagcaatcccccagtcagggtctccttttccaggctccgtgcaggaccctgggctccatgtgtggagagtggaaaagctcaagcccgttcccgttgcccaggaaaaccagggggtgtttttctctggagactcttatctggtgttgcataatggccctgaggaagtcagccacttacatcttaatacactcctcggagagagaccagtgcagcacagagaggtccaaggaaacgagtcagatctgtttatgagttattttcctcggggtctcaagtaccaagagggaggtgtggaatctgccttccataagacctccactggcgctcctgctgcaattaagaagttgtaccaagtaaagggcaagaagaacatcagagcgactgagagggctcttaattgggactcttttaatactggcgattgtttcattttagatttaggccagaacatctttgcctggtgcggaggcaagagtaatatattagagagaaataaagcacgcgaccttgccctcgcaatcagagattccgagagacagggcaaagcccaggtagaaatcgtgactgacggtgaggagccagctgagatgatccaggttctgggtccaaagccggcattaaaggaaggcaatccggaggaagatctgactgcagataaagccaacgcacaggccgcagccctatataaggtttccgacgcaacaggccaaatgaacctgacgaaggtggcggactcctccccattcgctctggaacttttgatctctgacgattgttttgtgttagataacggactttgcgggaagatctatatatggaaaggcagaaaggcgaacgagaaggagcgtcaggccgctttgcaggttgctgagggcttcatttctcgaatgcagtatgcgccaaatacacaggtggagatcctgccgcaggggcatgaaagccccattttcaaacagttttttaaagactggaagtag

SEQ ID NO: 216961 - DNA, 654 bp, Artificial Sequence
  Description of Artificial Sequence: Synthetic coding sequence
atggaaggcagtttctccgatggtggtgcacttccggagggactggccgaggaagctgagccacaaggggcagcctggtcaggtgactcagggacagtttcccagagtcactcctcggcctctggcccatgggaagatgaaggagccgaggacggcgctcccggtcgcgacctcccgttattaaggagagctgccgctggctacgctgcctgtttgctccctggcgctggagcacgcccagaagtagaggcgcttgatgcttctttggaagacctgcttaccagagttgatgagttcgtgggaatgttggatatgttaaggggcgactctagccatgtcgtgtccgaaggggtgccaagaatccacgccaaagcagctgagatgcgaagaatttattcaaggatcgaccggctggaggcatttgtcaggatggttggtggtcgtgtcgctagaatggaggaacaggtgactaaggctgaggctgagctgggaacttttcctcgtgcattcaagaagttgctccacaccatgaatgttccatctctgttcagcaagagcgccccatctcgaccccagcaagccggatacgaagctccggtactgtttaggacggaggactatttcccatgctgttctgagagaccacagctatag

SEQ ID NO: 216962 - DNA, 6678 bp, Artificial Sequence
  Description of Artificial Sequence: Synthetic coding sequence
atggccgctctggtcttggaggacggctctgtccttcgtggccaaccattcggagccgctgtctccaccgccggtgaagtggtcttccagacggggatggtgggctatccagaagccctcaccgacccgtcctataaggcgcagatcctggtgctaacataccccttaataggcaattatggaatacctccagatgagatggatgaattcgggctgtgcaagtggtttgagtcctccggcattcatgtcgcagccctagtcgtaggggaatgctgtccaaccccttcgcactggagcgcaacacgcacactgcacgagtggctccagcagcacggaatcccaggtttgcaaggagtagatacaagagaattaactaaaaagctgcgtgaacaaggatcattgctcggtaaactagtgcagaacgggactgaaccatcctcactccccttccttgatcccaacgctcgccctctcgtaccagaagtgagcattaagacaccacgggtgttcaataccggcggtgcacctagaatcctcgccttggattgtggactaaagtacaaccagatccgctgtctgtgtcagcgtggtgccgaggtgactgtggtcccctgggaccacgctctggatagtcaggagtacgaagggctgtttctgagcaacgggccaggagatcctgcatcctaccccagcgtggtttcaacgttgtctcgagtgctgagcgaaccgaaccctaggcccgtgttcggcatatgtttgggccaccagctacttgctttggccattggggcaaaaacctacaagatgcgttatggaaatagaggtcacaaccaaccctgtttgctcgtagggagcggtcgctgcttcttgacttcacagaatcacggctttgctgtggaaaccgacagcctgccggcagactgggctcctttgtttaccaatgcaaatgacggatcgaatgagggcattgtgcataattccctgcctttcttttcagtccagttccacccagagcaccaggcgggaccatcagacatggagctcctctttgatatctttcttgaaactgtgaaagaagcgacggccggaaacccagggggtcagactgtgcgggagaggttgacggaaagactctgtccacctggaattcctacccctggctctggacttccaccacccaggaaggtgctgattcttggtagcggcggactctctattggacaagcgggtgaattcgattactccggctctcaggctattaaagcattaaaggaagagaacattcagactctgctcatcaatccaaacatcgcaacggtccagaccagccagggactggccgataaggtgtatttcctgcctatcacacctcattatgtaacccaggtgataagaaatgaacgccctgatggcgttttactgacattcggtgggcagaccgcactgaattgtggtgtcgagctgaccaaggcaggcgtgttagccaggtacggcgtgcgggtcctgggcacccctgtggaaaccatagaattaacagaagaccggcgagcctttgcagcgagaatggctgagatcggagagcacgttgctccaagcgaagccgcaaacagcctcgaacaggcgcaggctgctgccgagcgcctagggtaccctgtccttgtacgagcggcatttgccctgggaggactgggcagtggattcgcttcaaacagagaggagctaagcgccctcgtggcccctgcctttgcgcacacgtcacaggtcttggtcgacaaaagtcttaaaggctggaaggagatagaatacgaagtggtcagggatgcttatggcaactgtgtgactgtctgcaacatggagaatctggacccactaggcatccataccggcgagtccatagtggtagctccctcccagactttgaacgaccgcgagtaccagcttctaagacaaaccgctatcaaggtaactcaacacttgggcatcgtaggagaatgcaacgttcaatatgccctgaaccctgaaagcgagcagtactacatcatcgaggtcaacgccagactgtcgcgatcatcagccctcgctagcaaggccaccggatatccactcgcctatgtggccgcaaagctcgcgctggggatccctttacccgaattgaggaacagcgtcactggaggcacagccgcattcgaacccagtgtcgactactgtgtagtgaagattcctagatgggatctaagcaagtttcttcgtgtttccaccaaaataggctcctgcatgaagtctgtcggtgaggttatgggtatcggccgaagtttcgaggaggcgttccagaaggcccttcggatggttgacgagaactgcgtgggctttgatcacacggttaagcccgttagcgacatggaactggaaacccctaccgataagcggatttttgtggtcgccgcagccctttgggctgggtattcggtcgacagactttacgaactcaccagaatagacagatggttcctccaccgtatgaaaaggatcattgcccacgcacagttgctggaacagcacaggggccagcctctccctcctgatcttctgcagcaggccaaatgtcttgggttctccgacaagcagattgctctcgcggtgctcagcacagaactggcagtgagaaagctgaggcaggagctgggtatctgtcccgctgttaagcaaatagatactgttgcagcagagtggccagcacagactaactacctctatctgacttactggggcacaacacatgatctgacgttccggacccctcacgtcctcgtgttaggaagtggagtgtacaggatcgggtctagcgtcgagtttgactggtgtgccgtggggtgtattcaacagctaagaaaaatgggttataagacgattatggttaattataatcccgaaaccgtgagcacagactatgatatgtgcgatcgactttactttgacgagatttccttcgaagtcgttatggacatttatgaactcgaaaatcctgagggcgtcatcctttcgatgggtggccagctgccgaacaacatggccatggccctccatagacagcagtgtagagtactcggcacgtctcctgaggccatcgattccgccgagaacaggtttaagttttcccgactcttggataccatcggtataagccagccccagtggagagagctatctgatttggaatcggcacgtcagttctgccagacagtcggatatccttgtgtggtgcgcccaagttacgttttgagtggtgcagcaatgaatgtcgcttacaccgatggagatctagaacggtttctgtcttccgcagctgctgtgtctaaggagcatcccgtcgtaataagtaagtttatccaggaagctaaggagattgatgtggatgccgttgcttctgacggcgtcgttgcggcaatagctatatctgagcatgtggagaacgccggagtacattctggcgacgctacgctggtcacccccccacaagacatcaccgccaagacactcgagagaattaaggcaatcgttcacgcagttggacaggagctccaagtcactggacctttcaatctgcaactcattgccaaagatgaccaactgaaggtgatcgagtgtaacgtcagagttagtcgttctttcccattcgtgagtaagaccctgggtgtcgacttggtggccctggctacccgggtcatcatgggagaggaggttgaacctgtcggtctgatgactggatctggtgttgtgggtgtcaaggtgccgcagttttcattctctcgccttgccggtgccgacgtggttttgggggtggaaatgacctccaccggagaggtcgccggattcggcgagagtaggtgcgaagcgtatctgaaagctatgctgtctaccggttttaagattccaaaaaaaaacatcttactgactattgggagctacaaaaacaagtcagagcttctgcctacggttcgcctgctcgaatctctcggatattctctgtatgccagtctcggcacagccgatttctacactgagcacggcgtcaaagtgaccgctgtcgactggcatttcgaagaggccgtcgacggggaatgtcctccccagcggagcatactggagcagttggccgaaaagaacttcgagctggtcataaacctctctatgaggggagccggaggtaggcgcctatcttcctttgtcacaaaagggtacaggaccaggcgactggccgcagacttcagcgttcctttgataattgatatcaagtgcactaaactgttcgtggaggctctcgggcaaatcggcccagcaccacctcttaaagttcacgtcgactgtatgacctcacaaaaacttgtgagattgccaggccttattgacgttcatgtgcacctgcgcgagccaggaggtacacacaaagaagacttcgcttctggcacagccgctgctcttgcaggcggtatcacaatggtgtgcgcgatgcctaacactcgccctcccataatagatgcccctgcactggcacttgctcagaagctggctgaagctggtgcacgctgcgactttgccttattcctcggtgcctcaagcgagaacgccggaacactaggcacggtcgcaggttctgccgcagggttgaagctgtacctcaacgaaacgtttagtgagctgcgtcttgactccgtggtgcagtggatggagcatttcgagacatggccaagccacctccctatagtcgcacacgctgaacaacagacagtagcagccgtgttgatggtcgcgcaactgactcaacggagcgttcacatctgccacgtggccaggaaagaggagattctattgataaaggctgccaaagcgcgagggctgcccgttacctgcgaggtggctccccaccacctgttcctcagccatgacgaccttgagcggctcggacctgggaaaggagaagtgaggcccgagttagggagtagacaagatgtggaggccctgtgggaaaacatggccgtcattgactgttttgcttctgaccacgcgcctcataccttagaggagaaatgtggatcaagaccacccccagggtttccaggcttagagactatgctgcctctactgctgacagctgtctctgaaggacgattaagcctcgatgacctgctgcaaaggctgcaccacaaccccagaaggatttttcatctgcctccccaggaggacacttacgttgaggtggacttggaacacgagtggaccattccgagccatatgccattctcaaaggcccactggacccccttcgaggggcaaaaggtgaagggcaccgtgcgtagggtggtgcttagaggagaagtggcttacatcgatggccaggttttagtgccgcctggatatggccaggacgtgagaaaatggccacaaggagcagtccctcaactgccaccatccgccccagcaacctccgagatgactactactcccgaacgtccaaggcgcggtatcccaggccttcctgacggaagatttcacctgccacccagaatccaccgggctagtgacccgggtctccccgctgaggaaccaaaggagaaatctagtcggaaggttgctgagcctgaactcatgggcacaccagatgggacgtgttaccctccgccaccagtgcctagacaggcatctccccagaatcttggtacaccgggtctgctgcacccacagaccagcccccttctgcattccctcgtgggtcagcacatcctcagcgtgcaacagttcacaaaggatcagatgtcgcatttgtttaatgtcgcccacacattgcggatgatggtgcagaaggagcgcagtctagatatcctcaaagggaaggtgatggcctcaatgttctacgaggtgtcaactcggacatcctcatctttcgctgctgcaatggcccgactgggcggtgccgtgttatctttcagcgaagcgacctcatctgtgcagaaaggagaatccctagctgacagcgtgcagacaatgagctgttatgccgacgtagtagttttgcgtcatcctcagcccggagctgttgaacttgcagcgaaacactgtcgaaggcccgtgatcaatgcaggagacggggtcggggaacaccctacccaagctctgcttgacatattcactatccgcgaagaattgggcactgtcaacggaatgaccattaccatggttggcgacctgaaacatgggcgaactgtgcattctttggcctgtcttctcacacagtatagggtctctctgcggtacgtggctccaccctctctccgcatgccgcctacggtgcgtgccttcgtggccagtaggggcacaaagcaggaagaattcgagtccattgaggaagccctaccagacaccgatgtgctatatatgaccaggattcagaaggaacgatttggaagcactcaggaatacgaggcctgttttggtcagttcatcttaactccccatatcatgaccagagctaaaaaaaaaatggttgtaatgcaccctatgcccagagtgaacgagatctctgtcgaggtggacagcgatccaagggccgcatactttcggcaggccgaaaacggcatgtatattagaatggccctgctcgctacggtgttggggagattttac

SEQ ID NO: 216963 - DNA, 1440 bp, Artificial Sequence
  Description of Artificial Sequence: Synthetic coding sequence
atggaaaagggcctaacactcccccaagactgccgagacttcgttcattctctgaagatgcgatccaaatatgccttattcctggtcttcgttgttatagtgtttgttttcatcgagaaggagaataagattatatccagggtcagcgataaactcaaacagatacctcaggcactggccgacgctaattccaccgaccctgccctcatcctcgccgagaatgccagtttgctatccctttctgagctcgactcggcgttttcgcaactgcagagtcgactcagaaacctgtccctgcagctcggtgtcgagccggcaatggaggctgctggtgaggaagaagaggaacagagaaaagaggaggagcccccacggccagcggtggctggtcctagaaggcacgttcttctgatggctactactcggacaggttcttccttcgtgggtgagtttttcaaccagcaaggtaatattttctatttgttcgaacccctgtggcacattgaaagaacagtgagctttgaaccaggtggagctaacgctgctggatctgcccttgtatacagagacgtgctgaaacagctttttctgtgtgatttgtatgttctggagcacttcatcactcctctgccagaagatcacctgactcaatttatgttccgccgtggctcctcaaggtccctgtgtgaggaccctgtttgtacccccttcgtgaaaaaggttttcgaaaagtaccactgcaaaaaccggaggtgcgggcctttaaacgtgacgcttgcagctgaggcctgcaggaggaaggagcatatggctttgaaggcagtaaggattcgccaactggagtttctgcagcccttggcagaagatccccgtctggatctccgcgtcatccagctcgtgagggatcccagagccgtgttagcttctcggatggtggccttcgcgggtaaatacaaaacatggaaaaagtggctggacgacgaggggcaagacggacttcgagaagaggaggtacagcggcttaggggaaactgcgaatccatccgactgagcgcagaattgggcctccgacaacctgcatggctccggggacggtacatgctggtgagatatgaggacgtggccaggggacctctgcagaaagccagggaaatgtatagatttgcaggcattcccctaaccccacaggtagaggactggattcaaaagaacacgcaggcggctcatgacggatccggaatatactctacccagaagaattctagcgaacagtttgagaagtggcgattttctatgccattcaagctcgcacaggtggtgcaagcagcctgcgggccagccatgagactctttgggtacaaactcgcccgtgacgcggctgcactgactaaccggtcagtaagcctccttgaggagcgaggcacattttgggtcacatag

SEQ ID NO: 216964 - DNA, 1236 bp, Artificial Sequence
  Description of Artificial Sequence: Synthetic coding sequence
atgcaatgttcttggaaggccgttttacttctggctcttgctagcattgcaattcagtacaccgcgatcagaacatttaccgccaagtctttccacacctgcccaggcttggctgaggctggcttggccgaaagactgtgtgaggaaagccctacttttgcctacaatctgtccaggaagactcacattctcattctggccaccacccgtagcggttcctccttcgtggggcagctttttaaccagcacctagacgtgttctatttgttcgagcctctctatcatgtccagaacacacttattccacggtttacccaaggtaagtcccctgccgacaggcgtgtgatgctgggggctagccgcgacctcctccgctccctctacgactgcgacctttatttcctggagaattacataaagcctccaccggttaatcataccaccgaccgaattttcagacgtggcgctagccgggtgctttgttccaggcccgtttgcgatccaccgggtccagctgatctggtcctggaagagggcgattgcgtccggaagtgtggcttactcaacttgacagtggctgccgaggcatgcagggaacgttcacacgtagccattaagacagtgagagtgcctgaagtgaatgacctgcgagctctcgttgaagacccccgtctcaacttgaaggttatacagctggtccgggaccccagaggaattctcgcaagtaggagcgagacattcagagacacgtatagattgtggcggttgtggtacggtacaggcagaaaaccctataatctagacgtgacccagctcacaactgtgtgcgaagacttctccaacagcgtctccaccggccttatgcgtccaccctggttgaagggtaaatatatgctcgttcgctacgaagatctcgcacggaaccccatgaagaagacagaggaaatatacggattcttggggataccactggattctcacgtggctcgctggatccagaataacacccgcggtgaccccaccctcggcaaacataaatacgggaccgtgcgaaactccgcggcaacagctgagaagtggcggttcagactgtcctatgatatcgttgcctttgcccagaacgcctgtcaacaagtgctcgcccaattaggctacaagatcgccgcaagtgaggaagaactgaagaatccctctgtgtccctcgtcgaggaaagagattttaggcctttctcatag

SEQ ID NO: 216965 - DNA, 1131 bp, Artificial Sequence
  Description of Artificial Sequence: Synthetic coding sequence
atgttccctcggcctttgactccgctggctgcccctaatggggcagagcccctggggagggccttaaggagagcccctctcgggcgagccagggctggcctcggaggccctccactcttgctcccttcaatgttgatgtttgctgtgatcgtcgcctcttcaggcctcttattaatgatcgaacggggaatcttggctgagatgaagcctctgccccttcacccacctggtcgtgagggcacggcgtggcgcggaaaggccccaaagcctggagggttgtccctgagggcaggcgacgctgaccttcaggttcgtcaggatgtacggaatcgaacgctccgagcagtctgcggccagcccggtatgcctagagatccttgggacctgcccgtaggccaacggagaaccctgcttcgccatattcttgtgtccgacagatataggttcttgtactgttatgtgcccaaggttgcttgctctaattggaaacgggtcatgaaggtgttagcaggcgttttggactctgtggacgtgcgcctcaagatggatcataggtcagatctggtttttctcgctgacctgcgtccagaagagatacggtataggctgcaacattattttaagttcttgttcgtgagggaaccgctagagcgtttactctccgcatacagaaataagtttggggagatacgagagtatcagcagcgttacggggctgagatcgtgaggaggtaccgcgctggagccggtccctcacctgccggagatgacgtgacctttcccgaattccttagatacctcgtggacgaggatccagagcgaatgaacgagcattggatgccagtctatcacctctgccagccttgtgccgtgcattatgactttgtcggctcatacgaaaggctggaagccgacgctaatcaagtgctagaatgggtgagggcaccgcctcacgttcgcttcccagccaggcaggcctggtacagaccggcttccccagagtctctgcattatcacctttgtagtgcccctcgcgctctactgcaggatgtcctgccaaagtatatcttggacttcagcttgttcgcgtacccccttcccaatgtcactaaggaggcgtgtcagcaatag

SEQ ID NO: 216966 - DNA, 1275 bp, Artificial Sequence
  Description of Artificial Sequence: Synthetic coding sequence
atgacgctacgtcctggaaccatgcggttggcctgtatgtttagctccatattgctcttcggggctgctggcctactcttgttcattagtctacaggacccgacagaactagcgcctcaacaagtccctgggatcaaattcaacattcggcctaggcaaccacaccacgatcttccgcctggcggatcacaggatggagacctgaaggaacccactgaacgcgtaactagggacctctcaagcggggctccaagggggaggaatcttccagctcctgaccagcctcaaccccctcttcagaggggcactaggctgaggctgcgacagcggcgacgtcgtctcctaattaagaagatgcccgctgcagctaccattccagctaactcctccgacgcacccttcattaggccgggacctgggacacttgatggaaggtgggtgagcctgcaccgcagtcaacaagagagaaaaagagtgatgcaggaggcgtgcgccaaatatcgggcttccagtagtcgccgagcagtgaccccgcgtcatgtgagccgaattttcgtcgaggacagacatcgggtcttatattgcgaggtgccaaaagcaggttgcagcaattggaagagagtcctcatggttcttgcaggactggccagtagcacagccgatattcagcacaacacggtacattacgggtccgccctcaagaggctggacacctttgataggcagggtattttacatcgtttgagtacgtacacgaagatgctctttgtccgagaacctttcgaacggttggtgagtgcgtttcgagacaagttcgaacacccgaacagctactaccatcccgttttcggaaaggctattctggccagatatagagccaacgccagcagggaagctctgcgcaccggcagtggagtgcgtttcccagagttcgtgcagtatcttctggacgttcacaggcccgtcggcatggacattcactgggatcatgtcagtagattgtgtagtccgtgtttgattgactatgactttgtagggaagtttgagagtatggaagatgatgctaacttttttctctcactgattcgcgcacccagaaacctcacattccctaggtttaaggataggcattcacaggaagcgagaaccacagctaggattgcgcaccagtattttgctcagctgtctgctctgcagcgtcagcggacgtatgatttctattacatggactacctcatgttcaactactctaagccctttgcagatctgtactag

SEQ ID NO: 216967 - DNA, 1275 bp, Artificial Sequence
  Description of Artificial Sequence: Synthetic coding sequence
atgacactgcgtcccggaacaatgaggctggcttgcatgttcagcagtatcttgctgttcggggcagctgggctactgctgttcatctcgctgcaagatcctactgaactggccccacaacaagtgccagggattaaatttaatattagaccgagacagccccaccatgatctgccgccaggtggatctcaggacggagacctgaaggagcctaccgagagggtgacacgggaccttagtagcggcgctcccaggggacgaaatctccccgctcccgaccagccacaacctcccttacagcgcggtactcgactcagattgcgccagcgccgacggaggctgcttatcaaaaagatgcccgctgccgctactataccggcaaactcatctgatgccccttttattaggcccggtcccggaacactggacggtcgatgggtgtccctccaccggagccaacaagaacggaagcgcgtgatgcaggaagcctgcgcaaagtatagagcctcatcatcacgccgtgccgttaccccaagacatgtctcacgtatttttgtggaggatcgccatcgggtcctttattgcgaggtacctaaggctggttgttccaattggaagcgcgtcctaatggtccttgccggtctcgcatcaagcactgccgacattcaacacaacaccgtgcattatgggagtgcccttaaacgtctcgacaccttcgataggcagggcatccttcatagactttccacttatacaaaaatgctgttcgtgcgagagccttttgaacgattggtgagtgcttttcgggataaattcgagcatcccaacagttactaccatcccgtgttcggcaaagccatcttggccaggtatcgcgcaaatgcctcgagggaggccttacgaaccgggtccggcgtgcggttcccagagtttgtgcagtatctgttggatgtccataggccagtaggaatggacatacactgggatcacgtttctcgcctgtgctctccctgcctcatcgactacgactttgtgggaaaattcgagagcatggaagatgatgctaacttctttctctctctgattagagcgcctagaaatctcacttttcctcggtttaaggaccggcactctcaggaggccagaaccaccgctcggatcgcccaccagtactttgcccagctttccgcactgcaacggcagcgtacctatgatttctattatatggactacttgatgttcaattattctaaaccttttgccgatttatattag

SEQ ID NO: 216968 - DNA, 1275 bp, Artificial Sequence
  Description of Artificial Sequence: Synthetic coding sequence
atgacactcagacctggaacaatgcgtctggcttgtatgttcagtagtatcttactgtttggtgccgcaggcctccttctgtttatttctctccaggaccccaccgagctggcaccccagcaggtccccggaatcaaattcaacatccggccacgacaaccgcaccacgatctaccgccagggggtagtcaggatggggacctcaaggaacctactgagcgagtcactcgtgacctgtcctcgggagccccaagaggacggaatctgccagctcctgatcagccacaaccgcctctgcagcgtggtacacgactcaggctcagacaacgacgcaggcgtctcctgatcaagaaaatgcctgccgctgccacgatccctgctaactcctcagatgccccattcatacgccctggcccaggcacactggatgggagatgggtctcactccacaggtctcagcaggagcgcaaacgcgttatgcaagaggcctgtgcgaagtaccgcgcatctagcagtaggcgggctgtgaccccaaggcacgtcagcaggatctttgtggaggaccgacaccgggttctatattgcgaggtcccaaaggccggatgctctaattggaagagagtgctgatggtcctcgccggtttagcatcttcaaccgcagatattcagcacaacacagttcattacgggtcggccctcaaaagactggacaccttcgatcgccaaggcattctccacagactgagcacatataccaaaatgctctttgtcagggagccctttgagaggctggtcagtgccttccgtgacaagtttgagcaccccaacagttactatcacccagtctttggtaaagccattctggcgaggtacagggccaacgccagtagggaggcccttcgcacaggctctggggtccggttcccagaattcgtccagtacttactcgatgtgcatagacccgttggcatggacatacactgggatcatgtctcgcggttgtgttccccgtgtcttatcgactacgacttcgttggaaagttcgagtcaatggaagacgacgcaaactttttcctatcattaatcagagctccacggaacttgacttttccaaggttcaaagaccggcactctcaggaagcacggacgaccgcaaggatcgcccaccagtacttcgctcagttatccgccctgcagaggcagcgcacctatgacttttactatatggattacctgatgtttaattactccaaaccatttgccgacctgtattag

SEQ ID NO: 216969 - DNA, 1686 bp, Artificial Sequence
  Description of Artificial Sequence: Synthetic coding sequence
atgcgacactgtatcaattgttgtatacagctactaccggacggggctcacaaacagcaggtgaactgccagggcggtcctcaccatggtcatcaggcatgccctacctgcaaaggggaaaataagattctcttccgggtcgatagcaagcaaatgaacctcctggctgtacttgaggtgcgcacagaagggaacgagaactggggcggtttcctacgtttcaagaaaggtaagagatgttctctggtgttcggactcatcatcatgaccctggtgatggcctcctacatcttgtccggcgcacaccaggagctgctgatcagtagcccttttcattatggcggatttcccagcaatcctagtctaatggactctgaaaatcccagtgacacaaaagagcatcaccaccagtcatcagttaacaatataagctacatgaaggactacccatcaatcaagcttattatcaactccattaccaccagaattgaatttaccaccaggcagctgcccgatcttgaagaccttaagaaacaggagcttcatatgttctctgttattcctaataagttcctcccaaattctaaaagcccatgttggtacgaagagttttccggccagaacacaaccgacccttacttaactaattcttacgtgctttatagcaagcggttccgtagtaccttcgatgcgctgagaaaggccttctggggtcacctagcgcacgcacatggtaaacacttccggctgagatgtctaccccacttctatatcataggccagcctaagtgcggcactactgatctgtacgaccgcctgagattgcatcccgaggttaagttttcagccattaaggaaccgcactggtggacgcgaaagcggttcgggatcgtgagactacgcgacggcctgagagaccgttatccagtcgaagattacctcgatctcttcgacctcgcggcacaccagatccaccaaggtctgcaggcctccagcgctaaggaacagtcaaagatgaacaccataatcattggcgaggcgtccgcttccacaatgtgggataacaatgcctggacattcttttatgacaactctaccgacggcgagcctccctttctcacacaggatttcatccatgcttttcaacccaacgctcggctcattgttatgctgcgagatccagtcgaaagactgtattctgattatctgtactttgcttcgtccaataaatcggctgacgatttccatgaaaaagtaactgaagctttacagctgtttgaaaattgtatgctggattactctttgcgtgcctgtgtgtataacaacaccctgaacaacgcaatgcctgtgagacttcaggtggggctgtacgccgtttaccttctggactggctgagcgtgttcgataagcaacaattcctgatcttacggctcgaggatcatgcctcaaatgtcaaatatacaatgcataaggtttttcaattcctgaacctggggcctttatcagaaaaacaggaggctcttatgactaaatctcccgctagtaacgctagaaggccggaggatcggaatttgggcccaatgtggccgatcactcagaagatactcagagatttttaccgcccttttaacgctaggctggcccaggtgctcgctgacgaagccttcgcctggaagaccacttag

SEQ ID NO: 216970 - DNA, 1521 bp, Artificial Sequence
  Description of Artificial Sequence: Synthetic coding sequence
atgaggcactgcattaactgctgtattcagctgttaccagacggcgcacacaagcaacaggtgaattgtcagggagggccacatcacggccaccaggcctgccccacctgtaaaggtgagaacaaaatattatttagagtggatagtaagcaaatgaacctccttgccgtcctcgaagtgcgtactgagggcaacgagaattgggggggtttcttgcgcttcaagaagggcaaaaggtgtagcctggtgtttgggcttatcatcatgaccctggtgatggccagttacatcctatcaggcgcacaccaggaactgctcataagctcacccttccactacgggggattcccttctaacccatctctcatggactcggagaacccatcagataccaaagaacaccaccatcaatcatctgtgaacaatatctcttatatgaaggattacccttctattaagctgataattaattcaatcacaactcgaatagagttcaccacgagacagctgccagatctagaagacctcaagaagcaggagttgcacatgttctcagtgattcctaataaattcttaccaaactcgaagagcccctgctggtatgaagagttcagcggccaaaatacaaccgacccttatctgactaatagttatgttctttactcaaaacgcttccgatctacctttgatgcgttgagaaaggctttctggggtcacttggcccacgctcacgggaagcactttcgactgaggtgcctgccacacttttacataatcgggcagcccaagtgtggaaccaccgatctgtacgacagactgcgtctccacccagaagtgaaattcagcgcgattaaggagccccactggtggacaaggaagcggtttgggattgtcagactgcgcgacggcttgagggaccgctatcccgttgaggattatttggacctttttgatctggcagcacatcaaattcatcagggcctccaggcctcaagcgccaaagagcagagtaagatgaacacaatcattatcggggaagcttctgcgtctacgatgtgggacaacaatgcttggaccttcttttatgataattctacagatggggaaccccctttcctcacacaggacttcattcacgcctttcagccaaatgcccgtctgatcgtcatgctccgggatcccgttgaaagactctacagtgactacctctatttcgcatccagcaataagtctgccgacgattttcacgaaaaggtgaccgaggctctccagttgtttgagaactgtatgcttgattatagcctccgagcctgcgtgtataacaatacgttgaacaatgctatgccggtatgcacccctcccccaagaacacctcgagctggtccttggcaaaaggaattggtttgctgctattatgcaagcgggatagtcggattacgtttctccatcggtacggagcggtctgtgctcatgtgtaaatgttgctctccactgttcatggatgtgaaagctgaaaattag

SEQ ID NO: 216971 - DNA, 624 bp, Artificial Sequence
  Description of Artificial Sequence: Synthetic coding sequence
atgcgccactgcatcaactgctgcattcaattgctccccgatggagctcacaaacaacaagtaaattgtcaggggggacctcaccacgggcaccaggcatgccctacctgtaaaggggagaacaagatcctgttcagggtggattcaaagcaaatgaacctgcttgccgtcctggaggtgaggacagaagggaatgaaaactggggagggtttcttaggttcaaaaaagggaagcgctgctccctcgtgttcggcctcattataatgacacttgtaatggcatcctacatcctctctggggctcaccaggagctgctaattagctctccattccattatggcggtttcccatctaacccatccctgatggattccgaaaacccatctgatacgaaggaacatcaccatcagtcgtccgtgaacaacattagctatatgaaggattacccgtctatcaagctgattattaactccattaccacacgcattgagtttacgacccgccaactcccagatttagaggatctgaagaaacaagagttacatatgttctcagttatacccaacaaattcctgcccaagcacaatgcgcaggcagaactgggcctaaatgtggcctgttag

SEQ ID NO: 216972 - DNA, 1686 bp, Artificial Sequence
  Description of Artificial Sequence: Synthetic coding sequence
atgaggcactgtatcaattgctgcatacagttgcttccagatggcgctcacaagcagcaagttaattgtcagggcggtccgcatcacggacaccaagcttgtcccacgtgcaaaggcgagaataagatcctgtttcgggtcgacagcaaacagatgaacctgcttgctgtcttagaggtcaggactgaggggaatgaaaattggggcggattccttcggttcaagaagggcaagcgctgcagcctggtgtttgggctgatcattatgactctggtgatggcatcctatatcctctccggggctcatcaggagcttctcattagctctccattccactacgggggatttccttcaaatccaagtctgatggacagcgagaacccctctgatacaaaagaacaccaccatcagtcctctgtgaacaatatcagttatatgaaggattaccccagcataaagttaattatcaacagcatcacgactaggattgaattcaccactaggcagctgccagaccttgaggatttgaagaagcaagagttgcacatgtttagtgtgattcctaacaagtttcttcctaactcaaagtccccctgttggtacgaggagtttagtggccagaatactactgatccgtatctaacaaacagctacgttctgtatagtaaaagatttaggtcaaccttcgacgcactcaggaaggcgttttgggggcacctcgcccacgcacacggaaagcactttaggctgcggtgtctgccccacttttacatcattggccaacccaaatgtgggacgaccgacctttatgataggctaaggctgcatcctgaagtgaaattttctgccatcaaagaaccacactggtggacccgcaaacgtttcggaatcgtgagactgagagatggtctgcgggacagataccctgtcgaagactatcttgatctgtttgacctcgcagctcaccaaatacatcagggacttcaagcatcttccgccaaggaacagagtaagatgaataccattataatcggcgaggcatctgcaagcactatgtgggacaacaacgcatggaccttcttctacgacaattctaccgacggggaacctccttttctaactcaagactttatccacgcatttcagccaaatgctcggctaatcgttatgttgcgggaccccgttgagcgcttgtattctgactatctctacttcgccagttctaacaagagtgcagatgatttccatgaaaaagttacggaagctcttcagttgtttgagaattgtatgctggattatagcctccgcgcttgcgtttataacaatacccttaataacgccatgccggtccgactgcaggtcggcctgtatgccgtttatctgctagattggctgtcagtctttgacaaacagcagttcttgatccttagactggaagaccatgcgtctaacgtaaagtataccatgcacaaggtgttccagttcctaaatctaggtcctcttagcgagaagcaggaagcgctgatgacaaagagtcctgcgtctaacgcccgtcgccctgaggatcgcaatttgggaccaatgtggcctattacacagaagatcttgagggatttttacaggccctttaatgccagactcgctcaggtgctggctgatgaagcgttcgcttggaagacaacctag

SEQ ID NO: 216973 - DNA, 1449 bp, Artificial Sequence
  Description of Artificial Sequence: Synthetic coding sequence
atgcgacactgcatcaactgttgcatccagcttttgcccgatggcgcacataaacagcaggtgaactgccaagggggtccacatcacggccaccaggcgtgtcctacttgtaagggcgagaataagatcctattcagggtggactccaagcaaatgaatctgctcgcagtgctggaggtgaggactgaaggcaacgagaattggggcggtttccttaggtttaagaagggtaagagatgctcacttgtgtttggtctgataattatgaccctggtcatggcctcctatatcctttctggggcacatcaggagctgttgatttcttcaccattccactatgggggtttcccatccaatccaagcctcatggattccgaaaatccttctgacacaaaagagcatcaccatcagagctccgtgaacaatatctcgtacatgaaagattatccaagcatcaagttaattattaattcgattacgacgcggatagagttcaccaccagacagctccccgatttagaggacttgaagaaacaggagcttcacatgtttagcgtcattcccaacaaattcctcccaaattctaaatccccctgttggtacgaggagttctcgggccagaacaccactgacccttatctcacaaacagctacgttctatactccaagagatttcggagcacttttgatgcccttcgcaaggcattctggggacacctggcacacgcccatggaaagcacttcagactgcgttgtctaccacacttttacattattgggcagcccaaatgtggcacaacagacctgtacgataggctaagacttcatcccgaagtaaagttttcagccattaaagaaccccactggtggaccaggaaaaggttcggcattgtgagattaagggacgggcttcgagaccggtaccccgttgaggattatctcgacttatttgacctggcagctcaccaaatccaccagggattacaggcatcttccgcaaaagaacagagtaaaatgaataccataatcatcggggaggcctccgcctcgaccatgtgggacaacaacgcctggaccttcttctacgataactccactgacggagagcctccgttcctcacacaggacttcatacatgcctttcagccgaatgcacgcttgatcgtgatgctgagagatccagttgagcgcttatatagtgactacctatactttgcttcttctaataagtccgccgacgattttcatgagaaggtcactgaggccctccagctgttcgagaattgcatgctggactacagccttcgagcctgcgtctataacaatacattgaacaacgccatgcccgtttgcacgcctcctccggtgccccctgagctggctcccggacgacgtagctggttcgtggtgatcatgcaggccgctctgtgggtgtgtgtgagcgcatag

SEQ ID NO: 216974 - DNA, 1236 bp, Artificial Sequence
  Description of Artificial Sequence: Synthetic coding sequence
atgggtatgcgggcaagggtgcctaaagtcgcccactcaactaggcggcctcccgcagcacgtatgtggttaccacggttcagttcgaagaccgtgactgtgttgcttctggcccagactacatgcttgctgctgttcattatctccaggccaggaccttccagcccagccggtggagaggaccgagtccatgtattagttctgtctagctggcgcagcgggtcatcctttctcggacagctgttcagccaacaccctgacgtgttttacctcatggagcctgcttggcacgtctggacgaccctgtctcaaggatcggctgccaccctgcatatggccgttcgggacttaatgagatctatctttctctgcgacatggatgtgttcgacgcgtacatgcctcagtctcgcaacctgagcgccttttttaattgggcaacaagcagggcattgtgttctccacctgcatgttccgcctttccaaggggcaccattagcaaacaggatgtgtgcaaaaccttatgtactcgccagccattctcacttgctcgcgaagcgtgcagatcttatagccacgtggtcctcaaagaggtacggttcttcaatctacaagtgctgtatcctttgctctccgatccagctcttaatttacgcattgtgcatctggtgcgtgatcccagagctgtcctgcggtcacgggaggccgcaggacccatattggcccgagataatggcatcgttctgggcaccaatggcaaatgggtcgaggccgacccccatctccgcctgataagagaggtttgcaggtctcatgtgcgcattgcagaggccgctacgttgaagcctccccctttccttaggggaaggtatcggctggtgagatttgaggatctcgccagggagcccctggcagagatccgagccctctacgcttttaccggcctaacactgacaccccagctggaggcatggatacacaacataacgcacggttccggtatcgggaaaccaatagaagcctttcataccagtagtagaaacgcccgaaacgtgagccaggcttggaggcacgctttgccctttaccaaaatcctaagagtccaggaagtgtgtgctggcgctctgcagctgcttgggtatcgcccagtgtactcagccgaccaacagcgagacctgactctcgatctcgtgctgcctcgagggcctgaccacttctcatgggcaagcccagactag

SEQ ID NO: 216975 - DNA, 1254 bp, Artificial Sequence
  Description of Artificial Sequence: Synthetic coding sequence
atgagcaggcacttaccctggatctgtgaccagcggtgctcatctccttcatccccaggcagatggcctcctgccgctagaatgtggcttcccaggttctctagtaaaactgtgaccgtcctgctgctcgcccagaccacatgtcttctgcttttcataatctctcggcctggtcccagtagtccagccggaggtgaagacagggtccacgtccttgtgctgtcttcctggcgctctggttcttcctttctggggcagctgttttcgcagcatcctgatgttttttacttgatggagccagcttggcatgtgtggaccaccttgtctcagggcagcgctgccaccttgcatatggctgtgagagacttaatgaggagtatctttctctgcgatatggacgtcttcgacgcctatatgccccagagccgtaatttatccgccttttttaattgggctacctcaagggcactgtgtagccccccagcctgcagcgccttccctagaggcacgattagcaaacaagacgtctgcaagacgctttgcactcgtcagccttttagcttagctagggaagcgtgtaggtcgtacagccacgttgtccttaaggaggtgcggttttttaatctccaggtactgtatcccctgctatccgaccccgctctaaacctgaggattgttcacctggtccgcgatccccgagccgttctacgttcgcgagaggctgctggacccatactcgcccgtgacaatggtatcgtgctgggcactaacgggaaatgggtcgaggcggacccccaccttcggctcattcgtgaagtgtgccggtctcacgtgcgcattgcggaggccgcaacactgaaaccccctccttttcttcggggtagatataggctcgtccggttcgaagacctggcaagagaaccactggcggagatcagagctctctacgcctttaccggactcaccctcactcctcagcttgaagcctggatccataatataacccacgggagtggaatcgggaaacccatcgaagccttccacacaagctcccgtaatgctcggaatgtgagccaggcctggcggcatgccttacctttcactaagatccttcgggtccaagaggtttgtgccggtgccctgcaacttctagggtacaggccagtgtactcagccgaccagcagcgtgatctcactcttgacctggtgcttcctagaggcccagaccacttcagttgggcctctcccgattag

SEQ ID NO: 216976 - DNA, 1188 bp, Artificial Sequence
  Description of Artificial Sequence: Synthetic coding sequence
atgtggttaccaagggtcagtagcaccgccgtcaccgctctgttactcgcccagacattcttattacttttcctcgtctcccgccctggtccctcaagccctgctggcggtgaggctagggtgcatgtactggtgctcagtagctggagaagcggctcaagcttcgttggccagttgtttaaccagcacccagatgtattctatttgatggagccggcttggcacgtgtggacgaccctcagtcagggcagcgccgcaaccctgcacatggccgtgcgggacctggttaggagcgtgtttctctgcgacatggacgtgtttgatgcgtacttgccatggaggaggaatctatctgatctattccagtgggcggtgagtcgcgctctttgttccccccctgcatgctccgctttcccccgtggtgccatctccagcgaggctgtttgcaagccactctgtgctagacagtctttcacattggcacgcgaggcgtgtcggtcatatagtcatgtcgtcctaaaggaggttcgattttttaacctccaagtgctgtacccactgctttctgatccggctctaaatctgaggatagttcacctagtaagggatccccgtgccgtgctgaggtcccgagaacaaaccgccaaggcacttgccagagacaacggtattgttctgggcaccaacggaacatgggtcgaagctgatcctggactccgcgtcgtgagggaggtgtgccgttcccatgtgcgtatagcagaggccgcaacactcaagccacccccattcctgcgaggacgctaccggcttgtgcggtttgaggaccttgctcgggaacctctcgcggagatcagggctctctatgctttcacaggcctatctctgacgccacaactggaagcctggattcataacataacccatggaagcggtcctggggctcgcagggaagcattcaagacaagcagccgtaacgccctaaacgtgtcccaggcctggcgccacgcactcccctttgcaaagattagaagggtacaagaactatgcgcaggagcactccagctgcttggctaccgtccggtgtattctgaagatgaacagaggaaccttgcgttagatctagtcctgccacggggtctgaatggatttacctgggcatcatccacagccagccacccgagaaactag

SEQ ID NO: 216977 - DNA, 1188 bp, Artificial Sequence
  Description of Artificial Sequence: Synthetic coding sequence
atgtggctgccgcgagtctcctccaccgcagtcaccgcattgctccttgctcaaacctttctgctgctgttcctagtgagccgcccaggaccttccagccccgcaggtggagaagcccgtgttcacgtgctggttttgtcctcctggcgctcgggctcatcttttgtcggtcagctttttaaccagcatcccgacgtcttctatcttatggaaccggcatggcacgtctggacaaccctgtcacaggggagcgccgctaccctccatatggcagttagagatctggttagaagcgttttcctgtgcgatatggacgtctttgacgcttacttgccgtggaggcggaatctgtctgatctatttcagtgggcagtttcacgggctctgtgttcacctccggcttgctccgcctttcctagaggggctatttcctccgaggctgtctgcaagcctctctgtgcaagacaaagctttactctggcacgggaggcctgtcgcagttacagtcacgtcgtgctgaaagaagtccggttctttaatttgcaggtactgtatcctctgctgtccgacccagccttgaacctgaggatcgttcacctggtgagggacccgagggctgtgctcaggtctcgggagcaaaccgccaaagcactggcccgagataatggaatcgttcttggtactaatggcacctgggtagaagcagatccaggcctgcgcgtggtgcgagaagtgtgccgtagccacgtccgcatcgctgaggccgctaccctcaagcctcctccctttctgcggggtcgctataggctggtccggttcgaggatctggcgagggaaccgctagcagagattagagccctctatgctttcacaggtttgagtcttaccccccagctcgaagcatggatacataacattactcacggcagcggtcccggtgccagaagggaggccttcaaaacctcatctagaaacgctctgaacgtgtctcaggcctggcgccacgctctgcctttcgccaagattcggagggtgcaagagctttgcgccggtgctctacagctgctggggtacaggcctgtctatagcgaggacgaacagcgaaacctggccctggatctcgtgttgcccaggggcctgaacggattcacctgggcctcgagcaccgcctcccacccccgaaactag

SEQ ID NO: 216978 - DNA, 1461 bp, Artificial Sequence
  Description of Artificial Sequence: Synthetic coding sequence
atgaagggacgcaggcggaggcgcagagagtattgcaagtttgctttacttctggtcctttacaccctggttttgctcctcgtgccctccgtgctggacggcggtagggacggggacaaaggggctgagcactgccccggtctccagcggagcctaggtgtatggagtctggaggcagctgctgctggagaaagagagcagggcgctgaagcacgtgccgcagaagagggtggcgctaaccaatcacctcgtttcccttccaacttatctggggctgtgggcgaagcagtgtcacgggaaaagcagcacatttatgtgcacgccacttggagaactggaagttccttccttggcgagctgttcaaccagcaccccgatgtattttatctctacgagcccatgtggcatctgtggcaggcgctgtatccgggtgatgcggagtctctccaaggcgctctacgtgacatgttgaggagtttgttcaggtgcgactttagcgtgttacgactttatgcccctcctggcgaccctgctgcaagagcacccgacaccgctaatctaaccaccgccgcactattccgctggaggacaaataaggtcatttgtagtccccctctgtgccccggagccccacgtgctcgagccgaagtgggcttggtggaggataccgcctgcgagaggtcatgcccacccgtggcaattcgcgcactcgaggctgaatgccgcaagtacccagtcgtggttatcaaggacgttagactgctcgacctcggggtgctcgtgcccttactgcgcgatccaggacttaatctaaaagtagtgcagctctttcgcgaccctagagcggtgcacaatagtcggctgaaaagccggcaagggctactccgtgaatcaatccaggtcttgaggactcgccagagaggagacagatttcaccgcgtgctcctggcccacggcgtcggggctaggccaggtggtcagtcccgcgcactgcctgctgcaccgagagctgacttttttctcacaggtgcattggaggtaatctgcgaagcatggcttcgcgacttactctttgccagaggagctccggcttggctgcgaaggcgatatttgagacttcggtatgaagatctcgtaagacagcccagagcacagcttcgcaggctactgagattttctggactaagagccctcgcagctctggacgccttcgccttaaacatgacacggggtgcagcttatggcgctgaccgtccctttcacctgtctgctagagatgctagagaggcagtccacgcctggcgtgagcgactttcccgagaacaagttcgtcaggtggaggctgcctgcgcaccagccatgaggcttctggcctatccaagatctggggaagagggtgatgccgagcagcctagagagggggagacgcctctcgagatggacgctgacggcgctacttag

SEQ ID NO: 216979 - DNA, 1593 bp, Artificial Sequence
  Description of Artificial Sequence: Synthetic coding sequence
atgtctcgctctccccaaagagctttgccaccaggtgcactccctcggctgctgcaggccgctcctgccgcagccccaagggcgctccttcctcagtggccccgacgtccaggcaggcggtggcctgctagccccttggggatgaaagtgttccgtcggaaagctttggtgttatgcgccggatatgctttactgctcgtactaaccatgctcaacctgctggactacaaatggcacaaagaaccgctacagcagtgcaatccggacgggccactcggagcagcagccggagcagctggtggaagctgggggaggccaggtcctccccctgcgggaccacccagagcccacgcaagactcgatctccgcacaccgtatagacccccagctgctgcagtgggtgctgcccctgcagctgccgcagggatggcaggcgtggcagctcccccaggcaacggaacacgaggaaccggaggagtgggcgacaagcgccagctcgtgtatgtgttcacaacctggaggtctggttcaagctttttcggagagctgtttaatcaaaatcccgaggtgttcttcttatatgaaccggtgtggcacgtgtggcagaaactttatcccggtgacgctgtgtcccttcagggggctgccagagacatgttgagcgccctgtatcggtgcgaccttagcgtgttccagctgtattcgcccgctggatcggggggtaggaacttgactacactgggtatcttcggcgcagccacaaacaaagtggtctgttcctcccctctttgtcccgcataccgaaaggaagtcgtcggcttagtcgatgaccgtgtgtgcaaaaagtgtccaccccagagacttgctagatttgaggaagaatgtcgtaagtacaggaccctggtcatcaagggtgtgagagtcttcgatgtggcggtcctggcacccctcttgcgggatcctgccttggatttgaaggtaatccatctcgtgcgagacccacgggcagtggcctcctccagaatacgttctcgccacggacttataagagagtctctgcaggttgtgagatctagagaccccagggcccatcgtatgccttttctcgaagctgctgggcacaaactcggagctaaaaaagaaggggtcggcggaccggctgattaccacgccctgggggcaatggaagtcatttgcaactccatggcaaagactcttcagactgctctccagccccctgactggcttcaggggcactaccttgtggtccgctatgaagaccttgtgggagatcccgtgaagacattacgcagagtttacgacttcgtgggactcctagtcagtccagagatggaacaattcgcccttaatatgacatcaggatcgggatcgtccagcaagcctttcgttgtgtccgcacgaaacgctacccaagcagccaacgcgtggcggaccgcgctcactttccaacagattaaacaggtggaagaattttgctatcagccaatggcggtccttggatacgagagagtaaactcacctgaggaggtcaaagatttgagcaaaacattgctccgcaagcctcgcctctag

SEQ ID NO: 216980 - DNA, 1071 bp, Artificial Sequence
  Description of Artificial Sequence: Synthetic coding sequence
atgcaccatcagtggctgctgctggccgcatgtttctgggtgatattcatgttcatggtggcctctaaattcattaccctgacgtttaaagatcctgatgtttactctgccaagcaggaatttttgtttctgactaccatgcccgaggtcagaaaattgccagaagaaaaacacatacctgaagagctgaaaccaacaggaaaggagctcccagactctcagttggttcagcccctggtctacatggagcgcctggagttgattcgaaatgtatgtcgcgatgacgcgttgaagaatttatctcacacccctgtctctaaattcgtcctcgatcggatctttgtatgtgacaagcataagatacttttttgtcagacacccaaagttggtaacacacaatggaagaaagttctgatcgttcttaacggggctttttctagcattgaggagatccctgagaatgtggttcatgaccatgagaagaatggactccccaggctcagctctttttctgatgcagagatccagaagcgcttgaaaacctactttaaattttttattgtccgagatccattcgaacgattaattagcgcctttaaggacaagttcgtgcacaaccccagatttgagccctggtatcgccatgagatcgcgccaggtatcatcaggaaatatagacgcaacagaaccgagacccgcggaattcagtttgaagacttcgttaggtacctgggagaccccaatcatcggtggctggatctgcagtttggtgatcatataattcattgggtgacttatgtggagctgtgcgctccctgtgagataatgtacagcgtgattggacatcacgaaaccctggaggatgacgctccttacatcttgaaagaagctggcatcgatcacctcgtttcataccccacaatacccccaggaatcacagtctacaaccgcacaaaagtggagcattactttctgggcatttctaagagagacatccgccgactgtacgcacgcttcgaaggcgatttcaaactgtttggctatcagaaaccagactttttgctgaactag

SEQ ID NO: 216981 - DNA, 426 bp, Artificial Sequence
  Description of Artificial Sequence: Synthetic coding sequence
atgcatcatcagtggctcctgttagccgcttgcttctgggttatattcatgtttatggtggcaagcaagttcataacgctaacttttaaggatccagacgtttacagtgcaaaacaggagttccttttcctcacaaccatgccggaggtccggaaattacccgaggagaaacatatccccgaagagttaaagccaacgggtaaagaacttcctgacagtcagcttgtacaacctctcgtgtacatggagcgcctggaactgataaggaatgtatgccgcgatgacgccttgaagaacctcagccacaccccagtctcaaaatttgtgctagaccggatcttcgtatgtgataaacataagatcctgttttgtcagacgcctaaagtgggcaacactcagtggaagaaggtactgatagtcctgtag

SEQ ID NO: 216982 - DNA, 1071 bp, Artificial Sequence
  Description of Artificial Sequence: Synthetic coding sequence
atgcatcaccagtggctgcttttggcagcatgcttttgggtgatttttatgtttatggttgcctccaaattcattactttaacgttcaaggatccagatgtctactccgccaaacaggagttcctctttctcacgactatgcctgaggttcggaagctcccagaagagaagcacataccagaagaactgaagcctacaggcaaggaattacccgatagtcagctggtgcagcctcttgtgtacatggaacggctggaactgattaggaacgtgtgtcgtgatgatgcactgaaaaatctgtcacataccccggtgtcaaaatttgtcttggataggattttcgtctgcgacaagcacaagatcctgttctgccagacccccaaggttggcaatactcagtggaaaaaagttctgatagtgctgaacggggctttctcctccattgaagaaataccggaaaatgtggtgcacgaccatgagaaaaatggcctaccacgcttaagcagtttcagtgacgcagaaatccagaaaaggctgaagacatattttaagttcttcatcgtgagagacccatttgagcgccttatctccgcctttaaggataagttcgtgcataatccacgttttgagccatggtaccggcatgagatcgcgccaggcatcatacgaaaataccggcgtaaccgaaccgagactaggggaatccaattcgaagacttcgtgcgttacctgggtgatcctaaccatcggtggctggacttacagttcggtgaccacataatacactgggtcacctacgtggagttgtgtgcaccctgcgagattatgtattcagttattggccaccatgagacattggaggatgatgccccttatattctcaaagaggctggcatcgatcatctcgtatcatatcccacgatcccccctgggatcacagtgtacaataggaccaaggttgagcactactttctgggcatatctaagcgcgatatccgcagactttacgcacgatttgagggggatttcaagctttttggttaccagaagcccgatttcctgttaaactag

SEQ ID NO: 216983 - DNA, 195 bp, Artificial Sequence
  Description of Artificial Sequence: Synthetic coding sequence
atgcatcaccagtggttgcttttggccgcttgcttttgggtgatttttatgttcatggttgcaagcaaatttatcacccttacatttaaagaccccgatgtctactcggcgaagcaggagttcttattcctgacaacaatgcctgaagtgagaaagcttccggaggagaagcacatcccggaagagctcaagtag

SEQ ID NO: 216984 - DNA, 402 bp, Artificial Sequence
  Description of Artificial Sequence: Synthetic coding sequence
atgcatcaccaatggttgttgttggccgcatgtttttgggtgatcttcatgttcatggtggcctccaagtttattacactgaccttcaaagaccctgatgtgtattcggccaaacaggaatttctcttcctcactaccatgccagaagttcggaagctccccgaggagaagcacattcctgaggagttaaagccgaccgggaaggagttgcctgattctcagctggtccaaccgctggtgtatatggaacggttggaactcataagaaacgtatgccgcgacgacgctcttaaaaaccttagccacactccagtgtccaagtttgtgcttgacaggatcttcgtctgcgataagcacaagatcctgttttgtcagacaccaaaagtgggcaatacccaatag

SEQ ID NO: 216985 - DNA, 258 bp, Artificial Sequence
  Description of Artificial Sequence: Synthetic coding sequence
atgcaccaccagtggctgctgttggccgcatgtttttgggtgatatttatgtttatggtagcttctaagttcattacacttacttttaaggaccctgacgtgtatagcgcgaaacaggaattcctcttcttgaccaccatgcccgaggtgcggaaactgccggaagagaagcacatccctgaggaactgaagccgacagggaaggagcttcctgactcacaactggtgcagcccttggtatacatggagcgcttatag

SEQ ID NO: 216986 - DNA, 102 bp, Artificial Sequence
  Description of Artificial Sequence: Synthetic coding sequence
atgcaccaccaatggcttttgttagcagcttgtttttgggtcattttcatgtttatggtggcctccaaattcattaccctgacttttaaggatcctgattag

SEQ ID NO: 216987 - DNA, 1215 bp, Artificial Sequence
  Description of Artificial Sequence: Synthetic coding sequence
atgcagagaaaagccggaaagaaggagcacgtacagctccgcgataagaggaaccaggagccacagtttaggggcaacaccgccagaaagtgtgagcctcaggcggcagaaggaagagtcagtgagtggctgcggtgcgacaacatgcaccaccagtggcttttgctggcagcttgtttttgggtcatctttatgttcatggtcgccagcaaatttataacgctgaccttcaaggaccccgatgtttactccgcaaaacaggagttcctgttcttaactaccatgcccgaggtgcgaaaactgccagaagaaaaacacatcccagaagaattaaaaccgactggaaaagagctgcctgacagccagctggtacagccccttgtgtacatggagaggctggagctcatccgcaacgtttgcagagacgacgcattgaagaatctgtcccacacgccagtgagcaagtttgtgctggaccggattttcgtatgcgacaaacacaaaatcctcttctgccagacccccaaggttggcaacacccagtggaaaaaggtactcatcgtgctcaatggtgctttctctagcatagaagagatccctgaaaacgtggtgcatgaccatgagaaaaatggcctcccacgcttatcctccttcagcgatgctgaaatccagaagcgcttgaagacatacttcaaattcttcatcgttcgcgatccctttgagcgcttgatctcggcttttaaagacaaatttgttcacaacccccgatttgaaccatggtaccggcacgagatagcccctgggattattcgcaagtatcggcgtaatcgcaccgagacacgtgggatacaatttgaggatttcgtccgctacctcggcgaccccaatcatcgatggctcgatctgcagttcggagaccacataattcattgggttacctatgtggaactttgtgcaccctgtgagatcatgtacagtgttattggccaccacgagaccttggaagatgatgcaccctatatattaaaagaggcgggtatcgatcatctcgttagctaccccaccatccctccgggtattacagtgtataatagaaccaaagttgagcattactttcttggcatatcgaagagggacattcggagactctacgcccgttttgagggggacttcaagttgtttggctaccagaagccagattttctcttaaattag

SEQ ID NO: 216988 - DNA, 786 bp, Artificial Sequence
  Description of Artificial Sequence: Synthetic coding sequence
atggcttcaccagactgggggtacgacgacaagaatgggccagaacaatggtcaaaattataccccatagcaaacggcaataaccagagccctgtggacatcaaaacctctgaaaccaaacacgacactagcttaaaaccgatttcggtctcatacaaccctgcaactgccaaggagatcattaacgtggggcatagcttccacgtgaattttgaggacaatgacaaccgaagcgtattaaagggtggacccttctctgattcttatcggctctttcagttccactttcattgggggagcaccaatgagcacgggtctgaacatactgtggatggagttaaatattccgcggagctgcacgtggcccattggaattctgcaaagtatagctccttagcagaagcagcttctaaggcagacggattggccgtcataggagtcctcatgaaggtgggggaggccaatccgaaacttcagaaagttctggatgccctgcaggccattaagacaaagggtaaaagagcccctttcactaattttgatccctccactcttctgccctcaagcctcgacttttggacatacccgggatctcttactcatccacccttgtatgaatctgtcacatggatcatttgcaaagagtctatttcagtcagttctgaacagctggcacagtttagatcactgctgagtaacgttgaaggtgataatgccgtcccaatgcagcacaataaccggccaacccaacctctcaagggcagaaccgtgcgggcatcattctag

SEQ ID NO: 216989 - DNA, 786 bp, Artificial Sequence
  Description of Artificial Sequence: Synthetic coding sequence
atggcgtcgccagattgggggtacgacgacaagaacggacctgagcaatggagcaagttgtatccaatcgctaacggaaataatcagagccctgtggatattaaaacctcagaaaccaagcacgatacaagccttaagcccattagtgtaagttataaccctgccaccgcgaaagagatcattaacgtaggtcatagcttccacgtgaactttgaggacaacgacaaccgctcggtcctaaagggtgggcctttctccgattcttataggctgttccagttccatttccattggggatccaccaatgagcatggatccgaacacaccgtagacggagtgaagtatagcgctgaacttcatgtcgcacactggaattctgcgaagtatagctccctggccgaggccgcatcgaaggccgatggattagcagtgattggggtactgatgaaggtgggcgaggccaatcccaagctgcagaaggtccttgatgcgctgcaagccattaagactaaggggaaacgggctcccttcactaatttcgatcccagcacccttctgccctcgtcactggacttctggacctaccccggttctctgacccacccccctttgtatgaaagcgtgacctggataatatgcaaagaaagcatttctgtgtcctccgagcagttagcgcagtttagatctttgctgagcaatgtggagggtgacaacgctgtgcccatgcagcacaataataggccaactcagcctctaaaggggcgaactgtcagagcttctttttag

SEQ ID NO: 216990 - DNA, 786 bp, Artificial Sequence
  Description of Artificial Sequence: Synthetic coding sequence
atggcttctcccgactggggttacgacgataagaatggaccagaacagtggtccaagctttaccccatcgcgaatggcaacaaccagagtcctgttgacattaagacttccgaaaccaagcatgacacatcgctgaagccaatctcagtttcttacaatccagcaacagctaaagagataattaatgtaggccactcctttcatgtgaactttgaagataacgataaccgctcagtgctcaaggggggacccttcagtgattcctatagactatttcagtttcacttccactggggaagcaccaatgaacatgggtctgagcatactgttgatggcgttaaatactctgccgaacttcacgtagcccactggaatagcgcaaaatattccagccttgccgaagctgctagcaaagcggatggcttagccgtgatcggcgttctgatgaaggtcggagaggcgaaccctaagttacagaaggtgctggacgccctgcaagctataaagaccaagggcaagcgggcaccatttaccaatttcgatccctccacgctgctgccatcctccctcgacttttggacgtaccctgggtccctgacccacccccctctgtacgagagcgtgacgtggatcatatgcaaggaatccatatccgtctcttcagaacagcttgcacagttccggtcactattatctaatgtggaaggggacaatgctgttccgatgcagcataacaatcggccaacacagccgctgaaaggacgtacggttcgggcaagcttctag

SEQ ID NO: 216991 - DNA, 531 bp, Artificial Sequence
  Description of Artificial Sequence: Synthetic coding sequence
atggcttcccccgattggggctatgatgacaaaaatggacccgagcagtggtccaagctttaccccatcgctaacggaaacaaccagtcacccgtggacattaaaacctctgaaacaaaacatgacaccagtttaaagccaattagcgtgagttataaccccgctactgccaaggaaattattaacgtaggacacagctttcatgtgaacttcgaagacaatgataacagaagcgtgctcaagggcggaccattttccgatagctatcggctgtttcagttccacttccattggggcagcacaaatgaacacggcagtgagcacactgtggacggggttaagtattcagccgaacttcacgtggctcactggaatagcgcgaaatattcatcattggcggaagccgcatctaaggctgacggactagcagtgattggagtgttaatgaaggtcggcgaggcaaacccgaagctccagaaagtactagacgctttgcaggccattaagaccaagggaaaacgcgctccttag

SEQ ID NO: 216992 - DNA, 756 bp, Artificial Sequence
  Description of Artificial Sequence: Synthetic coding sequence
atggcttcccctgactggggctatgatgataaaaacggacctgagcaatggtctaaactataccccatcgccaatggcaataaccagtcaccggtcgatatcaaaacaagcgagaccaagcacgatacatctcttaagccaatcagcgttagctataaccctgccactgcgaaggagatcattaacgtcgggcactcctttcacgtgaatttcgaggataatgacaacaggtccgtgttgaagggcggtccattctcagactcatatcgtctgtttcaattccacttccactggggaagcactaatgagcatggctctgagcacaccgtcgatggagtaaaatatagtgcagagcttcacgtggctcattggaactccgcaaagtactcatctctggccgaggcggcatccaaggctgatggactggctgtcatcggcgtactgatgaaggtcggcgaggcgaacccaaaacttcagaaggtgttggacgctttgcaggcaataaaaacgaaaggcaagcgcgcaccattcaccaatttcgatccctcaaccctgttgccttctagtctcgatttttggacgtatcctggatccttgactcaccctcccctgtacgaaagcgttacatggatcatttgtaaggagagcattagtgtctcctctgagcaactggcccagttccgctcactcctcagcaacgtggaaggagacaatgcagtgcccatgcagcataacaaccgcccaacacagccatag

SEQ ID NO: 216993 - DNA, 69 bp, Artificial Sequence
  Description of Artificial Sequence: Synthetic coding sequence
atggccagcccggattggggctacgacgataaaaacgggcctgagcagtggagcaagctatacccttag

SEQ ID NO: 216994 - DNA, 450 bp, Artificial Sequence
  Description of Artificial Sequence: Synthetic coding sequence
atggcctcccctgactggggctatgacgacaaaaatggtcccgaacagtggtcgaagctatatccaatcgcgaatggcaacaatcagagcccagtggatatcaagacaagcgaaacaaaacacgacacttccttaaagccgatatctgtgtcgtataatcccgctaccgctaaagaaatcatcaacgtgggccattcattccacgtcaacttcgaggacaacgacaatagatccgttctaaaggggggtcctttctcagattcatatcgactgtttcaattccactttcactgggggagcaccaatgaacatggctctgaacacactgtggatggagttaaatactcagcagagctgcacgtggcccattggaacagcgccaagtacagtagtctcgcagaagcagcaagcaaagccgacgggctggcagtcatcggggtgctgatgtag

SEQ ID NO: 216995 - DNA, 450 bp, Artificial Sequence
  Description of Artificial Sequence: Synthetic coding sequence
atggccagtcccgactgggggtatgatgataaaaacggtcctgagcagtggtctaagctgtatcctattgccaatggaaataaccagtctccagtggatatcaagaccagcgaaacaaaacacgataccagcctgaagccaatctccgtgagctacaaccccgctacggcgaaggaaattattaacgttggtcactcctttcacgtcaatttcgaagataacgacaatagatccgtgttgaaaggcggtcctttctctgatagctaccgcctgttccagtttcactttcattggggctctaccaatgagcatggttcggagcatacagtagacggagtcaaatacagtgctgagttgcacgtggcccattggaattctgccaaatactccagcctggcagaggcagcgtcaaaagcagacggcctggcagtgattggagtcctgatgtag

SEQ ID NO: 216996 - DNA, 357 bp, Artificial Sequence
  Description of Artificial Sequence: Synthetic coding sequence
atggcctcacctgattggggatatgatgataaaaatggccctgagcagtggtcaaagctataccctatcgccaacggcaataatcagtctccagtcgacattaaaaccagcgagaccaagcacgacacctcactaaaacccatcagcgtgtcatacaatccagctacagccaaggagattattaatgtggggcatagcttccacgtgaatttcgaagataatgataaccggtcagtcctgaaggggggaccattctcagatagctacagactcttccagtttcatttccattggggatctaccaatgagcacggctctgagcacaccgtggatggagtcaagtattccgcagagtag

SEQ ID NO: 216997 - DNA, 447 bp, Artificial Sequence
  Description of Artificial Sequence: Synthetic coding sequence
atggcatcccccgattggggatacgacgataagaacggaccggagcagtggtccaagctatacccaattgctaacggaaataaccagagtccagtggatatcaagacatccgagaccaaacacgataccagtctaaaaccaatctctgtgagttataatcccgctactgctaaagagatcattaatgtgggccatagtttccatgtaaactttgaggacaatgataacaggtctgtgttgaaaggcggaccattcagtgatagctatcggctgttccagtttcactttcactggggatctactaacgagcatggaagtgagcacactgtcgatggggtcaagtatagcgccgaactgcacgtggctcattggaactcagctaaatacagttcactggcagaagcagcctctaaggctgacgggctagcggtcatcggcgtgctatag

SEQ ID NO: 216998 - DNA, 786 bp, Artificial Sequence
  Description of Artificial Sequence: Synthetic coding sequence
atggcatcccctgactggggttacgacgacaaaaatggcccagagcagtggtccaagctgtacccaattgccaacggaaacaaccaatcccctgtggacataaaaacatctgaaacaaagcatgatactagccttaagccgatctccgtgtcctataaccctgcaacagccaaagaaatcatcaatgtgggacacagctttcacgttaactttgaggataacgacaaccgatccgttctgaagggaggcccattcagtgacagttaccgactgttccagtttcatttccactgggggtccacgaacgaacacggctctgaacacacagtggacggggttaagtacagcgcggagttgcacgtcgctcactggaatagcgccaaatactcctccttggctgaggccgcttcaaaggcagatggtcttgccgtaataggcgtcttgatgaaggtcggagaggccaatcctaagctgcagaaggtgttggatgccctacaggcgatcaaaaccaagggcaaacgcgcaccatttacaaatttcgaccccagtactcttctgccaagctcgttagatttctggacctaccctggatcgctgactcaccccccactttacgaatccgtcacctggatcatctgcaaggaaagcattagtgtctccagcgagcagctagcccagttccgttccctgctgagcaacgtagaaggagataacgccgtccctatgcagcataataaccggcctactcagcccctgaaaggaaggacagttcgtgccagcttctag

SEQ ID NO: 216999 - DNA, 300 bp, Artificial Sequence
  Description of Artificial Sequence: Synthetic coding sequence
atggcatcccctgactggggctatgatgacaaaaatggccctgagcagtggagtaaattatacccaatagccaacggaaacaaccaaagccccgtggacattaaaacctccgagacaaaacatgacacttcacttaagcccatttcagtgagctataatcccgcaactgccaaggagattatcaacgtggggcactcctttcatgttaatttcgaagataatgacaaccgctcagtgcttaaaggcggacccttttcagatagctacaggctctttcaatttcatttccattggggctag

SEQ ID NO: 217000 - DNA, 786 bp, Artificial Sequence
  Description of Artificial Sequence: Synthetic coding sequence
atggcctcacctgattgggggtacgacgacaaaaacggcccagagcagtggagtaaactctatccgattgcaaacgggaacaaccagtccccggtggatattaagacctctgagaccaagcacgatacttcactcaagcccatatcagtgtcttataaccctgccactgccaaggagattattaacgtcggtcactccttccacgtgaatttcgaagataatgataatcgctccgtgttgaaagggggtcctttctccgattcctatcgacttttccaattccatttccattggggctcaaccaatgagcacggttccgagcacacggttgacggcgtcaaatattccgcggagctacatgtcgcgcactggaatagcgccaaatattctagtttggccgaagcagcatctaaggcagatggattggcggtcattggggtcctcatgaaagtcggagaagctaatcccaagctgcagaaggtgcttgacgctttacaggccatcaaaaccaaaggtaagagggcgccatttacaaactttgacccctctactctgctgccatcaagtctggatttttggacttaccccggatccctcacccatccacctctgtacgagagtgtaacgtggatcatatgcaaggagtctatttccgtcagctcagaacaacttgcgcaattcagaagtttactttcaaacgttgaaggggataatgctgtacctatgcagcacaacaacaggcccacccagccgttgaaaggacggactgtcagagcttctttttag

SEQ ID NO: 217001 - DNA, 786 bp, Artificial Sequence
  Description of Artificial Sequence: Synthetic coding sequence
atggctagtcctgattgggggtacgacgacaagaatggccctgagcagtggtctaaattatacccaattgctaacggcaacaatcagagccccgtggacattaagacctcagagactaaacacgacactagccttaagccaatttcagtgtcatacaatcctgcaacggccaaagaaatcataaatgtgggacattctttccacgtgaacttcgaggacaacgacaacagatccgttcttaaaggtggacccttttctgattcctatcggctattccagtttcacttccactgggggagcacaaacgagcacggctctgagcatactgtggacggcgttaaatactcagcagaactgcacgtagcccattggaactcagccaagtacagcagtctggcggaggctgcgtccaaggccgacggcctggctgttatcggcgtacttatgaaagttggcgaggctaatcctaagctccagaaagtgttggatgcattgcaagccattaagactaaggggaaaagagccccttttaccaactttgatccctctacactcctccctagtagcctggatttttggacataccctgggtccctgacacatccccctctctatgagtcggtgacttggatcatctgtaaggagagtatatcagtctcgtctgagcagctggcccagttcagatccctgctctccaatgtcgagggtgacaacgccgttccgatgcagcacaataataggcctacacagccgctgaagggtagaaccgtcagggcctccttttag

SEQ ID NO: 217002 - DNA, 783 bp, Artificial Sequence
  Description of Artificial Sequence: Synthetic coding sequence
atgagccaccactggggctatggcaaacacaatggcccagagcactggcataaagacttccctatagcaaaaggagaacggcagagcccagtggatatcgacacgcacaccgccaaatacgatccttctctgaagcccctgagcgttagttacgatcaggctacttccctccgtattttaaacaatgggcacgcttttaacgtggaattcgacgacagtcaggacaaggccgtgcttaagggcggaccactggatggcacttatcgcttgatacagttccactttcactggggaagcctggatggccagggttctgagcataccgtcgacaagaagaaatatgccgcagagctccacttggtacattggaacacaaagtacggtgacttcggtaaagccgtccaacaacccgacggtcttgccgtactgggaattttcctgaaagtgggaagtgcaaaacccggactgcagaaggtggttgatgtgttagattcgatcaaaaccaagggcaaaagcgcggacttcactaacttcgatcccagaggactgttgcccgagtcactggattattggacctaccctgggagccttacaacccctcctttgcttgagtgtgtaacctggattgtgctgaaagaacctattagcgtttcttccgaacaagttcttaaattccgtaaactgaactttaacggggagggcgagccggaggaactaatggtagataattggcggcctgcacagccgcttaagaaccgccagatcaaagcaagttttaaatag

SEQ ID NO: 217003 - DNA, 783 bp, Artificial Sequence
  Description of Artificial Sequence: Synthetic coding sequence
atggccaaagagtgggggtatgccagccataatgggccagaccattggcatgagctgtttcccaatgctaagggagaaaatcaaagccctgtggaattgcataccaaggatattcgacatgatccttctctgcagccctggagtgtttcatatgatggcggatccgccaagactatcttgaataacggtaaaacatgccgcgtggtgttcgatgatacttacgatagatcgatgctcaggggaggtccactacccggaccatacagactcagacagtttcaccttcactggggttcctctgatgaccatggcagcgagcacaccgtggatggcgtaaagtatgctgctgaactccatcttgtacactggaacccaaaatataacacctttaaagaagcccttaagcagagagacggcatcgcagttattggaatcttccttaaaatcgggcacgaaaacggggagtttcagatctttttggacgctctcgacaaaatcaaaacgaaaggtaaggaggcaccatttacaaaatttgaccccagctgtctctttcctgcttgtagagactactggacctatcaggggagtttcactaccccaccatgtgaagaatgtatagtgtggctcctgctgaaggaaccaatgacggtgtccagcgaccagatggctaagctgaggtccctgctgtcgtccgctgagaacgagccgcctgtgcctttggtgtccaattggagacctccccaacccatcaataacagggttgtacgtgcctcctttaaatag

SEQ ID NO: 217004 - DNA, 735 bp, Artificial Sequence
  Description of Artificial Sequence: Synthetic coding sequence
atggcaaaagaatggggttatgcatcccacaacggtccagatcattggcatgaactatttccaaatgccaagggcgagaaccagtctccatggtctgtgtcttatgacgggggatctgccaaaacaatcttgaacaacggaaaaacctgtagggtcgtgtttgacgacacatatgatcggtctatgttgagaggaggcccactacctggcccatataggctgcgccagttccacctgcactggggatcctccgacgaccatggttcggagcataccgttgacggcgtcaaatacgccgctgagcttcacttggtacactggaatccaaaatacaatacctttaaagaagctctgaagcagcgcgacggcattgccgtcatcgggatctttttaaagatcgggcacgagaatggtgagtttcaaatttttctcgatgcattagacaaaattaagacgaagggaaaagaagcacccttcaccaaatttgacccatcttgcctatttcctgcctgtcgcgattactggacatatcagggtagctttactactcccccatgcgaagaatgtattgtgtggctgctgctgaaggagccaatgaccgtgtcctccgaccagatggccaagcttcgatccctgttgtcatccgctgagaatgaacctcccgtgcccttagtgtctaactggagacctccccagcctataaataacagggtagtaagagctagctttaagtag

SEQ ID NO: 217005 - DNA, 954 bp, Artificial Sequence
  Description of Artificial Sequence: Synthetic coding sequence
atggttgtgatgaactccctccgagtcatcctgcaggcttctccaggaaagctcttatggaggaaattccaaatcccccgatttatgcccgctagaccctgctccctttacacttgcacatacaaaactcgcaaccgcgcactgcatccactgtgggaatctgttgacttagtccccggaggcgatcggcagtcacccatcaatatcagatggcgtgatagtgtttatgatccaggcctcaagcctttgacaatctcatatgatccggcaacatgccttcacgtgtggaataacgggtatagctttctggtggagttcgaggacagtacagacaagagcgttatcaagggagggcctttggagcataactatcgacttaagcagtttcacttccattggggtgcaatagacgcatggggaagtgagcatacggtagacagcaaatgcttccccgctgagttgcacttggtacactggaatgcggtccggtttgagaactttgaggatgccgctctggaggagaatgggttagccgtgatcggagtgttcctcaagttaggcaaacaccacaaagaactgcagaaactggtggacacattaccctctattaaacacaaggacgcactggttgaatttggcagcttcgatccgtcctgtctgatgcccacatgccccgactattggacatactctggctcactgaccacgccccctctttcggagtcagtgacttggatcataaaaaaacaaccagtggaagtggaccacgaccagctggagcaatttagaacccttctgtttaccagtgagggggaaaaagagaagcgcatggttgacaacttccggccactgcaacctttaatgaaccgcactgtgcggagttcttttcggcacgactacgtcctgaacgtacaggctaaaccaaaacctgcaactagccaggccacaccctag

SEQ ID NO: 217006 - DNA, 954 bp, Artificial Sequence
  Description of Artificial Sequence: Synthetic coding sequence
atggtcgtgatgaactcgctcagagtgatcctgcaagcgagtcccggaaagttattatggaggaagtttcaaattcctcgatttatgccagccaggccgtgctccctgtacacctgtacttataagacccggaaccgggctttacacccactgtgggagtcggtggatcttgtgccgggaggggaccgacaatcaccaattaacatccgctggcgcgactctgtctatgaccccggacttaaacctctgactatttcttatgaccctgccacatgtctgcatgtgtggaacaacggatacagcttcctggttgagttcgaggattcgaccgataagtcagtaatcaaagggggtccactggaacacaattaccgcctcaagcaatttcattttcactggggcgcaatagatgcatggggatctgaacatacagtggattctaaatgttttccggctgagctacatctcgttcactggaacgcagtaagatttgaaaacttcgaggacgctgctctggaggagaacggcctggccgtgataggggtgttcctgaagctgggcaagcatcacaaggagctccagaagttagtggatacgcttccatcgattaagcataaagatgccctcgtggagttcggctcattcgatccaagctgtctgatgccaacttgtccagattactggacatattccggatcccttacgacacccccactttcagaaagcgtcacctggatcattaagaagcagcctgtggaggttgatcacgatcaacttgagcagtttcgcacccttctattcacttccgagggagaaaaagagaaaaggatggtggacaatttccgcccactccagcccttgatgaaccgaactgtccgatcttcctttcgccacgattatgtcttgaacgtgcaagccaagccaaaacccgcaaccagtcaggctacaccatag

SEQ ID NO: 217007 - DNA, 411 bp, Artificial Sequence
  Description of Artificial Sequence: Synthetic coding sequence
atggttgtgatgaattcgctgcgggtaatcctgcaggcttctcccggtaaattgctctggcggaagttccaaattccacgctttatgcctgctagaccctgttctctgtatacatgtacctataaaacaagaaacagagccctgcatcctttgtgggaaagtgtagatcttgtccccggaggcgaccggcaatcgcccatcaacatccgctggagagactccgtgtatgatccgggtcttaagccgctgactatctcctacgatcctgcaacctgcctccacgtatggaacaatggttattctttcctggtcgagtttgaggactctacagataagtccgtgataaaaggagggccattggaacacaactaccggctcaagcagttccatttccactggggggctatctag

SEQ ID NO: 217008 - DNA, 231 bp, Artificial Sequence
  Description of Artificial Sequence: Synthetic coding sequence
atggttgtgatgaatagcttaagagtgattctccaggcctctcccggtaagttgctttggagaaagtttcaaatccccagatttatgccggctaggccatgttcgctttacacatgcacatataaaacccgtaacagagccctgcaccctctttgggagagtgttgacctagttcccggaggcgataggcagtctcctattaatattcgatggcgagacagtgtgtactag

SEQ ID NO: 217009 - DNA, 540 bp, Artificial Sequence
  Description of Artificial Sequence: Synthetic coding sequence
atgcgcgctttagtgctcctcttgtccttgtttctccttggtggtcaggcccagcatgtgtccgactggacatattctgaaggcgcacttgatgaagctcactggccgcagcactatcccgcttgcggtggtcagagacagtctcccatcaacctgcagcgcactaaggttaggtataatccctctttaaaaggcctaaacatgacaggctatgaaactcaggctggggaattcccaatggttaataacggacacacggactggcaggcggagctttttctcccctctctatccagcccatgcggggagggggcaaagcacaaaggacagcgccaatggctctgttctccatccctcgacagctggtgggaagcaattatcgacggtggaagcctttgggcgaccttggcggagtgtggcctccgggctgaggggccagaggaaggcaggcacatggaagaaaagtcccctgctagtcagggtgcctgcagcgggtcgagactgccaatcagtcgtggcccttgtacctttttcctgtag

SEQ ID NO: 217010 - DNA, 942 bp, Artificial Sequence
  Description of Artificial Sequence: Synthetic coding sequence
atgagggccctagtcttgctactgagcctgttcctgctagggggacaggcccaacacgtgtccgactggacctattctgagggagcactggatgaggctcattggccacagcactaccctgcttgcggaggtcagagacagtccccaattaacctccaaagaactaaggtacgctataatccctcgctcaagggtctgaacatgaccggttacgaaacacaggctggcgagttccccatggtcaataacggccacacggtgcaaatcagtctcccatcgaccatgaggatgaccgtggccgatggcactgtatatatcgcccaacagatgcatttccactggggcggagcctcctctgagatttccggctcagagcatacggtggatggaattagacacgtcatcgagatccatatagtccattacaactccaagtataagtcatacgacatcgcccaggacgcccctgatgggttggcagtcctggctgccttcgtggaagtcaagaactatcctgaaaacacctactactccaattttatctctcatttagccaacatcaaatatcctgggcagcgcacaactctcacaggcctcgatgtgcaagacatgctccccagaaacttacagcattactacacctaccacgggagtctgaccacccctccgtgcaccgagaatgtccattggttcgtgctcgctgacttcgtgaagctgtcccgaacccaggtgtggaaacttgagaactccctgttggatcacaggaacaagacaatccacaatgattaccggagaactcaacctctcaaccacagggtagtggagtcaaattttcctaatcaaggcaagggccatgggggacaccgtgggcgttctcaaaaccctcgagtacaaccaaccagtactcgccatcccctggctctgggctctctcgaagcttag

SEQ ID NO: 217011 - DNA, 927 bp, Artificial Sequence
  Description of Artificial Sequence: Synthetic coding sequence
atgcgcgctttggtccttctgctttcgctgttcctgctgggcggacaggcccagcacgtgagcgattggacctattcagagggcgcattagacgaagcccattggcctcaacactatcctgcttgtggtggacagcgacagtcaccaataaaccttcagaggaccaaagtccgctacaatccgtccttgaagggactgaatatgacaggttatgaaacacaagctggagagtttcccatggtaaacaatggccacactgtccaaatctcattgccttccactatgagaatgacagttgctgacggtacagtctacattgcccagcaaatgcacttccactggggtggggcttcttccgaaatctccggcagcgagcataccgtcgacgggatccggcacgtaatagaaatccatatagttcactacaacagtaagtataaaagctatgatattgctcaggatgcacccgacggtctggcagtgctcgcagcttttgtagaggtgaagaattatccagagaatacctattatagtaacttcatttctcatcttgctaacatcaagtatcccggacagcgaactacactgacaggcctagacgttcaggacatgctgcctaggaatttgcagcattactatacttatcacggatcactcactacacctccttgcaccgagaatgtgcactggttcgtgcttgccgatttcgtcaaactaagccgtacccaagtgtggaaattagagaattcactcctggatcacaggaataagacaattcacaacgactacagacggacacagccccttaaccaccgcgtcgtggagagcaacttccccaaccaggagtataccttggggtctgagttccagttctatttgcataagattgaggaaattctcgattacttgagacgggcactgaactag

SEQ ID NO: 217012 - DNA, 795 bp, Artificial Sequence
  Description of Artificial Sequence: Synthetic coding sequence
atgaccggtcaccatggttggggatacggccaggacgatggcccttcccactggcacaagttgtaccccattgcacaaggtgatagacagtcaccaattaatatcatcagcagtcaggcggtctacagcccatccctgcagcccctcgagctgagctatgaagcctgtatgagtctttcaatcaccaataatgggcatagcgtgcaggtggacttcaacgacagtgatgataggacggtcgtgaccggcggtcctctcgagggtccttacagactgaaacagttccacttccactggggtaagaaacatgatgtcggttctgagcatacggtggacgggaagagctttccaagtgagctgcatctggtacactggaacgccaaaaagtatagcacatttggtgaagctgcctcagcgccagatggtctggcagtggtgggtgtgtttttggagacaggggatgagcatccctccatgaatagacttacggatgctctctacatggtccgttttaaaggcacgaaggctcaattcagttgctttaacccaaaatgccttctcccagcctcacgtcattactggacttacccaggatctcttaccacgcctcccctgagcgaatctgttacctggattgtactcagggagccgatttgtatctctgagagacaaatgggtaaattccggagcctgctctttacctcagaagacgatgaacgcattcacatggtgaacaacttccgcccaccacaacctctgaaagggagggtcgtgaaggctagttttagagcatag

SEQ ID NO: 217013 - DNA, 627 bp, Artificial Sequence
  Description of Artificial Sequence: Synthetic coding sequence
atgagcctgtcgatcacaaacaacggacatagtgttcaagtcgatttcaacgattcagacgaccgcaccgtagtgacagggggaccactggagggcccataccgactgaagcagttccatttccactgggggaagaagcacgatgttgggtccgaacataccgtggatggaaagagtttcccctctgaactgcatctggtgcattggaacgccaaaaaatactccacatttggtgaggctgcctcagcgccagatggcctggcggtcgtcggtgtgttcttggaaactggcgatgagcaccctagcatgaaccgactgaccgacgctctgtatatggtgagatttaaaggcacaaaggcacagttctcctgttttaatcctaaatgtctgctgcccgcttccaggcactactggacttaccctggatcattgactacccccccactctccgagtccgttacttggatcgtcttgcgggagcctatctgtatctccgagaggcaaatgggcaagttccggtcactgctgttcacatcggaggatgacgagcgaatccacatggtgaataatttcagaccacctcaacctctgaaaggacgtgtggtaaaggcgtcctttagggcgtag

SEQ ID NO: 217014 - DNA, 873 bp, Artificial Sequence
  Description of Artificial Sequence: Synthetic coding sequence
atggctgacttgtcattcatcgaagacacagtagccttccctgagaaagaggaggatgaggaagaggaagaggagggggttgagtggggatacgaagagggtgtggagtggggtctggtgttccctgatgctaacggagagtaccagtcacccattaacctcaactcgcgcgaggcccgatatgatccatcactgctggatgtcaggctatcacccaattacgttgtctgccgagactgcgaggtcaccaatgatgggcacacaattcaggtgatcctcaaatccaaaagcgtcttaagtgggggtccactcccacagggccatgagtttgagttgtacgaagtgagatttcactggggcagggaaaaccaaaggggctccgaacacaccgtgaactttaaggcctttcccatggagctacacttaatacactggaactctaccttatttggcagcattgatgaggctgtcggcaaaccccacggcatcgctattatagctctattcgtgcaaatcggcaaagagcacgttggtttaaaagccgtgactgagatcctgcaggacatccaatacaagggcaaatcaaagactatcccctgttttaatcctaacaccttgctccccgatccgcttttaagggattattgggtctacgagggaagcctgacaatccctccgtgcagcgagggagtgacatggattctgtttcgctatcctttgacaatatcccagctgcagatcgaagaatttagacgcttgagaactcatgtgaagggcgcagagctggtggaagggtgcgacggaatcctgggggataacttccgtccgacccaacctttgtcggatcgagtaatccgggctgcatttcagtag

SEQ ID NO: 217015 - DNA, 987 bp, Artificial Sequence
  Description of Artificial Sequence: Synthetic coding sequence
atggagatcgtctgggaggttctgttccttctgcaagcgaatttcatcgtgtgtatctccgcccagcaaaattcaccaaaaattcacgagggctggtgggcctacaaggaggtcgtacagggcagttttgtgccagttcccagcttctggggactcgtcaatagcgcctggaacttgtgctccgttggtaagcggcagtcccccgtgaacattgagacctctcacatgatattcgaccccttcctcaccccattgagaatcaatacaggcggtcggaaagtgagcggaaccatgtataacacaggacgccatgtcagccttagactggataaagagcatctggttaatatttctggcggtcccatgacttacagccaccggctcgaggaaatacggttacatttcggtagcgaagactctcagggaagtgagcacctgctcaatggccaagctttctccggcgaggtacagttaatacactataaccacgagttgtatacaaacgtcactgaagctgccaagtctcctaatggcctagtggtagtgagtatctttatcaaagtgagcgactctagtaatccattcttaaatcggatgttgaaccgggataccattacccgcatcacatacaaaaacgacgcctatttgctgcaggggcttaatatcgaggaactgtatcctgagacatcatccttcatcacctatgatggctcaatgactatcccaccgtgttatgagaccgcctcatggataatcatgaataaaccggtatacataacaaggatgcagatgcactctcttcgtctattgtcccagaaccagccaagccaaatctttctttcaatgtccgataacttcagacccgtgcagcccctgaataacagatgcattcgcactaacattaacttttcattgcaggggaaggactgtcctaataaccgagcccaaaagctccagtatcgggttaacgagtggttacttaagtag

SEQ ID NO: 217016 - DNA, 1005 bp, Artificial Sequence
  Description of Artificial Sequence: Synthetic coding sequence
atggcgtccatccgctcgaggtctggctgtggcttcaccgaaccagatgagctatgcatggtaggcgtgagggaaaacgcgcagcagaatagcccaaaaatccatgagggttggtgggcctacaaggaagtggtgcagggcagtttcgtgccagtgcctagtttctggggtctggtcaatagtgcgtggaacctgtgctccgtgggaaagcggcagagccctgttaatatcgagacctcacacatgatcttcgatcctttcctgacgccgctgagaatcaacaccgggggtcggaaggtgtcaggtacaatgtacaatacaggtaggcatgtctctctcagactggataaggagcacctggtgaacatcagtggcggtcccatgacctactcccaccgattggaggagattcggcttcacttcggctcggaggactcccaaggctccgagcaccttctgaacgggcaagcattctccggggaagtgcaactgattcactataaccatgaactgtataccaacgtgaccgaggcagctaagagccccaatgggctcgtggtagtcagcatcttcattaaagttagtgatagtagcaatccttttctcaacaggatgctgaaccgcgacaccataacacgaattacctacaagaacgacgcctaccttctccaaggactgaacatagaagaattgtacccggaaacttccagtttcatcacttatgacggaagtatgaccatcccaccatgttatgaaaccgctagctggattattatgaacaaacccgtctacattacccgaatgcagatgcacagtctgagactactgagccagaatcagcctagccagattttcctctctatgagcgacaacttccgtcctgtgcagccactgaataaccgctgtattagaaccaacatcaacttctctctccagggcaaggactgtccaaacaacagggctcagaaattgcagtaccgcgttaacgagtggttactgaaatag

SEQ ID NO: 217017 - DNA, 987 bp, Artificial Sequence
  Description of Artificial Sequence: Synthetic coding sequence
atggaaatcgtttgggaggttttatttctgctccaagccaactttatcgtgtgcattagtgcgcagcagaattcaccgaagattcacgagggatggtgggcctataaggaggtcgttcaggggtccttcgtgccggtcccatccttctggggcctggtgaactcagcgtggaacctttgctcagtcggcaagaggcagtcaccggtgaatatagaaacctctcacatgattttcgatccatttttaacaccattgcggattaacaccggtgggagaaaggtaagtggcacaatgtacaatacaggccgacatgtctccctacgcctcgataaggagcatttagtgaacatctccggcggtccgatgacctactcccacagactcgaagaaatcagactccatttcggtagcgaagactcacaagggagtgagcatctattaaatggacaagcctttagcggcgaagtgcagctgatccactacaatcatgagctgtacactaacgtaaccgaagctgcgaagtccccaaacggtctcgttgtcgtttctatcttcattaaagtttccgatagctccaatccatttctcaacaggatgctgaatagagataccataacacgcattacatacaagaacgacgcatatcttctgcagggcctgaatatagaggaactgtatcccgaaacaagtagcttcattacatatgatgggagtatgactatccctccatgctatgagactgcctcatggataatcatgaataagccagtttacatcacgcggatgcaaatgcatagcctcaggttgctttctcagaaccagccttcgcaaatcttcctgagtatgagtgataacttcaggcccgtgcaacccctaaataatcgttgtatccggaccaacattaacttttccttacagggcaaggattgcccgaacaaccgcgcacagaagcttcagtatagggtgaatgagtggctcctgaagtag

SEQ ID NO: 217018 - DNA, 987 bp, Artificial Sequence
  Description of Artificial Sequence: Synthetic coding sequence
atggagatcgtgtgggaagtgctttttctgttacaggccaactttatagtgtgtatctccgcacagcagaatagccctaaaattcatgaagggtggtgggcctacaaagaagtcgtacagggctcgttcgtgcctgttcccagcttttggggccttgtgaattctgcctggaatctctgctccgttggcaaacggcagagcccagtgaatatcgaaacctcccacatgatctttgatccattcctgaccccactaagaataaacactggagggcgtaaggtgagcggcacgatgtataatacaggccgacacgtgtctcttcggctggacaaagaacacctcgtgaatatcagtggcggtcctatgacatattcccatagactagaagagattaggttgcattttggcagtgaagattcccaggggagtgaacatctccttaatggccaagcttttagcggcgaagtgcagctgattcattacaaccatgagctatataccaatgtcaccgaggccgcaaaaagccccaacggcctagtagtggttagcatttttattaaggtgtccgattccagtaacccttttctgaaccgcatgctaaatagagatactatcacgcggataacttataaaaatgatgcgtacctccttcaagggctcaatattgaagaactttaccctgaaactagctcgttcataacctatgacggcagtatgacaattccaccctgttatgaaacagcctcctggattataatgaataagccggtctacatcacaagaatgcaaatgcattcactcagactgctgtcacagaaccagccctctcagatctttctgagtatgtccgacaactttagacccgtgcaaccccttaataatcgatgcattcgaacgaatataaatttctcactacagggcaaagattgccctaacaatcgtgctcagaagctgcagtatcgggtgaacgaatggcttctgaagtag

SEQ ID NO: 217019 - DNA, 987 bp, Artificial Sequence
  Description of Artificial Sequence: Synthetic coding sequence
atgggcgcagctgctcggctgtcagcccctcgagctctggtgctctgggccgctttaggcgcagcagcacacatcgggccagcgccagacccagaggattggtggtcatataaggacaatcttcagggtaactttgttcccggtccaccgttctggggtctggtcaatgccgcatggtcactgtgcgccgtgggcaagcgccagagccctgttgatgtggaattgaaaagagtcctgtacgacccttttctaccccctttgcggctgtctactgggggtgaaaagctgcgtgggacactgtataataccggccgtcatgtgagcttcctgcctgctcctaggccggtggtgaatgtgtccgggggaccactgctgtactcacacaggttaagtgagctgcgactgcttttcggggctcgagatggcgctggcagcgagcatcagattaaccaccagggattttcagccgaggtgcagcttatccacttcaatcaggaactgtatggcaactttagcgccgctagtcgtgggccaaacgggctggccatcctgtcactgtttgtcaatgtagctagcactagtaaccctttcctgtccaggctgctaaatagagacaccattactcggatttcctataaaaacgacgcctattttctgcaggatctgtccctcgagttgttgttccccgagagttttggattcattacatatcaagggagcctgagcactcctccatgctctgagactgtaacatggatcctaatagaccgtgccctgaacattacaagccttcaaatgcattcactgcggctcctaagtcaaaaccccccttcccaaatttttcagtcccttagtggaaactctagaccccttcaacccctggctcaccgagcgttgcgagggaacagagaccccaggcatcccgagaggcgctgtcggggtcctaactacaggctgcacgtcgacggcgttccccatggcaggtag

SEQ ID NO: 217020 - DNA, 1065 bp, Artificial Sequence
  Description of Artificial Sequence: Synthetic coding sequence
atgccgagacggtccttgcacgccgctgccgtcctgctactagtgatcctgaaggagcagccttcttcccctgcaccggttaacgggagtaaatggacttactttggccctgacggagagaactcatggtctaagaaatacccaagttgcggagggctgctgcagtcaccaatcgacctgcactccgacatactgcagtacgacgcaagtctaactcccttagaattccagggctataacctctccgccaataagcagtttttgctcacgaataatggccacagcgtcaaactcaacctccccagcgatatgcacattcaaggactgcagtcccgctattctgctacacaactgcatttgcactgggggaatcctaatgatccacatggaagtgaacacactgtgagcggccagcactttgccgctgaattgcatattgtgcattacaacagcgatttgtatccagatgcctcaaccgcatctaataagagtgagggcctggccgtcctggccgtcctgattgaaatgggctcttttaatccatcttacgataagatcttctcccacctgcaacacgtgaaatataaaggtcaggaggctttcgttccaggctttaatatcgaggaactcctgccagagaggacagcagagtactaccgataccgtggtagcttaaccacccctccttgtaaccccacagttctttggaccgtgttccgaaatcctgtccaaatctcccaggaacaattgttagcattggagacggcactatactgtacccatatggatgacccgagccctagggaaatgataaataatttcaggcaagtccagaaattcgatgaaaggttggtgtatacgtcgtttagtcaagtgcaggtgtgcactgctgctggtcttagcctcggcatcattctgagtctggctttagccggaattctcggaatctgtatcgtggttgtcgtgtcgatttggctattccggcgaaagtctataaagaagggagacaacaagggtgtgatctataaacccgcaactaagatggagacagaggctcacgcgtag

SEQ ID NO: 217021 - DNA, 1032 bp, Artificial Sequence
  Description of Artificial Sequence: Synthetic coding sequence
atgcccagaaggtctctgcatgccgctgctgtgctgctgctggtgatcctgaaggagcagccaagctcccctgcgccagtgaatggatcgaagtggacgtactttggccctgatggcgagaactcctggtccaaaaagtatcctagctgcgggggtctgctgcagagtccgattgatcttcatagcgacatactccagtacgatgccagcctcaccccgctggagtttcaggggtacaatctttctgcaaacaagcagttcctactcacaaacaacggccactcggtcaaacttaatctgccgtcagacatgcatattcaaggcctgcagtctagatactctgctactcagttacacctgcactggggcaatcccaacgacccccacggtagcgagcacacagtcagtggccagcactttgccgcagagttacacattgtgcactacaacagcgacctctacccagacgcatccactgcatctaacaagtctgagggcctggcggtgttggcagttcttatagaaatgggcagcttcaatcctagctatgacaaaattttcagccacctgcagcatgtcaaatataagggccaggaagcctttgtgccgggatttaatatcgaagaactccttcccgaacgtaccgctgaatattacagatataggggctccctcactacccctccttgtaaccccaccgttctgtggacagtctttcggaatcccgtccagatttctcaagaacagctgttagcactcgaaactgcactttactgcacacatatggatgatccgtcacctagagaaatgattaataatttccgacaggtgcagaaattcgacgaaaggttggtatacacttccttcagccaaggaataatcttaagcctggctctggctggtatactcgggatctgcatcgtggtcgtagtctcgatctggctgttcagaaggaagagcatcaaaaaaggggataacaaaggcgtgatatacaagcccgcaactaagatggaaaccgaagcgcatgcatag

SEQ ID NO: 217022 - DNA, 852 bp, Artificial Sequence
  Description of Artificial Sequence: Synthetic coding sequence
atgccaaggcgttcactgcatgccgcagccgttctgttactggtgatccttaaggaacaaccaagctctcctgcacctgtgaatggctccaaatggacttatttcgttaagctgaatcttcccagtgacatgcacatacagggtctccagtcaaggtattctgccacccagttgcatttgcactggggtaacccaaatgacccccatggaagcgaacacacagtgtctggccagcattttgccgcagagctgcacattgtgcactataacagcgacctatacccagatgcctctacagcgtccaacaagagcgagggcctagcagtgctcgcggtgctaattgaaatgggctcttttaacccaagctatgataaaatctttagtcacctgcagcatgtgaagtacaaaggacaagaggccttcgtcccaggattcaacatcgaggaattgctacccgagaggacagccgagtattatcggtataggggttccctcacaactccaccttgtaatcctactgttctctggacagtgtttaggaaccccgtgcaaatctctcaagagcaactgttggctctggagacggccttgtattgcacacatatggacgacccatccccgcgtgagatgattaacaactttaggcaggtgcagaagttcgacgagcgccttgtgtatacttctttttcgcagggtatcattctgagtcttgcgctcgccggaatcttgggaatctgcatcgtggttgtggttagcatttggctcttccgcaggaaatcaataaagaaaggagacaacaagggcgtcatttacaaaccagccactaaaatggaaaccgaagcccacgcctag

SEQ ID NO: 217023 - DNA, 1014 bp, Artificial Sequence
  Description of Artificial Sequence: Synthetic coding sequence
atgctgttcagcgctctactgctggaagtgatttggattttggcagccgatggcggacagcactggacgtacgagggccctcacggacaggaccattggccggcttcttacccggaatgcggcaataatgcacagagtccgatcgacatacagacggactctgtcacgttcgatcccgacctgccagcactgcagcctcacggctatgatcaacccggtacagaacctctggacctgcataataacggacataccgtgcagctgtcactcccttccaccctgtatctgggcggattacccagaaagtacgtagccgctcagctccacttacactgggggcagaagggatccccaggcggatcagaacaccagatcaacagcgaagcgaccttcgccgagttacacattgttcattacgatagtgactcatatgacagcctcagcgaggccgctgagaggccgcaggggttggctgtgctgggtatactaattgaggttggcgagaccaaaaacatcgcatatgaacacatcctctcacacttgcatgaggtccgacataaagatcagaaaacatctgtccccccatttaatcttagggagctgctcccgaagcaactgggtcagtattttcggtataatggttctttgactacgcccccatgctatcagtcagtcctttggacagtgttctatagaagaagccaaatttctatggagcaactagagaaactgcagggcacgctgttctcaactgaggaggagcctagcaagcttctggtccagaattacagagcactccagccgctcaatcaacggatggtgtttgcaagcttcatacaagccggatcatcctatacgacaggcgagatgctgtccctgggagttggtattcttgtcgggtgtctatgtctcttattggctgtgtattttatcgcaagaaaaatccggaagaagagattggaaaatcgcaagtccgtggtctttacctcagcgcaggctacaaccgaggcctag

SEQ ID NO: 217024 - DNA, 834 bp, Artificial Sequence
  Description of Artificial Sequence: Synthetic coding sequence
atgtctagtggtatacacgtcgcattagtcacgggcggaaacaaaggcatcggccttgctatcgtccgcgatctgtgtagactgttttccggcgatgtggtgctgactgctagagacgtgacccgtggacaagctgccgtccagcagttacaggccgaggggctgtctcccaggttccatcagctggatattgatgacttgcagtccatacgcgctctgagggatttcctgcgcaaggaatatgggggtctggacgtgctcgttaacaacgcaggtatcgctttcaaagttgccgatcctacgcctttccatattcaagctgaagtgacaatgaagactaacttctttgggactagagatgtgtgtaccgagctactcccattaataaaaccccagggcagagttgtaaatgtcagttccattatgtcagttagggctctgaaaagctgcagccctgagctgcaacagaaattccgctctgagaccatcacagaggaagaactggtcggcttaatgaacaagttcgtggaagacaccaagaagggagtacatcagaaggaaggatggccatcctcggcctacggagtgacaaagattggtgtgactgtgttgtcccggatccacgccaggaagcttagtgaacaaagaaagggcgacaaaatcctccttaatgcttgctgtcctggctgggtccgaacggacatggcaggcccaaaagctacaaagagccccgaggagggagccgagacccccgtctatttagctctgctcccacccgacgccgaggggccacatggtcagtttgtgagtgagaaaagagtagaacagtggtag

SEQ ID NO: 217025 - DNA, 834 bp, Artificial Sequence
  Description of Artificial Sequence: Synthetic coding sequence
atgtcatcttgttcgagagtcgctttagtgacaggggcaaatagaggtattgggctggccattgctagagaactttgcagacagttttcgggggatgtcgtattgacggctcgggacgtcgctcgcggacaagctgctgtgcaacaactacaagcagaaggtctgtcaccccgattccaccagctagatatagacgacctccagagtatcagagcccttcgagattttctgagaaaagaatatgggggtttgaacgtgcttgtcaacaacgcagctgtcgcattcaagtctgacgatcctatgccatttgacataaaagccgaaatgacgcttaagactaatttttttgcgacaaggaacatgtgcaacgaactattgccaatcatgaagccccatggccgtgtggtcaacatctccagcctacagtgcctgcgcgcttttgagaactgctccgaagatcttcaggagaggtttcatagtgagacccttactgaaggtgacctggtcgatctgatgaagaaatttgtggaggatacaaaaaacgaagtgcatgagcgtgagggctggcccaattcaccttatggggtgagcaagctgggcgtcaccgtgcttagtcgcattcttgcacgcagactcgacgaaaaaaggaaagctgatcggattttagttaatgcttgctgcccgggacctgtcaaaaccgatatggacgggaaggattcgattcgcaccgtcgaggagggggcagaaacccccgtctatctcgctttactacctcctgatgcgacagagccacaagggcaattggttcatgataaggtcgtgcaaaactggtag

SEQ ID NO: 217026 - DNA, 2169 bp, Artificial Sequence
  Description of Artificial Sequence: Synthetic coding sequence
atgctcacaatggggaggctacagcttgtggtcctgggacttacatgctgctgggcagtggccagtgccgcaaaactcggcgctgtgtacacggagggtggtttcgtggagggcgtgaacaaaaaactgggcttactgggcgacagcgtcgatatttttaagggaataccttttgccgcacctactaaggcgcttgagaacccccagccccaccctggctggcaggggacattgaaggctaaaaatttcaaaaagcgctgcctccaggctacaatcactcaggactccacgtatggagacgaggactgcctgtatctgaatatctgggtgcctcaaggtcgaaagcaggtgagccgcgacctcccggtgatgatttggatttacggcggagcattcctgatgggttccggccacggagctaattttttgaataattacctgtacgacggcgaggagattgccacccggggaaatgtgattgtcgtgacattcaactacagagtaggaccactgggcttcctctccaccggagatgcgaacctgcctgggaattatgggttgagggatcagcacatggctatagcttgggtcaaacggaatatagccgcttttgggggtgaccccaacaatattacattattcggtgagtctgcaggcggtgcttctgtctcactacaaacgctgagcccttataacaagggactgatacgacgtgctattagccaaagcggagtcgcgttaagtccctgggtgatccagaaaaacccacttttttgggcaaagaaggtggctgagaaggttggctgcccagtaggtgacgccgcaaggatggcccagtgcctaaaagtgacagatccacgcgctcttacactggcctacaaggtgccactggccggactggaatatccaatgctacactacgtgggcttcgtaccggtgatcgatggcgatttcatccccgcagatccaatcaatctgtatgccaacgccgctgacatcgactacatagcgggtaccaacaatatggacggccatattttcgctagcatcgatatgcccgctattaataaaggcaataaaaaggtcacagaagacttctacaagttggtgagcgaatttacaataaccaagggtctgaggggagcgaagacaacattcgatgtgtacaccgaatcatgggcacaggatccaagtcaggagaacaagaaaaagacagttgtggatttcgaaaccgacgttctcttcctggtgcctactgagattgccctcgcccaacatagggctaatgctaagtcagcaaagacgtatgcctatctcttcagtcatccttctaggatgcccgtctacccaaaatgggtcggcgcagatcacgcagatgatatacagtacgtctttggaaaaccgttcgccacaccaacgggttataggccccaggaccgaacggtgtccaaagcgatgattgcctactggacgaactttgccaagaccggggatcccaacatgggggacagtgcagtccccacgcattgggaaccatacacaaccgaaaattccggctacctggagatcactaaaaagatgggtagttctagcatgaagcggtctctgagaacaaatttcctcaggtattggactctaacttacttagcactgcccacagtgaccgatcaggaggcgacccctgtccctcccaccggtgactccgaggcaactccagtgcctccaacgggggattctgagacggctccagtgccacccaccggggactctggggcacccccagtgcctcccacgggagatagcggcgctccacccgtacctccaaccggagacagtggcgctccaccggtgcccccaactggtgattcgggggctcctcccgttccccctaccggcgatagcggtgcaccaccggtcccccctactggcgatgccggaccccctcccgttcctcctaccggtgactcgggcgctcctcccgtccctccaacaggcgactccggggcacctcccgtgacacccaccggggattccgagacagcaccagtccccccaaccggcgactcaggggcaccacctgtcccaccgaccggtgacagcgaggccgctccggtccctcccacagatgacagcaaggaggcccagatgccagcagtcatccgattttag

SEQ ID NO: 217027 - DNA, 2064 bp, Artificial Sequence
  Description of Artificial Sequence: Synthetic coding sequence
atgggtcgtctgcagctcgtagtgctgggtttaacctgctgctgggcggtggcctctgctgccaaactgggagctgtatacacagagggcggatttgtggagggggtgaataaaaagctggggctcctaggggacagcgttgatatctttaaaggcattccattcgcagctcctactaaagcgctggaaaacccccagccgcaccccggatggcagggcacgctgaaagctaaaaatttcaaaaaacgttgtttgcaggccactatcactcaagattctacttatggagatgaagattgcctgtatctcaacatttgggttccccaggggagaaaacaggtgtcacgggatctgccagtcatgatctggatttatggcggtgcatttctgatgggatccggacatggcgcaaattttctcaacaactatctctacgatggtgaagaaattgccactcgcggaaatgtcatcgtggtgacatttaattacagagttggccctctcggttttttatccactggagacgcaaacttacccggaaactatggactaagagaccagcacatggccatcgcttgggttaaacgaaatattgccgctttcggcggagaccccaacaacattactctctttggcgagtcagccggaggtgccagtgtgagtttacagacgctgtccccatataacaaaggattgattcgcagggccatatcacagtccggcgtggccctctcaccttgggttattcaaaagaacccacttttctgggccaaaaaagttgcagagaaagtgggatgtcccgtgggcgatgctgcgcgaatggcccagtgcctgaaggtgaccgaccctcgggctctgactctggcctataaggttcctctggcagggctcgagtatcccatgctccactatgtggggtttgtccctgtgattgacggtgatttcattcctgccgatccaattaatctgtacgcgaacgcagctgacatcgactacatcgccggtactaacaacatggatgggcatattttcgcgagcatagatatgccggctattaataaggggaataaaaaggtaacagaggaggatttctacaaactcgtgtccgagttcacaattaccaagggcttacgtggagccaagacgaccttcgacgtgtacacagagagttgggcccaagacccaagccaggagaataagaagaaaacagttgtagacttcgagaccgatgtgctatttctcgttccaaccgaaatcgcccttgcccagcatagggctaacgccaaggatccaaatatgggcgactctgccgtgcctacccattgggagccctacactactgaaaacagcgggtacttagagatcacaaaaaaaatggggtcttcctccatgaaaagatccttgaggaccaatttcctgaggtactggaccctaacctatctggctctgccgaccgtcacggatcaggaagccacacctgtccctcccaccggggactccgaggctacacccgtgccaccaacgggtgactctgaaacggcaccagtgccccctaccggcgactccggggcacctcctgtgccacctaccggtgacagcggggctcctcctgtgccacctacaggggactccggtgccccacccgtcccccctaccggagatagcggggctccccctgtgcctccaactggggacagtggagcgcctcccgttcctcctactggcgattctggagccccaccagtaccacctaccggggatagtggcgctcccccagtgccccctactggtgacagcggagccccacccgtgccgccaactggggacgcaggcccaccacctgtgccacccactggcgactctggagcccctccagttccaccgacaggagactcaggcgcaccacctgttactccaacaggggactctgagaccgcccctgtgccgccaactggcgattctggtgcccctcctgtgcctccgacaggagacagtgaggccgctcccgtccccccaacggacgactccaaagaagcccagatgccagcagtgattaggttctag

SEQ ID NO: 217028 - DNA, 2271 bp, Artificial Sequence
  Description of Artificial Sequence: Synthetic coding sequence
atgctgacaatggggcgtttgcagttggtggtgctgggcctgacttgttgctgggcagtagcctctgccgcaaagctcggagccgtttacaccgaagggggtttcgtcgagggtgtcaacaagaagctgggactcctgggtgacagtgtagacatatttaaggggataccgttcgccgctccaaccaaagccttggaaaacccccagcctcacccagggtggcaggggaccttgaaagctaaaaatttcaagaaaagatgcctgcaggcaactatcacccaggattccacctacggagacgaggattgtttgtacctgaacatctgggtaccacagggcaggaagcaggtcagccgagatctgcccgtgatgatctggatttacggtggggcttttctcatgggctccggccacggcgcaaactttcttaacaactatttatatgatggcgaagaaatcgcaacccggggtaatgtgatcgtcgtaaccttcaattaccgagtggggcctctgggctttttgtccactggcgacgctaatcttccagggaattacgggctgcgcgatcagcacatggccatcgcatgggtgaagaggaacattgccgcatttgggggtgatcctaataacataacactgttcggagagtcagcagggggagcctctgtgagccttcagacactctccccctataataaaggattgatcagacgggctatctcgcagtcgggagtggcactgtccccatgggtgatacagaagaaccctctgttctgggcaaaaaaggttgctgaaaaggtcggctgtccagtgggtgacgcagctcggatggcccagtgcttaaaggttacagaccctcgtgcactgactctggcctataaggtaccactggcgggactggaatatccgatgttacattacgtgggtttcgttccagtgatcgacggcgactttatcccagctgaccccatcaacctatacgctaacgcagccgacattgactatatcgcaggtaccaacaacatggacggccatatcttcgccagcattgatatgcctgctattaacaagggaaacaaaaaagtaacagaagaggatttctacaaactggttagtgagttcactatcacaaagggattgaggggcgcaaaaacgacattcgatgtgtacacagaaagctgggcacaggacccctctcaggagaataaaaaaaaaacagtggtggatttcgagacagacgtgctatttctggtacctacagagatagcccttgcacagcatcgggctaatgccaagagcgccaagacctacgcttacctgttctcgcacccctcaagaatgccagtgtatccaaagtgggtgggagccgaccacgccgacgacatccagtatgtgtttggcaaaccattcgcgacacctaccggctataggcctcaagaccggaccgtctccaaggctatgattgcttattggactaatttcgcaaagacaggcgaccccaatatgggcgattccgctgtgcccacccattgggaaccatacactaccgaaaatagtggttacctcgagattaccaaaaagatgggcagctctagtatgaaaagatctctaagaaccaactttctccgctactggactctgacgtatctcgcccttcccactgtgaccgatcaggaagcgaccccagtaccaccaacaggtgactccgaagcaacccccgtgcctcctaccggggactcggagacggcccctgtgccccctactggggattccggcgctcccccagtgccacccaccggcgattcaggggctcctcctgttccccctacaggagattccggagcaccaccagtgcccccaactggtgacagcggggctcccccagtgccacccacaggcgatagcggcgcacccccagtaccacctactggcgatagcggtgctcctccagttcccccaaccggtgatagtggtgcccctcctgttccacctacgggcgacagtggcgcaccccctgtgcctcccaccggagatgccggtcccccacccgtgcctcctaccggtgattcaggagcaccccctgtgcctcctactggagattcaggggcacccccagtgactcctactggcgatagcgaaacggcccctgtccctcctaccggagattccggcgctccacccgtgccacccaccggcgattctgaggctgctcccgtgccacccaccgatgactctaaggaggctcagatgcctgcagtgatccggttctag

SEQ ID NO: 217029 - DNA, 1707 bp, Artificial Sequence
  Description of Artificial Sequence: Synthetic coding sequence
atgtggctcagagccttcatcctggctacgctgagcgccagcgcagcctgggcgggacacccgtcctccccgccagttgttgacacggttcatggaaaggtgcttggtaagttcgtgtccctggagggcttcgcccaaccggtcgctatatttctcggaatcccgttcgcaaaacctccgctaggccctcttagatttactcccccacagcccgctgaaccttggtcgtttgtcaagaatgctacaagctaccctcccatgtgcacgcaggaccccaaagcaggccagctactctcagagctgttcacaaacagaaaggagaatatccccttaaagctctctgaagattgcttgtacctaaacatttatacacctgccgatctcaccaagaagaaccgccttccggtgatggtctggattcacggcggaggcctgatggttggagccgctagcacttacgacggcctggctctagcggctcacgaaaacgtcgtggtagtgaccatccaataccgtctcggcatctggggatttttttcaaccggcgacgagcattctcgcggaaattgggggcacttagaccaggtggccgctctccggtgggtacaagacaacatcgcatctttcggcggaaatccaggctctgtgacaatctttggcgaatcggcgggaggcgaatcagtatctgtgctggtcctttcaccactggcaaagaatttattccatagagcgatctcagagagcggcgtggcactgacatccgtgctggtcaagaagggtgatgtgaagccgctggccgagcagatcgccatcacagcagggtgcaagaccaccacatccgctgttatggtgcactgcttgcgccagaaaacagaagaagagctgcttgagaccactctgaaaatgaaattccttagtttggatctgcagggcgatcctcgtgagagccaaccattgctcgggacggttatcgatggaatgctgcttctcaaaactcccgaagagcttcaagccgagcgcaattttcacacagtcccttatatggttgggattaataagcaggagtttggatggctgatccctatgcagctgatgagctatccactgagtgaaggacagttagatcagaaaacagctatgagcctgctgtggaaaagctacccactagtgtgtatcgcaaaggaactgataccagaggcgaccgagaagtatttagggggaactgacgacaccgtcaagaagaaggacctgtttctggaccttatcgccgatgtcatgttcggcgtcccgtccgtgatagtggccagaaaccatcgggacgccggtgccccaacctacatgtacgagttccagtacaggccatcatttagctccgacatgaagccaaagacagtgatcggcgaccatggcgatgagctgttttcagttttcggggcacccttcttgaaggaaggagcttcagaagaggagattaggttaagcaaaatggtgatgaagttttgggccaactttgcccgaaatgggaatcctaatggcgaaggactgccccattggcctgagtacaatcagaaagagggttatctgcagattggcgcaaacactcaggcagcacagaaattaaaagataaagaagtcgctttctggactaatctctttgctaaaaaagccgtggagaagcctcctcagaccgagcacatcgaactatag

SEQ ID NO: 217030 - DNA, 1704 bp, Artificial Sequence
  Description of Artificial Sequence: Synthetic coding sequence
atgtggttgagagcatttattctggccactctcagtgcttctgctgcatggggccaccctagcagccccccagtggtggacacagtccatgggaaggtactcggaaaattcgtaagcctggaaggcttcgcacaaccagtcgccatctttcttggcattcctttcgccaaaccacctctcggtcctctgcggtttacccctccccagccagctgagccttggtcctttgttaaaaatgcgacgtcctatccccctatgtgtacccaagatccaaaagcgggtcagctgctcagcgaactctttaccaaccgcaaagaaaacattcctctcaagctgagcgaagattgcttgtatctgaatatctatacccctgccgacctgactaagaagaaccggctccccgtaatggtgtggatccacggtggaggactaatggtcggggcagcaagtacctacgacgggttagcactggccgctcacgaaaatgtggtcgtggtgactatccagtataggctcgggatttggggatttttcagcacaggcgacgagcattcaaggggtaactggggacatttagatcaggtggccgcactgagatgggtgcaggacaacattgcctccttcggtgggaatcccggtagtgtgacaatttttggagagtctgctggcggtgaaagcgtttccgtcctggtactcagtccccttgctaaaaacttgttccatagagctatcagcgaatccggagtagctctaacatccgtgctcgtgaagaaaggcgatgtcaaaccattagccgagcagatagctatcacggctggatgtaagacaaccacgtcagccgtaatggtccactgccttcggcaaaagacagaggaggaacttctcgaaaccacgctaaaaatgaaatttttgtccctagatctccagggcgaccctcgcgagagtcagccccttttgggaactgtcatcgatggcatgctgctgctgaagacacccgaggaactccaggcagaaaggaattttcacaccgttccctacatggtgggaattaataagcaggaatttgggtggctgatccccatgcaactgatgtcataccctttgtctgagggacagctcgaccagaagacagctatgtctctcctgtggaagagttatccactggtgtgcatagctaaagagctcatccccgaggccaccgagaaatacctggggggaaccgacgataccgttaaaaagaaagacttgttcctggacctgatagcagatgtgatgtttggagtcccatctgtcatagtggctagaaatcacagagacgccggtgcgcctacttatatgtatgaatttcaataccgcccaagcttcagctcagacatgaaacccaaaacagtcattggcgatcatggggacgagctttttagcgtgttcggagcgccttttcttaaagaaggagcttccgaagaggagatcaggttgagtaagatggtaatgaagttctgggcaaacttcgccaggaacggcaacccgaacggagagggcctgccccattggcctgagtataatcagaaggagggctatctgcagataggggcaaacacacaggctgctcagaaacttaaggataaggaggtggcattctggactaacttgttcgccaaaaaggccgtcgaaaaaccaccccagacggagcacattgaactttag

SEQ ID NO: 217031 - DNA, 1701 bp, Artificial Sequence
  Description of Artificial Sequence: Synthetic coding sequence
atgtggttaagagccttcatcctagcaactttgtcagcctctgctgcctgggggcacccttcctccccaccggttgtggacacggttcatggaaaggtcctggggaagtttgtgtcgctggagggattcgcccaacctgtggcaatttttctcggaatccccttcgcgaagcctcctctcggtccactgcgctttacaccaccacagcctgcagagccatggtcgttcgtaaagaacgcaaccagctatccccctatgtgtacccaggacccaaaagcgggacagctgctttcggaactgtttacaaataggaaggaaaacatccccctaaaactctccgaggattgtctgtacttgaatatctacacacctgcggacctgacaaagaaaaaccgtctgcccgtaatggtgtggattcatgggggtggactgatggttggagctgcatcaacatacgatggactggcactggctgctcacgaaaatgtcgtggttgtgacaatccaatacaggctgggtatttgggggttttttagtaccggggatgagcactccaggggcaactggggacatcttgaccaagtggccgcactccgctgggtgcaggataacatagcatcctttggaggcaacccgggaagcgtaacaatttttggagagagcgcaggcggagagagtgtgtccgtcctcgtgctgtccccgcttgccaaaaacctgtttcaccgcgctatttctgagtctggagtggcccttacatcagtcttagtgaagaaaggagacgtgaaaccacttgctgagcagatcgccatcaccgccggttgcaagacgaccacgtcagcagttatggtccactgcctcaggcagaagaccgaagaagaacttctcgagaccacattgaagatgaaatttttgtccttggacttacagggtgacccacgggagagccaacctctgctcgggaccgtgattgacgggatgttgttgttaaagacaccagaggagctccaggcggagaggaacttccacactgtaccatatatggtcggtatcaacaagcaggagttcggatggttgattcctatgctgatgtcgtatcctctgagtgaaggccagctagatcaaaagactgcaatgtcgctcctgtggaaatcttatcctttagtctgcatagcgaaagagctcatcccagaggcgactgagaaatacctgggcggaacagacgatactgtgaagaaaaaggatctctttctggaccttatagctgatgtgatgtttggtgtaccctccgtaatagttgctcggaatcacagggatgccggagcacctacatacatgtacgagtttcagtatcggccatcttttagctcagacatgaaaccgaagactgtcatcggcgaccatggggatgaactgttctctgtcttcggcgcaccctttctgaaggaaggcgcatccgaggaagaaatccggctgtccaagatggtgatgaaattctgggcgaactttgccaggaacggaaatccaaacggcgagggactcccacactggcctgaatacaatcagaaggagggatatcttcagattggagccaatactcaagccgcacagaagctgaaagataaagaagtagcattttggaccaacttgtttgcaaagaaagccgtagagaagccaccccagaccgaacatatcgaattatag

SEQ ID NO: 217032 - DNA, 1299 bp, Artificial Sequence
  Description of Artificial Sequence: Synthetic coding sequence
atggtttggattcatgggggagggctgatggttggcgcagcctctacatatgacggcctcgctttggctgcacatgagaacgtggtcgtcgtcacaattcagtatcgactgggcatctggggatttttctctacaggagatgagcactcccgcggaaattggggccatctagaccaggtcgcggctctgaggtgggtccaggataacatcgccagtttcgggggaaaccccggatctgtcacaatcttcggagagagcgcaggaggggaaagtgtgagcgtcctggtgctgagcccgctcgcgaagaacttgttccatcgcgcaatctctgagagcggcgttgcccttacctccgttctggtgaaaaaaggcgatgtgaagccgctcgccgaacagattgctatcactgcgggatgcaaaaccactacctctgcggttatggtacactgtctccgccagaaaactgaggaggaactacttgaaacaacactgaagatgaaattcctgagcttggacttgcagggcgacccaagggaatcacagccactgctggggacggtgattgatggaatgttgctactcaaaaccccagaagagttgcaagccgagcgcaactttcacacagtgccatacatggttgggatcaacaagcaggagttcgggtggctgatcccaatgcagctcatgagctacccgctatccgagggccagctcgaccaaaagacagcaatgtccctcctgtggaaaagctatccactcgtttgtatcgccaaggaactcatccctgaagccactgagaaataccttggaggaaccgacgacacagttaaaaaaaaagatttgttcttggaccttattgcagatgtaatgtttggagtcccatccgttattgtggcgagaaaccaccgcgacgcaggagccccaacctacatgtacgaattccaatacaggccttctttcagcagcgacatgaagccaaaaacagttattggcgaccacggcgacgagctgttcagtgtgttcggcgcaccttttctcaaggagggagcatctgaggaggaaatccggttgagcaagatggtcatgaagttttgggccaactttgctagaaatggaaatcctaatggcgaggggctgccgcactggccagagtacaatcagaaggaaggttatcttcagattggtgctaatacgcaggccgctcagaaactgaaagacaaggaagtggctttctggactaaccttttcgccaagaaagccgtggaaaagccacctcagaccgagcacatagagctttag

SEQ ID NO: 217033 - DNA, 1716 bp, Artificial Sequence
  Description of Artificial Sequence: Synthetic coding sequence
atggaacgcgctgtgagagtggagagcggtgtgctcgtcggtgtcgtatgcctgctgttggcgtgcccagccacggcaaccggtcctgaagttgcccaaccggaggtggatactaccctgggaagagtgaggggtagacaagttggcgtgaaggggacagatcgactagtaaatgtatttctggggatcccttttgcacagcccccactgggtcccgatcgtttcagcgcccctcatccagcccagccgtgggagggggtgcgggatgcgtcaactgcgcctccgatgtgtttgcaggatgtggagtccatgaacagcagtcggtttgtactgaacggtaaacagcagatcttttccgtctctgaggactgcctcgtattgaacgtgtacagcccggcagaggtccccgctggcagcggaagacctgttatggtttgggtgcatggaggcgcactgattaccggcgcagcaaccagctacgatgggagcgccctcgccgcttacggcgatgtggtggtcgtgaccgtccagtatcgtctgggtgttctcgggttttttagcacaggggatgagcatgcaccaggcaaccaagggtttctggatgtggttgcagctctccgctgggtacaggagaatattgccccatttgggggagatctgaattgtgtgaccgtgttcggtggcagcgccggtggtagtattatctccgggttggttttgtcacctgtggctgcagggctctttcatcgggctattactcagtctggcgtgattaccacgcccggaattattgactcccacccttggcctctcgcccagaagatagccaatacacttgcctgctcctccagcagcccggcagaaatggtgcagtgcctacaacagaaggagggggaggagttggtgttatccaaaaagttgaaaaacactatttatcctctgacagtagatggcactgtgttcccgaaatccccgaaggagcttctgaaagagaagcctttccattccgtgccgtttctcatgggcgtgaacaatcacgaattctcttggttgattccacgcggttgggggttactggacactatggagcagatgagcagggaggacatgctggccatatccacaccagtcctgacatccctggatgtcccacccgagatgatgccaactgtgattgacgaatatctggggagcaatagcgacgcccaggccaagtgccaagcttttcaggagtttatgggagatgtgttcattaacgtcccaacggtgagtttctccaggtatctccgggatagtggcagtcccgtgtttttttacgaatttcagcatcggccatcatccttcgctaagattaagccagcctgggtgaaggccgatcatggagcagagggtgccttcgtcttcggcggtcccttccttatggatgaaagtagccgcctcgcgttccctgaggccaccgaagaggagaagcagctgtccctcacaatgatggcacagtggacccatttcgcgcgaaccggcgaccccaatagcaaggcactccccccatggccacagtttaatcaggccgaacaatacctcgagattaaccccgtgccgcgtgccggacagaaattccgagaggcctggatgcagttctggagtgaaactcttccgagcaagatccagcagtggcaccagaagcagaagaatcggaaggctcaggaggatttgtag

SEQ ID NO: 217034 - DNA, 633 bp, Artificial Sequence
  Description of Artificial Sequence: Synthetic coding sequence
atggaacagatgagcagggaagatatgctagccatctcaacgcctgtgctgacatcgctggacgtgccccctgagatgatgccaacagtgattgatgaatatctgggctcgaactctgatgcccaagccaaatgtcaagccttccaggagtttatgggggacgtgttcattaacgtcccaactgtgtccttctctaggtacctgcgggacagtgggtcgcccgttttcttttacgagtttcaacatcgaccatcatccttcgccaagattaagcccgcatgggtgaaggccgaccatggagctgagggggctttcgtgttcggtggcccttttctaatggatgagtcttcccgccttgctttccccgaggccactgaggaggagaagcagttgtcactgactatgatggcacagtggactcactttgcccgtacaggtgacccaaactcaaaggcccttccaccgtggccccagttcaaccaggccgaacagtatctggagataaatccagtgcctagggctgggcagaaattccgggaggcttggatgcaattctggtctgagaccctcccctcaaagatacagcaatggcaccagaagcaaaagaaccggaaggcccaggaggatctctag

SEQ ID NO: 217035 - DNA, 1707 bp, Artificial Sequence
  Description of Artificial Sequence: Synthetic coding sequence
atggaacgcgcagttagagtggagtcgggggtgctggtcggagtcgtctgtctcctgctcgcctgtcccgctactgccacgggcccagaagtcgcccagccggaagtagacactacccttgggcgagtgcgcggtcgccaagtgggagttaagggaaccgatcgactggtcaacgtatttttggggatcccctttgctcagccccctctgggcccagatcgcttcagcgccccacaccccgcacaaccgtgggagggcgtccgcgacgcgtcaactgctccgccaatgtgtcttcaggacgtagagtcaatgaatagctccagattcgtccttaacggcaagcagcagatcttctcggtcagcgaggattgccttgtgttaaatgtgtacagtcccgctgaagtcccggctgggagcggcagacccgtgatggtctgggtccacgggggagctttgatcaccggcgctgctacatcctatgacggctctgccctggcggcatacggcgatgtggtggtagtcactgttcagtatcggctgggtgtgctgggatttttctccacgggggacgagcacgcccctggcaatcagggatttctcgacgttgtcgccgcattgaggtgggtccaggagaatattgctccgttcggaggcgatttgaattgtgtcacagtgtttggaggctctgccggaggttcaattatttcaggcctcgttcttagccccgtagctgccggtctcttccaccgagccatcacgcagtcaggggtgattaccacccccggtatcatagactctcacccatggcctctcgcacagaagatcgctaacactttagcatgcagttcttcttcccccgcagagatggtccagtgtcttcaacagaaggaaggcgaagaactcgtgttgtccaagaagctgaagaacacaatataccccctcactgtcgacggaaccgtgttccccaaaagcccaaaagaattacttaaagaaaagccctttcattccgtgccctttctgatgggcgttaacaatcacgaattttcttggcttatccctagaggctgggggctgctagatacaatggagcagatgagccgagaggacatgctggccatcagcacgcccgtcctcaccagtctggatgtgcctccggagatgatgccaaccgtgatcgacgagtacctgggctcgaattctgatgcgcaggccaagtgtcaggcatttcaggagtttatgggagacgttttcattaacgttccaactgtctccttctcacgctatctacgcgatagcgggagtcccgtgttcttttacgaatttcagcacaggccttctagttttgctaagattaaacccgcttgggtgaaggccgatcacggagctgagggggcttttgtctttgggggtccatttctaatggacgaaagctccaggctcgaggccacagaagaagagaagcaactcagcctgactatgatggcccagtggacccattttgccagaaccggggacccaaattccaaagccttgcccccatggccacagtttaaccaggctgaacaatacttagaaatcaaccccgtgccaagagcagggcagaaattccgagaggcatggatgcaattctggagcgagaccctgccttccaagatccagcagtggcaccagaagcagaagaacagaaaggcacaggaggacctttag

SEQ ID NO: 217036 - DNA, 738 bp, Artificial Sequence
  Description of Artificial Sequence: Synthetic coding sequence
atggctaatgaggcctatccgtgcccttgcgacatcggtcaccgactggagtacggtgggctcggccgagaggtgcaggttgagcatattaaagcatacgtcactaagtcacctgtcgatgcaggcaaagcggtgattgtcatccaggatatctttggctggcaactgccgaacacacggtacattgctgacatgatcagcgggaatggttataccactattgtaccagatttttttgtcgggcaggaaccatgggacccaagcggcgattggtcaatatttccagaatggctgaaaactagaaacgctcagaaaatcgatagggaaatcagcgccatactgaaatacctgaaacagcagtgtcatgcgcagaagatcggcatcgtgggattctgctggggcggaactgctgttcaccatctgatgatgaaatattccgagtttcgagccggagtttccgtgtacggaatcgtgaaagattccgaagatatctacaacctgaaaaatccaacgttattcatattcgctgagaacgacgtcgtgatccctctaaaggacgtctctctcttaacccagaaattaaaggaacactgcaaggtggagtatcagatcaagaccttctccggacagacgcacggattcgttcatcggaagcgggaagattgctctcctgccgacaagccatatatcgatgaggctagacgtaatctgattgagtggctgaacaaatacatgtag

SEQ ID NO: 217037 - DNA, 1260 bp, Artificial Sequence
  Description of Artificial Sequence: Synthetic coding sequence
atgagaggactgcttgtcctgtcagtgttgctaggcgcagtgtttggaaaagaagattttgtaggccatcaggtccttcgcatctccgtggcagacgaagcccaggtgcagaaagttaaggagctcgaggatcttgagcacttgcaattagatttctggcggggacccgctcatccgggaagccccatcgacgttcgggtcccatttccaagtattcaggcggtgaaaatctttctggaaagccacggaatctcctacgaaacgatgattgaggatgtccagtcgctgttggatgaagagcaagaacaaatgttcgccttcaggagccgagcacgctcaacagacacttttaactacgctacttatcataccctcgaagagatatacgatttcctagacctattagttgcggaaaatccccacttggtgtcaaaaattcagattggaaacacttacgaaggcagacccatttacgtccttaaattttcgactggaggctcgaaacggcctgcaatttggattgatacaggtatccactcgagggaatgggtgactcaggcttctggcgtgtggttcgccaagaaaatcacccaggactacgggcaggatgcagctttcacagccatactcgacactctggatatctttctggagatagttactaatcccgacgggtttgcattcactcattccaccaacaggatgtggagaaaaacaagatctcataccgcgggtagcttgtgtatcggcgtcgacccaaatcgaaactgggatgctggatttgggctgtcaggtgccagctctaatccttgctccgaaacttatcatggcaagtttgccaactcagaggttgaggtaaagagtatagtggacttcgtgaaggatcatggtaatattaaagcctttatctcgatccattcttactcccagctgcttatgtacccctacggctacaagaccgaacccgtgccggaccaagacgaactggatcagctttccaaggctgcagtgacagccctagcaagcttgtacggcaccaagtttaattatgggtccattattaaggctatttaccaggccagtggatccacaatcgactggacctatagtcagggcattaaatacagctttacattcgagctcagggatactgggaggtatgggttcctcctccccgcttcccagattatcccgacagcgaaagagacttggcttgctttacttaccattatggagcacacccttaatcacccatactag

SEQ ID NO: 217038 - DNA, 1098 bp, Artificial Sequence
  Description of Artificial Sequence: Synthetic coding sequence
atggaccgggcagccctgctgggcttagcacgcctgtgtgccctgtgggcagccttgcttgtgttgttcccttatggagcacagggaaattggatgtggctggggatcgcctcattcggagttcccgagaagctgggatgcgccaaccttcctctgaattcgcggcagaaggaactctgtaaacggaagccctatcttctcccctccatcagagagggagctaggctagggatacaggaatgcgggtctcagttccgccatgagcgatggaactgcatgattacagcggctgcgacgactgctcccatgggtgcgtctcctcttttcggttatgaattgtccagcggcaccaaggaaactgccttcatttacgcagtcatggcagctggactggtgcactcagttacccgcagttgctccgcgggtaatatgaccgagtgtagctgcgacaccactctgcaaaatggcggttcagcttctgaaggctggcattggggtggatgctcggatgacgtgcaatatggcatgtggtttagccgtaagttcctggatttccccatcgggaataccaccggtaaggagaacaaggtgctgcttgccatgaacctccacaataatgaggccggacggcaggcagtagctaagcttatgtcggtcgattgcaggtgtcacggggtgtctggctcttgtgctgtaaaaacctgttggaaaaccatgagctctttcgaaaagatcggacatcttctcaaggacaagtatgagaattcaatccagatctcagataaaaccaagagaaaaatgagacggcgagaaaaggaccaacgcaagatccctattcacaaagacgatttactgtacgtgaacaaatccccgaactattgcgtggaggataagaagctcggaattcctggcacccagggcagagagtgcaaccgcacatcagaaggcgctgatggatgtaatctgctttgttgtggtcgcggatacaatacacatgtggtacgacatgtagagagatgcgaatgcaaatttatttggtgctgttacgttcgctgtagacgatgtgagtccatgaccgacgtgcacacctgtaagtag

SEQ ID NO: 217039 - DNA, 1254 bp, Artificial Sequence
  Description of Artificial Sequence: Synthetic coding sequence
atgaggcttattctgccagtaggccttatcgctaccacactagccatcgcgcctgttcggtttgacagggagaaagtgttcagggttaagcctcaggatgaaaagcaggcagatatcattaaggacctggcgaaaactaacgaacttgatttttggtaccctggggctacccatcacgttgccgcaaacatgatggtggactttcgagtgtctgaaaaagaatctcaagccattcagtcagctttggatcagaacaagatgcattacgagattctgatccatgatctgcaggaagaaatagaaaaacagttcgacgtcaaggaggacattcccggacggcacagttacgccaagtataacaattgggaaaagatcgtggcctggactgagaagatgatggataaatatcctgagatggtctccagaattaagataggctctacagtggaggacaaccccctgtatgtacttaagataggagagaagaatgagcgtcggaaagcgatcttcacagattgcggcatccacgcgagagagtgggtgtcccccgcattctgtcagtggttcgtgtatcaggctacaaaaacctacgggaggaacaagatcatgaccaaattactggaccgaatgaatttctatattctcccagtgttcaacgtggacggatacatctggagctggacgaagaacaggatgtggaggaagaatagaagcaagaatcaaaattccaagtgtatcggaactgacctgaataggaactttaacgcatcctggaatagcatccctaacactaatgacccatgcgccgacaactatcgaggatccgcgccagagtctgagaaagaaaccaaggcggtgacaaactttatcaggagccatctcaacgagatcaaggtctacatcacattccactcctatagccagatgttgttgttcccttacggctacacttcaaaactgcccccaaaccacgaggacctggccaaagtcgccaagatcggaactgacgtcctgagcacccgatacgaaactaggtacatctatgggccaattgaatcaacaatttaccctatttccgggagttctctggattgggcttacgacttgggcatcaaacacacgtttgctttcgaattgagggacaagggcaagttcggttttctgttgcctgaaagtaggataaaacctacatgtcgggaaacgatgctggctgttaaattcattgccaagtatatactcaagcacacgtcatag

SEQ ID NO: 217040 - DNA, 1260 bp, Artificial Sequence
  Description of Artificial Sequence: Synthetic coding sequence
atggctatgcgactgatccttttcttcggggctctgttcggtcacatctactgcctggaaaccttcgtcggcgatcaggttctggagattgtgccgagcaatgaggaacaaatcaaaaacctgctgcagctcgaggcgcaggaacatctccagctcgatttctggaaaagccccacaaccccaggagaaacggcccatgtgagggtaccgtttgtcaacgtgcaagccgtgaaggttttcctggagtcccagggaattgcgtacagtatcatgatcgaagatgtgcaggttctgctggataaggaaaacgaggagatgctcttcaataggagacgcgagaggtcaggtaatttcaacttcggagcctatcatacgctggaggaaatatctcaggagatggataacctggtggcggagcaccctggcctggtgtctaaggtgaatataggtagtagcttcgaaaaccgcccaatgaacgttctgaaattcagtactgggggagataagccagccatatggctggacgcgggtatacacgccagagaatgggttacacaagcaactgcactgtggaccgctaacaagatagtgtcagactatggtaaggaccccagtataaccagcatcctcgacgctttggatatttttctgctccccgtgaccaatcccgacgggtatgtcttctcgcagaccaaaaacaggatgtggaggaaaacgagatctaaggtttcaggctccctttgcgtgggagtagacccaaaccgtaattgggatgcagggtttggtggacccggtgccagctcaaatccttgctctgactcttaccacgggccatctgccaacagtgaagttgaagtgaaaagcatagtcgatttcattaagtcacacgggaaggtgaaagcctttattacccttcactcctactctcagcttctcatgtttccctacggttacaagtgcaccaagctggacgatttcgatgaactctctgaggtcgcccagaaggccgcacagtcgcttagatcgctacacggaacaaaatataaggtcggcccaatatgctccgtgatctatcaggccagcggtggtagcattgactggtcctatgattatggaattaagtactcttttgcttttgagttgagggacacaggtagatacggcttcctacttccagcacgccagattctgccgacagctgaagagacttggctaggactgaaggctattatggaacacgtgagggaccacccttattag

SEQ ID NO: 217041 - DNA, 1167 bp, Artificial Sequence
  Description of Artificial Sequence: Synthetic coding sequence
atgcgctggatactgttcattggggctctaataggatcgtctatctgtggtcaggagaagttttttggggatcaggtacttagaatcaacgtcagaaatggtgacgagatatctaagcttagccagctcgttaatagcaataatctgaaattaaatttctggaaatcaccttcttcttttaatagaccggtcgatgtgttggtgccctcggtgtcactgcaagccttcaagtcatttctccggtctcagggattagagtatgccgtaactatcgaggacctgcagatttatcatgagatggataacattgcggcagacttcccagatctggcccgtcgggtcaaaataggccactctttcgagaatagacccatgtatgtgcttaagtttagcaccggtaagggcgtccgccgtcccgcagtctggcttaatgccggaatccactcgagagaatggattagccaggccaccgcgatctggactgctcgaaagatcgtgtcagattatcagcgagacccggcaatcacctcaatccttgagaagatggacatatttttgctgccagttgccaatcctgacggctatgtttacacacagactcagaaccgcttatggagaaaaacacgcagcaggaatccgggtagttcctgtataggcgcagaccccaaccgtaactggaacgcctcctttgctgggaaaggggcaagcgacaacccatgctccgaggtgtatcatggtccacacgcaaactctgaagttgaggtgaaatccgtcgtggactttatccaaaaacatggtaattttaaagggttcattgatttacattcgtattcccaactattgatgtacccctatggatacagtgttaagaaagcacctgatgctgaggagctggataaagtggccaggctggcagccaaggccctggcgagcgtatccggaaccgaataccaggttggcccaacttgcaccacagtgtaccctgcttcaggcagttcaattgactgggcatacgataacggcatcaaattcgccttcacatttgagcttcgcgacactggcacctatggttttctgctcccagcaaaccagatcatcccaacggccgaagagacatggctgggcctgaagaccatcatggagcatgtacgcgacaacttatattag

SEQ ID NO: 217042 - DNA, 681 bp, Artificial Sequence
  Description of Artificial Sequence: Synthetic coding sequence
atgaagattgtgtctgactatcagcgggatcccgcaataactagcatcctggaaaaaatggacatttttctcctgccagtggctaaccccgatgggtacgtatacacacagactcagaatcgtctgtggcgtaagacccgttcccgcaatccagggtcatcatgcatcggcgcagacccaaacagaaactggaacgcttcgtttgctggcaagggggcatccgataacccttgttctgaggtgtatcatggcccacatgctaacagcgaagtagaggtgaagagtgtggtggacttcatccaaaaacatgggaattttaagggcttcattgatcttcatagctattcacagctcctaatgtatccctacggatatagtgtgaagaaagctccagacgccgaagaactggataaagtggcccgattggcagcaaaggcactcgcctccgtctctgggacggaataccaggtgggccctacctgtaccactgtgtatccggcttccggcagctccatcgactgggcgtatgataatggcataaagtttgcgtttacattcgagctgcgagacaccggaacatatggcttcctgctccccgcaaaccagattattcctactgccgaagagacttggctcgggttgaaaactataatggaacatgtgagggataatttgtattag

SEQ ID NO: 217043 - DNA, 582 bp, Artificial Sequence
  Description of Artificial Sequence: Synthetic coding sequence
atgcatcatcttaataagacccacagtggactgatccatatgttttcgatagggaggtcatatgagggacgcagcttatttatcctgaagctcgggaggcgctccaggctgaagcgcgcagtgtggatcgactgcggcatccatgcaagagagtggataggacctgcattttgccagtggtttgtcaaggaggctctgttgacatataagtcagatcccgctatgaggaagatgcttaaccatctgtatttttatattatgccggtgtttaacgtcgacgggtaccacttctcctggaccaacgatagattttggagaaaaactcggtcaaggaattccaggttccgctgccgcggagtggacgccaaccgtaactggaaagtcaagtggtgtgacgtatcctcggggagttccatggattgggcctacaaaaacgggattccttacgccttcgcattcgaactgagggacaccggatatttcgggttcctcctaccagagatgctgattaagcctacttgcacagagactatgttggcagtcaaaaatatcactatgcacctcttgaagaagtgcccctag

SEQ ID NO: 217044 - DNA, 1314 bp, Artificial Sequence
  Description of Artificial Sequence: Synthetic coding sequence
atgaagtgtcttggaaaaagaagaggccaggccgcagcctttttgcctctgtgctggctgtttttgaagatcctgcaaccaggtcactcacatctctataacaaccgttacgcaggtgacaaggttatcagattcattccaaaaacagaagaggaggcctatgcgctcaagaagatttcgtaccaattaaaggtagacctatggcagccgtccagcatcagctacgtcagcgagggcaccgtcaccgacgttcacataccacagaacggatcgcgcgctcttctggcctttcttcaggaagccaatattcagtataaggtgcttatagaggacctccagaagacactagaaaagggtagttctttgcacacacagaggaaccgaaggtctctgtctggatacaactatgaggtgtaccacagcctggaagagattcagaattggatgcaccacttaaataaaacacattccggattaatacatatgttttcgatcggcaggagctacgaaggcagaagtcttttcattctgaagctcgggagacggtcaaggctcaagagagcagtgtggatcgattgtggcatacacgcccgagagtggattgggccagccttttgtcagtggttcgtgaaagaagccctccttacttataaatctgatccggctatgcggaagatgcttaaccatctgtatttttacatcatgcctgtgtttaacgttgatggataccacttcagctggaccaatgacagattctggcgcaaaacccgcagcaggaacagcaggttccggtgtcgcggtgtggatgctaacagaaattggaaggtgaaatggtgtgacgagggagcctccatgcatccatgcgacgatacatactgtgggccattccctgaatccgaaccagaggtgaaggccgtggccaatttcttacgtaagcataggaagcacataagggcttatctcagcttccacgcctatgcccagatgttgctgtacccgtactcatataaatacgctaccatcccaaacttcagatgtgtggagagcgcagcttataaagcagtaaacgctctgcaaagtgtatatggcgtgcggtaccgctacggacctgctagtacgacgctttatgtcagctctggctcctctatggactgggcctataagaatgggatcccctacgccttcgccttcgagctgagagacaccggctactttggattcctactgccagaaatgttgatcaaacctacctgcaccgagactatgctggccgtaaagaatattactatgcatctgttgaagaaatgcccttag

SEQ ID NO: 217045 - DNA, 948 bp, Artificial Sequence
  Description of Artificial Sequence: Synthetic coding sequence
atgaagtgcctcgggaagaggagaggacaggcggcagcgtttctgcccctctgctggctcttcctcaaaatcctccaacccggacatagtcatttatacaacaaccgctatgcaggtgacaaggttatccggttcattccaaaaacagaagaagaagcctacgcgctgaagaagataagctaccagctcaaagttgacctgtggcagccaagctctatctcgtatgtgtcggagggcacggtgaccgacgtccacatcccacaaaatgggagtagggcacttctggcgtttcttcaggaagccaatattcagtataaggtgctcattgaggacctgcagaagactttagagaaaggcagctccctccacacccaaaggaaccgccgtagtctgagtggctataactacgaggtgtatcacagtttggaagagatccaaaattggatgcatcatttaaataagacacatagcggactaatccatatgttctcgattggcagatcatatgagggcagaagcttgttcatacttaaactcggtaggcgcagcaggcttaagagagcagtgtggatcgactgtggtatccatgcccgtgaatggattggaccagcattttgtcagtggttcgtgaaagaagcccttcttacatacaagtccgacccggctatgagaaagatgctaaatcacttgtatttttacatcatgccagtctttaacgtcgatggctatcacttctcctggaccaatgaccggttttggcgtaagactcggagcaggaattctcggttccgctgccgtggcgtggacgcaaatcggaactggaaggtcaaatggtgtggaaaattcggaacaaactgggatcccgaccccaaggtaagtgccggattcaccctccagaacatgagtcccgaagatagccatggccgactgatgttcttttgtatgtag

SEQ ID NO: 217046 - DNA, 1272 bp, Artificial Sequence
  Description of Artificial Sequence: Synthetic coding sequence
atgaagctctgctccctggccgtccttgtccccatcgtcttgttctgtgagcaacatgtgtttgcatttcagtctggccaggttttagccgcactgccaagaacctccaggcaggtccaagtgcttcaaaatctgacaacgacttacgagattgtcctgtggcaaccagtgacagccgacctcattgtgaaaaaaaagcaggtacatttctttgtgaatgccagcgacgttgataacgtcaaagcgcatctaaacgtgagcggaatcccatgcagtgtcctcctggctgacgtagaggatctcatccagcaacagattagcaacgatacggtgagcccaagggccagcgcctcatattacgaacaataccacagcctgaatgagatttacagttggatcgagtttatcacagagagacacccagacatgctgacaaagatccacatcggatcaagtttcgaaaaataccccctctatgtgctgaaagtctccggcaaggaacaggctgcaaagaacgcgatctggattgactgcggaattcatgctagggagtggatctcaccggctttctgtctgtggtttattgggcatattacgcaattctacgggatcatcgggcagtacaccaacttactgaggcttgtcgacttttacgtcatgccagtggtgaatgtggatggctacgactatagctggaaaaagaaccggatgtggagaaagaaccggtccttttacgccaataatcattgtatcggaactgacctaaatagaaactttgctagcaaacactggtgcgaagagggcgcttcttctagcagttgctctgaaacgtactgtggactttatcccgagagcgaaccggaggtgaaggctgtggcaagttttcttcggagaaatattaaccagattaaggcttacatctcaatgcattcatacagtcagcacatcgttttcccctatagctatactcgtagcaaaagtaaggatcatgaagagttgtcactggtggcttctgaggccgttagagccattgagaaaatatcaaaaaacaccaggtacactcacggccacggctccgagactctgtacctggctcccggaggcggagatgattggatctatgatctcggcataaagtattccttcacaatcgaattgcgggatacagggacatatgggtttctcctgccagaacggtacatcaaacccacctgtcgggaggcgttcgccgcagtgtccaaaattgcctggcacgttatccggaacgtgtag

SEQ ID NO: 217047 - DNA, 1083 bp, Artificial Sequence
  Description of Artificial Sequence: Synthetic coding sequence
atgaaactgtgctctctcgcagtgctcgtccccatcgtgctgttctgcgaacaacacgtgttcgctttccagagcgggcaagtgctggccgctttgccacgcacctcaaggcaggttcaggttctgcagaatctcacaacaacgtacgaaatcgtgctctggcagccagttacagcagatctaattgtgaagaaaaaacaagtgcattttttcgtgaatgcaagcgacgttgacaatgtgaaggcgcacctaaatgtgagtggaatcccttgttccgtgctattggctgatgtcgaggacctcattcaacaacagatctccaacgacacagttagccctcgggctagcgccagttactacgaacagtaccacagtctgaacgagatttattcttggatcgagtttattaccgaacggcatcccgacatgttaaccaagatccatatagggagctcgttcgagaaataccctctatatgttctgaaggttagcgggaaggagcaggccgcaaaaaatgccatatggatcgattgtggcattcatgctcgcgagtggatatctccggcattttgtctctggtttattggacacaatcgaatgtggcggaagaacagatcgttctatgccaataaccattgcatcggaaccgatcttaatcgcaacttcgctagcaaacattggtgcgaagagggcgcatcctcttcaagctgttccgagacgtattgtggactgtatccggaatctgagccagaagtgaaagctgtggctagcttcttacgcaggaacatcaaccagatcaaggcctatatatctatgcactcgtatagccagcacattgtgtttccttactcatatactcgatccaaatctaaagaccatgaggaactgtcacttgtggctagtgaagccgttagagctatcgagaagatttctaagaatactaggtatacccatgggcacggaagtgaaacactgtacctggctcccggaggcggagacgactggatctatgacctggggataaaatactccgtcacctccaatccacctgtggagaagctcttgcctctgtccctcaagtag

SEQ ID NO: 217048 - DNA, 849 bp, Artificial Sequence
  Description of Artificial Sequence: Synthetic coding sequence
atgttgccccttctgcggtgcgtgcctagagtgctaggctcttccgtggctggcctgcgggcagctgctccggcttctccattccgccagctccttcagccagctcctcggctatgtacccgccctttcggcctactttctgtacgggcaggttcagaaaggcgacccggactgcttcggcctaggggaccctgcgcctgcggctgtggctgtggatcattacataccgatggcgacaaggccttcgtcgattttcttagtgatgagatcaaggaggagcggaagatccaaaagcacaagaccttgccaaagatgtctggtggatgggagctggagttgaatggaaccgaggccaaactggtgcggaaagtggcaggagagaaaatcactgtaacctttaatatcaacaatagcattccacccacttttgatggtgaggaagaaccatcccaggggcaaaaggtagaagaacaggagcccgagctgactagtactcctaactttgtggtcgaggtgattaaaaacgatgatggaaagaaggctctcgtgttagactgccattatccagaagatgaagtcggacaggaggatgaagctgaatctgacatcttcagcattcgtgaagtgtcattccaaagcacgggcgaatctgagtggaaagacactaactatacgctgaacacagactcactggattgggccttgtacgaccatctgatggacttcctggctgatcgaggggtggataacacgttcgctgacgaacttgtggaactcagcacagctttagagcatcaggagtacatcaccttcctcgaggacttaaaatcatttgttaagtctcaatag

SEQ ID NO: 217049 - DNA, 3402 bp, Artificial Sequence
  Description of Artificial Sequence: Synthetic coding sequence
atgcgctttgtgctcagcggcaatcttcatggtggatcagttgtggcctcttaccccttcgatgattcccccgagcacaaggctacggggatatattccaaaacatccgacgacgaggtgttcaaatacttagcaaaggcgtacgcaagcaatcaccctatcatgaagactggcgaaccgcactgccccggagacgaggacgagacatttaaggacgggatcacgaacggggctcattggtacgacgttgaaggagggatgcaggattacaactacgtctgggctaattgctttgagattacacttgaactcagctgctgcaagtaccctccagcttctcagcttagacaggaatgggaaaacaacagggagtcacttatcacactgatcgagaaagtgcacatcggagtcaagggatttgtgaaagacagcatcaccggctccggtctggagaacgccacgatttctgtggcaggaatcaatcacaatatcacaacaggacgttttggggacttctatagactgctggtccccggtacttataacctcaccgttgtgcttaccggttatatgcctctgacagtgacaaatgttgttgtgaaagagggacccgcaactgaggttgactttagtttacgccctactgtgacttcagtgatcccagatactactgaagctgtgtctaccgcttctacagtggcaattcctaacatcttaagtggaacaagcagtagctatcagccaattcagccgaaagatttccaccaccatcattttcctgatatggaaatctttctgaggcgcttcgccaatgagtatcccaacattacccgcttgtacagcctcggcaagtcagtggagtcccgcgaattatacgttatggagatcagcgacaacccaggcgtgcatgaacccggtgagccggaattcaagtatataggcaatatgcacgggaacgaggtggtagggagggagctcctgttaaatctcatcgaatatttatgtaaaaattttggcaccgatccagaggtcacagacttggtgcataataccaggattcatcttatgccatccatgaatccggacggctacgagaagtctcaggagggagacagcattagcgtcatcggtcggaataactctaacaactttgatctgaaccgcaattttcccgatcagttcgtccagatcacagaccccacccagccagagaccatcgccgtgatgtcatggatgaagtcatacccctttgttttgtctgcaaacctgcacgggggttctttggtggtgaactacccttttgacgatgatgagcagggccttgctacctactctaaatcccccgacgatgccgtcttccagcagatcgctctgagttatagtaaagaaaattcccaaatgtttcagggaagaccatgcaaaaacatgtatcctaacgagtacttccctcacggtattacaaacggcgcatcctggtataatgtgcctggcggtatgcaagattggaattacctccaaacgaactgttttgaagtgactatcgaactggggtgcgttaagtaccctctggaaaaggagctcccgaacttttgggagcagaacaggcggtctctcatccagttcatgaaacaagtgcaccagggagtccgcggttttgttctggacgcaactgacgggcgaggcattctcaatgccactattagcgtggctgaaataaaccaccccgttactacctataaaactggcgactattggcgactcttggttcctgggacttataagataaccgcatcagcaaggggctacaatccggttaccaagaatgtcactgtaaagagcgaaggcgcaatccaggtcaactttaccctggtgagaagttcaacagactcaaataacgagtcaaagaaagggaagggcgcatctagcagcacaaacgacgcttcagatcccacaactaaggagttcgagactctgattaaagatttgtcggccgagaacggtttggagtccttaatgctgcgcagctcaagcaacctagcattggctctataccgataccattcctacaaggacttgtcagagtttctgagaggtttggtgatgaactaccctcacataaccaacctaaccaaccttggccagtccactgagtacaggcacatatggtcactggagatctctaacaaacccaatgtgtcagaacctgaggagcccaagatacggtttgtcgcaggaattcacggcaatgcgcctgtgggtacggagctcctgttggcactggccgaattcctgtgcctgaactacaagaagaacccagctgtcactcagctggttgaccggacccgtatcgttatcgtaccttccttgaatcctgacgggcgtgaaagagcgcaggaaaaggattgtaccagcaagatcgggcagacaaacgccagagggaaggacctggacaccgacttcacgaacaacgcatcccagcctgagacaaaggccatcatagagaacctgattcaaaagcaggattttagcttgtcagtcgccctggatggcggaagcatgctagtgacatatccctatgacaaacctgttcaaactgtagaaaataaggaaacattgaaacacttggcgagcctgtatgcaaacaatcacccatctatgcatatgggtcagccttcttgccccaataaaagcgacgagaatatccctggaggagtgatgaggggagcagaatggcactctcacctgggcagtatgaaggactattctgttacatacggccactgtccagagattactgtttatacatcatgttgctatttcccatctgctgctcggttgcccagcttgtgggctgataataaacgctcactgttaagtatgttggttgaagtccacaaaggggtccacggtttcgttaaggataagaccggtaagcccattagtaaggccgtcatcgtgctgaatgagggtataaaagtgcagaccaaggagggcggatacttccacgtgcttctggcaccaggcgtgcacaatataatcgccatcgcagacggctatcagcagcagcattctcaggtattcgtccatcacgatgccgctagctcagtggttattgtgttcgatacagacaacagaatattcgggctgccacgagagctggttgtgactgtcagcggggctaccatgtcagcccttattctcacagcctgcatcatctggtgcatctgtagtatcaagagcaacagacataaggatggtttccatcgactgagacagcatcacgacgagtacgaagacgaaatccgaatgatgtcgaccggtagcaaaaagtccctgctttcccacgagttccaggatgaaaccgacaccgaagaagagaccctctacagtagcaagcactag

SEQ ID NO: 217050 - DNA, 1149 bp, Artificial Sequence
  Description of Artificial Sequence: Synthetic coding sequence
atgagaaggcggaggcggctgcagcaagaggacggcatcagcttcgaatatcaccgctatcctgaactcagagaggcccttgtttcagtctggctccagtgcactgcaatatcaaggatttatactgttggacgaagtttcgagggccgagaacttctggtgatagagctttcagacaaccccggagtgcatgagcctggggagccagagtttaagtatattggtaacatgcacgggaatgaagctgtgggccgtgagctccttattttcctggctcaatacctttgtaacgagtatcagaagggcaacgaaactatcgtgaacctgattcactccacgagaatccatataatgccttctctgaaccctgatggtttcgaaaaagctgcgagccagcccggagagcttaaagattggttcgtggggaggtccaacgcacagggaattgacctgaataggaactttccagatttagacagaattgtgtacgttaatgaaaaagaggggggacccaataatcacctgctgaagaatatgaagaagattgtggaccagaacacaaagctggcacctgagactaaagcggtgatccattggataatggacatccctttcgttctttcagccaatctgcacggcggtgatcttgtcgctaattacccttatgacgaaacaagatctggatctgcccacgaatactcctctagcccggatgatgcaatcttccagtcactggcacgggcttattcctccttcaacccggcaatgtcagacccaaaccgaccgccttgccgtaagaacgacgacgattcatctttcgtcgacggcaccacgaatggcggagcatggtacagcgtgcccggaggtatgcaagactttaactaccttagtagcaattgttttgagatcaccgtggagctttcatgcgagaaattccctccagaagaaaccctcaagacctattgggaggacaataagaatagcctgatatcgtacctggaacagattcataggggggtgaaagggttcgtccgcgacttacaaggaaatcctatcgccaatgcaacaatctctgtcgagggaatagatcacgacgtcaccagtgcgaaagatggggattactggcgcctattaacgtggaaactgtag

SEQ ID NO: 217051 - DNA, 1431 bp, Artificial Sequence
  Description of Artificial Sequence: Synthetic coding sequence
atggcaggccgaggaggatccgctctgctggctttgtgtggcgctctcgcagcctgtgggtggctcctcggagctgaagcccaggagccaggagcgcctgccgctggaatgagacgtaggaggcggctacagcaggaggacggtatctccttcgaataccatagataccccgaactgagagaggctttagtgagtgtgtggcttcagtgtacagccattagccgaatctacaccgtgggcaggtctttcgaggggcgtgagctgttggtcatcgaacttagcgacaacccaggcgtgcacgaacctggggagccggaatttaagtacatcgggaatatgcatggcaacgaggccgtcggtagagaactgctgatcttcctcgcgcagtacctgtgcaatgaataccagaaggggaacgaaactatcgtgaacctcattcattccacacgtatccacattatgccgagcctcaatccagacggatttgaaaaagctgcgtcgcagcccggagagttgaaagattggttcgtcggcaggtccaacgctcagggtattgatctgaacaggaatttcccagatctcgatcgaatagtctacgtgaacgagaaggaaggtggaccaaacaatcaccttctgaaaaacatgaagaaaattgtggaccagaacactaaattggccccagagacaaaagccgtgatccattggatcatggacattcccttcgtgcttagcgctaatctgcatggaggagacttagttgccaattacccctacgatgagactcggtccgggtcggcgcatgagtatagttcttcaccagacgacgccatttttcaatctctggccagagcctatagcagtttcaaccctgcgatgagcgacccaaacagacccccatgtcggaagaatgatgacgatagctcttttgtggacggcaccactaatggcggagcatggtattcagtgcctggaggtatgcaggacttcaactatctctcttcgaactgtttcgaaatcactgtggaattgagttgtgaaaagttcccacccgaagagaccctcaagacctattgggaggacaataagaattctttgatttcctatttggagcagattcatcgcggagtcaagggcttcgtgagggatctgcaggggaaccctattgctaatgcgacaatcagtgtggagggtatcgaccacgatgtcacatccgccaaggatggtgattactggcgtctactcattcccggtaattataagcttacggcctctgcccctggatacctcgctattacgaagaaggtggccgtcccatactccccggctgccggagtcgactttgaacttgagtcattctctgaacgcaaggaggaggaaaaagaggagctcatggagtggtggaagatgatgtctgagacattgaacttctag

SEQ ID NO: 217052 - DNA, 1332 bp, Artificial Sequence
  Description of Artificial Sequence: Synthetic coding sequence
atggatttcccttgtctctggctggggctgctgcttcccctggttgccgctcttgattttaattatcaccgccaggagggaatggaggccttcctcaagaccgttgcacagaactatagctcagtgacgcacctgcattccatagggaaatctgtgaaggggcgaaatctttgggtgttggtcgttgggagattccccaaggagcaccgaattggaattcctgagttcaaatatgtggctaatatgcatggggacgaaactgtgggtagagagctgttgttgcacctgatcgactacctggtgacaagtgacggtaaagatcccgaaattactaacttaataaatagcactagaatccacattatgccaagcatgaatcctgacggtttcgaggcagtaaaaaagcccgactgttattattctatagggagggagaactataatcagtatgatctcaaccgcaattttcctgatgcctttgagtacaataatgtctcccggcaacctgaaacagtggctgtgatgaaatggctaaagacggagacattcgtcctgtccgctaatctgcacggcggagcgctggtcgccagctaccctttcgataatggagtccaagccacaggcgctctgtactcccggagcttgacccccgatgacgacgtattccagtacctcgcccacacctacgcttcccgaaatccgaacatgaaaaaaggcgatgagtgcaaaaacaagatgaattttcccaatggcgtaactaacggctattcctggtatccacttcagggcggaatgcaggattataactatatctgggcccaatgttttgaaatcacactggagctgtcgtgttgtaagtaccccagagaagagaagctgccaagcttttggaacaacaacaaggccagtcttattgaatacattaaacaggtgcaccttggagtgaagggccaagtcttcgatcagaacggaaacccactccccaatgtcatcgtcgaagtccaagacagaaaacacatctgtccctataggacaaacaaatatggagaatactacctcctcctgctcccagggagttacatcataaacgttacggtacccggacatgatccccacatcactaaagtcattataccagaaaagtctcaaaacttctccgccctcaagaaagacatcctgctcccttttcagggacagttggattccatccccgtgagcaacccatcctgccctatgatccccctctatcggaacctgcctgatcatagcgccgctaccaaaccttctctgtttctgttcctcgtgtctctgcttcacattttcttcaaatag

SEQ ID NO: 217053 - DNA, 1332 bp, Artificial Sequence
  Description of Artificial Sequence: Synthetic coding sequence
atggatttcccttgcctctggctaggtttactgttgcctcttgtcgccgctctcgacttcaattatcacaggcaggaggggatggaggctttcctgaagaccgttgctcagaattacagcagcgtaacacatctgcacagtataggcaagtccgttaagggtcgcaacctgtgggtgctggtggtgggccgtttccccaaggagcaccgcatcgggatcccagagttcaaatatgtcgcaaacatgcatggagatgaaactgtaggtagagagcttctcctccatctaatcgactatttggtcacctccgacggaaaggatcccgagataaccaatttaattaatagcaccaggatccatatcatgccaagcatgaatccggacggttttgaggctgtgaaaaagccggattgctactacagtataggtcgagaaaactataaccagtacgatctgaatagaaatttcccagacgcattcgagtataacaacgttagtaggcaaccagagaccgtggccgttatgaaatggttgaaaaccgaaacctttgtgctgtctgcaaacctgcacggtggagcattagtggcctcttaccctttcgataatggggtacaggccacaggggcactctattcacgatctctgacgcccgacgatgatgttttccagtacctcgctcacacttatgcctccaggaaccctaatatgaaaaaaggagatgagtgcaaaaataagatgaacttcccaaatggggtgacaaatggttatagctggtaccctctgcagggagggatgcaggactacaattatatttgggcgcagtgcttcgagattacgctggagctgtcctgttgtaagtatccgagagaggaaaaactgccatccttttggaataacaacaaggcctctctcatagaatatatcaaacaggttcaccttggcgttaagggtcaagtgttcgatcagaatggaaaccccctgcccaatgtgattgtggaggtgcaggaccggaagcacatatgcccttaccggacgaataaatatggcgagtattacctgctcttacttcccggtagttacatcataaacgtgaccgtgcctggacacgatccccatataactaaggtgattatcccagaaaagagtcagaatttcagcgcactcaaaaaggatatcctcctgcccttccagggacagctggattcgatccccgtctctaacccctcttgtcccatgattccgctgtatcgcaatctgcctgaccattccgctgcaacaaagccttctctctttctgtttttggtgtcccttctccatatatttttcaaatag

SEQ ID NO: 217054 - DNA, 1332 bp, Artificial Sequence
  Description of Artificial Sequence: Synthetic coding sequence
atggacttcccctgtctatggctcggactgctacttccgctggtcgctgcattggactttaattatcaccgccaggaggggatggaagctttcctgaaaacagtggctcagaattactccagcgtgacgcacctgcattcaattggcaagtccgttaagggacggaacctgtgggtactcgtggtgggcagattcccaaaggagcaccgcatcggtatacctgaatttaagtacgtagcaaatatgcatggcgatgagacagtagggagagaactgttgctgcatctgatcgactatctcgtgacctccgatggaaaggaccccgagattacaaacctaatcaactccactcggatccatatcatgcccagcatgaaccctgacggcttcgaagctgtcaagaaaccagactgctattacagcataggaagagaaaactacaatcagtatgaccttaacaggaacttccccgatgcatttgaatacaacaacgtatctagacagcctgaaaccgtcgccgtcatgaagtggctgaagacagagacttttgtgcttagcgccaatttacacggcggagccttagtcgcttcctatcccttcgacaacggcgtccaggcaaccggagcgctttactcccgcagtctgacaccggacgatgacgttttccagtacctggcccatacatatgcgtcgcgtaacccaaacatgaagaaaggcgatgagtgcaaaaataaaatgaattttccaaacggtgttaccaatggttatagttggtatcccctgcagggaggtatgcaggattacaattacatttgggcccagtgctttgaaatcacattggagctgtcatgttgtaaataccctagggaagaaaaactccctagtttttggaacaacaataaagcatccttaattgagtatatcaagcaggtacacctcggtgtgaagggacaggtgtttgatcaaaacggcaacccgctacccaacgtgatcgtcgaggtccaagacagaaagcacatctgcccgtatcggactaataagtatggggagtattatctgctgctgctcccaggtagttacatcattaacgtcacggtaccaggtcatgacccccatataaccaaggtaattatccccgaaaagagccagaatttcagcgccctcaaaaaagatatcttgcttccttttcagggccaactagatagcatccctgttagtaatccatcatgcccaatgatccccctgtatcgaaaccttcccgatcactcagcagccaccaaaccgtcactgtttctgttcctggtgtccctgctacacatcttctttaaatag

SEQ ID NO: 217055 - DNA, 411 bp, Artificial Sequence
  Description of Artificial Sequence: Synthetic coding sequence
atggactttccttgtctctggctgggcctcttgcttcccctcgtggccgcactggactttaattaccaccggcaggaggggatggaagccttcctgaaaactgtggctcagaactacagcagcgtgacccacctgcattctataggaaagtcagtgaagggcagaaacctatgggttctggtggtcgggaggtttccaaaggagcacaggattggtatccccgaatttaagtacgtcgcgaacatgcatggcgacgagaccgttggcagagagcttcttctacatctgatcgactacctagtgacgtctgatgggaaagatccagagataaccaatctgataaacagcacccgcatccatattatgccctccatgaaccccgatggattcgaagccgtcaagaaaccctag

SEQ ID NO: 217056 - DNA, 750 bp, Artificial Sequence
  Description of Artificial Sequence: Synthetic coding sequence
atggacttcccttgcttatggctgggcttactgctgcccctcgtggcggctctggactttaactaccatcggcaagaaggtatggaagctttcctgaaaacggttgctcagaattatagcagcgttactcacttacactctatcgggaaatctgtgaagggcaggaatctgtgggtgctagtggtgggcagattccccaaggagcaccgaatcggaattcccgagttcaagtacgtggcaaacatgcatggggatgagacagtgggcagagagctgcttttgcacctgatagattacctggtaaccagcgacggaaaagacccagagatcaccaacctcatcaacagcacaaggattcacatcatgccgagtatgaaccctgacggctttgaagctgtgaagaagcccgactgttattactctattggccgagaaaattacaaccaatacgatctcaacagaaacttccccgatgctttcgagtataacaacgtgtccaggcaaccagagacggtagccgttatgaaatggctcaaaacggagacgttcgttctttccgcaaatctccacgggggtgcactcgtggccagttacccatttgacaatggtgtacaagctactggagccctgtattccaggagtctgacaccagatgacgacgtattccaatacctagcacatacatacgcttccagaaaccctaatatgaagaagggggatgagtgtaaaaataaaatgaactttccctag

SEQ ID NO: 217057 - DNA, 1332 bp, Artificial Sequence
  Description of Artificial Sequence: Synthetic coding sequence
atggacttcccatgtctgtggttagggttgctgctgcctctcgtcgctgctctggacttcaactaccataggcaggaagggatggaggcttttctcaaaacagtcgcccaaaactattcaagcgttactcacctccatagcatcggaaagtccgttaaaggacggaatctgtgggtacttgttgtcggaaggttcccaaaggagcatcgcatcggcatccccgagtttaagtatgtcgctaatatgcacggtgacgagaccgtcgggagagagttgctgctgcatctcatcgattatctggtgacgtcggatgggaaagacccagaaatcaccaacctgattaatagcacccgaatccacattatgcccagcatgaacccggacggtttcgaggcagtgaaaaagcccgattgctactattccatcggaagggaaaattacaatcaatacgacttaaaccgtaattttccagacgcctttgaatataacaacgtgtcaaggcagcccgaaacggtggcggtcatgaagtggctcaagactgagacctttgtcctcagcgcaaatctgcacggcggagcccttgttgcctcctacccattcgacaatggggtccaggccactggagccctttattctcgatctctaacacccgacgacgatgtcttccaatatctcgctcatacatatgccagtcgaaacccaaacatgaagaaaggtgatgagtgcaagaataaaatgaactttcccaacggagtgacaaatggctacagctggtaccccctccagggtggcatgcaggattacaattatatctgggcccagtgtttcgaaatcaccttagaactcagctgctgtaagtaccccagggaagaaaaactgccctcgttttggaacaataacaaggccagcctcatagaatacatcaaacaggtacacctgggtgttaagggacaggtgttcgaccaaaatggcaacccactgccaaatgtgatcgttgaggtacaggaccgtaaacatatttgcccttaccgaaccaataaatatggcgagtattatctactgcttcttcctggtagctatattatcaacgtaactgtgcccggtcacgacccacatataaccaaagtgattattcctgagaagagtcagaacttctcagccctgaagaaagatatcctcttgcccttccaggggcagctagattctattcccgtaagcaaccctagctgcccaatgatccctctgtataggaacctaccggaccactccgccgcaacgaagccctcgctgttcctctttcttgtctcactgctgcacattttctttaagtag

SEQ ID NO: 217058 - DNA, 1377 bp, Artificial Sequence
  Description of Artificial Sequence: Synthetic coding sequence
atgagtgatttattgagtgtgtttttacatcttctgttgctctttaagttggttgctcccgtgacctttagacaccatcgatacgacgacctagtgcgtacactctataaggttcaaaatgagtgtccaggaatcacccgcgtctattccattggaaggagcgtcgaaggtaggcatttgtatgttctcgaattctccgatcaccctggcattcatgaacccctggagcctgaggtcaaatatgtgggcaacatgcacggaaacgaggccctcggtagagaactgatgctccagctgagcgagttcctctgcgaagaattccgaaacagaaatcagcggatcgtgcaactgatacaggatacacggatccatattttgccgagtatgaatcccgacggctatgaggtggccgctgcgcagggcccaaacaagcccggttacttggttggcagaaataacgccaacggcgttgacctgaacaggaactttcccgatctcaatacctacatttattacaacgagaagtacggaggtcccaaccaccacctaccccttcccgacaactggaagtcccaagtcgagcctgaaaccagggctgttatccgatggatgcactcattcaatttcgttctgtccgctaatctgcatggtggagctgtagtcgctaactatccctacgataaaagcttcgagcatagagtgaggggtgtcagacgcacagccagtacacccaccccagacgacaaactattccagaagttggccaaagtgtactcatacgcccatgggtggatgttccaggggtggaactgtggagattatttcccagacggaatcaccaatggggcttcctggtattccctgtccaaaggcatgcaggacttcaactacctccatactaattgttttgagatcacactcgagctttcctgtgacaagttcccgcctgaggaagagctgcagagagagtggcttggcaacagggaagcactgatccagttcctggagcaggtgcaccaggggataaaaggtatggtgctggacgagaattataacaatctggcaaacgctgtaatttcagtttccggcatcaatcatgacgtgaccagtggcgaccatggcgattatttcagattgcttctgcctggtatctataccgtgtcagccaccgccccaggctacgacccggagacagtgacagtcacagttggccctgcagagcccacactcgtcaacttccacctaaagaggtctattccacaagtgtctcctgtgcgcagggctccctcacggagacacggtgttcgcgctaaagttcagccacaagctcggaagaaggagatggagatgcgtcagctacagcggggaccagcatag

SEQ ID NO: 217059 - DNA, 615 bp, Artificial Sequence
  Description of Artificial Sequence: Synthetic coding sequence
atgcactcattcaacttcgtgttgtcagccaatttacacggaggtgcagtcgtagccaactacccatatgataaaagttttgagcaccgagttcgcggtgttcgcagaactgcatcaacacctactcccgacgataagttattccagaaattagccaaagtgtacagctacgctcacggatggatgtttcaagggtggaattgcggggactatttccccgacggaatcacgaatggggcttcctggtactccctgtcaaaaggaatgcaggattttaactacctccacacaaattgttttgaaataacactggaattatcctgtgacaagtttccgccagaggaggagctacagcgagagtggttgggcaatagggaggcgctaatccagtttttggagcaggtacaccaaggcattaaaggtatggtgctggacgagaattataacaatctcgccaatgcggtaatctctgtgtcaggaataaatcatgacgtcactagtggcgaccacggagactatttccgcctacttctgccaggaatatatacggtgtcagccacagccccaggttatgatcccgagacggtgaccgttactgttggtccagctgagtag

SEQ ID NO: 217060 - DNA, 1638 bp, Artificial Sequence
  Description of Artificial Sequence: Synthetic coding sequence
atgctccccggagcatggctgctctggacgtctctgctgctgctggcgaggcccgcacagccgtgtccaatgggctgcgattgcttcgtgcaggaagtcttttgttctgacgaggaattggctaccgtgccacttgacatcccaccctacacaaaaaatatcattttcgtagaaacatcctttacgacgctagagacgagagccttcgggtccaaccccaatctgacgaaagtggtattcctgaacacacaattgtgccagtttcgtccggacgcgtttggcggtctgcctaggttggaggatctggaggttaccggctcaagttttctgaacctttccaccaacattttcagtaaccttactagcctagggaaactgaccttgaactttaatatgctggaggccttacctgagggcctgttccagcatctcgccgcactggagtcccttcatctgcaggggaaccagctccaggctcttccgagaaggctgtttcagcccctgacacaccttaaaaccctcaacctggcacaaaatctgctcgcccagctgcctgaggaattgttccaccccctgacaagccttcagacactcaaactctctaataatgctctgtcaggactgccacagggagtttttggaaaactaggtagcttgcaggagctctttctggatagtaataacatcagcgagttaccgccacaggtcttcagtcagctcttttgtctggagagactttggctacagcgaaatgctattactcatcttcccttgtcaattttcgcctccctcggcaatcttaccttcctgtccctgcaatggaatatgctcagggtacttccggcaggactgtttgctcacaccccttgccttgtgggattgtctcttacgcataatcaactggaaacagtggcagaagggacattcgcccatctaagtaacctgcggagtttaatgctgtcctataatgcaattacccatcttcccgctgggatattccgggatctagaggagctggtgaaactctacctgggtagcaataacctaacagctctccatcctgccctgtttcagaacctttcgaaactcgaactgttaagcctcagcaagaatcagttaacaactctgcctgagggcatcttcgatacaaattataatctcttcaacctggcacttcatggcaacccgtggcagtgcgactgtcacctcgcgtacctattcaattggcttcaacagtacacagatagactgctgaacatccagacatattgcgctggaccagcttacctgaaaggtcaggtggtgcccgcactaaatgaaaagcagctggtctgtcctgttacgagggaccatctgggttttcaggtgacgtggcccgacgaatcaaaagctggcggttcatgggaccttgcggtccaagagagggccgctcggtcacagtgtacctatagcaacccagaggggacagttgtgttagcctgcgatcaggcccagtgccggtggttaaatgtccaattaagccctcagcagggctcactgggactgcagtacaacgcctcccaagagtgggacctcagatcctcttgtggatccttgcgactgactgtaagcattgaagccagagccgcaggaccttag

SEQ ID NO: 217061 - DNA, 1638 bp, Artificial Sequence
  Description of Artificial Sequence: Synthetic coding sequence
atgcttcccggagcatggttattgtggacctccctgcttctcctggccaggccagctcagccatgtccaatgggttgcgattgctttgtgcaggaagtcttttgttccgatgaagagcttgccacagtacccctggacatccctccgtacactaagaatatcatattcgtggaaacgtcctttaccacccttgaaacacgggcattcggctcaaaccctaacctgacaaaggtggttttcctgaacactcagttatgtcagtttaggcctgacgccttcggcggtctgcctcgcctcgaagatctcgaggttacgggatcaagctttcttaatctgagcacgaacatcttttctaatctgacatccctgggtaagctaaccctgaatttcaatatgctggaggctcttcccgagggactgttccaacatctggccgctctcgaatcactacacctgcaaggcaaccagttgcaggctctaccacgtcggttgttccagcctctcacccacttgaagactctgaatctggctcagaacctgctggcacaactgcccgaggaattgttccaccctctcacgtctctgcagactctgaagctgtccaacaatgcattaagcggtctaccccagggtgtctttggcaagctgggcagcctgcaagaactgtttcttgactcaaacaatatttcagaacttcctccacaggtcttttcccagctgttctgcctggaacggctgtggcttcagaggaacgctattacccacctgccgctgtccatcttcgcttcactgggcaatctgacctttctgagcctccagtggaatatgctacgcgttctcccagccggactgtttgcacataccccgtgtctggttggccttagcttaacacataaccagctggagactgtggctgagggcacatttgctcatctgtccaacctgcgatctttgatgctctcgtacaacgccatcactcacctgccggctggcatatttcgggacctggaagaacttgtgaagctctatctcggctcaaacaacctgaccgccttgcaccccgcactctttcagaacctgtctaaactcgagctgcttagcctgagtaaaaatcagttgaccaccctgcctgagggcatctttgacaccaattacaatctgttcaacctggctctccatggcaatccctggcagtgtgattgccacctggcatacctgttcaactggctgcaacaatatacagatcgtttactgaacatccagacatactgcgctggccctgcctacctcaagggacaagtagtgccagcactgaacgaaaagcaattagtgtgtcctgtgactcgcgaccatcttggttttcaggtcacatggcccgacgaatccaaagcaggtggaagctgggacctagcagtgcaggaaagagccgctcgctctcagtgtacctatagtaatcccgaagggaccgtggttctggcgtgtgatcaggcccagtgcaggtggctgaacgtccaactctccccccaacagggtagcttaggactgcagtataacgcaagccaagagtgggaccttagaagctcctgtgggagtctgcgtttgacagtctccatcgaggcgagagccgctggaccttag

SEQ ID NO: 217062 - DNA, 1431 bp, Artificial Sequence
  Description of Artificial Sequence: Synthetic coding sequence
atggtaggcgctatgtggaaagtgatcgtgagtctggtcctcctgatgccaggcccatgtgacggcttatttagatctctttatcggtctgttagcatgcccccaaagggagattctggccagcctctgttcctgaccccttacattgaggccggtaagatccagaagggccgtgaactcagtttggtgggaccctttcccggtctgaacatgaagagctacgcgggatttctgaccgtgaataagacttacaatagcaatctgtttttctggttttttcccgcacagattcagccagaggacgctcccgtggtcctctggctacaagggggaccaggcggatctagtatgttcggccttttcgttgagcacggaccgtacgtcgtgaccagcaacatgacactccgggaccgagactttccttggaccactacgctctccatgctgtacattgacaaccctgttggcacgggcttttcatttactgacgacacccacggctacgctgtaaacgaggatgacgtagccagagacctgtactctgctttgatccagttctttcaaatctttcctgagtataagaataatgatttttatgtaaccggcgaatcctatgcgggtaaatacgtgcccgcaatcgcacatctaatccactccctgaatcctgtacgcgaggtgaagatcaacctgaacggaatcgcaattggggacggatacagtgatcccgagtccattataggcggttacgccgagttcttgtaccagatcggcctgctcgacgaaaagcagaagaaatactttcagaagcagtgccacgaatgcatcgagcacattcgaaagcaaaattggtttgaggccttcgaaatcctggataagttgctggacggtgacttaactagtgacccaagctattttcagaacgtgactggttgctccaactactataacttcttgcggtgcacggagcccgaggatcagctgtattacgtcaaatttcttagtcttcctgaagtgagacaggcaattcatgttggaaaccaaacgttcaatgacggaactattgtcgagaaatacttaagagaggataccgtgcaaagcgtgaaaccttggcttacagaaataatgaacaattacaaagttcttatttacaacggacagctggacatcatcgtggccgcagctctgacagagcgcagcctgatggggatggactggaaggggagtcaggagtataagaaggctgagaaaaaagtctggaaaatctttaagtccgatagtgaggtcgcgggttatatcagacaagcaggggattttcatcaggtgatcattcgtggaggtggtcacatcctcccctacgatcaaccgttacgagcgttcgacatgatcaacagattcatttacggcaagggctgggatccttacgtggggtag

SEQ ID NO: 217063 - DNA, 1431 bp, Artificial Sequence
  Description of Artificial Sequence: Synthetic coding sequence
atggttggagccatgtggaaagtcatcgtgtctttggtgctgctgatgccagggccatgtgatggacttttcaggtcactctatcggagcgtctccatgccacctaagggtgattcggggcagcctttgttcctaactccatacatcgaggctgggaagatccagaaagggagggagctctctttagtggggccttttccaggactgaatatgaaatcatatgccggattcttgaccgtgaacaaaacttataattccaatctatttttttggttcttcccggcacagatacaacctgaagacgcacctgtcgttttgtggctgcagggcggtccaggaggctcttctatgttcggtctctttgtggagcacgggccatacgtcgtcactagcaacatgacgcttagagaccgcgatttcccatggactactactttgtctatgctgtacattgataatcccgtgggcactggtttcagttttacagatgacactcacggctatgcggtcaacgaagacgatgtcgcgagagacctatactcagccttaatccagttctttcagatcttccccgagtataagaacaacgatttctatgtgaccggcgaaagttacgccggaaagtacgtacccgctatcgcccatctaatccactccctgaacccagtgcgggaggtgaaaatcaaccttaatggaatcgctataggagatggttattcagaccccgagagcattataggcggatatgccgaatttctttatcagatcggactccttgatgagaagcaaaaaaagtacttccagaagcagtgtcacgaatgcatagaacacattaggaagcagaattggtttgaggccttcgagattctggacaagttattggatggggacctgacttctgacccgtcctactttcagaacgtaactggctgctccaactactacaattttctgaggtgtaccgaaccggaggatcagctgtattatgttaagtttctttcgctccccgaagtgagacaggccatccacgtggggaaccagacttttaacgacggcaccattgtcgagaagtatcttagagaggacacagtacagagtgtgaaaccttggctgaccgaaatcatgaacaactataaggttctgatatacaacggacaactagatatcattgttgccgctgcactgaccgagcgcagcctgatgggcatggattggaagggatcgcaggagtacaaaaaagccgaaaagaaggtatggaagatttttaagtccgacagtgaggttgcagggtacatccgccaggccggagatttccaccaggttatcatccggggtggcggtcacattctcccgtacgatcagcctctgcgcgcttttgatatgattaacaggttcatctatggaaaaggctgggatccgtacgtgggatag

SEQ ID NO: 217064 - DNA, 1431 bp, Artificial Sequence
  Description of Artificial Sequence: Synthetic coding sequence
atggtaggcgctatgtggaaggtcatagtgtctctcgttctgctgatgccgggaccatgcgatggactatttcggtctctgtataggtcagtgtcgatgccaccaaagggcgactctgggcagcccctgtttctaacaccatatattgaagcagggaagatacagaaaggacgagaactcagcctcgtcggaccgtttccgggtctgaacatgaaatcttatgccggatttctgacagttaataaaacctataatagcaatctctttttctggttcttcccggctcaaatccagcctgaggacgctcccgtggtcctttggttgcaaggaggccctggcggaagtagcatgtttggactcttcgttgagcacggaccgtacgtggtcactagcaacatgacccttagggacagggatttcccatggacaaccaccctctccatgctctatattgacaaccctgttgggaccggcttttcatttaccgacgatacccatggctacgcggtgaacgaagatgacgtggccagggacttgtacagcgcccttatccagttctttcagatcttccccgaatacaaaaacaatgacttttacgttacaggggaaagttatgccggaaagtacgttcctgccattgcacacctcatccactctcttaacccagttcgtgaggtgaaaattaacctaaatggaatcgcgataggggacgggtactcagatcctgagagtatcatcgggggatacgctgagttcctgtaccaaatcggtctgctggatgagaaacaaaagaagtattttcagaaacaatgtcatgagtgcattgaacatatccgcaaacagaattggttcgaggcctttgaaatcctagataaactactcgatggggacctgaccagtgatcccagttacttccaaaatgtgaccggatgcagtaactactataatttccttcggtgtacagaacctgaagaccagttgtattacgtgaagttcctgtcgttacccgaggtgaggcaggccattcacgtgggcaaccaaacatttaatgacgggactatagtagagaagtaccttcgtgaagacaccgttcagtccgtaaaaccgtggctgacagaaatcatgaataactataaggtgctgatctacaatggccagctcgacataatcgtggcagccgcactcacggagagatcactgatgggaatggattggaaagggagtcaggaatacaaaaaggccgagaagaaggtgtggaaaatatttaaaagcgattcagaagttgctggctatattcggcaagccggagactttcatcaggttataatccgaggaggtggacacatcctgccttatgatcagccactgcgggcattcgacatgatcaaccgctttatatacggcaagggttgggacccgtacgtcgggtag

SEQ ID NO: 217065 - DNA, 21 bp, Artificial Sequence
  Description of Artificial Sequence: Synthetic coding sequence
atggtcggtgccatgtggtag

SEQ ID NO: 217066 - DNA, 159 bp, Artificial Sequence
  Description of Artificial Sequence: Synthetic coding sequence
atggttggcgctatgtggaaagtgattgtatcccttgtactgcttatgcctggcccatgcgatggcctctttaggtcactgtaccgctcagtcagcatgcccccaaaaggggattcaggtcaacctctgtttcttactccctatatcgaagctggatag

SEQ ID NO: 217067 - DNA, 132 bp, Artificial Sequence
  Description of Artificial Sequence: Synthetic coding sequence
atggtgggcgcaatgtggaaggtgatagtcagcctggtgttgctgatgcccggaccatgcgatggattgttcagatccctgtacaggtctgtgagcatgccacccaaaggcgattctggtcagccgctgtag

SEQ ID NO: 217068 - DNA, 699 bp, Artificial Sequence
  Description of Artificial Sequence: Synthetic coding sequence
atgttcggtctcttcgttgaacacggaccgtacgtcgtaacttcaaacatgacactcagagaccgggacttcccctggacaacaaccttgtccatgctatatatcgacaacccagtcggcacaggcttttcgttcacagatgatacccatggttatgccgtgaacgaggacgatgtagccagagatctgtattccgcgttgatccagtttttccagatcttccctgagtacaaaaataacgatttttacgtcacaggggagagctatgcgggaaaatatgtgcccgctattgctcaccttattcattctcttaatccagttcgggaagtgaagatcaatcttaatggtatagccataggcgacggctatagcgaccccgagagtataattgggggttacgcagaatttctgtaccagattgggctcctcgatgagaaacagaaaaaatactttcagaaacagtgtcacgaatgcatcgagcacattcgtaagcaaaactggttcgaggcgttcgaaatcctagacaagctgcttgacggggacctgacaagcgacccgtcgtatttccaaaacgtgaccggctgctcaaactactacaattttttaagatgcaccgaaccggaagatcagctctactatgtgaagttcctaagtctgcccgaggtgcgacaggctccgagaggtgaatctgatttctag

SEQ ID NO: 217069 - DNA, 1581 bp, Artificial Sequence
  Description of Artificial Sequence: Synthetic coding sequence
atggggcacctctccgcccctctccaccgcgtgagagtgccctggcagggactactcctgactgctagtctactgaccttttggaatcccccaaccacggcccagctcaccactgagtcaatgccattcaatgtggctgaagggaaggaggtcctattactggtccacaacttaccccagcaactgtttggatactcctggtacaaaggagagcgcgtggacggcaatcgacaaatagtggggtacgccataggtacccagcaagccacgccagggcctgccaactctggacgcgagacaatctaccccaacgcttctctgcttatccagaatgtcacccagaacgacactggattttatacactgcaagtaattaagagcgacctggtgaatgaagaggctacaggccagttccacgtgtatcccgagcttcccaagccctcaatctccagcaacaactctaatccggtcgaggacaaggacgccgtggcgtttacatgtgaacccgagacccaggatacgacttatctgtggtggattaacaatcagtctttgcccgtatccccaagactgcagctgagcaatggcaaccgtacactgacactgttgagcgtgacgcggaacgacacaggtccgtatgaatgcgaaatccagaatcccgtttctgcgaataggtctgaccccgtgaccttaaacgttacatacggcccagatacacctactatcagcccttccgatacatattatagacccggtgccaatctgagcctatcatgctacgctgcttctaatccccctgcccagtacagttggctgatcaatggcactttccaacagtccacacaggaattgtttatcccaaacataaccgtgaacaactccggatcttacacatgccacgccaacaatagcgtgaccggctgcaacaggaccaccgttaaaactattatcgttaccgaattgagccccgtggtggcaaagccacagattaaagcgagtaaaacaacagtgaccggggacaaggatagcgttaatttaacctgttccacgaatgatacaggaatttccatccgatggttttttaagaatcagtcgctaccctcctcggaacggatgaagctttcccaagggaacactactctgtctattaaccccgtaaagcgggaggacgctggaacttattggtgcgaagtcttcaaccctatatctaaaaaccaatctgacccgattatgctgaatgttaattacaacgccctgcctcaagagaacggactgtcaccaggcgcaatcgcgggaattgtgataggtgttgtagccctagtcgctcttatcgctgtggcactcgcttgcttcctgcactttggcaagacaggaagagcgagcgaccagagagatctcactgaacataagccttctgtctccaaccacacccaggaccactcaaatgacccacccaacaaaatgaacgaagtaacctacagtacattaaattttgaagctcagcagccgacacagccaacaagcgcatcccctagtctgacagctactgaaattatttactctgaggttaagaagcaatag

SEQ ID NO: 217070 - DNA, 1080 bp, Artificial Sequence
  Description of Artificial Sequence: Synthetic coding sequence
atgccttttaacgtggctgaaggaaaagaggtcctgctgctggtgcacaatttgcctcagcagctcttcggatactcgtggtacaaaggcgagcgcgtggacggcaatcgccagatcgtaggatacgcaatcgggacgcaacaggccactccaggccctgccaattccggtcgcgaaaccatctatcctaacgcatccctcctgattcagaatgttactcaaaacgacaccggcttttacactctgcaggtcatcaagtcagacctggtgaatgaggaagcgactggacaatttcatgtgtatccagagttgcccaagcccagcatctcttcaaataatagcaaccccgtggaggataaagatgccgtagctttcacctgcgagccagaaacacaggacaccacctacttgtggtggattaacaaccagtccctgcccgtgtccccacggttgcagctgtctaatgggaataggacgctgactctgctaagtgtcactagaaacgataccgggccttacgagtgcgaaattcagaatccagtgtcagccaataggagcgatcccgtgacgttgaatgtcacctacgggcctgatactcctactatctctcctagcgacacatactaccggccaggggcaaacctgagcctgtcctgttatgccgcttccaaccccccagcccagtacagctggttgatcaacggcacatttcaacaaagcacccaagaactcttcataccgaacatcaccgtcaataacagcggctcttacacatgtcacgctaacaattcagtaacaggttgtaacagaacaaccgtgaaaacaattatcgtcacagagatggccttccaccacgttgctaaggccggactgaagctcctgtcgtccagcaacccccctgcctccacaagccagtccgcaaaaatcacggataacgctctgccccaagagaatggactatcccctggcgctatagctggcatagtgattggggtggtggccctggtcgcattgatagccgtggcattggcctgctttcttcactttggcaagactgggagctccggaccactccaatag

SEQ ID NO: 217071 - DNA, 1056 bp, Artificial Sequence
  Description of Artificial Sequence: Synthetic coding sequence
atgggccacttgtctgcgccactgcacagggttagggtcccttggcagggtctcctactcaccgctagccttttaaccttttggaacccacctactaccgcgcagctgacgacagagtctatgccatttaatgtcgctgagggcaaggaggtgctcctactcgtacataatctgccccagcagcttttcggctactcctggtataagggggaaagagttgatggcaatcggcagatcgtcggttatgctattggtacccagcaggcaacccctgggcctgccaatagtggtcgcgaaaccatttaccctaatgcaagcctgctaatccagaatgtgacccagaacgataccggattctacactttacaggtcatcaagagtgatctggtgaacgaagaagctacaggccaattccacgtctaccctgagctgcccaaaccaagtatctcctctaataacagcaacccggtggaggacaaggacgcagtggccttcacatgtgaacctgaaacacaagacaccacatacctgtggtggataaataaccagagcttgcccgtgagcccgcgacttcagctgagcaacggcaacaggactctaacacttctgagcgtcactcgcaatgatacagggccttatgagtgcgaaattcagaatcccgtgtccgcaaacagatctgatcccgtgacgctcaacgtcacgtacgggcctgacactccaacgataagcccaagcgacacatattaccggcctggcgctaacttgtcactgtcctgttatgcggcttcgaatcctcccgctcagtactcgtggttgataaatgggaccttccaacaatctacccaggagctcttcatccccaacatcactgtgaataactctggctcatacacttgccatgcaaataatagcgtaactggctgtaatcgcactaccgttaaaaccattatcgtcaccgagagtccagtgctaggcgaggatgaggccgttcccggacagcaccacccccaacacaagccttgccaagagggagggtgctgggatgttttggtttag

SEQ ID NO: 217072 - DNA, 759 bp, Artificial Sequence
  Description of Artificial Sequence: Synthetic coding sequence
atggggcacctctctgctccactccatagagtgcgcgtgccatggcagggcctgcttttaactgcatccctgctgaccttttggaacccacccacaacagcccaactgacaactgagagtatgcctttcaacgtcgccgagggaaaagaggtgttactattagtgcacaatttgcctcagcagctattcggctacagctggtataagggggagagggtggatggaaatcggcagatcgtaggctacgccatcggtactcagcaggccactcctgggcctgcgaattcaggtagggaaactatctaccctaacgcctcactcctcatccaaaacgtgacacaaaatgacacaggcttttacactctgcaggtaattaaaagcgatctcgtcaacgaggaagccaccggacagttccacgtgtatcacaacgcactccctcaggaaaatggcttgagcccgggtgccatcgcaggaatagtgatcggagtggttgccctggtggcactcatagcagtcgctttagcctgtttccttcatttcgggaagaccgggagagcctctgaccaacgagatctgacagagcacaagccatcagtgtctaatcacacgcaggaccacagcaatgatccacccaacaagatgaatgaagttacctactccacccttaacttcgaagcccaacagccaacgcaaccaacttcagcctcacctagtttgacagccaccgagatcatctattctgaggttaagaagcaatag

SEQ ID NO: 217073 - DNA, 1293 bp, Artificial Sequence
  Description of Artificial Sequence: Synthetic coding sequence
atgggccatctttccgccccacttcaccgcgttagagtaccctggcaggggctcctcctcaccgcatcccttcttactttttggaatccccctaccaccgcacagttgacaacagagtcaatgccatttaatgtggctgaaggtaaagaagtgctgctcctcgtccataatctgccacagcagctgttcggctactcctggtacaagggggaaagggtggacggcaatcggcagatcgttgggtatgccatagggacacagcaggccactccgggacctgctaattccgggcgagagaccatctaccctaacgccagtcttctgattcagaatgtaactcagaatgataccggtttttacactttacaggtcatcaaaagtgatctcgtcaatgaggaagcaaccggacagttccatgtgtatcctgagttaccaaagcccagcatcagcagcaacaatagtaaccctgtcgaggataaggatgctgtcgcattcacctgtgagcccgaaacacaggacactacctatctttggtggatcaataaccagtctttgcctgtttccccaaggctgcagttgagcaacggaaacaggacattgaccctcctgagcgtgaccaggaacgacaccggcccatatgagtgcgaaattcagaatccagttagtgctaacaggagcgaccctgtcaccttgaacgttacttatggccctgatacgcctacaatctccccatccgatacgtattacagacccggtgccaacctgtccctttcctgttacgcagctagcaatccgcctgcccaatattcctggcttattaatggaaccttccagcagtccacacaggagctttttatccccaatatcaccgtgaataattcaggtagttacacttgccatgcaaataattcagtgaccggctgcaatcggaccaccgtcaaaacaatcatcgtgacggataacgcgcttccacaggagaatggactatcccccggagcaattgccggtatcgtgataggcgtagtggccttggtagcgcttatcgctgttgctctggcttgctttctgcactttggtaagacgggcagggcatcagaccagagagatcttacggaacacaagccctcagtatccaaccatacacaggaccactccaacgaccctcccaacaaaatgaatgaagtcacatatagcaccctgaactttgaggctcagcaacccacccagccaaccagtgcctccccctccttgaccgccactgagatcatctactccgaagtgaaaaagcagtag

SEQ ID NO: 217074 - DNA, 1386 bp, Artificial Sequence
  Description of Artificial Sequence: Synthetic coding sequence
atggggcacctttctgccccacttcacagagtgagagtcccgtggcagggcctgctacttacagcctccttacttactttctggaatccgccaacaactgcacagctcaccactgaatctatgccttttaacgtggccgagggaaaagaagtgctgttattggtccataacttaccgcagcagctgttcggctattcctggtataaaggtgaaagggtcgatggcaacagacagattgttggctacgcaataggcactcaacaggcaacccctggtcctgcaaattcagggagagaaactatatatcctaacgcctcgctgcttatccagaatgtgacccagaacgacacaggcttctacaccctacaggttatcaagagcgacctggtgaatgaagaggccacgggtcagttccacgtctacccggaattacctaagccctcaatcagtagtaacaattccaaccctgtggaagataaagacgccgtggcctttacgtgtgagccagaaacgcaggacaccacttatttgtggtggattaacaaccaaagccttccagtaagccctagactgcagcttagtaacggcaacagaacgctgaccctattaagcgtgactaggaatgacacaggcccatacgagtgcgaaattcagaatccagtgtccgccaatcggtccgacccagtgactctcaacgtgacgtacggaccagacactccaactatttccccatctgacacctattaccgacccggtgcaaatctctcactctcctgctacgctgcctctaatccaccggctcagtactcttggttaataaacggaacattccagcagagcactcaggaacttttcattcccaacatcaccgtaaacaattccggttcctacacttgtcatgccaataattctgtgaccgggtgtaatagaacgactgtgaaaacaattattgtcaccgagaggcagaatctgacaatgttaccaaggctggatagtaacagttgggctcaagcaattctgccctctgtttcccagtctgcggagatcactgacaacgcgttgccccaggaaaatgggctcagtcccggagcaatcgcagggatcgtgatcggagtggtggcactggtggcactgattgctgtggctctggcctgttttttgcactttggcaagacagggcgagcttccgaccaacgggatctgaccgaacacaaacccagtgtgagtaaccacacacaggaccattccaatgatcctcccaacaagatgaatgaagttacttacagcacactcaactttgaagcacagcagccgactcagcccacctctgcctctccttcattgactgcgactgagattatctattctgaagtaaaaaaacaatag

SEQ ID NO: 217075 - DNA, 1254 bp, Artificial Sequence
  Description of Artificial Sequence: Synthetic coding sequence
atgggacacctgagcgcccctctgcatcgagtgcgggttccttggcaagggttgttacttaccgcctctctcctgacattctggaaccctccgaccacagcccagttaaccaccgagtctatgccattcaacgtcgccgaggggaaggaggtgctactcctcgttcacaacctaccccagcaacttttcggctatagttggtataaaggcgagcgggtggacggtaaccgtcagatcgtggggtatgccatagggacccagcaagcaactcccggtccagccaatagtggaagggaaacaatctacccaaatgcctcactgcttatccagaatgtcacccagaacgataccggattttacactctgcaggtgatcaagtcggacctggtcaatgaagaggcaacagggcaatttcacgtgtatcctgaactccctaagccgagcatttctagtaacaactcgaatcctgttgaagacaaggatgctgtggcttttacatgtgaaccagagacccaagacactacatacttgtggtggattaacaatcagtccctgccagtgagccctcggctgcagctaagcaatggcaatcgcacactgacccttctcagcgtaactcgaaatgatacgggtccttatgaatgcgaaatacagaacccggtttctgccaaccgaagcgacccagtcacattaaatgtcacttacggccctgatacgccaactatctctccttcagatacctactacaggccaggggcaaatctgtccctaagttgttacgcggcatctaaccctcccgctcagtacagctggctgatcaacggaaccttccaacaatcaactcaggaactttttatccccaatatcactgtgaacaactccggtagttatacctgtcatgccaataacagtgtgactggttgcaaccgcactacagtgaaaacaattatcgtaacggagttgtctccagtggtagccaagcctcagattaaggcctccaaaaccacggtgacaggagacaaggactccgtgaatctgacatgcagcactaatgataccggcatctcaatcagatggttctttaagaaccagtccctcccatccagcgaaaggatgaaattatctcagggtaatacgaccctctccattaatcccgtaaagagagaggacgccggaacatactggtgcgaagtgttcaacccaataagcaaaaatcaatcagatcccataatgcttaacgtgaactgcaaatag

SEQ ID NO: 217076 - DNA, 1437 bp, Artificial Sequence
  Description of Artificial Sequence: Synthetic coding sequence
atgccattcaatgtggccgagggaaaggaggttctgctactggtccataatcttcctcagcaactgtttgggtactcctggtataagggcgagagagtagatgggaacagacagattgtgggatacgccatcggcactcagcaggctacaccaggacccgctaacagcgggagagagacaatttatccaaacgcatctttgctcatacagaacgtcactcaaaatgacacaggcttttatacgctgcaggtgattaagtcggatctggtcaacgaggaagctactggccagttccacgtataccccgaacttcccaaaccgtcgatatcctcaaataactctaatcccgtggaggataaggacgccgttgcctttacatgcgagcccgagacacaggataccacgtacctgtggtggatcaacaaccagtctttgcctgttagccccaggctccagctaagcaatggcaatcggaccctcacactgctgtccgtcacccggaatgatactggaccttacgagtgcgagattcaaaatcctgtgtcggctaatcggtccgacccagtcacattgaatgtcacctatgggcctgatacacccacgatctcgcccagcgacacttactatagaccaggggctaacctgagcctcagttgctatgcagccagtaatccaccagctcagtatagctggctgataaatggaacctttcagcagtctactcaggagctattcataccgaacattactgtaaacaatagcggcagttacacttgccatgctaataattccgtaaccggctgtaaccggaccaccgttaagactattatcgtgacggaactgtcaccggtggtggcgaagcctcagattaaggcttctaagactacggtgacaggagacaaagacagcgttaacctgacctgcagcaccaacgataccgggatcagcatacgctggtttttcaaaaatcagagtctgccgtcttccgaacgtatgaagctgtcgcagggaaatacgaccttgtcaattaatccagtcaagcgagaagatgctggaacatattggtgcgaagtctttaaccccatctctaaaaatcagtccgacccaataatgctgaatgaaatggcttttcaccatgtggctaaggccggattgaaattactcagttcctctaatcctcctgcgtctacctctcagtcagccaagatcacagagcggcaaaatttaaccatgttgcccagattagattcaaatagctgggctcaggctatcctgccttccgtctcccagagcgccgagataactgacaatgctttgccgcaggagaatggcctgtccccaggagcaatcgccggtatcgttatcggggtagttgcgctcgtggcgctgatcgctgtggccctggcttgttttctgcatttcggtaagaccggatag

SEQ ID NO: 217077 - DNA, 966 bp, Artificial Sequence
  Description of Artificial Sequence: Synthetic coding sequence
atggggcatctgtccgctcctcttcacagagtccgggtgccttggcaaggtcttctgcttacagcttccctgctgaccttttggaatcctcccaccacagctcaactaactacagagtctatgcctttcaatgtggcggaaggcaaagaagtccttctgctcgttcataacctaccccagcagctgttcggatattcttggtacaaaggagaaagagtggatggtaacaggcagatagtaggttacgctattggaactcagcaggccacccctggacccgcaaatagcggaagagaaacaatttacccaaatgcgagtcttctgatccaaaacgtgacccaaaatgatactggtttttatacgctgcaagttattaaaagtgatcttgtgaatgaggaagccaccgggcaatttcatgtctaccccgaattgccaaagccttccatctccagtaataactcaaatcctgtggaggataaggatgccgttgcatttacatgtgaacccgagactcaggacaccacctacctgtggtggataaacaaccagagtctgcccgtgagcccacgtctccagctctccaacggaaatcgaacgctgacattattgagcgtgacccggaacgacactggcccttacgagtgtgagattcagaaccctgtaagcgccaatcgatccgatccagtgaccctgaacgtaacctatggacccgacactcctaccatttccccttccgacacctactacagacctggagcgaatctctcgctcagttgttacgctgccagtaaccctcctgctcagtatagctggctgatcaacgggacttttcagcagtcgactcaagagctctttattcctaacatcactgttaacaattccggcagctatacctgccacgccaacaacagtgtgactgggtgtaacagaactaccgtaaaaacaattatagttaccggcaaatag

SEQ ID NO: 217078 - DNA, 1458 bp, Artificial Sequence
  Description of Artificial Sequence: Synthetic coding sequence
cggggagaccgggcagcagtccttgaagctttcctggaacctaagctgtcctcaactggagaagaccgggcatcccgtcggcatcacggcgcacccctgtctcctaccagccagtctgcctgcactctcgggctgctgctgacagcaagcctccttaccttctggaatcctcccaccacggcgcagctgacaacagagtccatgccgtttaatgttgcagagggcaaagaggttttgctgctcgtgcataacctccctcagcagctgttcgggtatagctggtacaaaggcgagagagtggacgggaacaggcaaatcgttggatatgcaattggcacacagcaggccacccctgggcctgcgaactctggccgtgagactatctaccccaacgcttccctgttaattcaaaatgtgacacagaatgatacaggtttctataccctgcaggtcattaagagcgacctggtcaacgaggaggccaccgggcaattccacgtgtatcctgagctccccaaaccaagtataagcagtaacaactccaatccagtggaagataaagacgccgtggcctttacttgtgagcccgaaactcaagatacaacttacctgtggtggattaacaaccagagcctgccagtctccccgcgactgcaactgtctaacggaaaccggacgctcacactgctgtcagtgactcgaaatgatacaggaccctacgaatgtgagatacagaatcctgtctcagcaaaccgaagcgatcccgtgaccctgaatgtgacctacggccctgacaccccgactattagcccctcggatacttactaccggcctggcgctaatttgagcctgagttgctacgccgcaagtaaccccccagcccaatattcttggctgatcaacggtactttccagcagagcacacaggaactattcatccctaacattaccgtgaataattctgggagctacacttgccacgccaacaactctgttacaggatgtaacaggactactgtgaaaacaatcatagtcaccgagttgtctccggtcgtcgccaaaccccaaataaaagcaagcaaaacaaccgtaacgggggataaagattctgtgaacctgacatgctccaccaacgataccggtatcagtataaggtggttcttcaagaatcagagtctaccctcctccgagcgcatgaaattgagccagggcaacactaccctgtccatcaaccctgtaaagcgtgaagatgccggaacctattggtgcgaagtttttaaccccatctcaaaaaatcaaagtgacccaataatgctcaacgtgaactacaatgcattgccccaggagaacgggttgagtccaggcgcaatcgccggaattgtgatcggagtggtagccctggtggctcttattgcagtagcccttgcatgtttcctgcactttggcaagactggatag

SEQ ID NO: 217079 - DNA, 1395 bp, Artificial Sequence
  Description of Artificial Sequence: Synthetic coding sequence
atgggccacctgagcgctccacttcaccgggtgcgagtgccctggcagggactgctgttgaccgcttctctgctaaccttctggaaccctccaaccactgcccagttaaccactgagtccatgccttttaatgttgcggagggcaaagaggttctgctgctcgtccataacttaccccaacagctgtttggctatagttggtacaaaggggaacgagtagacggaaacagacagatcgtaggatatgccataggcacgcaacaggctacaccgggaccagcgaactcaggccgtgaaaccatttaccccaatgccagcctcctaatccaaaacgtgacccagaatgatacaggtttttacacccttcaagttattaagtcagacttggtgaacgaggaggccaccggccagtttcacgtttacccagaactgcccaagcctagtatctcatccaataactcaaacccggtggaggataaagacgctgtggcctttacctgtgagcctgagacacaggataccacctatctttggtggataaacaaccagtctctgccggtttcccctaggctccagctttcaaatggaaaccggactttaacattgctctctgttaccaggaacgacacaggaccttacgaatgcgaaattcagaatccggtgagtgcgaaccgatccgaccctgtgacactcaatgtgacgtacggtcccgacaccccaacgatttcaccatctgacacctattataggccgggagcgaacttaagcctaagctgctacgccgctagtaatcctccagcccagtatagttggctcataaatggcacatttcagcagtcaacgcaggagctgtttatccccaatattaccgtgaacaatagtggttcttatacatgccacgctaacaattcggtcactggctgtaaccgcaccaccgtcaagacgatcattgtgacagagctctcacctgtggtggctaaacctcaaattaaagcgtctaagaccaccgtcaccggagataaagacagtgtgaacttgacatgttccaccaacgatactggtatcagtattaggtggttttttaaaaaccagtcactgccctcctccgagcgaatgaagctgtctcagggcaacactactttatccatcaaccctgtcaagagggaagatgccggaacttactggtgcgaggttttcaatcccattagcaaaaaccaaagtgaccccatcatgttaaacgtaaattacaatgcccttcctcaggagaacgggctctcccccggagcaatagctggcattgtcattggcgttgtggccctggtagccctgatcgcggtcgcactggcatgctttcttcatttcggaaaaaccggctccagcgggcctctgcagtag

SEQ ID NO: 217080 - DNA, 1107 bp, Artificial Sequence
  Description of Artificial Sequence: Synthetic coding sequence
atggggcacctgtcagcccctctccaccgtgtcagggtaccatggcaggggctcctcctgacagcgtcgctgctcaccttctggaacccaccaacaaccgcccagttaactactgaatcaatgccattcaacgttgctgagggtaaggaagtcctgttgctagtacacaacctgccgcaacagctttttggctattcttggtacaaaggcgagagggtggatgggaataggcaaattgtaggctacgccattggaacgcagcaagccactcccggacccgcaaattccggacgcgagacaatttatcctaatgccagcttgctgatccagaacgtgacgcagaatgataccgggttctacactctccaggtgataaagagcgacctagtcaatgaggaggctactgggcagtttcatgtgtatcccgagctgccaaaaccctcgatctctagcaataactccaaccctgtcgaggataaggatgccgtggcatttacatgtgaacccgaaacacaggacacaacatatctatggtggattaacaatcagagcttgcccgttagtccacggctgcagctcagtaatgggaatcggacgctgaccctcctctcagtaacccggaatgacactggcccttacgagtgtgaaatacaaaaccctgtttcagcaaacagatcagatcccgtgactttgaacgtgacatatgggccagacacccccaccattagtccgtcagatacatattaccgtccaggggcaaacctcagcctgtcttgctacgcagcatctaatccccctgcacagtattcttggctaattaacggcacttttcaacaaagcacgcaggaactgttcatccccaatatcacagtgaataacagcggctcttacacctgccatgccaataacagtgtgacaggctgcaaccggacaacggttaaaaccattatcgttacagataatgccctccctcaagaaaatgggctgagtcccggagccattgccggaattgtcatcggggtggttgcactggttgcgctcatagcagtggctctagcatgctttctccacttcggtaagaccggctcgagtgggcctctgcagtag

SEQ ID NO: 217081 - DNA, 906 bp, Artificial Sequence
  Description of Artificial Sequence: Synthetic coding sequence
atgctggctctacgcgtggcccgtggtagttggggggctctgcgaggcgcagcctgggcaccaggcacccgtcccagcaagagacgggcttgctgggccttgctccctccggttccctgctgcctcggctgtcttgccgagcgctggaggttaagacctgcagcattggggctgcggctgccaggcatcgggcagcggaaccattgctcaggagccggaaaggcagctcctaggcctgccgcaggagctggcgcagctgctgaggccccaggcggtcagtggggacctgcctctaccccttccctatacgagaacccctggaccatcccaaacatgttatcaatgactagaattggtctcgccccagtactcgggtatctcataatcgaggaggacttcaacatagccctgggggtctttgccctcgctggactgactgatttgcttgacggctttatagctcggaattgggcaaatcagaggtcagctctcggcagcgccctggacccgctagcagacaagatcctgatctcaattctctacgttagcttgacatacgccgacctcatacccgtaccattaacctacatgattatttctagagacgtgatgcttattgctgccgtgttttatgtccggtatcggacccttcctacccctcggacactggctaaatactttaatccttgctacgcaaccgcacgtctaaagcctacctttatttccaaagtgaacaccgccgtccagcttatcctggttgccgctagcctcgccgctccggtgttcaactatgcagattcgatctacctgcagatactatggtgctttacggctttcacgacggccgcatccgcctatagttactatcactacggacggaagaccgttcaggtgatcaaggactag

SEQ ID NO: 217082 - DNA, 609 bp, Artificial Sequence
  Description of Artificial Sequence: Synthetic coding sequence
atgcctcagtacgaaaatccctggaccatacccaacatgctaagcatgacaaggatcgggttggccccagtgcttggttacttgatcatcgaagaagactttaatattgccctaggagtttttgcattagctggacttaccgaccttttggatggtttcattgctaggaactgggcaaaccaacgcagtgctctggggagtgcgctggaccctttggcagacaaaattctaatctctatcctgtatgtcagtcttacatatgccgacctgatcccggtgccattgacctacatgataatctcgagggacgtaatgctaatcgccgctgtcttctacgtcaggtaccggactttgccaacgccgaggaccttagcaaaatattttaacccatgttacgccaccgctcgcttaaagccaacattcatatccaaagtgaacactgcggtgcagttgattcttgtggctgcttccctggcggctccggtgttcaactatgcagacagtatttatttacaaatattgtggtgctttactgccttcacgacagccgcatctgcatatagctattatcactacggaagaaagacagtgcaggtcataaaggattag

SEQ ID NO: 217083 - DNA, 618 bp, Artificial Sequence
  Description of Artificial Sequence: Synthetic coding sequence
atgctggccctccgggtagctcggggtagttggggcgcacttcgcggtgcagcgtgggctcccggaacaagacctagtaagagaagggcctgctgggcacttctgccgccagtgccctgctgcctgggctgcctggccgagcgctggcgcttgaggcctgcggctctcggcctgcgcttgccagggattggacagcggaatcactgtagcggagccggtaaggccgctcccagaccagccgcaggagccggagccgcagcagaagctccgggagggcagtggggaccagcttctaccccctctttatatgagaatccctggaccattcccaacatgctgtcaatgacaaggatcggactcgctcccgtcctgggttatttgatcatcgaagaggactttaacattgccctcggagtgttcgcccttgcgggattgactgatttgctcgatggatttattgccaggaattgggctaaccagcgcagcgccttaggatctgctttggaccccctcgcagacaaaatcctgatttcgattctctatgtgtcacttacgtatgccgatttgatcccagcaaatacttgtcaggttttccagagcctgctgtgccattgctag

SEQ ID NO: 217084 - DNA, 12210 bp, Artificial Sequence
  Description of Artificial Sequence: Synthetic coding sequence
atggccagtcgggacagcaatcacgcaggcgagtcatttttggggtcagatggtgatgaggaagcaacccgagagcttgaaacggaagaggagtcggaaggggaagaggatgagactgcggctgagtctgaggaggaacccgacagtagactgtctgatcaggatgaggagggaaaaattaaacaagaatacatcattagtgacccctccttctccatggtcacagtacagcgagaggattctggaataacctgggaaacgaatagcagcagaagctctaccccatgggccagcgaggaatcccagacttcaggcgtttgcagcagagagggatcaacggtcaattctcctcctggaaacgtgtcatttattgtagacgaggtcaaaaaggtccgcaagcgaactcataagagcaagcacgggtcccctagcctacggcgtaagggtaatcgcaagcgtaatagtttcgagagccaggacgtgcccaccaacaagaaggggtctcccctgacctccgcatcccaggttttaacgaccgagaaagagaagagttacacgggcatctacgacaaagcacgcaaaaaaaagacaacgagcaatactccccctatcacaggcgctatatacaaagagcataaacccctggttctgcggccagtgtatatcggcaccgtccaatacaaaataaaaatgttcaatagtgtgaaagaagaactcattcccttgcagttctatggcacactccctaaaggttacgtcatcaaagagattcactaccggaagggaaaagacgcctccatctccctcgaacccgatctcgataactcagggagcaatactgtgtccaaaacgcgcaaactagttgctcagagcattgaagataaggtgaaagaagtgttccccccttggagaggcgctctgtcgaagggtagcgagagcctaacacttatgttcagccacgaggatcagaagaaaatctacgccgattcccccctcaatgctacgtccgccctagagcataccgtgccaagctatagttcctcaggcagggccgagcagggaattcagcttcgacactctcagtccgttccccagcagcctgaggacgaggccaaaccccatgaggtagaacctccttcagtcacccccgacaccccagccacaatgtttttgaggacaaccaaggaggagtgcgaactggcctctcccggaacggcagcgtcagaaaacgactcctcggtgtctcccagctttgcaaatgaggttaagaaagaggatgtctactccgcgcatcactcaatatccctcgaagccgcaagtccgggtctggctgcctctacgcaggatggcctggatccagaccaagagcagccagacttgacttcaatcgaaagggctgaacccgtatctgccaagctgacccctacacacccaagtgtgaaaggcgagaaagaggagaatatgctggaaccaagcatctcactgtccgaacccctgatgctggaggaaccggaaaaagaggagattgaaaccagtctacctatcgcgataacaccagaacccgaggactcaaacctagttgaagaggaaattgtagagttggactatcccgaatcccccctagtgtctgaaaaacccttcccccctcatatgtccccagaagtggaacacaaggaggaggagcttattcttcccttactcgccgcttcctcacccgagcatgtggccctgagtgaggaggaacgcgaggagattgcttcagtgtccacgggctcggcttttgtctccgagtattccgttcctcaggatcttaaccacgagttacaggagcaagaaggagaacccgtacccccatccaatgtggaggctattgccgaacacgccgtgctgtccgaggaggagaatgaggagtttgaagcatactcccctgcagccgcaccaacctctgagtcctcactgtccccttcaacaactgaaaaaacttcagaaaaccagtcgcctctgtttagtacagtaacccctgagtacatggtcctttctggggacgaggccagcgagagcggctgttacacaccagactccacctcagctagcgaatacagcgtccctagtctggccactaaggagtctctaaaaaaaaccattgaccgaaagagtcctctgattctgaaaggggtatcagaatacatgatccctagtgaagaaaaggaggatactggaagctttacaccagccgttgctccggcatccgaaccaagcctctcaccctctacaaccgaaaagacctcagaatgccagtcaccgctaccttcgaccgcgacctctgaacacgttgtgccaagtgaaggcgaggatctggggagcgagaggttcaccccagattcaaagctgatatctaagtatgccgcaccactgaatgccacccaggaatcccagaagaaaatcatcaatgaggcatcacaattcaaacccaagggcatttctgaacacacggtgctatcggtggatggcaaggaggttattggcccttcatctcccgatctcgttgtagcctccgagcattccttcccccctcacacaacggagatgactagcgaatgtcaggccccaccactttccgcaaccccctccgagtacgttgttctatctgatgaggaagctgtcgaactggaaaggtatacgccatcaagcacgtcagccagtgaattttccgtacctccatatgccacacctgaagctcaggaggaggagatcgtgcaccgttctctcaacctgaaaggagccagttctccaatgaacctttccgaggaggaccaggaggacataggccctttttccccagatagtgcctttgtatcggagttttcattccccccatacgccacacaggaggcagagaagagagagttcgaatgcgactcacctatttgtctcacctccccttccgagcatacaatcctttccgatgaagacacagaggaagccgagctcttctctcccgactccgccagtcaggtatctatccctccgttccggatctccgaaaccgagaaaaatgagctggaacccgattctctcctaaccgctgtcagtgcatccggatattcctgcttctctgaagccgacgaagaagacattggatccactgctgccacaccggtgtctgagcagtttagtagctctcagaaacaaaaggccgaaacgttccctttgatgtctcctctcgaggatctatctcttccacccagcacagataaatcggaaaaagctgagattaaacctgagatcccgaccacgagtaccagcgtcagcgagtacctcatcctggctcaaaaacagaaaacccaggcttacctagagcccgagtcggaggaccttattccgtcccacctgacctccgaggtggaaaaaggggagcgggaagccagttcatcagtcgctgctattccagctgcccttcccgctcagtccagtatcgtgaaagaggagacaaagccagctagccctcacagcgtgctacccgacagcgtgccagctatcaaaaaggagcaggagccaaccgctgcgctcaccctgaaggccgctgacgagcaaatggcactgagcaaagtgagaaaggaagagatcgtacctgatagccaggaggctactgcccacgtgagccaagaccagaagatggagccccagcctcccaacgtgcccgaatccgagatgaaatacagtgtgttaccagatatggttgatgaacctaaaaagggagtgaaaccgaaacttgtgctgaacgtgacttctgagcttgagcaacgaaagctgagtaaaaatgaaccagaggtgatcaagccatatagcccactcaaggaaactagcctgagcggccctgaagccctaagcgcggttaagatggagatgaagcatgactcaaagatcaccacaaccccaattgtcctacattctgcctcctccggcgtggaaaaacaggtggaacacggaccccctgcactagctttctcggccctttcggaggagatcaagaaggagatcgaaccatctagttctaccacaacagcgtctgtaactaaactagacagcaatctcacaagagcggtgaaggaggaaatacctactgacagctcgctgataacacctgttgatcgccctgtattgaccaaagtcggcaagggggagctgggctccggattacctcctctcgtgactagcgccgacgaacacagcgtgctcgctgaggaggacaaggtggccatcaaaggtgcttccccaattgaaactagctctaagcacttggcatggtccgaagccgagaaggagattaaattcgacagcttaccgagcgtttccagtattgctgagcattccgtgcttagtgaggtcgaggccaaggaggttaaggctggattaccagtgatcaagaccagtagctctcagcatagtgataagtcagaggaggctcgcgtcgaggacaagcaggacctcctcttctctacagtatgtgacagtgagcgcctggtctcctcccagaaaaagtcccttatgtcaacctcggaagtgctcgaaccagagcacgagctgccactttctctgtggggcgagattaaaaagaaagagaccgaactgcccagttcacagaacgtgtcgcctgcctccaaacacattattcccaaagggaaggacgaggaaacagcttcatcatcccccgagctcgagaaccttgcctctggtcttgcgcctacactattgttgttgtctgatgataagaacaaaccagctgtcgaggtgagcagcactgcccagggcgacttcccctctgaaaagcaggatgtagcattggcagaactcagtctggagcccgaaaaaaaggacaagccacaccagcccttggagctgcctaacgcaggcagtgaattcagctcagacttggggagacagagcggctctattggaactaagcaagccaaatctccaatcaccgaaacagaggacagcgtcctagaaaaggggccagctgaattacggtcccgcgaaggcaaggaggagaacagagagttgtgcgccagctccaccatgcccgcaatctccgagttgagctccctgcttcgggaagagagtcagaacgaagaaattaagccttttagcccgaagattattagcctggaatcaaaggaacctccagcttcagtggccgaagggggaaaccctgaagaattccaaccattcaccttcagtctgaaggggctgtccgaagaagtgtcccatcccgctgatttcaagaaagggggtaatcaagagatcggaccgttgcctcccactggaaacctgaaagctcaggtgatgggtgacatcctcgacaaactctcagaggaaactgggcatccgaatagttctcaggtactgcagtcaattaccgaaccgtcaaaaatagccccatccgatctcctggtcgagcagaaaaagactgagaaggccctacactcagaccaaactgtgaaactaccagatgtgagtaccagttccgaggacaagcaagacctgggcatcaagcagttttctctcatgcgagaaaatttgcctctcgagcagtccaaatcctttatgacgacgaagcctgccgatgtgaaagagacaaaaatggaggaatttttcatctcccccaaagacgaaaattggatgctggggaaacctgagaacgtggcctctcagcatgaacagcgcatcgctggatcagtgcagctcgatagcagttctagcaatgagctaaggccagggcagctgaaagcggctgtgtcatccaaggaccacacctgcgaggtgcggaagcaagtcctccctcactccgccgaggaatcccatctttcatcgcaagaggccgtcagcgcgctcgacacatcgtctggaaacacagaaacgctcagctccaagagttattctagtgaggaggtgaaactggctgaggaacctaaatcgctggtccttgccggaaatgttgagaggaacatcgccgaaggcaaggagatccatagcctgatggagagcgaatccctgctgctggagaaggctaatactgagttgtcatggccttcaaaagaagattcccaggaaaagattaaactgccccctgaacgatttttccagaagcccgtctctggcttgagcgttgagcaggtaaagtccgagactatctcctcttctgtgaagaccgctcattttcccgcagagggagtggaacctgccctgggcaatgaaaaagaagcccaccggtccacccccccattcccagaggagaaacctttagaggaatccaaaatggtgcaatcaaaggttatagatgatgcagacgagggcaagaaacccagtccagaggtaaagattcccacacagagaaaacccataagttccatccatgctcgggagcctcagagtcccgagtcgcctgaggttacacagaacccacccactcaacctaaggtggccaagcctgatctgccagaagagaaagggaaaaaaggtatcagtagcttcaaatcatggatgagttccttattcttcggtagttctactccagacaataaggtggctgagcaggaggatctggagactcaacctagtcctagtgtggagaaggctgtgacagtaatcgacccagagggaacaatccctactaatttcaacgtagcagagaagcccgcagatcattccttgagcgaggtgaaactcaagactgcagacgagccaagaggcaccctggttaaatccggggacggccagaatgtcaaagaaaaatcaatgatactgagcaatgtggaggatcttcaacagccaaagtttatatcagaagtttcccgtgaggactatgggaaaaaagagatcagtggcgactccgaggagatgaacattaactctgtggtcacatcagctgacggcgagaaccttgaaatacagtcctacagcttgatcggtgagaaattggtcatggaagaagcaaaaacaatcgtaccccctcacgtgacagattctaagcgggtgcagaagccggcaatcgcacctcctagtaaatggaacatctccatatttaaggaagaacctagatcagaccagaaacaaaagagcctactgagcttcgatgtggtagacaaagttccgcagcagcctaagagcgcctcctctaattttgctagcaaaaacattactaaagagtccgaaaaacccgaaagcataattctgccagtcgaggagtccaaagggagtctcatcgatttcagtgaagacaggctgaagaaggagatgcagaaccctaccagcctgaagatcagtgaagaggagacaaaactgaggtctgtgtctcccaccgagaagaaggataacctggagaacagatcatataccctggcagaaaagaaggtgctggcagagaagcagaattccgtggctcctctggagctgagggacagtaatgagataggcaagacacagatcacactaggatcccgttcgaccgaactcaaggaatcaaaagccgatgctatgccccagcacttctatcagaacgaggactacaatgaacgtcccaaaatcatcgtcggatccgagaaggaaaaaggcgaagaaaaggagaaccaggtctacgtcctcagcgaggggaagaagcagcaggagcatcagccatactccgttaacgttgctgagagtatgagcagggagtcagacatcagtctaggtcattctctcggcgaaacccaatctttctcgcttgtcaaggcgactagcgttactgaaaaaagtgaggccatgcttgctgaggcccaccccgagattcgcgaagccaaggcagttgggacccaaccccatcccttagaggaaagcaaagtcttggttgagaagactaaaacatttctccccgtggccctcagctgcagagatgagattgagaaccattccctctcacaggaagggaatcttgttctcgagaagtcttccagggacatgccggaccactcagaggagaaggagcagtttagagaaagtgagcttagcaagggaggatcggtcgacattaccaaggagaccgttaaacagggcttccaggaaaaagccgtgggcacgcagccccgtcctctggaagaaagcaaagtgctggtggagaagacaaaaacctttcttcctgtggtcctgtcatgtcacgacgagattgagaatcattctctgtcccaggagggcaacctggtgctggagaaatcgagccgagatatgccagaccattcagaggaaaaggagcagttcaaagaatctgaattgtggaaagggggatctgtggatatcaccaaggagtcaatgaaggaggggttcccttcgaaggagtccgagagaacactggctcgcccattcgacgagacgaagagttcggaaacgcctccttacctgttgagccctgtgaaaccacagacacttgcatcaggtgcgagccctgaaatcaatgcggtgaaaaaaaaagagatgccgaggagtgagctcacgccagagaggcatacagtgcacaccatccagacatcaaaagatgatacgagcgacgtccccaagcaaagcgtgctggtgtccaaacaccacctagaagcggcagaagacacacgcgtgaaggagcccctttctagcgccaaatccaattacgcacagttcatttcaaacacgtctgccagcaatgccgacaagatggtgtcgaataaggagatgcctaaggagccagaggacacttacgccaaaggcgaggactttacagtgacgtccaagccagctgggctgtccgaagaccagaaaaccgccttctccataatcagcgaggggtgcgagatcctgaatattcatgctccagccttcatcagcagcatcgatcaggaagagagcgagcagatgcaggacaagttggagtacctggaggagaaagcgtcctttaaaacaatacccctccccgacgattccgagaccgtcgcctgtcataaaacattgaagtcccggctggaggatgaaaaggtgacccctctgaaggaaaataagcagaaagagactcacaaaactaaagaagaaatttcaactgatagcgagaccgatttgtcctttatccagccaacaattcccagtgaagaggattactttgaaaagtataccttgattgactacaatattagcccagacccagagaagcaaaaggcaccgcaaaaactcaacgtagaagagaagctttcaaaagaagtgacagaggaaaccattagctttcctgtgagctcagttgagagtgccctggaacacgagtacgaccttgtaaagctagacgagtcgttttacggtcccgagaagggccacaacattttatcacacccggaaacacagtcacagaatagtgcagatcggaatgtgagtaaggatacaaaacgcgatgttgattctaagagcccagggatgcccctcttcgaggccgaagaaggagtcctgagcagaacgcagatctttccaaccacgatcaaagtgatagacccggagttccttgaagaaccgccagccctggcctttctctacaaggacttatacgaggaagccgtgggcgagaagaagaaagaggaagaaacagcgtctgaaggtgactccgtgaattcggaagcgagttttccaagcagaaattccgataccgacgatggtacgggtatatacttcgagaaatacatcctcaaagacgatatcctgcatgacacgagtctcactcagaaagatcaggggcagggccttgaggaaaaacgtgtcggaaaggacgatagctatcagcctatcgctgcagaaggcgaaatttggggaaaatttggcaccatctgtcgggagaaatccttagaggagcaaaaaggagtgtacggagagggtgaaagtgtggaccacgtcgaaaccgtcggaaacgtcgccatgcagaaaaaggcacccatcaccgaagacgtcagggtcgcaactcagaagattagctacgcggttccgttcgaggatacacatcacgtgctggagcgcgctgacgaagccggaagccatggcaacgaggtgggaaacgccagccccgaggttaacttgaatgtgccagtgcaggtctcattccccgaggaggagtttgcatccggcgctacccatgttcaggagaccagtctggaagaacctaaaatcctcgtgcctcctgagcccagtgaagaaagactgagaaactcaccagtgcaggatgagtatgaattcacagaaagccttcacaatgaggtggtgccccaggatattctgagcgaggagttgagttctgaatctaccccggaagatgttctgtcacaaggtaaggaatccttcgagcacatcagtgaaaatgaatttgctagcgaagcagagcagtccacaccagccgaacaaaaagaactaggcagtgaacgtaaggaggaggatcagctgagctctgaggtggtaaccgaaaaggcacaaaaggagcttaaaaagtcacagattgacacttattgctacacatgtaagtgtccgatttccgctacagataaagtctttggaacacataaggaccacgaggtctcaactctggacaccgccatttcagccgtgaaggtgcagttggccgagttcctggagaatctccaggagaagtccctgagaatcgaggctttcgtttctgagatagagagctttttcaacaccattgaagagaactgttccaaaaatgaaaaaagacttgaagaacaaaacgaggaaatgatgaaaaaggtgctcgcacaatatgacgaaaaagctcagtcgtttgaggaagttaaaaaaaaaaaaatggaattcttacatgaacaaatggtccatttcttacaaagtatggacactgctaaggacacactcgagaccattgttcgggaggcagaggagcttgacgaggctgtgttcctgacatctttcgaagagattaacgagcgcctgctaagtgctatggagagtaccgcctcattagagaaaatgcctgctgctttcagtctctttgaacattatgacgacagtagcgctcgatctgaccaaatgttaaaacaagtggcagtgccccagcctccacggctagagccccaagaaccaaactctgccacctctaccaccatcgctgtgtattggagtatgaacaaagaggacgtcattgatagttttcaggtttactgtatggaggaacctcaagatgaccaggaggtgaacgagctagtggaggagtaccgacttactgtgaaagagtcctactgcatttttgaagatctcgagcctgaccggtgttaccaagtttgggtcatggctgtgaattttaccggatgttcattgccttcagagagagctatcttcaggaccgctcctagcacaccagtcatccgagcggaagactgcactgtatgctggaacaccgccaccattcgctggcgcccaacaacccccgaagcgaccgagacgtacactctcgaatactgccggcagcatagcccggaaggtgagggtctgagatcatttagtggaattaaggggctacaattgaaggtgaacctgcagcctaatgataattatttcttctatgtcagggctattaatgcattcggcaccagcgaacagtccgaggcagctttgatctcgacgcgcggtactcgttttctgttgttgcgtgagactgctcacccagccctccatatcagctcatccggcaccgtcatctcgtttggcgagcgcaggcggcttactgaaatccccagcgttttgggtgaggagctgcccagctgcgggcagcactattgggagactactgtcacagactgccctgcataccgcctcgggatctgctctagtagcgcggtgcaagctggcgctctgggccagggggagacttcttggtacatgcactgtagtgaaccacagcggtatacctttttctactccggcattgtgtcagacgtccatgtgaccgaacgacccgctagggtgggcatcctgctagattataacaatcagcgactcattttcattaacgcagagagtgagcagttactctttatcatccgacaccgatttaatgagggtgtgcacccagcattcgccctggagaagcccggaaaatgtaccttacacctcgggatcgagcctcccgatagcgttcgacacaaatag

SEQ ID NO: 217085 - DNA, 678 bp, Artificial Sequence
  Description of Artificial Sequence: Synthetic coding sequence
atggatctgagagctggggactcgtggggaatgcttgcctgcctgtgtaccgtcctgtggcatctgccagcagtgcctgctctgaaccgtacaggcgaccctggtcccggacccagcattcagaaaacatacgacttgactcggtatctggagcatcagctgagaagtcttgctggtacatatctgaactacttagggcctccttttaacgaacccgacttcaatccaccgagactgggagcagagaccctccccagagcgaccgtagacctggaagtgtggcggtcactcaatgataagcttaggctgacacagaattacgaggcctatagtcatcttctttgctatctgcggggattgaatcgccaggccgcaacggcagagttacggaggagcctcgcccatttctgcacctctctacagggtctgttgggaagcatcgccggagtgatggctgctctgggctacccactgccacaaccactgcctggtacggaacctacatggacgcccggtccagcccattcagattttctgcagaaaatggatgatttctggttgctgaaagagctacagacctggctctggcgcagcgcgaaagacttcaatagactgaagaagaagatgcagccgccagcggctgctgtgacgctccatctgggggctcacggattttag

SEQ ID NO: 217086 - DNA, 648 bp, Artificial Sequence
  Description of Artificial Sequence: Synthetic coding sequence
atgcttgcatgtctgtgtacggtgctgtggcacctaccggctgtacccgctctgaaccgcaccggagaccccggaccagggccttccatccagaaaacttacgacttaacgcggtacctggaacatcagttgcgttctctcgccggtacgtacttgaattatttaggccctcctttcaacgagcccgacttcaatccgccacgactgggggcagaaacactgcccagggctactgtcgatctcgaggtctggcgctccctgaatgacaagctgcgcctgacacagaattacgaggcctatagtcaccttctgtgctaccttcgcggtctcaataggcaggcagctactgccgaactcaggcgctcacttgcgcatttttgcaccagcctgcagggtctgctgggatccatagctggggtaatggctgccttgggctacccactcccccagccattaccgggaacagaacctacttggaccccgggacccgcacattctgactttttgcaaaagatggatgatttttggctgctgaaggaactgcagacttggttgtggcgaagtgcaaaggattttaataggctcaagaaaaaaatgcagccccctgctgcggcagtcaccctgcatctcggggctcacgggttctag

SEQ ID NO: 217087 - DNA, 648 bp, Artificial Sequence
  Description of Artificial Sequence: Synthetic coding sequence
atgctcgcctgtctgtgcacggtgctgtggcatttgcccgcagtgccagccctcaataggactggagacccagggccaggaccaagtatccagaaaacttacgatttaacccggtacctagagcatcagctaagaagtctcgcaggcacatacctcaactatctgggccctcctttcaacgaacctgacttcaacccgcctcgactaggcgctgagactcttccacgcgcaactgtggaccttgaggtttggaggtcacttaacgacaagctgagactcactcaaaattacgaggcctactcacacctactgtgctacctgagaggattgaaccgacaggccgctacagccgagctgaggcgatctctcgctcatttttgtacctccctacaaggtctgctggggtcgattgcgggagtgatggcagccctggggtatcctttaccacaacctttgcctggtactgaacccacctggacccccggacccgcacattcagactttctacagaagatggatgacttctggctgcttaaggagctgcagacgtggctttggaggtcggccaaggacttcaacaggctcaaaaaaaaaatgcagccgcctgccgctgctgtgacgcttcacttaggcgcacatgggttctag

SEQ ID NO: 217088 - DNA, 1881 bp, Artificial Sequence
  Description of Artificial Sequence: Synthetic coding sequence
atgttggcattcgccgctagaacggttgtgaaaccactgggctttctaaagccattctccttgatgaaggcatcttcccgtttcaaagctcaccaggatgctttgcctaggctccctgtgccacctctgcagcaaagtttagatcactatttgaaggcccttcagccgatcgtgtctgaagaagagtgggcccacacaaagcagctggtagacgagttccaggcctccggaggggtgggagaaaggctgcagaagggcttggaaagacgggctagaaagacggagaattggctaagtgaatggtggcttaagacagcctacctgcagtatagacagccagtggtaatctactcctcaccaggcgtaatgttacccaagcaagactttgtggatttacagggacagctgaggttcgctgccaaactcatcgaaggcgtgttggatttcaaggtgatgattgacaatgagactctacctgtggagtacctgggcggaaaaccgctttgcatgaaccaatactatcagatcttatcgtcctgccgcgtccctggccctaagcaggacacagtttctaactttagtaagacaaaaaaaccaccaactcatattaccgttgtccataactatcaattttttgagctggatgtctatcactcggacggcacccccctgacagcagaccaaattttcgtgcagctggagaaaatttggaatagcagccttcaaactaacaaggagcctgtcggtattctcacatccaaccacaggaatagctgggcaaaggcttacaatacattgattaaggataaggtgaaccgtgacagcgtgcgaagcatacaaaaatctatcttcacggtgtgcttggatgccaccatgcccagagtcagcgaagacgtctacagatcacacgtggcaggccagatgcttcacggcggaggttcaaggctaaactctggcaaccgctggttcgataagactctccagtttattgtggctgaagatgggagttgcggattggtctacgaacacgccgctgccgagggcccaccaatcgtaacactgctcgactacgtgatagaatacacaaaaaaacccgagctcgttaggagccccctagtgcccctccccatgcctaagaaactcaggttcaatatcacaccggagatcaaaagtgacatcgagaaagccaaacagaacttgtccatcatgatacaagatctggacatcaccgtgatggtgtttcaccatttcgggaaggacttcccaaaatctgagaagcttagccccgacgcttttatccagatggcgctgcagcttgcctattatcgtatttacgggcaggcatgtgcaacctacgaatctgccagcttacggatgtttcatctgggtagaactgatacaattcgctctgccagtatggactccttgacattcgtgaaagccatggacgatagctccgtgacggagcatcagaaagtggagctgctgcgtaaggcggtccaggcacacagaggctatacagatagggccatcaggggagaagcattcgaccgtcatctcctgggcctgaaacttcaagccatagaagacctggtctctatgccggatatcttcatggacacttcctacgccatagcaatgcatttccatctcagcacaagtcaagtccccgctaagacggactgtgtgatgttcttcggtccggtggtgcctgacggctacggagtctgttataacccaatggaggcccatattaatttttcactctccgcttacaacagctgtgcagaaaccaatgccgctcgtctggctcactatcttgagaaggccctcctggacatgagggcgctgttgcagagtcatcccagagctaagctctag

SEQ ID NO: 217089 - DNA, 1638 bp, Artificial Sequence
  Description of Artificial Sequence: Synthetic coding sequence
atgttggcctttgcagctaggaccgttgtgaaacctctgggcttcctgaaaccgttcagtttgatgaaggccagttcaaggtttaaggcgcatcaggatgccctgccacggctgcccgtgcctcctctccagcagtcactggatcactaccttaaggcgctacagcccattgtcagtgaagaagagtgggcacacaccaaacaactggtagatgaattccaggctagcggcggagtgggggaacgtttgcagaagggactagagagacgcgcacgcaagacagaaaattggttgagcgagtggtggctgaaaactgcttacctccagtaccgccagcccgtggtaatttactccagtcctggggtgatgctgcctaagcaggatttcgtggacctgcaaggccagctacgattcgctgccaaactgatcgaaggtgtgctcgatttcaaagttatgatagataacgagacgctacctgtagagtacctgggcggaaagcctctttgcatgaaccaatattaccagatcctatcatcctgtagggttcccggacccaagcaggatacagtgtcaaatttctctaaaacaaaaaaaccccctacccacatcacagtggtgcacaactatcagtttttcgagctagatgtatatcactccgacggcaccccactgacagccgatcagatcttcgtacagctggagaaaatttggaactcctctcttcagactaataaggaaccagtaggcattctcacatcaaaccaccggaatagctgggctaaagcctacaacactctaatcaaggacaaagtgaacagggacagtgttcgctccatacagaaaaagaagcctgaactggtgagatctccactagtacccttacccatgccaaaaaaattacgatttaacatcacccccgaaattaaatctgatatcgagaaagcaaaacaaaatctaagtattatgatccaggacttagatatcacggtcatggtattccaccactttggcaaggacttccctaagagcgagaagttgtccccagacgcgttcattcagatggcccttcaactcgcatattatagaatttacggacaggcgtgtgctacgtacgagtcagcatcactgcgaatgttccatctcggacggaccgacacaattaggagtgccagcatggacagccttacttttgtgaaagcgatggacgattccagtgtgactgagcatcagaaagttgaactcctcagaaaagctgtgcaagcacatcggggatacaccgacagagctatacgaggagaggcctttgacaggcacctgctgggcctgaagctgcaggcaattgaagacctggtttctatgcccgatatctttatggacaccagttacgcaatcgctatgcactttcacctgtccacaagtcaggtgcccgcaaaaactgactgcgtcatgttttttggcccagtggtgcccgatggatacggggtgtgctacaaccctatggaggctcacatcaacttctcactcagcgcctacaattcctgtgccgagacaaacgcagctcggctcgcgcattacctggagaaggcactacttgacatgagggccctgttgcagtcccatccaagagccaagctttag

SEQ ID NO: 217090 - DNA, 2322 bp, Artificial Sequence
  Description of Artificial Sequence: Synthetic coding sequence
atggcggaggctcatcaggccgtggccttccagttcaccgtcaccccagatggaattgaccttcggctttctcacgaagctctgagacagatatacttatccgggctgcatagctggaagaaaaagtttattcgcttcaaaaacgggataataaccggtgtttaccccgcaagtcccagtagctggctgatcgtggtcgtgggtgtgatgaccactatgtacgccaaaattgacccctcgcttggaataatcgccaagataaacagaaccttggagacagctaactgcatgtcatctcagaccaagaatgtcgtctctggggtgctgttcggcactggactttgggttgcactgattgtgaccatgcggtactctctgaaggtcttattaagttaccacggttggatgttcaccgagcacggaaagatgagcagggctaccaagatctggatgggcatggtaaagatttttagtggcaggaagccaatgctttacagcttccagacaagcctgccacgcttgcccgtgcctgcagttaaggatactgtaaataggtacttgcagtctgtaagacccctaatgaaagaggaagacttcaagaggatgactgccctagcccaagacttcgccgtgggcctcggccctcggcttcagtggtacctgaagctgaagagctggtgggctaccaactacgtctcggactggtgggaagaatatatctatttacggggtagggggcctctcatggtgaacagtaattactacgctatggatttgctgtatatcttgccgacgcatatacaggctgccagagccggaaatgccattcacgcaattttactttatcgtagaaaactggaccgagaagagattaaaccaattagactgctcggctctactatacctctgtgttcagctcagtgggaacgcatgttcaatacttcccgaattcctggcgaggaaaccgacacaattcagcatatgagggactctaagcacatcgtggtctaccacaggggacgctatttcaaagtgtggctgtaccacgatggaagactgctcaagccgcgtgagatggagcaacagatgcagcgaatcctagataatacttccgagccgcagcctggggaggcgagacttgccgctctcaccgcaggggatcgcgtaccatgggccagatgtagacaggcatacttcgggaggggtaagaataagcaaagcctagacgccgtggagaaggctgccttttttgttaccctggatgaaactgaggaggggtatcggtcagaagatcccgacacctctatggactcatatgcaaagtccctcctccatggaaggtgctacgatcgctggttcgataagagctttacattcgtggtttttaaaaacggcaagatgggtctgaatgctgaacactcctgggcagacgccccaattgttgcccacttgtgggagtacgttatgtctattgatagcctgcagctgggatatgctgaagatggccattgcaagggtgacataaaccctaatataccctacccaactcgattgcagtgggacatccccggagaatgccaggaagttatagagacgtcccttaacaccgcgaatttactggccaatgacgtggacttccacagcttcccgttcgtggccttcggtaaagggattatcaagaaatgtagaacttctcccgacgcatttgttcagctggcgcttcaattagcacattacaaggacatgggcaaattttgcctcacgtacgaggcttcaatgacacggctctttcgggagggccgtacagaaacagtccgttcatgtaccactgagtcttgcgacttcgtgcgagcgatggtggatccggctcagaccgtggaacagcggctgaagctcttcaaactggcttcggagaagcatcagcatatgtatcgcttagccatgaccgggtcaggaattgacagacatttattttgcctgtacgttgtcagcaaatatctggcagtggagtctcccttcctaaaagaagtgctgtcagagccatggcgtctctccacctcacagactccgcagcaacaggttgaattgttcgaccttgagaataatcccgagtatgtctcaagtggtggcggatttggtccagtggccgacgacggatatggcgtatcctacattctggttggggagaacctcataaattttcacatcagctccaagttcagctgcccagaaactgatagccatcggttcggccgtcacctgaaagaagctatgactgacattatcaccttgttcgggctgagctctaattctaaaaagtag

SEQ ID NO: 217091 - DNA, 2271 bp, Artificial Sequence
  Description of Artificial Sequence: Synthetic coding sequence
atggcagaagctcatcaggctgtggccttccagttcacagtgacccctgatggaatagacctgcgactttctcatgaagcactcagacagatttatctctctggactccacagctggaagaaaaaattcatccggttcaagaacgggattattacaggcgtatatcctgcatccccaagtagctggcttatagtggtggtcggagtgatgacgaccatgtacgcaaaaatcgatccttcactcgggatcatcgctaaaatcaataggaccctggaaactgctaattgcatgagttcccagaccaagaatgtagtgtccggcgttctcttcggaacaggattgtgggtcgccttaattgtcacaatgagatacagcctgaaggtactattgtcctatcacggatggatgttcaccgaacacggcaaaatgagtcgtgcgacgaagatttggatgggcatggtgaaaatatttagcggcaggaagccaatgctctactcatttcagaccagtctccctcgactccccgtgcccgcagtgaaagacactgtcaacaggtacctccagtcagtgcgcccactgatgaaggaagaggactttaaaagaatgactgctctggcccaggacttcgcagttgggctgggccctcgactccagtggtaccttaaattgaaatcatggtgggcaactaactacgtgagtgactggtgggaggagtatatctacctgagggggcgaggcccacttatggtcaactctaattattatgctatggaccttttatacatactgcctacgcatatccaggcagctagggccggaaacgccatacatgcaatcctcttgtacagacggaaattggatagagaggagatcaagccgattcggctcctggggagcacaataccgttgtgcagcgcgcagtgggagcgaatgtttaatacatccagaatccccggagaagagactgacacaatccaacacatgagggattctaaacatatcgtggtctaccatcgtggcaggtacttcaaagtttggctataccacgatgggaggctgctgaagcctagagagatggagcagcagatgcagagaatcctagataacaccagcgagcctcagcccggtgaagccaggttggctgcccttacagccggagacagggtaccatgggctagatgccgccaagcatactttggaagaggtaaaaacaagcagtctctggacgctgtcgaaaaagcggctttttttgtcactctggatgagacagaggagggataccggagcgaagatccggacacctctatggactcttacgctaaaagcctgttgcatggtcggtgttacgaccgttggttcgacaagagtttcacgttcgtggtctttaagaacgggaagatgggacttaatgctgagcactcatgggcagacgctccaatagtggcccatctgtgggagtacgttatgtcgattgactccctccagctgggctacgctgaggacggacactgtaagggggatattaacccaaatatcccatatcccacccggctgcaatgggatattcctggggagtgccaggaggttattgagacttccttgaacacggcaaacctgctggcgaacgatgtagatttccattctttccctttcgtcgcttttggaaaagggatcattaaaaaatgtcgcacttctccagatgcatttgtccagctggcattgcagctagcccactataaagacatgggcaaattctgtctgacatatgaggccagtatgacacgcctttttcgggaggggcgaaccgagacggtgaggtcatgtactacagaaagctgcgatttcgtgagagccatggtggatcctgctcagacagttgaacagcgcctaaaattgttcaaactggcgagcgagaaacaccaacatatgtatcggctagctatgaccgggtcaggtatagaccggcacctgttttgtctttacgtggtgtccaagtacctcgctgtagagtctccatttctgaaagaggtcctctccgaaccgtggcgcctgagtacttcacagactccacagcagcaggttgagttgttcgatctggaaaataacccggagtatgtatctagcggcggagggttcggacccgtggccgacgacgggtatggcgtgagctacatcctggttggggagaatctcatcaactttcatataagcagtaagttttcttgcccagagactgggatcatttcacagggaccttcatctgatacatag

SEQ ID NO: 217092 - DNA, 2322 bp, Artificial Sequence
  Description of Artificial Sequence: Synthetic coding sequence
atggcagaagcgcaccaggccgtggcctttcaattcactgtgacgcctgatggaatcgatctccggttaagtcacgaggcactgagacagatatatctgagtgggctccattcatggaagaaaaagtttatccggttcaagaacgggatcattactggagtatatccggctagcccttcctcatggctaatcgtggttgtgggtgtgatgacaaccatgtatgcaaagattgacccttcactgggtattatcgccaaaattaatcggacgctggagacggctaattgtatgtcctcacaaacgaagaacgtggtcagtggagtactgttcggaaccggcctgtgggttgccctgattgtcactatgaggtacagcttaaaagtactgctgtcctatcacggttggatgttcacagagcatgggaagatgagcagagccactaaaatctggatggggatggtcaaaatcttttctggtagaaaacccatgctctacagtttccaaacaagtctgcctcgactgcctgtgcccgcagttaaagataccgtgaaccgctacttgcagtcagttcgcccactgatgaaagaggaagatttcaagcggatgaccgcactggcccaagacttcgcagtgggactcggccctagacttcaatggtacttgaagctcaagtcgtggtgggcaactaattacgtgagtgactggtgggaggagtacatttatctgcgcggaagaggcccactgatggttaacagtaattactacgcaatggacctgctgtatatacttcccactcacattcaagcggctagggctggaaatgcgattcatgcaattctgttgtatcgcagaaaacttgatagagaagagataaagccaatccggctgctcggcagtacaattcccctctgctctgcacagtgggagcgtatgttcaacactagtaggatcccaggagaagagacagataccatccagcacatgcgggactccaaacacatcgtggtctatcacaggggcaggtactttaaagtctggttgtaccacgatggcagactcctgaaacctcgggagatggagcagcagatgcagaggatcctggacaatacatctgagccacaacctggcgaagcgaggctcgccgctttgacagctggggatagggtaccttgggccagatgccgccaggcatattttggcagaggaaagaacaaacaaagcctggatgctgtcgagaaggctgcctttttcgtgacactggatgaaacggaggaaggttatagaagtgaagaccctgatacttccatggactcgtacgccaagtccctgttgcatggacggtgctatgatagatggttcgataagagtttcacattcgtggtctttaagaacggcaagatgggactgaacgcagagcacagttgggccgacgctcctatagttgcgcacctgtgggaatacgtaatgtccatcgacagcctgcagttgggctatgccgaggacggccactgtaaaggagatattaatcccaatatcccatacccaacacgcttacaatgggacatccctggagaatgtcaagaggtgattgagacttctctgaacacagcaaacctactggccaacgatgtggacttccactccttcccatttgtggcctttgggaaggggatcatcaaaaagtgcaggacttcacccgatgcctttgtccagttggctctgcaactcgcacactacaaagatatgggcaagttttgtctgacatacgaggccagcatgacccgtttatttcgcgagggtaggacagaaacggtacgctcatgtactaccgagagctgcgacttcgtgcgcgcaatggtggatccggcacagacagttgaacaacggctgaaacttttcaaactagcctccgagaaacaccagcacatgtataggctcgcaatgacgggctccggaatagaccgtcatctgttctgcctgtatgtagtttccaaatatctggccgtagagtctccttttctgaaggaagtgctgagcgagccctggagactgtctacttcgcagactccacaacagcaggtagaactttttgaccttgaaaacaaccccgagtacgtgagctcaggcggaggctttggacccgtagccgatgatggctacggggtatcctatatcctcgtgggggaaaatctgataaatttccatattagcagtaagtttagctgccccgaaacagactcccacagatttgggaggcacctcaaagaagctatgacagacataatcaccttatttggactttcgagcaatagcaaaaagtag

SEQ ID NO: 217093 - DNA, 2322 bp, Artificial Sequence
  Description of Artificial Sequence: Synthetic coding sequence
atggccgaggctcaccaagctgttgcctttcagtttacagtgacccctgacggcatcgatttgcgattgtctcatgaggccctgcggcagatctacctcagcggactccacagttggaagaaaaagtttatccggtttaaaaatggaatcataactggagtgtaccctgccagcccatcaagctggctcatcgtggtcgttggcgtaatgactacaatgtacgctaagattgacccatctctgggcataatcgccaagattaaccgcactctagaaactgccaattgtatgtcctcgcagactaaaaacgtcgtgtcaggagtattgttcggcactggactgtgggttgccctcattgtcacgatgagatattccctcaaagtgctgctgagttaccatggatggatgtttacagaacacgggaaaatgtcaagagcaacaaaaatctggatgggtatggttaagattttctcagggagaaagcctatgctgtactctttccagacaagcctgcccagactgccagtccctgccgtgaaagacactgtgaatcgctaccttcaatccgtccgccctctcatgaaggaggaagattttaagagaatgaccgcgttggctcaggatttcgccgtggggcttggacccaggttgcagtggtacctcaagctcaaatcgtggtgggccacaaattacgtatccgattggtgggaggaatatatttacctgcgtggtcgcggaccactaatggtgaactcaaattactacgcaatggacctattgtacatcctacctacccacattcaggccgctcgggctgggaacgccatccacgccatccttctctataggagaaaattggaccgagaagagattaaacccatccggcttcttgggtccacgattcctctttgctcagcacagtgggaaagaatgtttaatacaagccggattcctggcgaggagacggatactatccaacacatgagggatagtaagcacatcgttgtataccatcggggacggtattttaaggtatggctttatcatgatggtcggcttcttaagccaagggagatggagcagcagatgcagcgaatcctggacaatactagtgaacctcagccaggggaggcacgcctcgccgcacttacagcaggagacagagtgccttgggctaggtgccgacaggcctacttcgggaggggaaaaaataaacaaagtctagacgccgtcgagaaggccgctttcttcgtcaccttggatgagactgaagaaggttaccgtagcgaagaccctgacaccagtatggactcatatgccaagtccctcctgcacgggaggtgctatgaccgctggtttgataaaagcttcacattcgttgtgtttaaaaacgggaaaatgggtcttaatgcagagcactcttgggccgatgctcctatagtggcacacttatgggaatatgttatgtcgatagatagtctgcaactgggatatgcagaggacgggcattgcaaaggggatattaaccctaatatcccctaccccactcggctgcagtgggatatccccggtgagtgtcaggaggtcattgaaaccagcctaaacactgctaacctgttggccaacgatgtggacttccacagcttccccttcgtagcatttggaaagggcatcatcaagaagtgcagaacctcccccgacgctttcgtgcaactggcacttcaactcgctcactacaaggatatgggaaagttctgtttgacgtatgaggcctcgatgactcgattatttcgcgaggggaggacggaaacagtgaggtcgtgcacaaccgagtcatgtgattttgtgcgagctatggtcgatcctgcccagactgtggagcagagactaaagctgtttaagctggcgagcgagaagcaccaacatatgtatagactcgcaatgacaggcagcggcatagaccggcacctgttctgtttgtatgtcgtttccaagtatctcgctgtggagtctcctttcttaaaggaggtgctgtcagaaccctggcgactgtctacatcccagacccctcagcagcaggtggagctgttcgacttggagaataaccccgagtacgttagtagcggagggggatttggccctgtggctgacgatgggtacggagtgtcatacatcctagtgggggaaaatctgatcaactttcacatttcaagcaagttttcctgtcctgaaacagactctcataggtttggcagacacctgaaagaagccatgaccgacatcattacgctgttcggcctcagcagtaattccaagaaatag

SEQ ID NO: 217094 - DNA, 2271 bp, Artificial Sequence
  Description of Artificial Sequence: Synthetic coding sequence
atggccgaggctcatcaagccgtggcatttcagtttaccgttacaccagacggcattgacctcagactgtcacacgaagctcttcggcagatatatttgtcggggctgcacagctggaagaaaaagttcattcggtttaagaatggcatcatcactggggtgtatcccgcttctccatctagttggcttattgtggtcgttggtgtgatgacaaccatgtatgccaagatcgaccccagtcttggaatcatcgccaagatcaatcgtaccctggagacagcaaattgtatgtcctcacagacgaaaaacgtggtgagcggagtcttgttcgggacgggactctgggtggcgctgattgtgacaatgcgctactcattaaaagtgcttctgagctaccacggatggatgttcacagaacatggaaagatgagccgagctaccaaaatttggatgggcatggtgaagattttctcaggaagaaagcccatgttgtatagttttcagacctctctgcccagactgcctgttccagccgtaaaagacaccgttaatcgctatctgcagtccgtaaggcccctgatgaaggaagaggacttcaagcgtatgacagccctggcacaggacttcgctgttggacttggccctagactccagtggtacctgaaattaaaatcctggtgggctacgaattacgtgagcgactggtgggaagagtatatctatctgagaggaagagggccactgatggtcaacagtaattattacgcaatggatcttctgtatatccttcccacgcacatccaggcagcacgggcaggtaatgccattcacgccattttgctctatagacggaaactcgatagagaggaaatcaaacccatacgactgctgggctctaccatccctctatgttcagcccagtgggagcgtatgtttaacactagccgcattccaggcgaggaaaccgacaccattcaacatatgagagactctaagcatattgtagtgtaccaccggggtcgctacttcaaagtgtggttgtatcacgacggacgcctcctgaaacctagggagatggagcagcagatgcagcgtatcctggacaacacgagcgaaccccaacctggggaggcaaggctcgctgctcttacagcaggtgacagggtgccgtgggctagatgtaggcaggcttattttggtcgcggtaaaaataaacagtcattggacgctgttgagaaagccgctttttttgtgaccctcgacgaaacggaggaaggctatcgctcagaggatcctgacacgagcatggatagttacgctaaatccttactccacggcaggtgctacgataggtggtttgacaagtcattcacctttgtggtgttcaagaatggaaagatgggtctgaacgctgagcactcgtgggcagatgctcctatcgtcgctcacctctgggagtacgttatgagtatagatagcctgcagctggggtacgcagaggacggccactgtaaaggtgacattaaccccaatattccctatcctaccaggttgcagtgggacatccccggagagtgccaagaagtaattgagaccagcctgaacacagctaacttattagcaaatgatgttgattttcactcctttccctttgtggcttttggcaaagggattattaagaagtgcagaacttctccagatgcattcgtgcaactggcactgcagctggctcattacaaagatatggggaagttctgtcttacttacgaggcatcgatgactcgcctcttcagagagggaagaaccgagacagtgagatcatgcaccacagagagctgcgattttgtacgtgcgatggtggatccagcacaaacggtcgagcagagactgaagttgttcaaactcgctagcgaaaaacatcaacacatgtatcgcctggcaatgaccgggagtgggatcgatcggcatctgttctgcctgtacgtggtgagcaagtatctggcagtggaaagcccttttctgaaggaggtccttagcgaaccctggcggctgtcaacatcccaaaccccacaacaacaggtcgagctgtttgatcttgagaataacccggagtacgtgtccagcgggggagggtttggccctgtcgcggacgacggttatggggtttcctatatcttagtcggggagaatctcattaacttccacatttcatcaaagttcagttgtcctgagacaggaattattagccagggaccctccagtgacacctag

SEQ ID NO: 217095 - DNA, 2319 bp, Artificial Sequence
  Description of Artificial Sequence: Synthetic coding sequence
atggctgaggcccatcaagctgtcgctttccagttcactgttacacccgacggggtcgattttcggctgagccgcgaggcccttaagcatgtttatctcagtggcatcaacagctggaagaagagattgatcaggatcaagaacggcatcctcagaggagtgtaccccggaagtccaacatcttggcttgtcgtcatcatggcaaccgtgggatcttccttttgcaacgtggatatctctctcgggcttgtaagttgtatccagagatgtctgccacagggttgcgggccatatcagactccccagactcgggcactgctgtcaatggctatcttctctaccggagtctgggtcacaggcatcttttttttcagacagactcttaagctgctgttgtgttatcatggctggatgtttgagatgcacgggaaaacttccaacctgacacgaatctgggcgatgtgcatcagattactgagctccagacaccccatgttgtacagcttccaaaccagtctgccgaaattgcctgttcctcgcgttagcgcgactattcagcgctacctggagtcagtgagaccgttactggacgacgaagagtactaccgcatggaattacttgcgaaggaattccaggataagacagctcccaggttgcagaagtatctcgtgctaaaaagctggtgggccagcaactacgtttcagattggtgggaggagtacatctacctgcgcggacgttccccgctgatggttaactcaaattattacgttatggatctggtgctgattaaaaacacagacgtccaggcagctagactgggcaatatcatacacgctatgatcatgtatcgtcgcaagctggatagggaagaaattaagcctgtgatggctctgggtattgtgccaatgtgttcctatcaaatggaacgcatgtttaacacaacccggattcctggcaaagatacagatgtattacagcacctttccgactctcgacacgtagcagtataccataaagggaggttctttaaactgtggctttacgaaggcgcacgtctcctgaagccacaggacctcgaaatgcaattccagcggatcttggacgacccatccccaccccagcccggtgaggaaaaattagccgctctgacagcaggcggtcgagttgagtgggcccaggcacggcaggctttcttttcctcggggaagaacaaagcagcattggaggccatcgagagagcagctttctttgtggcattggatgaggaaagctattcatatgacccagaggacgaggcttctctgtctctgtatgggaaagccctcctgcatgggaactgctataataggtggttcgataaatccttcacactcatctcctttaagaacggacaactgggattaaatgcagaacacgcctgggccgacgccccaatcatcggacatttatgggagttcgtgctcggtactgattcattccacctgggctacacagaaactggtcattgtctgggtaagcctaaccccgctctcgcccctccgacccgtctccaatgggatattcctaagcagtgtcaagccgtgatagaatcctcgtaccaggtcgccaaagctctcgccgacgatgttgaactctattgctttcagtttctgcccttcggcaaagggctgattaagaagtgcagaacttccccagacgcgttcgtgcaaatcgcgctgcagctggcacatttccgcgatagaggcaagttttgccttacatatgaggcgtcaatgacccggatgttccgggagggaagaaccgaaacagttagatcctgtacatccgagtccacagcattcgtccaggctatgatggagggtagccatacaaaggccgatctaagagatctctttcagaaagccgcaaagaaacatcagaacatgtatcgcttggccatgacaggggcaggcattgaccgacacctattttgcctttacttggtctctaagtatttaggtgtttcatcccccttcctcgcagaggtcctgagcgagccatggcgcctgagcacttcccaaatccctcagagtcagattagaatgtttgacccagagcagcacccgaaccacctaggcgcaggtgggggttttggacctgtggctgacgatggctacggcgtctcatatatgatcgcaggcgagaacacaatcttttttcacatctcttctaagttctcatcttccgaaacaaacgcacagagattcgggaaccacattcgcaaggctctgctggacatcgcagatttgtttcaggtgcctaaagcctacagctag

SEQ ID NO: 217096 - DNA, 2319 bp, Artificial Sequence
  Description of Artificial Sequence: Synthetic coding sequence
atggcagaagcccatcaggcagttgcatttcagtttacggtgacaccggacggagttgatttcagattaagccgggaggccctgaaacacgtttacctgagtggcattaacagttggaagaagcggctgatacggattaaaaacggcatcctgcgcggtgtgtatcccggatcccctacctcttggctggtcgtcattatggcaactgtgggaagttcattttgcaatgtggatatctcattgggcttagtttcatgtatccagcggtgtttaccccaaggatgcggtccatatcagacgcctcagacccgtgctctcctgagcatggccatcttttcaactggcgtttgggtcacaggcatctttttctttcggcagacactcaagctgcttttgtgctaccacgggtggatgtttgagatgcatggaaagacgagtaatctcacccgcatctgggctatgtgcatccgcctcttgagctccagacatcccatgttgtactctttccagacaagcctgcctaaattgcccgtgcccagggtcagtgcaacaattcagaggtatttagagtctgtgcggcctctgctggatgatgaggagtactaccgaatggagcttctcgccaaggagtttcaggacaaaaccgcacccagactccagaagtacttagtacttaaatcttggtgggctagtaattacgtgtcagattggtgggaagagtatatctatttgcgcggacggtctccactgatggtgaattcaaattactacgtcatggatttggtgctgatcaagaacactgatgtacaagctgccaggcttggcaacattattcacgctatgatcatgtacaggcgtaaactggatagagaagagattaagccggtcatggccctagggatagtgccaatgtgttcttaccagatggaaaggatgtttaatactacaagaatacctggaaaagatactgatgttttgcagcatttaagcgactcacgacacgtagcagtataccacaagggcaggttctttaaactgtggttgtacgaaggagccagactactgaaaccccaggacctggagatgcagttccagcgcatcttggacgacccaagtccacctcagccaggcgaggagaaactggctgcactgactgccggtgggagagtagaatgggcccaagcccgacaggcatttttctcctctggcaaaaataaagccgcactggaagcgatcgagcgtgcggctttttttgttgccctggacgaagaatcttactcctacgaccccgaagacgaggctagtctatcgctctacggcaaagctctgctgcatggtaactgctacaacagatggttcgacaaatccttcacactcattagcttcaaaaacggacagctcggtttgaacgctgagcacgcctgggcggatgccccaatcattgggcatctctgggagttcgtgctgggaacggattctttccatctcggctatacggaaaccggccactgccttggcaaacctaacccggcactggcccctcctacgcgactgcagtgggatattcccaagcagtgtcaagccgtaatagaatccagctaccaagtggccaaggcacttgccgacgatgtggagctatattgtttccaattcctcccttttggcaaaggcttgatcaaaaaatgtcgaaccagccctgacgcattcgtgcagatcgcactacagcttgcccattttagagacagggggaagttttgcttaacgtatgaggcatccatgacacgcatgtttcgcgaggggaggaccgaaacagtgcgctcgtgcacaagtgaaagcacagcgtttgtccaagcaatgatggaaggctcccatacaaaggctgacctgcgagacctgtttcagaaggcagcaaaaaaacatcagaacatgtatcgcctggctatgacaggagctggcattgacagacatctgttttgtttgtacttggtttctaagtatttgggcgtttcctctccctttcttgccgaggtgttatccgaaccttggcgcctgagcacatcccagataccacaatctcagatccggatgttcgacccagagcaacatcctaatcatcttggcgctgggggaggatttggacccgtggcggacgatgggtatggtgttagctatatgattgctggcgagaacaccatttttttccacatctcatccaaattcagcagctccgaaactaatgcccaacggttcgggaatcacatccgcaaggcattgttagacatcgcagacttattccaggttcctaaggcctacagctag

SEQ ID NO: 217097 - DNA, 2319 bp, Artificial Sequence
  Description of Artificial Sequence: Synthetic coding sequence
atggccgaggctcaccaagctgtggctttccaattcaccgtgaccccagacggcgtggattttcgtctttcaagggaagcattgaagcatgtctacctgtctggcatcaacagctggaagaaacgcctcattcgcataaaaaatggtatactgagaggcgtgtaccctgggagccctacaagctggctggtcgtgatcatggctaccgtgggctcctctttttgcaatgtcgatatctccttaggactggtatcctgcatccaacgatgccttccacagggctgcggaccctaccagacacctcagaccagggcactactctccatggcgatcttctcaactggagtgtgggtaactggtattttcttttttagacaaaccttgaagctcctgctgtgctaccacggatggatgtttgagatgcacggaaagactagtaacctgacgcgcatatgggccatgtgcattcgcttacttagctccagacatcccatgctctatagtttccagacttccctgcctaagttgccggtccctcgcgtgtctgccactatccaacgctacctcgagagcgtgcggcctctgttagacgacgaagagtattatcggatggaactgctcgccaaggaattccaggacaagacagccccacggctgcagaagtacctcgtcctgaaatcctggtgggcctccaattatgtctctgactggtgggaagagtatatttatctgcgagggcgaagccctctgatggtcaattcgaactactacgtgatggatctggttctgatcaagaacacagatgtgcaagctgcaaggttgggcaacatcatccacgctatgatcatgtaccgcagaaagttagatagagaggaaattaagcctgtcatggcactgggaatcgttcccatgtgctcttatcaaatggagagaatgtttaatacaactcgaattccaggcaaagatacggacgtgctccaacatctgtctgattccaggcatgtggcagtctaccataaagggagattcttcaagttgtggctctacgagggagccaggctgctgaaaccccaggacctagagatgcaatttcagaggattctggatgacccttcgccccctcagccaggcgaggagaagcttgctgccttgacagcgggtggcagggtggagtgggcccaggccaggcaagcctttttcagttcgggcaaaaacaaggcagcgcttgaggccatcgagagggctgcctttttcgttgcacttgatgaagaatcatattcttacgaccctgaggacgaggcctccttgtctctctatggcaaagccttgcttcatggcaattgttacaatcgttggttcgataaatcctttactcttatatcattcaaaaacggacaactgggtctcaacgccgagcacgcgtgggccgatgcccctattattggccatctgtgggagttcgtgctgggtaccgattcctttcacctgggatacaccgagaccggccactgtctcggcaagccaaacccagcgctcgccccaccgacgcggctgcagtgggacattcccaagcagtgccaggccgtgatcgaatcaagctaccaggtcgctaaggctttggccgacgacgtcgagctgtattgctttcagtttctgcctttcggcaaggggttaataaaaaagtgccgaacgtcccccgacgcgtttgtgcagatcgcattgcagcttgcccacttcagggaccgaggaaagttctgtctgacctacgaagctagtatgacacgcatgttccgcgagggcagaacggaaactgttaggagctgcacaagcgagtctacagcgtttgtgcaggccatgatggagggcagccatacaaaggccgatcttcgggatctctttcagaaagctgccaagaaacaccagaatatgtaccggctggctatgacaggggctggcatcgaccgccatctgttttgtctttacttggtgtcaaaataccttggggtcagctcaccttttttagccgaggtactgtcagagccatggagactgtctacttcacaaatcccacagtctcagattcggatgtttgatcccgaacagcatcccaatcatctgggtgccggtggtgggttcgggcctgtggccgacgacggctacggtgtttcctacatgattgctggagagaacaccattttctttcacatttcctctaagttcagctcctcagaaactaacgcccagcgattcggcaaccacatcaggaaggccctcttggacattgccgacctcttccaggtgccaaaggcctacagctag

SEQ ID NO: 217098 - DNA, 2319 bp, Artificial Sequence
  Description of Artificial Sequence: Synthetic coding sequence
atggcagaagcccaccaagctgttgcctttcaatttacagtaactcctgacggggtggatttcagactgagtcgagaagccctgaagcatgtatacctgtcaggaatcaatagctggaaaaaaagactcatcagaatcaaaaatgggatcctgcggggagtttatccgggatccccaacgtcttggctcgttgtgattatggccacagtcggatcatcattttgtaacgtggacattagcctagggctcgtgagttgtatccaacgctgccttccgcagggatgcggcccataccaaactcctcagactagagcccttctctccatggccatcttttcgacaggagtatgggtaacaggtattttcttcttcaggcagacgctgaaattgctactctgttaccatgggtggatgttcgaaatgcacggcaagacgagtaatctgacacggatctgggcaatgtgcattcggctactgagttcacggcatcccatgctgtattcctttcaaacaagtcttcctaagctaccggtgccgagggtttccgccacaatccagcggtacctggagtcagtgcggccacttcttgacgacgaagagtactatcgcatggaactgctagccaaagagtttcaggataagactgctccacgattacagaaatatctcgtgcttaaaagctggtgggctagcaactatgtatccgattggtgggaggaatatatctacttgcgcggaaggtcacctttaatggttaacagtaattactacgtgatggatctggtgttaatcaaaaatactgacgtgcaggccgctagactgggtaacattattcacgccatgatcatgtacaggcgtaagctggacagagaagaaattaagcccgtgatggccctggggattgtgcccatgtgctcatatcagatggagcgaatgtttaatacgaccaggatcccaggtaaagacactgacgtcctgcaacacctgagtgatagccgccacgtggctgtgtatcacaaaggaagattctttaaactgtggctctacgaaggggctcggcttttaaagcctcaagacctcgagatgcagtttcagcgcatcctggacgacccaagccctccccagcctggagaggagaagcttgctgccttgactgccggaggtcgcgtggaatgggcgcaggcacggcaggccttcttctcatctggtaaaaataaagctgcattagaagctattgagcgggcagccttcttcgttgcattggatgaggagtcatacagttacgatcccgaggatgaagcaagcctgagtctctatgggaaagctcttctgcacgggaattgttacaaccggtggttcgacaaaagcttcacactgatcagctttaagaacggccagctgggccttaatgcggaacatgcttgggcggacgcacctattatcggacacttatgggagttcgtgctggggaccgattcctttcaccttggttacaccgaaaccggacattgtctgggcaagcctaacccggctctcgctcctcctactagattgcaatgggacattcccaagcagtgccaggcagtgatcgaatcatcataccaagtggctaaggcactggctgatgatgtagagctttattgttttcagttcttgcccttcgggaagggcctcattaagaagtgtagaacttccccagacgcattcgtgcagatcgccctccagctagcacacttccgggaccgcggtaaattttgtctgacctatgaagcttctatgacacgaatgttcagagaaggtaggactgagacagtaagatcgtgtacaagcgaaagcacggcctttgtacaggcaatgatggaggggtctcatactaaagcagatctgagagaccttttccagaaagcagccaagaaacaccagaacatgtatcgattggctatgactggggcaggcattgacagacacctattctgtctgtatttggtgagtaagtatctcggggtatcatctcccttcctggctgaggtgctgtcagagccctggcgtctttccactagtcagatccctcaaagtcagatacgtatgttcgatcccgagcagcaccccaaccatctgggagctggtggtggttttggacccgttgccgacgacggttacggagtgtcctacatgatcgctggggaaaataccatcttctttcacatttccagtaagttctccagctccgagaccaacgctcagagatttggtaatcacatcagaaaagccctactcgatatcgctgacctcttccaggtgcctaaggcatacagttag

SEQ ID NO: 217099 - DNA, 378 bp, Artificial Sequence
  Description of Artificial Sequence: Synthetic coding sequence
atggcggaagcccatcaggccgtggctttccagttcactgttacgccagacggagtagactttcggctgtcacgtgaggctctgaagcacgtgtacctgtccggaatcaactcctggaagaagaggctcatcaggatcaaaaatggaatcttaaggggtgtgtaccctgggtctccaacctcatggctcgtggtcattatggccaccgtgggaagctctttctgtaacgtcgatataagtctgggtctggtaagttgcatccagcggtgtctcccgcaaggttgtggtccttaccagactccgcagactcgtgccctgctcagtatggccatcttcagtacaggtgtgtgggtcacaggtatttttttctttcggtag

SEQ ID NO: 217100 - DNA, 1704 bp, Artificial Sequence
  Description of Artificial Sequence: Synthetic coding sequence
atggaacttctggctaaagaatttcaagataagaccgcccctcgtctgcagaagtacctcgtgttgaaatcctggtgggcgagcaattacgtcagcgattggtgggaggagtatatctaccttaggggaaggtctcccctgatggtcaattccaattattacgtgatggaccttgtcttgatcaaaaacaccgatgtccaggccgctcgtctgggcaacattattcatgcgatgataatgtaccgccgtaaactcgacagggaggaaatcaagcctgttatggccctggggatcgtcccaatgtgcagttatcaaatggaacgcatgtttaataccacccgtatcccaggcaaagataccgatgtcctacagcatctctctgattctagacatgtcgctgtctatcacaagggacgcttcttcaagttgtggctctatgaaggcgctaggctgttgaaaccccaggatctggaaatgcagtttcagcgtattctggacgacccttctccaccccaaccgggagaggagaagctggccgctctgacggctggaggaagggttgagtgggcccaagccaggcaggccttttttagttccggcaagaacaaagccgcacttgaggcaattgagcgcgctgcattctttgttgctctagacgaggaaagttattcctacgatccagaggacgaggcctccctgagtctctatggaaaggccctcttacacgggaactgttataacaggtggtttgacaagtcttttacccttattagcttcaagaacggccaattgggcctgaatgccgagcatgcctgggcggatgctccaattataggccacctgtgggagtttgtactagggacagatagctttcatctcgggtatacagaaacaggccactgcctggggaaacctaatccagccctagcccctcctacccggttgcaatgggacattccaaagcaagccgtaattgaatcttcttatcaagtcgccaaagccctggcagatgacgtggaactgtattgttttcagtttctgccattcggaaagggcttgatcaagaagtgtcgaacaagtcccgatgccttcgtgcagatagcattgcagctggctcatttcagagataggggaaagttctgtctcacttacgaggcctcaatgacaaggatgttcagggagggtcgtaccgagaccgttcggtcttgtacgagtgaaagtaccgcattcgtccaggccatgatggagggaagccatacaaaggctgacctgagggacttgtttcagaaagccgctaagaaacaccagaatatgtatcgcctggcaatgactggggcaggcatcgacagacatctgttttgtctgtatcttgtgtctaaatatttgggggtttcttctcctttcctcgccgaagtgctaagcgagccttggcgcttgagtacatcccagattccgcagtctcagatacgcatgtttgatccggaacagcaccccaaccatctcggagctggtgggggtttcgggcctgtcgcagacgatggttatggggtgtcctacatgattgctggtgagaatacaatcttttttcacattagctcaaagttttcatccagcgagaccaatgcacaacggttcggaaatcatattaggaaagccctccttgacattgccgatctgttccaagtgcccaaagcctactcatag

SEQ ID NO: 217101 - DNA, 2076 bp, Artificial Sequence
  Description of Artificial Sequence: Synthetic coding sequence
atggctgaggcccaccaggccgttgccttccagtttaccgtgactcctgacggcgtggatttcagactgtccagggaggctttgaagcatgtgtatctgtctgggattaacagctggaagaagcgcttgatacgcataaagaacggtattctgcgcggagtctaccctggatccccaacatcatggctggtggtgatcatggcgactgtgggcagctccttctgtaatgtcgatatcagcttggggttggtgagctgcattcagagatgtctacctcaggggtgtggaccgtaccagactccgcaaacccgagcactattatccatggccatatttagtaccggagtttgggttacgggcatcttcttctttaggcagacgctcaagttgctgctgtgctatcacggctggatgtttgaaatgcacggaaaaacttccaacctgacccgcatctgggccatgtgcatccgcctcctcagcagtcgccacccaatgctgtattcatttcagacttcgttgccaaagctgccagtgcctcgggtgtctgctacgatacaacgatatcttgagtccgtgcggccactgttagacgatgaggagtactacagaatggagctgctcgcaaaagaattccaagacaagaccgcccctcgcctgcagaagtatctggtactcaagtcctggtgggccagtaattatgtatcagattggtgggaggagtacatttacctgaggggtcgcagcccgctcatggtgaacagtaattactacgtcatggacctcgtgctgattaagaacaccgatgttcaggctgcaaggctggggaatataattcatgcaatgattatgtacagacgcaagcttgaccgcgaggaaattaaacctgtaatggccctgggcatcgtacctatgtgctcctatcagatggagcggatgttcaatacaacaagaatcccgggaaaagataccgacgtgctgcaacacctttcggattcccgccacgtggcggtgtaccacaagggaaggttttttaagctatggctgtatgaaggtgctaggctcttgtcactgtatggcaaagcgctgctgcacggaaactgttacaacagatggtttgacaaatcattcaccctgatttcttttaagaacggtcagctcggtctgaatgccgaacatgcttgggctgacgctcctattattggtcacctctgggagttcgtgttgggtactgactcatttcacctgggatacactgagaccggtcattgtctgggtaaaccaaacccggctctagcccctcctacaagactgcagtgggacatcccgaagcagtgtcaagcagtcatagaatcatcctatcaggtggcgaaggctcttgcagatgatgtcgagctatattgctttcagtttctccccttcggtaagggactgataaaaaaatgcagaaccagtccagacgcgttcgtgcagattgcattgcagctcgcgcacttcagggaccgcggaaaattctgtcttacttatgaggcctctatgactaggatgtttcgagagggacgaaccgagacggtacgtagctgtaccagcgagagtacagcatttgttcaagccatgatggagggatctcacacaaaggctgacctgagggatctgttccagaaagctgcgaagaagcaccagaatatgtatcgactcgcgatgactggagccggaattgatcgccatctattttgcctctaccttgtgagtaaatatctgggcgtcagttctccctttctcgccgaggtcctttctgaaccttggagattgagtaccagtcagatcccgcagtctcaaattaggatgttcgatcccgagcagcatccgaaccatctgggcgcagggggagggtttgggcctgtggccgacgacggttacggtgtgtcttacatgattgcaggcgaaaacaccattttcttccacatatcttctaagttttcaagcagcgagacaaacgctcagaggtttggcaaccatatccgaaaggcactgctcgatatcgcggacctgtttcaggtcccaaaggcatacagttag

SEQ ID NO: 217102 - DNA, 2217 bp, Artificial Sequence
  Description of Artificial Sequence: Synthetic coding sequence
atggccgaagcccatcaggcggtagcctttcagtttaccgtaaccccagatggtgtagacttccggttatcccgggaagccttgaagcatgtgtacctgtctggcattaacagctggaaaaaaagactgattcgcattaaaaatggaatcttgcgcggagtttaccccggtagccctactagctggttggtggtcattatggcaactgtaggttcttctttctgcaatgttgacatcagcctaggcttggtgtcctgtatccagcgctgccttccccagggatgtggtccttatcaaacgccccaaactcgggcactgttatcaatggccatctttagtacgggagtttgggtgaccgggatatttttcttcagacagactctgaagttactcttgtgctaccatggttggatgttcgagatgcacgggaagacgagcaatctgactcgtatttgggcctacctagagagcgtgcgcccactgctggatgacgaagagtactaccgcatggagctactggccaaggagttccaggataagacagcacctcgtctgcagaagtatctcgtactgaaatcatggtgggccagtaattatgtctcagattggtgggaggagtatatttacctcagaggtcgatctccgctcatggtgaattctaattactacgtcatggatctggtgcttattaagaatactgatgtgcaggcagctaggttgggaaacattattcacgccatgatcatgtaccggcgaaagctggatcgtgaagaaattaagcccgttatggcgttaggcattgtgccaatgtgtagctaccagatggagcgcatgttcaacaccacccgcattcccggtaaggataccgacgtccttcaacacctttccgacagcaggcacgtggctgtgtatcacaagggaaggttttttaagctgtggctatatgaaggggctagactccttaagccgcaggacttagaaatgcaatttcagcggatattggatgaccccagtccgccacagcctggggaggaaaagctggccgcattgactgccggaggaagggtcgagtgggcgcaagccaggcaggcatttttcagttcggggaagaacaaggccgcactggaggcgattgaacgtgcggcattttttgtggctctcgatgaagagagttactcttacgacccagaggatgaggcatcactgtccctatacggcaaagccctcctgcatggtaattgttataaccggtggttcgataagtcttttacactgattagttttaagaacggtcagttaggcttgaacgcagagcatgcatgggccgacgctccgattattgggcatctctgggagttcgttctggggacagacagctttcacttaggctatacagagacagggcactgtctcggcaaacccaatcctgcactggcacctcctacgagactacagtgggatattcccaagcagtgccaagccgttatcgagtcttcctaccaggttgccaaagccttggctgatgacgtcgaactgtattgctttcaattccttccctttgggaaaggactcatcaagaaatgtaggacaagcccagacgcatttgttcaaatagctctacagctggcacacttccgggacagaggaaagttttgtttaacttatgaggccagcatgacacgcatgttccgagagggccgaaccgagacagttcgttcatgtacatcagagagcactgccttcgtccaggcgatgatggagggcagtcataccaaagcagatctgcgcgatctgtttcagaaagctgccaaaaaacaccagaatatgtacagactggccatgacaggagctgggatcgacaggcatttgttctgcctgtacctggtgagtaagtatttaggtgtatcttcacctttccttgccgaagttttgagtgagccttggcgtctgagcacatcccaaattccccagagtcagattcgcatgttcgaccccgagcagcacccaaaccatcttggcgcagggggaggctttggcccagtggccgatgacgggtatggggtttcctatatgatcgcaggggagaacactattttctttcatatttcctctaagtttagctcttcagagaccaacgcccaacggttcgggaatcacattaggaaagccttgctagatatcgccgacctgtttcaggtgccaaaagcttatagctag

SEQ ID NO: 217103 - DNA, 1458 bp, Artificial Sequence
  Description of Artificial Sequence: Synthetic coding sequence
atgctgtttagctatcagaggagtttacctagacagccggtaccatccgtgcaggacactgtacgcaagtatctagagtccgttcgaccgatcctgtctgatgaggatttcgactggaccgcggtgctagcacaagagttccttcgactgcaggcctctctgctgcagtggtatttgcggctgaaatcatggtgggcctctaattacgtatctgactggtgggaggagttcgtttacttgcgctcccgtaatcccctcatggtcaattctaactattatatgatggacttcctatatgtaacgccaactccgctccaggccgcacgggctgggaatgcagttcacgcactcctgctatacaggcatagattaaaccgccaggagattccccctgtgaggggacctcaatgggttcgtgatggcggagtcgttctctggcctctgggacacgtgggccctgggcgtcagctaaccgctcacggatttctgcagacattgctaatgggtatgcgtcccctgtgctctgcacagtacgaaaagatctttaataccaccaggatccctggtgttcagaaagactacatccgccacctgcatgactcccagcacgtggccgtctttcacaggggtaggttttttaggatgggtacccactctcgtaattccctgctctctccccgagcgttggaacagcagttccagaggatccttgacgatccttcgcccgcatgtcctcatgaggagcacctggctgctctcactgcagcaccacgaggcacttgggcgcaagtgcgcacatcactgaagacacaggccgcagaagcgctcgaggcggtggagggtgccgcttttttcgtgagccttgatgcagaacctgctggattaacaagagaggatccagccgcaagtctggatgcatatgcgcacgctttactggccggacgcggacacgaccgatggttcgacaagagcttcaccctgatagtgttcagtaacggtaagctgggattgagcgtggaacactcatgggctgattgtcctatctctggccacatgtgggaatttactttggctacagaatgctttcagcttgggtactccacagatggccattgcaagggtcaccctgatccaaccttgccacagcctcagaggctgcagtgggacctcccggaccaaatccactcgagtatatcgctggcactgcggggagccaagatcttgtccgagaacgtggactgccacgtggtacctttttccctgtttggaaaaagcttcatacggcgatgtcatctcagttcggattcatttattcagatagcccttcagttggcccacttcagggttagctgggtgccgcatccacagcccccacagggcctgtcgccccctgaacctccaaggccagccccacctaggtttctggtggtcgccgctatcgtcggaaggccgagttag

SEQ ID NO: 217104 - DNA, 2412 bp, Artificial Sequence
  Description of Artificial Sequence: Synthetic coding sequence
atggccgaagcacaccaagcggtcggatttagaccaagcctaacctccgacggagcagaagttgagctgtccgccccagttttgcaggagatctacttgtcagggctgcgtagctggaagcggcatctgagtcgattttggaacgattttctgactggtgtttttcccgcaagcccccttagctggcttttcctatttagtgcaatacaacttgcctggtttctgcagttagacccgtctctgggcctgatggagaaaattaaagaattgctacccgattgggggggacaacatcacgggctgcgcggagtactggcagctgcccttttcgcctcatgtctgtggggggctttgattttcacgcttcatgttgcgctgcgcttactgctgagttaccacggttggttgctggaaccacacggagcgatgtcaagccccactaagacttggctcgcattggttcggattttctcaggccgacacccaatgctattcagttaccaacgctccctgccaagacagcctgtgccctctgtccaggatacagtacgtaagtaccttgaaagcgtgagaccaatactgagcgacgaagacttcgattggaccgcagtgcttgcccaggagtttctgaggttacaggcttctttgcttcagtggtacctcaggctgaagtcatggtgggcctcgaattacgtatctgactggtgggaagagttcgtatacctgagaagccggaatcctctcatggtgaacagtaactattacatgatggatttcctgtatgtgacccccacccccctccaggcagcgagagcaggtaatgccgtccatgccctcctactttatcgtcatcggctgaatagacaggagattccacctaccttattaatggggatgaggccactctgctcagcccagtatgagaaaattttcaataccacgcgtattcccggagtacagaaagactacatacgtcatctgcatgactcacaacatgttgcagtgttccaccgagggagattcttcagaatgggcacgcacagcagaaactcactgttgagtcccagagcactggagcaacagtttcagaggatcctggacgacccaagtcctgcttgtccgcacgaggaacatctggccgctttgactgcagctcctaggggcacgtgggcccaggtacggacatctcttaaaacccaagccgctgaagccttggaggccgtagagggtgctgcgttctttgtgtcactcgatgctgagccagccggtctgacaagggaagatccggcagcaagtctcgacgcatacgctcatgctttgttagctggacgcggacacgataggtggtttgataaatccttcactctcatagtcttttctaacgggaagctcggcctgtccgtggagcatagttgggccgattgtcctattagtggccacatgtgggaattcacgttggccacggaatgcttccagctaggttatagcacggacggacactgtaaaggacatccagatccgaccctgccgcagccacagaggttacagtgggacctgccagatcagatccatagctccatctctctggccctaagaggcgcaaaaattctgtcggaaaacgtggactgccacgtagtgccttttagcctcttcggtaagagcttcattcgtcgttgtcacttaagtagcgattcattcatccagatcgcactgcagttagctcattttagagacaggggccagttctgtttaacatatgaaagtgccatgactcgcctgttcctggagggtcgaacagagacagtgaggtcctgcacaagggaggcctgcaacttcgtgcgggcaatggaagataaagagaaaaccgaccctcagtgtctcgctctatttagggttgccgtcgataagcatcaagctctgctgaaggcagcaatgtcaggccaaggggtcgacagacacttgtttgccctgtacatcgttagccgttttttacatttgcagagccctttccttactcaggtccatagtgaacagtggcagttaagtacctcacagatacccgtacagcagatgcacctcttcgatgtacacaattacccggactatgttagctcaggcggtggattcggcccagccgacgaccatgggtatggcgtcagctatatcttcatgggcgatgggatgatcactttccatatatccagtaaaaaaagcagtacaaaaactgactcccaccgcctgggccagcatattgaagacgcgttgctggatgttgcctccctctttcaggcgggtcagcactttaagcgtaggtttagggggtccggcaaggaaaattctcgtcacaggtgcgggttcctttccaggcagacaggagctagtaaagcttcgatgacgtctaccgatttttag

SEQ ID NO: 217105 - DNA, 2145 bp, Artificial Sequence
  Description of Artificial Sequence: Synthetic coding sequence
atggccgaagcccaccaggcggtgggcttccgtccttccttgacctccgatggagctgaagtagaactgagcgcacccgtgcttcaggaaatctacttgagtggtctgagatcttggaagcgacatctgagtaggttttggaatgactttttgacaggcgtgtttccagcctccccactcagctggcttttcctctttagcgccatacaactggcatggtttctccagcttgacccctcactcgggctcatggagaagattaaggagcttctcccggactggggcggtcagcaccatgggcttcgaggcgtgctggccgctgctctatttgcctcttgtctttggggcgctttgattttcactctgcacgttgctttaagattgctccttagttatcacggatggttgctcgagcctcatggcgcaatgtcctccccaactaagacatggcttgccctggttcgtatctttagtgggcgtcatccaatgctgttctcatatcagcggtcactgcctcgtcagccagtccctagtgttcaagatactgtgcggaaatacctcgagagcgtgcgaccaatcctatctgatgaggacttcgattggacagccgtgctggcacaggaattcctcaggctccaggcttcattattgcagtggtatttgcgtctcaagtcgtggtgggcttccaactacgtgtcagactggtgggaagaatttgtgtatctgcgatccagaaaccccctcatggtcaattcaaactactacatgatggattttctgtacgtgacgccaacacccctccaggccgctcgtgctggaaatgccgtgcatgcactccttctttaccgacataggctgaaccggcaagagatcccccctacgctgctcatgggcatgcgcccattgtgcagtgcccagtatgaaaagatcttcaataccaccagaatccccggagttcagaaagactatatccgccatctgcacgatagccagcacgtggctgtgttccatcgagggcgatttttcagaatgggaacacattctcggaattccttgctgtctccacgagcccttgagcagcagtttcagcgcatactggatgacccctcacccgcatgccctcacgaggagcatctcgcggctctaaccgcggctccacggggtacatgggcccaggtgagaacatccttaaaaacacaggcggctgaggcccttgaagccgtggagggagccgcattttttgtgagtctggatgccgagccagcgggactgacacgggaggaccccgcagcgagcctcgacgcctatgcccacgcgttgctggccggaaggggtcatgacaggtggttcgacaagagctttacccttattgtgttcagtaacggcaagttgggattgtcagtggaacacagctgggcggattgccctatttccggacatatgtgggagttcaccttagccacagagtgttttcagctgggctacagtaccgacggccattgtaaagggcaccccgaccccaccctgccccagcctcagcggttacagtgggacctcccagatcagatccactcttcaatctcactggcccttcggggagctaagattcttagtgaaaacgtggactgtcatgtagtgcctttctcgctgttcggtaaatccttcatcaggcgatgtcacctatccagcgacagttttattcagatagcgctccagctagcacacttccgcgaccggggacaattttgcttgacctacgaaagcgcgatgactagactatttcttgagggaagaacagagacggtccgatcatgtacacgagaggcatgcaatttcgtccgtgctatggaagacaaagagaagaccgcagatgatcacgggtatggcgttagctacatctttatgggtgatggcatgattacctttcatatctctagtaagaagtcaagtacaaagacagattctcaccggctcggtcagcacatcgaagatgcgcttcttgatgtggcctcattgttccaggctgggcagcactttaagaggcgcttcaggggttcagggaaggaaaactccaggcacaggtgcgggttcctctcaaggcaaacgggggctagtaaagccagtatgacatcgactgatttctag

SEQ ID NO: 217106 - DNA, 2412 bp, Artificial Sequence
  Description of Artificial Sequence: Synthetic coding sequence
atggccgaggcccaccaggctgtcggctttagaccaagcctcacttccgacggagccgaggtcgagctttcagccccagtactccaggaaatttacctatccggcctgcggagttggaagcgacatctgtcaagattttggaacgatttcttaaccggggtatttcccgcttcgcccctgtcttggttatttttgttttctgcaatacagctggcttggttcctgcagctagatcccagcttagggctcatggagaagatcaaagagctgttacctgactgggggggacagcatcacggtctgagaggagttctagccgctgcattgttcgcctcctgcctctggggcgcactcatatttaccctccacgtcgccctaaggctcctactctcataccacggctggttactggagccacacggggcaatgtcctcccctactaaaacttggctggcattagtgcgaatcttcagcggtaggcacccaatgctcttctcttatcaacgctccctgccacgccagccagtcccctcagtgcaggacaccgtgaggaaatacctggaaagcgttagacccatcttaagcgatgaagactttgattggacagccgtgctcgcgcaggaatttctgcggctgcaggctagcttgctgcagtggtacttgcggctgaaaagctggtgggcctcgaattatgtttccgactggtgggaagagttcgtatatctaagaagtcgaaacccgctgatggtcaattctaattactatatgatggacttcctctatgttacccctactcctttgcaggccgctcgagccggtaatgctgtccacgccctgctcttgtatcgccacaggctgaacagacaggagattccacctaccctgctgatgggcatgcgccctctttgttctgctcagtacgaaaagattttcaataccactaggattcctggtgtacagaaggattacattagacacctgcatgatagtcagcatgtggccgtctttcatcggggtaggttctttcgaatgggcactcatagccgtaactcactcctgtctcctagagcactggagcagcagtttcagcgaatcctagacgacccttctcccgcttgcccgcatgaggaacacctggcagcactgactgcagcacccaggggcacctgggctcaggtgagaacgtccttgaaaacccaggccgctgaagccctggaggcagttgagggcgcagcgttcttcgtcagtcttgacgctgagcccgctggactgacccgcgaagatcccgctgccagcctggacgcctatgcccatgcactcctggccggaagaggtcacgataggtggttcgacaaatccttcacactgatcgtcttctcaaacggtaagctgggcctgagtgtcgaacattcctgggccgattgccccattagcggacacatgtgggagttcactcttgccaccgagtgtttccagttaggctactccacagatgggcattgcaagggacatccagaccccaccttgccacagcctcagcggctacaatgggatctgcccgaccagattcacagctcaatctctttggctctgagaggggcaaagatactctctgaaaacgttgactgtcacgtggttccctttagcttatttggtaaaagtttcatacgacgatgccacctgtcaagtgactccttcatccagattgccctgcaacttgctcactttcgtgaccgcggtcagttttgtctgacctacgaatccgctatgacgaggctgttcctcgaaggcaggaccgagaccgtgcgaagctgtacaagagaggcttgcaatttcgtgcgagccatggaggataaagagaagacagacccgcagtgtttggccctctttcgcgtggccgtcgataagcaccaggccctgctgaaggccgctatgtctggccagggcgtggaccgtcacctcttcgctctctatatcgtctcaaggtttctccacctccagagccctttccttacccaggtccatagcgagcagtggcagctctccacttcacagattccagtgcagcagatgcatttatttgatgtacacaattacccggattatgtgagctctggagggggtttcggccctgccgacgatcacgggtatggtgtctcctacattttcatgggtgacgggatgataactttccacatctcctctaagaagtcatcaactaagaccgacagccaccgcctaggtcagcacattgaggatgctcttctggatgtggccagcctgttccaggctggacagcattttaagcgcagattcagaggcagtggtaaagagaacagcaggcatcggtgcggattcctcagtaggcagaccggggcaagtaaggcatccatgacttcaaccgacttttag

SEQ ID NO: 217107 - DNA, 2379 bp, Artificial Sequence
  Description of Artificial Sequence: Synthetic coding sequence
atggccgaagctcatcaggccgtggggttccgccctagtcttacctccgatggggcagaggttgaactgagcgcacccgtcttacaagagatttatctgtccggactgcgctcctggaaacggcatctgagtcggttctggaacgactttcttaccggcgtttttcccgcaagtcccttgtcttggctgtttctcttttcagcaattcagctggcctggtttttacaattagacccgagccttgggctgatggaaaaaattaaagagctgctccccgattggggcggacagcaccacggactgcggggagttctggcggctgcactgtttgcctcttgcctctggggagccctgattttcacactgcacgttgcccttcgcctcctgttgtcttatcatggctggctcctagagccgcacggagccatgagttctcccactaaaacttggcttgcgctcgttaggatattctccggtcgccacccaatgctattcagctaccagcgcagtcttcccagacagcccgtaccatctgtgcaggataccgtgagaaagtacctggaatctgtgcgacccattctctcagatgaggacttcgactggaccgccgtgctggctcaagaattcctgagacttcaagcctctttgcttcagtggtacctgcggctgaagtcctggtgggcaagtaactatgtgtctgattggtgggaagaattcgtgtacctccgtagccggaaccccctcatggtcaactcgaattactatatgatggctgctcgagcaggtaacgcggtgcacgccctcctcctgtatcggcatcgtctaaatcgccaagagatcccgccaacactcctaatgggtatgagacctctttgcagcgctcagtacgagaagattttcaataccacaaggatccctggcgtccaaaaggattatattcgccacctgcacgattctcagcacgttgcggtgttccatagaggccgattcttccgcatggggacccattctcggaactctctgcttagtcccagggcactcgaacagcagttccaacgcattctcgatgacccctctccggcttgcccacatgaagagcatctcgccgcactaacagctgctcccagaggtacctgggcccaggtgaggacgtctctgaagacgcaggccgcagaagctctggaagctgtggagggagctgcgtttttcgtgtctctcgacgctgaacctgccggtcttacaagggaggatcccgcagcaagcctcgatgcctacgcacatgccctgctggctggcaggggccacgacagatggttcgataaaagctttactctgatcgtgttttccaacggcaagttgggtctcagtgtggaacacagctgggctgattgcccaataagcgggcacatgtgggagttcacccttgccacagaatgttttcagctcggatatagcactgacggtcattgtaaggggcatcccgatcccactctgcctcaacctcagcggctgcagtgggatcttcctgatcagatccattcctctatctcactggccctcagaggcgctaagatcctctccgaaaacgtggactgccacgtggtgcctttcagcctgtttggaaaatcttttatcagaaggtgccatcttagtagcgactcttttatccagatagccttacaactggcgcactttagagatcggggacaattctgccttacatacgaaagcgcaatgacccgattatttctcgagggcaggaccgaaaccgttagatcgtgtacccgagaagcctgcaattttgttagggcaatggaggacaaagagaaaacagaccctcagtgcctggccttgtttagagttgctgtagataagcatcaggctctccttaaggccgctatgtccgggcagggcgtcgatcggcacttgtttgccctttacatagtctcccggtttcttcacctgcagtctccttttctgacccaggttcattccgaacagtggcagttgtcaacttctcaaatcccagtccagcagatgcacctcttcgacgtacacaattaccctgactatgtgtcaagcggcggaggttttgggccagcagacgatcacggctacggagtgtcctacatttttatgggcgacgggatgattactttccacatttcttccaaaaaatcaagtacaaagaccgactctcatcgtctcggacaacatatagaggacgctttactagatgtggcctctctcttccaagcaggccagcactttaagcgccgtttcaggggtagtggcaaggagaactctcggcaccggtgcgggttcctttcccgtcagacgggggcttcaaaagcttctatgaccagcacggacttctag

SEQ ID NO: 217108 - DNA, 2412 bp, Artificial Sequence
  Description of Artificial Sequence: Synthetic coding sequence
atggctgaagcacaccaggccgtaggcttcaggccatccctgacttccgacggagccgaggtggaactgagtgccccagtactacaggagatttacctgtcaggactccggtcttggaagcgccacctgtcaagattctggaacgacttcctcacaggggtctttcccgcaagccccctcagttggctctttctgttctcggccatacaactggcgtggttcctccaactggatccaagcctcggtctgatggaaaagataaaagaactgctacccgattggggtggtcagcaccacggactccggggagtcctggccgcagcattgttcgccagttgtctctggggggctctgatttttaccctgcatgtggccctcaggctcctgctaagctatcatggatggttactcgaaccacatggtgcaatgtcctccccaaccaagacgtggctggcattggttcgcatcttcagtgggcgtcaccccatgctattttcataccaacggtctctgccaagacaacctgtccccagcgttcaagacaccgtgaggaagtatcttgaaagtgtgagacccatactctcagacgaagattttgattggaccgcggttcttgcacaagagtttctgcgactccaagcatcattgttgcagtggtatctcaggctcaagtcatggtgggccagtaattacgtatccgactggtgggaagaattcgtgtatctgcggtctcgcaatccgttgatggtgaatagcaactattacatgatggacttcctgtacgttaccccaacgccgcttcaggccgctagagcaggcaacgctgtgcatgctcttctgttataccgtcatcggctcaatcgacaggaaatcccaccaaccttgttaatgggaatgaggcccttgtgctcagcacaatacgagaaaatttttaacactactcgtatcccaggagtccagaaagattatatccggcatcttcacgactcacaacatgtggcagtgtttcatcgaggacggttctttagaatgggcacccactccaggaattctctactgtcacccagggccctcgagcagcagttccagcgcatccttgacgacccttcacccgcatgcccacacgaagagcacctggcagccctgactgccgcacccagaggtacctgggcccaggtgcgtacttctctgaaaacccaggctgctgaggcacttgaagccgttgagggagccgcattttttgtgtctttggatgccgaacccgcaggcttaacccgggaagatccagctgcttctctggatgcttatgcccatgccttgctggccggtaggggccacgataggtggtttgataagtccttcaccctgatcgtcttcagcaatggtaaactcggactgagtgtcgagcatagttgggctgattgtcctattagtggacacatgtgggagtttacattggcgacggagtgtttccagttaggatactccacggacggccattgtaaaggtcatccagatccgaccctgccgcaaccgcagaggctgcagtgggacctccctgaccaaatccactcatccatttctctcgcactgcgaggcgctaagattctcagcgaaaatgttgattgccatgtcgttccctttagtctattcgggaagtcattcatccggaggtgtcacctaagtagcgacagttttatacagatcgcgctacagctagcgcatttccgggacagaggccagttttgtctgacatacgaaagtgccatgacccggctattcttggagggaagaacagaaaccgtccggagctgcacgcgggaagcctgtaattttgttcgggctatggaggataaggaaaagacagacccccagtgtctagctttgtttagggtcgccgtggataaacatcaggccctgctgaaggccgcaatgtccggacaaggagttgaccgacacttgtttgctctttacattgtgtccagattcctccatttacagtccccatttctcacccaggtccacagcgaacagtggcagctgagtacatctcagattcctgtccagcagatgcacctgtttgacgtccacaattacccagattacgtgtctagtgggggtgggttcggccctgctgacgaccatggttacggagtatcttacatttttatgggggatggcatgatcaccttccatattagctccaaaaaatcaagcacaaagactgattcccaccgccttggacagcacattgaagacgccctgttggatgtggcctctctcttccaggctgggcagcactttaagagacggttccgcggatccgggaaagagaactctcgtcatcgctgtgggttcctgtctagacagactggtgcctccaaagcttctatgacgagcaccgacttctag

SEQ ID NO: 217109 - DNA, 1524 bp, Artificial Sequence
  Description of Artificial Sequence: Synthetic coding sequence
atggaccccaagctcggtcggatggctgcatcattattagccgtcttgttgctactgcttgagagaggaatgtttagctccccgagtccaccacctgctctgctggagaaggttttccagtacatcgatctccaccaggatgaattcgttcaaactctgaaggagtgggtggcgatcgagtccgattctgtccaacccgtgcctcgcttccgtcaagaactgttcaggatgatggctgtagctgcagatacattgcagcggctgggcgctagagtggccagcgtagacatgggcccacagcagctgccagacggccagtcgcttcctattccacccattatcctggcagagttaggctcagatcctacaaagggtaccgtttgcttttacgggcacctcgatgtccagcccgcagatcgtggcgatgggtggctcacagacccatatgtactcactgaggtcgacggtaagctgtacggcagaggggcaaccgataacaaggggcctgtgctcgcatggatcaacgctgtgtctgccttccgcgctcttgagcaggacctcccagtgaacataaagttcataatcgagggcatggaggaggcagggtctgtagctctcgaagagttggtggaaaaagagaaggacaggttttttagcggcgttgactacatagtgattagcgataacttgtggatcagtcagcgcaaacctgctataacctacggcacacggggaaatagctattttatggtcgaagtgaaatgccgggaccaggatttccacagcggaacctttggcggtatcctgcacgagcctatggccgatctggtggctctgctcggctcactggtggactcctccggtcatatacttgttcccggaatttacgatgaggtagtgcctcttactgaagaagaaattaacacatacaaagcaattcatttggatctcgaagagtatagaaactcctcccgagtggagaaattcctgtttgataccaaggaggagattcttatgcatctgtggcgttatcccagcctgtccatccacggaattgagggggctttcgacgaacctggcactaagacggtaattcctggcagggtcatcggtaagtttagcatcaggctggtgccacatatgaacgtcagtgccgtcgaaaagcaggttacccgccacttggaggatgtgttttctaaaaggaactcatccaacaaaatggtcgtttcgatgaccctgggtttgcatccctggatagctaacatagatgatacccaatatctagcagccaagagggccatccgcactgtattcggcacagagcccgacatgattagagacggaagtaccatcccaattgcaaaaatgttccaggagatcgtccacaagtcggtggtactgatacccctaggtgccgtcgacgatggagagcatagtcagaatgaaaagatcaaccggtggaattatatagaaggcaccaagctcttcgccgcttttttcctggaaatggcccagttgcactag

SEQ ID NO: 217110 - DNA, 2484 bp, Artificial Sequence
  Description of Artificial Sequence: Synthetic coding sequence
atgcttctctgtctaagtcccgcttggctaatgaaagtccccgctcccggacaaccaggagaagccgcactgctggtttctaaggctgtgagctttcatcccggtgggttgacctttctcgacgacttcgttcccccacggagagcaacgtatttcctggctggtttaggcctgggcccaggacgtggtagggaagccgctgaactggccagagatttaacctgtccaactggcgcatccgcggagcttgctcggctgctggaggaccggttattaacaaggcaactgttagctcagcaggggggagtagccgtgccagctaccctcgcttttacgtacaagccccctgggctcttgcgaggaggggacgcctccttgggcctcagactggttgaactgtcgggcaaagaaggccaggaaactctcgtaaaggaggaggtggaggcgttcttgcgaagcgaagccctcggagatatcttgcaggttgctgtcaaactgagcggatggagatggaggggaagacaggcatggcgcctgcatcctcgggctgaactgggggctgttgttgacacagtcctggccctccttgagaaacttgaggaagaggagtccgtcctcgtggaggccgtgtacccaccagcgcaacttccgtgttcagatgggccatcgcccggtcctggactggccgtcaggatctgcgcggtggtgtgtcgaacacagggtgaccggcctctcctgtcgaaagtcgtgtgcggcgtgggacgtggtgataggccactacgtcatcacaatagtttgccacggacccttgaggtcgcgttggcacagtgtggcctcggcgaggaagcccaggtcgccgctgttcgccagcgtgtcaaggccgctgccgaggcggctctcgctgcagtgttggccctcgaggctggcctgtcagccgaacagaggggtgggcgacgagcccacactgatttcctgggagtggattttgctctcactgccgcaggcggagtgctgacccccgtcgccctggaacttaatggtggactttgcttggaggcctgcggggcattggaaggactgtgggcggcacctaggctcggtcccgcagcagatgaagcagttgcagcacctctggtcgagacgatgctgagaaggtcggccaggtgtctgatggagggaaagcagctgcttgtcgtaggcgctggcggagtttcaaaaaagtttgtgtgggaggccgctagagactacggtctccagctgcacctcgtcgaatcagatccaaaccatttcgccagtcaactcgtgcagacgttcatccattttgatatgactgaacacagaagggatgaggagaacgcccgactactcgccgagctcgttagagccaggggtctcaagctggacgggtgctttagctactgggacgattgtctggtccttacagctctactctgtcaggaactaggcctgccctgctccagcccagcagcaatgcgcctcgccaagcagaagtcactcacacagttgcatctcctgcaccaccatggtcctccctggcccgcaccaagcctacatgctgtcccttgttgtcctctggaaagcgaagcagacgtcgaacgagccgtccaccaagtacctcttccgggagtaatgaagcttgagttcggggctggcgcagttggggttaggctggtcgaggatgccccacagtgccacgagcatttcagtaggatcacgcgggatttacagggcgaggccgaccatccaggcatcggcctgggctggggtaatgctatgctcctgatggaatttgtcgagggaaccgaacatgatgttgacctcgtgctgtttggaggacggctgctggcagctttcgtgtctgacaacggccctacccgactgcccggattcactgaaactgccgcatgcatgccaaccggtctggctccagagcaggaagcacaaatggtgcaggctgccttccggtgttgcctcgggtgtggcttactagacggtgtgttcaacgtggagctgaagcttaccggggcaggaccacgtctcatcgagattaacccgagaatgggtggtttttacctgcgcgattggatcctagaactgtacggtgtggatctgttactcgccgctgtgatggtggcctgtgggctgagaccagctctccccactcgacccagagctaggggccacctggtaggcgttatgtgtttagtgtctcaacacctccaggctctttctagtaccgcgtcccgtgaaactctgcaggccttgcacgacagagggctgctcaggctcaacttgctagaagaagccctcgtcccaggtgagtacgaagaaccctactgtagtgtggcttgcgccggtcctagtcccaccgaagccagactccgtctgttagggctgtgccagggcttgggcattgatggtccctcttatcctgtggcccatttcctatcacacttcaaatag

SEQ ID NO: 217111 - DNA, 2484 bp, Artificial Sequence
  Description of Artificial Sequence: Synthetic coding sequence
atgctcctttgcctctcacccgcttggctaatgaaggtgcctgctcctggtcagcccggtgaggctgcactgctagtttcaaaggccgtgtcctttcatcccggaggccttacatttcttgatgattttgttccaccgaggcgcgcaacgtacttcttggccggactgggtctggggcctggacggggtagagaagcagctgagcttgccagagatctgacctgtcccacaggggcttccgcagagctcgccaggcttctggaagatcgcctcttgactcgtcagttgctggcccagcagggaggtgtagctgttcctgccactcttgcattcacatacaaacctcctggattgctgcgcggtggggacgcctccttaggactgcggctggtggaactctcaggtaaagagggtcaggaaaccctggtgaaggaagaagtcgaagctttcctgagatctgaggctcttggcgatatccttcaggttgcagtcaaactgtccggatggaggtggcgcggtcgccaggcctggcgtctgcaccccagggcagaattaggcgcagttgtcgataccgtcctagctctgcttgagaaacttgaggaggaagaatctgtgctcgttgaggcagtgtatccacctgcacagctcccgtgctctgacggtccctcccccggtcccggactggcagtgcggatttgtgcagttgtgtgtcgcacacagggcgacaggccgctcctctctaaggtggtgtgcggcgtgggtcgaggcgacagacctctgcgacaccataactccctaccgcgtaccttggaagtggctctggctcagtgcggcttgggggaagaagctcaagtcgccgcagtgaggcagcgcgtgaaggccgctgctgaggctgcactggcagccgtcctggcactggaggctgggctaagcgccgagcaacgcggaggcaggcgggctcacactgacttcctcggcgtggatttcgcccttacggcagcaggcggtgtgcttactcctgtcgccctggaattgaacggcggactctgtctagaagcctgtggcgctctcgagggactctgggcagcacccaggctgggcccagcagcagatgaagccgtcgctgcaccccttgtggagaccatgctgcggaggagtgcgagatgcctaatggaggggaagcagctcctcgtggtgggcgcagggggagtttcaaagaaatttgtgtgggaagctgcgagggactacggcctacaacttcaccttgtggagtcagacccaaatcattttgccagtcagctggtgcagaccttcatccactttgatatgaccgagcacagacgagatgaggagaacgcccgtctactcgcggagctggttcgtgcacgtggcctaaagcttgatggatgctttagttactgggacgactgcctggttctgacggctctcctctgccaggagctgggcctaccctgtagcagcccggcagctatgcgcctggccaaacagaagtcactgacccagctgcatttgctgcatcaccacgggcctccatggcctgcgccatcgctccatgccgtgccctgctgcccattggaaagtgaggccgacgtggaacgcgctgtgcatcaagtgcctctgcccggtgtcatgaagcttgaattcggtgctggggcagtgggggtgaggctcgtggaggatgcgcctcagtgccacgagcatttttcaaggatcactagagacctgcagggagaggccgaccatcccggaatcggcctaggatggggtaatgccatgctgttaatggagttcgtggaggggactgaacacgacgttgacctcgttttgttcggagggagattgctggccgcttttgtatctgataacggaccgactaggcttccaggtttcacagaaaccgctgcttgtatgccaacaggcctggcccctgagcaagaggcacagatggttcaggcagcttttaggtgctgtctgggttgtggtctgctggatggcgtctttaacgtagaactcaagctgacaggcgcaggacccagactaattgagataaacccaaggatgggcggattctacctcagagactggatcttggagctttacggtgtggacctcctgctagctgccgtgatggtggcgtgcggcctcaggccagcactacctacacgaccgagggccagaggccacctggtgggggtgatgtgtcttgtatcccagcacttacaggcgctgtcatctaccgcatccagagagacattacaagccctgcatgacagaggcctgctgaggctgaatctgctggaggaagcactggtcccgggagagtatgaggagccgtactgctccgtggcttgcgccggtccctctcccactgaagcacggctccggctcctggggctctgccaggggctgggcattgatggtccctcctaccctgtggcgcattttctctcccatttcaagtag

SEQ ID NO: 217112 - DNA, 2853 bp, Artificial Sequence
  Description of Artificial Sequence: Synthetic coding sequence
atgctctccctcgacccttctggccctgagtgggattgccccctgggctctaaagacctggaagaggagggcccttggggcggtgggtcaggcctcccgccaaccggctgctttccgggatcttggcggcaagacgtgggactggactgtaagggatctccagagggagccgaggcccgtgcctggactgtctattactattccctactgcagtcatgtctgcagcaggccggactgcccgagacccaggaccgaggacaagttccaaggacagggtgtcctggagcagaagttactctttgtgtactgggctctccctccaccttcctgcctgttctcctcgagggcggtgtgcaaagcccaggcaatatgctcctttgcctgtcgcccgcttggttgatgaaagtgccagctcctggccagccaggtgaagcagccctgctcgtgtctaaggcagtctcattccaccccggtggcctcacattcctggatgacttcgtgccacccaggcgtgcaacgtatttcctggccggattgggcctagggccaggcagggggagagaggctgctgagctggcccgagatctcacgtgccccactggggcttccgctgaactggccagactcttagaggacaggctgctaacgaggcaattactcgcgcaacaaggaggagttgctgtgcctgccactctggcctttacatacaaaccgccaggtttgctgcgtggtggcgacgcgtccctggggctccggctcgtggagctgtctggcaaagagggacaagagactcttgtcaaggaggaggttgaagcatttctccggtccgaagccttgggtgacattctgcaagtcgcggtgaaactttctgggtggcgttggcgcggacggcaggcctggcggttgcatccgagagctgagctgggcgcagttgtagacactgttctcgcactgctcgagaaactggaagaagaggaatcagtgctggtcgaagcagtttaccctcctgcacagttgccgtgctccgatggaccatcacctggacctggcctcgccgtacgaatctgcgctgtggtgtgtagaacgcagggggaccgcccactgctgagcaaggtggtgtgtggggtggggaggggcgataggcccctgcgacaccataattctctgccgaggaccttggaggtggccctcgcacagtgcgggctgggcgaagaagcacaggtggccgcagtgcgacagagagtgaaggctgctgccgaggccgctctcgcagccgtgctggccctcgaagccggtctgagcgcagagcagcggggagggaggcgggctcacactgatttcctgggcgtggatttcgccctcaccgctgcagggggagtgcttactccagtggccctcgagttaaacgggggactttgcctggaagcttgcggagcacttgaaggcttgtgggcagcaccaaggctaggcccagccgctgacgaagccgttgcagctccccttgtggaaactatgctgaggcgctccgcacggtgcttgatggaaggcaaacaactgctcgtggtgggcgctggaggtgtctccaagaagttcgtgtgggaggctgctagggactacgggctccaactgcatctagtagagagcgacccgaatcactttgccagccagctcgtgcaaaccttcattcattttgacatgacagaacaccgaagggacgaggagaacgcaagacttcttgcagagttggtgcgcgcaaggggtctaaaattggacgggtgtttttcatattgggatgactgtctagttttgacagcactactctgccaggagttgggcctcccttgcagtagtcctgccgctatgagactggccaagcagaaatctctcacccagcttcacctgctgcatcaccatggcccaccttggccagcccctagtctgcatgctgtcccttgttgccccctggagtcggaagcagacgtagagcgggctgtccatcaggttccactgcctggagtcatgaaactggagtttggcgcaggagcagtcggagtgcgcctagtggaggacgcacctcagtgtcacgagcactttagtcgcataaccagagatctccagggcgaggctgatcacccgggtatcggtctagggtgggggaatgctatgttgctgatggagttcgtggaagggaccgaacacgacgtggacctggtgctgtttggaggtcgactactagctgcttttgtgtcagataatggaccaactcgactgcccggattcacagagacagccgcttgtatgcccacgggcctagcgccagaacaggaagcccagatggtccaagccgcatttcggtgttgcctgggctgcggccttctggacggcgtgtttaatgtcgagcttaagttaacaggcgctggtccgagactgattgaaatcaatcctcggatggggggattctacctgcgcgactggatcctagaattatatggcgtcgacctgctgctggcagctgtaatggttgcctgcggactccgtcccgctctgcccacgagaccacgggcaaggggccacctagtgggggtgatgtgtcttgtgtcccagcatctgcaagcgctcagtagcacagcaagcagggagacattgcaagccctccacgatcgtggcctgctccgattgaatctgctggaggaagcactggtgccaggggagtatgaggagccttactgctctgtcgcctgtgccggaccatctcctacagaagccaggcttcgtttactgggcctgtgtcagggtctgggtattgatggccctagctacccggtggcccactttttgtcacacttcaagtag

SEQ ID NO: 217113 - DNA, 2775 bp, Artificial Sequence
  Description of Artificial Sequence: Synthetic coding sequence
atgctgagcctggatcccagcgggccagaatgggattgtccgctgggcagcaaagacctggaggaggagggtccctggggcggaggaagcggactcccccctacaggctgttttcccggtagctggcgccaggatgtcggcttagattgtaaggggagccccgaaggggctgaggcacgcgcatggactgtctactattacagcctcctgcagagttgcctgcaacaggcaggcctccctgagacccaagaccgtggccaggtgcctcgcaccggctgccctggggctgaggtcacgttgtgtgtacttgggtcgccttccacctttcttccggtgttactggaaggaggcgtgcagtctcctggcaatatgctgctttgcctctctcccgcttggctcatgaaggttccagctccaggccagccaggggaggcagcccttttggtgagtaaagctgtgtccttccaccccggtggactcacgtttttagatgactttgtgccccctaggagggctacgtacttcctcgcaggattaggccttggaccagggcgaggtcgtgaggcagccgagctggctcgagatctgacctgtcccacaggcgcaagcgctgagctggcacgcctcctcgaggacagacttctgactcgacagttattagcacaacaggggggagtggctgtgccagccactttggccttcacgtacaaacccccaggcctcctgcggggaggcgatgccagcttgggcctaagacttgtggagctgtccggcaaggagggacaagaaactctggtcaaggaggaggtggaagctttcctacgaagtgaggctctgggcgacatccttcaggtggctgtcaagctgtccggatggcgctggcggggtcgccaggcctggagactccacccgagggccgaactgggcgctgtggtggatactgtgctggcgctgttagaaaaacttgaggaagaagagagcgtgctcgtggaagctgtgtatccccctgctcagcttccatgcagcgatggaccctccccgggacctggcctcgccgtgagaatatgcgcagtggtatgtcgaacacagggtgacaggccactgttgtcaaaagtggtgtgcggtgtcggacgaggtgaccggcctctcagacatcataactcactgccgagaaccctcgaggcggctctggccgctgtgctggctcttgaagccggtctttctgccgaacagaggggaggacgacgcgctcacacggacttcttaggcgtggacttcgccctgacagcagcaggtggagtgttaacccctgtcgcgctcgaactcaatggaggcctgtgtctcgaggcatgtggcgcacttgaagggctgtgggccgcaccacgacttgggcctgctgcggacgaggccgtggcagctcccctcgttgaaactatgctgagacggtccgcccgttgtctgatggagggcaaacaactgctggtcgtgggcgctggaggagtgagcaaaaagtttgtgtgggaggccgcaagagattacgggctgcagttacacctggtggagtctgatcccaatcatttcgccagccaactcgtacagacttttatccacttcgacatgacagaacacaggagagacgaggagaatgccaggctgctggcggaactcgttcgggctagagggctcaagctggatggatgcttctcatactgggacgattgtttagtgctgaccgcgctcttgtgccaggagctcggtctgccctgttcctccccagctgccatgagactggcaaagcaaaaaagcctgacccagcttcacctccttcatcaccatgggcctccttggccggcaccgagcctccacgccgtcccctgctgcccgcttgaaagtgaggcagatgttgagagggccgtacaccaggtgcctctccctggtgttatgaaattggagtttggtgctggagcagtgggcgtccgtctggtggaagatgcccctcagtgccacgaacatttcagccggattaccagggatctgcagggggaggcagatcacccaggtattgggttgggctgggggaatgcaatgttgctcatggaatttgtggaagggaccgagcacgatgtggacctggtactctttggcggacggttactggctgcttttgtctcagacaatggtccaactcgcctgcccggttttacagaaacagccgcatgcatgcctactggcctcgccccagagcaggaggcacagatggtgcaagccgctttcaggtgctgtctgggctgtggattacttgacggagtgttcaatgtggagctcaaactcacaggggcaggcccacggctcattgaaataaacccaagaatgggaggattctacctgagggattggattttggaattgtatggcgtggacctgctgttggccgcagtaatggttgcctgcggactgcggccagccctgcccaccaggcctcgcgcaagaggacacctggtgggcgtgatgtgtctggtaagtcagcatttacaagccctgtccagcaccgcgtccagagagactttgcaggctctgcacgaccgcggactccttaggttgaatcttctggaggaagcactggtgcccggagagtacgaagagccctattgctccgtcgcatgtgctggtccatcccctacagaagccaggctccggctactcgggctctgtcaaggcctgggaatcgatggaccgagctacccagtagcccacttcctgagccacttcaagtag

SEQ ID NO: 217114 - DNA, 903 bp, Artificial Sequence
  Description of Artificial Sequence: Synthetic coding sequence
atgtgtccactggcccatccagcacaggatttgcctctgctgccgagccagctgagtctcgatccctctggtcccgagtgggactgccccctcgggtccaaggaccttgaggaggaagggccttgggggggtgggagtggactcccgcctacaggttgctttccaggcagctggcggcaagacgtgggattggactgcaaaggtagtccagaaggcgctgaggctagggcctggactgtctactactattcattactccagtcttgtcttcagcaggctggactgcctgagacccaggataggggacaggttccacgaacaggatgcccgggagccgaagtcacgttgtgtgtgctaggatccccaagcacttttctgcctgtactcctggaaggcggagtgcaaagccccggaaacatgctgctatgcttatctcccgcttggctgatgaaagttcctgcacctgggcagccgggtgaggccgctctgctcgtctctaaggcagtatctttccaccccggagggctgaccttcctcgatgatttcgtgcctcccagacgcgcaacatactttcttgccggactcgggctggggcctggtaggggacgtgaagctgcagagttggcgcgtgatcttacctgtcctacaggcgcatcagctgaactagcaagacttcttgaagatcgactgctgactcgacagctgctggcccagcaagggggagtcgcagtgccagcaactcttgctttcacatacaaacctcccggattgctgagagggggagacgcatcactcggcctgcgcttagtggagctttccgggaaggagggccaggagacactcgttaaggaagagcgcacttggctcggtccaaaaccctggaccaacccagggaagacctag

SEQ ID NO: 217115 - DNA, 2775 bp, Artificial Sequence
  Description of Artificial Sequence: Synthetic coding sequence
atgttgtcgctcgacccatccgggcctgaatgggactgtcctctggggagcaaggacctggaggaggagggtccctggggtggcggatcaggtctgcccccaacaggctgttttcctggatcatggcggcaagacgtaggacttgattgtaaggggtccccagaaggcgctgaagcgagagcctggacagtgtactactacagcttgcttcaatcatgtctgcagcaggccggtcttccagagactcaagatcgcggtcaggtgccaaggaccggttgccccggagcagaggttacactgtgcgtgttaggctcaccctctacatttcttcctgtactgctcgaggggggagtccagagcccaggaaatatgctgttgtgcctctctcctgcatggctgatgaaggtcccagctccgggtcagcccggagaggcagccctcttggtttctaaagctgtgtcctttcatcctggagggctgaccttcctggatgatttcgtgcctccacgcagggctacgtactttctggcaggcctgggcctgggccctggtcgtgggcgagaggcagctgagctggcacgcgacctgacctgccccactggcgcttcagccgaactggcaaggttactcgaggatcgtttgctgacgcgccagctgttagcccaacaggggggtgtcgccgtcccggcaaccctagccttcacctacaaaccccctggtctcttgagagggggtgacgcttcccttggcctccggctggtagaactgtcaggaaaagaaggacaggagaccttggtaaaggaggaagtcgaggcctttctgagatccgaggcactgggggatattttgcaagtggcggtgaagctcagcggatggcgctggcgcggtcgtcaggcatggaggctgcaccctcgggcagagctcggggctgtggttgacacagtgctggcactcctggagaagcttgaagaggaggagtctgtgctagtcgaggccgtgtacccccctgcacagctgccgtgctcagacgggccatcacctgggccagggctggcagtgcggatatgcgcggtggtatgtcgcacccagggagatcgccctttattgtcgaaagtcgtttgcggggtcgggcgaggagatcggccactacggcaccataacagcctgccgagaacccttgaggtggccctcgccgcagtgctcgccctcgaggcgggattaagcgctgagcagaggggcggacgtagggctcataccgacttcctgggggtggatttcgcactcactgccgcaggtggggtcttgacaccagtggccctggagctgaacggcggattgtgtctggaggcctgtggggcattagagggactctgggccgctccacgccttggaccagccgctgatgaggcagtggccgcaccgcttgtggagacgatgttacggaggagtgcgcgttgtctcatggaaggcaaacagctcctggttgtgggcgcaggtggtgtgtccaaaaaattcgtgtgggaagccgctagagactacggtctgcagttacacttggtggaatcagacccaaaccacttcgcgagccagctagtacagaccttcatccacttcgatatgacagagcatcggagggatgaagaaaatgctcgactgctcgctgaattggtccgggcaaggggtctgaagctggatggatgcttcagctattgggacgattgtctggttttaaccgccttgctgtgccaggaactcggtctgccatgctctagccccgctgcaatgcggttagcaaagcagaaatccctgacccagctgcatctactccaccatcatggcccaccatggccagctccaagcttacacgcagtgccatgctgcccattggagtcagaggccgatgtggagcgcgctgtgcatcaggttcccttgccgggagtaatgaaactcgaatttggtgcaggggcagttggcgtgcggctggtggaggatgcccctcagtgccacgaacacttctcccgcattacacgggatctgcagggggaggctgaccatccaggcattggccttggctggggtaatgccatgctccttatggagtttgtcgaagggactgaacatgacgtcgacctggtcctgttcgggggacggttgttagctgcctttgtaagtgataatggaccaacaaggctgcctggattcaccgaaacagctgcatgcatgcctacaggacttgcacccgaacaggaagcacagatggtgcaggctgcttttcgctgctgtctgggatgcggcctactcgacggcgtgttcaacgtggaactgaaactcacaggcgcaggccctcgccttattgaaatcaatcccaggatgggcggattctacctccgtgactggatacttgagctgtacggtgtggatcttttactggcggcagtgatggtggcctgtggcctgcgcccagcgctgcctacacgacctcgcgctcggggacatcttgttggtgtcatgtgccttgtgtcccagcaccttcaggccctatcttctacagcctccagggagactcttcaggccctgcatgacaggggactgctgcgtctcaacttattggaagaagctctcgtcccaggggagtacgaggagccttactgttcagtcgcctgcgccggaccgagccctacagaagcccgtttaagactcctgggactatgccagggtttgggcatagatggcccatcctaccccgtcgcacacttcttaagtcactttaaatag

SEQ ID NO: 217116 - DNA, 1206 bp, Artificial Sequence
  Description of Artificial Sequence: Synthetic coding sequence
atggaaccagggcgaagaggggcagcggcattgctagctctgctgtgtgtggcttgcgctcttcgagccggaagggcccagtatgaaagatattccttccgcagctttccacgtgatgagctcatgcctctggagagcgcctaccgtcacgctctggacaaatactctggagagcattgggcagaatctgtaggctacttggaaatttccctaagactccacagactgcttcgggactccgaggcattttgtcacaggaactgcagcgccgctccacagccagagcccgctgctgggctggcatcgtatccagaactccggttgttcggtggcctgctccgacgagcgcattgcttaaagcgatgtaaacagggcctccctgcttttcggcagtcccagccgagtagagaagtgctagcagatttccagagacgtgagccgtacaagttccttcagtttgcatactttaaggcgaacaaccttccaaaggccattgctgcagcacacaccttcttactgaaacaccccgacgacgaaatgatgaagaggaacatggcctactacaagtcccttccaggtgccgaagattatatcaaagatttggagactaagagctacgagtctctatttatcagagcagtgcgcgcttataatggggagaattggcgcaccagcatcaccgatatggagctggctttacccgacttttttaaagcattctatgaatgcctggctgcatgcgaaggctcgcgcgaaattaaggactttaaggatttttacttgagcattgccgatcactatgtggaggtgcttgagtgcaagatccagtgtgaggagaatctcactcctgtgatcggagggtatcccgttgaaaaattcgtcgctacaatgtatcattatctgcagtttgcttattataaactgaacgacctcaagaacgccgcaccatgtgcagtgtcatacctgttattcgaccagaacgataaggtgatgcagcaaaatctggtatactaccagtatcatcgcgacacttggggcctttccgacgagcactttcagccacggcctgaagccgtacagttttttaacgtgactacattgcagaaggagttgtatgatttcgcgaaggagaacataatggacgatgatgagggagaggtcgtcgagtatgtggacgatctgctcgagctggaggagacctcgtag

SEQ ID NO: 217117 - DNA, 789 bp, Artificial Sequence
  Description of Artificial Sequence: Synthetic coding sequence
atggagcccggtaggcgtggggctgcggctctgcttgcccttctgtgcgtcgcatgcgccctgagagcaggtagagctcagtacgaaaggtacagctttcgctccttccccagggatgaactcatgcctctggaaagtgcctaccggcacgcgttggacaaatatagcggcgaacactgggccgaatcagtgggatacctggagataagtttaaggctgcacaggctactgcgagacagcgaggccttttgtcacaggaactgctccgccgctccccaacctgaaccggctgctggtttggccagctatcccgaacttcgcctgtttggaggactgctccgacgagcgcactgcctgaaacggtgcaaacaggggctcccagcttttcgacagagccagccatctcgagaggtccttgctgactttcaacgcagggaaccctataaatttctacagtttgcttattttaaagcaaataacctaccgaaggcaattgctgccgctcacacatttctgctgaaacatcctgatgatgaaatgatgaaaagaaatatggcctactataagagtcttcccggagccgaagactacttgaagacctggaagccaagccatatgaaggcttgctcgtctgagcagtgcggacacacaaccgttaggacaggcgagcatccctctcagacatggagctggccctttcctacatcgtccaaacccttcacctcagtgtcacagcctgctagagtgcctggaaggtcacgcacatcccgcatatcaactttcccgtag

SEQ ID NO: 217118 - DNA, 789 bp, Artificial Sequence
  Description of Artificial Sequence: Synthetic coding sequence
atggaaccagggagaagaggggctgctgcactgctggcgctgttgtgtgtagcctgtgcactgagagccggtagagctcagtacgagcggtattcatttcgttcctttccaagggatgagctgatgccactcgaaagcgcttatagacatgccctcgacaagtatagcggcgagcattgggcagagtccgtggggtatctggagataagtctccggctccacagattgctccgagatagcgaagctttctgtcaccgcaactgctctgcggcacctcagccagagcccgcagccggtttagcttcataccccgagctgcggctgtttggtgggctgctgcgcagggcacactgcctgaagaggtgtaaacaagggctgcccgctttccgccagtcacagcccagtcgcgaagttttggcagattttcagaggagagaaccatataagtttctgcagtttgcttatttcaaagccaacaatctgccaaaggctattgctgctgctcacacttttctgctgaagcaccctgatgatgagatgatgaagcgtaatatggcgtactacaagagcctcccgggagccgaagattacatcaaagacctggaaacgaagtcctacgagagtctgttcatcgaacagtgcggacacacaactgttaggactggcgaacatccttcccaaacttggtcttggccctttccgaccagttctaagccctttacatccgtatcacagccagctcgggtacctgggcgtagtcggaccagccgtattagtacttttccatag

SEQ ID NO: 217119 - DNA, 1167 bp, Artificial Sequence
  Description of Artificial Sequence: Synthetic coding sequence
atggagccaggcagaagaggagcagccgctctcttggccctgctgtgcgtcgcgtgcgctcttagggccggtcgcgcacagtacgaacgttattcttttcgtagcttcccccgtgacgaattaatgcccctggaaagcgcctaccggcacgctctggacaaatactccggtgagcactgggcagaatcggttcgcgactcagaggcattctgccataggaactgctctgccgcaccacagcccgaacctgccgctggcttggcctcctaccccgaactgagattgttcggcggactccttaggcgcgctcactgtcttaagcgttgcaagcagggattgcccgcatttaggcagtcccaaccatcaagagaagtccttgcagacttccagagacgggagccatacaagttcctgcagtttgcatactttaaagcaaacaatcttccaaaagccatcgctgccgcacacacattcttgctgaaacaccctgatgatgagatgatgaaaaggaacatggcctattataagagcctgccaggtgcagaagactacattaaagatttggagacaaagtcctacgagtcgcttttcatcagggctgtccgagcatacaatggcgagaactggcgaacatccatcacagacatggaacttgctcttcccgattttttcaaagccttctacgaatgtctggctgcgtgtgaaggctcacgggagattaaagacttcaaggatttctacctgagcattgctgaccattatgtagaagtcttggaatgtaaaatccagtgtgaggaaaacctgacccccgtgatcggcggatatcccgtggagaagttcgtggccacaatgtatcactatctacagttcgcgtattataagttaaatgatctgaagaatgcagcaccctgcgcagtctcgtatttgctgttcgatcagaatgacaaggtgatgcagcagaatctcgtgtattaccagtaccatcgtgatacttggggcctgtctgacgaacactttcagcccaggccagaggccgtgcagttcttcaatgtaacaactctccaaaaagaactgtatgatttcgccaaggaaaatatcatggacgacgacgagggcgaggtggtggagtacgtcgacgacctgctagaattggaagaaacgtcttag

SEQ ID NO: 217120 - DNA, 3471 bp, Artificial Sequence
  Description of Artificial Sequence: Synthetic coding sequence
atggcgtcgctgctaccactcctatgtctgtgcgtggtcgctgcacacttggctggcgcacgagatgcgacacccactgaagaaccaatggccaccgccttggggctcgagcgcagatctgtgtacaccggccagccatcccccgctctggaggattgggaggaggccagcgagtggaccagttggtttaatgtggatcatccaggcggtgacggcgattttgaatcactcgctgccatccggttttactacgggccagccagggtctgcccacggccactggcacttgaagcccgaacaacggattgggctctgccttctgccgtgggggaaagagtgcatctaaaccctacacggggattttggtgtctgaatcgcgagcagcctcgtggcaggaggtgttccaactaccatgttaggttccgttgccctctagaggcatcttggggagcctggggtccttggggtccttgcagtgggtcttgtggaccagggagacgactgagaaggaggcactgtccttcgccggctggggacgcctgcccaggccgacccctggaagcgcagaagtgtgtgagacccaggtgcccaggatgctctttggatacatgcgagtgccctgaccatattctgctcggatctgtggttactccttctggccagccgctgctcggcgcacgtgtctccttgcgtgatcaacccggaacagtagccaccagcgacgcacacgggacgtttcgggttcctggcgtgtgtgctgattctcgggcaaacatccgcgcacagatggatggtttctcagccggagaggctcaggctcaggccaacggctccatctcagtggtcaccataatcctcgataaactggaaaagccttatcttgtgaaacatccagaaagtcgtgtgagagaagctggtcagaatgtgactttttgttgcaaagcctctggcactccaatgcccaagaaatatagctggttccataatggcactctactcgatcggagggcgcacggttacggggctcacctggagctccgcggactgcgccctgaccaggccggaatatatcactgtaaagcatggaatgaggcaggggcagtgcgctccggcaccgctagactaaccgtgctggcgccaggccagccagcttgcgatccaagacctagagagtacctgatcaaacttccagaagattgcggtcagcccggatcagggccagcctatttagatgtgggcctttgccccgatacacggtgtccatctctggccggttcaagcccgaggtgcggcgacgccagttcacgatgctgttctgtccgaagattggagcggagagagattcattgccccggatatgtgcttcccgtcaaggttgtggccgagtgtggctgtcagaagtgccttccgccaaggggacttgtgcggggtcgcgtggtcgccgctgattcaggagaaccactgaggttcgctcggattcttctggggcaagagcccattggcttcaccgcttaccagggcgactttacgatcgaggtcccaccctcaactcagcgtctcgtcgtcacctttgtggatcctagtggcgagttcatggatgcggtccgggtgctgccattcgaccccaggggggcaggggtttatcatgaagtgaaggccatgcgcaaaaaggctcctgttattctgcacacatcccagtccaacacaattccactcggggagctggaagacgaagcccctttgggagagctggtcctgcccagcggcgcattcagaagagcagacggcaagccatactcaggtcccgtggaggctcgcgtgactttcgtggatccacgtgacctgacctctgcagccagcgctccatcagatttgcggttcgttgactcagacggcgagctagctcctctgcggacatacggcatgttcagcgtggatctgcgagcccctggcagcgcagagcagctgcaagtgggtcctgtcgccgttcgcgtggccgctagtcaaatccatatgcccggacacgttgaggctcttaagctttggtccctcaatcctgagaccggactgtgggaggaagaatctgggttccggagagaaggctcaagcggcccaagagtgaggcgagaggagcgtgtctttctggtggggaatgtggagataagggagcgcagactgtttaatttggatgtacctgagcgtaggaggtgttttgtaaaagttcgcgcttatgcaaatgataaattcacacctagcgagcaggttgaaggcgtcgttgtcaccctggtgaacctcgagcccgctcccggtttttcggccaatccaagagcctggggcagattcgatagcgcagtgaccggaccaaacggagcatgcttacctgcattttgcgacgctgatcgtccagatgcatacaccgccttggtgaccgccacattgggcggagaagagctggagccagccccatccctaccacggcctcttccagccaccgtgggtgtcactcagccttatctggaccggctgggatatcgacggaccgaccacgatgaccccgcttttaagagaaacggcttccggattaatttggcgaagccaagacccggagatcccgctgaagcgaatgggccagtttacccctggcgatcactccgtgagtgccaaggtgctcccgtcaccgctagccattttagattcgctcgcgtggaggccgacaaatacgagtacaacgtcgtccctttccgggaggggactccggcatcatggacaggcgatctcttagcatggtggcccaatcctcaggagtttcgcgcatgcttcctgaaagtgaaaatccaggggccacaggaatacatggtgcgttcccataatgccggagggtcgcatccaagaaccaggggtcagctgtacggactgagagacgctagaagcgtgcgggatccggaaaggcctgggaccagcgccgcttgcgtcgagttcaagtgttctgggatgctgttcgaccaacggcaagtggacagaacgttagtgaccattatgcctcagggatcatgtaggagagtcgccgtaaacggcttgttgcgagactatcttacccgtcatccccctcctgtgcctgctgaagatcctgccgctttctctatgttagctcccttggatccattgggtcacaactatggcgtctacaccgttactgaccagagccctagactggccaaggagattgctattggacgatgcttcgatggatcatccgatgggtttagtagggagatgaaagcggatgccggaacagctgtgactttccagtgtagagaaccacctgctggtcgccctagtctcttccagagactgctggagagccccgcaacagctctgggtgatattaggagagaaatgagcgaggcagctcaggcacaggcgcgtgcgtctgggcctttgcggaccagaagagggagggttcggcagtag

SEQ ID NO: 217121 - DNA, 3555 bp, Artificial Sequence
  Description of Artificial Sequence: Synthetic coding sequence
atggtcggaacaaaagcgtgggttttttcattcttagtgttggaagtgacaagcgtgctcggcaggcaaactatgctaacccaatcagtgagacgggtgcagccgggtaaaaagaaccccagcatcttcgcgaagcctgccgacacattggagagccccggagagtggacgacgtggttcaatatcgactatcccggaggcaagggagactacgagcgactggacgcgataagattttactacggcgacagggtatgcgctagacccctgcggctggaggcacggactactgactggacaccagccggtagtaccggccaggttgtacatgggtctccacgtgaaggcttctggtgtctgaatcgggaacagagacctggtcagaactgttccaattacacagtcaggttcctgtgccctccaggctcactcaggcgtgacacggagaggatttggtctccatggagcccatggagtaaatgttccgctgcctgtggacagacaggggtgcagactcgtaccagaatttgcctggctgaaatggtctctctgtgttctgaggcgtccgaagaagggcagcactgcatgggccaggattgtactgcctgcgacctcacatgcccgatggggcaggttaacgctgattgtgatgcatgcatgtgccaggacttcatgttacacggagcagtcagtctacccggaggggctccagcctccggggctgcgatttaccttctgacaaagactccaaagctactgacgcagacagacagcgacggccgttttcgaatcccaggtctgtgcccagacggcaaatccattctgaaaattacgaaggtcaaattcgcgcctattgtcctgactatgcccaagacctccttgaaagccgcaacaatcaaggccgagtttgtgagggctgagactccatacatggtcatgaaccccgaaacgaaagccagacgcgcaggccaatccgtgagcctatgctgtaaggccaccggaaaacccagacctgataagtacttctggtatcacaacgatactctgctggacccgtctctgtataaacacgagtcaaagcttgtcctgcggaaattacagcagcatcaggcgggtgagtacttctgcaaagcacagagtgatgctggagcagtaaagagcaaagtggcccaacttatagtgatagctagcgacgagacaccatgtaacccagtgcctgagtcttatcttatccgtctccctcatgattgttttcagaacgcgaccaatagcttctactatgacgtaggccgatgccctgtcaaaacctgcgccggacaacaggataatgggattagatgtcgtgacgcagtccagaactgctgcggcatatcaaagacagaagaaagggagattcaatgcagcggatatacactgcctacgaaagtggcaaaggagtgttcatgccaacggtgtactgaaacacgctccatcgtgagaggccgtgtctccgcagctgacaatggagagccaatgaggtttggccatgtgtacatgggaaacagcagagtttcaatgaccggttacaaggggacgttcaccctgcacgtgccacaggacaccgaaaggctggtattaaccttcgtcgacagattgcagaagttcgtgaatactactaaggtactgcctttcaataagaagggatccgccgtgttccatgagataaagatgctccggaggaagaagccgatcacacttgaggctatggagacaaatataatacccctcggggaggttgtgggggaagatcccatggccgagcttgaaatccctagtaggagcttttaccggcaaaacggggagccctacatcggaaaggtgaaggctagcgtcacatttcttgatcctagaaacatctcaaccgcaaccgctgcccagaccgacttgaatttcattaatgatgagggggatacgttccctctgaggacctatggcatgttcagcgtagatttccgggatgaggttaccagcgaaccattgaatgccggaaaggttaaggtgcacctggattcgacccaggtcaaaatgcctgaacacatttctaccgtgaagctttggtctttgaaccccgatactgggctgtgggaagaggagggcgactttaaattcgaaaaccagaggcgcaacaagagagaggataggactttcctcgtcgggaatttggagataagggaacggagactctttaacctggatgtcccagaatcacgaaggtgttttgtgaaagtcagagcatacaggagcgagcgctttctgccatctgagcaaatacaaggcgtcgttataagcgtgattaacttggaacccagaaccgggtttcttagcaaccctagagcttggggtaggttcgattctgtcatcactggccctaacggggcatgtgtacccgcattttgcgacgaccagagtcctgacgcctattctgcctacgtcttggcatccttagcaggcgaggaactccaggctgttgaaagcagtcccaaattcaatcccaacgcgatcggcgtcccacagccttacctgaacaaattgaactaccgtagaacagaccatgaagatcctcgcgtcaaaaagaccgcattccaaatcagcatggccaagccgaggcccaattccgccgaagaatcaaacggccctatttacgctttcgagaacctgcgggcatgtgaagaggctcctcccagcgcggctcacttccgcttctatcagattgagggtgaccgatacgattacaataccgtcccatttaatgaagacgaccctatgagctggaccgaggattatctcgcctggtggcccaaacctatggaattccgcgcatgctacatcaaggtcaagattgttggcccactagaagttaacgtccgatctcgcaacatgggaggcactcatcgacaaaccgttggcaaactgtacggcatacgcgacgtgcggagcacgagggatagagaccagcccaatgtttcagctgcatgcctggaatttaagtgctctggaatgctctacgatcaagacagagtggatcgaactctggtgaaagtaatcccccagggatcttgcaggcgagcaagcgtgaatcccatgttgcatgagtacctcgttaaccacctgcccctggcggtcaacaacgatactagcgagtacacaatgctggcgccactcgatcccttaggacacaattacggtatatatactgtgactgatcaggacccgaggacagcaaaggagattgccctgggtagatgctttgatggcaccagcgacggatcctcacgcattatgaagtccaacgtgggggtcgctcttacttttaactgcgtggagaggcaagtggggcgacagtcagcattccagtacctgcagtcaacacctgctcaaagccccgctgcgggaactgtccagggacgggtccctagtaggcgacaacagagggccagtcgtggtgggcaaagacagggaggcgtggtggccagcttgcgatttcccagagtggcccaacaacctttgatcaattag

SEQ ID NO: 217122 - DNA, 8148 bp, Artificial Sequence
  Description of Artificial Sequence: Synthetic coding sequence
atggccgctgcagcaggcggtggctcatgtccgggaccaggtagtgcccgaggaaggttcccaggccgaccacgtggagcaggagggggaggaggtcgagggggaaggggcaacggagcggaacgcgtgagagtagctctgcggagaggcggtggcgcaacgggtcctggcggagcggagccaggagaagatacagcacttctccggctcctcggcctgagacggggacttaggagactgcgccgtctgtgggccggtccacgagtccagagaggccgaggccgtggtcgcggacgaggctggggccctagcagggggtgtgtccccgaggaggagagttccgacggggaatccgatgaagaggaatttcagggattccattccgacgaggatgtcgccccttcaagcttacggagcgcactgaggagccaaaggggtcgtgcccctagagggagagggcgaaaacacaaaacaaccccactgccacctccgagactcgccgatgtggctcctactccacccaaaaccccagccagaaagcgtggcgaggaaggcacagaacggatggttcaggctctgactgaactgctccggagagctcaggctccacaggcgccaaggagccgagcttgcgaaccttcaacccctaggaggagtcggggaagacccccagggagaccagccggaccctgccggaggaaacagcaggccgtggtggtagccgaagccgctgtgacaatacccaaaccagagccaccccctccagtagtccccgtaaaacaccaaacaggctcttggaagtgtaaagagggtcctggccctggaccagggacaccgcgtaggggaggtcagagttcacgcggtgggcgaggcggacgcggacgagggcgaggaggcggacttccctttgtgatcaaatttgtaagtagggctaaaaaggttaagatgggccagctcagccttggtcttgaatccggccaggggcagggtcaacatgaggaatcctggcaggacgtgccccaacggagagtgggcagcgggcaagggggatctccttgttggaagaaacaggagcagaaactcgatgatgaggaagaagaaaaaaaagaggaggaagagaaagacaaagagggagaggagaaagaggagagggcggtcgccgaagagatgatgcccgcagctgagaaggaggaggcaaagctgcctcccccacccttaactccccctgctccctcccctccccctccgcttcctcctccttcgacatcccctcccccaccattgtgcccgccaccacccccacccgtgagcccccctccactgccttcccctcctcccccacccgcacaggaagagcaggaagagtcccctccacccgtggtacccgcaacctgtagccgcaagagaggcaggcctccactcacccctagccagcgcgcagaacgcgaagctgccagggcaggccctgagggaacctcaccacccacgcctactccgagcactgccactggcggaccacccgaggactccccgactgtcgcccctaagtcaacgacctttctgaagaacatccgacagtttatcatgcctgtcgtgtccgccaggtctagtcgcgtgattaagacaccacggaggtttatggatgaagatcctcctaagcccccaaaagtcgaggtgtcacctgttctccgtccgcctatcactacgtctcctcctgtccctcaggagcccgcacccgtgccaagcccacctagggcccctactccaccctccacacccgtgcccctgccggaaaagaggcgctcgatcctgcgtgaacccacgttcagatggacctctctgactagagaacttccaccaccaccacccgcacctccacctccacccgcaccgtctcccccacccgctcccgcaacgagctcaaggcggcctttgctgctgcgggcaccccagttcacacctagcgaagcccacctcaagatctacgagagtgtgctgacgcccccaccactgggagctcctgaggctccagaacctgagcccccacccgcagatgactctcctgccgaaccagagcctcgagccgtggggagaacaaatcatctgtcactgcccagattcgcacctgtcgtgaccacacccgtgaaggcagaggtgtccccccacggggctcccgctctctctaatggaccacagacacaggcgcagctgcttcagcccctgcaagcgctccagacccagctgttgccacaggcactacccccaccacagcctcagctgcagcctccaccctccccacaacagatgccacctctggagaaggctcgtatagccggagttgggtccctgcccctaagcggtgtggaggagaagatgtttagtctgctgaagcgagctaaagtgcaacttttcaaaattgaccagcagcagcaacagaaagtggcagccagtatgcccctaagtcccggagggcagatggaagaggttgccggagctgtcaagcagatcagtgacagaggcccagtaaggagcgaggatgaatcagtcgaggccaaaagagaaaggccgtccggtcccgaatcccctgttcagggcccaagaattaagcatgtgtgcagacacgccgcagtggctctcggtcaggctcgggctatggttccggaggacgtcccccgtctaagtgcgctgccgctgcgcgatcgccaagacctggcaacggaagatacttctagtgccagcgagaccgagtccgttccctctcggagtaggcggggtaaagtggaggcggctggcccaggcggagagagcgagcccacaggaagtggcggtacattggcgcacacgcctaggcgatctctaccaagccatcacggcaagaagatgcgtatggcacgctgtgggcactgtcgaggatgcctcagggtgcaggattgcgggtcctgtgtcaattgtcttgacaagccaaaattcggagggcctaacactaaaaagcagtgttgcgtgtatagaaagtgcgataaaattgaggcccgaaagatggagagactggccaaaaaaggcaggacaatagttaaaaccctcttgccttgggactcagatgagtctcccgaggctagccccggtcctcctggcccacggagaggagctggtgccggagggcctcgagaggaggtggtggctcaccccggtcctgaggagcaagactccctgctgcaacgcaaatcggcccgtaggtgtgtgaaacaacggccaagctatgatattttcgaagacagcgacgactcggaaccagggggtccacctgcccctcgccgtagaaccccacgcgagaatgagttacccctgcctgagccagaggagcaatcaagaccacggaagcccacacttcagccggtgttgcagctgaaagcccgaaggcgacttgataaggacgccctggcccctggccctttcgcatccttccctaatggctggaccggtaaacaaaaatctccggacggcgtacacagagtcagggtagatttcaaggaagattgcgatctggagaacgtttggctgatgggcggactctctgtgctcacctctgtgccgggtggtccacccatggtgtgcctcctgtgcgctagcaagggactacacgaactggtgttctgccaggtttgttgcgacccatttcatcccttctgcctcgaggaggccgaaaggcccctcccacagcaccacgacacctggtgttgccgacgatgtaagttttgccacgtgtgtggcaggaagggtcgtggctctaagcacctgctcgagtgtgagagatgtagacacgcttaccatcctgcctgcctgggtccctcctaccccacccgtgcaactcgtaaacgtcgccattggatttgcagcgcctgcgtgagatgcaaatcttgcggtgcgacaccgggaaagaactgggacgtggagtggtctggagattatagcctctgcccacgctgtacccagctgtatgagaagggtaactattgtcccatctgcacgcgctgctacgaggacaatgactatgaatcaaagatgatgcaatgcgcccagtgtgatcattgggtgcacgcgaagtgcgagggtctgagcgacgaggactatgaaatccttagtggtctcccagacagtgtactctacacctgcggaccctgcgctggagcagcacagccaaggtggcgggaagcactgtccggcgctctacaagggggtctgaggcaggtcctgcagggactgctgagcagcaaagtggtgggccctctgctgctctgcactcagtgcggccctgacggtaaacaattgcatcctggtccctgcggcttacaagccgtcagtcagcgatttgaagacgggcactacaagagcgtgcattcgttcatggaagatatggttggaatcttaatgcgccattccgaggagggggaaacccctgatagaagagcgggaggccagatgaaagggctgctgctcaaactgctcgagagcgccttcggttggtttgacgcccatgaccctaagtattggcgcagatcaactaggctcccgaacggggtgctacctaacgctgttttaccccctagtcttgatcacgtctatgcccagtggcggcagcaggagccagagacaccagaatcaggccaacccccaggtgaccccagcgcagccttccaagggaaagacccggctgccttcagccacctggaagatcctcgacagtgcgccctctgcttgaaatatggtgatgccgactctaaggaagccggtaggttgctgtatattggccaaaatgaatggacgcatgtgaactgcgctatctggagcgccgaggtgtttgaagagaatgatggctccctcaagaatgtacacgccgcagtggcgagaggacgtcaaatgcgctgtgaactttgcctaaagcccggagcaactgtaggctgctgcttgtcctcctgtctgtccaacttccactttatgtgtgccagagcaagctattgcatttttcaggacgacaaaaaggttttttgccagaagcacaccgacctactggatggcaaggagattgtgaatccggacggtttcgacgttctcaggagagtctacgtggattttgaaggcatcaatttcaagcgcaagttcctgaccgggctggagcccgacgccatcaacgtgttaatcggaagcatcaggatcgatagcctaggcaccctgagcgatttatctgactgtgaagggcgattgttcccaattgggtatcagtgcagtcgtctgtactggtccactgtcgatgccagaagacgatgttggtaccgctgccgcatcctcgaatatcgcccatggggacccagagaggagccagcccatcttgaggccgcagaggaaaaccagacaatcgttcactcaccagccccatcctcagaaccccctggcggagaggacccaccgctcgataccgatgttctcgtgcctggagcccctgaacgtcactctcctattcagaatctggaccctcccctacgacctgactcaggcagcgcacctccaccggctcctcggagtttcagtggagcaaggatcaaagtgccaaactattctcccagccgcaggccactcggcggtgtctccttcggccctctgcccagccccggttcaccatcatcactaacccatcatatccccactgttggcgatcccgattttcctgcaccccctaggagatcccgtcgacccagtcctctggctccgagaccccctccaagccgatgggccagccccccactgaagacctctccccagcttcgtgtgcccccacccacaagcgttgtgacagccctgacacccacctccggcgaacttgcacccccaggccctgccccaagtcccccacccccagaagatctgggtcccgacttcgaagacatggaagttgtgtccgggttatctgctgcagatttggatttcgccgctagcctgctggggacagagccatttcaagaggaaatcgtggctgcaggggctatggggtcatcacacggaggaccgggtgattcatccgaagaggaaagcagcccaacctcccggtacattcattttcccgtcaccgtggtttctgcccctggtctggccccatctgccacccccggtgcaccccgtatcgaacaacttgatggggtggacgatggcacagacagcgaggccgaggcggtccagcagccacgcggacagggcaccccaccctcagggcctggtgttgtgagagcgggagtgttaggggctgccggagatcgggctcgaccgccagaggacttgccatctgaaatcgtggacttcgttctcaagaatttgggtggaccgggagatgggggtgcgggtccaagagaagaatcgttgcctcctgctcctcccctcgccaatgggagccagcctagccagggtttaaccgcctcaccagccgaccccacccggaccttcgcatggctgcccggtgctcccggtgtgcgtgtcctttctctgggcccagcccctgaacctcctaagcctgctaccagcaaaattattctggttaacaaactgggccaggtgttcgtcaaaatggccggagagggagagcctgtccccccacccgtcaagcagccgccactgcctccaactattagccccacagctccaacatcgtggaccctgccaccagggcctctcctgggtgtccttccggtggttggcgttgtgaggcctgctcctcctcccccacccccaccactgaccctggtcctcagctcaggccctgcatcaccccctaggcaggctatacgggtcaagcgtgtgtctaccttctccggacgtagtccacccgcaccacccccatacaaagctccacgcctggacgaagatggagaggcttcagaggacacacctcaagtgcccggattgggctctgggggttttagccgagtgcgtatgaaaaccccaacagtccgtggtgtgctggatttagatcgacctggggagccggctggagaagaatcacccggaccactgcaggagaggagcccactgctacccctcccggaggatggaccgcctcaggtgcccgacggcccaccggatctccttctggagagtcagtggcaccattactccggtgaggcaagttcctcggaggaagagcccccttcccccgatgataaggagaaccaagcccctaagagaacaggacctcacttaagattcgagattagcagcgaagatggtttcagcgtggaagccgaaagtttggagggagcttggagaacgctgattgagaaagtccaggaggctcggggtcacgctcgcctaagacatctttctttttcaggtatgagcggagctcgcctacttggaattcatcacgacgcagttatcttcctggctgaacagctaccaggtgctcagaggtgccagcattacaaatttagataccaccagcagggcgagggccaggaagaacctcctctgaaccctcatggtgcggctagagcagaggtttatcttcgtaaatgcaccttcgatatgttcaacttcctcgcgtctcagcatcgtgtgctcccagaaggagccacgtgcgacgaggaagaagatgaggtgcagctcagatctaccaggagagccactagcctggaactccccatggctatgagattccggcaccttaagaagactagcaaggaagcggttggtgtctatcgatcagcgatccacggtaggggactattttgtaaaagaaatatcgatgccggtgaaatggtgatagagtatagcggaatcgttattcggtctgtgctgacagacaagagagaaaaattctatgatggtaaaggtattgggtgctacatgtttcgcatggatgattttgacgtggttgacgccaccatgcacggaaatgccgctcgctttattaaccactcatgcgagccaaactgtttctcccgcgtgatccatgtcgagggacaaaaacatatcgtgatatttgctcttcgcaggattttgcggggtgaagaactcacatatgattataaatttcctatcgaagacgccagcaacaagctgccgtgcaactgcggagccaagcggtgtcggaggtttttaaattac

SEQ ID NO: 217123 - DNA, 2115 bp, Artificial Sequence
  Description of Artificial Sequence: Synthetic coding sequence
atggtgcctgacactgcatgcgttttgctgttaaccctcgccgctctcggagcttctggacagggtcagagccctctgggatcagacctggggcctcagatgctgcgggaactgcaggaaaccaatgccgctctgcaggatgtcagagagctgctgcgccagcaggtacgggagatcacttttcttaagaataccgtcatggagtgcgatgcatgcggcatgcagcagagtgtaaggactggcctgcccagcgtgcggccactccttcactgtgcaccaggattttgttttccaggagtggcatgcatccaaaccgagtccggggcaaggtgtggcccttgtccggcagggtttactggaaacggatcacactgtacagacgtgaacgaatgcgagacagggcagcacaattgcgttcctaactcggtttgcatcaacactagaggatcatttcagtgcggtccttgtcaacccggttttgtgggggatcaagcctctggctgccaaagaagagctcagcgcttttgtccagatggtagtccaagtgaatgccatgagcacgccgactgcgttcttgagagggatggatctcgcagctgcgtgtgcgccgtggggtgggctggcaatggcattctctgcggtcgcgatactgaccttgacggatttccggatgagaaattgagatgcccggaaaggcagtgtcgtaaggacaactgtgttaccgtgcccaattcaggacaggaggacgtcgaccgtgatggcattggagatgcctgcgacccagacgcagacggcgacggcgtccctaacgagaaggacaactgccctttagttaggaaccctgaccaacgtaacacggacgaggataagtggggcgacgcctgtgacaattgcagatcacagaaaaacgacgaccaaaaggacactgatcaggatggtaggggagacgcctgtgacgacgacatcgacggggataggatccgcaaccaggccgacaattgcccccgtgttcccaacagcgaccagaaggacagtgatggagacggcattggggatgcgtgcgataattgccctcagaagagcaaccccgatcaggctgacgtggaccatgatttcgtgggcgatgcttgcgatagcgaccaggaccaggacggagatggccatcaggactctagggataattgtccaacagtgcctaactcggcgcaagaggatagcgaccatgacgggcagggcgatgcttgcgacgatgatgatgacaacgatggtgttcccgactctcgtgataactgcaggcttgtgcccaaccccggacaagaggatgccgatagggatggcgttggcgacgtgtgtcaggacgattttgatgccgacaaggtagtggacaaaatcgacgtctgtccggagaatgccgaagtcactctgacggattttagggcctttcagaccgttgtccttgatccagagggcgacgcgcagatcgaccctaattgggtggttctgaatcaggggagagagatcgttcagacgatgaatagcgaccccggattggcggtgggatacaccgctttcaatggcgtagactttgagggcacattccacgtcaataccgtgaccgatgacgattatgctgggttcatcttcggctatcaagactctagctcgttctatgtggtgatgtggaaacagatggagcagacttactggcaggccaatcccttccgagcagtagccgaaccgggtattcagctgaaggctgtgaagtcatccactggtcccggagagcagttacgtaacgctctttggcacactggcgataccgaaagtcaggtccgtctgctgtggaaagatccaaggaacgtcggctggaaagataagaagtcctaccggtggtttctgcagcacagacctcaggtgggatatatccgagttcgcttttacgagggcccagagctcgtggccgactcaaatgtcgtcttggacacaacaatgcgcggagggcgactgggggtcttttgtttttcacaggaaaacatcatatgggctaatctgcgttatcggtgcaacgacactatccctgaggactatgagacacatcagctccgccaggcatag

SEQ ID NO: 217124 - DNA, 2235 bp, Artificial Sequence
  Description of Artificial Sequence: Synthetic coding sequence
atggtaccagatacagcctgcgtgcttctcttaactctggccgcattgggcgcaagcggccagggacaaagccccctcggatccgatctgggtcctcagatgctgagagagctgcaggagaccaacgctgccctgcaagacgttagagaactgctgcgccaacaggttagagagatcacatttctcaagaacactgtgatggagtgtgatgcctgcggtatgcagcaaagtgtccgaactggactgccttccgtacggcctctgttacactgtgcaccagggttttgtttccccggaccttgtcccgcaggcttcactggcaacgggagccattgcacagacgtcaatgagtgtaatgcccacccctgctttcctcgagtaaggtgcattaacacgtctcccggattccgatgcgaggcgtgccctcccggatattcaggaccaacccatcaaggggtagggctcgcattcgcaaaggccaataaacaggtgtgtacggacatcaacgagtgcgaaactggccagcataactgcgtgccgaattcagtgtgtatcaacactaggggttcttttcaatgcggaccgtgccagcccggtttcgtcggggaccaagcatccggatgccagcggagagcccagagattctgtcctgatggctccccctccgagtgtcacgagcacgctgactgtgtgctcgaacgagatggctctcgatcttgtgtgtgcgctgtgggctgggccggaaatgggatactgtgtggcagggacaccgacctcgacgggtttccagatgaaaagctcagatgtccagagcggcagtgccgaaaagataattgtgtcaccgtcccaaactcaggccaggaggatgtggatagagatgggataggagacgcttgtgatccagacgcggacggtgacggagtgcccaatgagaaagacaactgcccactggtccgtaacccagatcagagaaacaccgacgaggacaagtggggcgacgcttgtgacaactgtaggagtcagaagaacgacgaccagaaggataccgatcaggacggacggggtgatgcttgtgatgatgatatagacggcgacaggattcgcaatcaggcggacaactgtcctagggtgccaaactctgatcaaaaagactccgacggagatggaataggagatgcctgtgacaattgtccacagaagagcaatcccgatcaggccgatgtggaccacgacttcgtgggtgacgcatgcgactctgaccaggatcaagatggggatggacatcaggactcccgggacaattgtccaacagtgccaaatagtgcccaggaagactctgaccatgatggacagggcgatgcctgcgacgacgacgatgataacgatggcgtgcccgactcccgggacaactgtcgactcgttcccaaccctgggcaggaggacgcggaccgcgacggggtgggtgatgtgtgtcaagacgatttcgacgcagacaaagtggtggacaagatcgatgtctgtccagaaaatgctgaagtgactctcaccgatttcagagcgttccagaccgttgtgctagaccccgaaggggacgcgcaaatcgatccaaattgggtcgtcctaaaccaaggcagagagatagtccagacaatgaacagcgatccaggactggctgtgggttatacagctttcaatggagtggattttgaaggcacatttcatgttaacaccgttacagatgatgattacgcagggtttattttcggctaccaggatagctctagcttctatgtggtgatgtggaaacaaatggagcagacttactggcaggctaacccattccgagctgtggccgagccaggcatccaacttaaggccgtaaaaagtagtaccgggcctggggagcaactgaggaacgccttatggcacacaggcgacaccgaaagtcaggtaaggctgctgtggaaagacccacgaaatgttgggtggaaagataaaaaaagctatcgctggtttctgcagcatcggccacaggtaggatatattagagtaagattctacgaaggacctgaactggtggcagacagtaatgtcgtcctcgatactaccatgcggggtggcagactgggcgtcttttgctttagtcaggaaaatattatctgggctaacttgaggtacaggtgcaacgacaccattcccgaggattatgagactcaccagctgagacaggcttag

SEQ ID NO: 217125 - DNA, 2394 bp, Artificial Sequence
  Description of Artificial Sequence: Synthetic coding sequence
atggctgcgcttgcgtacaatctaggaaaacgcgagattaaccattacttttccgtccgcagcgcaaaggtattagccctggtggccgtgctgctcctagccgcatgtcatcttgccagccgtcgatatcgcggtaatgattcctgcgagtatctcctgtcatccggcaggtttctcggagaaaaggtgtggcagccccactcttgcatgatgcataaatataagatttcagaagcaaaaaattgcctagtcgacaagcacatcgcctttattggggattcgaggatcagacagttgttttactctttcgtaaagatcatcaatccgcaattcaaggaggagggaaataaacatgaaaacattcccttcgaggataagaccgcatcggtcaaggtcgactttctgtggcaccccgaggtcaatggctctatgaagcagtgcatcaaagtctggaccgaggactcaattgctaagcctcacgtaattgtggctggggctgccacttggtcaattaaaattcataacgggagctcggaagcactgtcccagtacaaaatgaacatcaccagcatcgctccccttcttgagaagcttgctaagacttctgatgtgtattgggtccttcaggaccccgtgtatgaagacctactgtcagaaaataggaaaatgattaccaatgagaagattgacgcctataatgaggctgctgtgagcattctgaatagctccactcgaaactctaagagtaatgtcaagatgttcagcgtaagcaagctcattgcccaggaaaccattatggaatctcttgacgggctccatctacctgaatccagtagggagactaccgccatgattctgatgaacgtgtattgcaataagatcctgaagcctgttgatggatcatgctgtcagcctcggcctcccgtgacacttatccagaagctagcagcctgcttttttactttaagcataattggttacctcatcttctatatcatccatcgcaatgctcatcgtaagaacaaaccctgcacagatctggaatccggtgaagagaagaagaacattatcaacacccctgttagcagcctggaaattttgctgcaatccttctgtaagttaggtctgatcatggcatacttttacatgtgtgatagagccaatctgttcatgaaggagaacaaattttacacacattcttcttttttcatcccaatcatctatatacttgtactcggcgtgttctacaatgaaaataccaaggaaactaaagtgctcaacagggagcagactgacgaatggaaaggatggatgcagctggtgatccttatttatcatatctccggggcttcaactttccttcctgtgtacatgcacattcgcgttctcgtcgcagcctacctctttcaaactggttatggccatttctcctatttctggattaagggggactttggtatctacagagtgtgccaagtgctgttcagactgaacttcttggtggtggtgctgtgtattgttatggatcggccttatcagttttactatttcgtgcccctggtcaccgtctggttcatggtgatctatgtaaccctcgccctgtggccccaaatcatccagaagaaagcaaatggtaactgtttctggcatttcggccttctgctaaaactgggcttccttctgctgttcatttgtttccttgcttacagtcagggcgcttttgaaaaaatatttagtttgtggccactgtcaaagtgtttcgaacttaagggcaatgtttacgagtggtggtttcggtggaggctggatcgctatgtggtgtttcatggaatgttatttgcctttatttatcttgctctgcagaaaaggcagattctgtccgaagggaaaggtgagccgctgttttccaataagatcagtaacttcctactgtttatcagcgtcgtgtcgttcctcacctactcaatttgggcaagctcttgtaaaaataaggctgaatgcaatgagttgcacccgagcgtcagcgtagtccagattctagctttcatcctgatccgcaacatccccggatatgcaaggagcgtttattcctcattcttcgcctggttcgggaagatcagcctggaactttttatctgtcagtaccacatttggttagccgcagacactcgtggtatcctggtgttaatccccggtaatcccatgttgaacatcatcgtctctacttttatttttgtgtgtgtggctcatgaaattagccagatcaccaatgatctagcacagattatcatccccaaggacaacagcagcttactcaagaggttggcctgtattgccgcattcttctgtgggctgctcattctctcctctatacaagataaatccaaacactag

SEQ ID NO: 217126 - DNA, 2721 bp, Artificial Sequence
  Description of Artificial Sequence: Synthetic coding sequence
atggccggtaacgtgaagaaaagctcaggagccggagggggttctggcagcggcggaagcggctcagggggtttgatcggactaatgaaggatgcctttcagcctcatcaccatcaccaccaccatctaagcccacaccctcccggaaccgtagataagaagatggtggagaaatgctggaagttgatggataaggtggtgcgcctatgtcagaaccccaaactcgcccttaaaaactcgccaccttacatcctagacctcctgcccgacacttaccagcatttacggactatactgagtaggtatgaaggtaaaatggaaaccttgggtgagaacgaatacttccgggtgttcatggaaaacctgatgaaaaagacgaaacaaacaatctcactattcaaggaaggaaaggagcgaatgtacgaggagaactcccaacccaggaggaacttaactaagctgtctttgatctttagccacatgctggccgagctgaagggcatcttcccctccggactgtttcagggcgatacctttcggattactaaagcagacgccgctgaattttggaggaaggcatttggagaaaagaccatcgtgccatggaagtctttcagacaggccctgcacgaagtccaccctatctcatccgggctggaagcgatggctcttaaatccacgatcgatcttacctgtaacgactatatttccgtgtttgaattcgatatcttcaccaggcttttccagccgtggtcttcactgctgcggaactggaacagtctggctgtgacccacccaggatatatggcattcctgacctacgacgaagtaaaagctaggctgcagaagtttattcataaacccggtagttacatttttcgccttagctgcacgagactgggtcaatgggccattggatatgtaactgcagatggcaatatactccaaaccatcccacacaataagccactcttccaggcactgattgacggctttcgcgaggggttttatctcttcccggatggcagaaaccagaatcccgaccttactggactctgcgagcccacgcctcaagaccatatcaaggtcacacaggaacagtacgagctgtactgtgagatgggctcgactttccagctttgcaagatatgcgctgagaatgataaggacgtgaaaatcgagccctgtggccatctgatgtgtacgtcttgtctgacttcgtggcaggaaagcgaaggccagggctgtcccttttgccggtgtgagattaaagggacagagcccatagtggttgacccttttgaccccaggggctctggatccttgctgcgccaaggtgcggaaggcgcacccagcccgaactacgatgatgatgatgacgagcgcgctgatgacactctgttcatgatgaaggaactcgcaggggctaaagtggaacgccctccatcccctttctccatggcaccccaggcatccctgcctcctgtgcctccacgcttggatcttcttccacagcgagtgtgtgttccctcttcggcctctgctctgggcaccgcctctaaagcggcttccggcagcctgcacaaggacaaacctcttcccgtcccgcctactttgagagatctgcccccaccaccacctcccgatcgcccttactccgtgggtgctgaatcgaggcctcagaggagaccgttgccctgcacgcctggtgactgcccatcccgcgacaagctgcccccagtccccagctccaggctgggcgatagctggctacctagaccgattcccaaggtgcccgtgagtgcccctagcagctcagacccctggacaggcagagagcttaccaaccgccactcattgccatttagcctgccgtcccaaatggaaccccgacccgacgtacctaggcttggttccacattctctttggacacatccatgtctatgaattcttctccgttggtgggtcccgaatgcgaccatcctaaaattaagccatcatccagtgccaacgcaatctatagcctagcggctcggccactgcctgtcccaaaattgcccccaggggaacagtgcgagggcgaggaagatacagaatacatgaccccgagctctcggccactgcgtccgttagatactagccagtcttccagggcgtgtgattgcgaccaacagatcgactcctgcacatacgaggctatgtataatattcagtctcaagctccaagtattaccgaatcatctactttcggagaagggaatctggccgctgcacacgccaataccggccctgaggagagcgagaacgaggatgacggatacgacgtccctaagccgcctgtccccgctgtcctcgccagacgcaccttatctgacatcagcaacgcatcctcatcctttggctggctgtcactggacggggacccaacaacaaacgtgacagaaggctcgcaggtacctgagcggccacccaagcctttcccgagacgcataaattccgaaaggaaagccggttcttgccagcagggcagtggccctgcagcctcggccgcaactgcatctccccaattgtcgagcgagatcgaaaaccttatgtcccagggatatagctatcaggacattcagaaggcactcgtgatagcccagaacaatatcgagatggccaaaaatatcctgcgcgagtttgtctctatatccagcccagcccacgtggcaacatag

SEQ ID NO: 217127 - DNA, 2949 bp, Artificial Sequence
  Description of Artificial Sequence: Synthetic coding sequence
atggccaactcaatgaatgggcgaaatccaggtggtcggggtggcaacccgagaaaaggccgaattctcggcattatcgacgctatccaagacgcagttggcccacccaagcaggcagccgctgacaggcgaacagtcgagaagacatggaagctcatggacaaggtagtacggctgtgccagaacccaaaactccagctgaagaactcccccccatacattcttgatatcctgcctgacacctaccaacacctgaggctgatcctttccaaatacgatgataatcaaaagctagcgcagttgagtgaaaatgagtattttaagatctatattgattcgcttatgaaaaagtccaagcgagccattcgactgttcaaggagggaaaagaacggatgtacgaggaacagtcgcaagataggcgcaacctgactaagttgtcactgatcttctcgcacatgctcgccgaaatcaaagcaattttccccaatggtcaatttcagggtgacaacttcaggatcacaaaagcagacgccgcagagttttggaggaagtttttcggagacaagacaattgtgccttggaaagtttttcggcaatgtctccacgaagtccaccagatatcctcaggtttggaagccatggctctcaagtctacaatagacttaacgtgtaacgattacatcagcgtgttcgagttcgacatcttcactagactcttccagccgtggggctccatattgaggaattggaacttcttagctgttacacatccagggtacatggccttcctcacttacgacgaggtcaaagcccgactccagaaatacagtaccaaacccggaagttacatctttcggctttcgtgtactaggctaggacagtgggctatcgggtatgtgacgggcgacggcaatatcttacagacaattccccacaataagcccctttttcaagctctgattgacgggtctcgagaaggcttctacctttatccggacggacggtcatacaaccccgatttgaccggactgtgcgagccaacaccacatgaccacattaaggttactcaagaacagtatgaactgtactgtgagatggggagcaccttccagttatgtaaaatttgcgctgagaacgataaggatgtcaagatcgaaccatgcggacacctgatgtgcacctcatgtttgacagcttggcaggagtccgacggacagggctgtcccttctgtcggtgtgagattaaaggcactgagccgatcattgtggacccttttgatcccagggacgaggggtctcggtgttgctccattattgacccttttggcatgccgatgcttgatcttgacgacgatgacgatcgcgaggagagcctaatgatgaacagacttgccaatgtgaggaaatgtaccgataggcagaattctcctgtgacttcacctggatcctcaccgctcgctcagcgacggaaacctcagccagaccctctgcagattccacacctgagtctgccccctgtaccccctagactcgatttaatccaaaaaggcatagtgaggtctccatgcggaagcccgactgggtcccccaagagctctccttgcatggtccgcaaacaggacaaacctctccctgcgcctccaccgcctttgagggacccacccccaccaccacccgaacgtccaccaccgatccccccagacaatcgtctcagccggcatatccaccatgttgagagcgttccatccagagaccctccgatgcctctggaagcctggtgccctcgagacgtgttcggcacgaaccaattggttggatgtaggctgctcggagaggggtcacccaaaccagggatcaccgcctcctcgaacgtgaatggccgacactctagggtgggcagcgacccggtactaatgcggaagcatcgccgtcacgatctaccactcgaaggcgctaaagtgttcagcaatgggcatctggggtccgaggaatacgatgtgccgccaagactgagtcctcctcctccggtgaccactctgctgcctagcatcaaatgcacgggacctcttgcaaactcccttagcgaaaaaacaagggatcctgttgaagaggacgatgatgaatacaagattccgtcttcccatcccgtgtccctgaactcccaaccctctcactgtcacaacgtaaaacctcccgtgaggtcttgcgacaatggtcactgcatgcttaatggcacccacggcccttcaagcgaaaaaaagagcaacatacccgacttgtctatttacctgaagggcgatgtttttgactctgctagtgacccagtacccctgcctcccgctagaccaccaacgcgcgataaccccaagcacggctcgtcattgaaccgcacacccagtgactacgacctgctgattccacccttgggggaagacgcgtttgatgccctccctccgtccctcccacccccacccccaccagcacgccattccctgatcgagcattcaaagccaccaggcagcagttccagaccttcctctggtcaggatttattcctgctgcccagtgacccctttgtcgacctggcctccgggcaggtacctctcccacccgctcgtaggcttcctggagagaacgtgaaaacaaatcgcacgtcccaggactacgaccagttgccctcgtgctccgatggatcccaagcgcctgcccgtcccccaaaaccacgtccaaggcgcaccgcccctgagatccatcacagaaaaccccatgggcctgaagccgctctagagaacgtagacgccaagattgctaagttgatgggcgaaggctacgctttcgaagaggtgaagagagccttggagattgcccaaaacaacgtggaggtcgcaaggtccatcctgcgagagttcgcgttcccccctccagtgagtccgaggctgaatttgtag

SEQ ID NO: 217128 - DNA, 2883 bp, Artificial Sequence
  Description of Artificial Sequence: Synthetic coding sequence
atggctctcgctcccggaccagacgcacatgcacatctgccaccactaattgagttaaagttccagatggccaattcaatgaacgggaggaatccagggggtcgcggaggcaatccacgcaaaggacggatcctcggaatcatcgacgctattcaggacgccgtcggtccacctaaacaggccgcagcagatcgcagaacagtggagaaaacttggaaactgatggacaaagtcgtcaggctctgtcagaatccaaaactgcagttaaaaaactcacctccatatattctagacattttacccgacacgtaccagcaccttaggcttatcctctccaaatatgatgacaatcagaaactggcacaactctctgagaatgaatactttaagatttacatcgatagccttatgaagaaaagtaagcgcgcaattagattattcaaagaaggtaaggagcgaatgtacgaggaacagtctcaagaccgtcgtaatctgaccaaactctcccttatctttagccacatgttagcagagattaaggccatcttccccaacggtcaatttcagggggataatttcaggatcacaaaggcagacgcggcagaattctggcgtaaattcttcggggataaaaccattgtgccctggaaggttttcagacagtgcctgcacgaggttcaccagatcagttccggcctcgaagccatggctctcaaaagcacaattgacctgacttgcaacgattacattagcgtgtttgaatttgacatttttacaagactttttcaaccttgggggagcattttgcgcaattggaattttctcgctgttactcacccaggctatatggccttcctcacttacgacgaagtgaaggcccgactacagaaatatagcaccaaaccaggttcatatattttccgcttgtcttgtactcggcttggccagtgggctattggttatgtaacaggcgatggtaacatactccagacaatccctcacaacaaacctctattccaggccctaatcgacgggagtcgagagggattctacctgtatccggacggaaggtcgtataacccagatctgacaggcctctgcgaacccaccccccatgatcacatcaaggttacgcaggagcagtatgagctgtattgcgaaatgggtagtactttccagctctgcaagatctgcgctgaaaatgataaggatgtgaaaatcgaaccctgcgggcatctgatgtgcacttcctgtctgacagcctggcaggagagcgacgggcaggggtgtcccttttgccgatgcgagatcaaaggaaccgagccaatcatcgtcgacccttttgatccccgagacgaaggatctcgctgctgcagcattatcgatcctttcggaatgccgatgcttgatttagatgacgatgatgaccgcgaagaatccctgatgatgaaccgccttgctaacgtgaggaaatgcaccgacaggcagaatagtcccgttacctcaccgggttcgagtccattagcacagcggagaaaaccccaacccgatcccctgcagataccacacctcagcctgccgcctgtgcctccaaggctggaccttatccagaaaggcattgtccggtccccctgtgggtcccctaccggcagccctaagtctagcccgtgcatggtgcgaaaacaggacaaaccgctgccggcaccaccccctccgctaagagaccctcccccaccaccgcctgagcgaccacccccaattccccctgataaccgcctgagccggcacatccaccacgtggagagcgtaccttcacgcgatcctccaatgcctcttgaggcatggtgtccgagggacgtcttcggaacaaatcagctggtcggctgcaggctgctgggggagggatcacccaaaccagggatcactgcctcttcaaacgtgaacggtagacacagtagagtagggtcggaccccgtgctgatgcgtaagcataggaggcacgatctgcccttggaaggcgctaaagtcttctcaaatggccacctcggatcggaagagtatgatgtccctcccagactcagcccacctccgccagtaactaccctcctgccctccataaaatgtactgggccactcgcaaatagcctatctgagaagaccagagatcctgtcgaggaggacgatgacgaatataaaatcccaagctcacaccccgtgtccttgaactcccagccctcacactgccacaatgtcaaaccccctgttaggtcctgtgacaacggtcactgtatgcttaatggtacacacggtccttcctctgagaagaaaagtaacataccagatctctcaatctatttgaaaggcgaggatgcttttgatgccctgcctccaagtttgcctccgccaccgcctccagcacgtcacagcctgatagagcactccaaacccccagggagctcaagtcggccatctagcggccaagacctcttcctactgccctcggatccctttgtcgatcttgccagtggccaggtgcccctgccacctgccaggcgactgccgggagaaaatgtcaaaacgaaccgcacctcccaggactatgatcagcttcctagttgctctgacggaagtcaagcacccgctcgcccacctaaaccacggccaaggcgtaccgcacccgagattcaccaccggaagccccatggacctgaggctgctctggagaatgttgacgccaaaattgcgaagttgatgggcgaagggtacgcctttgaggaagtcaaacgcgcactcgaaattgcccaaaataacgtggaggtcgctcgctcgatcctcagggaatttgcatttcctcctccagtatcccccagactcaatctctag

SEQ ID NO: 217129 - DNA, 2313 bp, Artificial Sequence
  Description of Artificial Sequence: Synthetic coding sequence
atggccaatagtatgaacggaaggaaccctggcggaagaggcggaaatccacgcaaggggagaatccttggaataatcgacgctatccaggacgcggtgggcccacccaagcaggcagccgctgatcggagaacagtggagaagacctggaaattgatggacaaagtggtccgactctgtcagaaccctaaactccaactgaagaattcacctccttatattctggacatcctgcctgacacatatcaacatctgcgtctgatcctgagtaaatatgacgacaaccagaagcttgcccagctgagtgaaaatgagtactttaaaatttatatcgactccctgatgaagaaaagcaaacgggctatccgtctgtttaaagagggcaaagaaagaatgtatgaggagcaatcccaggaccgtaggaatctcacaaaactaagccttatcttctcccatatgttggccgagattaaagccattttccccaacggtcagttccagggcgacaatttcaggattaccaaggcggatgctgctgagttttggcggaagttttttggtgataagaccatagtcccctggaaagtttttaggcagtgccttcacgaggtccaccaaatttcttctggcctggaggcaatggccctgaaaagtactatcgatctcacttgcaacgattatatctctgtattcgaattcgacattttcacacgtctttttcagccctggggaagcattctcaggaattggaattttctggcagtgactcaccccggttatatggctttcctaacctacgatgaggttaaggcacgcctgcagaaatacagtaccaaaccaggtagctacatatttcgcctctcatgtacacgcctcggccaatgggctattggctatgtgactggagatggtaacatactgcagacgatccctcataataaacctctgttccaggcactgatcgatggttcccgcgagggcttttacctttaccccgacgggaggtcgtacaacccggacctgaccgggctctgtgagccaaccccacacgatcacattaaggtgacccaggagcagtacgagctttactgcgagatgggcagcactttccagctgtgcaaaatttgcgccgagaatgacaaggacgtcaagatcgagccttgcggacacctaatgtgtacaagctgtttgaccgcatggcaggaaagcgacggccagggatgccctttctgtagatgtgaaattaaaggcacagaacctatcatcgtggacccgtttgaccctcgggacgaagggtctcgatgttgcagcataattgatcccttcggaatgcccatgctggatttggacgatgacgatgatcgtgaagagtcactgatgatgaatcggcttgcgaatgttcgcaagtgtacagatagacagaatagcccggtcacatctccaggatcatctccgttggcccagaggaggaaacctcagcctgatccgctccagatcccccacttgtcactgccacccgtgccaccacggctggacttgatccaaaagggaatcgtgcgcagtccatgcggaagcccgacaggttccccaaagtcatctccctgcatggtgcgcaagcaggataaaccacttcccgctcctccaccgcctctcagggaccccccacctcccccacctgaacgacctcctcccataccgcctgacaaccgtctatctcgccatatccatcatgtggagtccgtgcccagcagagatcccccaatgccattggaggcttggtgccccagagatgtatttgggacgaatcaactagtgggatgtcgactgcttggtgaagggtcaccaaagcccggtatcaccgcttccagcaacgtaaacggaagacacagtcgtgttggctctgatcccgtgctgatgaggaagcatcgaagacacgatcttcccctggaaggggcaaaagtgttcagtaatggtcatcttggctcggaggagtacgacgtcccccctagactgtctcctccgcctccggtgacgacactcctgccttcaataaaatgcacgggaccacttgccaattcattgtcagagaaaaccagagaccctgtcgaagaggacgatgacgaatataagatcccttccagccaccctgtttcgttgaactcgcagccatcccactgtcataatgtgaagccaccagttagaagttgtgacaacggtcactgtatgctcaacggaacgcacgggcctagttctgagaagaaaagcaacattcccgatctgtctatttacttgaagggtacttacagaatctag

SEQ ID NO: 217130 - DNA, 2433 bp, Artificial Sequence
  Description of Artificial Sequence: Synthetic coding sequence
atggcaaactcaatgaatggccgtaaccctgggggtcgcggtggtaatcctcggaaaggtagaattctcggtattatcgatgcaattcaggatgccgtcggtcctcccaagcaggccgctgcggaccgcagaacagttgaaaagacctggaagctgatggataaggtggtgaggctgtgccagaacccaaagctgcagctgaaaaactctccaccatatattcttgacatccttcccgatacctatcagcacctgcggttgattctatccaagtacgacgataaccagaagcttgcacaactttcagaaaatgaatatttcaagatttatatcgattcactgatgaaaaaaagcaaacgggcaattcggctgttcaaagagggaaaggaacgcatgtatgaagagcaatcacaggaccgcagaaacttaactaaattgtctttaatcttcagtcacatgctggccgaaatcaaagccatcttccccaatggtcaatttcagggagataattttcggataaccaaagcagatgctgctgagttctggagaaaattcttcggtgataagacaatagtgccttggaaggtgtttcggcagtgtttgcatgaggttcaccagatctctagtggattagaagccatggcattaaaatccaccatcgacttgacttgcaatgactatatttctgttttcgagtttgacatctttactcgactgtttcagccttggggcagcatcctacgcaactggaactttctcgctgtcacgcacccaggttacatggctttcttgacttacgatgaggtgaaagcaaggctgcagaaatactcaactaagccaggctcatacatatttcgcttaagctgtacccgcctggggcagtgggcaatcggatacgtcacaggggatgggaatatcctccagactatcccccataataaacctttatttcaagccctgatagatgggagtcgcgagggattttatctgtatcctgatgggcgatcctacaatcccgatctgaccggactgtgcgagcccactcctcatgaccacataaaagtcacccaggaacagtacgaattgtattgtgagatgggttctacattccagctgtgcaagatttgcgccgagaatgacaaagatgttaaaatcgaaccctgcggccatctgatgtgtactagctgccttaccgcctggcaggagagtgacggtcagggctgtccattttgcagatgcgagatcaaagggaccgaaccgattatcgtggatccatttgacccgagggacgaaggatctaggtgttgcagcattatcgatccattcggcatgcccatgctggatctggatgatgacgatgatcgagaggagagtctcatgatgaatcgactcgccaacgttagaaagtgcacggatagacagaactcaccagtgacatctcctggatccagtcctctcgcacaacgccgtaaaccacaacctgatcccctccagatccctcatctttccctgccaccggtgccaccaagacttgacctgattcaaaaagggattgtgcggagcccatgcgggtccccgacaggcagtccaaagagcagcccctgcatggtgcgcaaacaggataaaccacttccagctccgcctccgcctctcagagacccccctcccccaccgccagagagacctcccccaatacctcccgataaccgcctatcccgccatattcatcatgtggagtctgtcccatcccgggatcctcctatgccattagaggcatggtgcccccgagatgtgtttggaacgaaccagctcgtgggctgtcgcctgctcggtgaaggatcgccaaaacctggcattactgctagttctaatgttaatggtcgccactcaagggttgggtccgaccctgtactgatgcgcaagcataggcgtcacgaccttcctttggagggagccaaagtgttctcaaatggacacctaggaagcgaagagtacgacgtcccaccaagacttagccctcctcccccagtgactaccctgctgcccagcattaagtgtactggtccccttgctaacagtttgtccgaaaagacacgcgaccccgtggaggaggatgacgatgagtacaagattccgagctcccatcccgtttccctcaattcccagccctcacactgccataatgtgaagcctcccgttagatcctgtgacaacggacactgcatgctgaatggcacacacggccctagttccgagaagaagagcaacatcccagacctgtcaatctacctgaagggagacgtcttcgatagcgcttctgatccagttcctctcccacccgcacgccctcccacaagagataatcccaagcatgggtcttccctgaatcgcactccatccgactacgatctgctcatcccccctcttggatag

SEQ ID NO: 217131 - DNA, 420 bp, Artificial Sequence
  Description of Artificial Sequence: Synthetic coding sequence
atggctaattccatgaatggacgcaacccaggagggaggggcggaaacccgcgaaagggaagaattctgggcattatagacgccatacaggacgctgtcggaccacctaagcaggccgctgctgataggagaactgtcgagaagacctggaagctgatggacaaggtggtcaggctgtgtcaaaacccgaagctgcagctgaagaatagccctccatacattctagatattctgcccgacacctatcagcatttgagattaatattgagtaaatatgatgacaatcagaaactggcacagctgtccgagaatgagtattttaagatctatattgacagtttgatgaaaaagagtaagagagctatccggttgtttaaagaaggaaaagagcggatgtacgaggaacagagtcaggattag

SEQ ID NO: 217132 - DNA, 684 bp, Artificial Sequence
  Description of Artificial Sequence: Synthetic coding sequence
atggccctggcgccagggccagacgcgcacgcgcatttaccgccactgatcgaacttaagttccagatggcaaactcaatgaacggaagaaaccccggaggacgaggcggaaatcctagaaagggaaggatactgggaatcatagacgccattcaagacgcagtgggcccacctaagcaggcggcagcagataggagaacagtggagaaaacttggaagctcatggataaggtcgttcgtctatgccaaaatcccaagttgcagcttaagaactcccctccttatatcctggatatccttccggacacctatcaacacctgagactaattttgtccaaatacgatgataaccaaaagctggcccagctgtcagaaaatgaatatttcaagatttacatcgatagtctaatgaagaaatctaaaagggctattcggctgttcaaggaaggtaaagagaggatgtatgaggaacagagccaggatcgcactatcgtgccttggaaggtgtttagacaatgccttcatgaggttcatcagatcagctctggattggaagctatggcccttaagagcacgattgatctcacctgtaatgactatatttctgtttttgaatttgacatcttcactagattgttccaagtgtccgataatttcaccgagtatttgatttacttgacttag

SEQ ID NO: 217133 - DNA, 1425 bp, Artificial Sequence
  Description of Artificial Sequence: Synthetic coding sequence
atggctctcgcagttgctccctggggcagacagtgggaagaggcccgagccctcggccgagctgtgaggatgctgcagcgtctggaagaacagtgtgtcgacccacgactgagtgtctctcccccaagcttgcgcgacctcctccccaggacagcccagctcctgagagaggtggcgcactctagaagggccgcagggggtggtggcccaggtggacctggtggatccggggacttcctgttaatttacttggccaacttggaggctaagtctcgacaggtggcggctctgcttccacccagaggcagaagatccgcaaatgacgaactcttcagggccggaagccggctgagacgacagctcgccaagctcgccatcatcttcagccatatgcacgccgagctccatgcactcttccccggaggcaaatactgtggacacatgtatcagctgacaaaggctcccgcacacacattttggagagagagttgcggcgctcggtgcgttctcccctgggctgagttcgagtcattgctcggcacttgccaccccgttgagccaggatgcaccgcattggctcttcggaccaccatagacctgacttgctctggccatgttagcatttttgagttcgatgtcttcacaagattgttccagccctggcctacccttctcaagaattggcagctcctggccgtgaaccatcccggatacatggcattcctcacatatgatgaggttcaggaaaggttgcaagcctgcagagataaacctggctcgtacatctttagaccctcttgcactcgactgggccaatgggcaattggctacgtgtcgagcgatggatcaattctgcagactatccccgcaaataaaccattgtctcaggtgctgctggaagggcagaaggacggcttctatctttatccagatggtaaaactcacaaccctgatctaaccgagctggggcaagcagagcctcaacagagaatccatgtgagcgaggagcagctccagctgtattgggctatggactctacgttcgagctctgcaaaatatgcgctgaaagtaacaaggatgtcaaaatcgagccatgtggacacttgctctgttcttgttgcctggccgcttggcaacatagcgattcacagacatgtcctttctgtcgctgtgaaatcaagggatgggaggcagtctccatctaccaatttcacggtcaggccactgcagaagactcggggaactcctccgaccaggaggggcgtgagttggagctgggtcaggttcccctatccgccccaccgctgccccctaggcccgatctgccaccacgaaaacccaggaatgcgcaacccaaggtgcgcttactaaagggcaattcaccaccagctgcattggggccacaggaccctgctccggcatag

SEQ ID NO: 217134 - DNA, 1287 bp, Artificial Sequence
  Description of Artificial Sequence: Synthetic coding sequence
atggctctcgcagtagccccttggggacggcaatgggaagaagccagagccctgggtcgcgcagtcagaatgctccagagacttgaagaacagtgcgtcgaccccaggctgtcagtatcaccccctagcctccgcgacctgttacctcggactgcccaattactcagggaggtcgcccattcacgaagggcggctggtggaggcggaccaggaggacctggcggaagtggggactttctgctgatctacttggcaaacttggaagccaagtcccgccaggtggccgctctgttgcctcccagagggcgtaggagcgctaatgacgaactcttccgcgctggttcccggctgaggcgccagctcgcgaaactagcgatcattttcagtcatatgcatgctgaactgcatgccctgtttcctgggggaaaatattgtgggcacatgtaccagttaactaaagctcctgcacatacgttctggcgcgaatcatgtggagcacgctgcgtgctgccgtgggcagaattcgaatctctgctggggacatgccatcctgttgagcctggctgtacagcccttgcgctccgtacgactatcgatctgacatgctccggccatgtgagcatttttgagtttgacgtgtttacgagactattccaaccctggccaaccctactcaaaaactggcagctcttggccgtgaatcatcctggatacatggcttttttaacgtatgatgaggtacaggagcgactacaggcctgtagggacaagcccggttcttacctgtaccctgacggcaagactcataaccccgacctgacggaattggggcaggccgagccccaacagaggattcacgtatcagaggaacagctgcaactttactgggccatggattcaacctttgagctctgtaagatctgcgccgagtctaataaagacgttaagattgaaccatgcgggcacttgctgtgcagctgttgtcttgcggcttggcagcattcggactcccagacctgccccttttgtaggtgcgagatcaaggggtgggaagctgtatcaatttaccagttccatggccaggcaaccgccgaagacagtggcaattcatccgaccaggaaggcagagagctggagctaggtcaggtacccctgtcggctcccccactgccacctcgacctgacctgccacctagaaagccacgcaacgcacagcctaaggtccgcctgctgaaggggaattcaccccctgccgcattggggccacaggaccccgcacctgcttag

SEQ ID NO: 217135 - DNA, 2355 bp, Artificial Sequence
  Description of Artificial Sequence: Synthetic coding sequence
atgtcggaccaaaagaaagaggaagaagaggaagcggctgcagccgctgccatggcaaccgaaggaggaaagacatcagagcctgagaacaataataagaagcctaaaacctcaggttcacaggattcacaaccctcccccctagccctgctggccgcaacttgctctaaaatcggaacacctggcgaaaaccaagcaaccggccagcagcagataatcattgacccatcccagggcctagtccaactacaaaaccagcctcaacagctggagctggttactacacagttggccggtaacgcatggcagctggtggcctctactcccccagcaagcaaagagaacaacgtttctcaacctgcctcgtccagttcttccagcagttcgtctaacaacgggtctgccagtccaactaaaacgaagtcaggcaactcctcaacacctggacagtttcaggtaatccaagtccagaacccttcgggctcagtccagtaccaggtaattccacaactgcagacagtggaaggacaacagatccagatcaatcccaccagctcatccagtttacaggatcttcagggacagatacaattgatctccgcgggtaacaaccaagccatattaaccgcggcaaacaggactgctagcggaaacatcctagctcagaatctggcaaaccagaccgtcccggtgcagattcgtccaggcgtgtccattcccctgcagctccagacactcccaggcacccaagcccaggttgtcacgacactgcccattaatattggaggggttacgttagctctgcctgtgatcaacaacgtggcagccggtggaggtaccgggcaggtcggtcagcctgccgctactgcggactcaggaaccagcaacgggaatcagcttgtgtctactccaacaaacacgactacgagtgccagtacaatgccggagtcacccagctcaagcacaacttgtaccacaacagcctcaacctctctcacgtccagcgacacactcgtaagttccgccgatactggccagtatgcaagcactagtgccagctcttctgaaaggaccatagaggaaagccagacaccagctgcaaccgaaagcgaggcccagtcctctagccagctccaacccaacggaatgcagaacgctcaggaccagtctaactccctacagcaggtgcaaattgtggggcaaccgatcttgcagcaaatccagatccagcaaccgcaacagcagattattcaggctatccctccacaatcgttccaactgcagtcgggccagacaatccaaaccattcagcagcagcccctgcaaaatgtacagttgcaggccgttaaccccacacaggtgctgattagagcgcctacgctgacaccatctggccagataagttggcagacggtgcaggtacagaatatccagtcactgtccaatctgcaggtacagaacgccggtctgtctcagcagctgactattacaccagtgagttctagcggaggaacgacgttggcccagatcgcgccagtcgcagtggcgggagcgccaatcactcttaatacagcccagctcgccagcgtgccaaatctgcagacagtcagcgtggccaacctgggcgcagcaggagtgcaggtacagggggtacccgtgactatcactagcgttgctggacaacagcagggccaggacggggtgaaggtccaacaggcaaccattgccccagtgaccgtggcggtcggtggaatcgccaatgctaccattggagcggtctctccagaccagctgacacaagtgcacctccagcagggtcaacagaccagtgaccaggaggtacagcccggaaagaggctgcgcagagtagcgtgcagctgccccaattgccgcgaaggagaaggaagaggaagtaacgagcccggaaagaagaaacagcacatttgccatatagagggttgcggcaaagtctacggaaagactagccatttgcgggcacacttacgctggcatactggagagcgccctttcatttgtaattggatgttttgcggtaagagattcacccgatctgacgagctgcaaagacaccggcgaactcatacaggcgaaaaacggtttgagtgcccggagtgttctaaacggtttatgcgtagtgaccacttgtcaaaacacgtcaagacccatcagaataagaagggcggaggtactgccctcgccatcgtgacctcgggggagctcgattcgtcggttaccgaagtgctgggctctcctaggatcgtcactgtcgccgctatcagccaggacagtaaccctgctacccctaatgtctcgacaaatatggaagagttttag

SEQ ID NO: 217136 - DNA, 1476 bp, Artificial Sequence
  Description of Artificial Sequence: Synthetic coding sequence
atggaccacaccgacaatgaattacaggggacaaattcgtcaggcagcttagggggattggacgttcgcaggaggatacccatcaaactgattagcaagcaagcaaataaagcgaaaccagcccctcggacgcagcgcaccataaatcgaatgcctgcaaaagctcccccaggtgatgaagaggggtttgactataatgaggaagagcgctatgattgtaagggcggagaattatttgcgaaccaacgcaggtttcccggacacctcttttgggactttcagattaacatcctgggggagaaggacgatacacctgttcatttctgcgacaagtgcgggctgcccattaagatatatgggaggatgattccgtgcaagcacgttttttgctacgactgtgcaattctccacgaaaaaaagggcgataagatgtgtcccggatgcagtgaccccgtgcagaggattgagcagtgcacgagaggctccctgttcatgtgctccatcgtgcaggggtgcaagaggacctatctgagccagagagatctccaggctcatataaaccacagacatatgagagccggaaaaccagtcactcgagcatccctcgagaatgtgcacccccctatagctccaccaccgacagaaattcccgagcggtttattatgccgccagataagcatcatatgagccatattcctcccaagcaacacattatgatgcctccgccacccttgcagcatgtaccacacgaacactataatcagccccacgaagatataagggctcccccagccgaattgtcaatggctcccccaccgccaagaagtgtgtcacaggaaacctttagaatttccacccggaagcactctaacttgatcacagttccgattcaagatgactctaacagcggcgctagggagccccctccacctgctcctgctcccgcacatcaccaccccgaataccagggccagccagtcgtttcgcacccccatcacattatgccacctcagcaacactacgctccacccccaccaccaccgccacctattagccaccccatgcctcaccctcctcaggccgcaggcacaccgcatttggtctacagccaggctcctcctcccccaatgaccagtgcccctccccctatcaccccaccaccagggcatatcatcgcacagatgcctccttatatgaaccatccaccaccaggtcctccccctccccagcacggagggccacccgtcacggcgcctccccctcatcattataaccccaattctttgccccagttcaccgaagatcaggggacactgtctccgccttttacacagcctgggggaatgtcccccggtatctggcctgccccaagaggcccacctcccccacccagactgcagggacctccaagccagaccccccttcctggaccacaccatcctgatcaaactagatatcgaccctactaccaatag

SEQ ID NO: 217137 - DNA, 1113 bp, Artificial Sequence
  Description of Artificial Sequence: Synthetic coding sequence
atgattccatgtaaacacgtgttctgctatgactgcgctattttgcacgaaaagaagggcgacaagatgtgcccgggatgtagcgaccccgtgcagagaatcgagcaatgtacaaggggctctttgttcatgtgttccatcgtacaaggctgtaaacgcacttatctgtcacaaagagacctgcaggcccatatcaaccaccggcacatgagagctgggaagccggtcaccagagcgtccctggaaaatgtccatccgccaatcgcccctcctcctacggaaatccccgaacgtttcattatgccccctgataaacaccatatgtcacacattccccctaagcagcacatcatgatgccgccaccgcctctgcagcacgtgccccacgaacactacaatcaaccccatgaagatatacgtgcaccaccggctgagctgtcgatggcccctccacctccaaggagcgtgtctcaggagacatttcgaattagcacacggaaacacagtaacctgatcacagtgcctatccaggacgatagtaattccggcgctagggagcctccaccgccagcgcctgcccctgcccaccatcatccagagtaccagggccagccagtcgtatctcacccacaccacatcatgccccctcagcagcactacgcgcctccccctccccctccacccccaatctcccaccctatgccccatcccccacaggctgctggaacaccgcaccttgtttatagccaagcccctccgccacctatgacctccgcaccccctcccatcacccccccacccggtcatatcatcgcacagatgcccccttacatgaatcatcccccacctggccctccccctccacaacatgggggtccacctgtgaccgctccccctcctcaccattacaatccaaactcactgccacagttcaccgaggatcaggggactctttcccccccattcacccagcccggaggtatgtccccgggtatttggcccgctccgaggggtccaccccctccgcctaggctccaggggcctccaagtcagacccccctacccggacctcaccatccagaccagaccagataccgcccttattaccagtag

SEQ ID NO: 217138 - DNA, 681 bp, Artificial Sequence
  Description of Artificial Sequence: Synthetic coding sequence
atgaaggtactgattctcgcctgcttggtggcactggcactcgctcgggaaacgatcgagtccctatcatccagtgaagagtcaataaccgaatacaagcagaaagtcgagaaagttaaacacgaggatcagcagcagggggaggatgagcaccaggacaaaatataccctagcttccagccacagcccttgatttatcctttcgtagaaccgatcccgtatggttttctgccccaaaacatactaccactagcccagcccgctgtggttctacccgtcccccagcctgagattatggaggtgcccaaagcgaaggataccgtgtatacaaaaggcagagtaatgcctgtgctcaaatcccccaccatacccttctttgatccgcagattccaaagctaacagatctggaaaacttgcatctcccgctaccactgctgcagccactcatgcaacaagtcccgcagcccattccacaaacgctagccctgcccccacaacctctttggtcagtcccgcagccaaaagtcctcccaatcccacaacaggtcgtcccttatcctcagcgtgccgtccctgttcaggccctgctcctcaatcaggagctactcttaaatcctacccaccaaatctatcctgtgacccagcccctggctcctgtccacaaccctatctccgtatag

SEQ ID NO: 217139 - DNA, 549 bp, Artificial Sequence
  Description of Artificial Sequence: Synthetic coding sequence
atgaagtcttttctcctggtagttaacgcgctcgcactgactctcccattcttggccgtggaggtgcagaaccaaaagcaaccggcttgccatgagaacgacgagcgccctttttaccagaaaacggccccatacgtgccaatgtattatgttcccaactcatatccatactatgggactaatctgtaccaacggcgacctgccatcgctattaacaatccctacgtgccgagaacttactacgcaaacccagccgtggtgcggccacacgcgcaaatcccccaaaggcagtatctgcccaattctcacccccctactgtggtcagacgccctaacttacacccctcctttatcgccataccacccaagaagatacaggacaagatcattattccaacaataaataccatcgccaccgttgagccgactccagcccctgctaccgaacccacagtggactccgtggttacccccgaggctttcagtgagtccatcattacctcaactccagagacaactacagttgcagttacacctcctactgcgtag

SEQ ID NO: 217140 - DNA, 978 bp, Artificial Sequence
  Description of Artificial Sequence: Synthetic coding sequence
atggcctcgtccagtgggtctaaagccgaatttatcgtcggaggcaagtataagctggttaggaaaatcggatcgggcagcttcggtgacatttaccttgcaattaacatcaccaatggggaagaggtcgctgtaaagctggagtcgcagaaggcacgccacccccagctcctctatgagtcaaagctgtacaagatccttcaggggggtgttggcatccctcatatcagatggtatggacaagagaaagactataacgttttggtcatggacctgctagggccttcactggaagatctgttcaatttctgcagccggaggtttactatgaaaacagttcttatgctggcagatcagatgattagtagaatagaatatgtccacacgaagaactttattcatcgagacatcaaaccagataatttcctcatggggatcggacggcattgcaacaaactgtttctcatcgacttcgggcttgcaaaaaagtatcgggataataggaccagacaacatattccctacagggaggacaagaacctcaccggtacagcgaggtacgcgtcaattaacgcccatcttggtatcgaacagtcaaggcgtgatgacatggaatccctggggtatgttctgatgtattttaaccggacaagcctgccatggcaaggcctcaaagccgctaccaaaaagcagaaatacgaaaaaataagtgagaagaaaatgagcactccggtggaggtgctgtgcaagggcttccccgctgagttcgccatgtatttaaactactgcagggggctccgcttcgaagaagcccctgactatatgtacctgcgccagctatttcgcattctgttccgcacccttaaccatcagtatgattacaccttcgactggaccatgctgaagcagaaggcagcacaacaagctgcctcttcctcaggacaggggcagcaggctcagaccccgacgggattctag

SEQ ID NO: 217141 - DNA, 978 bp, Artificial Sequence
  Description of Artificial Sequence: Synthetic coding sequence
atggccagcagtagcgggagtaaggctgaattcatcgtgggaggcaagtataagctggtgcggaagatcggctcaggaagttttggggatatttacctggctatcaacattacaaacggagaggaggtggccgtcaagttggagtcacagaaagccaggcacccgcagctgttgtatgagagcaaactgtataagatcctgcagggaggagtgggcataccacatattagatggtatggccaggaaaaagactacaacgtgttggtaatggatctgctgggtcctagtctcgaagatctcttcaacttctgctctaggcgattcacaatgaagacagtcctcatgctggccgaccagatgatctccaggatcgagtatgtccacacaaaaaacttcatccacagggatattaaacccgataatttcttgatgggtatcggcagacactgcaataaattattcctcatagacttcggccttgccaagaagtacagggacaaccgcactcggcagcatatcccatatagagaggataaaaacctgacaggcaccgctcggtatgcctccattaatgcacacttaggtatcgagcagtcccgcagggacgacatggaatctcttgggtatgtcctgatgtatttcaaccgtaccagccttccctggcaggggctaaaggctgccacaaagaagcaaaaatacgagaagatcagcgagaaaaagatgtctaccccggtggaggtgctttgtaagggctttcctgccgagttcgccatgtacctgaattactgcagaggcctgaggttcgaggaggcacctgactacatgtacctccgacagctgttccgtattctgttccggacgctgaatcatcagtacgattatacgtttgactggacaatgctgaaacagaaagcagcacagcaagctgccagcagtagcggtcaggggcagcaggcacaaacacccactgggttttag

SEQ ID NO: 217142 - DNA, 1014 bp, Artificial Sequence
  Description of Artificial Sequence: Synthetic coding sequence
atggcgagcagctccgggagtaaagctgagtttattgttggaggtaagtacaagcttgtgcgaaagattggaagtgggtctttcggcgacatctaccttgcaatcaacataactaacggggaggaggtcgctgttaagctggagtcccagaaagcacgccatcctcagctgctgtacgaaagcaagctttataaaatcctacaaggaggcgttggtatccctcatattcgttggtacggacaagaaaaggactacaatgtgctggttatggacttgctcggtccatcccttgaggatctgttcaatttttgtagccgaagattcaccatgaagaccgttctgatgctcgctgaccagatgatttcccgaatcgagtacgttcatactaagaatttcatccaccgcgacatcaagcctgacaattttctgatgggcattggtagacattgcaacaaattattcctaattgactttgggctcgctaaaaagtatagggacaaccgcacccggcaacatatcccttaccgcgaggataaaaatctgacaggcaccgcacgatacgcctccattaacgcacatctgggaatcgagcagtcccgtagagacgacatggagtctctgggctacgtgctcatgtatttcaacagaacctcactgccgtggcaaggtctgaaagctgcaaccaaaaagcaaaagtatgaaaagatctcagaaaaaaaaatgtcgacaccggtcgaggtcctgtgcaaggggtttccagctgaatttgccatgtatcttaactactgcaggggactaagatttgaagaggctcctgattatatgtatctgcgccagctgttccggattttgttccgcaccctgaatcaccagtatgattatacatttgattggacgatgctgaagcagaaagccgcacaacaagctgctagctctagcggccagggccaacaggctcagactcctaccggcaaacaaaccgacaagacgaagagcaacatgaagggattctag

SEQ ID NO: 217143 - DNA, 1098 bp, Artificial Sequence
  Description of Artificial Sequence: Synthetic coding sequence
atggccagcagctcaggctctaaagctgaattcatcgtgggcggtaagtacaagctagttcgcaaaataggcagcggaagctttggcgacatttacctggccattaacattacaaatggcgaagaggtggctgtcaaactcgagtcacagaaagccaggcaccctcagcttctgtacgagagcaaactatataagattctgcaaggaggggtgggaattccgcacattaggtggtatggccaagagaaggactacaacgtcctagtcatggacctgctcggaccctcactcgaggatcttttcaatttttgtagccggaggttcactatgaagaccgtgctaatgctggctgaccagatgattagtcgaatcgagtatgtccacaccaaaaattttatccatcgcgatattaagcccgataattttctgatgggcatcggcaggcattgcaacaagtgcctggagagccccgtcggtaaacgcaagcggtcaatgacagtttctacctcacaggatccctccttctcaggacttaatcagctctttctcatcgacttcggactcgcaaagaagtatagagacaataggacacgacagcacatcccttatcgggaagacaaaaatctcactgggactgccaggtatgcatcaatcaacgcccacctgggcatcgagcagagcagacgggatgatatggaaagccttggctacgtgctaatgtactttaaccgcaccagcctcccatggcaggggctgaaggccgctactaaaaagcagaaatacgagaaaatcagcgagaagaagatgagcacacccgttgaagtactgtgcaagggatttcctgcagagtttgccatgtacttaaattattgcaggggactgaggttcgaagaggcccctgactacatgtatctgcgtcaattatttcgcatccttttccgtacgctgaatcaccagtatgattatacattcgactggacaatgctgaagcaaaaagccgctcagcaggccgctagcagctcaggccagggtcagcaggcccagacacccacaggaaaacaaaccgataagaccaagagcaatatgaaaggattttag

SEQ ID NO: 217144 - DNA, 1029 bp, Artificial Sequence
  Description of Artificial Sequence: Synthetic coding sequence
tgccgggaggaaatatctagaattgaatacattcattcaaaaaacttcattcatagggatgtgaaacctgacaactttctgatgggcttgggcaagaaaggtaacctggtgtatattatagactttggcctggccaagaaataccgggatgctcgtacccaccagcacattccctaccgggaaaataagaatctaacaggcactgcgaggtacgcctcaatcaatacccacctcggtatcgaacaatccaggcgtgacgacctggagtcgctggggtatgtgctcatgtatttcaacctgggctcactcccatggcaaggactaaaggcagcaacaaagagacagaaatacgagcgaataagcgaaaagaagatgagcacccccatcgaggtcttatgcaaagggtatccaagtgaattcgcaacctacctgaacttttgccggagtctgcgcttcgacgacaagcccgactacagctatctgcggcaattgttcagaaatttgtttcatagacagggctttagctacgattatgtcttcgactggaacatgctcaaatttggcgcttcccgcgctgccgacgatgctgaaagagagcgtcgagaccgcgaggagcgactacgccattccaggaaccctgctacccgcggactgccgagcacagcgtccgggaggctgcgcggaacccaagaggtagctccccctaccccgttgactcccacaagccacacagctaatacctccccgaggcccgtcagtgggatggagcgggaacggaaagtgtccatgagactgcacagaggtgcgccagtgaacatcagctcaagcgatctgactggcaggcaagacacttcccgtatgagtacctctcaggttggggctgaacttccaggaggtaggtgggctagcggataccctgtgcgagttaagagcggcctgtggttcctacaaggcttcttcttccctttcttccctccatttctcagggtctttaatctcgctagggtctggcggcttgggtgtcgctag

SEQ ID NO: 217145 - DNA, 1248 bp, Artificial Sequence
  Description of Artificial Sequence: Synthetic coding sequence
atggaactcagagtcggcaatagatatcgactgggcagaaagatcggatctggcagcttcggagatatttatctcggcacggacatagccgctggcgaggaagtcgctatcaaactcgagtgcgtgaaaacgaagcatccccagctccatatcgaaagcaagatctataagatgatgcagggcggtgtcggcattccaaccattcgatggtgcggagccgaaggggattataatgtgatggttatggaactactgggccctagtttagaggatctgttcaacttctgttcgcggaagttctccctcaagactgtattgctcttggccgatcagatgatttccagaatcgagtatatccactctaaaaattttattcaccgggatgtcaagccggataatttcctgatgggcttgggcaagaagggcaatcttgtgtacatcatcgactttggtctggccaagaaatacagggacgctcgtacccatcagcatattccatatagagagaataaaaatttgaccggcaccgcgagatatgcctccattaatacacacttgggcattgagcagagcaggcgggatgatctcgagtcgctggggtatgtgttaatgtacttcaacttgggctcactgccctggcaagggttgaaggctgcaactaagcggcaaaagtacgagagaatcagtgagaaaaagatgtcaacacctattgaggtcctttgtaagggatatccctccgaatttgcaacgtacttgaacttctgtagatcattgcgttttgacgataagccagactacagctatctgagacagctatttcggaatttgtttcatcggcagggattcagctacgactacgtgttcgactggaacatgcttaagttcggcgcatcgagagctgccgatgacgctgaaagagagagaagggatcgcgaggaacggctccggcattcccgtaatccagccactagagggctgccttctacagcatcaggcaggctgagggggactcaagaggtggcccctcccactccgttaacacctacctcacataccgccaacaccagccctcggcctgtaagcggcatggagagagaacgaaaggtgtctatgcgcctgcacagaggcgctcccgtgaatataagtagtagcgatctgacaggaaggcaggatactagcagaatgtcaacctcccaaatccccggtagagtcgccagctccgggttacagtccgtagttcataggtag

SEQ ID NO: 217146 - DNA, 1230 bp, Artificial Sequence
  Description of Artificial Sequence: Synthetic coding sequence
atggagttgcgtgtcggcaatcgctaccggcttggcaggaaaattgggtcagggtctttcggcgatatttatcttggcaccgacattgctgcaggcgaagaggtggccattaaattagagtgcgtaaagacaaaacaccctcagctgcacattgagagtaaaatatacaagatgatgcagggcggagtgggcatccccaccatccggtggtgcggtgccgagggtgactataatgtgatggtcatggagctgctgggaccctcccttgaagatctcttcaacttctgttcaagaaaattcagcctcaaaacagtgcttcttttggctgatcagatgatttcccgtatagagtatatccactccaagaactttattcatagagatgtaaagccagacaatttcctgatgggcctgggtaagaaaggcaacctcgtttacataatcgatttcgggctggccaaaaaatatagagatgctagaacccatcagcatatcccttaccgggaaaacaaaaacctgacaggaacagcccgatatgcctcgatcaacactcatctgggcatagaacagagtcgccgtgacgacctggagagccttggctacgttcttatgtactttaatctcggtagcctgccgtggcagggccttaaagcggcaaccaagagacaaaagtatgaaagaatctctgagaaaaaaatgagcaccccaatagaggtgctgtgtaagggatatcctagcgaatttgccacttatcttaatttttgcagaagcctgaggtttgatgacaaacccgattactcctacctgagacagctattccgcaacctgttccatcggcagggcttctcttatgactacgtctttgactggaatatgctgaagtttggcgcaagtcgggctgcagacgacgccgaacgggaaagaagagaccgagaggaacgtctgcgccattcacgtaacccagcaactcggggtcttccttcaaccgctagtggcagactgagaggtacccaagaggtggccccaccaacccccctgacaccgacgtcccatactgccaacacctcaccgagacccgtgtcaggtatggagagggaacgaaaagtcagtatgcgattacaccggggagctcccgttaacatctcatctagcgatctgacaggtcgtcaggatacgagcagaatgtcgacatcccagaattccattccctttgagcaccacggcaaatag

SEQ ID NO: 217147 - DNA, 1077 bp, Artificial Sequence
  Description of Artificial Sequence: Synthetic coding sequence
atgatgcagggcggtgtcgggattcctactattcgatggtgcggtgccgaaggggactacaacgtgatggtgatggaactgctcggtccctccctcgaggaccttttcaacttttgctcaagaaaattttctctgaaaaccgtgctgttgctggccgatcagatgatcagccgcatcgaatatattcatagtaaaaacttcatccaccgggacgttaaacccgacaatttcctgatgggcctgggcaagaaggggaacttagtatacataatcgatttcggactcgctaagaagtaccgagatgctaggacccaccaacacattccttaccgggagaacaaaaatttgaccggtaccgctagatatgcttctatcaatacccatctaggtattgaacagagtcggcgagacgatctggaatccctgggctacgtgctgatgtactttaatcttggatctttgccatggcagggtcttaaagccgcaacgaaacgccaaaagtatgagagaatctctgagaaaaaaatgagtactcccattgaggtactctgcaaagggtaccccagcgagttcgcaacctacctgaacttttgtagaagtttacggtttgatgataagcctgactactcttacttgcgccagctttttcggaacctattccaccggcagggattcagctacgactacgttttcgactggaatatgctcaagtttggggcttcccgggctgctgatgacgctgagcgagagcgtcgcgatcgtgaagagcgtttacgccatagtagaaaccccgctacaaggggcctaccctccactgcaagcggcaggctccgaggcacacaggaagtagcgccaccaacccccttgacccccacgagccacaccgctaatacctctccacgcccagtctctggcatggaacgagaaaggaaagtgagcatgcgtttgcatcgcggagccccagtgaatatctcaagctccgatcttactgggaggcaagacacgtcaagaatgtcaacatcccagatccctggaagagttgcatcatctggactccaaagtgtggtgcaccggtag

SEQ ID NO: 217148 - DNA, 381 bp, Artificial Sequence
  Description of Artificial Sequence: Synthetic coding sequence
atggagctgagggtaggcaacaggtaccgcttgggccgaaaaatcgggtccggttcctttggggatatatacctcggtaccgatattgcagccggtgaagaagtggccattaaactcgaatgcgtcaaaactaaacatccccagctccatattgagtccaaaatatacaagatgatgcaaggcggtgtgggaataccaactatccgttggtgcggcgctgaaggagattacaatgtcatggtcatggaactcctaggcccttccctcgaagatctatttaatttttgcagcaggaaattcagcctgaagactgtgcttcttctcgctgatcagatgaataatcccgaggaaatgacgtggtccctgtgggcgacatgctag

SEQ ID NO: 217149 - DNA, 1251 bp, Artificial Sequence
  Description of Artificial Sequence: Synthetic coding sequence
atggagctacgcgtgggcaacaagtacaggcttggccgtaaaatcgggagtggctcctttggggatatctatcttggggcaaacatcgcctctggtgaggaggtagccatcaaactggaatgcgtgaagactaaacatcctcagctccacatcgaatctaagttctacaaaatgatgcaagggggtgtaggtatcccgtccattaaatggtgtggcgcagaaggtgattacaacgtgatggtcatggaactactgggaccctcccttgaagacttgtttaacttctgcagccgcaagtttagcctaaagactgtactgctgctcgcagatcagatgatctcacggattgagtacatccacagtaaaaattttatccatcgcgacgtgaagcctgataatttccttatggggctgggaaagaaaggtaatttggtatacattattgatttcgggctcgcaaagaaatacagggacgccagaactcaccaacacattccatacagggagaacaagaacctgaccggcacagcacgttacgcttcaatcaatacgcacctgggaattgagcagtcaaggcgagatgacctagaatccctcggttatgtcctaatgtactttaacctgggttcattaccctggcaggggctgaaggctgctaccaagcgacaaaagtatgaaagaatcagtgaaaagaaaatgagcactccaatcgaggtgctgtgcaagggatacccgtccgaattctctacctatcttaatttctgcagatctttgcgcttcgacgacaagcccgattacagttatctaagacaactgtttaggaatttgtttcacagacagggtttctcttacgactacgtgtttgactggaacatgctgaagttcggagccgctcggaacccagaagacgtcgatcgggagcgcagagagcatgaaagggaagaaagaatgggccagcttagaggcagcgcaacaagggctttacccccaggccctcctacaggcgctacagccaacaggcttcgcagcgccgctgagccagtcgcatcgacacccgcaagtcgaatacaacctgctggtaatacctctcctcgtgctatatccagggtagacagagaacggaaggtcagcatgcggttgcatagaggtgcccctgccaatgtgtcttcctctgatctgacaggacgccaggaggtctctcgaatcccggcatcccagacaagcgtgccatttgaccacctcgggaagtag

SEQ ID NO: 217150 - DNA, 360 bp, Artificial Sequence
  Description of Artificial Sequence: Synthetic coding sequence
tgacgaaatcccgaggacgttgacagagaaagacgtgagcacgagcgcgaggagaggatgggccagttgagaggatctgccaccagagctttacctcctggccctcctactggcgcaacagcaaatcggctgaggtcagctgccgagcccgtggcttcaaccccggcttcacgcattcaacccgcaggaaatactagcccacgcgcaataagtcgcgtagatagagagaggaaggtgtcgatgcgcctacaccgaggcgctcctgcaaacgtgtcctccagcgatttgaccgggagacaggaggtcagcaggatccccgcttcccagaccagcgtaccatttgaccacctcggtaagtag

SEQ ID NO: 217151 - DNA, 1251 bp, Artificial Sequence
  Description of Artificial Sequence: Synthetic coding sequence
atggaactcagagtgggcaataaatataggttaggccgtaagattggctccggctcttttggtgacatttatctgggcgcaaatatagcctccggcgaagaggtcgcaattaagcttgagtgcgtaaagactaagcacccccagctgcatattgagagtaagttttacaagatgatgcagggcggagttggaattcccagcattaagtggtgcggcgctgagggggactacaatgtgatggtgatggagctcctcggcccatctctggaagacctcttcaacttttgctctcgcaagtttagcctcaagactgtcctcctcctcgctgaccagatgatatctcgaattgagtatattcactcaaaaaacttcattcatcgagacgtaaaaccggacaattttttgatgggcctcggcaagaaggggaatctcgtatatatcatcgacttcggactggcaaaaaagtaccgcgacgccagaacccaccagcacattccgtacagggagaacaagaacctaactggaacagcccgatacgcctctattaatacacacctagggatagagcagagccggcgagacgacctggagtctcttggctacgtattaatgtactttaatctgggctcactgccttggcaggggttgaaagcagcaacaaagcggcaaaagtatgagaggatcagcgagaagaaaatgagcacacctatcgaagttctatgcaagggatacccttccgagttttccacgtacttgaacttttgcaggtcgcttcggtttgacgataagccagactattcctacttgcgccagctcttcaggaacctgttccaccgacagggattttcttacgactatgtattcgactggaacatgctgaagtttggcgctgcaaggaatccagaggacgtggacagggagaggcgggagcacgagagagaagagagaatgggtcaactccgtggcagcgccacgcgcgctttgcccccaggcccacccacaggagctacagctaatcgcctcaggagcgctgcggaacccgtggcatccacgcctgcatctcggatccagcctgcagggaacacttctccacgcgctataagccgggtagacagggaaagaaaagtgtctatgcggcttcaccgaggtgccccagcaaatgtttctagttctgatcttactggaaggcaggaagtgtccaggatcccagcttcccaaacctctgtgccctttgatcatctggggaagtag

SEQ ID NO: 217152 - DNA, 1251 bp, Artificial Sequence
  Description of Artificial Sequence: Synthetic coding sequence
atggagttgcgggtaggcaataaataccgactgggccgaaagattgggtctggctcttttggagatatctaccttggcgctaacatagcgagtggcgaggaggtggctatcaaactggaatgtgtaaagacgaagcacccacaacttcacatagagtccaaattctataaaatgatgcagggaggcgtcggcataccatcgataaaatggtgcggcgcagagggcgattacaacgtgatggtaatggaactgctaggtccgtctcttgaggatcttttcaatttttgctccaggaaattctccttgaaaaccgtgctcctgctggctgaccagatgatctctcgcattgagtacatacacagcaaaaacttcatacaccgagatgtgaagcccgacaactttctcatgggcctgggcaagaaggggaatctcgtgtacattatcgacttcgggttggcaaaaaaataccgcgatgcacgtacccatcagcacataccctatcgggaaaacaaaaacctgactggaactgctaggtacgccagcattaacactcacctggggattgagcagagcaggagagacgacctggagtcccttggctacgtcctgatgtactttaacctgggctcattgccttggcagggtctgaaagccgctactaagcgccagaagtacgaaagaattagcgagaagaagatgtctacaccaattgaggtgctgtgtaaagggtatcccagtgaattttcaacttacctgaacttctgtcgaagtctccggtttgacgacaagcccgattacagctatctgcgacagctttttaggaacctgttccataggcaggggtttagttacgactacgtgttcgactggaatatgctgaaatttggcgctgccaggaaccccgaagatgtggacagggagcggagggagcacgagcgtgaagaaaggatgggccagctccggggatccgcaacaagagccttacctcctggaccccctactggagctacggccaatagactcaggagcgcagccgaacctgtggcgtctacgccagcgtcgcgtatccaacctgcaggaaacacgtctcctcgagcaatctcccgcgtggatcgggagagaaaggtgtccatgcgcctccaccggggtgcaccagccaacgtgtctagttcggatcttactggccgtcaggaagtaagtagaatcccggcttcgcagaccagcgtgcccttcgatcaccttggcaagtag

SEQ ID NO: 217153 - DNA, 1251 bp, Artificial Sequence
  Description of Artificial Sequence: Synthetic coding sequence
atggaactgcgcgtcggaaacaagtataggctgggcagaaagattgggtctggatccttcggggatatttacctgggcgcaaatattgccagtggtgaggaagttgcaatcaagctcgaatgcgtcaaaacaaaacaccctcagctgcacattgagtccaaattttacaaaatgatgcaaggaggtgtgggaatcccttccatcaagtggtgcggagccgagggtgactataatgtgatggtgatggagcttctcggacccagcttagaagacctgttcaacttttgctcccgcaagtttagtctaaagacagtgctgctcctggctgatcagatgatcagtaggattgagtacattcactccaaaaatttcatccaccgggatgtcaagccagacaacttcctgatggggttgggaaagaaaggcaacctggtttatatcatcgatttcggactggctaagaaatatagggatgctcgaacacatcagcacataccatatagggaaaataaaaatttaaccggtacagctcgctacgcatctattaatacacatctagggattgaacagagtcgcagagacgacctcgaatcactgggctacgtgctcatgtacttcaatctgggcagtcttccctggcaaggactgaaggcggctactaaaaggcagaagtatgaacggatctctgagaaaaagatgagcacacccatagaggttctatgtaaaggctatccaagtgagtttagtacgtacctgaatttttgcaggtcactgaggtttgatgataagcctgactattcctatcttcggcaactttttcgaaacctgtttcaccgccaagggtttagttacgattatgttttcgactggaatatgctcaagttcggggctgctcgcaaccccgaggacgtggatagggagaggagggagcacgagagagaagaaagaatgggccagctgcgcggatcagccacccgagcactaccccctgggcctccgaccggagcaaccgccaatcggctacggagcgccgcagagcccgttgcctctacgcccgcttcacgtatccaaccggctgggaacacttctcccagagccataagcagagtggatagagaacgaaaggtgagtatgcgcctgcaccgaggagcacctgcaaatgtttcgtcttccgaccttaccggtagacaggaggtgtcccgtataccagcgagtcaaacaagcgtacccttcgaccacctgggaaagtag

SEQ ID NO: 217154 - DNA, 1251 bp, Artificial Sequence
  Description of Artificial Sequence: Synthetic coding sequence
atggagttacgggttggcaacaaatatcggctagggaggaagatcggctcaggaagctttggggatatatacttgggagccaatatagccagtggtgaggaggtggccatcaagcttgagtgcgtgaagacgaagcacccgcagctgcacattgagtctaaattttataaaatgatgcagggcggagtcggcattcccagcatcaagtggtgcggcgctgagggagactacaacgtgatggtgatggagctgctcggaccgtccttagaagatttgtttaacttttgctcacggaagttctccctcaagaccgtactccttctagctgatcagatgatctcaaggattgagtacatacacagcaagaatttcatccatagagacgtgaaacccgacaatttcctgatggggcttggaaagaaagggaacttagtgtatatcatcgacttcggtctcgcgaagaaatacagagatgcacggacccaccaacacataccatatcgcgaaaacaagaaccttactggtaccgccagatacgctagcataaacacacatctggggattgaacagagccggcgagacgatctggagagcctcggatatgtcctaatgtattttaaccttgggtcactgccgtggcagggtctgaaggccgcaacaaaaaggcagaaatatgagcgcatctctgaaaaaaaaatgagcactcctatagaagtcttgtgcaaagggtacccatccgaattctccacctacctcaatttttgcaggagtctgagatttgacgataaacccgactattcttacttaaggcagctgttcagaaatttgtttcaccggcaaggattctcatatgactacgtgttcgattggaacatgttgaagtttggtgccgctcgaaaccccgaagacgtggacagagagcgcagagagcacgagcgcgaggagaggatgggccagctccgtggcagcgccaccagggctctacctcccggtcccccaactggagccaccgcgaacaggctgaggtctgccgctgagccagtcgcctctactcccgcttcgcgtattcaaccagccggaaatacaagcccgcgagctattagccgtgttgatcgcgagagaaaggtcagcatgcgcctgcatagaggggcacccgctaacgtgagctctagtgaccttacaggccgacaagaggtgtcacggatcccagcgtctcagaccagcgtcccgttcgaccacttggggaagtag

SEQ ID NO: 217155 - DNA, 678 bp, Artificial Sequence
  Description of Artificial Sequence: Synthetic coding sequence
atggaattgcgagtaggcaacaaataccggctcgggaggaaaatcggatcgggatctttcggcgacatctaccttggcgcaaacatagcctccggagaggaggtcgccattaaactggaatgtgtgaagacaaaacacccccaactccacattgagagtaagttctacaagatgatgcagggcggagtgggtattccctctattaagtggtgtggagccgagggagattataacgtgatggtgatggagctgctgggcccttcccttgaggacctgttcaacttttgtagccgaaagttctccctgaaaacagtgctcttgctggctgatcagatgatcagccggatagagtacatacacagcaagaatttcatccacagagatgtcaagcctgataacttccttatgggactagggaagaagggcaacctggtgtacattatcgacttcggactggccaaaaaatatcgggatgcgagaacccatcaacatattccgtacagggagaacaagaacctgacaggaactgcaagatacgcaagcataaacacccacttagggattgagcagagtaggagagacgatctagagtcattggggtacgtgttaatgtattttaacctggggagtctgccatggcagggactaaaagctgcaactaagaggcagaagtattag

SEQ ID NO: 217156 - DNA, 435 bp, Artificial Sequence
  Description of Artificial Sequence: Synthetic coding sequence
tgacgtaacctctttcaccgacaaggattttcctacgattacgtgttcgattggaacatgctgaagttcggcgctgctaggaaccccgaggacgtcgaccgtgagcgaagggagcatgaaagagaggagaggatgggccagctaagagggagcgctactcgcgcactgcctccagggcctcctaccggggctacagccaaccggttacgaagtgccgctgagccagtggcatctacccccgcatcacgaattcaacccgcaggaaacacaagccctagggctatcagcagagtggaccgggagcggaaagtgtcaatgaggctacatagaggtgctccagcaaatgtgagctcatccgatcttacaggcaggcaagaagtgtcacggataccagctagccaaacctccgtcccttttgaccatttaggaaagtag

SEQ ID NO: 217157 - DNA, 1182 bp, Artificial Sequence
  Description of Artificial Sequence: Synthetic coding sequence
atggaccaccctagtcgggaaaaggacgagaggcagaggaccaccaagccaatggctcagcgaagcgcccactgctcccgaccgtcaggctcatctagctccagtggtgtgcttatggtcggtcccaactttcgggtcggtaaaaagatcggatgtggaaattttggtgaattaaggctcggcaagaacctctacactaacgagtacgttgctataaagctggagccaatcaaaagccgtgcccctcagctccacctggaatatagattttacaaacaactgggatccgccggagaagggcttccccaggtgtattactttggaccctgtggcaaatacaatgccatggtccttgaactgcttggcccaagcctcgaggatctctttgatttatgcgaccggacattcaccctcaaaacagtgctaatgatagccatccagctgctatcaagaatggagtacgtgcactcaaaaaacctcatctacagggacgtcaagcccgaaaactttctgatagggcgtcagggcaacaaaaaggagcacgttatacacatcatcgacttcgggctcgccaaggagtacattgacccagagactaaaaagcatatcccctacagggagcataagtcattaacaggcacagctcgatatatgtccataaatacccacctgggtaaggagcaatcacgtcgggacgatctggaagctctgggccacatgttcatgtactttctgcggggatctctgccctggcagggactcaaagccgacactctgaaagaacggtatcagaagatcggagatacaaaaagaaatacgcccattgaggcactctgcgaaaatttccctgaggagatggcaacttacttaagatacgtccgacgcctggacttctttgagaaaccagattacgaatacctgcggacccttttcacagacctcttcgagaagaaggggtatacatttgactatgcgtacgattgggtaggaagaccgatcccaacaccagttgggtctgtccacgtggactccggggcttccgctataacgcgggaatcacacactcacagagaccggccatcgcaacagcagccgctccggaatcagtctctgcggacagtaactgcggagcactacgacgtaaataacagcgcaatatggcaccgcggaaggggaacttag

SEQ ID NO: 217158 - DNA, 1269 bp, Artificial Sequence
  Description of Artificial Sequence: Synthetic coding sequence
atggatcatccaagccgcgagaaagacgagaggcaacgaacaactaagcccatggcacagcgttccgcccactgttcaaggccttctggcagtagttcgtcaagtggcgtattgatggtgggacccaacttccgagtgggtaaaaaaattggatgcggcaattttggagaactgcggctggggaaaaacctttatacaaatgagtatgtggctatcaagctcgagcctataaagagtcgggcaccacagcttcatctcgagtaccggttttacaagcagctgggctctgctggtgaagggcttcctcaggtgtactattttgggccatgcgggaaatacaatgcgatggttctcgagctactcggcccaagcctggaagatctgttcgacttatgtgacaggacttttacactgaagacagttctgatgatcgctattcagttgctgtctagaatggaatatgtccattccaagaacctcatctatcgtgatgtgaaacccgaaaacttccttataggacgccaagggaataagaaggagcatgtgatccacatcatcgattttggcctagccaaagagtatatcgatcctgaaacaaagaagcatattccttatagggaacataaatctctgaccggaacagcaaggtacatgtctattaatactcacctgggcaaggagcaatccagacgagatgatctcgaggctctggggcatatgtttatgtactttctcagaggtagcctgccctggcagggcctgaaagctgatactctgaaagagaggtaccaaaagatcggggatacgaagcggaatactccaatcgaggccctgtgcgagaacttcccggaggagatggcaacttatctcagatacgttcggaggctggatttctttgagaaacctgactacgaatacttacgcacccttttcactgatcttttcgaaaaaaagggatacaccttcgactatgcatatgattgggtcgggagaccaatccctaccccagttggctctgtccacgtggattcgggggctagcgccattacccgggagtcccacacacatagagataggccttcacagcaacagccgttgcggaaccaggtggtctcatcgacaaatggagaactgaacgtggacgaccccacaggcgctcactccaacgcgccaattaccgcccatgctgaagtggaagttgtggaggaagccaagtgttgctgcttctttaagcggaagcgtaaaaagacagcccaaaggcacaaatag

SEQ ID NO: 217159 - DNA, 1137 bp, Artificial Sequence
  Description of Artificial Sequence: Synthetic coding sequence
atggatcatccttccagggagaaagatgaacgtcagaggacaacaaaacctatggcacaacgaagtgcccactgctccaggcccagcggcagttcctcgagctctggcgtgttgatggtcggcccaaatttcagagtgggcaagaagataggctgcggcaacttcggtgaactgcggcttggtaaaaatctctatactaacgagtacgttgcaatcaaactggaactgctgggccctagtctggaagacctgtttgacttatgcgaccggacattcacgctgaagaccgtcttgatgatagccattcagctgcttagccgcatggagtacgtgcatagtaaaaacctaatctatcgggacgtcaagcccgagaattttttgattggaagacagggcaacaaaaaagagcacgttatacacataatcgactttggcctcgcgaaggaatatattgacccagagaccaagaaacacattccatatcgggagcacaagtcactgacaggcactgctcgctacatgagcattaatacacacctggggaaagaacaatctagacgggacgacttggaagctctcggccacatgtttatgtattttcttagaggctccttaccctggcagggtcttaaagccgataccctaaaagagaggtaccagaaaattggagacaccaaacgcaacactcccatcgaggccttatgtgaaaattttcccgaagagatggcaacttatctgcggtacgtgaggagattagacttcttcgagaaacctgactacgagtatctgcgtacacttttcacagacctgttcgagaagaagggctatactttcgattacgcttatgactgggtcggccgacctattccaacaccagtcgggagtgtccatgtggactccggagccagtgccataacccgcgagagccacactcacagggaccgaccctcccagcagcaacccctgagaaatcaggtagtgagctccacgaacggcgagctgaatgttgatgacccaactggggcacactctaacgctccaatcaccgcccacgcggaggtggaggtcgtggaagaggcaaagtgctgctgtttcttcaagaggaaacgaaagaaaacagctcagcgccacaaatag

SEQ ID NO: 217160 - DNA, 1248 bp, Artificial Sequence
  Description of Artificial Sequence: Synthetic coding sequence
atggattttgacaagaaaggcggtaagggagaaacagaggagggccgtcggatgtcaaaggctggcggtggaaggagtagccacggtatccggtcatcaggaacatccagtggagtgttgatggtcggaccaaatttccgagtaggcaagaagatcgggtgtgggaattttggggaacttagactggggaaaaacctgtataccaatgagtacgtagctatcaaacttgagccaattaaaagtagggcccctcagttacatttggagtacaggttttacaaacagctctctgcaaccgaaggtgtcccccaggtttattactttgggccttgcggcaaatacaatgccatggtcttagaactactgggcccttccttggaggacctgtttgacctctgcgatagaacatttactctgaagactgtgttaatgattgccattcagctcatcactaggatggaatatgtccacacaaagtccctcatttatcgcgatgtgaagccggaaaatttcctggtggggagacccggaaccaagagacaacatgcgattcatatcatcgattttggattagcaaaggaatacatcgatccagaaacgaaaaaacacattccgtatagagagcacaagagcctgacaggcaccgcgagatatatgtcaattaatacccatctgggcaaggaacagagtcggagggatgacctggaggccctggggcacatgttcatgtattttctgcgcggaagccttccgtggcaagggttgaaagccgatacgcttaaggagcggtaccagaaaatcggggacacaaagagggcgactccgatcgaggtgctctgcgagaatttcccagaggaaatggcaacttatttacggtacgtaaggagactcgacttctttgaaaagcccgactacgattacctgcggaagttgtttaccgacctgtttgatcggtccgggtttgtcttcgactatgaatatgactgggctgggaagccattaccaactcctatcgggacagtgcacaccgatctgcctagtcagcctcagctgagggacaagactcaaccgcacagtaagaaccaggcactcaattctactaatggagagttgaacgctgatgaccccacagcaggccattcaaatgctccaatcactgcgccagccgaggtggaagtggcggatgagacaaaatgttgttgcttctttaaacgcagaaaaaggaagagcctccagagacataaatag

SEQ ID NO: 217161 - DNA, 645 bp, Artificial Sequence
  Description of Artificial Sequence: Synthetic coding sequence
atgtcaatcaatacacatcttggcaaagagcagtcccggagggacgacctcgaagctctcggccacatgttcatgtactttctgaggggaagcctcccatggcaagggctgaaggccgacacacttaaggaacgctaccagaagattggggacactaaacgggcaacccctatcgaagtcttgtgcgagaattttcccgaggagatggctacatacctccgatatgttaggcgcctggacttcttcgaaaagcccgattatgattatctcaggaagctgttcaccgatctgttcgaccgcagcggctttgtgttcgactatgaatacgattgggcaggtaagcccctgcctacacccattggtacggttcacactgacctgccatctcaacctcaacttcgggataagacgcagcctcccgaaagcagcccatgcagccctctggggagagatttggtgagaggcccacgtggccctcctaccgccgctcaaggtcagacattagccggtagccagaacgccgactgcagggggagagcatggctacgtaggccacacccaagagacgtgggttctctcccttcctgtaagacccttgctgagatctctacacccgtgtcttccccacccttgcaagaacactag

SEQ ID NO: 217162 - DNA, 1272 bp, Artificial Sequence
  Description of Artificial Sequence: Synthetic coding sequence
atggagaataaaaagaaggataaggataagagcgacgacaggatggctcgaccgtcaggaaggagcggccataacactcgcggtactggctcttcatcgtctggcgtgctgatggtgggccctaactttagggtcgggaaaaaaattgggtgtgggaattttggcgaattgaggcttgggaagaacctgtacacaaacgaatacgtggcaatcaaactggagcccatgaagagccgcgcaccccagctccacctagaatatagattttacaaacagctgggaagtggggatgggataccacaggtctactattttggcccttgtggaaaatataacgccatggtactggagcttctgggaccttctctcgaagacctgtttgatctgtgtgatcggaccttcagtctgaagactgttcttatgattgccattcagctcatttcgcggatggaatatgtgcacagcaagaatctgatttacagagatgtgaaaccagaaaactttttaattggcaggcccggaaataagacgcagcaggtgatccatattatcgactttggactcgctaaggagtacattgaccctgaaacgaaaaagcacataccctaccgggagcacaaaagccttactggcactgccagatacatgtctatcaatacacacttgggaaaggaacaaagcaggagggacgatcttgaggccctcggacatatgttcatgtactttctccgtggtagtttgccctggcagggtttgaaagctgacacactgaaggagcggtatcaaaaaattggagatactaagcgggctacacccatcgaggtcctttgtgaaaatttccctgagatggccacttatctgcggtacgtgcgtaggctggattttttcgaaaagccggactacgattacctaagaaaattgtttacagatctgttcgatcggaagggatatatgtttgactatgagtatgattggattgggaagcagctgcccacccccgtgggcgctgtgcagcaagatccagctctctcatctaaccgcgaggcacatcagcatcgcgacaaaatgcagcagagcaagaaccaggtggttagtagtactaacggcgaacttaatacagatgaccccacagccggacgtagtaatgctcccataacagcgcctactgaggtggaggttatggatgaaacaaattgccagaaagttctgaacatgtggtgctgttgctttttcaagaggcgtaagcggaaaacaattcagcggcataagtag

SEQ ID NO: 217163 - DNA, 1368 bp, Artificial Sequence
  Description of Artificial Sequence: Synthetic coding sequence
atggagaacaaaaagaaagacaaagacaaaagcgatgatcggatggctagacccagcggtaggtctggccacaacacccggggaaccggcagtagcagcagcggcgtgttgatggttggccctaactttcgagttggcaaaaagatcggctgtgggaactttggcgagcttcgtttaggaaagaacctttataccaacgaatacgtggctataaaactggaacctatgaaaagccgcgctcctcagctgcaccttgagtacagattttacaagcagctgggcagcggggatggcattcctcaggtctattacttcgggccttgtgggaaatacaacgcaatggtgttggagctgctaggtccttctctcgaggatctgtttgatctctgcgataggacttttagcttgaaaacagtcctgatgatcgcaatacagcttatcagccgtatggaatacgtccacagtaagaatctgatctaccgggacgtgaaacccgagaacttcctgatcggaagaccagggaataagacccagcaagtaattcatattatcgatttcggcttagctaaagagtatatagaccctgaaaccaaaaagcacatcccctaccgtgagcataagagtctgaccggcactgcaaggtatatgagcatcaacactcacctgggaaaggaacagtctcggagagacgatctggaggccctggggcacatgtttatgtactttttgagaggatcattgccatggcagggtctgaaagcggatacactaaaggagcgctatcagaagattggggatacaaaacgggcaacaccaatcgaagtgctctgtgagaatttccccgagatggcaacctatctgagatatgtgagacggcttgacttcttcgagaaaccagactatgattatcttcggaagcttttcaccgatctgttcgatcgcaaagggtacatgttcgactacgagtatgattggattgggaagcaactccccacgcccgtgggagccgtccaacaggatcctgccctgtcctcaaatcgggaggcacatcagcaccgggataaaatgcagcagagtaagaatcagagcgcggaccaccgggcagcctgggactcccagcaggccaacccacatcacctcagagcccacttggcagctgatcgccatgggggttcagttcaggttgtttcaagcactaatggtgaactcaatacagatgacccaacagccggtaggtctaacgcgcctattacagcaccaaccgaagtggaggtcatggacgagaccaattgccagaaggtactgaacatgtggtgttgctgcttctttaaacggaggaagcgcaagacgatccagcggcacaagtag

SEQ ID NO: 217164 - DNA, 1344 bp, Artificial Sequence
  Description of Artificial Sequence: Synthetic coding sequence
atggagaacaaaaaaaaagacaaagacaagtccgacgatcgtatggccagaccgtctgggcgatcaggccataacacccgcggaacaggtagttcctcttctggcgttcttatggtgggtcctaactttcgtgtagggaaaaagatcgggtgtgggaattttggagagctgagattagggaagaacctatataccaatgagtatgtagctattaaattagagcccatgaaaagccgcgcaccccaacttcatctggaatacaggttttacaagcaactaggcagtggcgatggaattccacaggtgtactacttcggcccatgtgggaagtacaacgccatggtgcttgaactgctggggccaagcttagaggacctgtttgacctatgcgacaggacttttagcctgaagaccgtgctgatgatcgcaattcaacttatctcacggatggagtacgtgcacagcaaaaacttaatctacagggatgtcaaaccagagaactttcttataggacgtccgggaaataagacacagcaggttattcatattattgacttcgggctggctaaagaatacattgatccagaaaccaagaaacatattccctatcgggagcataagtccctgaccggcacagccagatacatgtcaattaacacacacttgggcaaagagcaatcacggagagacgatctggaggctttagggcatatgttcatgtattttctgaggggatctctgccgtggcagggccttaaagccgacaccctgaaggagcggtatcagaaaatcggggacacaaaacgggcaaccccaattgaggtgctgtgcgagaacttcccagagatggcaacatacctcagatatgtaagacggctggattttttcgaaaagccagattatgattacctcagaaaactgttcacggatttattcgatcggaaggggtacatgttcgactacgaatatgattggattggtaagcagctgcctactccagtgggagcagtgcagcaggaccccgcactgtcctctaatcgagaagctcaccagcatcgggacaagatgcaacaaagcaaaaatcaatccgcagaccaccgcgcagcatgggattcccagcaagccaatccacaccatcttagggcccacctcgcagcagatcgacatgggggtagcgttcaggttgtgtctagtacgaatggcgagttaaataccgatgatccaaccgctggtaggtcgaatgctccgatcacagccccaaccgaagtggaagtgatggacgagacaaagtgctgttgctttttcaagcgtaggaagagaaaaactatccagaggcacaaatag

SEQ ID NO: 217165 - DNA, 1344 bp, Artificial Sequence
  Description of Artificial Sequence: Synthetic coding sequence
atggaaaataaaaaaaaggacaaggataaatctgacgacagaatggccaggccctcaggaaggagtggacataatactcgtggcacaggctcgagctcctcaggcgtattgatggtgggccctaacttccgagtgggaaagaaaatcggatgtggtaacttcggggagctacgtctcggaaagaacctgtataccaatgagtacgtcgcgatcaagctcgagcctatgaagagccgggctcctcagttgcatctggaatatcgcttctataagcagctcggtagcggagacggcataccgcaggtgtattacttcggaccttgcggaaaatacaatgctatggtgttggaattactgggtccctcactcgaggacctgttcgatctgtgcgataggacattctcccttaaaactgtgcttatgatcgccattcagctcataagcaggatggaatatgtgcacagcaaaaatctaatctatagggatgtcaagcctgaaaattttctgatcggcaggccaggtaacaagactcaacaggttatccacattattgactttggtctggctaaggagtacatcgaccccgagaccaagaagcacattccgtatagggagcataaatccctaacaggcactgctagatacatgtctattaacactcacttaggaaaggagcaaagtcggagagacgacctggaggctctgggacacatgtttatgtactttttgcgtgggtccctgccttggcagggattaaaggcagacacactaaaagagagatatcagaagatcggggacacaaagcgagcaacaccaattgaggtactgtgcgagaactttccagagatggccacctatctacggtacgtgagacggctggatttttttgaaaagcccgattacgactacctgagaaagctgtttactgatctcttcgatagaaaagggtacatgttcgactatgagtatgattggatagggaaacagctgccaaccccagttggggcagtgcagcaagatcctgcactgagctctaatcgtgaggcgcaccagcacagagataagatgcaacagtccaagaatcaaagcgccgaccatagggcggcttgggactctcagcaagcaaatcctcatcatttacgcgctcatctagccgcagacaggcacggcggtagcgtgcaggtggtgagcagcacaaacggcgagttaaacaccgacgacccaactgctgggaggagcaatgcccctatcaccgcgccaacagaagtggaggttatggatgaaaccaaatgctgctgcttctttaagcggagaaaacgcaaaaccattcaacgacataaatag

SEQ ID NO: 217166 - DNA, 1368 bp, Artificial Sequence
  Description of Artificial Sequence: Synthetic coding sequence
atggaaaataaaaagaaagacaaggataaatctgatgatcgtatggcacgaccctcaggtcgctctggacacaacacaagagggactggatcttccagcagtggggtgcttatggtgggaccaaacttccgagtagggaaaaagattggctgtgggaatttcggcgagctacggctgggaaagaacctttatactaacgagtacgtggcaatcaaactggagcctatgaaatcacgcgcaccccagctgcacctggaatatcgtttttataagcagcttggctcaggcgacggcatccctcaagtgtactacttcggcccttgcggaaagtataatgccatggttttggagctgctcggccctagcctggaagatttatttgatctgtgcgacaggacattctcactcaagaccgtgcttatgatcgcgatccagttgatcagcagaatggagtatgtacacagtaagaacctgatataccgtgatgttaagccagagaattttttgatcggacggccagggaacaaaacccagcaagtaatacatattatcgactttgggctggccaaggaatatatagaccccgaaaccaagaagcacataccatatcgggagcacaaaagtctcacgggaaccgcaagatacatgagcatcaacacacaccttggtaaggaacagtctagaagagacgacctggaagccctgggccacatgtttatgtattttctgcgtggcagtcttccatggcaaggcctgaaggccgataccttgaaagagcgctatcaaaagattggagacacaaagcgcgctacccccatcgaagtgctgtgcgagaatttcccggagatggctacttacctcagatacgtgcggagactcgacttttttgagaagcccgactacgactacttgcggaaactgtttacagacctcttcgatagaaaaggctacatgtttgattacgagtatgactggatcggtaaacagctcccaacaccagtaggagccgttcagcaggaccctgccctgagcagtaatagagaggcccaccagcatcgggataagatgcaacagtcaaaaaaccagtcggcagaccatcgagctgcatgggactctcaacaggcaaacccccaccacctccgcgcacatctggccgctgacagacacggcggaagcgttcaggtggtgtcgtccaccaatggcgaactgaatactgacgatccaactgccggaaggtccaatgcgccaatcacagcacccaccgaagtggaagttatggacgagactaactgccagaaagtcctaaatatgtggtgctgttgcttctttaaacgacgtaaaaggaagacaatccagagacacaaatag

SEQ ID NO: 217167 - DNA, 1275 bp, Artificial Sequence
  Description of Artificial Sequence: Synthetic coding sequence
atggagaacaaaaaaaaagataaagataaaagtgatgatcggatggcccgaccatccggtcgatctgggcacaacacccgcggaactggatcttcctcaagtggagtgctgatggtaggccctaactttcgagtgggcaaaaagatcggatgtggcaactttggggagctgaggctcggaaagaatttgtacaccaatgagtatgtagcaattaagctcgaacccatgaaaagtcgcgcaccgcagctgcaccttgagtatcggttttacaagcagctgggctcaggcgatggcattcctcaggtctactatttcggaccatgtggtaaatacaatgcaatggtgctggaattactcggcccatccctggaggatctgtttgatctgtgtgaccggactttttccctgaaaacagttctgatgattgccatccagctcatcagccgcatggaatacgtgcacagtaaaaacctgatctatcgggacgtgaagcccgaaaactttctcatcgggagacccggaaataagacacagcaagtgattcacattatcgacttcggactagcgaaagagtacatcgaccccgaaaccaagaaacatattccttatcgggagcacaaatccctgacagggactgctcgatacatgagtatcaacacacaccttggaaaggagcaatcccgacgtgatgatttggaagccctgggccatatgttcatgtactttcttcgaggcagtctgccatggcaagggcttaaggccgacacgttaaaggagcggtatcagaaaatcggcgataccaagcgcgcaacccctatcgaggtcctatgcgaaaatttcccggaagagatggctacttatctacgatatgtccggagacttgacttcttcgaaaaacctgactacgactatctgcgaaagctgttcactgatcttttcgatagaaagggctacatgttcgactatgaatacgattggatcgggaagcagctccctacccccgtgggggctgtgcaacaggaccccgcactctcaagcaaccgggaggcccaccaacaccgggataaaatgcagcaatctaaaaaccaagtggtgagctctacaaatggggagctcaacacagacgaccccactgccggtcggtccaatgcacccatcaccgctccaacagaggttgaagtgatggatgaaactaattgtcagaaggtcttaaacatgtggtgctgctgcttcttcaaacgacgtaagcgcaagacaatccagcgtcataaatag

SEQ ID NO: 217168 - DNA, 1272 bp, Artificial Sequence
  Description of Artificial Sequence: Synthetic coding sequence
atggaaaataagaagaaagataaggataaatcggacgaccgtatggctcgtccgagcgggcgttccgggcacaataccagggggacaggtagttccagtagcggagtcttgatggtgggcccaaattttcgggtgggtaagaagatcgggtgcgggaatttcggggagcttcgccttggtaagaacctgtataccaatgagtacgtggctattaagctggaacccatgaaatcccgggcacctcagttacatctggaatatcgcttctataaacagctgggcagtggcgatggaatcccacaggtgtactactttggaccatgcggcaaatacaacgccatggtacttgaactcttagggccatcactcgaagacctgttcgatttatgcgacagaaccttttccctgaaaacagttcttatgattgctatccaactgatttcccggatggagtacgtgcacagcaaaaacctaatctaccgcgacgtgaagcctgagaattttttaataggacgaccgggaaataaaacgcagcaggtcatacatatcatcgatttcggcctagccaaggagtacattgatccagaaacaaaaaaacacatcccttacagagaacataaaagcctcaccgggactgccaggtatatgagcattaatacccatctgggcaaggaacagtctagacgcgacgatttggaggccttgggacacatgttcatgtattttcttagaggttctctcccgtggcaggggctgaaagccgacactctgaaggagaggtaccagaaaattggggatactaagagggctacaccaatcgaggtgttgtgtgagaatttcccagagatggctacttaccttaggtatgtgcggcgactggatttcttcgaaaagccggattacgattatctgcgcaaattatttacagatctctttgatcgcaaagggtacatgtttgattatgaatatgattggatcggaaagcaactcccaacaccagtaggtgcagtacaacaagacccagctctctccagtaatagggaagcccatcaacatagagacaagatgcagcagagcaaaaatcaagttgtaagttctaccaatggggaattgaacacggacgacccaaccgcaggaagatcgaacgcgccaatcacggcccctacggaggtagaggtgatggatgagaccaattgccaaaaggtgctgaacatgtggtgctgttgcttttttaagaggaggaagcggaagaccatccagcgacataagtag

SEQ ID NO: 217169 - DNA, 648 bp, Artificial Sequence
  Description of Artificial Sequence: Synthetic coding sequence
atgagtagctctgaggaggtcagttggatttcctggttttgtgggctcagaggaaacgaatttttttgcgaggtggatgaagactacattcaggacaaattcaaccttacgggccttaatgagcaggtcccacactacagacaggcactggacatgatcctcgaccttgagcccgacgaggaactggaagacaaccctaatcagtctgatcttattgagcaggccgcagagatgctctacggtctaatccacgccagatacatcctgacaaatcggggtatcgctcagatgctggaaaagtaccagcagggggacttcggatattgccctcgggtttattgtgagaaccagcctatgctgccaattggcttgtccgacataccaggggaggcgatggtgaagctgtactgtcccaagtgtatggacgtgtatacccccaagtcatcacgccaccaccacacagacggcgcatactttggaaccggatttccacatatgctgtttatggttcatccagaatacagacccaagcgcccagccaatcagttcgtgcctcgcctgtacggattcaagatccaccccatggcatatcaactgcaactgcaggccgcttccaattttaaaagcccagtcaagaccataaggtag

SEQ ID NO: 217170 - DNA, 648 bp, Artificial Sequence
  Description of Artificial Sequence: Synthetic coding sequence
atgagcagtagcgaggaagtttcctggatcagctggttctgcggcctgcgcggaaatgaattcttctgtgaagtggatgaagactacatccaagacaagttcaatctgactggactaaatgagcaggtcccccactatcggcaggccttggacatgattctggacttagaaccagacgaagagttggaggacaatcccaaccaaagcgacttgatcgaacaggcagccgagatgctatatggccttatccacgccagatatattttaactaatcgcggaattgcccagatgcttgaaaagtatcaacagggcgattttggctattgtcccagggtatactgcgagaaccaacctatgttacccatcggcctgagcgatattccgggagaggctatggtaaaactctactgtcctaagtgcatggacgtgtatacacccaagagctcaaggcatcaccacactgacggggcatatttcggaactggctttcctcacatgctgtttatggttcaccctgagtacaggcccaaaaggcccgctaatcaatttgtaccgaggctttacggcttcaagattcaccccatggcttatcaacttcagctgcaggcagcctccaacttcaaatctcccgtaaaaaccattagatag

SEQ ID NO: 217171 - DNA, 648 bp, Artificial Sequence
  Description of Artificial Sequence: Synthetic coding sequence
atgtctagctcagaggaagtgtcctggatctcctggttttgcggattgcgaggcaacgaatttttctgcgaggtggatgaggactatatccaggacaagtttaacctaaccgggctcaatgaacaggtgcctcattatcgacaggcattggatatgattctggatttggagcctgatgaggaacttgaggataatccgaatcagagcgaccttatcgaacaggcagcggaaatgttgtacggccttatacatgcaaggtatattttaaccaaccggggaatcgctcagatgctcgaaaagtaccagcaaggcgacttcggctattgtcctagggtgtactgtgagaatcagcccatgctgcccatcgggcttagcgatattcctggtgaggccatggtgaagttatactgccccaagtgcatggatgtttatacccctaagtcaagcagacaccatcatacggacggagcttattttggtacaggcttcccacatatgttatttatggtgcaccccgaatatcggccaaaaagacctgcgaatcaatttgtccctcggctttacggcttcaagatccatccgatggcgtaccagctacagctacaggctgcaagcaatttcaagtcccctgtcaaaacgatacgctag

SEQ ID NO: 217172 - DNA, 648 bp, Artificial Sequence
  Description of Artificial Sequence: Synthetic coding sequence
atgagcagcagcgaagaagtcagttggatctcctggttctgtgggctgcgaggcaacgagttcttttgtgaggtggatgaggactatatccaagacaagtttaacctcaccggcctgaatgagcaggtcccacattatcgacaggccctcgatatgatactggatctagaacccgatgaggagctcgaggataatcccaatcagtccgatctgatcgaacaggccgctgagatgctctacggacttatccacgctagatacattttgaccaaccgtggaatcgcacaaatgctcgagaagtaccagcagggcgattttgggtactgccccagggtctactgtgaaaaccagccaatgctgcccatcggcctcagcgacatcccaggcgaagcaatggtgaagctgtactgtcctaaatgtatggacgtgtacactcctaagagtagtcgccaccaccatacagacggggcatatttcggcaccggttttccacacatgttatttatggtacatcccgagtatcggccaaagcgcccagccaaccagtttgtgccccgtctgtacggtttcaagatccatccaatggcctatcagctccaactacaggccgctagcaattttaagtccccagtgaagactattcgttag

SEQ ID NO: 217173 - DNA, 687 bp, Artificial Sequence
  Description of Artificial Sequence: Synthetic coding sequence
atgtctagcagtgaagaagtgagctggatctcatggttttgtgggctccgtgggaatgaattcttttgtgaggtggatgaggactatatccaagataaatttaatctcacaggtttgaacgaacaggtgcctcactacagacaggcccttgatatgatcctggacctggagcctgacgaagagttggaggataatccaaaccaaagcgatttgatcgagcaggcagccgagatgctctatggcctgattcacgcacggtatatcttgaccaatcgagggatcgcacagatgttggaaaaataccagcagggcgacttcggttattgtcctagggtgtactgtgaaaaccagccaatgcttcccattgggctgagcgacattcctggagaggccatggtgaaactgtactgtcctaaatgcatggacgtatacactccaaagagttcccgtcaccaccacaccgacggtgcttacttcggcaccgggtttcctcacatgctgttcatggtgcaccctgagtataggcccaagcgtccggcaaatcaatttgtgccgtcttcgtgctcacgacatccggatgttcccctactgcctcgaagacgcccattctgtcgcatgcatttccggctgagagaagtgtaccaccagcaactgattcctgtacatggcgaccatcatctgctctag

SEQ ID NO: 217174 - DNA, 648 bp, Artificial Sequence
  Description of Artificial Sequence: Synthetic coding sequence
atgtcttcttctgaggaggtctcttggatatcatggttctgtggtctaaggggcaacgaattcttctgcgaagtggatgaggattacatccaggacaagtttaatctgactggtctgaacgaacaggtgccacactacagacaggcattggacatgatactcgatctggaaccggatgaagaactggaagataacccaaatcagagcgaccttatcgagcaggccgctgagatgctatatggtctcatccacgcaagatatatcttaactaataggggcatcgcccagatgctcgagaagtatcagcagggagatttcgggtactgtcctcgtgtatactgtgaaaatcagccgatgttacctatcggtttgagtgacattcccggagaggcaatggttaaattgtattgtccaaagtgtatggatgtgtacacacccaaaagctctcggcaccaccacaccgacggagcctatttcggaacaggcttcccacacatgctgtttatggtgcaccctgaatacaggccaaagagacctgccaaccaatttgtcccccgactgtacggttttaaaattcaccctatggcttaccagctgcagcttcaagccgcaagcaacttcaaatcgcctgtgaagactattcgctag

SEQ ID NO: 217175 - DNA, 648 bp, Artificial Sequence
  Description of Artificial Sequence: Synthetic coding sequence
atgagctctagtgaggaggtttcttggatcagctggttttgtggactgcgcggaaacgagtttttttgtgaagtggacgaggactatattcaggacaagtttaacctcacaggactgaatgaacaggtcccgcactaccgccaggcgctggacatgatccttgatctggaacccgatgaagagcttgaggacaaccccaatcaaagtgacctcattgaacaagcagctgagatgctgtatggcttgatccacgcccgttatatcctgacgaatcggggtatcgcccagatgctggaaaaatatcagcagggagacttcgggtactgtcctagagtgtactgcgaaaatcagcccatgctcccaattgggctgtctgacattcccggagaggcgatggtgaagttgtactgccctaagtgcatggatgtatataccccaaaatcctcacggcatcaccataccgatggagcctactttggaacagggttcccacacatgttgttcatggtccatcccgagtacagacccaagcgcccagcaaaccaattcgtaccacggttgtatggctttaagatacacccgatggcctaccagcttcagctccaggccgctagcaattttaagtcaccagtcaaaaccattcgctag

SEQ ID NO: 217176 - DNA, 705 bp, Artificial Sequence
  Description of Artificial Sequence: Synthetic coding sequence
atggaaaaatgcaaagggactagcaggatggcaggaacgacatctgctgacgtaaaaatgtccagctcagaagaggtgtcatggatcagttggttttgcgggctacgcggaaatgagttcttttgcgaagtcgacgaagattacatccaggataagttcaatcttactggcctaaacgagcaggtcccccattataggcaagcactcgacatgatcctagatcttgaacctgatgaagagctcgaggataatcctaaccagtccgacctaattgaacaggccgcagaaatgctttacgggcttatccacgcccgttacattctgaccaaccggggtatcgcccaaatgctggagaagtaccagcagggagattttgggtactgtcccagagtctactgtgagaaccagcccatgctcccaatcgggctgtcagatattccaggtgaagcaatggtaaagctgtactgccccaagtgcatggacgtgtatactccaaagagttcccgccaccaccacactgacggagcctattttggtaccggctttcctcatatgctctttatggtgcaccctgagtatcgtcccaagcgcccagccaaccagttcgtgcctcgcctttatggtttcaagattcacccaatggcctatcagctacaactacaggctgcctctaattttaaatcgcctgtgaaaacgatccggtag

SEQ ID NO: 217177 - DNA, 648 bp, Artificial Sequence
  Description of Artificial Sequence: Synthetic coding sequence
atgtcctcttccgaagaggtctcctggatctcatggttctgcggactgagggggaacgaatttttttgcgaagtggatgaggattatatacaggacaagtttaaccttaccggattgaatgaacaggtcccccactaccgccaggcactggatatgattctggacttggagcccgatgaagagcttgaagataatcctaaccagtctgatctgatcgagcaggctgcagagatgttgtacgggctcattcacgcgcgatatatactgacgaataggggaatcgcccagatgctggagaagtaccaacagggagacttcgggtactgtcctagggtttattgcgagaatcagcctatgttgccaattggtttgtcagatattccaggtgaggccatggttaagctgtattgccctaaatgtatggacgtgtataccccaaagtcatccagacaccaccatacagatggcgcttattttggcaccggatttccacacatgctgttcatggttcatccagaatataggcctaagagaccagcaaaccaattcgtgcctagactgtatggttttaagatacatccgatggcttaccagctccagctgcaagccgcaagcaactttaagagccctgtcaagaccattagatag

SEQ ID NO: 217178 - DNA, 687 bp, Artificial Sequence
  Description of Artificial Sequence: Synthetic coding sequence
atgagtagttctgaggaggtgtcctggatatcctggttttgcggattgaggggtaacgaatttttctgcgaagtggacgaagattacattcaggataaattcaatctgaccggactcaatgaacaagtcccgcattaccgacaggccctagacatgatcctggacctagagcccgatgaggagctggaagataacccaaaccaatccgatctgattgaacaggctgcggaaatgctgtatggcctcattcatgcccgatacattctgacaaatagaggcatcgcccagatgctcgagaaatatcagcagggtgactttgggtactgtccacgtgtttactgcgagaatcagcccatgctgccaataggcctgagcgatattcctggggaagctatggtgaaactctactgccctaaatgcatggacgtgtacacacctaagtcatctcgtcaccaccatactgatggtgcttactttggaaccggcttccctcacatgttgttcatggtgcaccctgagtaccgccctaaacgcccagccaatcagttcgtgccaagcagctgcagccggcatccagacgtacccctcctgcctcgaagaaggcccttttgtcggatgcacttcaggctgcgcgaggtgtaccaccagcagctgattccagtgcatggagaccaccacctcctttag

SEQ ID NO: 217179 - DNA, 687 bp, Artificial Sequence
  Description of Artificial Sequence: Synthetic coding sequence
atgtcgtcaagcgaggaggtttcctggatctcctggttctgcggcttacgcggaaatgagttcttctgcgaggtagatgaggattatatccaagacaaattcaatctaacaggcctcaacgagcaagtgccccattaccgccaggccctggacatgattcttgacctggaacccgatgaggaattggaagataatcctaaccagagtgacttaattgagcaggctgcggaaatgctctatggtctgattcatgccagatatatacttactaaccgagggatcgcccaaatgctcgaaaagtatcagcagggcgatttcgggtattgccccagggtgtattgcgagaaccagccaatgttgccaataggtctgagcgatatccccggtgaggcgatggtgaaactgtactgtcccaaatgtatggatgtgtatacccccaagagctcccgacaccaccatacggatggcgcatactttggaactggatttccacacatgctgtttatggtgcaccccgagtatcgtcctaaaaggcccgcaaaccaatttgttcccagcagctgctccaggcaccctgatgtgcctttgctgccgagacgtcgccctttttgccgcatgcacttcaggctcagagaagtgtatcatcagcaacttattccagtgcacggtgaccaccatctgctctag

SEQ ID NO: 217180 - DNA, 648 bp, Artificial Sequence
  Description of Artificial Sequence: Synthetic coding sequence
atgtcatcaagtgaagaagtgagctggattagttggttttgtggactgagaggaaacgaattcttttgcgaggtagacgaggattatattcaggataagttcaatctgactggactcaatgagcaggtcccacactatagacaggctctagacatgatcttagacctcgaacctgatgaagagttagaggacaatcccaatcagtccgacttaatcgagcaggccgcagaaatgctctacggtctcattcacgcacgctacattctcaccaatcgaggcatcgctcaaatgttggaaaagtatcagcagggcgactttgggtactgccctcgcgtgtattgcgagaatcagcccatgctgcccatcggactgtccgatattcctggagaggccatggtaaaattgtattgcccgaaatgcatggacgtgtataccccgaagagtagcagacaccatcacaccgacggagcatatttcgggactggcttcccacatatgctgttcatggtgcatcctgagtacagacctaaacgcccagccaaccagttcgtcccgaggctctacgggttcaagattcacccaatggcttaccagctccagcttcaggcggctagcaactttaagagcccagtaaagacaatccggtag

SEQ ID NO: 217181 - DNA, 705 bp, Artificial Sequence
  Description of Artificial Sequence: Synthetic coding sequence
atggagaagtgcaagggaacctcacggatggccggaacaactagcgctgacgtgaagatgtccagtagcgaggaggtgtcttggatctcgtggttttgcggacttcggggaaatgaatttttctgcgaggtcgacgaggattatatccaggacaagtttaatctcaccggcctgaatgagcaggtccctcattacaggcaggccctcgacatgattctggatctcgaacctgacgaagagcttgaggacaatccgaaccagagcgacctgatcgaacaggccgctgagatgctgtatggcttaattcatgccagatacatcctaacaaatcgcggaattgcccaaatgctcgaaaagtaccaacagggcgattttggctactgtcctagagtctattgcgagaatcagccaatgttacccatcggcctcagcgatatccctggcgaagctatggtgaaactgtattgtccaaaatgtatggatgtttacacgccgaagtcttcccgccaccaccatacagacggtgcgtacttcgggacaggatttccacacatgctgtttatggttcaccccgagtacaggccgaagcggcctgctaatcagtttgtaccacgactttacggatttaaaatccaccctatggcgtatcaactgcagctgcaggcagcatctaattttaaaagcccggtcaaaactatccggtag

SEQ ID NO: 217182 - DNA, 648 bp, Artificial Sequence
  Description of Artificial Sequence: Synthetic coding sequence
atgtccagttctgaagaagtgagttggatctcatggttctgcggactacgaggaaacgaatttttctgcgaggtggatgaagactacatccaggataaattcaacctcactggtcttaacgaacaggtgcctcactatcggcaagccctggatatgattctggatttggagccagatgaagaactggaggataatcccaatcagtccgacctgatcgaacaggcagctgagatgttatatggactaatacacgccaggtatatcctcaccaatcgcggaattgctcagatgcttgagaaataccaacagggtgacttcgggtattgtccaagggtttactgcgagaatcagccaatgttgccgatcgggctctcagatatccctggggaggcaatggttaagctgtactgcccgaagtgtatggatgtttacactcctaaatcaagtcggcaccatcacaccgatggcgcatattttggtacaggattcccgcatatgctctttatggttcaccctgagtacaggcctaaacgaccagcgaaccaattcgtgcccaggctgtatgggtttaagattcaccctatggcctatcagctgcagctgcaggccgcaagtaatttcaagtcacctgtgaaaaccatccgctag

SEQ ID NO: 217183 - DNA, 705 bp, Artificial Sequence
  Description of Artificial Sequence: Synthetic coding sequence
atggagaagtgtaagggcacaagcagaatggctggcaccacttcggccgacgttaaaatgagtagctcggaagaagtgagctggattagctggttttgcgggctgcgcggtaatgaattcttctgtgaagtcgacgaggattatatccaggataagttcaacctcaccggcctgaatgagcaggtcccgcattataggcaggccctagatatgattcttgatctggaacctgacgaagagcttgaggataaccctaatcaaagcgatctcattgagcaagccgcagaaatgctgtatgggctgatacatgctagatacattttgaccaataggggcatcgctcagatgttagaaaagtaccagcagggcgatttcggctactgcccgagagtatattgtgagaatcaaccaatgctacccatcggcctttctgacataccgggagaggccatggtgaaactgtattgccccaaatgcatggacgtttacactcctaaatcttcaaggcaccaccataccgacggagcatattttggcacaggtttcccccacatgttattcatggtacatccagagtatcgtcctaagagaccggcaaatcagttcgtgccacggctctacggtttcaaaattcatccaatggcttaccaactgcagctgcaggccgcttccaactttaagtcccctgtgaaaacgattcggtag

SEQ ID NO: 217184 - DNA, 705 bp, Artificial Sequence
  Description of Artificial Sequence: Synthetic coding sequence
atggagaagtgcaagggcacctctagaatggcgggaacgacgtccgccgatgtgaaaatgtccagtagtgaggaggtgtcctggatctcttggttctgcggtctgcgaggaaatgagttcttttgcgaagtggacgaggactatattcaggacaagttcaatctcacaggtctcaacgagcaagtgccccactaccggcaggccttggatatgattttagatctcgagcccgacgaagagttggaggacaaccctaatcagtctgacctgatagagcaggccgctgagatgttgtacggcctgattcatgccagatacatcctaacaaatcgcggtatagcgcagatgctggagaaataccagcagggggatttcggttattgtccccgagtctattgtgagaatcagccgatgttacctatcgggctgagcgacatccccggagaggccatggtgaagctgtactgccccaaatgcatggacgtttacacccctaaatccagtaggcaccaccatacggacggtgcttatttcgggacgggatttccgcatatgctctttatggtccaccccgagtacaggcccaagaggcccgctaatcagttcgtccctaggctctacggcttcaaaatccatccgatggcctaccagcttcagctgcaagctgcatctaactttaagtcacctgtgaagacgattcgatag

SEQ ID NO: 217185 - DNA, 648 bp, Artificial Sequence
  Description of Artificial Sequence: Synthetic coding sequence
atgtcgagttcagaggaagtatcctggatttcttggttctgtgggctccggggtaacgagttcttctgcgaagtagacgaggactatattcaagacaagttcaacctcacaggcctgaacgaacaggtgccacactaccggcaggctctggacatgatcctcgatctggagcctgacgaagaactggaagacaatcccaaccagagcgacttaattgagcaggcggctgaaatgctgtatgggcttatccacgcccgatatatcctgacaaatcggggaatcgctcagatgctggaaaagtatcagcagggcgattttgggtattgtccccgagtgtattgcgagaaccagccaatgctacccatcggactatccgatatccctggtgaagctatggtgaaattgtattgtcccaaatgtatggacgtttatacgccgaagagcagccggcatcaccacacagacggagcgtattttgggacgggatttccccatatgctctttatggtgcaccctgagtaccggccaaaacggccagctaaccagttcgtaccaagactgtacggattcaagattcaccctatggcgtatcaactccagctgcaggccgcttcgaactttaaaagccctgtgaaaaccattaggtag

SEQ ID NO: 217186 - DNA, 648 bp, Artificial Sequence
  Description of Artificial Sequence: Synthetic coding sequence
atgtcttccagcgaagaagtgtcctggattagctggttctgtggcctgcggggaaacgaattcttttgtgaagttgatgaagactacatccaggataaattcaatctcacaggactgaatgagcaggtcccgcattaccgtcaagctctcgacatgatcctagacctcgagcctgacgaggagctggaagacaaccctaaccaatctgacctgattgaacaggctgcagagatgctatacggactgatccatgcgaggtatatcctgactaaccggggtattgcgcagatgctggagaagtatcagcagggagatttcggctactgccccagggtgtattgcgagaatcagcccatgctgcctatcgggctgagcgatattcccggagaggcgatggtgaaactgtactgccccaagtgcatggacgtctacactcccaaaagttctcggcaccaccacactgacggggcatatttcggcactggctttccgcacatgctgttcatggtgcacccagaatatcgcccaaaacgcccagctaaccagtttgtcccacgtctttacggttttaaaatccacccgatggcctaccagcttcagctgcaggccgcttctaacttcaaaagtcccgtcaagacaattagatag

SEQ ID NO: 217187 - DNA, 705 bp, Artificial Sequence
  Description of Artificial Sequence: Synthetic coding sequence
atggagaaatgtaagggcacaagcagaatggccggaacgaccagcgctgatgtgaagatgtcgagctctgaggaagtttcctggatctcctggttttgcgggctccgcggaaacgagttcttctgcgaggtggacgaagactacatacaggataaattcaacctgactggattaaacgaacaggtaccacattatcggcaggccttggatatgattctcgacctagaacccgacgaggagctggaggacaaccccaatcaatccgatctgatcgagcaagctgccgaaatgctttatgggttgatacacgccaggtatatcttaaccaatcgtgggattgcccagatgctggagaaataccagcaaggcgactttggctactgcccgagagtgtattgtgagaaccaacctatgctcccgatcggcttgtctgacatccccggagaggctatggtgaaattgtactgccctaagtgcatggatgtgtatacgcctaagtcctcccgccaccaccatacggatggcgcttactttggtacagggtttccgcacatgttattcatggtacaccccgaatacaggcccaagcgtcccgctaaccagttcgtgcccagactttatggcttcaaaattcatcctatggcgtaccagctgcagttgcaggcagctagcaactttaagtccccagtgaagactatcaggtag

SEQ ID NO: 217188 - DNA, 648 bp, Artificial Sequence
  Description of Artificial Sequence: Synthetic coding sequence
atgagtagcagtgaggaagtttcatggatcagttggttttgtggactaagggggaatgagtttttctgtgaggtcgacgaggactatattcaggataagttcaacctgactggcctgaacgagcaagtgccacactataggcaggccctggatatgatcctggatctggaacctgatgaggaattggaagataatcctaatcagagcgaccttatcgaacaggccgctgaaatgttatacggcctgattcacgctaggtatatactgactaacaggggtattgcacaaatgttggagaagtaccaacagggggactttggctattgcccgcgagtctattgtgagaaccagccaatgctgcccattggcctgagcgacattcctggtgaagccatggtgaaactatactgtccgaagtgcatggacgtgtacactcccaaatctagtcgacaccatcacacagacggagcttacttcggcacaggattcccacatatgctgttcatggttcaccccgagtaccgccctaaacggcctgctaatcagttcgtgccacgactgtacggctttaaaatccatccaatggcataccaattgcagctgcaggcagcatctaattttaaaagtccagtcaagaccatccgatag

SEQ ID NO: 217189 - DNA, 687 bp, Artificial Sequence
  Description of Artificial Sequence: Synthetic coding sequence
atgtccagcagtgaggaggttagctggatctcctggttctgcggactgagaggcaatgagtttttctgtgaggtcgacgaagattatatccaggacaaattcaatttgacgggcttgaacgagcaggtgccacactaccgtcaagctctcgatatgattctagacctggagccagacgaagagctcgaggacaatccaaatcagtcagacctgattgagcaagccgctgagatgctctacgggcttattcacgctcgttatatcttaacaaacagagggattgcacaaatgctcgagaagtaccagcaaggggacttcgggtactgtcccagggtgtactgtgagaatcaaccaatgctgccgatcgggctcagtgatatcccaggagaagccatggtgaaattgtactgtccaaaatgcatggacgtctacactcctaaaagctctcgacaccatcataccgacggggcttactttggcacaggatttccacacatgctgtttatggtgcacccagaataccggcctaaaaggcccgctaaccagttcgtcccatctagttgttctaggcaccctgacgttcccttgctgccaagacgcagacctttctgtaggatgcactttcggttaagggaagtgtaccaccagcagctcatccctgtgcacggggaccatcatctgctctag

SEQ ID NO: 217190 - DNA, 705 bp, Artificial Sequence
  Description of Artificial Sequence: Synthetic coding sequence
atggagaaatgcaagggtacctcaagaatggctggaactactagtgccgacgttaaaatgtcgtcctctgaagaagtttcctggatctcctggttctgcggactaagagggaacgaatttttttgcgaggttgatgaagattatatccaagacaaattcaacctaacaggcctcaacgaacaggtgccccactaccggcaagccttggatatgatactggatctggagcccgacgaagaattggaagataatcccaaccaatccgatcttatcgagcaggcggctgaaatgctctacgggctgatccacgcaaggtatattcttactaatagagggatcgcccagatgctcgagaaatatcaacagggcgattttggctattgtcctcgcgtctactgtgagaaccagccgatgttgccaattggactgtccgacatcccaggtgaggcgatggtgaaactgtactgtccaaaatgcatggatgtttacacaccaaagtcgtcaaggcaccatcacaccgacggagcctactttggcaccggcttcccccatatgctcttcatggtccacccagagtatcggcctaagagacctgcgaatcagttcgtgccacgcctatacggctttaaaatccacccaatggcttatcaattgcagctgcaggctgcctccaactttaaatctcccgtgaaaacgataaggtag

SEQ ID NO: 217191 - DNA, 648 bp, Artificial Sequence
  Description of Artificial Sequence: Synthetic coding sequence
atgtcaagtagcgaagaagtctcttggatctcctggttttgtggtctccgagggaacgagtttttctgcgaggtggatgaggactacattcaggacaaatttaacctaaccggtttgaatgagcaggtgcctcattacaggcaggcactggacatgattttggatctggaacctgatgaagagcttgaagataatcccaatcagagcgacctgatcgagcaagcggcagaaatgttgtacggcctgatacacgcacgttacatactgacaaaccgtgggatagctcagatgctcgagaagtaccagcagggtgacttcgggtactgtccacgcgtttactgcgaaaaccagccaatgctgcctataggtttgtctgatataccgggagaggccatggtgaagctctattgcccaaagtgtatggatgtgtatacaccaaagtcttcgaggcaccaccacacagacggggcttattttggcactggattccctcatatgttattcatggtgcacccagagtacaggccaaaacgtcccgcaaatcagtttgttccacggctgtatgggttcaaaatccatcccatggcttatcaactgcagttgcaggctgcttctaatttcaaaagcccagtgaagactattaggtag

SEQ ID NO: 217192 - DNA, 648 bp, Artificial Sequence
  Description of Artificial Sequence: Synthetic coding sequence
atgtcctccagtgaagaggtgtcttggatcagttggttctgcggcctccgcggtaacgagttcttttgtgaagtggacgaggactatatacaggacaagtttaatctgaccggactgaacgaacaggtacctcactaccggcaggctctcgatatgatcctagacttagagcccgacgaagaactggaggataacccaaaccagtctgacctgattgagcaagcggctgaaatgctatatggccttattcacgccagatatatactcactaacaggggtattgcgcagatgctagagaaataccagcagggcgactttggctactgccctagggtgtactgtgagaaccagccaatgctccctattgggttaagcgacatcccaggtgaagctatggtgaagctctattgccctaagtgcatggacgtgtatacacccaaatcttcacgccaccaccacaccgacggggcatactttggcactggcttcccccacatgttgtttatggtgcaccctgagtataggcccaagcgaccagcaaaccagttcgtgcccaggctgtatggtttcaaaatccatccgatggcctatcagctgcagctgcaggcagcaagcaacttcaaatctcccgtaaagacaatccggtag

SEQ ID NO: 217193 - DNA, 648 bp, Artificial Sequence
  Description of Artificial Sequence: Synthetic coding sequence
atgagttcttcagaggaggtcagctggatttcatggttttgcggcctccggggaaatgagttcttctgcgaagttgatgaggactatatccaggacaaatttaacctgactgggctgaatgagcaggttccccattacagacaggctctggacatgattctggacttggagcccgacgaagagttagaggacaaccctaaccagtccgatcttatcgagcaggccgcagagatgctatacggtctcatccacgctagatatatcttgacaaatcggggaatcgcccagatgctggagaagtatcagcagggagattttggatactgccccagagtgtactgcgagaatcaacccatgcttcctatcggtttgagtgacattccgggagaggcaatggtgaaactttactgccctaaatgcatggacgtgtatacgcctaaaagctcccgccatcaccacacagacggcgcttattttggaaccggtttcccacacatgcttttcatggtccaccctgagtaccgaccaaagcgcccagccaaccagttcgtgccgaggctctacgggttcaaaattcaccctatggcctatcagctgcagctgcaagccgctagcaatttcaagtcacctgtcaaaactatccggtag

SEQ ID NO: 217194 - DNA, 648 bp, Artificial Sequence
  Description of Artificial Sequence: Synthetic coding sequence
atgagttcatcagaagaggtcagttggatcagctggttctgcggactgaggggcaacgaatttttttgcgaagttgacgaggactacattcaggataaatttaacttaacgggtcttaatgagcaggttccacattatagacaggccctcgacatgatcctcgacctggagccagacgaggagttggaggataatcccaatcagagcgacctgatcgagcaggctgcagaaatgctctatggcctgatccacgccaggtatatcctcactaaccgtggcattgcccagatgctcgagaaatatcagcagggtgacttcggatactgtccccgagtgtattgtgagaatcagcccatgctgccgatagggctgagcgacattccgggtgaggccatggtgaagctgtattgcccaaagtgcatggacgtttatacacccaagtcttccagacaccaccatacagacggagcttatttcggcactggtttcccccacatgctgttcatggtgcaccctgaatatcggccaaaacggcctgccaaccagttcgtccctcgtctgtatggctttaagattcatcccatggcttaccagctacaactgcaggctgcctccaactttaagagccctgtaaagactatccggtag

SEQ ID NO: 217195 - DNA, 648 bp, Artificial Sequence
  Description of Artificial Sequence: Synthetic coding sequence
atgtccagttccgaagaggtatcctggatctcttggttttgcgggctccgtgggaacgaattcttctgtgaagtggacgaagactacattcaagataaatttaatctcacgggccttaacgaacaggtgcctcactatcggcaggctcttgacatgattctggacctggaaccagatgaagagctggaagataaccctaaccaaagcgacttgatcgaacaggccgctgaaatgctttacggtcttattcacgcacgatatattctgaccaatcgaggcatcgctcagatgttggagaagtatcagcagggggactttggttattgtcccagggtttattgtgagaaccagcctatgctgccgattgggttaagtgacatcccgggtgaagccatggttaagttgtactgcccaaagtgcatggacgtgtatactcccaaaagtagtcgtcaccaccacactgacggagcctattttggcactgggttcccccatatgctctttatggtccacccagaatatcgacctaagaggccggctaaccagttcgtgccccgactttacggctttaaaatccaccctatggcgtaccagctgcagctccaggctgcttccaactttaaatccccagtaaagaccattagatag

SEQ ID NO: 217196 - DNA, 648 bp, Artificial Sequence
  Description of Artificial Sequence: Synthetic coding sequence
atgtcctcttctgaggaagtgagttggatttcttggttctgtgggctgcgtggtaacgagtttttttgcgaggtggatgaggattacattcaggataagttcaacttaacagggctgaatgagcaggtcccccattacagacaggctctggacatgattcttgatctggagcccgacgaggagctggaagacaatcctaaccagagtgacttgatcgagcaggccgcagaaatgctctacggcctgatacacgcacggtatattttgacaaaccgaggaatagctcagatgctggaaaagtatcagcagggagattttggctattgccctcgtgtctattgcgaaaatcagcctatgttgcccatcggtctgagcgatatccccggtgaagccatggttaaactgtattgtccaaagtgcatggacgtgtatacacctaaatcttcacggcatcaccacacagatggcgcttatttcggtactggcttcccccacatgttgtttatggtgcatccggagtatcgcccaaagcgtccggctaaccaattcgtgccaaggctatatggcttcaaaattcacccaatggcctaccagttgcaacttcaggccgcatcaaattttaagtctcccgtcaagactataaggtag

SEQ ID NO: 217197 - DNA, 648 bp, Artificial Sequence
  Description of Artificial Sequence: Synthetic coding sequence
atgagttcatctgaggaagtatcttggattagctggttctgtggattgcgagggaatgagttcttctgcgaagtggacgaggactatatccaggacaagtttaaccttaccggtctgaacgaacaggtgccgcattatcggcaggcactagatatgatcctggatcttgagccagatgaagagcttgaggacaacccaaatcaatctgaccttatcgagcaggccgcagagatgctgtacggcctcatacacgcaaggtatattcttacaaaccggggaattgcccagatgctcgaaaagtatcagcagggagacttcgggtattgtccacgggtgtactgcgagaaccagcccatgctgcctataggattgagcgacatccccggtgaggctatggtaaaactctattgccctaaatgcatggacgtgtacacacctaagtcatcccgtcaccaccataccgacggtgcctattttggaaccggatttcctcatatgctgttcatggtgcacccagagtaccggcctaagagaccggcaaaccagtttgtgccccgactctacggatttaaaatccatccaatggcttaccaactccaactccaggctgcctccaattttaaatcacctgttaaaactatacggtag

SEQ ID NO: 217198 - DNA, 648 bp, Artificial Sequence
  Description of Artificial Sequence: Synthetic coding sequence
atgagttccagcgaggaagtgagttggatctcttggttttgcggtcttcggggaaatgaattcttctgcgaggtggatgaggactacattcaggataagttcaaccttaccggcctgaatgagcaggtgccccactatcgccaagcgctggacatgatcctcgacctggagcctgacgaagaactagaggataacccgaaccagtcagacctgattgaacaggcggctgagatgttgtacggtctgatccacgcacgttacatactaacaaacagaggcattgcccaaatgctggaaaaatatcagcagggagacttcggctattgccctcgcgtgtactgcgaaaatcagccaatgttgccgattgggttatctgacataccgggagaagccatggttaaactatactgcccaaagtgcatggacgtgtacacaccaaagtcaagcaggcaccaccatacagatggagcatactttggtacagggtttccgcacatgctttttatggtacaccctgaatacaggccaaaacggccagctaaccagttcgttccgcgattatatggattcaagatccatcccatggcttatcagctgcagttgcaagcagcatcaaactttaaatccccggttaaaaccatcagatag

SEQ ID NO: 217199 - DNA, 648 bp, Artificial Sequence
  Description of Artificial Sequence: Synthetic coding sequence
atgagctccagcgaggaggtttcctggatttcttggttctgtggacttcggggtaacgaattcttttgtgaggtggacgaggactacattcaggacaagttcaacttaacaggtctcaatgaacaagtgccacactatcgccaggccttggacatgattctggacttagagcccgacgaggaacttgaggataaccctaatcagtcagaccttatcgaacaagcagccgagatgctatacggactgatccatgccaggtacattctgacaaacagagggatcgctcagatgctggaaaagtaccagcagggggatttcggttattgtcctagggtatattgtgagaaccaacctatgctgcctattggactgagtgatattccaggcgaggctatggtaaagctctattgtcctaaatgcatggacgtctacacccccaaaagcagcaggcaccatcatacagacggggcttattttggcaccggattcccccacatgctgtttatggtacatcctgaatatcggccaaagcgaccagccaatcagttcgtaccacggctatacgggtttaagatccatcccatggcctatcagctgcagctccaggctgcgtccaactttaaatccccggttaagacaattcgctag

SEQ ID NO: 217200 - DNA, 4296 bp, Artificial Sequence
  Description of Artificial Sequence: Synthetic coding sequence
atgggtaaggagcaggagctggtgcaggctgtcaaggccgaggacgttggcactgcacagcgtctcctgcagcgaccacgaccgggtaaagcgaagttactgggctctactaagaaaataaatgtgaattttcaggaccccgatgggttttcagccctacatcacgccgctctgaacggcaataccgagctgataagtctactgctagaggcccaggccgcagtcgacatcaaagataataagggaatgagaccgcttcattacgccgcatggcagggccgaaaggagccgatgaaacttgtactgaaggcaggatccgccgtaaatatcccttccgacgaagggcatattcctttacatctcgccgctcaacacggacattatgacgtttcagagatgctactccagcatcagtctaatccctgtatggttgataattctggcaaaaccccgcttgacctggcttgcgagttcgggagagtgggtgtggtgcagcttctgctgtcgtctaacatgtgcgcagcccttctggagcctcgccctggcgacgcaaccgacccaaacggtacgtcccctctccatctcgcagctaagaacggtcacatcgacataatcaggcttctacttcaggctggcattgacataaaccggcagaccaaatcaggcaccgcacttcacgaggcagcactgtgtgggaagaccgaggtggtgcgtctgctactggacagcgggatcaacgctcatgtccggaatacctattcccagacagcacttgatattgtgcatcaatttactacgtctcaggcttcgcgcgaaatcaagcagctgctgagagaagcatccgctgcactgcaggttcgcgctaccaaggattactgtaacaattacgacttgacatcactcaacgtgaaggccggtgatatcataaccgtactggaacagcatcctgacggcagatggaagggttgcatccacgataaccgtaccggaaatgacagagtgggatattttccgagcagtctgggggaagcaattgtgaaaagagccggttcaagagcagggaccgaaccaagcctgccccaggggtcaagctctagcggcccttctgccccaccagaggagatatgggtgcttcggaagccctttgctggaggggatcgatctgggtcaatcagtgggatggctgggggacgtgggagcggcggacatgctctccacgccggatccgagggcgttaagctcctggccaccgtcctcagccagaaaagcgtgtcagaatccggtccaggtgattcccccgcaaagcccccagaaggcagcgccggtgtcgcgagatctcagccacctgtcgcccacgcaggccaggtgtatggagaacagccacccaagaagctggaacccgcaagcgaaggcaagtctagcgaagccgtgtcacagtggctgaccgcctttcaactccaactgtatgctcccaacttcatctccgcaggttatgatttgcccactatcagccgcatgacaccggaggacctcactgctatcggcgtgactaagcctggccaccggaaaaagatagcggctgaaatttcaggcctgtctatccccgattggctccctgagcacaagcctgcgaatctggcagtttggttgagtatgatcggtttagcccaatactacaaggtgctggtggataatggatatgaaaatatcgattttatcactgacattacatgggaggatctgcaggagattggcatcactaaattagggcatcagaaaaagctaatgctagcagtccgtaaacttgctgagctacagaaggccgaatatgccaaatacgagggaggccctttgcggagaaaggccccacagagcctggaggtaatggctattgaatcccccccaccaccggagccgacacctgccgattgccagagtcccaagatgaccacatttcaagactccgagctgtccgacgagctgcaggcagcgatgacggggccagccgaagtgggcccaacgaccgagaagccttcctcccatctaccacctaccccacgagccaccactcggcaagattcttctctaggcggaagggctagacacatgagttcatcccaggaactcctgggtgatgggcctcctgggccatcatccccaatgtcaaggagtcaagaatacctccttgatgagggccctgctccaggcactcccccaagagaggcgagacctgggagacacggccactcgattaagcgagcgagtgtgcctcctgttcctggcaagcccaggcaggtcctaccacccggtacctcacattttactcccccacagactcctaccaagaccagacccggatccccccaggccctgggtggaccccacggtcccgctcccgcaacagctaaagtcaagccaacaccccagttgctgcctcctaccgaaagaccaatgagtcctagaagcctgccccagtccccaacgcaccgcggatttgcctacgttttaccacaaccagttgaaggtgaggtggggccagccgcacccggtccagcgccacccccagtgcctacagcagtgccaaccctttgcctgccgcctgaagccgacgctgagccagggagacccaagaagcgtgcgcacagtctaaaccgttatgctgcttccgactcagaaccggaacgggatgaattgctggtacctgccgctgctggtccatatgcgacagtccagaggcgcgtaggcaggagtcattctgttagagccccagcaggtgccgacaaaaatgttaatcgcagccagagctttgctgtgcggccacggaaaaagggtcctccccctccccctccgaagaggagctcgagtgcgcttgcaagtgccaacttggcagacgagcctgttcccgatgcggaacctgaagacggactcctgggagtacgcgctcagtgccggagggcgagtgacctggccggatccgtggatacaggctcagctggatcggtcaaaagtatcgcagctatgctggaactgtcctccatcggtgggggaggcagggcagctaggagacctcccgagggccatccaacacctagacctgcgagcccagaaccaggtcgagttgcaaccgttctcgcttcagtgaaacacaaggaagcaataggaccaggaggtgaagtggtcaataggcgccgaacactgagtgggcctgtgaccggcctgctcgcaactgcgagacgtgggccaggggaatctgctgaccctgggccatttgtggaagatggcacgggcagacagcgccctcgcggtccgagcaagggcgaagcaggcgtggaaggcccacccctggccaaagtggaagcttcagctactctgaagcgacgaattagagcaaaacagaaccagcaggaaaacgtaaaatttatcctcacagagagcgacaccgtgaagaggaggccaaaagctaaagagcgggaagcaggcccagaaccccctccccctctttcagtctatcataacggcacagggacagtacggcgacgccctgcctcagagcaggcaggacccccagagcttccgcctcctccgcctcccgctgagcctccgccaacggatctagcgcatcttccgcctctcccaccacccgagggagaggcgcgaaagccggcaaagccgccagtctccccgaagcccgtgttgactcagcctgtccccaaattacagggcagcccaacaccaacctccaagaaagtgccgctcccaggaccagggagtcccgaggtgaagagggcccacggaactcccccacctgtgtcgcccaagccccctccacccccaacagcccctaagcccgttaaagccgttgccggtttgcccagcgggtctgccggaccttcccccgctccgtcaccagctaggcaaccacccgctgccctggcgaagccacccggaacgcccccttccttaggcgcatcccctgcaaaacccccatctccaggtgctcccgcactgcacgttcctgcaaagcctccccgtgcggctgctgccgcagcagctgccgcagcagcccctcccgcaccacccgagggggctagcccaggggacagcgccaggcaaaagctggaagagacctcagcttgtctggccgctgctttgcaggcggtggaagagaaaatccggcaggaggatgcccagggccctcgggattctgctgcagagaagagtaccgggagcatactcgacgatatcggctcaatgtttgacgacctggcggatcaactggacgcaatgttggagtag

SEQ ID NO: 217201 - DNA, 2115 bp, Artificial Sequence
  Description of Artificial Sequence: Synthetic coding sequence
atgtgcgcagcccttctagagccaagacctggggatgctaccgaccccaatggaacttctcccttacatctggccgctaaaaacggtcacatagacattatacgactgcttttgcaagcaggcatcgacattaacaggcagaccaagtcgggtacggccttgcatgaggccgcattatgcggtaaaaccgaagtggtgaggttgctgctcgattccggcattaatgcgcacgtaaggaatacctattcccagactgccctggacattgtgcaccagttcacaacttcccaggcaagtagagaaattaagcagctgctccgagaagcctctgccgctctgcaagtccgagccacgaaggattattgcaacaactacgacctcacatcactgaacgtcaaggctggagacattatcacggtgcttgaacagcacccggacggtcgatggaaagggtgcatacacgataaccgcacggggaatgatagagtcgggtacttcccttcctcgttaggtgaggccatcgtgaagagagcagggtcaagagccggaacggagccatccttgccccaggggtcgagctcaagcggtcccagtgcacccccagaggagatttgggtactcaggaagccttttgccggtggagaccggtccggaagcattagcggaatggctgggggtcggggttccgggggtcatgccttgcatgccggaagcgaaggcgtcaaactcctggcgaccgtactctcccagaagtctgtgtcagagagtgggcctggagattctccagcaaagccaccagagggatccgcgggtgtggcacgaagtcagccccctgtggcacatgcaggccaggtatacggcgaacaacctccgaagaagcttgagcccgcaagcgaggggaagagttccgaagccgtaagtcagtggctaacagccttccagttgcagctttatgcccctaatttcatcagcgccggatacgatctccccactattagccgcatgacccctgaggacttgactgccataggagtcactaagcccggacatcggaaaaagattgctgctgaaattagtggattgtccatccccgattggctgccagagcacaaacccgcaaatctagcagtatggctgagcatgattggtttagcccagtattataaagtgctggtggacaatgggtacgaaaatatcgacttcatcaccgacataacttgggaggatctgcaggagatcggaattactaaactcgggcaccagaaaaaactgatgctggctgtgagaaagctagccgagttacagaaggctgaatacgctaagtatgaaggaggacccttgcggaggaaagcccctcagtcactggaagtcatggccatcgagtcaccccctccgccagagccaactcctgccgactgccagtctcccaaaatgaccaccttccaggacagcgaactgtccgatgagctgcaggccgctatgactgggccagccgaggtgggtccgactacagaaaagccaagttcacacctcccccctactccaagggctaccacacgacaggacagctccctggggggacgcgctcgccacatgtcctccagccaggagctgttgggcgacggccctccagggcctagttcgcccatgagtaggtcacaggagtacttactggatgagggccctgcgcctgggacacccccacgcgaggctaggccaggacgccacggccattcaattaagagagccagcgtcccacccgtcccaggcaagccaaggcaggttctgccacccggtacctctcattttaccccaccccagacccctaccaagacgaggcctggaagtccccaggcactggggggaccacatgggccagcccctgccacagcgaaagtcaagcctacaccacagttgctgcctcctaccgaaagacccatgtcaccccgaagcttgccccagagcccaacccagcgaactggccctggacctgcgcagaactgcccgagcggtagacctgctagcagaagcggagctgcccaaggaaccggcgaccaggggcaggggccaccagcccctcctcacccgcagaacatttcgtaccaggagtactag

SEQ ID NO: 217202 - DNA, 3609 bp, Artificial Sequence
  Description of Artificial Sequence: Synthetic coding sequence
atggggagggagcaggacctcatcttagccgtgaaaaatggagatgtcactggtgtgcagaaattggtggccaaggtcaaggccaccaagaccaaactgcttggttctacaaaaagactaaacgtgaactaccaggatgccgacggtttctcagctctccatcacgccgcactggggggaagcctggagcttatcgccctgttgctggaagcgcaggcaacggtggatatcaaagactcaaacgggatgcgacctctgcattacgctgcgtggcaaggccgattggaaccagtgcggcttctgctgcgggcaagtgctgctgtgaatgccgcttccctcgacggccagataccactacacctcgctgcccagtacgggcattacgaggtctccgagatgctgctccagcaccaatccaacccttgccttgtcaacaaagcaaagaagacccccctcgacctggcatgtgagtttgggcgtctcaaggtcgctcagctgctgctcaacagtcatttatgcgtcgccctgctggaaggcgaagctaaggacccatgtgatcccaattacacgactccacttcaccttgcagctaagaacgggcaccgcgaagtaatccggcaattgcttcgggctggcatcgagatcaaccggcaaactaaaactggcactgcattgcatgaagccgctctctatggcaagactgaagtcgtgagactgctcctcgagggcggagtggacgtgaacatcagaaatacatacaaccaaacagcactagatatagtcaatcaattcactactagccaggctagccgtgaaataaaacagctcctacgagaggcaagcggaatcctaaaggttcgtgctctgaaggacttttggaaccttcatgatcctacagccctaaacgtcagggcgggtgacgtgataaccgtgctagaacaacacccggatggcaggtggaaaggacacattcacgagagccaacgtgggactgaccggattggctacttccccccagggatcgtggaggttgtgagtaagcgtgttggcatccccgcagccagactgccatctgccccaacgccactgcgtccaggttttagccggaccccccagcccccagcagaggagccaccacatcccttgacctactcacagcttccccgtgtgggcctcagccctgatagtcccgctggggaccgaaactctgtaggctctgaggggagcgtcggctccatccggtctgctggcagtggccaatcttctgaagggactaatgggcacgggcctgggctgctgattgaaaacgcacagcccttgccctcagcaggagaggaccaggttttgcccggactgcaccctccctcccttgccgacaacctatcacataggcctctcgcaaattgcagatcgggcgagcaaatctttacgcaagatgtcagacccgaacagctgttggagggcaaagacgcccaagctatccataactggctctccgagttccaactggagggttatacagcacacttcctgcaggccggttacgacgtgcccaccatctctaggatgacccccgaggaccttacagcaattggcgtgaccaagcccggacatcgtaagaagatcgcctcagaaatcgctcagctgagcattgcagaatggctgccgagctatattcccaccgacctgctggaatggctgtgtgcgctgggtttgccccagtatcacaagcagttggtttcatcaggctacgattctatgggtctggtggccgacttaacatgggaggaattacaagagataggggtgaataagctgggccaccagaagaagctgatgctgggcgtgaaacggctggcagaattgagacggggtttgctgcagggcgaagctttgtccgaaggtgggagaaggctggcaaagggaccagagctgatggccatcgaagggctcgaaaacggtgaggggcctgctactgctggtcccaggctcttaacattccaggggtcggagctcagtcctgaactgcaggccgctatggctgggggagggcctgagccattaccactcccgcctgcgcgatccccgtcacaggaatctattggcgctaggtctaggggatcaggccattcacaggagcagcctgccccacagccatctggaggggatccgagccccccacaggaaagaaatctgcccgaggggactgaacggccacccaagctttgttcctcgcttcctgggcaagggcctcccccatacgtattcatgtacccccagggttcaccgagctcacctgcgcctggcccaccgccaggagcaccctgggcgtttagctacttagccggtccacctgcaacccctcctgatccccctcgcccaaagcgcaggagccactccttatcccgcccaggccctactgaaggggatgctgaaggcgaagcagaaggcccagtcggcagcacactgggaagctacgccacccttaccaggcgcccaggtaggagtgctttagtgagaactagccccagtgtgactcctacgccagcacgcggtacccctaggtcccaatctttcgctctgcgggcaaggaggaaggggccaccgcctccaccaccgaagagactaagctctgtctcaggccctagccccgagcctccaccactcgacgaatcgcctgggcctaaggaaggcgcaacgggtcctaggcgaagaacgctgtcagagccagccggtccttcagagcctcccggaccccctgcccctgccggtccagcatccgatacagaggaggaggagcccggtcccgagggaacccccccatccagagggagtagtggcgaggggctaccattcgccgaagagggcaatctgaccatcaagcagagacccaaacctgctgggcctcctccaagagagactcccgtcccccctggcctcgactttaatctgaccgaatcagatacagtgaagcgcagacccaaatgcagggaacgagaacctctgcaaactgctctcttggcattcggtgttgcctctgccactccgggacctgccgctccgctaccttcgcccactcccggtgagtcacctcccgctagtagtctcccccagcctgaaccatccagcctgccagctcagggggtgccaacccccctggccccttctcctgctatgcaacctccagttcctccttgtccgggtcccggactagagagcagtgccgcttcgagatggaatggcgaaaccgagccaccagccgcacctgcagcccttctaaaggtgcccggtgccggaactgcccctaaacccgtctcagttgcctgcacacagctggcctttagcggccctaaacttgccccaagactggggcctcggcctgtcccaccaccccgtcccgagagcacaggcaccgtggggccaggacaggcccagcaacggctcgagcagactagttcctctctggctgccgcactacgcgctgcggagaaatccattggtacaaaagagcaagaagggaccccctccgcaagtacaaagcacattctggatgatatctctacaatgttcgatgcactggcagaccagctggatgcaatgttggattag

SEQ ID NO: 217203 - DNA, 3363 bp, Artificial Sequence
  Description of Artificial Sequence: Synthetic coding sequence
atgcgtccccttcactacgccgcttggcaaggacgtttggagcctgtccgactgcttcttagagcatctgcggcagtgaacgccgctagcctcgacgggcagattccattgcacctggcagcccagtacggtcattacgaggtgtcggaaatgctattacagcatcaaagcaatccctgtctcgtcaacaaggccaaaaaaaccccccttgacttggcctgtgaattcgggcgtctgaaggtcgcccaactgttactgaactcccatctttgtgtggctctcctagaaggggaagctaaggacccctgtgaccccaattatacaacaccactgcatcttgccgctaagaacgggcacagagaggtgattaggcagctactcagagctggaattgagataaaccggcagactaaaacaggcaccgcactccatgaggccgcactgtacggcaaaaccgaagttgtgcgccttcttctcgagggaggcgtggacgttaacatccgtaacacatacaatcagactgccctggacatcgtgaatcagttcactactagccaggctagtcgcgaaatcaagcagctactgcgggaggcctcaggcatcttgaaagtccgcgctcttaaggatttttggaatctgcacgacccgacagctctgaacgtccgggcaggcgacgtcattaccgtgcttgagcagcaccctgacggcaggtggaagggccacatccacgagagtcaaagaggcacagatcgaatcggttactttccccctgggattgttgaggtggtaagcaaacgtgtgggaattccagccgcaagactgccatcagctcctacccccctgagacctggattctcgaggactccccagcctcccgcagaagagcctcctcatccccttacgtactctcagctcccccgagtgggcttatctcctgatagcccagccggagatcgtaattctgtcggctcagaggggagcgtgggaagcatccgctctgccggatctgggcagagctctgagggaactaatggtcacggccctgggcttctgatcgaaaacgcgcagccattacctagtgccggagaagaccaggttctgcccggactgcaccccccaagtctagccgataacctgagccaccgaccattggctaattgtcgtagtggcgagcaaatttttacacaagacgtgagacccgagcaactgctggagggcaaagacgcacaggcaattcataactggctttctgaattccagctcgaaggctacacggcccatttcctgcaggccggatacgacgtgcccacgatcagccggatgacgcccgaggacttgacagccataggcgtgacaaagcccggtcaccgcaaaaaaatcgcttctgagattgctcagctttcgatagcagaatggcttccttcttatatacctacagacctactggaatggttgtgcgctctgggccttccacaataccacaagcaactggtgtcctcaggatatgattcaatgggcctcgtggccgatttgacctgggaagaattacaggaaatcggggtaaacaaattgggtcatcagaaaaagttgatgctgggtgtcaaaagattggccgagctgcgccgaggtctcctccaaggtgaagcgctttctgagggtggacgccgattggccaagggcccagaactgatggccatcgagggccttgaaaacggcgaagggccagccactgctggtcccaggctgctaacgtttcaagggtccgaactgtctcccgagcttcaggctgcaatggctggaggcggacccgagcccttgccgcttcctccggctaggtccccaagtcaggagagcattggcgcaagatctagaggttcaggccattcccaggagcaaccggctccccaacccagcggcggtgacccgagtccgcctcaggaacgaaacctccccgaagggaccgagcgccctccgaaattgtgctcctcactcccaggccagggtcccccaccctacgtgttcatgtatccacaaggatccccatcttcacctgcgcctggcccaccgccaggagccccatgggccttcagctacctggccggacctcccgcaacgccaccggaccccccaaggcccaagcgacgaagtcactccctgagcagacctggcccaaccgagggggatgccgagggtgaggcagaaggacccgtgggttccacgctcggcagctacgctacccttacccggagaccgggacggtccgcccttgtgcggacttctccttctgtgacacctacccccgcaaggggcacaccgagatcccaaagcttcgcactgagagctaggcgaaagggacccccaccaccaccacccaagcgtttgtcttccgtgagtggtccaagtcctgagccacctccccttgatgagtctcccggtccaaaggaaggagctactggacctagacggagaacattgagcgagcctgccggtccttccgagcctcccggaccccctgccccagcaggtccagcaagcgataccgaagaggaagagcctggccctgaaggtacacctccaagccgcggaagttccggagaaggcttgccatttgcggaagaaggcaatctgactatcaaacagagacctaaacccgctggtccgcctcccagagagacacccgttcccccaggactggattttaacctcactgagtcagataccgtcaagcggaggcctaagtgtcgtgagcgcgaaccattgcagacagccctcttagcgttcggcgtggctagcgccacgccgggacctgcggcaccactaccttccccgacccccggagagtcccccccagcctctagcctgccacagcctgagccgtctagtttgccagcccagggagtccccacccctctggctccaagtcctgcaatgcagcccccagtgcccccatgtccgggacccggtcttgagtcgagtgccgcaagcagatggaacggcgagacggagccacccgctgcccctgcggctctcttgaaggtgccaggagccggtacagcacctaagcccgtcagcgtcgcgtgcacacagcttgctttttcaggacctaagctcgccccacgcctgggcccaaggccagtaccacctccgagacccgaatctaccggcactgttggacctggacaggcccagcaacgcctcgagcagacatcctcatctcttgcggctgccctgcgcgctgctgaaaagtctattggtaccaaagagcaggaagggacccctagcgcatccaccaaacatatcctggacgacattagtacaatgttcgatgctctcgctgaccagcttgacgccatgctcgattag

SEQ ID NO: 217204 - DNA, 1026 bp, Artificial Sequence
  Description of Artificial Sequence: Synthetic coding sequence
atggcggacgaaaagcctagcaatggtgtgctggtgcatatggtgaagctgttaatcaagacttttttagatggcatattcgacgatctaatggagaacaacgtgcttaacactgatgagatacacctaattgggaagtgtctgaagtttgtcgtctcaaacgccgagaatctcgttgacgatataacagaaaccgctcagaccgcgggaaaaattttccgcgaacacctctggaacagcaaaaaacagttgagttctgatataagcagcgacggagagagagaagctaacatgccaggtctcaacattcgtaataaggagttcaactatctacacaataggaacggttcagaattggacctcttgggcatgagggacctactggagaacctcggctacagcgtcgtaataaaagaaaaccttaccgcgcaagaaatggagaccgcgctccggcagtttgccgctcacccggaacaccagtcatccgattcaacatttttggtctttatgtcacacagtatactcaacggtatctgcggaactaagcactgggatcaagagcctgatgttctgcatgatgatacaatttttgagattttcaataatagaaattgtcagagtctgaaagataagcctaaggtgataattatgcaggcgtgcaggggcaacggcgctggcatcgtgtggtttaccacagacagtggcaaggcgggagctgacacacatggcaggctgctacagggtaatatttgtaacgatgctgtaacaaaagctcatgtggagaaagattttatcgccttcaaaagttccaccccacacaacgtgtcctggcggcatgagacgaatggcagcgtgtttattagccaaataatctattactttagagaatactcgtggtcacaccatctggaggaaatctttcagaaagtgcaacattcgtttgaaacccctaacattttgacccagttacccacaatcgagcgtctgtcaatgactagatacttttatctattcccgggtaactag

SEQ ID NO: 217205 - DNA, 1026 bp, Artificial Sequence
  Description of Artificial Sequence: Synthetic coding sequence
atggccgacgaaaagccatctaacggcgtcctcgtccatatggtcaaactcctgatcaagacatttctggatgggattttcgatgacctaatggagaataacgtcctgaataccgatgagatccacctcattggcaaatgcttgaagttcgtggtgtctaatgctgagaatctggtggatgatatcactgaaacggcccagaccgctggtaagattttccgggaacacctgtggaatagtaaaaaacaactgtccagcgacatcagttctgatggcgagagagaagctaacatgccagggctcaatattaggaacaaggagttcaactacctgcataatcgcaatgggtctgagctggacctgcttggcatgcgggatctgctcgagaaccttggctactcagtcgtcattaaggagaatctgactgctcaggaaatggaaactgctcttcggcaattcgcagcacacccagagcatcagagctctgatagtacatttctcgtgtttatgtctcactctatcctgaacggtatttgtgggacaaagcactgggaccaggagccagacgtgttacacgatgacacaatttttgagatctttaataataggaactgccagagcctcaaagacaagcctaaagtgatcattatgcaagcctgccggggaaacggcgcagggattgtttggtttactactgatagcggaaaggcaggggctgacacccatggcagactgttgcagggaaacatatgtaatgatgcagttactaaagctcacgtcgagaaagattttatcgcctttaagagctccactccccataacgtctcttggagacatgagaccaatggctctgtcttcattagccaaattatttactatttccgggagtatagctggtctcaccatctcgaagagatctttcagaaggttcagcactcattcgagaccccgaatatactgactcaactacccaccatcgaaaggctcagcatgacgcgctacttttacctgttcccgggaaattag

SEQ ID NO: 217206 - DNA, 834 bp, Artificial Sequence
  Description of Artificial Sequence: Synthetic coding sequence
atggagaatacggagaattctgtggacagcaagtcaatcaagaatctagaacctaaaatcatccacggatcagagagcatggattccgggatatctctggataattcatataaaatggattacccagagatgggcctttgtatcatcatcaacaacaaaaatttccataagtccactggtatgacgtcccgctccgggaccgatgttgatgcggctaacctgagggaaacatttcgcaatttaaagtacgaggtacgaaacaaaaacgacctgaccagagaggagatcgtggagttgatgagggacgtatcaaaagaggaccatagcaaaaggagctcattcgtttgcgttttattaagccatggcgaggagggtattatctttggcacgaatggtccagtggacctcaagaaaattactaacttctttcgcggtgacagatgtcgatcactgacaggtaagcctaaactctttatcatccaggcttgccgcggaaccgagttagactgcggaatcgaaacagattccggagttgacgatgatatggcctgtcacaagataccagtggaagcggattttttgtatgcatattcaactgctccagggtattactcttggcgaaacagtaaggacggcagctggtttattcagtctctttgtgcaatgcttaaacagtatgcagacaagctggagtttatgcacatactgacccgcgtgaaccggaaagttgctaccgagttcgagagtttctcattcgacgctacttttcacgctaagaagcaaataccctgcatagtgtccatgttaaccaaagagctatatttttaccactag

SEQ ID NO: 217207 - DNA, 471 bp, Artificial Sequence
  Description of Artificial Sequence: Synthetic coding sequence
atgagtgacgcattgatcaaagtttctatggagaacaccgagaattctgtggactccaagtccatcaagaatctcgagccaaagattatacacggctctgagtctatggactcaggaattagtctggataatagttacaagatggactaccccgaaatgggtctctgtatcattatcaacaataagaacttccataagagcactggcatgacttcgcgatcaggaaccgacgtggatgccgcaaacctgagagaaacatttcgcaacctaaaatacgaggtccgtaacaaaaatgacctgacaagagaggagattgtcgaactgatgagagacgtaagcaaggaagatcacagtaagcggtctagttttgtgtgcgtgctcttaagccatggggaagagggaatcattttcgggaccaacggcccagtagacctcaagaataataaactatttcaacgcggatctttatag

SEQ ID NO: 217208 - DNA, 354 bp, Artificial Sequence
  Description of Artificial Sequence: Synthetic coding sequence
atggaaaacactgagaactccgtcgactcaaaaagtattaagaacctagaaccaaagatcatccatggatctgaaagcatggattctggcatcagcctcgataacagctacaaaatggattacccagagatgggtctctgcatcatcattaacaataaaaattttcataagtcgacaggaatgacaagcagaagcggaactgatgttgacgccgcaaatctgcgtgaaacattcaggaacttgaagtatgaagttaggaacaagaacgatctgaccagggaggagatcgtagagctgatgagggacgtcagtaaggaagatcactccaaaaggtcatcctttgtgtgcgtttag

SEQ ID NO: 217209 - DNA, 834 bp, Artificial Sequence
  Description of Artificial Sequence: Synthetic coding sequence
atggagaataccgagaactctgttgactctaagagcattaagaatttggaacccaagattattcacggctcggagagcatggatagcggaatcagtctcgacaactcctataaaatggattacccagagatggggctgtgcataatcatcaacaacaagaattttcataagtctacaggaatgacatcacggtccgggaccgatgtagacgctgccaatctcagagaaacatttagaaatctgaagtatgaggtgaggaataaaaacgacctgacacgggaggagattgtcgagctgatgagagatgtttccaaggaagaccatagcaaacgtagctcctttgtgtgcgtgctgctgtctcatggcgaggaggggataattttcggaacaaacggtcccgtcgatttgaaaaagatcactaacttttttagaggtgaccgttgccggtccctgacaggcaagccaaaactgttcatcatccaggcttgccgcggaaccgagcttgactgtggtatcgaaacagactctggagtggacgatgatatggcctgccataaaatccctgttgaggccgacttcttatatgcttattccaccgcgccaggttattactcttggcgaaacagcaaagatggcagctggttcatccaatccctgtgtgccatgctcaaacagtatgcggataaactggaattcatgcacatcctgacgcgggtcaatagaaaagtggctaccgagtttgagtcattctcctttgacgctacttttcacgccaagaagcaaattccctgcatcgtctccatgctgaccaaagagctctatttctaccattag

SEQ ID NO: 217210 - DNA, 966 bp, Artificial Sequence
  Description of Artificial Sequence: Synthetic coding sequence
atggcagatagcatgcaagagaaacagagaatggcaggacagatgctactgcaaacctttttcaacatcgaccagatctcccccaacaagaaggctcaccctaacatggaggcaggacctcccgagagcggtgaaagcacagatgccctgaagctgtgtccacacgaagaatttctccgactgtgtaaagaaagagccgaggaaatttatccaattaaagagcggaacaatcgcactaggttggccctgattatctgtaataccgaattcgaccacttgccacccaggaatggcgctgattttgacataacaggtatgaaggagttgttagagggtcttgactattcggtcgatgtggaggagaatctaacggctcgtgatatggaatctgctctgcgggcattcgccactcgcccagagcataagtcatcagattcgacattcttagtcttaatgtcacacggaattctcgagggcatctgcggaaccgtgcacgacgagaagaaacctgatgtgctcctctacgacacaatctttcagatatttaacaaccgcaactgtctgagtctgaaggataagcccaaggttatcatcgtgcaagcctgcagaggcgcaaatcggggtgagttatgggtccgggactccccggcttctctagaagtggctagctcccagtctagcgaaaatctcgaagaggacgcagtgtacaaaacccatgtcgaaaaagactttatcgcgttttgctcatctactcctcacaatgtctcatggagagactcaacaatgggaagtatctttataacccagcttatcacatgcttccagaagtacagttggtgttgtcacctggaagaggtgttccgcaaagtgcaacagagtttcgaaaccccacgtgccaaggcccaaatgccgacaatcgaacggctctctatgacaaggtacttttacctcttccccggaaattag

SEQ ID NO: 217211 - DNA, 213 bp, Artificial Sequence
  Description of Artificial Sequence: Synthetic coding sequence
atggagaaaaaggaatgcccagagaagtcctcatcatccgaagaagaactgccacggagggattctggtagctctcgcaacatcgacgcttccaaattaatacggttacagggatcgagaaagctcctggtggacaacagcatccgagagttgcaatacactaagacgggcattttttttcaagccgaggcctgcgtgacaaatgacacctag

SEQ ID NO: 217212 - DNA, 3099 bp, Artificial Sequence
  Description of Artificial Sequence: Synthetic coding sequence
atgccaggccgagccgaagcaggtgaggccgaagaagaggctggcgctggcagcggctcagaggcagaagaggatgccctctgggaaaggattgaaggagtgagacatcggcttgctagggccctgaatcccgcaaagctcaccccctatctcagacagtgcagagttatcgacgagcaggatgaggaggaagttttgtccacttatagattcccatgcagggtaaatcgtacggggaggctcatggatatcctgcggtgtagaggcaagcggggttacgaagcgttcctggaggccctggagttctactatccggagcattttacgctcctaaccggtcaggagcccgctcagaggtgttctatgattctggatgaagaaggtcccgaggggctgacccaatttctgatgaccgaggtaagacgacttcgagaagcacgtaagtcacagttgcagagagaacagcaactgcaagccagagggcgagttctggaagaggagcgagccggactggagcaacggctgagggatcagcagcaggctcaggagcgctgtcaacggctccgcgaggattgggaggctgggtcccttgagttactgcgactgaaagacgagaattacatgatcgccatgcgccttgcgcagttgtcggaggagaagaactcagctgtcctgcgatcgcgcgacttgcaactggcggtggatcaactcaaactcaaggtctcccggctggaggaggaatgcgccctgctgcggagggctagaggtccccctcccggtgcagaagaaaaggagaaggagaaggagaaggagaaagaacctgacaacgtcgacctcgtctccgagctgcgggctgagaaccagagactaaccgctagtcttagagaactgcaagaaggcctacagcaggaagcgagtaggcccggtgcccctggctcggagcggatcttgctggatatactcgagcacgactggagggaagcccaggactccagacaggagttgtgccagaagctccacgccgttcaaggagagctccagtgggcagaggaactcagggatcagtacttacaagaaatggaagacctcaggttgaagcatcggaccctgcagaaggactgcgacctttacaagcacaggatggccaccgtactcgcacaactcgaagaaatcgaaaaagagagggaccaagcgatccagagtcgcgaccgtatccaactgcagtacagtcagagccttattgaaaaggatcagtaccgcaagcaggtgagagggttggaagccgaaagggacgaacttctgaccacactgacctctcttgagggaacaaaagccctcctggaggtgcagctgcaaagagcccaggggggtacatgtctaaaagcttgtgctagttcgcacagcctgtgctcaaatttaagcagcacatggtccttgtcagagttcccctccccccttggcggtccggaagccactggggaggctgctgtcatggggggacctgagccccataattccgaggaggctaccgactccgaaaaagagatcaaccggctttccatattaccgttcccaccttctgcaggaagtatcttaagacgacagcgcgaggaggaccccgcaccgccaaagagaagtttctcctctatgtccgacattactggatctgtcacacttaaaccctggagtccaggactgtccagttcctcctcttccgattcagtgtggccattgggcaagccagaggggctgttggctcgtggctgcggtctggattttctgaataggtcactggcgattcgtgtgtctggtcgatcccctcccggaggaccagagccacaggacaaaggcccagatggcctctcgttttacggagacagatggtcaggcgctgtcgtgaggcgcgtccttagcggcccaggctccgctcgcatggagcccagggaacaaagagtcgaggctgcaggactggagggagcttgtcttgaagcagaggctcagcagcgaactctgctgtggaatcagggctctacgctcccatccttgatggattccaaagcatgccagtcttttcacgaagcactggaggcctgggcaaagggacctggtgcagaaccgttctatatccgagcaaacctgacgctgccggagcgagcggacccacatgctctctgtgtgaaggcccaggaaatccttcgactggtggacagcgcttacaagaggagacaggagtggttttgtacaagagtcgatcctctcacactcagggacctggataggggtaccgttcccaactaccaacgagcccagcagttgctggaggttcaggaaaaatgcctcccctcaagcaggcataggggtcctaggtcaaatctaaagaagcgtgccttagaccagctgagacttgttagacccaagcccgttggcgcacctgcgggagattccccagaccagctgctccttgagccctgcgcggaacccgaacggtctttgaggccatacagcttagtccgacctctcctggtcagcgctctgcgaccggttgtcctcctacccgaatgcctggctcctaggttgattcggaacttacttgacctgccctcctcccggctggactttcaagtatgtccagccgaatctttgagcggagaagagctgtgtccttcaagtgctcccggtgcccctaaggctcagcctgcgaccccagggctcggttctcgcattcgagcaatccaagaaagtgtgggcaaaaagcactgtctgcttgaattaggcgcaagaggtgtgcgagaactggtccagaacgaaatatatccaattgttatacacgtcgaggtgactgaaaaaaatgtgagagaagtgaggggtctgctggggcgaccaggttggcgggacagcgagctcctgcgccagtgtagaggatctgagcaagttttgtgggggttgccctgcagttgggtgcaggtgcccgctcacgaatggggccacgctgaagaattggcaaaagttgtgagagggaggattctccaagagcaggctaggctggtctgggtcgagtgcggctcctcacgcggatgtccatctagtagcgaggcctag

SEQ ID NO: 217213 - DNA, 3099 bp, Artificial Sequence
  Description of Artificial Sequence: Synthetic coding sequence
atgcccggaagagcggaggcaggggaggcagaagaggaagctggcgctgggagcggttcagaagcagaggaggatgctctctgggagcgcattgagggggtgaggcatcgcctcgcgcgtgccctcaatcccgctaagttgacgccgtacctccgacagtgtagagtgatcgacgaacaggacgaagaggaggtcctgtcgacatatcggtttccttgcagagtaaaccgaactggcaggttgatggacatactcagatgcagagggaagaggggctacgaagcttttctggaagctctggagttttactatcctgaacactttaccctgctgaccggtcaggagcctgcccagcggtgtagcatgattcttgacgaggaaggccctgagggcctgacgcagtttctcatgacagaagtgaggcggctgagggaggcccgtaagagtcagctccaaagagaacagcagttacaagccagaggacgagtgctggaggaagaaagagccggactcgaacagcgcctgcgtgaccaacagcaagcacaggagcgttgccaaagacttagagaggactgggaggccggaagcctggagctacttcggttgaaggatgaaaattacatgattgcaatgaggctggcccagctgagcgaggagaagaactctgccgtcctacgctctcgcgatctacagttggcagttgaccagctgaagctgaaggtatccagactagaggaggaatgtgctctgctgcgcagagctcgaggccctccccctggggctgaagagaaagagaaagaaaaggagaaggagaaggagcccgacaacgtcgatctcgtgagcgagctcagggccgaaaaccagagactgacagcttctctcagggaactacaggagggtctgcagcaagaggcatcccgccctggagctcccggtagcgagagaatcctactcgacattctcgagcatgattggcgcgaagcccaggatagcaggcaggagctgtgccagaagctccatgccgttcagggcgagctgcagtgggctgaagaactgagggaccagtacctccaggagatggaggatctgaggcttaagcatcggacgctgcaaaaggactgcgacctgtacaagcatcgtatggcaacggtgctggctcagttggaagagatcgaaaaggagagagaccaagccatccagagccgagacagaatccagctgcagtactcacagagcctaattgagaaggatcaatacaggaagcaggtgagggggcttgaggcagaacgcgacgagctcctgactaccctgaccagcttggagggaaccaaagcattgcttgaagttcagctacaaagagcacagggcggtacatgtctgaaggcctgcgcgagttctcacagcctatgcagtaacctgtcctcaacttggtccctgtccgagttcccatcaccccttggcggtcctgaggcaactggagaagccgcagtgatgggcggacctgaaccgcataattcagaggaggcaacagactctgagaaggagatcaaccgcctttctatactgcccttcccgccttctgccggaagtattctccgcaggcagagagaggaggaccccgctccccctaaacgatcattcagctccatgagcgatatcaccggttctgtgactctcaagccctggtcaccagggctttctagctcttcaagcagcgattctgtgtggccccttggaaaacctgaaggtcttttggcaagaggctgcggtctcgacttcctaaaccggagcctggccatccgcgtgtccggacgcagcccccctggtgggccagagccccaggataaaggaccagacggactgtccttttatggcgataggtggtccggagcagtagtgcgacgcgttctgtcaggtccgggatccgctaggatggagcccagagagcagcgggtggaagccgcagggcttgagggagcctgtctcgaggctgaagcacagcaacggaccctgctttggaaccagggctccacactgccaagtttgatggacagcaaagcatgtcagtcatttcacgaggccttggaagcatgggccaaaggaccgggagcagagcccttctacattcgcgctaaccttaccctgcctgagcgggcagacccacacgccctatgcgtgaaagcccaggagatccttcggttggtggactcggcctacaaacgacgccaagagtggttttgtacccgcgtcgatccgttaactctcagggatttggaccggggaaccgttcctaactaccagcgtgcgcaacagcttcttgaagtgcaggagaagtgtctgccctctagtcggcatcgaggaccacggtctaacctcaaaaagcgggctttggaccagcttcgacttgtgcgcccaaagcccgtgggcgctcctgccggagatagcccagatcagcttctgttggaaccctgtgcagagcctgagcgaagtctgaggccttacagcttggtgaggccactgctagttagtgccctgcgaccagtggtcctgctgccagagtgtctggcccctagactgatccgtaacctgctcgacctcccatcttctcggcttgactttcaggtgtgccccgctgagtcgctgtcaggggaggagctgtgtccgtcatctgctccgggtgcgcctaaagctcagcccgcaactccgggtcttggttcccggatcagggcaattcaagagtcagtagggaagaagcactgtctgcttgagcttggagcacgaggcgtgcgtgagctcgttcagaatgagatctaccccatcgtgattcatgtcgaagttactgagaaaaacgtcagagaggtgcgcggtctgttaggccgacctgggtggagagattctgagttgctccgccaatgccgcggatcagagcaggtgctctggggattaccttgctcttgggtgcaggtgccggctcacgaatgggggcacgccgaggaactggcaaaggtggttcggggaaggatcttgcaggagcaagccagactggtgtgggtggaatgtggatcttcccggggatgcccaagcagtagcgaggcctag

SEQ ID NO: 217214 - DNA, 2241 bp, Artificial Sequence
  Description of Artificial Sequence: Synthetic coding sequence
atgggggtaggtgtgggccttgggaatgggctgagactgctgccatggatggaggcctcccggcctggcgcaccaggcagtgagcgaattcttctcgacatattagaacacgactggagagaggctcaggacagcaggcaagagctctgtcaaaagttgcacgcagtgcagggtgagctgcaatgggcggaggagttgcgggaccagtaccttcaggagatggaggatctgcgtctcaagcaccgaacactgcaaaaagattgcgatctgtataagcaccgcatggccaccgtgttagctcagctggaagaaattgagaaagaacgggaccaggctattcagagcagagatcgcatacagctacagtactcccagagtcttattgaaaaggatcagtacaggaaacaggttagagggctggaagctgaaagagatgaactgctgacaacattgacatccttagaaggtacaaaagctctgctggaagtgcaactgcaaagggcgcaggggggtacgtgcctgaaggcatgcgcctcttcccattctctgtgctcaaatctgtcttccacgtggtccctaagtgagttccctagtcccctgggcggacctgaggccaccggcgaagccgctgtgatggggggtcccgaaccacacaattccgaggaggccacggactccgagaaggagattaatagacttagtatcctgccgtttcccccatcagctgggtcgatccttagaaggcagcgcgaagaggaccctgcacctcctaaacgttccttctccagtatgagcgacataaccggatctgttacactgaagccctggagccctggacttagctcctcaagctcttccgacagcgtctggccactgggaaagccagaaggcctgctcgccagaggttgcggcctggatttccttaaccggagccttgccatccgagttagtggaaggtccccccctgggggtcctgagcctcaggataagggcccagatgggctttccttctacggagatcgttggagcggcgcagtggtgcgccgtgtgttgtcaggcccaggctcggcgaggatggaaccaagagaacaacgagtcgaggcagccggacttgagggtgcctgtctagaggcagaggcccagcagcgcacattgctatggaaccaaggttccaccctcccgtctttaatggactctaaggcgtgccaatcctttcatgaagccctggaagcctgggctaaggggccaggtgcagaaccattttatatccgcgcaaatctgacactgcctgaaagggcggatccccacgccctctgcgtaaaagcacaggaaatcttacgcctggtggacagcgcctataaacgacgacaggagtggttttgcacgagagtggacccactgacacttagagacttagatcgcggtacagtccctaactaccagcgtgctcagcaattgctggaagtgcaggagaagtgtctcccaagttcgcggcatagaggccctcgcagcaatctgaagaagagagctctggaccagctccggttagtgcgcccaaaacccgtgggagccccagccggtgactcgcccgatcagcttctcttggagccgtgtgccgagccagagcggagtttacgcccttatagcctggtgcgaccactgttggtttctgcccttcgcccagtcgttctgctgcccgagtgcctggccccacggcttatccggaatctgctcgatttgccctccagcaggctggactttcaagtttgtcccgcagaatctctgtccggggaggagctctgcccttcttccgctccaggtgcccctaaagcccagcccgcaaccccaggcctgggcagtagaattcgggctatccaggagagtgttggcaagaagcattgcctccttgagcttggggcacggggtgtgagggagctggtacagaatgagatctatcctatcgtgatccacgttgaggttacagagaaaaatgtgcgagaggtacgcggactgctaggaaggccagggtggagagattccgagcttctcagacagtgcagaggcagcgagcaagtcctgtgggggctgccatgcagttgggtgcaggtgcctgcccatgaatggggccatgcggaagagctggccaaggtagtacgtggcagaatcctacaagagcaggccagactagtgtgggtggagtgtggctcctccagaggctgcccatcttcctccgaagcatag

SEQ ID NO: 217215 - DNA, 1443 bp, Artificial Sequence
  Description of Artificial Sequence: Synthetic coding sequence
atggaagatctgcggcttaagcatcgcacactccagaaagattgtgacctgtacaaacatcgaatggcaacagtactggcacaactggaggagatcgaaaaggaacgagaccaagcgatccagtccagggatagaattcagctccagtactcccaatccctcatcgagaaggaccaataccggaagcaagtcagggggttagaggccgagagagacgaattactcactaccctgaccagcctggagggaactaaggccttactggaagtacagctgcagcgtgcccagggtgggacttgcttgaaagcatgcgcctcttcgcacagcctgtgctctaatctgtcatcaacctggagccttagcgagttcccatcacctctgggtggacccgaagcgaccggcgaagccgctgtcatggggggtcctgaacctcacaatagcgaggaggctacggactctgagaaagaaattaaccgattatcaatcctgccattcccacccagcgcgggttctatcttgagacgccagcgggaggaggacccagcacctcctaagaggtctttttcatctatgtctgacattaccggctctgtgacccttaaaccatggagcccagggctaagctctagctcgtcttcagatagcgtctggccactgggcaagcctgaagggcttcttgcacggggttgcggactcgactttttgaatcgctccctcgccattagggtcagcgggagatccccgccaggcggtcccgagccccaggacaagggaccagatggcctctctttttatggggaccggtggagcggtgcggtcgtgcgcagagttctgagcggcccagggtcagctcgaatggaaccccgagaacagagagtggaggctgccggactcgaaggcgcatgcctggaggcagaagctcagcagcggactcttctgtggaaccaaggtagcaccttgcccagcctgatggattcaaaggcctgtcaaagcttccacgaggccctcgaggcgtgggcaaagggccctggtgctgagcccttctatattagggccaacctgactctccctgaacgggctgaccctcacgctctgtgcgttaaagcccaggaaatccttaggctcgtcgactctgcttacaagaggcgtcaggaatggttttgcaccagagtggacccactcacacttcgtgatcttgatcgtgggacagtgcctaattaccagagagcccaacagcttctggaagtgcaggaaaaatgtcttccatcctccaggcacaggggccctagaagcaacttgaagaagcgcgctctggatcagctgaggctggtgaggccaaaacctgttggcgctcctgctggcgatagtcctgaccagctcttgctggaaccttgtgctgaacctgaacgatccctgcggccatactccctagtcagaccttag

SEQ ID NO: 217216 - DNA, 222 bp, Artificial Sequence
  Description of Artificial Sequence: Synthetic coding sequence
atgcccggaggtggacccgagatggacgattacatggagactctcaaggatgaggaagatgcattgtgggagaatgtcgaatgtaaccggcatatgctctcgaggtacattaatccagcgaaactaaccccatacctgagacagtgtaaagtgatcgatgaacaagatgaggacgaggtgctgaacgcgccaatgttgccttctaaaattaatcgagcttag

SEQ ID NO: 217217 - DNA, 3465 bp, Artificial Sequence
  Description of Artificial Sequence: Synthetic coding sequence
atgccgggaggcggacccgaaatggatgattacatggagactttgaaggacgaggaggacgccctgtgggaaaatgtggaatgtaacagacatatgctgtcacgctacataaaccccgcaaagctgaccccatatctgagacagtgcaaagtgattgatgaacaggacgaggacgaagtcctcaacgcacctatgctaccctcaaagattaaccgcgcaggtaggctactggacatcctgcataccaaaggacaacggggatacgtcgtgtttctggagtctttggaattctactatccagagttgtataagctggtcacagggaaggaaccaacaagacggtttagcacaatcgtggtggaggaagggcacgagggacttacccatttcctgatgaatgaagtaatcaagcttcagcagcagatgaaggcgaaagatctacagaggtgcgaactgctagcacgtctccggcagctggaggatgagaagaagcagatgaccctcactagagtcgaactgcttacctttcaggaaaggtattataagatgaaggaggaaagagacagctacaacgatgagctcgtcaaggttaaagacgataattacaacttagctatgcgctacgcccagctttcagaggagaaaaacatggccgtgatgcgttccagagatttacagctggaaatcgaccagctgaaacaccgtctcaacaaaatggaggaggagtgcaagctcgagcgcaatcagagtctaaaactgaaaaatgatatcgaaaaccgccctaaaaaggagcaagtcttggagctcgaacgcgaaaatgagatgctgaagaccaaaaatcaagagctgcaaagcattatccaggccggaaagagaagcctgcccgacagcgataaagccattctggacatcctcgaacacgaccgcaaagaagccctggaggacaggcaggagctcgtgaatagaatctataatcttcaggaagaagcacggcaggccgaggaactgagggacaagtacctggaggagaaggaagacctcgagctaaaatgtagcactctcgggaaagattgtgagatgtataagcatagaatgaacaccgtcatgctgcaactcgaggaagtggagcgggaacgggatcaggcctttcattcacgagatgaggcgcagacacagtattcccagtgtctgattgagaaggacaagtaccgaaaacagatccgcgaacttgaggaaaaaaacgacgagatgcgcatcgaaatggtgcggagggaagcatgcattgtgaatcttgaaagcaaactgagaaggctctccaaggactctaacaaccttgaccagagcttacctcgcaacctgcctgtgaccatcatctcgcaggattttggcgacgcttctccccgaactaacgggcaggaagcagacgacagctctacctcagaggagagcccagaggattcaaagtacttcctgccataccatccacctcaacgaagaatgaatctgaaaggtatccagctacaacgtgcaaaaagtcccattagcctcaaaaggacgtctgacttccaggctaagggccacgaggaagaggggacggatgcctcgccatccagctgcggttctctgcctataacaaattccttcaccaaaatgcagccaccccgatctagaagttctattatgtccatcaccgctgaaccacccggaaatgactccattgtccgcagatacaaagaagatgcccctcaccgtagtaccgttgaagaggacaacgacagcggtggattcgacgcactggatctggacgacgacagtcacgagcgttattccttcggccctagttctatccattcttcaagcagttctcatcagtcagaaggcctcgatgcatacgacctggagcaggtcaatctgatgttcagaaaattcagtctcgagcgcccttttcgaccttcggttacatccgtggggcatgtaaggggcccagggccatccgttcagcataccacactcaacggagattcactcaccagccagctcacgttgctgggcggaaatgctcgcggatctttcgtgcactccgtgaaacctggcagcctagccgaaaaagccggtctcagggaaggccaccaacttctgctgctggagggctgcatccgaggcgaacgtcagtccgttccccttgatacctgtacaaaggaggaagcccattggacaatccagcgctgcagtggccctgtgacacttcactataaagttaatcatgaagggtaccgaaaattagtgaaggacatggaggatggactgattacctccggagactctttctacatccgactgaacctcaatatcagcagccagctggatgcctgcactatgtccctgaaatgcgacgatgtggtacatgtccgggacacgatgtatcaagatagacatgagtggctgtgtgctagagtcgaccctttcacagaccatgacctggacatgggaaccatccccagttactcacgagcacaacagctgttactcgtgaaactccagagactgatgcacagggggagccgcgaggaagtggatggtactcaccataccctacgggcactcagaaacaccctgcaaccagaagaagctctgagtacatccgatcctcgggtgtctccaaggctgagccgtgcctcatttttattcggacagttgctccagttcgtctctaggtctgaaaataagtacaaacggatgaactcaaatgagagagttaggatcattagtggcagccctctcgggagcctcgccaggtcttctttagatgccactaagctgcttaccgagaagcaggaggagctggatccagagtctgaactgggcaagaacctgagtctcattccgtacagtcttgttagagcattctattgcgaacggagaagacctgttctgttcacccccacagtgctcgctaagactttggtccagcgccttttgaactcaggcggtgccatggaattcaccatttgcaaaagcgatatcgttacccgcgacgaatttctgcgaaggcaaaagacagagacaatcatatacagtcgggagaaaaacccgaacgcctttgaatgcatagcaccggctaatatagaggccgtcgccgctaaaaacaagcattgcttactagaggctggcataggctgtacacgggatctaattaagtcaaatatataccccatagtcctgtttatccgggtttgtgagaaaaatattaaacgcttccggaagttgttgcccagaccagaaacagaggaggaatttttgagagtgtgtaggctgaaggaaaaagagctcgaagccctcccatgcttgtatgccacagtggaacccgacatgtggggctctgtcgaagagttacttagagttgtgaaggataaaattggagaggagcagcgcaagacgatttgggtggatgaggaccagttgtag

SEQ ID NO: 217218 - DNA, 3114 bp, Artificial Sequence
  Description of Artificial Sequence: Synthetic coding sequence
atggccaccgagtctacacccagcgaaatcattgaaagagagcgcaagaaacttctcgagattctccagcacgatccggattccatcctcgacaccctgactagtagaaggctgatatcggaggaggagtatgaaacactggagaatgtaaccgatctgttaaagaagagcaggaaactgctgatattagtccagaaaaagggcgaagctacctgccagcacttcctcaaatgtctcttttctaccttcccacagagcgctgctatctgcggcctcagacatgaagtgcttaaacatgagaacaccgtgcctccacaaagtatgggagcctctagcaactcagaggatgccttttcacccggaatcaagcagccagaggccccagagataacagtctttttcagcgagaaggagcacctggaccttgagacgagtgaattcttcagggataagaaaacatcgtatcgtgagactgcgctaagcgccagaaaaaacgagaaggaatacgatactcccgaagttactttgtcgtactctgtggagaaggtcggatgtgaggtacctgccacgataacatacattaaggatggccaacgctacgaggaacttgatgattctttgtatctggggaaggaggagtaccttggatctgtcgacacccccgaagacgcagaggcaaccgtcgaggaggaggtgtatgacgatccagaacacgtggggtacgacggcgaggaggacttcgaaaattcagagacgactgagttttcaggagaggaaccgtcctacgagggcagcgaaacctccctgtcattagaggaagagcaggagaagtcgattgaggagaggaaaaaggtgtttaaggatgttttgctctgcttgaatatggatcggagccgcaaagtcctgccggatttcgttaagcagttttccctggaccgagggtgtaaatggacccctgaaagccctggggatctggcctggaacttcctcatgaaggtgcaagccagagatgtgaccgccagagatagcatccttagtcataaggttctggatgaagatagcaaggaagacttgcttgcaggagtggagaacctggagatacgggatattcagaccattaaccctttggacgtcctgtgcgcaacgatgctgtgcagtgactcgagtctccaacgtcaggtgatgtcaaacatgtaccaatgtcagttcgctttaccactccttttacccgatgcagaaaataacaagagcatcctgatgctgggagccatgaaggatatcgtgaaaaagcagtctacgcagttcagcgggggtcccaccgaggatacagagaagtttctgactttaatgaagatgcctgtgatctcgttcgtaagactggggtattgcagtttttccaagtcgcgtattctcaataccctcctgagccccgcacagctaaagctccataaaatatttctccaccaggacctccctctactggtgcttcctcgccagattagtgatgggctggtggaaattacctggtgcttccctgactcagatgataggaaagaaaatcctttctttcagaaaccggtggccctcgccaacctgagaggcaacctcgagagcttctggacccaattcggtttccttatggaagtgtcctcggccgtcttcttcttcactgactgtctgggggaaaaagaatgggacctgctgatgttcttgggggaggcagcaattgagcgctgttactttgtgctttctagccaggcacgggagtctgaagaggctcagatttttcagagaatcctgaacttgaagcccgctcagctgttgttttgggagaggggggatgcgggagatcgcagaaaaaatatggaaggccttcaggctgccctacaggaagttatgttcagcagctgccttcggtgcgtgtccgtggaggacatggccgctctggcacgagagctcggaattcaggtcgacgaggattttgagaacacccagcggatccaggtcagctccggggaaaatatggccggtactgctgaaggggagggccaacagcggcactctcagcttaagagctcttccaaatcccaggccctgatgcctattcaggagccaggaactcagtgcgagttgtctcagaacttgcagaacctatatggtacccctgtgttccgcccagtgctggagaattcttggttatttcccacccggatcgggggaaatttcaaccacgtgtcgttaaaagcttcttgggtaatgggtcgacccttcggttctgagcagcggcctaaatggttccaccctctcccattccaaaacgcaggggctcagggcagaggcaaatctttcggtattcagtcttttcatccccagatcttctactctggtgagcgttttatgaagttttctcgggttgcccgtggttgtcattccaatggcactttcggcaggctccctaggcctatatgccagcacgttcaggcatgcccagagcgtcctcagatgatggggactttggaaagaagtagagctgtagcttctaagattggccactcttactccctggattcccagccggcacgcgctgtgggaaaaccgtggccacagcaggcatgcacccgcgtgaccgaactgacagaagcaactggaaaattgatcaggacgtcgcacatcggaaaaccccatccccagtctttccagccagccgcagctacccagaaactgaggcctgcgtctcagcagggagtgcagatgaaaacacaaggcggtgcatccaatcctgctttacagataggatcacaccctatgtgcaaaagctctcagtttaaatcagatcaaagcaatcctagcactgtgaagcactctcaaccgaagccattccactccgtaccttcccagcccaaatccagccaaacgaaatcttgtcagtctcagccgtcccagaccaagccctcaccttgcaagtctacacagccgaaacccagtcagccttggcctccacagagtaaaccatctcagccccgaccccctcagccaaagtcaagttccacgaatccctctcaggctaaagctcaccactcaaaggctggacagaagagaggcggtaagcactag

SEQ ID NO: 217219 - DNA, 933 bp, Artificial Sequence
  Description of Artificial Sequence: Synthetic coding sequence
atggccaccgaatcaaccccttcggagattatagaaagagaaagaaagaaacttctggaaatcctacaacatgatccggattctatactcgacaccctgacctcgcgacggctgatttccgaagaggaatacgagaccttggagaacgtgactgacctgttgaagaagtctaggaagctgctgattctagttcagaagaagggggaagccacatgccaacattttcttaagtgtctttttagcacctttccacaatctgcagccatttgcggccttcggcctgaagtgctcaagcacgagaatacagtacctccacaaagcatgggagcaagtagcaactctgaggatgcatttagtccagggatcaagcaaccggaggcccctgagattacagtgttcttctcagagaaagaacatctggacctcgagacgagtgagttcttccgtgacaaaaaaacttcatatcgcgagacagccctgagtgctcggaaaaatgaaaaagaatacgatactccagaagtcacgctctcttactctgtggagaaggtgggatgcgaggtgcccgcaacaattacatatatcaaggacggccagcgatatgaagaattagacgactccctatacctgggtaaagaagagtatctcggctctgtagataccccagaagatgctgaagccactgtggaggaggaggtgtacgatgacccagaacatgtcggttacgatggcgaagaagacttcgaaaactcagagaccaccgagttttccggggaggagcccagctatgagggttccgaaacaagcctgagcctcgaagaggaacaggagaaatcaatagaaggttggtctcgtacccatggattgaagcggtcttcccacgtgggcctcccaaaatgctgggactatcggagagaacccccttgtctggcctag

SEQ ID NO: 217220 - DNA, 1446 bp, Artificial Sequence
  Description of Artificial Sequence: Synthetic coding sequence
atggctactgaaagcacaccttctgaaatcatcgagagagagagaaaaaaactgctagagattctccagcatgatcccgactcgatcctcgacactttaacgtccaggcgcctgatatcagaggaggagtatgaaaccctagagaatgtaaccgacctcctgaagaaaagtaggaagcttctgattctggtgcagaaaaaaggggaggccacttgtcagcatttcttgaagtgcttgttcagtacctttccacagagcgccgctatttgtggcctgcgtcacgaagtgctcaagcatgagaataccgtccctccacagagcatgggagcttccagtaactcagaagacgcattttctcccggtattaaacagcccgaggcaccagagatcacggtgttcttcagcgaaaaggagcacctggacctggaaacatcagagttttttcgcgacaaaaagacttcttatcgggagaccgccctttcagccagaaaaaatgagaaggagtacgacacgccggaggtgaccttgagttattcagtggaaaaagtaggctgtgaagttccagcaactattacgtacattaaggatggccagaggtacgaagagctggacgattcactgtatctcgggaaggaagagtacctcggctccgtggacacccctgaagatgctgaggcaacagttgaggaagaagtgtatgacgatcctgaacacgttggctatgacggcgaggaggacttcgagaactctgagacgacagaattctcaggggaggagcctagctatgaagggtccgaaacttccctgtccttggaggaagagcaggaaaaaagtattgaggaacgaaagaaggtcttcaaagatgtcctcctttgccttaatatggaccgtagccgtaaggtgctacctgatttcgtgaagcagttctctttggataggggctgcaaatggacacctgaatctcccggagacctggcttggaatttcctgatgaaagtccaggccagagatgtgacagctcgagactctattcttagtcataaagtgctggacgaggactccaaagaagatcttctggcaggtgtggaaaaccttgaaattcgcgacatccagaccattaacccgctggatgtgctgtgtgccaccatgctgtgctccgactccagtctgcagagacaggtcatgtccaacatgtatcagtgtcagttcgcgttgccactcctgctgccagacgccgagaataacaagtccatcttgatgctcggagcaatgaaggatatcgtgaaaaagcagtctacacagttttctggcggtcctaccgaggacacagaaaaattccttactctgatgaagactcttaaaactctccgcgagttcaagttccctctcgagaaaacatggcttgggcagctgaaggttagggtctccaaggacactgtcagttag

SEQ ID NO: 217221 - DNA, 570 bp, Artificial Sequence
  Description of Artificial Sequence: Synthetic coding sequence
atggtacttgaacatcctgcacgagtcgaaccattttatgccgtgttagagtcaccttccttctctcttatgggtattctgcttcgcatcgcatccggtacaaggctcagcattcctattacttctaatactctgatctattatcatccccatcctgaggacatcaagttccatctttatcttgtaccctcagacgccctcctgaccaaggcaatcgatgacgaagaggatcggtttcacggagtgaggcttcagacaagtcccccaatggagcccctgaattttggcagctcttacattgtgagcaacagtgccaatttaaaggtgatgcccaaggagctgaagttaagttaccgctcacccggtgagatacagcacttcagtaagttctatgcaggacaaatgaaggagcctatacagctggagattacggagaaacggcatggtaccttagtgtgggacacagaggtgaagcccgtggatttgcagcttgtggccgcatcagcccctcccccattttccggcctgctgtggcagcggcaacctctaaatccaccgcctgccagatag

SEQ ID NO: 217222 - DNA, 1296 bp, Artificial Sequence
  Description of Artificial Sequence: Synthetic coding sequence
atgatgaggcagagacagtcacactactgttccgtgttgttcttgtcggtgaactacctcggtggaacatttcctggcgatatttgctccgaggagaaccagattgttagctcctatgcatcaaaggtttgtttcgaaatcgaggaggattataaaaatagacaatttctcggtcccgagggaaatgtggatgtcgagctgatcgacaagagcacaaaccgatattcagtttggtttcccaccgcaggttggtatctgtggagtgccactggcctgggctttctggtgagggacgaggtgacagtaaccattgcttttggctcatggagccaacacctcgcattagatctgcaacaccatgagcagtggctagtcgggggtcctctcttcgacgtgactgctgaacctgaggaggccgtcgccgagattcacctcccgcactttatcagcttgcagggagaggtggacgtctcatggtttctggttgcccatttcaaaaacgagggcatggtcctggagcacccagctcgagttgagcctttttacgctgtcctggagtctcctagctttagcctcatgggcattcttctgaggattgcatctggcacacgactttccatacctattacctcaaacactttaatctattatcaccctcacccagaggacatcaaattccacctatatctcgttccaagtgatgctctgctcaccaaagctatcgacgatgaagaagaccgatttcacggggtcagacttcaaaccagtccgccaatggaacccctgaattttggctcatcctatattgtctcaaattctgccaatctgaaggtcatgccaaaagaattgaagctgtcataccgcagtccaggagagatccagcatttttcaaagttttacgcaggccagatgaaagagcctatacaactggagatcacagaaaagcgtcatggcactttggtttgggatacagaggtgaaacctgtagatctacagctcgttgccgctagcgctcccccaccgttctctggggcagccttcgtgaaggaaaatcataggcagctgcaggcgagaatgggggacctgaaaggcgttctggacgacctgcaagacaacgaagtgctgaccgaaaacgagaaagaactggtggagcaggaaaaaacgcgccaatctaagaacgaggctctcctgtccatggtcgagaagaaaggggatctggccctggatgtgctgtttaggtctatttctgagagagacccctatctagtttcgtacttgaggcagcagaatctgtag

SEQ ID NO: 217223 - DNA, 1614 bp, Artificial Sequence
  Description of Artificial Sequence: Synthetic coding sequence
atggagaagaaggagtgcccggaaaagtcttcctccagcgaggaagagctgccccgacgggatagcggatcaagccgtaatatcgacgccagcaaactcattcgtcttcagggaagcaggaagttgttagttgataattcgatacgggagctgcagtacaccaagaccggtattttcttccaggcagaggcgtgtgtgacaaacgataccgtataccgagagctcccttgtgtgtctgaaaccctgtgcgacatcagtcactttttccaggaggatgatgagaccgaggcggagcctctgctgttccgggcagtcccggaatgtcagctgtcgggaggggatatcccctctgtatccgaggagcaggaaagcagcgaaggacaggattccggtgatatctgttcagaagagaaccagattgtgtcgtcttacgcctctaaggtctgctttgagattgaagaggattacaaaaaccgccagtttctcgggccagaaggaaacgtcgatgtggaactcatcgacaagagcaccaataggtattcagtatggtttcccaccgctggctggtacttgtggtccgccaccggtttgggcttccttgtcagggatgaggtcacagtgactatagcctttggcagttggtcgcagcacttggcattggacctgcagcaccacgaacagtggctcgtgggaggacctctgtttgacgtgacagcagagccagaagaggcagtcgcagagattcacctgcctcattttatttcccttcaggccggagaggtcgacgttagctggtttctggtggcccatttcaagaatgaaggcatggtgctggagcaccccgcaagggtggagccgttctatgccgttctggaaagcccatcattcagtttgatggggattctgttgagaatcgcgagcggaacaaggttatcaattcccataacgagcaataccctaatctattatcaccctcacccagaagacatcaagttccatctgtaccttgtgccctctgatgcccttttaaccaaggccatagacgacgaagaagacaggtttcacggcgtccgcctgcagacaagccctcccatggagcccctgaacttcggatcctcttacatcgtgagtaattcagcgaatctgaaagtcatgccaaaagagctgaagttgagttacagaagccctggggagatccaacacttctcaaagttttacgcaggacagatgaaagaaccaatccaactcgaaatcaccgagaagcggcacggcactttagtatgggacactgaagttaagccagtcgacctgcaactcgtggcagcgtcagccccacccccattttctggtgctgcattcgtgaaagagaaccacaggcagctgcaggccagaatgggtgatctgaagggcgtcctggacgatctccaggacaatgaggtgttaaccgaaaacgaaaaggaactggtcgagcaggagaagacacggcagtccaaaaatgaggctctgctcagcatggtggagaaaaagggtgacctcgctctggacgttctctttcggagtatctccgaacgagacccatacttggtgagctacctcaggcagcagaacctttag

SEQ ID NO: 217224 - DNA, 1464 bp, Artificial Sequence
  Description of Artificial Sequence: Synthetic coding sequence
atggagaagaaggagtgtccagaaaaaagtagtagttctgaggaggaacttcctagaagggtataccgggaattaccatgcgtgtccgagactctatgtgatatatcccactttttccaggaggatgatgaaaccgaagccgagcccctgctgtttcgcgctgttcccgagtgccagttaagcggaggcgatattccatctgtctctgaggaacaggagtcctcagagggccaggattctggagatatctgctccgaggaaaatcaaattgtatccagttacgcctctaaagtgtgtttcgagattgaagaggattacaagaatcgacaatttctgggaccggaggggaacgtcgacgtggagcttatcgataagtccaccaaccggtatagtgtgtggttccccaccgccggttggtacctgtggtccgcaaccggcttgggattcctggtccgggatgaggtcaccgtcaccatcgcttttgggtcctggtctcagcacctggcgctcgacctccagcatcacgaacagtggctggtgggcggacccctttttgatgtcacggctgaacctgaggaggccgtggcagagattcacctcccccacttcatcagtttgcaggccggagaggtagacgtgtcctggttccttgtggctcacttcaagaatgagggtatggtgttagaacatcccgctcgggtggaaccattctacgccgttctcgagtctccctcattcagtctcatgggcatcctcctacggatcgcatccggcacgcgcctgagcattccaataacctctaacaccctgatctactatcacccccatcccgaggatattaagttccacctgtatctggtgcccagcgatgcactgctgacaaaagcaatagatgacgaggaggacaggtttcacggagtgaggttacagacctcaccccctatggagccactcaacttcggatcttcctatatcgtgtccaactcagccaatcttaaagttatgcctaaagagttgaaacttagctatcgctcccctggcgagatccagcatttttctaaattctacgccggtcagatgaaggagccaattcagttggagatcactgagaagaggcatgggacgttagtttgggataccgaagttaaacctgtggaccttcagctggtagccgctagcgctcccccacccttttctggcgctgccttcgtgaaagaaaaccatcgccagcttcaagcccgtatgggagatctaaagggtgtacttgatgacctgcaggacaacgaggtgcttaccgagaatgaaaaagagcttgtggagcaggagaaaactcggcagagcaaaaacgaggcgttgctttcgatggtcgagaaaaagggagatctcgccctggacgtcctgtttcggtccatctccgagcgggatccttatctagtttcttatctgagacagcagaatctgtag

SEQ ID NO: 217225 - DNA, 1101 bp, Artificial Sequence
  Description of Artificial Sequence: Synthetic coding sequence
atgtcagactatgaaaatgacgacgaatgttggagtgtcctagagggatttagagtgacactcacaagcgtgattgaccccagccggattaccccatacctcagacaatgtaaggttttaaatcctgatgacgaagagcaggtccttagtgaccctaatctcgtaatccggaaaagaaaagtgggagttttacttgacatcctgcagcggacggggcacaagggttacgtcgcctttctagaatcacttgagctgtattacccacaactctataaaaaagtgactggcaaggagccagcccgtgtgttttcaatgattattgacgctagcggggaatcaggtctcacacagctcttgatgaccgaggtgatgaagctgcaaaaaaaagtgcaagacctaactgctctgctctcatctaaggatgacttcattaaggaattacgcgtgaaggactcgttactgaggaagcaccaagagagagtgcagagactaaaagaagaatgtgaggctggtagtcgtgagttgaagcgttgtaaggaggaaaattatgacttggcgatgcggctcgcccatcaatccgaagagaaaggggcagcactaatgcggaacagggatctgcagctagaaatcgaccagctcaagcattccttaatgaaggccgaagatgactgcaaagtagaaagaaagcacactctgaaactgaggcacgccatggaacagcggccttcgcaggagctgctttgggagcttcagcaggagaaggccctactgcaggccagggtgcaagagttagaggctagcgtgcaggagggcaagctggacaggtcctccccatatatccaggtgctggaggaagactggcggcaggcccttagagaccatcaggaacaggccaataccatcttttccctgagaaaggacctaaggcaaggagaagctagaagacttcggtgcatggaagaaaaagaaatgtttgagctgcaatgtttagcccttcgaaaagatagcaagatgtataaggaccgcatagaggcaattctcctgcagatggaagaggtggctatcgaaagagatcagtccacccagatggaggggctctag

SEQ ID NO: 217226 - DNA, 1611 bp, Artificial Sequence
  Description of Artificial Sequence: Synthetic coding sequence
atgtcagactacgaaaacgacgacgagtgctggtccgtgttggaagggttccgggtgacgttaactagcgtcattgatccatcccgaattactccatatctccgacagtgcaaggtgctgaaccccgacgatgaggaacaggtgctcagcgaccctaacctcgtgatccgcaagcgcaaggtcggcgtcttgctcgatattctacagcgcacaggccacaagggctatgtcgcttttttagagtctcttgagctgtactatccacagctctacaagaaagtgacaggaaaagagcctgctagagtattttcgatgatcatcgacgcttctggggaaagtggcctgactcaactgctcatgactgaggtgatgaaactgcagaagaaagtccaggacttgacagccttattgagctctaaggatgacttcatcaaagaacttcgggtgaaagacagcttactccggaaacatcaagagagagtgcaaagactgaaggaggaatgtgaggctgggtcgagggaactcaagaggtgcaaggaggaaaattacgatctggccatgagactagctcaccagtcagaagagaagggagcagcactgatgagaaatagggacctgcaactggagatagaccagctaaagcactctttgatgaaggctgaagacgactgtaaagtagaaaggaagcatacactgaagttacgccatgccatggagcagagaccttctcaggaactactctgggaattacaacaggaaaaagctctgctgcaggccagagtccaggaactggaggccagtgtgcaagagggtaagttagataggtcatcgccgtacatacaagtgctggaagaagattggagacaagccctgcgagatcaccaggagcaggcaaacactattttcagcttacggaaggacctccgtcaaggggaagcacggagacttcgttgtatggaagaaaaagagatgttcgaactccagtgtcttgccttacggaaagattccaagatgtacaaagaccgtatcgaagccattctgctgcagatggaggaagtggctatagagcgcgatcaggccattgctacgagagaggagctgcacgctcaacacgcaagggggcttcaggagaaggacgccctcaggaagcaggtgagagagcttggcgagaaagctgacgagttacagttacaggtgtttcagtgcgaggcccaactacttgccgtcgagggtaggctgaggcgtcagcagctggagacactcgtcctctcttctgatctcgaagacggatctccaagacgtagtcaggaactctctctgccccaagacctggaggacacccagttatcggataagggctgcctcgctggaggcggtagtccaaaacagccctttgctgccctgcatcaggagcaggtactccggaaccctcacgatgctgggctgagctctggcgaaccacctgaaaaggaacggaggagactcaaggagtcattcgagaattacagaaggaaacgtgcattgcgaaagatgcagaaaggttggagacagggggaggaggatcgagaaaatactacgggatcagacaatactgataccgagggctcttag

SEQ ID NO: 217227 - DNA, 1479 bp, Artificial Sequence
  Description of Artificial Sequence: Synthetic coding sequence
atgtccgattacgagaatgatgatgaatgctggtctgtcttggaggggttccgagttaccctgacttccgtgattgatccatcccgcataaccccttacctcagacaatgcaaagtgcttaatcctgacgacgaggagcaagtgctgtccgatcccaacctggtgattcggaaacgaaaggtgggcgtgcttttggacattttacagaggacaggccataagggctatgtcgccttcctagagtccttagagctctattaccctcagctttataagaaagtcaccggcaaggaacctgccagagtcttctccatgatcatcgacgcgtcaggcgaatccgggttaacccagctcctgatgacagaagtgatgaaactccagaaaaaagtgcaggacttgactgccctgctttctagcaaggatgactttataaaagagctgcgcgtgaaggactccctgctccgtaaacatcaggagagggtgcagcgcctgaaggaggagtgcgaggccggatctcgcgagttgaagcggtgcaaagaggagaattacgatctggctatgaggcttgctcaccaatccgaggagaaaggagccgctctgatgcgcaaccgggatctgcagctagaaattgaccagctgaaacatagcttaatgaaagccgaggacgattgcaaggtggaaaggaagcatacgctgaaacttaggcatgccatggaacaacgcccttcacaggagctgctgtgggagttgcagcaggaaaaggcactgctccaggcacgagtgcaggaactggaagcatccgtccaggaggggaaattagaccggagctcgccttacattcaggttcttgaagaagactggcggcaggcactgcgcgaccaccaggagcaggcgaacacaatcttcagcctgaggaaggacctgaggcagggcgaagcacggcgactgcgatgcatggaagaaaaggagatgtttgaactccaatgtcttgctttaaggaaagatagcaagatgtacaaagatcggattgaagccatcctcctgcagatggaagaagtggccattgaaagagaccaggctattgccacacgcgaggaactccatgcacagcatgcccgaggtctgcaggagaaggatgcactgaggaagcaggtacgggaattgggagaaaaggcggatgagcttcaactgcaggtcttccaatgcgaagcccagctccttgccgtcgaaggacgtctgagacgccagcagttggagactttagtcctgtcctccgatctggaagatggctcgccccgaaggtctcaggagttgagcttgcctcaggatctggaagacacacagctgagcgacaagggttgccttgccggtggcggatctccaaagcagcctttcgccgctctccatcaggaacaagtgcttaggaatccccacgacgccggaccggcagggctgcctggtattggcgctgtgtgctag

SEQ ID NO: 217228 - DNA, 3501 bp, Artificial Sequence
  Description of Artificial Sequence: Synthetic coding sequence
atggacctaggtacggccgagggcacgcgttgcactgatccccctgccggaaagcctgcaatggccccaaagcgaaagggtggtctgaaactgaacgcaatctgtgccaagctgagtcggcaggttgtggtggagaaaagggcggacgctggttctcatacagagggcagccccagccagccccgtgaccaggagaggtccggcccagaatctggggcagccagggccccacgctctgaagaagacaaaagaagggcagttatcgagaagtgggtgaacggagagtacagtgaagagccagctcccacccctgtgctggggaggattgctcgtgagggacttgagctgccccctgaaggggtgtatatggttcagccacaagggtgcagcgatgaggaggaccacgcagaagagccgagcaaggatgggggtgcactggaggagaaagatagcgacggtgcagcctcgaaagaggacagcggcccatcaacccgacaggctagtggcgaggcttcctctctgcgggattatgccgctagcacaatgaccgaattcttgggcatgttcgggtacgacgatcagaatacccgggacgagttggctcggaagattagtttcgagaagttgcacgcgggatccaccccagaagccgctacttcgagcatgctgcctacctcagaagatactctctccaaacgggctcggttcagtaaatatgaggagtatattagaaagctgaaggccggagagcagttgtcatggcctgcaccatctactaagaccgaggaaagggttggaaaagaagtcgttggcacccttcccggtctccgccttccctcctcaactgcgcatcttgagaccaaggccaccatcttacccctacccagccatagctcagtgcagatgcagaatctggtcgccagggcctcaaaatacgatttcttcattcagaagctgaaaacaggtgagaatctacgccctcaaaatggctctacttacaagaagccaagcaaatacgacctggaaaatgttaagtacttacacctcttcaagccgggagagggatccccagacatgggcggtgcgattgccttcaaaaccggaaaggttgggaggccatcgaagtacgatgtacggggaatccagaagccaggacccgcaaaagttccacccactccgtcgttggcacctgccccattagcgagtgtgccatccgcgcctagcgcaccaggtcccggaccagagcctcctgcatctttgtccttcaatacccctgagtatctaaagtctaccttctccaaaacggactcgatcacaaccggaacagtctccaccgttaaaaacgggctcccgacagataagcctgccgtgactgaagatgtgaacatataccagaagtacatcgccagattctcaggctcgcagcattgcggacatattcactgtgcgtaccagtatcgtgagcactaccattgcttggacccagaatgtaattaccagagatttacctccaagcaagacgttattcgccattacaatatgcataagaaacgcgataattccctgcagcatggattcatgaggttcagcccgctcgatgattgttccgtgtactaccatggctgtcatttgaacggcaagagcactcactatcactgtatgcaggtgggctgcaataaggtgtatactagcactagcgacgtgatgacgcacgagaacttccacaagaaaaacacacagttgatcaacgatggctttcaaagatttagagccactgaagactgtggaacagccgactgccagttctacggccagaaaaccactcacttccattgcagacgacctggatgtacatttacatttaaaaataagtgtgacatagaaaagcacaagtcctatcatattaaggacgacgcatatgcaaaagatggcttcaaaaaattctacaagtacgaagagtgtaaatacgagggatgcgtgtattcaaaagctactaaccacttccactgcatacgtgcagggtgcggattcactttcacctctacatcacagatgacatcacataaaagaaaacacgagcggaggcatatcagatccagtggagctctcgggcttcccccatctttgttgggagctaaagatacagaacatgaggaatccagcaatgatgatttagttgattttagcgctctttccagcaaaaatagcagcctttccgcctcccctacatcccaacagtccagtgccagcttggcggctgccacagccgcaacagaagccggtccttcggcaactaaaccgcctaactccaagatctcaggcctacttccccagggtctacctggcagcatcccactggctttggcactgagcaattctggcctcccaaccccgactccttacttcccgatcctagccggtagagggtccacttcactgccggtagggacaccttccttacttggggcagttagttcaggcagcgccgcatcagccactcccgacactccgacccttgtcgcctcaggggcaggcgattctgcaccggtggcagctgcatctgtgcccgcacctcccgcttccatcatggagaggatctctgcttctaaaggcttaattagtccaatgatggcccgacttgcagcggcagctctgaagccctccgctaccttcgaccccggtagcggccaacaggtcacccccgctcgattccctcccgcacaggtcaagccagaaccaggagaatcaaccggtgcacccggaccccatgaggcatctcaggatcgatcattggacctgaccgtgaaagagccaagcaacgaatctaatggccatgccgtgccggcaaactcctcactgctcagcagtctaatgaacaagatgagccaaggcaatccgggacttggaagtcttctgaacataaaagccgaagccgagggctctcctgccgctgaaccgtcccccttcctgggaaaggctgtgaaggcactagtgcaggagaagcttgccgagccttggaaggtttacctccggaggtttggcacaaaggacttctgtgatggccaatgcgatttcctgcacaaagctcacttccattgtgtggttgaagaatgcggagccctgttctcaactctggatggcgcaatcaagcacgccaacttccactttaggacagaaggtggcgctgccaaaggtaacaccgaagccgctttccccgcatccgccgcagaaacaaaacctcccatggccccttctagtccccctgttcctcctgtcacaacggctacagtctcctctctcgaaggcccagccccatctcctgcatccgtgcccagtaccccaaccttgctggcatggaaacaactcgcatcgactatcccacaaatgccgcagatccccgctagtgtccctcacctcccagcttccccactggctactacttccctggaaaatgcaaaacctcaggtaaaaccgggttttctacagttccaagaaaaatag

SEQ ID NO: 217229 - DNA, 5279 bp, Artificial Sequence
  Description of Artificial Sequence: Synthetic coding sequence
atggacttagggacggcggagggtaccaggtgcactgacccccctgctggcaagcctgccatggccccaaagagaaagggcggactcaagcttaacgctatatgtgccaaactcagccggcaggtagtagtggagaagcgtgcagacgctggctcccatactgaggggagcccctcccagcctagagatcaagagaggtcaggacccgaaagcggcgcagctagagcacccagatcagaggaagacaagcgcagagcagtcattgaaaaatgggttaacggtgagtattcagaggagccggcaccaaccccggtgctgggaaggatagccagggaggggctggagttgccacctgagggagtctacatggtacaaccccaaggttgctccgacgaggaggaccacgccgaggaaccctctaaagacggcggagcattagaagaaaaggattccgatggagcggcaagcaaagaggacagcgggccatctacaaggcaggcgtcaggggaggcctcttccctgcgcgactacgcagctagtactatgacagaattcctcggcatgtttgggtatgatgaccaaaatactcgtgacgagttggcacgcaaaatttctttcgaaaaactgcacgcaggctcaaccccagaggccgctacctccagcatgttgcccactagcgaggatacactgtcaaaaagggcccgattcagcaagtacgaggagtacattagaaaactcaaggcgggagaacagctctcctggcctgctccctccactaagactgaggagcgcgtcggcaaagaggtagtgggaaccctgcccggactgcgcctgccctcctccacagcgcacttggagactaaagcaacgatcttaccgctcccctcccattcctcggtgcagatgcagaatctggtagcacgcgcatctaaatatgatttctttatccagaagctcaaaacgggagagaacctccggccacaaaacggctctacgtacaagaagcccagcaagtacgacctcgagaacgtaaagtacctccatcttttcaagccgggtgaaggctcaccagacatgggaggcgctattgctttcaagacggggaaggtggggagaccctcaaagtacgatgtgaggggtatccaaaagcctggaccagccaaagttccgcctacaccttcactggcaccagcgcctttggctagcgtccccagcgctccaagcgctcccggaccgggtcccgaacccccagccagtttatcctttaatacccctgagtacctgaaatctacgttttcgaagaccgattcaattaccaccggaaccgtgagcacggtgaagaatggactccccacggacaagccagccgtgactgaggacgtcaatatatatcagaaatacattgctcggttttcaggttcccagcactgcggtcatattcactgtgcctatcaatatagggaacattatcattgcttagatcccgaatgcaattatcagcgctttacatcgaaacaggatgtgatccgacactacaacatgcacaagaagcgagacaattctctgcagcatggattcatgagatttagccctctcgatgactgctctgtttactatcacggctgtcacttgaacgggaaaagtacacattatcactgtatgcaggtaggctgtaataaagtttacacgagcacctccgatgttatgactcacgagaattttcacaaaaagaatacccagttgattaatgacggttttcagagattcagggctaccgaagactgcggcacggccgattgtcagttctacggacaaaagactacgcatttccattgcagacgcccagggtgtacttttacattcaaaaacaagtgcgatattgaaaaacacaagtcttatcacattaaggatgacgcctacgcgaaggatgggtttaagaaattctacaaatatgaagaatgtaagtatgagggatgtgtttatagtaaggccaccaaccatttccattgcatacgggctggctgcggcttcacatttacatcaacctcccagatgacatctcataagcggaagcacgagcggagacacatcaggtccagtggcgctctcggtctgcccccatccctattaggcgctaaagacacagagcacgaagagtcctccaatgatgatctggtcgatttctcagctctatctagcaagaactcatcactgtccgctagccccactagtcagcagagttccgcttccctggcagccgcaacagccgctacagaggccggtcctagtgccaccaagccacctaattcaaagataagtggcctgctcccacaggggcttcccggaagcatccccctagctttggccctctcgaactcaggcttgcctactccgactccatacttccccatactcgctggacggggttctacttctctgcctgtgggcacaccatcactcctgggtgctgtttcaagtggcagtgccgcatctgcgacccccgatacaccaactctcgtggcctcaggcgctggagattcagctcctgtcgcagctgcctcagttcctgcgccacccgctagtatcatggagagaatcagcgcctcgaaagggctcatcagcccaatgatggcgaggctggctgccgcagccctgaagccctccgctactttcgaccctggaagcggccaacaggttacacccgctcgcttcccaccagcacaggtcaagcccgaacccggagagagcaccggtgctccagggcctcacgaagcttcacaagatagatctctcgacctcactgtgaaggaacccagcaacgaaagcaacggacatgctgtgcctgccaattcatctttgctttctagtctcatgaacaagatgagccaaggtaatcccggtctaggctcactcctcaatataaaagcggaagctgaggggtcacctgccgcagagcctagcccttttcttggaaaagctgtgaaggctctggtgcaagagaagctggccgagccatggaaggtttatctgaggaggtttggaaccaaagacttttgtgacggccagtgtgatttcctccacaaagcacatttccactgcgtggtggaagaatgcggggcactgttctctacgctggatggcgcaattaaacatgccaattttcatttccgtacagaagggggagcagccaagggtaacaccgaggcagcgtttccagcctcagccgctgaaactaagcccccaatggcccctagtagtcctcccgtaccgcctgtgactacagccaccgtcagctcactggaaggtcccgcaccttctccagctagtgtcccgagtacccccactcttttagcgtggaaacagctcgccagtaccattccccagatgccacagatcccagcatctgtaccgcacctgcccgcttcacctttggcaacaacttccctcgagaacgctaagccgcaggtcaagcctggatttcttcaattccaggaaaatgatccttgtttggctacagactgcaagtacgctaacaagttccattttcactgtctgttcggcaactgcaaatacgtgtgcaaaaccagcggcaaggctgagtcccattgtcttgatcatattaatccgaacaacaaccttgtaaacgttagagatcagttcgcgtactacagtctccaatgcctgtgccctaaccaacactgcgagtttagaatgagggggcattatcactgtctgcggacagggtgttatttcgtaaccaacataaccaccaaacttccttggcacataaaaaagcatgagaaggccgagcgaagagcggcaaatggctttaaatattttactaagagagaggaatgcggtagactgggatgtaagtataaccaggtgaactcccacttccattgtatccgtgaggggtgtcagttttcctttctgcttaaacaccagatgacctctcatgctcgcaaacacatgcggcgaatgcttgggaagaatttcgaccgggttcctccttcccagggtcctcccggactcatggacgcagagacagatgagtgtatggactacacaggctgctccccgggagccatgtctagtgagtccagtaccatggataggagctgctcctccacaccggtggggaatgaatccacggccgctgggaacacaataagcatgcctacggccagcggggctaaaaagaggttttggataatcgaggatatgtccccctttggaaagaggaggaagactgcaagtagtcggaaaatgctggacgagggcatgatgctcgaaggatttagaaggtttgatctgtacgaggattgtaaggacgcagcatgccagttctctctgaaagtgacgcattaccactgcactagggaaaattgtggatacaagttctgcggacgcacacacatgtataagcatgctcagcatcacgacagggtggataacctggtgctggacgacttcaagcgcttcaaggccagcctgagctgccacttcgccgattgtccattctctggaacatccacacacttccattgcttgcgctgtagatttagatgcacggattcgacaaaagtgaccgcccaccgtaaacaccatggtaaacaggacgtgattagcgccgctgggttctgccagtttagcagcagcgcggactgtgcagtgcctgactgcaaatataagttgaaatgttcccacttccattgtactttcccgggttgccgccacaccgtcgtgggcatgtcacagatggattctcataaaagaaaacatgagaaacaggaaagaggggaaccagcagccgagggccctgccccagggcctcccatttcactggacggaagcctaagcctcggcgcagaacctgggtccctgctttttctacagagtgcagctgctggtttaggcctggccttgggcgacgccggagacccagggcctccggatgccgctgccccaggccctcgcgaaggggctgcggctgcggcagccgctgctggtgagtccagccaggaagatgaagaagaggagcttgagctacccgaagaagaagccgaggatgatgaagacgaggacgatgatgaggacgatgatgatgaggacgatgacgaggatgacgacgatgaagacttgcggaccgacagcgaggaatctctgccggaggccgctgctgaggctgcgggtgccggagcaaggacacctgctctcgccgcactcgcggcattgggagccccaggtcccgcaccaaccgccgcttccagccctta

SEQ ID NO: 217230 - DNA, 4332 bp, Artificial Sequence
  Description of Artificial Sequence: Synthetic coding sequence
caggagctcgaggccgctttgcaccgggatgatgttgaatttatttctgatctaatcgcgtgtctcctgcaggggtgttatcaacgccgtgatatcaccccccagacattccacagttaccttgaggacatcatcaattacagatgggagctcgaggaggggaaacccaaccccctgagagaagcaagcttccaggatctgcctctgagaactagagtggagatcctccatcgtttatgcgattaccgcctggatgccgatgacgtgttcgatctgttgaaaggactggacgccgattccctccgggtggaaccactcggcgaggacaactcgggggctctctactggtatttttatggtactcgtatgtacaaggaagaccctgtgcagggtaagagtaacggggagctgagtctgagcagggaatctgaaggccagaagaatgtcagctctatacccggtaaaaccggcaagagacgcggtcggccacccaaacgcaagaaattgcaggaagaaattttgctatcagaaaagcaggaagaaaacagtctcgccagtgagcctcagaccaggcatgggagccaggggccaggacagggcacatggtggttactctgccaaactgaggaagagtggagacaggtcaccgagtctttcagagagcgaactagcctcagggaacgccagctctataagctgctcagcgaggattttctccctgaaatatgtaacatgatcgcccagaagggaaaaagacctcagcgtactaaggccgaactccaccccagatggatgtcagatcatctctctataaaacctgttaagcaggaggaaacgcccgtcctgaccaggattgagaaacagaagcgcaaagaggaggaagaagagagacagatactgcttgctgtgcagaagaaagagcaggaacagatgcttaaggaagagaggaagagggagctcgaggagaaagtcaaggctgtggaaggcatgtgtagcgttagggttgtatggcgaggggcatgcttgtccacatctagacctgttgacagggcgaagagacgaaaactgagggaggagagagcatggttactcgctcagggcaaggagcttcctccagagctctcacacctggacccaaactctccgatgagagaggaaaaaaaaacgaaagacctctttgagctcgacgatgacttcacagctatgtataaagtgctggatgtagtaaaggcccacaaggactcttggcccttcctcgaacctgtggacgagagctacgcccctaattactaccagataatcaaagctccaatggatatcagttccatggaaaagaagctgaacggcggtctgtactgtaccaaagaagagttcgtcaatgacatgaaaacgatgttccgcaattgcaggaagtacaacggggagtcctctgagtacacaaaaatgtccgataatctcgagcggtgctttcatagggccatgatgaaacacttccctggcgaggacggcgatactgatgaagaattctggattcgcgaggacgaaaagcgggaaaagagacggagtcgggctgggcgatcgggcggtagccatgtctggaccagaagcagagacccagagggatctagtagaaaacagcagcctatggagaacggaggtaaaagtttgcctcccacacgacgagctcctagctctggagatgaccaatcctccagtagcacccagcctccacgcgaagtggggacaagcaatgggagggggttcagccatccactccactgtggcggtaccccatcacaagctccatttcttaaccagatgagacccgctgtccccggtacatttggtcccctcagaggctccgatcccgcaaccttatacggcagctccggggtccccgagccacaccccggagaaccggtgcagcagagacaaccctttaccatgcaacctccagttggcataaactccctcaggggccctcggttagggacccccgaagaaaagcagatgtgtggcggactcactcacctctcaaatatgggacctcaccctggatccctgcagctggggcagatctctggaccctctcaagatgggtccatgtacgcacctgcccagttccaaccaggatttatcccaccgcgtcatggaggcgctcccgctagaccacctgattttcctgagtcaagcgaaatacctccttcgcacatgtatagatcatacaagtatctgaacagggtgcattcggcggtttggaatggcaaccacggcgctaccaatcaggggcctctgggccctgacgaaaagcctcacctcggtccagggcctagccatcagcccaggacactgggacacgtcatggactcacgagtcatgcgaccgccagtgcctccaaaccagtggaccgaacagagcggcttcctgcctcacggggtgcccagcagcgggtacatgagacccccatgtaagtctgctggacatagactccaaccgcctcccgttccagcgccatcaagcttattcggagcacctgcccaggcacttagaggagtgcagggcggagactctatgatggacagccccgagatgatagctatgcagcagctaagcagcagagtgtgtcctccaggggtcccatatcatccacaccagcctgcccacccacgactaccaggccctttcccccaggttgcccaccccatgtctgtgaccgtctccgcacccaaaccagctctcggaaatcccggtcgggcacctgagaactccgaagctcaggaaccagagaacgaccaggccgagcccttgcctggtctcgaggagaagccaccaggcgttggcacctccgaaggggtgtacctgacacagctcccgcatcctacacctccactccagacagattgtacaagacagtccagcccacaggaacgagagaccgtgggacccgagcttaagtcatcctcaagcgagtcagctgacaactgcaaagcgatgaaggggaaaaacccgtggccctcagactcatcatatccaggacctgcggctcagggttgtgttcgcgatctttcaactgtagcagatagaggggcactttcagagaacggggtgattggcgaagcgagcccttgcggctccgagggaaaaggccttgggtctagcggttcagaaaaactgctgtgccccagaggtcgtacactccaagagactatgccttgcaccggtcaaaacgctgctaccccaccatccactgaccccggtctcaccggcggaacggtttcccagtttccgcctctctatatgccgggacttgaatatcctaactccgccgctcactaccacatttcgcccggtctgcagggagttgggcctgttatgggtggtaaatctccagcctcccacccacagcattttccacctaggggatttcagtccaatcatccgcactccggagggttccccagataccgtcctccccaaggcatgagatattcttatcaccctcctcctcagccctcctatcaccactatcagcggacaccatattacgcgtgtccgcagtctttctctgattggcaaaggccactgcacccacagggtagtccatcaggcccaccggcatcccaaccccctcctcctagatctttatttagcgacaaaaacgccatggctagcctgcagggctgcgagacccttaacgccgctttgacgagtccaaccaggatggatgcagttgccgctaaggtgcctaatgacggacagaatccagggccagaagaagagaagctggacgaatctatggagaggcccgagtcgccaaaggagttcttagacttggacaatcataacgcagccaccaaaagacaatcgtcattaagcgctagcgaatatctgtacggaacacctcctccgttatcttcaggtatgggatttggcagttctgcctttccgcctcacagcgtgatgctccagactggacccccttacaccccccaacgacctgcctctcatttccagccaagggcctactctagccccgtggctgcgctcccacctcaccaccccggtgctacccaacccaacgggctgtcccaggaagggccaatctaccggtgccaggaagagggactggggcacttccaagccgttatgatggagcaaattggtactcgctcagggatcagaggaccctttcaagaaatgtaccgcccaagtggcatgcagatgcatcccgttcagtctcaggcttcattccctaagacacccaccgcggctacgagtcaggaggaagtgccacctcataagcccccaacactgcccctggaccagtcgtag

SEQ ID NO: 217231 - DNA, 1371 bp, Artificial Sequence
  Description of Artificial Sequence: Synthetic coding sequence
gaattggaggccgcattacaccgcgatgatgtggagtttatctcagacctcatcgcctgccttctgcagggctgttaccaaagacgcgatataactccacaaaccttccactcctatctggaagacatcattaattatcgatgggagctggaggagggtaagcctaatccactgagggaagcttcgtttcaggatctcccactgcgaacgcgggtggaaattctgcaccggctgtgcgattaccggctggacgccgatgatgtgttcgacctgcttaagggactggatgccgactctcttagggtcgagccactgggggaagacaactccggggcactgtactggtacttctacggaacccggatgtacaaagaggacccagtccagggcaagtcgaacggggagctgtccttatccagagagtccgagggccagaaaaatgtatcatcgattcccggaaaaacagggaaacggagaggtaggccccctaagcggaagaaactgcaggaagaaattctcctctcagaaaaacaagaggagaattccctagcctcagagccacagacccgacatgggagccaaggccctggccagggaacttggtggcttctgtgccagaccgaggaggagtggaggcaagtaaccgaatctttccgcgagcgtacttctcttagggaacggcagctttacaagttgctgagtgaggacttcctgccagaaatatgcaatatgatagcccagaaggagactccagtcctcacacgtattgagaaacagaaaagaaaagaggaggaggaggagagacagatcctgctggccgtgcaaaagaaggagcaagaacaaatgctgaaggaagagcggaaaagggagctggaggagaaagtgaaagccgtagaggggatgtgcagtgtgagagtagtgtggcgcggtgcctgcttaagcacgagccgcccagtcgacagagcaaagaggagaaaactgcgcgaggagcgcgcttggctgttggcgcagggtaaggagttaccaccagaacttagccacttagaccctaattcaccaatgcgggaagaaaagaaaacgaaagacttgttcgaactcgacgacgatttcacggcgatgtataaggtcctggacgtggtgaaagctcacaaagactcttggcccttcctggagcctgtggatgagagctacgctcctaactactaccagatcattaaagccccaatggatatctctagtatggagaagaaattgaatggcggactgtattgtactaaggaggaatttgtgaatgacatgaaaacaatgtttaggaattgtcgaaagtacaacggcgaatcctctgggaagcagggccgtagcctctgctag

SEQ ID NO: 217232 - DNA, 1584 bp, Artificial Sequence
  Description of Artificial Sequence: Synthetic coding sequence
atggctgactcgcgggacccagccagtgaccaaatgcagcactggaaggaacaaagagcggctcagaaagccgatgtgcttacaaccggggctggcaaccccgttggcgacaaactgaacgtgatcactgtgggacccagaggcccactccttgttcaagatgttgtcttcaccgatgagatggcccactttgatagggagcggatccccgaacgagtagtccacgccaagggtgccggtgcgttcgggtatttcgaagtcacccacgatattaccaagtatagtaaagccaaggtctttgaacacataggcaaaaaaactcccatagctgtaagatttagtaccgtcgccggagagagcggctctgccgatacagtgagggatcctcgtggtttcgcagtcaagttttacacggaagatggcaactgggatctggtgggcaataacacccctatattcttcattcgggacccaattctctttccatcattcatccacagccaaaagaggaatccacagactcatctgaaagaccctgatatggtctgggacttttggagtctgcgcccagaaagtctgcatcaggtctctttcttgttctcggataggggcatcccagacgggcaccggcacatgaatggatacggatctcatacgtttaaactagtgaatgccaatggagaggcggtgtactgcaagtttcactacaagacagatcaggggatcaagaacttatccgttgaagacgcggctcggctgtcccaagaggacccagattatgggatccgggatctcttcaacgccatcgccacagggaaataccccagctggacattttatatccaagtaatgacgttcaatcaggctgaaacatttccatttaacccattcgacttaacaaaggtatggccacacaaggactacccgctaataccagtgggcaagttggtcctcaaccgaaaccccgtgaactattttgccgaagtggagcagattgcgttcgacccgagcaatatgcccccaggaattgaggccagccctgacaaaatgttacaagggagactcttcgcttatccggatactcataggcatcggttaggcccaaattacctacatattcccgtaaattgtccctatagggcgagggtcgccaattaccaacgggacggacctatgtgcatgcaggataaccaggggggagcgcctaactactacccgaattcttttggggcacccgagcagcagccctccgccttggagcactctatccagtacagcggcgaggtgcgcaggtttaatactgctaatgatgacaacgtgacgcaggtgcgagcgttctatgtcaacgtgctgaacgaagaacaacggaaaagactgtgtgagaatatcgcgggtcaccttaaggacgcccaaattttcatccagaagaaggcggtaaaaaacttcacggaagtgcatcccgactatggtagtcacatccaggccctgctcgataagtacaacgccgaaaagccgaaaaacgccattcacacattcgttcaatccggttcacatcttgctgcacgagagaaggcgaacctgtag

SEQ ID NO: 217233 - DNA, 816 bp, Artificial Sequence
  Description of Artificial Sequence: Synthetic coding sequence
atgccagaggcccctccactcctgctcgcagccgttctgctgggactggtacttctcgtggtgctgttgctcctgcttagacactggggttggggattgtgcttaatcgggtggaatgagttcatcctgcaacctattcacaacctacttatgggcgataccaaagagcaacgcattctgaaccatgtcctccagcatgccgaaccaggcaacgcccaaagcgtgttggaagccatcgacacctactgcgagcagaaagagtgggctatgaacgttggagacaagaaaggaaagattgttgacgcggttatccaggaacaccagcctagcgtactcttggaattaggcgcatattgtggatacagcgcagtgaggatggcccgtttgctatccccgggtgcacgcctgatcacaatcgaaatcaatccagattgcgccgcaataacgcagcggatggttgactttgctggtgttaaagataaggtcacgctagtggtcggcgcatcccaggacatcattccccagctcaaaaagaagtacgacgtcgatacactagatatggtcttcctcgaccactggaaggatcgatacctgccagataccctgcttttagaggaatgcggcttactgcggaaaggaaccgtgctgcttgcagacaatgttatctgtcccggtgcgcctgactttttagctcacgtccgcggaagtagttgcttcgagtgcacgcattaccagagctttcttgaatatagagaggttgtggacggtctggaaaaagctatttataaggggccaggtagcgaggctggcccatag

SEQ ID NO: 217234 - DNA, 816 bp, Artificial Sequence
  Description of Artificial Sequence: Synthetic coding sequence
atgcctgaagcccctccactcttgcttgccgcagtgttgctgggcctggtgctgctcgtggtgttactcctgctgctccgtcattggggttggggcctttgccttatagggtggaatgaattcatactgcaacctattcacaatctgttaatgggggacactaaggaacagcgaattctgaaccacgtgcttcagcacgccgagcctggaaatgctcagagcgtccttgaggccattgatacgtactgtgaacagaaagaatgggcaatgaatgttggcgacaagaaaggaaagatcgtcgacgcagtcatacaggaacaccagccgtctgttctgctcgagctcggtgcgtactgcggatactcggccgtccgaatggccaggcttctctccccgggagctcgcctgattactattgagatcaaccccgattgcgccgctattactcagagaatggtggacttcgctggagtgaaagataaagtgacactcgttgtgggtgccagtcaggacataattccccagctcaagaaaaagtacgacgtggatactctggacatggtgtttctggatcactggaaagacagatatctgcccgatactctcttactcgaggaatgcggactgttgcgaaagggcaccgtgttgctggctgacaatgtgatatgccctggcgcacccgactttctcgctcacgttcgcggtagctcgtgtttcgaatgcacacattaccagtcctttttagagtatcgagaggtcgtggatggtctggaaaaggctatctataaaggcccaggcagcgaggccggtccttag

SEQ ID NO: 217235 - DNA, 816 bp, Artificial Sequence
  Description of Artificial Sequence: Synthetic coding sequence
atgcccgaggcacctcccctgcttctggcagccgtgcttctgggtcttgtgctgctagtggttctcctgctgctgctgcgccactgggggtggggactgtgcctgattgggtggaacgagttcattctccaacccatccacaacctgctcatgggagatacaaaagaacagaggatcttgaaccacgtgctgcaacacgccgagcctggcaacgctcagtcagtgctggaggccattgacacttattgtgaacagaaggagtgggctatgaacgtgggcgacaagaaggggaaaatcgtggatgccgttatacaggaacatcagccgtcggtgctcctggagctgggggcatattgcggctatagtgcagttcggatggccaggctgctgagtccaggcgcacggttgataaccattgaaataaatcctgactgtgccgcaatcacacagaggatggttgattttgccggtgtcaaggataaagtgaccctggtggtcggggcaagtcaagatatcattccccagttgaaaaaaaagtacgatgtcgataccctcgacatggtgtttctggatcactggaaggatagataccttcctgataccctacttctggaagaatgcggactgcttagaaaggggacggtattgctcgcagacaacgtcatatgtccaggggcacccgatttcctggctcatgtcagaggcagttcctgctttgagtgtacccattaccaaagctttctggagtacagggaggtcgttgacgggctggagaaggccatttataaaggaccaggaagcgaagctggcccatag

SEQ ID NO: 217236 - DNA, 666 bp, Artificial Sequence
  Description of Artificial Sequence: Synthetic coding sequence
atgggagacacaaaggaacagagaatactgaaccacgtcctgcagcacgccgagcctggtaatgctcaatcagtgctggaggccatcgacacatactgcgaacagaaggaatgggctatgaatgttggtgataaaaagggcaaaatcgtggacgcggtgattcaggagcatcagcctagtgtcctcctcgaactcggggcatattgcggttattcagccgtgagaatggcacgtctgttaagtccaggagctcggcttattacaatagagataaatcccgactgcgctgcgataacacagagaatggtggacttcgcaggagtgaaagataaggtgaccctagttgtaggtgccagtcaggacatcattccacagcttaagaagaaatatgatgtcgacactctggatatggtgtttctggaccactggaaggatagatacttaccagacactttgctcctggaagagtgcggcctgctgagaaaaggcacagtgctgcttgcagacaatgtgatatgtccaggagcacccgactttctggctcatgtccggggtagttcgtgttttgagtgtacccactaccagtccttccttgagtaccgcgaggtggtggacggattggagaaagctatttacaaaggccctggatccgaagccggaccatag

SEQ ID NO: 217237 - DNA, 672 bp, Artificial Sequence
  Description of Artificial Sequence: Synthetic coding sequence
atgccagaagcccctccactgcttctcgccgctgtgttactgggcctggtcctcttggtcgtgctgctcctgctccttcggcattgggggtggggcctttgtctgatcggctggaacgagttcatcttacagccgatacacaaccttctcatgggcgataccaaggaacagcgtatcctaaatcacgtgttgcagcacgccgagccaggcaatgcccagagcgtgctggaagcaatcgacacctactgcgagcagaaggaatgggctatgaatgtgggcgacaagaagggaaagatcgtagatgccgtgattcaggaacaccagccctcagtgctgttggaactgggggcttactgcggctactccgccgtccggatggcacgtctgctgagccccggagcgaggttgataactatcgaaataaaccccgactgtgctgccatcacccaacggatggttgattttgctggcgttaaggataaagtaactctggtagtaggagcatctcaggacattattccacagctgaaaaagaagtacgacgtcgatacgcttgacatggtgtttctcgaccactggaaggatcggtatttgccggacactttgttattagaggagtgtggcctgctgcgcaagggtaccgtcctgctggcagacaacgtgatttgctag

SEQ ID NO: 217238 - DNA, 666 bp, Artificial Sequence
  Description of Artificial Sequence: Synthetic coding sequence
atgggcgatacaaaagagcagcggatactgaatcacgtgctgcagcatgccgagcctgggaacgctcagagcgtcctcgaagcaatcgacacatattgcgagcaaaaggaatgggctatgaatgtgggtgacaaaaaaggcaagatcgtcgatgccgtcattcaagagcatcaaccttctgttttactagaactgggagcatactgcggctacagcgctgtgcggatggcacgcctgctgtctccaggggcaaggcttatcactatcgagataaatccagactgcgctgctatcacccagcgcatggttgactttgctggcgtcaaggacaaggttacgctcgtcgtgggtgccagccaagacattatacctcagcttaaaaagaagtatgacgtggacacactcgatatggtgttcctggaccattggaaggatcggtatctgccagacactttgctgctggaggagtgcgggctgctgcggaaagggaccgtgttgctggccgataacgttatatgtcccggtgcacctgactttctggcccacgtccgcggaagcagctgcttcgagtgtacccattaccagtctttcctcgagtaccgggaggtggtcgatggactggaaaaagccatctataaggggcctgggagtgaggccggaccttag

SEQ ID NO: 217239 - DNA, 2664 bp, Artificial Sequence
  Description of Artificial Sequence: Synthetic coding sequence
atggccaatgggaccctaactcggagacatcagaacggacggttcgttggggacgcagatctggagcgccaaaagttctccgacttaaaattgaacggaccacaggaccactcacacttgctctactccactattcctaggatgcaggagcccggacagatcgtggaaacttataccgaggaggaccctgagggcgctatgagcgtggtctctgtggagacatcagacgatggcacaactcgccgaactgagaccaccgtgaagaaagttgtgaaaactgtaaccactagaaccgtccagccggttgccatgggcccagatggtctccctgtggatgcctcatcagtgtctaacaactacatccagaccctgggccgtgactttaggaagaacgggaatggagggcctgggccatacgtcggccaggcaggtactgccaccctgccaaggaacttccactaccctcccgacgggtattcccgccactacgaggacggatatccagggggatccgacaattatggctcactctcaagagtaacaaggatcgaggagcgttaccggccaagtatggaaggctacagagctccaagcaggcaggatgtgtatggaccccagccacaggtcagagtgggcggatcatctgttgacctacaccgcttccaccccgagccctacgggcttgaggacgaccaacggagtatgggttacgatgaccttgactacgggatgatgagcgactatggaaccgcacgcagaactgggactcccagcgatccgaggaggcgcttacgcagttacgaagatatgattggggaggaagtgccctccgaccaatactactgggccccactcgcccagcacgagaggggaagcctcgctagccttgactcgctgcggaaggggggaccccctccccctaattggcgccagcccgagctgccggaggttattgctatgctcggtttccggttagacgctgtgaagtctaatgcagctgcctacctacagcacctgtgctatcgcaacgacaaagtcaaaacggatgtgagaaagctgaagggtatccctgtgctcgtcggattattggatcacccaaaaaaggaagtccatctgggcgcttgtggagctcttaagaatatatccttcggacgagatcaggacaacaaaatcgcaatcaaaaattgcgacggagtgccagccttggtgagactgctgaggaaggccagggatatggatctgacggaagtgataaccggcaccctgtggaacctcagtagccatgattcgatcaagatggagatcgtggatcacgccctacacgctctgactgacgaggtcatcataccccattctggctgggagagggaacctaacgaggattgcaaacctaggcatatcgaatgggagagcgtgcttacaaacaccgcaggttgcctgagaaacgtcagttcagagcgctcagaggcccgtagaaaactgcgcgagtgtgatggattggtggatgcgctgatattcattgttcaggccgagattggccagaaagactcagattcgaagttggtggagaactgcgtgtgcttactgcgaaaccttagctatcaggttcaccgagaaattcctcaggccgagaggtaccaggaggccgctcctaatgtggcgaataatactggtccgcacgcggcaagctgcttcggcgctaaaaagggcaaagggaagaagccgatcgaagatcctgccaatgacaccgttgactttcctaagcgcacctctcccgcacggggatacgaattgctgttccaacccgaagtcgtgcggatatatatttctttattgaaagaaagtaaaacaccagcgatcttggaggccagcgcaggagcgattcaaaacttgtgcgccggacgctggacatatggtcgttatatccggtcagcactacggcaggaaaaagcattatcagccatagccgacctgctcacaaacgaacatgagagagtggtgaaagcagcctccggcgctctccgcaacctagcagtagatgctcggaacaaggagttgatcggtaagcacgctattcctaatttggtcaagaacctgcctggcggtcaacagaacagctcttggaatttttccgaggacaccgtaatcagtatccttaacaccattaacgaggtaattgcagagaatctggaagccgctaaaaagttacgggaaacccaggggatcgaaaagttggttctcattaacaaatcaggcaatagatcagaaaaagaggtgagagccgctgcacttgttctccagaccatctggggatacaaagagctgaggaagccgctggagaaagagggttggaagaagtccgatttccaggtcaatctgaataatgctagccggagccaaagctcacactcttatgatgattctactctccctctcattgatagaaaccagaagagcgataacaattactccacgcctaacgagagaggggatcacaacaggactctggatagatcgggcgatttaggcgatatggagcctctgaaaggcactacccccctgatgcaggatgaggggcaggagtccctcgaagaagaactggacgttctcgtgctcgatgatgagggcggacaggtgtcctatccatctatgcagaaaatttag

SEQ ID NO: 217240 - DNA, 1755 bp, Artificial Sequence
  Description of Artificial Sequence: Synthetic coding sequence
atggatgggtggcggagacccttgcagagtgtcggaaaggtttgcgaaaagaatatgaagacatcagagatgcacacaatgtccggcgcacaaaccggcaggaaggaaaagggagatccgctgaatatcgcaatcgataaaatgacaaagaaaacaagagatttgcgacggcagcttagaaaagctgtgatggatcacatctctgatagcttcttggagaccaatgtgccgctcctcgttttgatcgaagccgcaaagagtgggaacgagaaagaggtgaaggagtatgcacaggtgttccgggaacacgccaataaattggtcgaagtcgccaacctggcctgctccatctccaacaatgaggagggcgtcaagttggtgcgcatggctgcgacacagattgatagcttatgtccacaagtgattaatgctgcactgactctcgctgcacgccctcagtccaaggtggcacaggacaacatggatgtattcaaggatcagtgggaaaaacaagtaagggtgctgacagaggccgtggacgacattacatctgtagatgacttcctttccgtcagcgagaaccatatcctggaggatgtgaacaaatgcgttattgccctccaggagggagatgtggatacacttgatcgaacggcaggggcaattcggggacgggcagcccgtgtgattcatatcatcaacgccgagatggaaaattacgaggccggagtctacaccgagaaagttcttgaggcaaccaagctgttgtccgaaactgtgatgcccagattcgccgagcaggttgaagtggctatcgaggcactatcggctaatgtaccacaacccttcgaggaaaacgagttcattgatgcctccagactggtctatgacggagttagagacatcagaaaagcggtgctcatgatccgcacacccgaggaacttgaagatgactccgatttcgaacaagaggattacgacgtgagatctaggacttccgttcagaccgaggacgaccagttgatcgcagggcagagtgccagggctatcatggcccagctcccccaagaagaaaaagcgaagatagccgaacaagtggagatcttccaccaggaaaagagcaagcttgacgccgaagtggccaagtgggacgattccggaaacgatatcatcgtgctagccaagcaaatgtgtatgattatgatggagatgacggattttacacgaggcaagggccctctgaagaacactagcgatgtgatcaatgcggctaaaaagatagctgaagccggtagtaggatggacaagttggccagggcggtggctgatcaatgcccagactctgcctgcaagcaggatctgctggcgtatctacagcgcatcgcgctctattgccaccagctaaatatttgtagcaaggtgaaggccgaggttcagaatttgggcggagaattaattgtctctggactggactcagccaccagcctgattcaggctgcgaagaacctaatgaatgcagtggtcctcactgtaaaggcctcttacgtggctagcacaaagtaccagaaggtatacgggacagctgccgtgaactcacctgtggtgtcttggaagatgaaagccccagagaaaaaaccattggtgaaaagggagaaaccagaggagtttcagactcgcgtgagacggggaagtcaaaaaaaacacatatctcccgtacaggcgctttcggagtttaaggctatggactcattctag

SEQ ID NO: 217241 - DNA, 2820 bp, Artificial Sequence
  Description of Artificial Sequence: Synthetic coding sequence
atgagcgggctgatttgtctacagtacggactgtggcatggccagaagatcgactttggaggccctagaaggctgctgcagcggaatcgtggcgaaggctcaatgaccagcgccacctcaccaattatcctgaagtgggacccaaagtcacttgaaataagaacacttactgtggaaaggttgctggagcctctagtcacccaagttacaacactcgttaatactagcaacaaaggacctagtggcaaaaagaaaggacggagcaagaaagctcatgtgctggccgcttctgtcgaacaggctacgcagaattttctggaaaaaggagagcaaatcgctaaggaaagtcaagatctgaaggaggagctggtggcagccgtagaggatgttcgcaagcagggcgagacgatgaggatagcctctagcgagtttgccgatgatccatgcagttctgtgaaaagggggacaatggtcagggcggctagggccctactgtccgctgtgacccgcttgcttatcctcgctgatatggccgatgttatgcggttgctctcccacctcaagatcgtagaggaggccctcgaagccgtgaagaacgcaactaacgagcaggatctagcgaatcggttcaaggaattcgggaaggagatggtgaaactgaactacgtcgccgcacggcgacaacaggaactcaaggatcctcactgccgtgacgaaatggccgcagctcggggtgctttaaaaaagaacgctactatgctttatactgcttcccaggcattcctgcgacacccagatgtggcggctacacgagctaatagagactacgtttttaagcaggtccaggaagccatcgctggcatatcaaacgcagcacaggcaacaagtccgacagatgaggccaagggccacaccggcattggggagctagccgctgctctaaatgaattcgataacaaaattattcttgatccaatgacattctcagaggccagattccgtccatcacttgaggaaagactcgagagtattattagcggtgccgctctcatggccgactcgagttgcactcgagatgacaggagggaacgcattgtggccgaatgtaacgccgtgcgacaggcccttcaggacctcctttccgagtacatgaacaatacaggccgaaaagagaagggcgatcccctgaatatcgctattgacaagatgaccaaaaaaactcgggacttgagacgtcagctccgaaaagcagtcatggatcacatttccgattcattcctggaaacaaacgttcccctcttagtgctcatcgaggctgccaaaagcggcaacgagaaagaagtgaaggaatacgcacaggtgtttcgtgagcatgcaaacaagttggttgaagtagccaacctggcttgctcaatctccaacaacgaagaaggcgttaagctggtgcggatggccgctactcagattgacagcttgtgcccccaggtaattaatgcagcactcaccttagccgcacggcctcaaagcaaggttgcccaggataatatggacgttttcaaagaccaatgggaaaagcaagtcagggtccttacggaggcggtggacgatataaccagtgtggatgactttctgtctgtatccgaaaatcatatccttgaagacgtgaataaatgcgtgatcgcccttcaagaaggcgacgtggataccctcgaccggactgctggggctatccgcggacgagccgcacgcgttatccatataatcaatgcagagatggagaactacgaggcgggagtatacactgagaaagtgctcgaggctactaagcttcttagtgaaacagtcatgccgaggttcgctgagcaggtcgaggtcgctatcgaggctctgtctgccaatgtgccacagccttttgaggaaaatgagtttattgatgcttccaggctggtgtacgatggagtacgggatattcgtaaggccgtgctcatgattcgaactccagaagaactcgaggacgactccgactttgaacaggaagactatgatgtccggtcaagaacaagcgtacagaccgaggacgatcaactgatagctggccaaagcgctagggcaattatggcacaactcccacaggaagagaaggccaagattgccgaacaggtcgagatctttcatcaggagaagtctaaactggacgcagaagttgcgaagtgggacgactcaggaaatgacattattgtattagcaaagcagatgtgcatgattatgatggaaatgaccgacttcacaagggggaaaggtccactgaagaatacaagcgatgtaattaatgccgctaaaaaaatcgccgaggcgggatctagaatggataagttagcccgagccgtggcagatcagtgtcccgattctgcttgtaaacaggacctgctcgcgtacctccagcgcattgccttgtactgccaccagctgaacatctgttccaaagtcaaagctgaggtgcagaatctcggcggtgagctaatcgtgtccggattggacagtgcgacttctctaatccaggctgccaaaaacctcatgaacgccgtcgtgctgaccgtgaaggcgtcttatgtggcttcaaccaagtaccaaaaggtgtatgggaccgctgctgtaaactcacccgtcgtgagctggaagatgaaggcgccagagaaaaaacctctggtgaagcgcgaaaagccggaagagttccagacacgggtccgacgtggaagccagaagaagcacatctcccccgtccaggccctcagtgagtttaaggccatggactcgttttag

SEQ ID NO: 217242 - DNA, 2862 bp, Artificial Sequence
  Description of Artificial Sequence: Synthetic coding sequence
atgacttcggcaacgagccctatcattctcaagtgggatcccaaaagcctagaaatcaggacactcacagtggaaagactgttagagccattagtgacacaggtgacaacgcttgtgaatacttctaataagggcccatctggcaaaaagaaggggcgttccaaaaaggcacacgtgttggccgcttccgtggaacaggcaacacaaaatttcctagagaagggcgagcagatcgctaaagaatcacaggacctaaaggaggagcttgtagctgctgtggaagatgttagaaaacaaggcgaaacgatgagaatagcctcatcagaattcgccgatgacccttgctctagcgtgaagagaggcaccatggtcagggctgctcgcgcactcttgtcagctgttacccgcttattaatattggccgacatggccgacgtgatgagactgctttctcacctcaaaatagtcgaggaggctttggaggccgtgaagaatgcgaccaacgaacaagacctggctaaccgctttaaagagttcggaaaggagatggtgaagcttaactacgttgctgcgcgtcggcagcaggaactgaaggaccctcattgtagagatgaaatggccgcagctagaggcgctctcaaaaaaaatgctactatgctgtacactgcatcacaggctttcctgcgccatcctgacgttgcagctacccgggcaaaccgggattatgtatttaaacaggtgcaggaggcgatcgctggaataagcaacgccgcacaggcgacatcgccgaccgatgaagcgaaaggacataccggaatcggcgaattggccgcagcgctgaacgaatttgataacaagataatactagaccccatgacattctctgaggccaggttcaggcctagtctcgaggaaagactggagagcatcatctccggcgcagctctgatggccgacagttcctgtactcgcgacgatcgaagagaaagaattgttgccgaatgtaatgcagtgcgtcaggcccttcaagatctgttatctgaatacatgaataataccgggcgaaaggaaaaaggagacccccttaacattgcaatcgacaaaatgacaaaaaagactagggacctgaggcgccagctccgtaaagcagtaatggatcatatttctgatagctttctagagaccaacgtaccattgcttgttctcatcgaggcggctaaatcgggtaatgagaaagaggtgaaggagtacgcccaggtgtttcgtgagcacgccaacaaactggtagaagttgctaatctagcttgtagtataagtaataacgaagaaggcgtgaagctcgtccggatggcagccactcaaattgactccttgtgtcctcaagtgattaacgcggcactgactttggccgctcggcctcagagtaaggtggcccaagataatatggacgtctttaaggatcaatgggaaaaacaggtaagagtactgaccgaggctgtcgatgacataacgtccgtggacgatttcctctctgttagcgagaaccacatcctcgaagatgttaacaaatgtgtgatcgctttacaggagggcgatgtggacacgctggatcggaccgctggggctattcgcggacgagctgcccgagttatccacataattaacgcagagatggagaattatgaggctggagtgtacacagaaaaagtgctggaggccacaaagctactcagtgagactgtgatgcccaggttcgccgaacaggtggaggttgcgatcgaagcgttgagtgccaatgtgcctcagccattcgaagaaaatgaattcatcgatgcctcccgactggtctatgatggtgttcgcgatatacgaaaagctgtgttgatgattcgaaccccagaagagttggaagatgacagcgactttgaacaggaggactacgacgtcagaagccgtacatcggtgcaaactgaggacgaccagctcattgcagggcaaagcgctcgagccatcatggcacagttaccacaggaggaaaaagctaagatcgcagagcaggtggagatattccaccaggaaaaatcgaagttggatgccgaggtggctaaatgggacgacagcggaaatgatatcattgttctggcaaaacagatgtgcatgataatgatggagatgactgacttcacacgtggtaagggcccactgaagaacacttctgacgttatcaatgccgctaagaaaatagccgaggcgggtagtcgcatggacaagctggctcgcgcagtagcggatcaatgtcccgattccgcctgcaaacaggacctcctcgcgtacctgcaacggatcgctctatattgccaccagcttaatatatgcagcaaggttaaggccgaggtgcaaaacttgggaggtgagttgatcgtgtctggcaccggcgtgcaaagcactttcacgacattttacgaggtcgattgtgatgtcattgatggtgggagagcatctcagctcagcacacatctgccgacctgtgccgagggggctccgatcgggagcggaagctccgactcctctatgctcgactccgccacatcactgattcaggccgcaaagaatctgatgaacgctgtcgtgctgactgtcaaagcaagctacgttgcctccacaaagtaccaaaaagtatacggcacagccgcagttaattcccctgttgtgtcatggaagatgaaagctcctgagaagaagccgttagtgaagcgggagaagcccgaagagtttcagacacgagtacggcgaggctcgcagaagaaacacatatcccctgtgcaagccctgtcagagttcaaagcaatggacagcttctag

SEQ ID NO: 217243 - DNA, 354 bp, Artificial Sequence
  Description of Artificial Sequence: Synthetic coding sequence
atgacatctgcaacaagccctatcatcctcaaatgggaccccaaatcactggagatccggactctgaccgttgagagactcctggaacctttggttacacaggtcactaccttggtcaatacttccaataaaggaccatccgggaagaagaaagggaggtctaagaaggctcacgtgctggccgctagcgtcgagcaagctacccaaaatttcttggagaagggtgagcagatcgcaaaagaatctcaggatctgaaggaagagctggtcgcggcagtggaggacgtgcgtaagcaaggtgagaccatgcgcattgccagttcggaatttgcagacgacccttgctcatcatag

SEQ ID NO: 217244 - DNA, 201 bp, Artificial Sequence
  Description of Artificial Sequence: Synthetic coding sequence
atgacctccgccacaagtcccattattctcaaatgggaccccaagtctctggaaatcagaacgctcacggttgagcggctgcttgagcctctcgtgacacaggtgacaacactggtaaatacttctaacaagggccctagtggcaaaaaaaaaggacggagtaagaaagctcatgtcctggcagccagcgttgaacaatag

SEQ ID NO: 217245 - DNA, 2718 bp, Artificial Sequence
  Description of Artificial Sequence: Synthetic coding sequence
atgactagcgccacctctccaatcatattgaagtgggaccccaaaagcctggagatccggacgctgacggtcgagcgcctgttggagccactggtgactcaggtcactacgttggtgaacacatcaaacaaaggaccttccggaaaaaagaagggcaggtcaaagaaagcccacgtcctcgccgcatcagttgaacaagccacccagaactttctggagaaaggagaacaaattgcgaaagaaagtcaggatctgaaagaagagttggtggcagctgtcgaggacgtgaggaagcaaggagaaacaatgcggatcgcttctagcgaatttgccgatgacccatgctcttctgttaagcgcggaactatggtgcgagccgcaagggctcttttgagcgctgtcaccaggctgctcatcctggccgatatggcagacgtaatgaggcttctgagtcacttgaaaattgttgaggaggccctcgaggctgtgaagaatgctacaaatgaacaggatctggccaatcggttcaaggagtttggaaaagaaatggtgaagctcaactacgtggcggctcgcagacagcaagagctcaaagacccccactgtcgcgatgagatggcggctgcaagaggagctctgaaaaagaacgccacaatgctgtacacggccagtcaggccttcttaaggcaccctgatgtggcagccacgagggctaacagggactacgtattcaaacaagttcaggaagctatcgccggtatttctaatgccgcacaggcaaccagcccgacagatgaggctaagggtcacaccggaattggcgagttggcagccgcactgaatgaattcgataataagattatcctggatcccatgacatttagtgaggcacggttccgcccttcccttgaggaacggctggagtccattatctctggggcagctcttatggccgatagttcgtgtacacgcgatgacagacgtgagcgtattgtggctgagtgcaacgccgttagacaagctctgcaggacctcctatcagagtacatgaataatactggccgtaaagagaaaggcgaccctctgaacatagctattgataaaatgaccaagaaaaccagggacctgcggcgacagcttcgcaaggccgtgatggaccacatttcagacagttttttggaaacaaatgtgccgttgctcgttttgatcgaggccgctaagtctggcaacgagaaagaggtgaaagagtatgcacaagtcttccgcgagcatgctaataagctggtggaggtggcgaatctggcttgtagcatatcgaataatgaggagggcgtcaagctggtacgaatggctgccactcagatcgattccctgtgccctcaagtgataaacgccgcacttaccctggcagcgaggcctcagtctaaggtagctcaggataacatggatgtcttcaaggaccaatgggagaaacaggtgagggttcttacagaggcagttgacgacattaccagcgtagatgatttcctctctgtgtctgagaatcacatcctcgaggacgttaataagtgcgttatcgccttgcaggaaggcgacgttgacaccctcgatagaaccgctggtgctattcgcggacgggctgccagagttatccatatcattaatgctgaaatggaaaactacgaggccggtgtgtacactgagaaagtcctggaggccactaaactcttgtccgaaacagtgatgcccagattcgccgagcaagtggaggtcgcaatcgaagcactgagcgccaatgtgccacaaccttttgaagagaacgaatttatcgacgctagcagactggtctacgatggtgtacgggacattcgaaaagctgttctgatgataaggacccctgaagaattggaggatgacagcgacttcgaacaggaggactatgacgtccggtctcgtacctcagtgcagactgaggacgatcagctcatcgcaggacagagcgcccgtgccatcatggcgcagctcccccaggaagagaaagcaaagattgcggagcaggtggagatctttcatcaggagaagagcaagctcgacgcagaagtggccaaatgggacgatagcggcaacgatattatcgtgttagctaaacagatgtgtatgattatgatggagatgactgactttacccggggaaaaggtccgctgaagaacaccagcgacgtgatcaatgccgcaaagaagattgctgaggctggctcccgcatggataagctggctagagctgtcgccgatcagtgtcctgactccgcctgcaagcaggacctgcttgcctatctgcaaaggatcgccctatactgccaccagcttaacatctgttccaaagtaaaggcagaggtgcaaaatctcggcggagagctgatcgtgtctgggctcgattccgcaacctctctgatccaggccgcaaaaaatctgatgaatgccgtggtcttaactgtgaaggcttcgtatgtggcttccaccaagtatcaaaaagtgtacggcacagcggctgtgaattcccccgtcgtgtcatggaaaatgaaagcccctgagaaaaagcccctcgtgaagagagagaaaccagaagaatttcagacgcgcgtaaggcgcggaagtcaaaagaagcatatatccccagtgcaagctctctccgaattcaaagccatggatagtttttag

SEQ ID NO: 217246 - DNA, 2718 bp, Artificial Sequence
  Description of Artificial Sequence: Synthetic coding sequence
atgacctccgcaaccagccctattatcctgaaatgggatcccaaaagcctcgaaatacggaccctgaccgtggaacggctgcttgagcccctagttacacaggtgacaaccttggtaaatacaagcaacaaagggccttccggtaagaaaaagggcagatcaaaaaaggcacatgttctggctgccagcgtggaacaggcaacgcagaactttcttgaaaagggcgaacaaatcgctaaggaaagccaggacttaaaggaagagctggttgctgcagttgaggacgtgaggaagcagggcgagactatgcgcattgcttcctccgagtttgccgacgatccttgttcatctgtgaaacgtggaaccatggttcgtgctgctcgggctttgctttctgctgttacacggctcctcattttagcagatatggctgatgttatgcgcctgctgagccacctcaagatcgtcgaagaggctcttgaagcagtgaagaacgcgacaaatgaacaggacctagcaaataggttcaaagagttcggaaaggaaatggtgaagctaaattacgtggcggcaagaagacagcaggagctgaaagatccacactgcagagatgagatggccgctgccaggggcgctttgaagaagaacgctacgatgttgtacaccgcttctcaagccttcttaagacaccccgatgtcgctgcaactcgggcaaatcgcgattacgtgtttaaacaggtacaggaagcaatcgctgggatcagcaatgctgcccaggctacatcccctacagacgaagccaagggccacaccggtattggcgaactggccgcagccttaaatgaatttgataacaaaattattctggaccctatgaccttctcagaggctcgttttcgcccatcccttgaggagcgattggaatccataattagcggagctgccctcatggccgatagttcctgtacgcgcgacgatagacgggagaggattgtagccgaatgtaacgcagttcgacaagcactgcaggatttactgagcgaatacatgaacaataccggcagaaaggaaaagggggacccactgaacattgcaatcgataagatgaccaaaaagaccagggacttgagaaggcagctccggaaggcggtaatggatcatatcagtgactcctttctggaaactaacgtgcctctgcttgttctcatagaagccgctaagagcggcaatgagaaggaagtgaaggaatatgcccaggtgttcagagagcacgccaataagttagtggaggtcgctaatttggcgtgttcaatatctaacaatgaagagggggttaagctcgttcgaatggcggctactcagatcgatagtctctgtccacaagttattaacgctgccctgacactggccgctcggcctcagtctaaagtggctcaggacaatatggacgtcttcaaggatcagtgggagaaacaggtgcgtgtacttaccgaggctgtggacgatatcacttccgtcgacgatttcttgagcgtttctgagaaccacatccttgaagatgtgaataaatgtgtgattgccctgcaggagggggacgtcgacacactggatcgaacagcaggagctataaggggcagagccgcaagagtaatccatattatcaatgccgaaatggaaaactacgaagccggagtgtacactgagaaggtactggaggctacaaaactgctgagcgagacggtcatgccacggttcgccgaacaagtggaggtagctatcgaggccctgagtgctaatgttcctcagccattcgaagagaacgagttcatagacgcctctcgcctggtgtatgacggcgttagagatatccgaaaggcagtgcttatgattcgcacccccgaggagctcgaggacgactccgatttcgaacaggaagactacgacgtgagatctcggacttccgtgcagacagaggacgaccagctgatcgccggtcagagcgcccgagctatcatggcacagctgccccaggaggagaaggccaaaatcgccgaacaggtggaaatcttccatcaggaaaagtctaagctggatgcggaggttgcaaagtgggacgattccggaaacgatatcattgttcttgcaaaacaaatgtgtatgatcatgatggagatgaccgattttacgcggggaaaggggccactgaagaatacatccgatgtgataaacgccgctaagaagatcgcagaggcgggatcaaggatggacaagctggctagggcagttgccgatcagtgccctgatagcgcctgcaagcaggatctgctggcgtatctgcaacgcattgctctctactgccaccagttgaacatctgcagcaaggtgaaagccgaggtgcagaacctgggcggagaactgatcgtgagtggattagactccgctacatctctcatccaggccgctaaaaatttgatgaatgcggtggtactgacggtcaaagcctcttacgtggcctcaacaaaataccagaaagtgtacggaacagcagcagttaattctcctgtggtctcctggaagatgaaggcaccagagaagaaacctcttgtaaagagagagaagcctgaggaattccagacaagggtaagacgtggaagccaaaagaagcatatctcaccggtgcaagcgctcagcgaattcaaggcaatggacagtttttag

SEQ ID NO: 217247 - DNA, 2583 bp, Artificial Sequence
  Description of Artificial Sequence: Synthetic coding sequence
atgacctctgccaccagcccaatcatcctgaagtgggaccccaaatcattggagatccgcaccctcaccgtggaaaggttgctcgagcccctggtgactcaggtgacaacccttgtgaatacatccaataagggtccatccggtaagaagaaggggcgatctaagaaagcacacgtgctcgctgcctcagtggagcaggcaactcagaattttctggagaagggggaacaaatcgccaaagagtctcaggacttaaaagaagagttggtggcggctgtggaggatgttcggaaacaaggcgaaactatgcgtattgccagtagtgaattcgccgatgacccttgttcctctgtcaaaagaggcaccatggttagagctgccagggcactgttaagtgcagtcaccaggctgctgatcttagcggacatggccgacgttatgagactcttgtcgcatctcaaaatcgtagaggaagccctcgaggccgttaaaaatgccacaaatgaacaagatctggccaaccgctttaaagagtttgggaaagaaatggtcaagctcaactatgtggcggctcggagacagcaggagctgaaggatcctcactgcagagacgaaatggcagccgcacgcggagccctgaagaaaaatgccactatgctgtacactgctagccaagcctttcttcgccatccggatgtggcggctaccagagcaaacagagattatgtgttcaaacaggttcaagaggctatcgccggtatcagtaacgcggcacaggcgacaagtcccactgatgaggccaaaggccacacaggcattggagagctggcagctgccctgaacgagttcgataataagatcattctggatcccatgacttttagcgaggcgagatttagaccctccctagaggagcgcttggagtcaattatctctggagcagccttaatggccgactcttcctgcacacgcgacgataggagggagcgaattgtggccgagtgcaacgccgtaaggcaggcactgcaagacctgctgtcagagtatatgaacaacacaggacgcaaagagaagggagaccctctcaatatagccatcgataaaatgaccaagaaaacccgcgatctccggcgacagctgagaaaagctgtgatggaccatattagtgactctttcctcgagaccaatgttccactgctggtactgatcgaggcggcaaagtctggcaacgaaaaagaggtgaaagaatacgcacaggtcttccgggagcacgcaaataaactcgtggaggttgccaatctggcttgcagtatttctaacaatgaggaaggcgtaaagctggtgcggatggctgctactcagattgattcactgtgtccacaggtgataaacgcagccctcaccctcgctgctaggccacagagtaaggtcgcccaggataatatggacgtttttaaggaccaatgggagaaacaggtccgggtactgaccgaggcagtggacgacattaccagcgtagatgatttcctgagcgtctccgaaaatcacatactagaagacgtcaacaaatgtgtgattgcgctgcaagagggcgacgtagacacccttgatcgcaccgccggagccataagaggccgagcggctagagtgatccatatcattaacgctgagatggagaattacgaggccggagtttatacagaaaaggtgttagaggcgacaaagttactctcagaaacggtgatgcctaggttcgctgagcaagttgaagttgccatcgaggcactgtcggctaatgttccccagccctttgaggagaacgagtttatagacgctagccgactcgtatacgacggggtgcgagatatcaggaaggctgtccttatgatacggacccctgaggagctagaggacgattccgatttcgagcaggaggattacgatgtgagaagcagaaccagtgtgcagaccgaggacgatcagctcattgctgggcagtccgctagagctatcatggctcagctgccccaggaagagaaagctaagatagcagagcaagtcgagattttccaccaagagaagagtaaactcgacgccgaggtggctaagtgggacgattcaggcaatgacatcattgtgcttgcaaagcagatgtgcatgatcatgatggagatgactgacttcacacggggaaagggccctttaaagaataccagtgacgtcatcaatgccgcaaagaaaatagcagaggctggctccagaatggacaagcttgccagggcagtggctgaccaactcgattcggctaccagcctgatccaggctgcaaagaatttgatgaacgcggtggtcctcacggttaaagcctcatacgttgcttcaacaaagtaccaaaaagtttacggcacagcggcagtgaattctcctgttgtgagctggaaaatgaaggctcccgaaaagaagcccctggtaaagagggaaaaacctgaagagttccagaccagagtgagaaggggatctcagaaaaagcatatcagcccagtgcaggctttaagcgagttcaaggcaatggactcattttag

SEQ ID NO: 217248 - DNA, 2718 bp, Artificial Sequence
  Description of Artificial Sequence: Synthetic coding sequence
atgacctctgcaacgtcccccataatactcaaatgggaccctaaatccctggaaatccggaccctgacagtggaaagacttctcgagcccctggtcactcaggtaaccacgttagtgaacacatccaacaagggcccatccggcaaaaagaagggacgttccaaaaaggcacacgtgctcgcagccagcgttgagcaagcaacccaaaactttctggaaaagggcgaacagatcgcgaaggagtcccaggacctgaaggaggaactcgtggccgcagtggaggatgtaaggaaacaaggggagactatgcggattgcatctagtgagttcgccgatgatccgtgttcctctgttaaacgcggtaccatggtgcgggcagccagggctttgctgtccgcagtaacacgcctactcatcttagcggacatggctgacgttatgagactgttatctcacctgaaaatcgtggaggaggccctagaggcagtgaagaacgcaacgaatgaacaagacctggccaatcgctttaaggaatttgggaaggaaatggtcaagttaaactacgtagcagcccgacgccagcaggaattaaaggaccctcattgtagggacgagatggcggcagcacgcggagcactgaaaaaaaatgcaacaatgctctacactgcctctcaggcattcttgagacatcccgatgttgccgcaacaagggccaacagagactacgtgtttaaacaggttcaggaggcaatagcaggcattagcaacgcagcccaagcaactagccccaccgatgaggcaaagggccacacaggaatcggggagctggctgccgctctgaatgagttcgataacaagataatattggatccaatgacatttagcgaggcacgattccgcccaagcctggaggagaggctggagtcgataatttccggagctgcacttatggctgattcgagctgcacgcgtgatgaccggagagagcgcattgtggccgagtgcaacgcagtgaggcaggcactgcaggacctactgtctgagtatatgaataataccggacgaaaggagaagggcgatccgttgaacatcgccattgacaagatgaccaagaagacccgggacttacgcaggcagctgcgtaaggctgtgatggatcatatcagcgacagctttctggaaacaaacgtccctcttttagtcctgattgaagccgctaagagcggaaacgagaaggaggtgaaagagtacgcacaagtgttcagggaacatgcaaacaagctcgtggaagtcgctaacctggcttgctctatctccaataatgaagaaggggtaaagctggtgcgtatggcagctacacaaattgactctctttgcccacaagttatcaacgctgcactgaccctcgccgctagaccccagagtaaggtggcgcaggacaatatggacgtcttcaaggatcagtgggaaaagcaagtgcgggttctcacggaggcagttgacgatattacctctgtggatgatttcttatctgtgtccgagaatcacatcttggaggacgtgaataaatgcgtcattgcgctacaggaaggggacgtggataccctagatagaaccgcgggagccattcggggaagagccgcaagagtgatacatattattaacgcagagatggaaaattatgaagccggagtctataccgagaaagtcctcgaagcaacaaaactcttgtccgaaactgtgatgcctcgcttcgcagagcaggtggaggtggccattgaggcacttagcgctaacgtcccccagccctttgaagagaacgagtttatcgacgctagccgcctagtgtacgatggggtgagggatattagaaaggcggtcctgatgatcagaactcctgaagaactcgaagacgattctgactttgagcaagaggattacgacgttcgaagccgcacttccgtccagaccgaagacgaccagcttattgccggtcagagcgcgagagccatcatggcacagctcccacaagaggagaaggcgaaaatagccgagcaggtggaaatcttccaccaggagaagtccaaactggacgctgaggtggctaaatgggacgactccggcaatgacattatcgtgttggcaaagcagatgtgtatgatcatgatggaaatgaccgacttcacgcggggtaagggccctcttaagaacactagtgatgtaatcaatgctgccaagaagatcgcggaagccggttcacgaatggataagcttgccagagctgtcgccgaccagtgcccagactccgcctgcaaacaggacctgctggcatacctgcagcgcatcgccctatactgccatcagctgaatatctgctcgaaagtgaaagccgaggtccagaacctgggcggagaattgattgtcagcggcctggatagcgcaacctccctgattcaggcagccaaaaacttaatgaacgccgtcgttttgactgtaaaagctagctacgtcgcctctactaagtatcagaaggtttacggaaccgctgctgtgaactcccctgtggttagttggaagatgaaagctccagagaagaagcctcttgtcaagagagagaagccagaggagttccagacaagagtcaggcgagggtcgcagaagaagcacatttctccggtgcaggctctgagcgaattcaaggccatggactcgttttag

SEQ ID NO: 217249 - DNA, 582 bp, Artificial Sequence
  Description of Artificial Sequence: Synthetic coding sequence
atgagtgcagaaacgccaatcaccctgaatattgaccctcaggacctgcaagttcagaccttcacagtggagaagctgctggagcctctgatcattcaggtaaccacactggtgaactgcccacaaaacccatcttcccgcaagaagggacgaagcaagcgggcttccgtgctactcgctagcgtggaggaagcgacgtggaacctgttagataagggagagaagattgctcaggaagccacagtccttaaggacgaactgacagccagcttagaggaagtcaggaaggaatcagaggccttgaaggtcagcgcggaacggttcactgatgacccctgctttttgccaaagagggaggctgtggtgcaggcggctcgcgctttgctggcagccgtgactaggttgctgatcctggctgatatgatcgatgtgatgtgcctcctgcagcacgtgtctgctttccagcgtacatttgagtccctgaagaacgtggccaataaatcagacttacagaagacatatcagaagctgggcaaagagctcgaaaacttggactatctggccttcaagagacagcaatag

SEQ ID NO: 217250 - DNA, 705 bp, Artificial Sequence
  Description of Artificial Sequence: Synthetic coding sequence
atgacgcagctgccggaagccgagaaagaaaagattgctgaacaggtcgccgatttcaaaaaagtaaagagcaaacttgatgccgaaatcgaaatttgggacgatactagtaatgatataatagtgcttgccaaaaacatgtgcatgattatgatggagatgacagatttcactagaggcaagggccctttgaaacatactaccgatgttatttatgccgctaaaatgatcagtgagtccggctcacgaatggacgtactcgctagacaaattgctaatcagtgccccgacccatcctgtaaacaggacctgttagcctacttggaacaaattaaattctatagtcatcaacttaaaatttgcagccaggtcaaggcagaaattcagaatctgggcggtgagctcattatgtcagccctggactctgtaacaagccttatccaggctgctaaaaatcttatgaatgccgttgtccagaccgttaaaatgagctatattgcctctaccaagatcatcaggattcagtccccagctgggccaagacaccctgtcgtcatgtggaggatgaaagccccagccaaaaaacccctcatcaagcgggagaaacctgaagagacatgcgctgctgtgcgcagaggcagcgcgaaaaaaaaaattcatcctctgcaggttatgtcggaatttaggggaaggcagatctattag

SEQ ID NO: 217251 - DNA, 2688 bp, Artificial Sequence
  Description of Artificial Sequence: Synthetic coding sequence
atgagcgccgagacgcccatcaccctcaatattgatccacaagacctgcaagtgcagacattcaccgttgagaagttactggagcccttgatcatccaggtgacaactctggtgaactgtccccaaaatcccagctccagaaaaaaaggaaggtctaagcgcgcatcagtgctcctggcctctgtggaggaagccacgtggaacctattggataagggtgaaaaaatagcccaggaagccactgtgctgaaggatgagcttactgctagtctggaagaggtaaggaaggaatctgaggccctcaaagtgtcagcagagcgctttaccgatgacccttgcttcctgcctaagagggaggcagtcgtccaagcggcaagggcgctcctggcagcagtgacgaggctactgatcttagcagacatgatcgacgtcatgtgtctactccagcacgtgagtgcctttcaacgcacttttgagtctctgaaaaacgtggccaacaaatcagacctgcagaagacttaccagaagctgggaaaagaactagagaacctggattatctcgcctttaagcgccagcaggacctgaaaagccctaatcaaagggacgaaatcgctggggcacgagcgtctctcaaggaaaacagtcctctgctgcatagcatttgcagcgcctgtctggagcactctgacgttgcaagtttgaaggcgagcaaggataccgtctgtgaagaaattcagaatgctctcaatgttattagcaatgcttcccagggaattcagaacatgacaactcctccagaaccacaggcggcaacactcggatccgccttggatgagctggaaaacctaatcgttctgaacccattgacggtcacagaagaggaaatacgcccttcccttgagaaacgtctcgaagccatcatctctggcgcagctcttctggctgactcgtcgtgcaccagggacctgcaccgcgaacgcattatcgcagaatgcaacgcaatccgccaggctttgcaggatcttctgtcggaatacatgaacaatgctgggaaaaaagaacggtccaacacactcaacattgccttggacaacatgtgcaagaaaacacgcgaccttcgcagacaattacgcaaagctatcattgaccacgtgtctgattcatttctcgatacaactgttcccctgttggtgttgatagaagcagccaagaacgggagggaaaaagaaattaaagagtacgcagccatcttccatgaacatacaagccgactggtggaggtggctaacctggcgtgctctatgtccaccaacgaggacggcatcaagatcgttaagatagctgccaaccatctcgagaccttatgccctcagatcataaatgctgccctcgccctcgccgctcggccaaagtcacaggccgtcaaaaacactatggagatgtacaagaggacttgggaaaatcatatacacgtgctgacagaagccgtggatgatattacctcaatcgatgattttctcgccgtttcagaatcccatattttggaagatgtgaataagtgcattatcgccctcagagaccaggatgcagataaccttgacagagctgccggtgccatacgcggaagggccgcacgtgtggcccacatcgtgacaggcgagatggactcgtacgagccaggggcatatacagagggtgtcatgcgcaacgtcaactttctcactagcactgtaatcccggaatttgtgacccaggtgaatgtggcccttgaagccctgtcaaaatcctccctgaatgtgctcgatgataaccagtttgtggatattagtaagaagatatatgatacgatccatgatatacgctgttcagtcatgatgattaggacccccgaagaactggaagatgtatcggacctcgaggaagagcacgaggtccgctcccacacttctatccagaccgagggcaagacggaccgagctaaaatgacgcaactgccagaagcagaaaaagaaaagattgccgagcaggtggccgatttcaagaaggtgaagtccaagttggacgctgagatcgaaatttgggatgatacgtcaaatgacatcatcgtgctggctaagaatatgtgtatgatcatgatggagatgaccgacttcaccaggggtaagggacccctcaagcatacaaccgatgtcatttacgccgcaaaaatgatttccgaaagtgggtctcggatggacgtgctagctaggcagatcgccaaccagtgccctgaccccagctgcaaacaggacttgctcgcctacttggagcaaatcaaattttatagccatcagttaaaaatctgctcccaggtgaaagccgaaattcagaatctcggcggtgagttaatcatgtccgcgctagattccgtaacatcgctgatccaggctgcaaagaacctaatgaacgcggttgtgcagactgtgaagatgagttacattgcttcaaccaagattatccggatccaatcgccagcagggccaagacaccctgtggtaatgtggcggatgaaggctcctgctaaaaagccactgatcaaaagggagaagcccgaggaaacctgtgccgcagtccggaggggcagtgccaaaaaaaaaatccacccccttcaggtgatgtctgaatttagaggacgtcagatttattag

SEQ ID NO: 217252 - DNA, 2688 bp, Artificial Sequence
  Description of Artificial Sequence: Synthetic coding sequence
atgtcagctgaaacccctattaccctgaatatagacccacaggacctgcaggttcagaccttcacggtggaaaaacttcttgagcctcttataatacaggtgacaacactcgtcaactgtccgcaaaacccctcctccaggaaaaaaggccgttccaaacgcgcaagcgtcctgctggcctctgtggaggaggccacctggaatctactcgataagggcgagaagattgcccaggaggccaccgtcctgaaggacgaactgaccgctagcctcgaagaagtgcgcaaggaatcagaagcactcaaagtgtccgccgagcgcttcaccgatgatccttgctttctgcccaagcgggaggccgtggtgcaggccgcacgcgctctgctcgccgcagttacccgtctcctgatcctagctgatatgatcgacgtcatgtgcctcttgcagcatgtttcagcgtttcagcgtacctttgaaagcctgaaaaatgttgccaataagagcgacctgcagaaaacatatcagaaactgggtaaagaactcgaaaacctggattatctcgcgtttaaacgtcagcaagacctgaaatctcctaatcagagagatgaaatagcaggcgctagggctagtctgaaggaaaatagcccactcctgcattccatttgcagcgcctgcctggaacattccgatgtggcctcccttaaagcctccaaagacactgtttgtgaggagatccagaatgcgcttaacgtaattagcaacgcttctcagggcatccagaatatgacaacacccccagagccgcaggctgcgaccctggggtcagccctggatgagctcgaaaacttgattgtgctgaacccactcaccgtcactgaagaggagattagaccatcattggaaaagcgcctcgaagcaattatcagcggggcagcgcttctagctgatagttcctgtacacgggatcttcatagagagagaatcattgcggaatgcaatgccatccggcaggcgctgcaggatctccttagtgagtacatgaacaatgcgggaaagaaagaaagatctaataccttgaacattgcactggacaatatgtgcaagaagacacgcgatttacgccgacagttgcggaaggctattatagaccacgttagcgatagctttctggataccaccgttccccttctggtgctaatcgaagccgctaagaacgggcgagaaaaagaaataaaagaatacgctgctatttttcacgagcacacctcccggcttgtagaagtggccaacctagcttgcagtatgagtactaatgaggacgggatcaagattgtcaaaatcgctgctaaccatctagaaactctgtgccctcagatcatcaatgccgctctcgctttggctgccagacccaagagccaggccgtaaagaatactatggaaatgtacaagagaacatgggaaaaccacatccacgttctcacagaagccgtagacgatataacaagtattgatgactttctcgctgtctctgaaagccacatcctggaggatgtgaataaatgcatcattgcactgagagatcaggacgcagacaacttggatcgcgcagcaggcgctataagaggtcgtgctgctagggtggcacacatagtgaccggcgaaatggatagttatgaacccggagcctacactgagggcgttatgaggaacgtgaatttcctcactagcacggttatcccagagtttgtgacgcaggtgaacgtagcattagaggctctgtcaaaaagctctctcaatgttctggatgataaccaatttgtcgatatttctaagaaaatttatgacaccatacatgatattcggtgctcagtaatgatgattcggactcctgaagagctggaagatgtatctgaccttgaggaagagcatgaagtgcgtagtcatactagcatccaaacggagggcaagactgacagagcaaagatgactcagctccccgaagcggagaaagaaaaaatagctgaacaggttgccgactttaaaaaagtgaagtcaaaactggatgccgagatcgaaatctgggatgacacctccaacgacataatcgtcctggctaagaacatgtgcatgatcatgatggaaatgactgacttcactagaggcaagggtccacttaaacacacgacagatgtgatctacgctgcgaagatgattagtgagtccggatcgcgtatggacgtacttgcgagacagatagcgaaccagtgtccagacccatcctgtaagcaggatctcctggcatacctggagcagatcaagttttatagccatcaacttaaaatttgtagtcaggtcaaggccgagatccaaaatctgggcggagagctgattatgtctgccctggacagtgtgacatccttgatccaggcagcaaagaaccttatgaatgcggtcgtgcaaacggtcaagatgagctacattgcctctactaagatcatccgcattcagtcccctgccggaccccgacacccagtagtcatgtggaggatgaaagcccctgccaaaaagccattgatcaagagagaaaagccagaagaaacctgcgccgcagtgcgcaggggctcagccaagaagaaaattcaccccctgcaagttatgagcgagttcagaggccgtcaaatttactag

SEQ ID NO: 217253 - DNA, 1131 bp, Artificial Sequence
  Description of Artificial Sequence: Synthetic coding sequence
atgtccgcggaaacccccatcactcttaacatcgacccccaagatctccaggtccagactttcacggtagagaagctgttggagcctctgatcatccaggtgaccacactggtcaactgtccacagaatccctcctctaggaagaagggcagaagtaaaagagcctccgtgttgctggcctcagtggaagaagccacctggaatctacttgacaagggagaaaagatagcccaggaagctaccgtactgaaagacgagctgactgcatcccttgaggaagtcagaaaggagtctgaggctcttaaagtcagcgctgaacggttcaccgatgacccctgcttcctcccaaaaagggaggctgtggttcaagctgcgagagcgctgcttgctgctgtcacaagacttctgattctcgccgatatgattgacgttatgtgtctgctccaacacgtgtctgcctttcaaaggaccttcgagtctttgaaaaacgtggctaataagtcagatctgcagaaaacctatcagaaactcggaaaggaactcgagaacctggactacctggctttcaaacgccagcaagatctcaaatcacctaaccagagagacgaaatcgccggagctcgcgctagtttgaaagagaactcccctctgcttcactctatctgctctgcctgtcttgaacattccgatgtggccagcctaaaagcttcaaaagacaccgtgtgtgaggaaatccaaaatgcactcaacgtcatctcgaacgcttcccaaggcatacaaaatatgaccacacctcccgaaccacaggccgctactctgggcagtgctctggatgagctggagaacttgatcgttctcaatcccctaactgttactgaggaagagatccgccctagtttggaaaaaaggctcgaagccatcataagtggcgctgcactacttgccgatagtagctgcaccagagatctgcatcgtgagaggatcatcgccgagtgtaatgccatcagacaggccttgcaagatctgctttccgagtacatgaacaatctgtgtaatcagaagagcgatctcggactgaccggtgtgaaaatcaaactgctggaggagtgtatcattttttggtcactgtag

SEQ ID NO: 217254 - DNA, 582 bp, Artificial Sequence
  Description of Artificial Sequence: Synthetic coding sequence
atgagcgccgagacgcctattaccttaaacattgacccacaggatctacaagtacagactttcactgtggagaaactgcttgaaccactcataatccaggtgacaaccctcgtcaattgccctcagaatccatctagtaggaagaagggtcggtctaagcgtgcctccgtgctattggcttccgtggaagaagccacctggaacctgttggataagggcgaaaaaatcgcccaggaggccactgtgctgaaggatgagcttacggccagccttgaggaggtgcgaaaagagtccgaggccctcaaggtgtcagcagagcgttttactgatgatccctgcttcttgccaaaaagggaggcggtcgtgcaggccgctcgggctcttttggcagcagtcacaagactgttgatcttggctgatatgatagacgtgatgtgcttgttgcagcacgtctctgcattccagcgtacatttgaaagtctgaaaaacgtggctaacaagtccgatctgcagaaaacctaccaaaaactgggcaaggagctggagaacctggattatctagccttcaaacgtcagcagtag

SEQ ID NO: 217255 - DNA, 1131 bp, Artificial Sequence
  Description of Artificial Sequence: Synthetic coding sequence
atgtcagccgaaacgcctattacattgaacattgaccctcaggacctgcaggtgcaaacattcactgtggaaaaactgctggagccgttgatcattcaggtgacgacactggttaactgtccacagaatcctagctctagaaagaaaggccgatcgaagagagccagcgtcttactagcctcagtagaggaggcaacgtggaatcttctggacaaaggcgaaaagattgcacaagaagcgactgtcctcaaagatgagcttactgccagtctggaagaggtgagaaaggaatctgaggcccttaaagttagcgccgagcgctttacagacgacccttgttttctgccgaagcgggaggcagtagtgcaagccgcaagagctctgctggctgccgtgaccaggctccttatactcgctgacatgattgatgtgatgtgtctgttgcagcatgtctccgcttttcaacgcacgtttgagagtctgaagaacgttgcaaacaaaagtgacctacagaaaacatatcagaagctggggaaggagttagaaaacttggattatctggcattcaagagacagcaggatcttaaatcccctaatcaacgggatgagatcgccggtgcccgagcatctctgaaggagaattcccccctgctgcactcaatctgcagtgcgtgtttggaacatagcgacgtggcctccctcaaggctagcaaggacacggtgtgtgaagaaattcagaacgctttgaacgtcatcagcaatgcatcacagggcatccagaacatgaccactccccctgagcctcaggctgctaccctcgggtctgccttggacgagctggaaaatcttatcgtcttaaaccccctgacagtcactgaggaggaaatccgcccttccctggaaaagcggctggaggcaatcatctcaggtgccgctttgctggctgactcgagttgtacaagggacctgcatagagagaggatcatcgccgagtgtaacgcaattaggcaagcactccaagacttattatccgagtacatgaataacctgtgcaaccagaagagcgatctgggcctgactggcgtgaaaattaagttactagaagagtgcattattttttggagcctctag

SEQ ID NO: 217256 - DNA, 2205 bp, Artificial Sequence
  Description of Artificial Sequence: Synthetic coding sequence
atggcagcgtcccccggaccagcgggagtgggcggagcaggagctgtttacggcagcgggtccagtggattcgccttagacagtgggctggaaatcaaaaccaggagcgttgagcaaaccctcctgccgctggtgtcccagatcaccaccctgattaaccacaaagataacaccaaaaagagcgacaaaaccctgcaggccattcagcgcgtggggcaagctgtgaatctcgctgtcgggcgattcgttaaggtgggcgaggccatcgcaaacgaaaactgggatctgaaagaggagattaatatcgcctgcatcgaggcaaaacaggccggagaaaccatagccgctctgactgatatcacgaatctcaatcacctcgagagtgatggccagattaccatctttactgacaagaccggcgtaataaaagcagcaagattgttgttatcctccgtaaccaaggtgttgttgttagcggatagggtcgtgattaagcagatcatcacatcgaggaataaggtgctggccactatggagcgactggagaaggtaaattccttccaggaatttgtgcagatattctcacagtttggcaatgaaatggtggagttcgcacacctgagcggagaccgccagaacgatctgaaggacgagaaaaagaaagccaagatggccgcagcacgggctgttctcgaaaaatgcacaatgatgctcctgaccgctagcaagacctgcctgcgacaccccaactgcgagagcgcccacaagaataaagaaggggttttcgatcgtatgaaagtcgcactggataaagtgattgagattgttactgattgtaagccaaacggtgaaaccgacatcagttccatttcaattttcactgggatcaaagagttcaaaatgaatatcgaagcactccgagaaaatctatattttcagagtaaggaaaatctttcagttacactggaagtcatcttagagaggatggaggacttcacggactctgcgtacacaagtcacgagcaccgcgagagaatcctcgaactgagcacccaggcaagaatggagctacagcagctcatctcagtgtggatacaggcccagtcaaagaagaccaagtcgattgctgaggagttagagctgtctattctgaagatatctcactcactgaatgaattgaaaaaggaactgcactctaccgccacccagttagctgccgatctcctcaagtatcacgcagaccacgtagttctcaaggctcttaagctgactggggtggaaggcaatctggaggctctcgccgaatacgcatgcaaactttcggagcagaaagaacagctagttgaaacatgtcgccttttaagacacatcagcggtacagagccactcgagatcacttgcatacacgccgaggaaaccttccaggtaacgggacagcaaatcatcagcgccgcagaaacccttacgctgcatccgtctagtaagatagctaaggagaatttagacgtgttctgcgaggcatgggagtctcagatttctgacatgagcaccctcctccgcgagattaacgacgtatttgagggcagaagaggggagaagtacggctatctgtctctcccaaaacctatgaagaacaatgccaatctcaagtcactcaagcctgataagccagattcagaggagcaagctaagatcgcaaaacttgggctgaaactgggactgctgacctcagatgcggattgtgagatagagaagtgggaagatcaggaaaacgaaatagtgcagtacggacgcaatatgagctcaatggcttactccttatatttattcacacggggagaaggccctctaaagactagccaggatcttattcatcagctcgaggtgtttgctgcggaaggactcaagttgacatctagcgtccaggccttctccaagcaattaaaggatgatgataagctgatgcttctgctggaaataaacaaactgatccccctatgtcaccaactccagacggtgaccaagacctccctgcaaaataaggtgtttcttaaggtcgataaatgcatcacaaaaacacgctctatgatggcactgttggtgcagcttctgtctctctgctacaagctactgaaaaagctgcagatggagaataacgggtgggtcagcgtgacgaacaaagacaccatggactcgaagacctag

SEQ ID NO: 217257 - DNA, 1953 bp, Artificial Sequence
  Description of Artificial Sequence: Synthetic coding sequence
atggccgctagtccagggccagccggagtggggggagcgggagccgtttacggttctggctcctccgggttcgccttagatagtgggctggagatcaagactcgatcggtcgagcagaccctgctcccactggttagccagattaccaccttaatcaaccacaaagacaacactaaaaagtcagacaagacactgcaggccatccagagggtgggacaagctgtgaatcttgcagttggacgcttcgtaaaggtgggtgaagctattgccaacgaaaactgggacttaaaggaggagattaacattgcatgcattgaggctaagcaggctggagaaaccattgccgctctgacagatatcactaatctgaatcacttagagtccgacgggcaaataactatctttaccgacaaaactggggtgatcaaagcagctcgactcctcctcagctcagtgacaaaagttcttctgctcgccgacagagtcgtaattaaacaaatcatcacatcaaggaataaagttctggctaccatggaaaggctggaaaaggtcaactcatttcaggagtttgtccagatcttttcacagtttgggaacgaaatggtggagtttgcccacctgagcggagaccgccaaaacgatctgaaggatgaaaagaagaaggctaaaatggccgcagctcgcgctgtcctggaaaagtgcacaatgatgcttcttacagcaagcaagacctgcctgcggcacccgaattgcgagagcgcccacaaaaataaagagggtgttttcgatcggatgaaggtggccctcgacaaggtcattgagatagtgactgactgcaaacccaacggagagactgacatctcatctatctcgatcttcacaggtatcaaagaatttaagatgaacatcgaagctttaagggaaaatctgtacttccagtccaaagagaacctgagcgtcacacttgaggtgattttggaacggatggaggatttcacagatagtgcatacacctcccatgagcaccgtgaaagaattctcgaattaagtacccaggcacgtatggagcttcagcagctgatcagcgtctggatacaagcccagtccaagaaaaccaaaagcattgctgaggagttggaattgagcattctcaagatttctcactcgctcaatgaactgaaaaaggagatcattagcgccgcagaaacattgactttgcacccaagttccaaaatcgcaaaagaaaatctggatgttttttgcgaagcttgggagtcacaaatcagcgatatgagtaccctcctgcgcgagattaacgacgtgttcgaaggccgtcgaggggaaaaatacggatacctgagtctgccaaaaccaatgaaaaataatgccaatttgaagagcctgaagcccgataaaccagatagtgaagagcaggccaaaatcgcgaagttgggacttaaactgggacttttgaccagtgacgccgattgtgagatagaaaagtgggaggatcaggaaaacgagattgtgcaatatggtcgtaacatgtctagcatggcttattctctctacctcttcaccagaggcgaggggcctttgaaaacaagtcaagacctaatccatcaactcgaagtttttgccgcagagggcctgaagctgacgagttcggtgcaggcattctctaagcagctgaaagacgatgataagctgatgctgcttttggaaattaataaactgataccactatgtcatcagctccagacggtcacaaagacatccctacagaataaggtatttctgaaggtggacaagtgcattacaaaaacacggagtatgatggccctgctcgtgcaattgttatcactctgctataagttactgaaaaagctgcagatggaaaacaacgggtgggttagcgtgactaacaaggacactatggactccaaaacttag

SEQ ID NO: 217258 - DNA, 552 bp, Artificial Sequence
  Description of Artificial Sequence: Synthetic coding sequence
atggccgcttctccaggccctgcaggggttggaggagcaggggctgtgtacgggtccggttccagcggatttgcactcgattctggacttgagatcaagactcggagtgtggagcagaccctcctccccctagtcagtcagatcaccaccttgatcaaccataaggacaacacgaagaagagtgacaagaccttgcaggctatccagagggttggtcaggccgtaaacttagctgtgggcaggtttgttaaggtgggcgaagcaatcgccaacgaaaactgggacctcaaggaagaaataaatatcgcctgtattgaagcaaagcaggcaggagaaactatcgccgctttaaccgatatcaccaacctgaaccacctggagagcgatggccaaatcactatttttacggacaagaccggggtcatcaaagccgctcgcctgcttttatcctcagtgacaaaggtacttctgctggcagatagagtcgtcattaagcagatcatcacaagtaggaataagcgcctgacaatctataacctccgacactcttag

SEQ ID NO: 217259 - DNA, 408 bp, Artificial Sequence
  Description of Artificial Sequence: Synthetic coding sequence
atgtcgagcatggcctactccttgtacttgtttacacggggtgagggtccattgaaaacatcgcaggatttgatccaccagctggaagtgtttgcggctgagggactcaaattaacttctagtgtgcaagccttttcgaagcaattgaaggacgacgataaactcatgctcctcctggagataaacaagctgattcccttatgccatcaactgcaaacagtcaccaagacttccctgcaaaataaagtgtttctaaaggtagacaagtgtatcactaagacaagatccatgatggccctcctggttcagcttctgagtctctgttacaagctgctaaagaaacttcaaatggaaaataatgggtgggtctctgtgaccaataaggacaccatggactcaaagacttag

SEQ ID NO: 217260 - DNA, 2157 bp, Artificial Sequence
  Description of Artificial Sequence: Synthetic coding sequence
atggctgcgagcccgggacccgctggagtgggaggggcaggggctgtttacggatcagggagctccgggttcgccttagactcaggtctggagatcaagactcgctcagttgaacaaactctgctgccactggtgtcccagatcaccacgctcatcaaccacaaggataacaccaaaaaatcagacaagacgctacaggccatccagcgcgtcgggcaggctgttaacctagcggttggacgatttgtgaaagtgggagaagcaattgccaacgaaaactgggacctcaaagaggaaattaatatcgcctgcatcgaggccaaacaggcaggtgaaaccatcgcggctctcactgacattaccaacctgaaccaccttgaatcagatggccagattaccatttttactgacaaaactggggtcatcaaggcagcccgactgctgcttagctctgtgaccaaggtcttgttgctagccgacagggttgtgatcaaacagatcataacctcacgcaataaagtacttgccacgatggagagactagaaaaggtgaacagtttccaggagtttgtacagatttttagccagtttgggaacgagatggttgagttcgcgcatctcagcggagacagacagaatgacctgaaggacgaaaagaaaaaagcgaagatggccgctgcgagggccgtcctggagaaatgtactatgatgctgcttactgctagtaaaacctgtcttcgtcatcccaactgtgagagcgctcacaaaaacaaggaaggtgttttcgatcgcatgaaagtagccctggataaggttatcgagatcgttaccgattgtaagcccaatggagagactgacatctcctcgatatcaatctttaccgggattaaggagttcaagatgaatattgaggccctcagagaaaatctgtatttccagagcaaggaaaatctcagcgtgactttggaagttatcttagagcgcatggaggacttcactgattccgcctatacatcacacgagcacagagaacgcattcttgagctttctacacaggccagaatggaacttcagcaactgatcagtgtctggattcaggctcagagcaaaaaaacaaaatctatcgccgaagagctcgaattgtctattctgaaaatttcacattcactcaatgagctgaaaaaagagctgcacagcacagccacccagttggctgccgacctcctgaagtaccacgccgatcatgtggtcctcaaagctctgaaactgacaggagtggaagggaaccttgaggctttggcagagtacgcttgtaagctttctgagcagaaggagcagctggtggagacctgccgtctgctgcggcacatcagcggcacagagcctttagagattacctgcattcacgcagaagagaccttccaggttaccgggcagcagattatttccgcagctgagactctgaccctccacccaagctcaaaaatcgcaaaagagaacttagacgtgttttgcgaggcctgggagtcgcagatctctgacatgtcaacactgctccgggagattaacgatgtgttcgaggggagacgaggggagaaatacggttatcttagcctgcccaaaccaatgaaaaacaatgccaacctgaagtctctgaagcccgataaacctgattctgaagaacaggcgaagatagccaagttggggttgaaacttggactgctgacctctgatgccgactgcgaaatcgagaagtgggaagaccaggagaacgagattgtacagtatgggcgaaatatgtcgtctatggcctactctctctacttgttcactagaggggaggggccattaaaaacaagccaggacctgattcatcagcttgaagtgttcgcagccgagggcctgaagctcacctcctctgtgcaggccttctccaaacaattaaaagatgacgacaagctcatgttgctgctcgaaatcaacaagctcatacccttgtgccaccaattgcagacagttactaagacctccctgcagaataaggtattccttaaagtcgataagtgcattactaagacaagatctatgatggccctgctcgtgcaattgctttctctgtgctataagctactgaaaaaaagcgagacacggtactag

SEQ ID NO: 217261 - DNA, 2802 bp, Artificial Sequence
  Description of Artificial Sequence: Synthetic coding sequence
atggatgactctgaggtcgagtctacggccagcatcctagcctccgtcaaggaacaggaggcacagttcgaaaaattaactagagccctggaggaggagagaagacatgtgtctgcacagttagaacgcgtgcgcgtttccccacaggacgccaaccccctaatggctaatggaaccctcacccggcgtcatcagaatggccgtttcgtgggggacgccgatcttgagcgccagaagttctcagatctgaagctcaatggaccccaggatcactcccatctcttgtattcaactatcccacgaatgcaagagccaggccagatagtggagacttatacggaggaagatcctgagggcgctatgagcgttgtaagcgttgagacttctgatgacggaaccactcggaggaccgaaacaaccgtgaaaaaggtggtgaagacagttactactaggactgtgcaacctgtggcaatgggccctgacggcttacctgtggatgcaagtagcgtcagcaataactatattcagactctgggaagagacttccggaaaaacggcaacggtggccctggtccttatgtcggtcaggcgggtaccgccaccctacccaggaactttcactaccccccagacggctactctagacactatgaggacggatatccaggtggcagcgataactacggttctctgagccgggtcacgaggatagaagagcgctaccgcccttctatggagggctaccgcgctccttccaggcaagacgtctacggcccacagcctcaggtccgggtgggcggaagctcagttgacctgcaccgcttccatcctgagccctacgggctggaagatgaccaacgcagcatggggtatgacgatcttgattacggcatgatgtccgactacggcaccgccagaaggaccgggacccctagcgaccccaggcgcagattgaggagttatgaagacatgattggcgaagaagtgccttccgaccagtactattgggctccccttgcgcagcacgaacgagggtcacttgcctctctggactccctgagaaaagggggaccccctccaccgaactggcgccaacccgagctgcctgaggtgattgccatgcttgggtttcgactggatgctgtcaaaagtaatgcagccgcttatctgcagcatctgtgctatcgcaatgacaaagtaaagactgatgtaaggaaattgaaggggattcctgtactggtcggactgctagatcaccccaaaaaggaggttcatttgggtgcgtgcggggctcttaagaatattagctttggaagggatcaagacaataagattgccatcaaaaattgcgacggcgtacctgcactcgtgcggctgctgcgaaaggcccgagacatggatctgactgaggttatcactgggaccctatggaacttgtcttcccatgactccattaagatggaaatcgtagaccacgctctgcacgctctgacagacgaggtgatcatcccacatagtggctgggagagagaaccaaatgaggattgcaagccacgacacatagaatgggagtcagttctgactaacaccgccggatgtctgcgaaacgtgtcctctgagcggtcggaagccagaagaaagctgagagagtgcgacggcctcgtggatgccctgattttcatagtgcaggctgaaatcggccaaaaggattctgacagcaagttagtagagaattgcgtctgtctgctgagaaacctttcttatcaagtccatcgcgagatcccccaggctgagcgttatcaggaggccgctccaaatgtggccaataacaccgggccacacgccgcttcctgctttggagcgaagaaaggaaaaggtaagaagccgatcgaggaccccgcaaacgacacagtggatttcccaaagcgtaccagcccagcccgaggttacgaactgctctttcagccggaggtagtgcgcatctacatttccctgttaaaggaatctaagacgcctgcaatcctggaggcaagtgctggggcaatccaaaacctgtgtgctggcagatggacctacggacgctacattagaagcgcactccgccaggaaaaggccttaagcgccatcgccgacctgctgaccaacgaacacgagcgcgtggtaaaggccgcatccggagccttgaggaacctggccgtggacgctcgtaacaaggaactgattggcaagcacgcgattcccaacttggtgaagaacctgccaggtggacagcagaacagcagctggaacttcagtgaggacacggtcatttcaatcctcaacaccattaacgaggtgatcgccgagaacctcgaggcggctaaaaaactcagagagacacaagggatcgaaaaactagtgcttattaacaagtcgggtaatcggtcggaaaaagaggtacgggcagcagcccttgtactgcaaactatttggggctataaagaattacggaaaccattggagaaggaggggtggaaaaaaagtgactttcaggtgaacttgaacaacgcttccaggagtcagtcatctcatagttacgatgacagcacactaccgttgatagaccgtaatcaaaaatccgacaaaaagcccgatcgggaagaaattcagatgtctaatatggggagcaacaccaaaagccttgataataactattctacccccaatgagaggggtgatcataataggaccctggataggtcaggcgatctgggagatatggagccactaaaggggactacacccctgatgcagaaaatctag

SEQ ID NO: 217262 - DNA, 2844 bp, Artificial Sequence
  Description of Artificial Sequence: Synthetic coding sequence
atggacgactccgaggtggaatccacagcttcaatactggcctccgtgaaagaacaggaggcccagttcgagaaacttactcgcgctttggaagaggaacgcaggcatgtgtctgcccagttggagcgagtgcgggtgagtccacaggatgccaacccactgatggctaacggtacccttacaaggaggcatcagaatggaaggttcgttggcgacgccgaccttgaacgacagaaattcagcgacctgaagctgaatggaccacaggatcatagccatctgctttatagcacaattcctcggatgcaggagccgggtcagatcgtggagacctacactgaagaagatccagagggggcaatgagcgtcgtatctgtggagacctctgatgatggtactacaaggcggacagagactacagtgaagaaggtagtcaaaaccgtgaccacacgaaccgtccaaccagtggccatgggacccgatggacttcctgtagacgcttcctccgtgtccaataactatattcagaccttggggagagacttccggaaaaatggtaacggtggtcctggcccatatgttgggcaggccggaaccgccaccctcccacggaacttccactacccccctgacggctactcacgccattacgaggacggatatccaggcggaagcgacaactacggtagtctgtcccgcgtgacccgcattgaggaacgctaccgccctagcatggaaggctacagagcccctagtcgccaagatgtgtatggcccacaaccacaggtgcgcgttggagggagcagtgtggatttgcatcgctttcatcccgaaccgtatggtttagaggatgaccagagatcaatgggctacgatgacctggactatgggatgatgtcagattacggcacagccagacgcacgggaaccccctctgatccacgtcgacggttaagatcatacgaagacatgatcggggaggaggtccccagtgatcagtactactgggccccactggcacagcacgagagaggatctctggcctccctggactccctgcgaaaaggtggaccacctcccccaaattggcgccagcccgagcttcccgaggtgattgcgatgttaggatttaggttagacgcagtgaagtctaatgccgctgcatatctacagcatttgtgttacaggaatgataaggtgaaaacagatgtacgaaagcttaaaggtattccagttcttgtggggcttctagaccacccgaagaaagaggtccatctgggcgcttgtggtgcactgaagaatataagctttggacgcgaccaggacaataagattgcaattaagaattgtgacggcgtgcccgctttggttcggctgctgcggaaggcgcgagacatggatctgaccgaggtgatcactggaacactgtggaacctcagctcccacgactctatcaaaatggagattgtggatcacgcactgcacgcccttactgacgaagtgatcatcccgcacagcgggtgggagcgcgaaccgaacgaggactgcaaacccaggcatattgagtgggagtctgtcctgacgaatacagcgggttgccttcgaaatgttagctccgagcggtccgaggcaaggaggaaacttagggagtgtgatggtctggttgacgccctcattttcatcgtccaggccgaaatcggtcaaaaggattctgattcaaagttagtggaaaattgcgtgtgcctgttgaggaatttaagctaccaggttcacagggaaatcccccaggcagaacgctatcaggaagcggctccgaacgtggcgaataacaccgggcctcacgcggcttcatgcttcggagccaagaaggggaaggacgagtggttctctaggggaaaaaaacccatcgaggacccggcaaatgataccgtagatttccctaagaggacctcccccgcaagaggttacgagctgctgttccagcccgaggtggtgagaatttatatatctctgttgaaggaaagcaaaacccccgcaattcttgaggcttcagccggtgcgattcagaatctgtgcgcgggaaggtggacttacggacggtacatccggagtgctctgagacaggaaaaggctctgtccgccatagccgatttattaactaatgagcacgagagagtcgttaaggccgctagcggagccctgcgtaacctggcagtagatgcgaggaacaaagaactgataggaaagcacgcaatcccaaatctagttaagaatctcccagggggacagcaaaattcctcgtggaattttagcgaggatacagtgatctctattctgaacactattaacgaggtcattgctgagaacctggaagcagctaagaaactgagggaaacgcaaggcatcgaaaagcttgtgttgataaataagagcggaaatcgctcagaaaaagaggtcagagctgcagctctcgtgctgcagacaatttgggggtacaaggaactccgcaagcccctggaaaaagagggatggaaaaagagcgactttcaagtcaacctgaataatgcctcccggtcacaatcatcccacagttacgacgactctaccctccctctcatcgaccgtaatcaaaaatctgataataactacagcactcctaacgagaggggagaccacaacaggaccttagacaggtccggggatctgggcgacatggaaccattaaagggcacaaccccactgatgcaggacgaaggacaggagagccttgaggaggaactcgacgtgcttgtgctggacgacgaaggaggccaggtgagttacccgtctatgcagaaaatctag

SEQ ID NO: 217263 - DNA, 2889 bp, Artificial Sequence
  Description of Artificial Sequence: Synthetic coding sequence
atggacgatagtgaggtagaatctactgctagcatcctagcgtctgtgaaagagcaagaagctcagttcgaaaaactgactagagctctggaagaggagaggaggcacgtatccgcgcaattggaaagagtgagggtgagtccgcaggacgcaaatccattaatggcaaacgggacgctcactaggcgccaccagaatggtaggttcgtcggcgatgccgatctcgagaggcaaaaattttccgacctcaagctgaacggacctcaagatcactcacatcttctttatagcaccatcccaaggatgcaggagcctggccagattgttgaaacctacacggaggaggacccggagggggcaatgagcgtggtgagcgtggagaccagtgacgatggaactacccgtaggactgagaccaccgtgaagaaggtcgtgaaaaccgtaacgactagaacagtgcagcccgtggccatgggaccagacggcctgcccgtggatgcttctagtgtgagcaataactatatccagacactggggagggattttcgcaaaaatggcaatggcggtccaggcccttatgtgggacaggccggaacggccactctgccccgaaactttcattatccgccagacgggtatagccggcactacgaggacggatatcctgggggttcagataattatggttccctgagtagagtgaccagaatcgaggaaagataccgaccttccatggaaggttaccgtgccccttctcgacaggatgtgtacggaccacagcctcaggtgcgggtgggaggatcctctgttgacctgcacagattccatcccgagccctacgggcttgaggatgaccagcggagtatggggtatgatgatttagattacggaatgatgagcgactatggaacagcgcgaaggaccggaacgcccagcgatcctaggcgacgcctgaggagctacgaggatatgattggagaagaggtgcctagcgatcagtattactgggcgccactggcgcagcatgagcgcggttctttggcttcattagacagcctgcgcaagggcggtccaccacctcccaactggagacagcccgagctgcccgaagtgatcgcaatgctcgggttccgcctagatgcggttaaatcaaatgccgctgcttatctacagcacctctgctaccgcaacgataaggtaaaaaccgatgtgcggaagctgaaagggatccctgtcctagtgggcctgctggaccaccctaaaaaggaggtgcatctgggcgcttgtggggctctgaagaacataagcttcggtcgtgatcaggataacaagatcgcaatcaagaattgtgacggcgtgcccgcacttgtccggctgctgcgcaaggcaagagatatggaccttacagaagtcatcaccggcaccttatggaatctgagttctcacgatagcattaaaatggagatagtagatcatgcactgcatgccctcactgatgaagttataatcccccattccggatgggagagggagcccaatgaggactgcaaacccagacacatcgagtgggagagtgttctgaccaatacagccggttgtttgaggaatgtgtcaagcgagcggtctgaagcgagacgtaagctaagagagtgcgatggccttgtagatgcccttatcttcattgttcaggccgagatagggcagaaggattccgactctaaactggtggagaattgcgtttgtctgttgagaaacctctcgtaccaggtgcatcgtgagatcccccaagccgaaagataccaggaagccgcacctaacgttgcaaataacaccggaccccacgctgcttcatgtttcggggctaaaaaaggcaagggcaaaaaacccatcgaggatcctgccaacgataccgtggacttcccgaaacgaacctccccggcaagggggtatgagctgctttttcagcccgaagttgtgaggatttatatcagcctgcttaaggagagtaagacaccagcaatcttggaagcttctgccggtgcaatccagaatctctgcgccggtaggtggacatatggccgatacattcgttctgccctccgacaagagaaagcattaagcgcgatcgcggacctgctaacgaacgaacatgagcgcgtggtgaaagccgcatccggtgctctcagaaacctcgctgttgatgccaggaataaggaactgatcggcaaacacgccattcctaatctggtaaaaaacctgcccggagggcagcagaattcttcatggaacttcagcgaggacacggtgatctccatcctcaatacaatcaatgaggtaatcgcagaaaatctcgaggctgctaaaaagctgcgcgagacccaaggcattgagaaactggtgctaataaataagtccggtaatagatccgagaaagaggtgcgtgcggctgccctggtgctacagaccatatggggttataaagagcttcgcaagcctctggaaaaggaggggtggaaaaaatctgattttcaagtcaatctcaataacgcttctcggtcgcagtccagtcattcctacgacgactccacccttccattaattgatcgcaaccagaagtcagataagaaacctgatcgggaagaaatacagatgtccaacatgggcagcaacacgaagtcactcgacaataattacagcaccccaaacgaacggggagaccacaaccggacccttgatcggagtggggacctgggcgatatggagcctctgaaaggaaccacacctcttatgcaggacgaaggtcaggaatccttggaggaggagctggacgtgctggtgctcgacgatgaggggggacaggtcagctacccgtctatgcagaagatctag

SEQ ID NO: 217264 - DNA, 2826 bp, Artificial Sequence
  Description of Artificial Sequence: Synthetic coding sequence
atggatgatagcgaggtcgaaagcaccgcttcaatcctcgcgtctgtgaaggagcaggaagcccaattcgagaagcttacacgcgctttggaggaggaacgacgtcatgtcagcgcgcagctggaacgagtgagggtgagtccccaagatgctaatccgctgatggcaaacgggacacttacacgaaggcatcagaatgggagattcgtgggtgacgcagacctggagaggcagaagttctccgacctgaaactcaatggaccccaggatcattcacatttactgtattcaacgattcctaggatgcaggaacccggacagatcgtcgaaacatatacagaagaggatcctgaaggagccatgagtgttgtgtctgttgagacgtctgacgatggcacaacccggaggaccgagactacagttaagaaggtggtgaagactgtgactacacgcactgtgcaacccgtggccatgggtcctgatgggctcccagtggatgcctcttctgtatccaataattatatccagactctgggccgagactttcgtaagaatggcaatggcggtccgggtccatatgtgggtcaggccggtaccgcgactctaccacggaactttcactaccctcccgatgggtatagccgacactacgaggacggttatcccggaggcagcgacaactacgggtcactgagccgcgttacccgcatcgaggagaggtacagaccctcgatggaagggtacagagcgccttcccgacaggatgtgtacggccctcaaccacaagtccgggtcggaggctccagcgtcgatttgcaccgtttccatccggagccttacggactcgaagacgatcagcgcagtatgggttacgatgacctcgactatggaatgatgtcggattatggtaccgccagaagaaccgggacaccaagcgatcccaggaggcgtttgagatcttacgaggacatgattggagaggaggttccctccgatcagtattactgggcccctcttgcccaacacgaaagagggtccctggcttctctagacagtcttcggaagggcggtccacctccaccaaactggaggcagcctgaactacccgaagttattgccatgttaggttttcgcctggacgccgtgaagagtaacgcagccgcatatcttcaacacctctgttaccgaaacgataaggttaaaactgatgtgaggaaactcaagggcatccctgtgttggtgggcttactcgatcatccaaagaaggaagtacatcttggtgcgtgcggcgcactcaaaaatatttcttttggtcgggatcaggataataagatcgcgataaaaaactgtgacggagtgccagccctggtacgcctcttgaggaaagccagggatatggatctgaccgaggtgattaccggcactctttggaacctgagcagccacgatagcatcaagatggagatcgtcgaccatgcccttcatgccttgacagatgaggtcatcattccccatagcggctgggagagggaaccaaacgaggattgtaaacccagacacatcgagtgggagtccgtactgaccaatactgccggatgcctgcggaatgttagctccgagagaagtgaggcgcgacggaagctgagagaatgtgatgggctggtggacgctctgatctttatcgtgcaagccgagattgggcaaaaagacagcgactcaaagctggtggaaaactgcgtgtgcctactccgcaatctgtcctatcaagtccatcgggagattcctcaggccgaacgctatcaggaggctgcccctaacgtggcaaataataccggacctcacgccgcttcatgtttcggcgctaagaaaggcaagggaaaaaaacccatcgaggacccggcaaacgataccgttgacttccctaaaaggacgtctcctgcaaggggctatgaactcctttttcagcctgaggtcgtccggatttatatcagtttacttaaggaaagcaagacaccagctatccttgaggcctctgctggcgcaattcagaacctgtgtgccggtcgctggacctatggccgttatatccgcagtgccttgaggcaggaaaaagcgctgagtgcaatcgccgatctgctgactaatgagcacgagagggtggtgaaggctgccagcggagccctgcgcaatctagccgtcgacgcacggaacaaggagctcattggaaagcatgctatacctaatctggtcaaaaacctgccaggcggtcaacagaactcatcttggaatttctcagaagataccgtgatttcaattctgaatacaatcaatgaagtgatcgcggagaatttggaggccgctaagaagcttagagagactcagggaatagaaaagctggttctgattaacaaaagcgggaaccggtccgagaaggaggtccgggcagccgcacttgtgctgcagacaatctggggttataaggaactgcggaaaccactggagaaagagggatggaaaaaatctgattttcaagttaacttgaacaacgccagtagatcccaatcctcccactcgtatgacgacagtactcttccactgattgaccggaatcaaaagagtgataataattatagcacgcccaatgagcgcggagaccataacagaacactggatcgaagtggcgacctgggagatatggagccattgaaaggaactacacctctcatgcaagacgagggccaagagtccttggaggaggagctggacgtgctcgtcctggacgacgagggaggacaagtgtcttatccgtcaatgcagaaaatctag

SEQ ID NO: 217265 - DNA, 2802 bp, Artificial Sequence
  Description of Artificial Sequence: Synthetic coding sequence
atggacgacagcgaagtcgagagtaccgccagcatactggcttccgtgaaggaacaagaggcccagttcgagaaattaacacgcgctttggaggaagaaaggagacacgttagcgcacagctggagcgcgtgcgagtgtcccctcaggatgccaatccccttatggcaaacgggaccctgacaagaaggcaccagaacggcaggtttgtgggcgacgctgacttggaaaggcagaagttcagcgatctaaaactaaacggcccacaggatcatagtcacttgttgtacagcacgatcccccgaatgcaggaacccggtcagatcgtggaaacctataccgaagaggatccagagggagctatgagcgtcgttagtgtggaaacaagtgatgacggcacaacgcggagaactgaaaccaccgtcaagaaagttgttaaaacagttactaccaggaccgtgcaacccgtagcaatggggccagacggtttgcctgtagatgcaagctctgtgagcaacaattacatacagacgctcggtagggacttccggaaaaacggaaatggcggacctggaccatatgtcggccaggccggaacggcgaccctgcccaggaactttcattatccaccagacgggtactccagacattatgaagatggctatcccggaggatctgacaactatggctcactgagccgcgttacaaggattgaggagcggtacagacccagcatggaagggtacagagcccctagccgccaggacgtgtacggacctcagccccaggttagggtgggtgggtcgagcgtggacttgcatagattccatccagagccatacggtctggaggacgatcaaaggtctatggggtatgatgacctagattacgggatgatgtcagactatgggacagctcgcaggactggaacgccttctgatcctaggcgacgattgagatcatacgaggacatgatcggagaagaggtgccttctgaccagtattactgggccccactggctcagcacgagcggggaagtcttgcttcgctggattccctacgaaaggggggtccacctccacctaactggcgacaaccagaacttccagaagttatcgctatgctgggattccggctggacgctgtaaaatcaaacgccgcagcctacctgcagcatctctgttacagaaatgataaggtgaagacggatgtgcgtaaactcaaggggattcccgtcttagtgggcctgcttgaccaccctaaaaaggaggtccacttaggcgcttgcggcgcactgaaaaacatcagctttgggcgtgaccaggacaacaaaattgccattaagaattgcgacggtgttcccgctctggttcgcctgcttcgaaaagcacgagatatggatctgactgaagttattacaggcaccctgtggaatctgtccagccatgacagcatcaaaatggagattgtggaccatgcgctgcacgcattaactgatgaagtcattatcccccacagcggctgggagcgcgagccaaatgaagactgcaagcccagacatatcgaatgggagtcagtcctgaccaatacagccggatgcctgcgaaacgtgagttctgagagatcagaggctcgcagaaaattaagagaatgcgacggcttggtggacgctctgatcttcatagtgcaggcggagatcggtcagaaggattcagatagtaagctggtcgaaaactgcgtctgtctcctgcggaacctgtcctatcaggttcatagggagataccccaggcagagcggtatcaggaagcagccccaaatgtggcgaataacacgggtccccatgccgcatcgtgcttcggcgctaagaaaggaaaagggaagaagcctatcgaggaccccgctaacgataccgtagacttccccaaacgcacatccccggcacgaggttacgaactcctcttccagccggaagtggttagaatctatatcagcttgctgaaggagagcaaaactccagccattctggaagcctctgctggagctatccagaatctttgcgccggacgctggacctacggcagatacatacgaagcgccctgcgacaggagaaagctctgtccgccatcgcagacctgctcaccaatgagcacgagcgggtcgtgaaagctgcgtctggcgcactgcgcaatctcgcggtcgatgcgagaaacaaagagctaatcggcaagcatgccatcccaaatttggtgaagaatttgccaggaggccaacaaaatagctcctggaacttttccgaggacaccgtgattagtatactgaacaccataaacgaggtcatcgccgaaaatctggaagcggctaaaaagctgagggagacacaggggatcgaaaagctcgtgctcattaataaatcaggcaaccgctccgagaaagaagtgagggccgctgcattggtcctacaaacaatttggggatataaagagctccgcaagccattggagaaagagggatggaaaaaatccgattttcaggtgaatctgaataacgcttctcggagccaaagttcccattcatacgacgattccacattaccactgatcgatcgaaaccaaaagagcgataaaaaacccgaccgagaagagatccagatgagcaacatggggtcaaatacaaaaagcctggacaacaactattccacacccaacgagcgcggagaccataatcgaaccctggacaggtctggagacctaggggacatggaacccctgaaaggcaccacgccacttatgcaaaaaatatag

SEQ ID NO: 217266 - DNA, 2817 bp, Artificial Sequence
  Description of Artificial Sequence: Synthetic coding sequence
atggacgacagcgaagtggagtccactgcgtccatccttgcctccgtgaaagaacaagaggctcagttcgagaagctcacccgcgcactggaggaggagcgtaggcatgtatccgcccagttggaaagggttagagtgagcccccaagacgctaaccccctcatggccaatggcacactcactcgcagacatcagaacgggcgtttcgttggggacgcagatctcgaacggcagaagttttccgacttaaagctgaacggtccgcaggatcatagccatctcctatacagcactatcccaaggatgcaagagccaggccagattgtggagacatacacggaggaggacccggagggcgcaatgtcggtggtaagcgtggaaacatctgacgatggtacaactcgcagaacggagacgaccgtcaaaaaagtagtaaaaacggtgactacacggactgtccagcccgtggcaatgggacccgatggattgcctgtggacgcctcatccgtgtctaacaattatattcagactcttggtagggatttccgaaagaatgggaacggaggaccgggtccctatgttgggcaggccggtaccgcaactctgcctagaaattttcactacccacccgacggctattcccgacactatgaggatggctatcctggtggttctgataattatggttccctttctcgcgtcacccgcatcgaagaacgctatagaccgtccatggaagggtacagggccccttccaggcaggacgtttacgggccacagccgcaggttagagtgggaggctcatcggtggatctgcaccggttccacccagagccttacggcctcgaggacgatcagcgtagcatgggatacgacgaccttgattatggtatgatgagtgactacggcactgcacggaggacaggcactccatcagaccccagacgcagattaagatcctacgaagacatgatcggagaggaggtcccgtctgaccaatactattgggcacctctggctcaacacgagcggggaagcctggcaagtttggattcccttaggaagggaggaccgcctccccctaattggagacagccagaactccccgaagtgattgctatgttgggatttcgacttgacgccgtaaaaagcaacgcagctgcatacctgcagcacctgtgctaccgcaatgataaggtgaagactgacgttcgaaagctgaaaggtatcccagtgctggtcggactgcttgaccaccccaagaaggaggtccacctgggggcttgtggggcacttaagaacattagctttggtcgcgaccaagataacaaaatagctatcaagaattgcgatggagttcctgctctggtaaggctccttcggaaagctcgggatatggatctcactgaggtaattaccggtactctgtggaatctctccagtcatgatagcattaagatggaaatagtagatcacgccctgcatgcgttaacggacgaagtaatcattccacacagcggatgggagcgcgagcccaacgaggactgtaaacccaggcacatcgaatgggagtccgtactgactaataccgcaggatgcttacgcaacgtaagctccgaaaggagcgaggcgagaagaaaactgcgggaatgtgacgggctggttgatgctcttatatttattgtacaagccgagattgggcaaaaggattcagattccaaactagttgagaactgtgtgtgcttactgcgaaatctgagttatcaagttcatcgggaaatccctcaagctgagagataccaggaggccgcacctaacgttgccaataacaccggaccccacgcggcatcttgcttcggagcaaagaaaggcaaagacgagtggttcagtcgtggcaaaaagccaatcgaagaccccgcaaacgatacagtcgatttccccaaacggacttctcccgcaaggggttacgaactcctctttcagccagaagtggtgcggatctacatttcactcttaaaagagtccaaaactcccgcaatccttgaagcttcggccggtgcgatccagaacctttgcgccggaaggtggacgtacgggagatacatccggtctgcgttaaggcaggaaaaagcgctgtctgcaattgcggacttgctgactaatgagcacgagagggtggtgaaagccgcttccggcgctttgaggaacctcgcagtagacgcgagaaacaaggaactaattgggaaacacgctatccccaatttagtgaagaacctgcccggaggccagcagaacagtagttggaacttctcagaggatacggtgattagcatactgaatacaatcaatgaagtaatagccgagaacctggaggctgccaaaaagttaagagagacgcaaggaatcgagaaattggtgctaatcaataaaagtggaaaccgctcagagaaggaagtgcgcgctgctgctctcgtgttgcagacaatttggggatataaggagctgcgtaagcctctggagaaggaaggttggaagaaatctgatttccaggttaatctgaacaacgcaagtcggtcccagagttcacacagctacgatgatagtactttacccttgatcgacaggaatcagaagagcgataaaaaacccgacagggaagagatacagatgagcaatatgggatccaacacaaagagcctagacaataattactccacaccaaatgaaaggggcgatcataaccggaccctcgatcgttccggcgatctgggtgatatggaaccattgaagggcacaacaccattgatgaagatctag

SEQ ID NO: 217267 - DNA, 2907 bp, Artificial Sequence
  Description of Artificial Sequence: Synthetic coding sequence
atggatgatagcgaggtggagtcaaccgcttccatcctggctagcgtgaaggaacaagaagctcaattcgaaaagttaacccgggctctcgaggaggagagaagacacgtgagcgcccaattggagcgggtgagggttagccctcaagacgccaaccccttaatggcaaatgggaccctgacaaggcgccaccagaacggaaggttcgtcggagacgcagacctggaacggcaaaagttctcagacctgaagttaaatggtccccaagaccactcccatcttctgtatagtacaatcccacgcatgcaagagcctggacagatcgtcgagacttacaccgaagaggaccccgaaggtgctatgtccgtggtcagcgtggaaacttctgatgatggtactacgaggcgcactgaaacaacggtgaaaaaggtggtgaaaaccgtgaccactcggacagtgcagccagtcgcaatgggtcccgacggattgccggtggatgccagctctgtatccaacaattatatccaaaccctgggcagggatttccgaaagaatggcaacggaggccctggtccgtatgtagggcaggctggcaccgccacgctaccgaggaacttccactatccacctgatggatacagtcgccactatgaggatggttatcccggtggtagtgataactatggatccttgagccgcgtgactcggattgaggaacggtatagaccttccatggaaggatatcgggctcccagccgccaggacgtttacggcccacagcctcaggtgcgtgtgggaggaagctcagtggacttgcaccggttccatccagagccctacggtctcgaggacgaccaaagatccatggggtatgacgatctggactatgggatgatgagcgactatggtactgcacgaagaacaggcaccccctcggatccgcgacgtcgtctgcgttcttacgaggatatgataggcgaagaggtgccaagtgatcagtactactgggcccctctggcacagcacgagagaggtagcctagcctcgctcgacagcctgagaaagggcggaccgccaccacccaactggaggcagcctgagctcccagaggtgatagcaatgctgggttttaggctcgacgccgtgaagagcaacgctgctgcctatctccagcatttgtgctaccgaaatgataaggtcaagaccgacgtgcggaaactgaaaggaatcccggtgctggtcggtttgctcgatcaccctaaaaaagaggtccacttgggggcatgcggcgctttaaagaacattagcttcggaagggatcaggacaataagatcgccataaaaaactgtgatggcgttcccgcattggtccgcctgctaaggaaggctcgagatatggaccttaccgaggtcataacaggaacgctgtggaatctatcttctcatgactccattaagatggaaatcgtcgaccatgcactacatgcattgactgatgaagtgataataccccatagcggttgggagcgggagcctaatgaagattgcaagccgaggcacattgagtgggagtcagttcttacgaatacagctgggtgcctgcggaatgtctcttctgaacgcagcgaggccaggaggaagctgcgcgagtgtgacggccttgtggatgcccttattttcatcgttcaggcggaaattggacagaaagactcagactcaaagctcgtcgagaactgtgtatgcttgctgcgcaatctgagctaccaggtacatcgcgagataccacaggcagagcggtaccaggaggccgcacctaatgtggctaacaataccggtccccacgcagcatcatgctttggggcaaagaagggcaaggatgaatggtttagtaggggaaagaaaccaattgaggacccagccaacgatactgttgactttcccaagagaacttcccctgccagagggtacgaactgctattccagccggaggtggtgcgcatttatatttctttgcttaaggaaagcaaaacgcccgctattcttgaggcaagcgctggagcaatccagaacctgtgcgctggacggtggacctacggccgatatattcgatcagctctccgacaggagaaggctctgtcagcgatcgctgacctgctcaccaacgagcatgaaagggtcgttaaagcagctagcggagccttaaggaacctcgcagttgatgcacgcaacaaagaactgatcggtaagcatgcaatcccaaatctcgtcaaaaatcttcctggtggtcagcaaaactcttcttggaatttcagcgaggacacagttatcagcatcctaaacaccatcaatgaagttatcgccgagaacctggaggcggctaaaaaactccgggagacacagggaatcgagaagctggtgttaattaataagagcgggaatcgaagcgagaaggaagtccgggcagctgctctggtgctacaaaccatctggggatataaagagttgcgcaagcccctggaaaaagagggctggaaaaagtccgattttcaggttaatctgaataatgcaagccgttcccaatcttcccatagttatgacgactccacattgccactcatagatagaaaccagaagagtgacaagaaacccgatagggaggaaatccagatgtcaaacatggggagcaacaccaagtccctggacaataactacagtaccccgaacgaaagaggggatcacaacaggactcttgaccggagtggagacctgggagatatggagccacttaagggaacaacacctcttatgcaagatgagggccaagagtcattggaggaggagttagatgtgcttgtgttggacgatgagggaggccaggtcagttacccgtctatgcaaaagatctag

SEQ ID NO: 217268 - DNA, 2604 bp, Artificial Sequence
  Description of Artificial Sequence: Synthetic coding sequence
atgcaggaaccaggacagatagtagaaacgtacacagaggaggaccctgagggagctatgtctgtggttagtgtggaaacatctgatgacgggaccacccgtcggacagaaaccactgtgaaaaaggtggtgaaaactgttaccacaaggaccgttcagccagtggctatgggtcccgacggactgccagtggacgccagtagcgtctccaataactacattcagacattaggccgtgacttccgtaaaaacggaaacggtggccctggaccctacgttggccaggccggaactgcaacactaccccgtaacttccactatcctccagacgggtacagtaggcactatgaggacggataccccggaggatccgacaattatgggagcttaagcagagtgacccggatcgaagagcggtataggccctccatggagggataccgggcacctagcagacaggatgtctacgggcctcagccccaggtccgtgtgggtggatctagcgtcgaccttcatcgatttcatccggagccatacggtctagaggatgatcaacgttcaatgggttacgacgacctggattacgggatgatgtcagactatggaaccgctcggagaaccgggactccgtctgacccaagacggaggctgcgctcttacgaagatatgatcggggaagaagtgccttctgaccaatactactgggcccctcttgcgcagcacgagcgcggtagcctcgcaagcttggattcgctgcggaagggcggaccccctccccctaattggcggcaacccgaacttcccgaggtgatcgctatgcttggctttcgccttgacgccgtgaagtctaacgctgccgcttaccttcagcacctttgttatcgtaacgacaaagtgaagaccgatgtgagaaaattgaaagggattccagtcctcgtcgggcttcttgaccatcccaaaaaggaggtacacttaggggcttgtggtgcactgaagaatatctcctttggtagggatcaggataacaagatcgctattaaaaattgcgacggcgtgcccgctttggtgcgccttctacgaaaagcccgagacatggatttgactgaagtgatcacaggtaccctgtggaatctttcttcgcacgattccatcaagatggagattgtggatcacgccttacatgcccttactgatgaagtcataatcccccatagcggctgggagagagagccaaacgaggattgtaaacccagacatatcgagtgggagagtgtgctgacaaacaccgctgggtgcctgcgcaatgtgagctccgagcggtcagaggccaggaggaaattgcgggaatgcgacggccttgtcgacgccctgatctttatagtgcaagctgaaattggccaaaaagactccgattcaaagctcgtggagaactgcgtgtgtctgctccggaacctctcatatcaggtccatagagagatcccacaggctgaacggtaccaggaggctgcacccaacgtggccaataataccggacctcacgcggcaagctgtttcggggcaaagaagggtaaagatgaatggttcagccggggaaagaagcccatcgaagaccccgctaatgatacagtcgattttcccaagcgcactagccctgcgaggggatacgaactgctttttcagcctgaagtagtaaggatttacatatcactgctgaaagagtctaaaactcccgctattcttgaggcctctgctggggctatccagaatctgtgtgccggacggtggacatacggacgctatatcagaagtgccctgaggcaggaaaaagccctgtcagcaatagcagatctgctgactaatgaacacgagcgggtggtgaaggccgcttctggggctcttaggaacctggccgtggacgctagaaataaggagttaatcgggaagcacgcgatcccgaatctggttaagaatctgcccggaggacagcagaattcttcctggaatttctccgaggacaccgttatctccatcctgaacaccattaacgaggttattgcagagaacctcgaggcagcaaagaaactcagagagacccaggggatcgaaaaactggtgcttatcaacaagtccggcaaccgatcagaaaaagaagtacgcgctgcagctctggttctgcagaccatctgggggtacaaggagctgcggaaacctctggaaaaagagggttggaaaaagagtgactttcaggtgaacctgaacaatgcttctcgatcccaatcctcgcatagttatgacgattccacgctgcctcttattgaccgcaatcagaaaagcgacaagaaacctgaccgggaggaaatccagatgtctaacatggggtcaaataccaagagtctggacaacaactactccacacctaatgaacggggtgaccacaatcggaccctggatagaagcggtgatctgggagatatggaaccgctaaaggggacaacgcctctgatgcaggacgaggggcaggaatccctcgaagaggaattagatgtacttgtactcgatgatgaaggaggccaggtgtcttacccaagcatgcagaaaatctag

SEQ ID NO: 217269 - DNA, 2499 bp, Artificial Sequence
  Description of Artificial Sequence: Synthetic coding sequence
atgcaggaaccaggacagatcgtggagacctacaccgaggaagaccccgaaggggcaatgtcagttgtcagcgtggagacaagtgacgacggtactacaagacggactgagacgacagttaagaaggttgttaagaccgttacaacccgcacagtccagcctgtggcaatggggcctgacgggttgcccgtcgatgccagctctgtctcaaataattatatccagaccctcggtagagattttcgaaagaatgggaacgggggtccgggaccatatgttgggcaggcaggcacagccaccctgcctcggaacttccactacccaccagacggctattcccgtcattatgaagacggctatcctggcggatccgacaattacgggtcactctcacgggtgacaaggattgaagagcgctatcgccctagcatggagggctaccgtgctccttctaggcaggatgtgtatgggccacagccccaggtccgtgttggtgggtctagcgtggaccttcaccgctttcaccctgagccctacggtttagaagacgaccagcgctccatgggctacgacgatctcgactatggcatgatgagtgattacgggaccgcgcgaaggaccggtactcctagcgaccccaggcgcagactccggagctatgaagacatgatcggcgaagaagtaccaagcgatcagtactattgggccccattggcgcagcacgagcgaggaagtctagcaagtctggacagcttgcggaagggcggtcctccccctcctaactggagacagccagaactgcctgaggtcatcgctatgctgggttttcggctggatgctgtgaaatcaaatgcagcagcttacctacaacacctctgttaccgcaacgacaaagtcaagactgatgtccggaagttaaaggggatcccggttctggtggggctcttggatcatcctaagaaagaggtgcaccttggtgcatgtggtgctctcaagaacatcagtttcgggagggatcaggacaataagattgcgattaaaaactgcgatggcgtgccggcacttgtccgactgcttaggaaggccagagacatggacctgacagaggtcatcaccggcaccctgtggaacctgagttcacacgatagtattaaaatggagatcgtcgaccacgcgctgcacgctctgaccgacgaagtgattattcctcactctgggtgggaaagagagcccaatgaagactgcaaacctcggcatatagagtgggaaagcgtcctgaccaacacagcgggttgtctaaggaatgtatctagcgagagatcagaagctcgcaggaagctgagggagtgtgacgggctagtagacgcattaatctttatagtgcaggcagagataggccagaaggatagcgatagtaaacttgtggagaactgcgtttgcctgcttcggaatctgtcttaccaggtgcacagggaaattccacaggccgagaggtaccaggaggctgcccctaacgtggccaacaataccggccctcacgcagcctcttgttttggcgcaaaaaaaggaaaaggcaagaaacccattgaggatcccgctaacgatacggtggactttccaaagcgtacatctcccgctcggggatacgagctgctgttccagccagaagtagttcggatatacatctccctgctcaaagaaagcaagacccccgctattctggaggctagcgccggagccattcagaatttgtgtgcaggacggtggacttacggaagatatatcaggtctgcgctgagacaggaaaaggcgttaagtgctatcgctgaccttttgacaaatgaacatgagcgagtcgtgaaagccgcatctggcgctttgcggaatctcgcagtagatgccagaaataaggagctcatcggcaagcacgcaatccctaacctggtgaaaaacctgccaggaggacagcagaactcctcttggaacttctccgaggacacagttatctccatcctgaataccattaatgaagtcatcgccgagaacttggaagccgctaaaaagctgagagagactcagggtatcgaaaaattagtgctcatcaacaaatccggaaacagatcagagaaggaggtacgcgctgccgcactggtgctgcagaccatttgggggtacaaagagctacggaagcccttagagaaggaagggtggaagaagtcagactttcaggtgaatctgaacaacgcctcaagatcgcaaagcagccacagttacgacgattccaccctcccgcttatcgaccggaatcaaaaatctgacaagaaaccagatagggaagaaattcagatgagcaacatggggtctaatactaagagcctggacaataattattctacccctaatgagcgcggagatcataaccggaccttggataggtccggggatctcggcgacatggagcctcttaaaggaactaccccgcttatgcagaaaatctag

SEQ ID NO: 217270 - DNA, 2802 bp, Artificial Sequence
  Description of Artificial Sequence: Synthetic coding sequence
atggatgactccgaagttgagtctaccgcctctatcttggcatctgtcaaagagcaggaggcgcagttcgaaaaactgacaagagcactggaggaggaacggaggcatgttagcgctcagctggaaagggtcagagtatctccacaggatgcaaaccccctgatggcaaacggcacacttactagaaggcaccagaatgggcgtttcgtcggagacgctgacttggaaaggcagaagttcagcgacttaaagctcaacggccctcaggaccactcacatcttctttattctacaatccctcggatgcaggaaccgggtcagatcgtggagacttacaccgaagaggatccagagggagcaatgtctgtggtcagcgtcgaaacgagcgatgatggtacaacacgcaggaccgagacaacagtgaagaaagtggtcaagaccgtaacaaccagaaccgtccaaccagtggccatggggcctgatgggctcccagtcgatgcctctagcgtgagcaataattacatccagactctcggaagggactttagaaaaaatggaaacggcggtccgggtccttacgtggggcaagcaggtactgcaaccctgccccgtaactttcactaccctccggatggatacagtagacattacgaggacggttatcccggagggagcgacaactacggctctctcagccgcgtcactcgcattgaagagcggtatcgaccctctatggaggggtaccgcgctcccagtcggcaggatgtctacggaccccaaccacaggtgcgcgtgggtggatccagcgtcgatttacatcggttccaccctgaaccgtatggactagaggacgatcaacggagcatgggctatgatgacctcgactatggaatgatgtctgactatggaacagccaggcgcacggggacccctagtgaccccagaagacggctcagatcatacgaagacatgataggcgaggaggttcccagcgaccagtattactgggcacctcttgcacagcatgagcggggatctcttgcttccctggattctctcagaaaggggggaccaccaccgccaaactggcgccagcccgaactccctgaggtgattgctatgcttggctttcggctggatgcagtaaagtctaacgcagctgcttatttacaacacctatgctacaggaatgacaaagtgaagaccgacgtgaggaaactgaagggaatcccagttttggtcggtctgctagatcacccaaagaaggaggtgcatctgggcgcatgtggggctctgaagaatatctccttcggcagggatcaggacaacaagattgcaatcaaaaattgcgacggtgtccccgctctcgttcggctgcttagaaaagctcgggacatggaccttacggaggtgattacagggacactgtggaatctgagtagccacgattcaattaagatggagattgtggaccatgccctgcacgccctgacagacgaggtcattatcccccactctggttgggagagggaacccaacgaagattgtaagccacgccacattgagtgggagagcgttctgactaacactgccggttgccttagaaacgtgagctccgaacgttctgaagcaagaagaaaattgagagagtgcgacgggctggtggacgccttgatcttcatcgtacaggcagagatagggcagaaggacagcgactcaaaactggtcgaaaattgtgtgtgtcttctcaggaacctctcgtaccaagtacaccgagagataccacaggcggagagataccaggaggccgctcctaacgtggccaacaacaccggaccgcatgccgcaagttgcttcggcgctaagaagggaaagggaaaaaagcctattgaggatcctgcgaatgacacagtcgactttccaaagcgcacctcaccggctcggggatacgagctgctctttcaaccagaggttgtgcggatctatatctcccttctcaaggaatctaagaccccggctatcctcgaagcctcagctggcgctattcagaatctgtgtgctggacgttggacctatggccgttatatccggagcgccctcaggcaggagaaagcactctcagccattgccgatcttctgaccaatgagcacgaacgcgtcgtgaaagctgcgtccggtgctttgaggaatctggctgtagacgcacgcaacaaggagttgatcggaaagcacgcgattccaaacctagtcaaaaacctgccgggaggacaacagaactccagctggaactttagcgaggatacagttatatccatcctgaatacaattaatgaggtgatagctgagaatctcgaggctgctaaaaaattgcgcgagacccagggcatagaaaagttagtgctaataaacaagtctggcaatcgatcggaaaaggaagtgcgggctgctgcactagtgttgcaaactatctggggctacaaggaattgcggaaacctttggagaaagaggggtggaagaaaagtgacttccaggtgaatctgaacaatgccagccgctcacagtccagtcactcatatgacgatagcaccctgccactaattgataggaaccagaagtctgataaaaagcccgatcgcgaagagatccagatgtccaatatggggtctaacactaaatctctggacaacaattacagcacgccaaacgagcggggagatcacaaccggactctggacagatctggtgatctgggcgatatggagccacttaaagggacaacccccttgatgcagaagatctag

SEQ ID NO: 217271 - DNA, 15 bp, Artificial Sequence
  Description of Artificial Sequence: Synthetic coding sequence
atggacgactcctag

SEQ ID NO: 217272 - DNA, 2802 bp, Artificial Sequence
  Description of Artificial Sequence: Synthetic coding sequence
atggatgacagcgaggtggagtcgaccgcctcaattctggcgagtgttaaggagcaggaagcacagttcgagaagctgacccgagcgctggaggaagaacgtaggcacgtttcagcacaactggagcgcgtgcgcgtgtctccacaggatgcaaatcccctgatggccaacgggacacttacccgtaggcaccagaacggacggtttgttggggacgctgacttggaaaggcagaagttctccgacctgaagctcaacggcccacaggatcattcccaccttttgtactctaccatccctaggatgcaggagccaggacagattgtggaaacgtatactgaggaggaccctgagggcgctatgtcagtcgtctcggttgagacgtcggacgatgggaccacccgacggaccgagaccaccgtgaaaaaagtggtcaagacagtgaccacacgaaccgtgcagcccgttgcgatggggccagatgggttgcctgtcgacgcctcctcggtctcaaacaattacatccaaacactcggacgcgatttccggaaaaacggcaatggaggtcccggtccgtatgtgggacaggctggcactgcgactctgcccaggaactttcactatcctccagacgggtactctaggcattatgaggacgggtaccctggaggctcagacaactatgggtccctttcaagggtgacccgtatcgaggagcgatacaggccaagcatggagggttacagagcgccttcccgtcaggatgtatacggacctcagccccaggtaagagtcggcggatcaagcgtcgacctgcatagatttcaccccgagccctacggactggaagacgaccagagatctatgggatacgacgacctggactatggaatgatgtccgattacggcactgctagacgaaccggcacaccctcagatccacggagacgccttagaagttatgaagatatgattggcgaggaggtgccaagtgatcagtactactgggccccactggctcagcatgaaagggggagtctggcgagccttgactcactgaggaaggggggtcctcccccacccaactggcgccaacctgaactgcccgaggtgatcgccatgttgggctttaggctggatgccgtgaaaagcaatgctgcagcttatcttcagcacctgtgctaccgcaacgacaaagtgaaaacagacgtgagaaagttgaaagggataccagtcttagtgggcctactcgatcatccaaaaaaggaagttcacctaggggcatgtggcgcacttaagaatatttcgtttggccgtgaccaggacaacaagatcgctataaaaaactgtgacggagttcccgcattggtccggttactccggaaggcacgggatatggacttgacagaggtgattaccgggactctttggaacctgtcaagccacgattccattaaaatggagattgtggatcacgctcttcacgcattgaccgatgaggtgatcatcccccactcaggctgggagcgagaacctaatgaagactgtaaacccaggcatatcgaatgggagtcagtactgactaataccgccggatgcctccgaaacgtgagttctgagcggtctgaagcccgacgaaaactgcgggaatgcgacggcctggtcgacgcattaatcttcattgtgcaggcagagatagggcaaaaggacagtgattcaaagctggtcgagaactgtgtgtgtctcctgcgtaatctgtcctatcaggtgcacagagagatccctcaagcggaaaggtatcaagaagccgcaccaaatgtcgctaacaacactggcccacacgctgcaagctgctttggagcaaagaagggaaagggtaaaaagccaatcgaggaccccgcaaatgacaccgtggactttccgaagcggacaagccccgcacgtggctacgaacttctgttccagcctgaagtcgtccggatatacatctccctgctgaaggaatcaaagactcccgcaatcctggaggcctccgcaggcgctattcagaatctgtgtgccggacgatggacatatgggcgatatatacgatctgctttacggcaggaaaaggccttgtctgccatcgctgatctgctgacaaacgagcacgaacgagttgtaaaagccgcttcaggtgccctccgcaatcttgcagtagatgcgaggaacaaggaacttatagggaagcacgctatccccaatctagtgaaaaatcttccaggcggacaacagaactcctcttggaacttttctgaggacaccgtcatctccattttgaatacgataaatgaggtgatcgcggaaaacctggaggccgcaaaaaaacttcgcgagacacaggggattgaaaagctggtattgatcaacaaatctggtaatcggagtgagaaagaggtcagagcggcagctcttgttctgcagacaatatggggatacaaagaattgcgaaagcccctcgaaaaggaaggatggaagaaaagcgatttccaagttaacctgaataacgccagtagatcccagtccagtcacagttacgacgatagtaccctgcctctgattgacaggaaccagaaaagcgacaagaaacccgatagggaggaaatccaaatgtctaacatgggtagcaatactaaatcactggacaataactactccactccaaacgagaggggggatcacaatcggaccttggatcggagcggtgacctgggagacatggagccactgaaaggcactactcctctaatgcaaaaaatttag

SEQ ID NO: 217273 - DNA, 1851 bp, Artificial Sequence
  Description of Artificial Sequence: Synthetic coding sequence
atgatcggagaagaagtgcctagcgaccagtactactgggccccactggcccagcatgaaaggggtagcttggcctcgttagactcactgagaaaagggggaccccctcctcctaactggcgccagcctgagctacccgaagtcatcgccatgctggggttccgcctcgacgccgttaagtcaaacgcagctgcttatctgcagcatctgtgctacagaaacgataaagttaagaccgacgtgagaaagttaaaaggcataccagtgctggtcgggctgctggaccaccctaagaaggaggtccatttaggggcttgtggagccctgaagaacatcagcttcggtcgtgatcaagacaataagatcgctattaagaattgcgatggagtgcctgcactcgtgcgcctcctgcgcaaagctcgggacatggacctgacagaggttatcacaggaacactatggaatctgtccagtcacgatagcattaagatggaaattgttgaccacgcactgcatgcactcacagacgaggtgataatccctcactctggctgggaacgggaacctaatgaagattgtaagccacgccacattgagtgggagtccgtcctaacaaatacagccggatgtctgcgtaatgtgagtagcgaaaggtctgaagcccgtcggaagttaagagaatgcgatgggttggtggatgctcttatctttattgtacaggccgaaattggccagaaggacagtgactccaagctcgtcgagaattgtgtttgcctgctgcgtaatctgagctaccaggtccatcgtgagatcccccaagcagagcgttaccaggaggcagcccctaatgtggcgaacaatacagggcctcacgccgcaagttgctttggtgctaagaaaggcaaggatgagtggttctcaaggggaaagaaaccaatcgaggatcccgctaacgacaccgtcgattttcccaagcgcacctctccagctcggggatatgaactcctgttccagccagaggtggtccggatctacatttccctgctcaaggaatcaaaaaccccagccatcctcgaggcaagcgccggtgcgatccagaacctgtgtgctgggagatggacgtatgggcgatatatccgatctgccctcaggcaggagaaggccctttccgccatcgccgacctcttaacaaatgaacacgagcgcgtcgtgaaggctgcctccggcgcactgcggaatctcgctgttgacgcacgtaacaaagaactcattggcaagcatgcaattccaaacttagtcaaaaatctccccggtggccagcagaattcttcatggaacttctccgaagatacagtcataagcattcttaatactatcaacgaagttatagctgagaatctggaagccgctaaaaagctgagggaaacacaggggatagaaaaactcgtgctgattaacaaatctgggaacaggagtgaaaaagaggtccgtgccgctgccttggtgcttcagacgatttggggatacaaagagctcagaaaaccactggaaaaggagggctggaagaaatctgattttcaggtgaacttgaataatgcatctcgctctcagagctcccactcctatgacgactctacacttcccctcattgatcggaaccagaagtctgacaagaaaccagatagggaagaaatacagatgtctaatatgggatccaatactaaatccttggacaataattatagtaccccaaatgagcgtggtgaccataatcggactttggatcgaagtggcgatttgggggacatggagcccttgaaaggcactacgccactgatgcagaagatctag

SEQ ID NO: 217274 - DNA, 2727 bp, Artificial Sequence
  Description of Artificial Sequence: Synthetic coding sequence
atggcaaacgggacactgactcggaggcatcaaaatgggcgatttgtcggcgatgctgatttagagcggcaaaaattcagcgacttaaaactgaatggtcctcaggatcattcccatctgctttactcgaccatccccaggatgcaggaacccggacaaatcgtggaaacttataccgaggaggacccagagggggctatgtccgtcgtttccgtggaaacatctgatgatggaaccacccgtaggaccgaaactaccgtgaaaaaggtcgtcaagaccgtaactaccagaacggtccagccggtggcaatgggtccagacggattaccagtcgacgccagctcggtcagtaataattatattcaaacgctcggtagagatttcagaaaaaacggtaacgggggacctgggccatatgtcgggcaggctggcactgcaacgttgcctcggaactttcattatccacctgatggttactcaaggcactatgaagatgggtatccaggcggaagtgataattatgggagtctatcccgtgtaactagaatcgaggaaaggtaccgtccctccatggaaggctatcgggctccgagtagacaggatgtgtacggtccccagcctcaggtgcgggttggaggcagctctgttgatttgcacagatttcaccccgagccctacgggttggaggatgaccagcggagcatgggttacgacgatctcgattacggaatgatgtctgactatggcaccgcacgtagaacaggtaccccctctgaccctagacggagattaagaagctacgaagacatgataggggaggaagtgccttcagatcagtactattgggcgccactggcacagcacgaacgaggaagcttggctagccttgacagtctccgcaaaggcggacctccccctcccaattggcgacagcccgagctgccagaagtaatcgcgatgctggggtttcggcttgacgccgtgaagtccaatgcagccgcatacttacagcatctgtgctatagaaacgacaaagttaagactgatgtgcgaaagctcaaaggcattcctgtcctggtcggtctccttgaccatcccaaaaaggaagtccatctgggagcctgcggcgcactaaagaatatctccttcggaagggatcaagacaataagatcgcgattaaaaactgtgacggagtacccgcactagtgcgcctgcttcgcaaggccagagatatggacctaactgaagtcatcacaggaacactgtggaatctcagcagccatgattccatcaaaatggagattgtggaccatgccctccacgccctcaccgacgaagtcataataccccattcaggatgggaacgggagccaaacgaagattgtaagccacgccacatcgagtgggagtcagtcctcaccaataccgcaggttgtctgagaaacgtctcctctgaaaggtccgaggctagaagaaaactacgtgagtgtgacgggctggtggacgcactcatttttatagtgcaggcagagatcgggcagaaggacagcgatagtaaactggtggagaactgcgtttgccttcttcggaatcttagctatcaggttcacagggaaattccgcaagctgagagatatcaggaggctgctcctaacgtagcgaacaacaccggtccgcacgccgcatcttgctttggagccaaaaagggtaagggtaagaagcccatcgaggatccagcaaacgatacggtggattttcctaagaggacaagtcccgctcgaggatatgaactgctctttcagcctgaagtcgtgaggatttatatctccctgctgaaagagtcgaaaaccccagccatactggaagcctccgccggagcaatccagaatctgtgcgctggacgatggacctacggacggtacattcggagtgcactgaggcaggagaaggctcttagcgcaatcgccgacctgctgaccaacgaacacgagagggttgttaaggccgcttcaggtgcactccggaacctggccgtggacgcgagaaacaaggagctgattgggaaacatgccatcccaaacctggtgaaaaacctccctgggggtcagcagaactcgagttggaacttcagcgaagataccgtgatctccatcctgaacactatcaacgaggtgattgctgagaacctggaagctgccaagaaactccgcgagacacaggggatcgagaagctagtgctaatcaacaaatccggaaaccggtctgagaaagaagtccgagctgctgctctggttttacaaacgatctggggttacaaagagcttaggaaacccctggaaaaggagggttggaaaaagtcggacttccaagttaatctaaacaacgctagccgatcacaaagctctcattcttatgacgacagcactctccctctgatcgatcgcaaccaaaagtctgacaagaagcctgatagagaagagatccagatgagcaacatgggcagtaacacaaagtcactggacaataattatagcacccccaacgaaagaggggaccacaatcgcacccttgatcgaagcggcgatctgggcgacatggaaccactgaagggcacaacccccctgatgcaggacgagggacaagagagcctggaggaggagctagatgtcttagttctggacgacgagggtggacaggtgtcctacccctctatgcagaagatctag

SEQ ID NO: 217275 - DNA, 1833 bp, Artificial Sequence
  Description of Artificial Sequence: Synthetic coding sequence
atgatcggggaggaagttccttccgaccagtattattgggcccctcttgcccagcatgaacgtggctcactggcgagcctcgactcccttcggaagggtggcccaccacccccaaattggaggcagcccgagctgcctgaagtgatcgcgatgctcgggttccggctggatgctgtgaagagcaatgccgcagcgtacctgcagcacctgtgttacaggaacgataaggtaaaaacagatgtgcgaaaactgaagggcatcccagtcctggtgggcttgctagatcacccaaaaaaagaggttcatctgggggcatgtggggcactgaaaaacatctcgttcgggcgtgaccaagataacaaaattgcgattaaaaattgtgatggcgtgcctgccttagtgcgactgctgcgaaaagcacgggacatggatctaactgaagtgatcactggaacactctggaatctgagctctcacgattcaatcaaaatggaaatcgttgaccacgctctgcacgccctcactgatgaggttataatacctcacagtgggtgggagagagaacccaatgaagactgtaaacccaggcatattgagtgggagtccgtactgacaaacaccgcgggatgtctccgcaacgtcagctctgaacgctcggaagcccgaagaaaactgcgggagtgtgacgggttagttgacgccctcattttcattgttcaagccgagatcggacaaaaggatagtgactcaaagctagtggagaactgtgtatgtttgctgcgcaatctgtcatatcaggtccaccgagagataccacaggccgagcgctatcaggaggccgcaccaaatgtcgccaataacacgggcccacacgctgcctcgtgctttggtgctaaaaaaggcaagggcaagaagccaattgaagacccagctaatgataccgttgacttccctaaacgcacaagccccgcacgcggttacgagctgcttttccaacctgaggtggtgcgcatttacatctccctgctgaaggagtcgaagacccctgcaatcctggaggcttctgcaggagctatccaaaacctttgcgcgggacgctggacctacggacggtacatcaggagcgcactgaggcaggaaaaagctcttagtgcaatagccgacctgctgactaacgagcacgaacgcgtggtcaaggccgcttctggggcattgcgaaatctggcagtcgacgccaggaataaggagctcatcgggaagcatgccattccaaatctggtgaagaacttacccggaggccagcagaattcctcctggaacttcagtgaggatacggtgatcagtattctcaacaccattaacgaggtgattgcagagaatcttgaagccgctaaaaagctgcgcgagacccagggaatcgagaaactagtactcattaataagtctggtaaccggtccgaaaaggaggtgagagcagccgctctggtcctccagaccatttggggatataaggagctacgtaagcccctggaaaaggaagggtggaaaaagtctgatttccaggtcaacctgaacaatgcatcaaggagccagtcttctcactcttatgatgattcaacccttcctctgatcgaccgaaaccagaagtctgacaagaaacccgacagagaggagatacagatgagtaacatgggcagcaacacaaaaagtctcgataataactattctacccccaacgagaggggggatcacaatcgcactcttgaccgcagcggggatctgggagatatggaacccttaaagggaactacgcccctgatgcaaaagatttag

SEQ ID NO: 217276 - DNA, 1938 bp, Artificial Sequence
  Description of Artificial Sequence: Synthetic coding sequence
atgataggcgaggaggtgccttcagatcagtattattgggctccccttgctcagcacgagcgcggtagtctggcctcacttgattctctgcgaaaaggaggtccaccccctcccaactggagacaaccggagctgcctgaagtgatcgccatgctggggtttcgcctggacgctgttaaatccaacgctgcagcctatctgcaacacctctgttatcgcaatgacaaagtaaagaccgatgtgaggaagctgaagggcattcccgtccttgttggactcctggaccaccctaagaaagaagttcaccttggagcctgcggggctctaaagaatatatcattcgggagggaccaggataacaagatagctatcaagaactgtgacggggtgcccgctctggtccgcttgctgaggaaggcacgggatatggatctcaccgaagtgatcacaggtaccctctggaacctctcctcacacgattccatcaaaatggaaatcgtcgaccacgccttgcatgcactgaccgatgaagttatcatcccgcattccggctgggaacgagagcctaatgaggattgcaagcctcgtcacatcgaatgggaaagcgtgttgacgaataccgccggatgtttgcgcaacgtctcctctgagaggagcgaagcaaggcggaagctgagggagtgcgatggtcttgttgatgccctgatattcatcgtgcaggcggagatcggtcaaaaggactccgattccaagttggttgagaactgtgtatgtctgctgagaaatcttagctaccaggtgcatcgagaaattcctcaggccgagagataccaggaggccgctcccaatgtcgcgaataatactggccctcacgctgccagctgtttcggagctaaaaaaggaaaggacgaatggttctcgcgcggaaaaaagccaatcgaggaccctgcaaacgatacagttgatttccctaagagaacgtccccagcaaggggctacgagctcctgtttcaaccggaggtcgtcagaatctatatctcgttacttaaagaatccaaaactcctgccatcctggaagcgtccgccggagcgatccagaacctgtgcgccggtaggtggacatatggcagatacatacgttccgccctgcgccaggaaaaagctctcagcgccatcgcagacctcctaacaaacgagcatgaaagggtggttaaggccgcaagcggggcattgaggaatctcgccgtggacgctcgtaataaagagctgattggaaaacatgcgattccaaacttagtcaaaaatctcccgggtggacagcagaattcatcctggaatttctcagaagacaccgtaataagcatcctgaacactatcaacgaagtgatcgccgagaatcttgaagccgcaaaaaaattacgggagacccaaggcatagaaaagctggtgttgatcaacaagtctggtaatcgctctgagaaagaggtgcgagccgctgctctggtgcttcagactatttggggatacaaagagctgcgaaaaccactcgagaaggagggctggaagaagagtgacttccaggttaacctgaataacgcatcaagatcccagtctagccactcatacgacgatagcaccctccctttaatcgataggaatcagaagtcagacaagaaacccgacagagaggagatccagatgagtaacatgggctcaaatacaaagtccctagacaataattatagcacacctaatgaacgaggcgatcacaatcgaaccctggacagaagtggcgaccttggcgatatggagccgctcaagggtacgaccccactcatgcaggacgaggggcaggagtctcttgaggaggagttggacgtcctggtgctggacgatgaagggggtcaagttagctacccatccatgcagaagatatag

SEQ ID NO: 217277 - DNA, 2517 bp, Artificial Sequence
  Description of Artificial Sequence: Synthetic coding sequence
atgcaggaaccaggccaaattgtcgagacatacacagaagaagatcctgagggggctatgtcagtggtaagcgtcgagactagtgacgatggcaccacacgtcgaacagagactactgtcaaaaaagtcgtaaagacagtaacaacgaggaccgtgcagccagtggccatgggccctgatggactgcccgtagacgcttccagtgtttccaacaattacattcaaaccctgggtcgtgactttagaaaaaacggcaatgggggacctggcccatatgtggggcaggctggcaccgcaacactgcccaggaatttccattaccctccagatggttactcaagacactacgaagatggctatcccggaggcagcgataactatggcagtttgtccagagtgactcggattgaggaaagatatcgccctagcatggagggttacagagccccatcaaggcaagacgtctacggacctcaacctcaggtacgagtgggagggagctcggttgacctgcaccgctttcacccggagccctacgggctggaagatgatcagcgctctatgggatacgatgatttggactatggtatgatgtcggattatggtacagctagacgaaccggtacccctagcgatccacgcaggagattacggagttacgaggatatgatcggtgaggaagtcccctccgaccagtactactgggctcctctggctcaacatgaacgcggatctttagcatctctggattccttgagaaagggtgggcctccgcctcccaactggagacagcccgaactgccagaagtaatcgccatgttggggttccgactggatgccgtgaagtcaaatgccgctgcttatctccagcatctctgctatcgaaacgataaagtgaaaactgatgtaaggaagcttaagggaatccctgtcctggtagggctgttggatcaccccaagaaggaggtacatctgggcgcatgtggggcactgaaaaatattagcttcgggcgagaccaggacaacaagattgctatcaagaactgcgatggggtacctgcactggtgaggctattgagaaaggctcgcgacatggatctgacggaggtgatcacggggaccctctggaatctctcctcccacgactccataaaaatggagattgttgatcacgccttacacgccctgaccgacgaggtcatcattcctcattcaggctgggagcgggaacccaacgaggattgtaaaccacgccatatagagtgggagtctgtcctgacaaacactgccggatgcctgcggaatgtgtcgagcgagagaagtgaggctcggagaaaactgcgggaatgtgacgggctcgtggacgcattgattttcattgtccaggccgagattggccagaaggattcagattcaaagttagtcgagaactgcgtttgtctgttgcgtaacctctcatatcaggtgcaccgcgaaatacctcaggccgagcggtatcaagaagccgctccaaatgtggccaataacacaggacctcatgctgcctcttgcttcggcgcaaaaaaggggaaggacgaatggttttctagagggaagaagccgatcgaagatcctgccaacgacacagtggatttccccaagaggacaagcccggctaggggctacgagctgctgtttcaaccagaggtcgtaagaatttatatatccctgctcaaagagagtaagactccggcaatcctagaggcaagtgcaggagctatacagaatttgtgtgccggtcgctggacatacggcagatacatccggtccgccttgcgccaggagaaagccctctccgccatcgcagaccttcttacgaatgagcatgagagagtggtgaaagcagccagtggagcattgcggaacctcgccgtggacgcgaggaacaaggaattaatcggaaaacacgctattcccaatttggtgaaaaacctacccggtggccagcagaactcttcatggaactttagcgaggacacagtcatttcgatcctcaacaccataaacgaagtgatcgccgagaatttggaggccgctaaaaaattacgtgagacacagggcatcgagaaactggtcctgatcaacaaaagtgggaacaggtcagagaaggaagtgagggccgcagcacttgtcttgcagacaatttgggggtataaagagctgcgcaaaccactcgaaaaagaaggttggaaaaaatccgattttcaagtaaacctgaacaacgcctctcgctcacaatcatctcacagttacgacgactcaaccctacctctcattgacagaaaccagaagtctgacaagaagcccgatcgggaggagatccagatgtctaatatgggtagcaataccaagtctctcgacaacaactatagcacaccaaacgagagaggcgaccacaatcgcactctggaccggtcaggcgatctcggggatatggagcccttgaaaggcactacgcccctgatgcaaaagatctag

SEQ ID NO: 217278 - DNA, 2640 bp, Artificial Sequence
  Description of Artificial Sequence: Synthetic coding sequence
atggccaacggtacactcaccagacggcatcaaaacggacggtttgtcggcgatgccgacctggaaaggcagaagttttcagatctgaagctgaacggaccccaggaccacagtcacctgctgtactccactattcccaggatgcaggagccaggacagatagttgagacctacacagaggaagatcctgagggagctatgtctgtggtttctgttgagaccagtgatgatggcaccacaagacgcaccgagacgaccgtgaagaaggtggttaagactgtgacgactcggactgtgcagcccgttgccatgggtccagacggcctgcctgtcgatgcttcaagtgtttcgaataactatatccaaaccctcggcagagacttccgtaagaacggcaacggaggtccaggcccttacgtcggccaggcaggaaccgctacgctcccacgcaactttcattaccccccagacgggtattcacgacattacgaggatggttacccgggtggcagcgacaactacgggtccttgtctcgggtaaccaggatagaggaaaggtacaggcctagtatggaaggctacagggcgccatcccgccaagacgtgtatggcccacagccgcaagtcagggtagggggaagcagcgtggacttacaccgcttccatccagagccttatggactggaggacgaccagcggtctatgggatacgacgatctggactacggcatgatgtcggactacgggacagcacgcagaacagggaccccgtctgatccgaggaggcgcctgaggagttacgaggatatgataggggaggaggttccatccgatcagtattactgggctccactggcacagcacgagcgcggatctctggccagcctggattctttgagaaaggggggaccgccaccacccaactggcgccaacctgagcttccggaagtcatcgccatgctggggttcaggcttgacgctgtgaagtccaatgcagccgcttacttgcagcacctgtgttaccgtaacgacaaggtcaaaacagacgtgcggaaactgaagggtattcctgttctggtgggcctgctggaccacccgaagaaggaggtgcaccttggtgcgtgcggtgctttaaaaaatatctcatttggacgagatcaggacaataagattgcaattaagaattgcgacggagtaccagctctggtgcgattactgcgaaaggcgcgagacatggatctgaccgaggtgatcactgggactctgtggaatttatcatctcacgattctatcaagatggaaattgtggaccatgcactgcacgcattgacggacgaggtaatcattccccacagcggatgggagagagaaccaaatgaggactgtaaacccaggcatatcgagtgggaaagtgttctcaccaacactgccggatgccttaggaacgtttctagtgagagaagcgaggccagacgaaagttgagagagtgcgacggactcgtcgacgcactaatcttcatcgtgcaagcagagatcggacaaaaagattctgacagcaaacttgtggagaactgcgtgtgcttattgcgcaacctgagctaccaagtccaccgggagattccgcaggcggagcggtaccaagaggccgctcctaatgtggctaataataccggccctcacgcagctagctgcttcggcgcaaaaaagggcaaaggcaaaaaacctatcgaggatcccgctaacgacacagtggattttcctaagaggacgagcccggcacgcggttatgaactcctgttccaacctgaggtagtgcggatctacatcagcctgttgaaggagtccaagacccccgctattctggaggctagcgccggagccatccagaatctgtgtgccggtcgatggacttatggacggtatatcaggtcggcgctgagacaagagaaggcactgtccgccatagctgaccttttgactaatgagcatgagagagttgtcaaagccgcttctggagctctccggaatctggcggtagacgctcggaacaaggaacttattgggaaacatgccatacctaatctggtgaaaaatctacccggtggtcagcagaattcttcctggaatttcagcgaagataccgtgatttccatcctgaacacaattaacgaggtgatagcggagaacctggaagccgcaaagaagcttcgtgagacccagggcattgaaaagctcgtgcttattaataaatcgggaaaccgcagcgaaaaggaggtgcgggcagctgcgctggttttgcagacaatctggggatacaaagaactccggaaaccactagaaaaggaggggtggaagaagagcgacttccaggttaacttaaataacgctagtcgttcccagtcatcccactcttacgacgactctactctccctctcatcgatcgcaatcagaagtctgataagaaaccagaccgggaggagatccaaatgagtaatatgggatccaacacaaagtctcttgacaacaactactctacccccaatgagagaggggaccacaacaggacactagatcgaagtggggacttgggggacatggagccgctcaaggggacgaccccactgatgcagaagatctag

SEQ ID NO: 217279 - DNA, 2640 bp, Artificial Sequence
  Description of Artificial Sequence: Synthetic coding sequence
atggccaatgggacattgacaagaaggcaccaaaatggaagatttgtgggtgatgcagatcttgagcggcagaagttctctgaccttaagctgaatgggcctcaggaccattctcatctgctttacagcaccattcccagaatgcaggaacccggacagattgttgagacttacacggaggaagatcccgagggggcaatgagcgtggtctcagtcgagaccagcgatgacggaactacacgcagaaccgagacaacagttaaaaaagtagtaaagacggtgaccacaaggaccgtgcagcctgttgccatgggtcccgatggactacctgtggacgcatccagcgtcagcaacaactacatccagactctaggtcgcgattttcgcaaaaatggaaacgggggtcctggaccatacgtcggccaggccggaacagcaacattgccaaggaattttcactacccaccagatggttattcacggcattacgaagatgggtaccccggtggtagcgacaattacggttctctgagcagagtgacgcgtatcgaggagcgctaccgaccctctatggaaggctatcgggctccatctcgccaagacgtttacggaccacagccccaggttcgcgtcgggggatcgtccgttgacctgcatcggtttcacccagaaccttatggcctagaagatgatcagcgctctatggggtacgacgatctggattacgggatgatgagtgattacggcactgcacggaggactggcactccttctgatccgaggcgcaggcttagatcatacgaggacatgattggtgaagaggtcccatccgatcagtactattgggctccactcgctcagcacgagcgcggaagcctggcatccctggattcactgcggaaaggcggaccccctccacctaactggcgtcagcccgagctgccagaggtgattgcgatgctaggttttagactggacgctgtgaaatccaacgctgcagcctatttgcagcatctgtgctatcgaaacgacaaagtgaagaccgacgtgagaaagctgaaaggaattcccgttttggtgggcctgttggatcacccgaagaaggaggttcatctgggagcctgcggggcattgaagaacatatcattcggaagagaccaagacaataagatagctattaagaactgcgacggtgttcccgctttggttagactgttacgcaaagctcgtgatatggacttaaccgaagtgataaccggtactctctggaacctgagctcccatgattcgattaaaatggagattgtcgaccatgctctccatgcccttaccgacgaagtaataattccacactctgggtgggagcgtgaaccaaacgaagactgtaagccgaggcacattgagtgggagtctgtactgaccaacaccgccggatgcctgcgaaacgtgtcttccgagagatcagaagcgaggaggaaactgagagaatgcgatggtctcgtcgatgccctcatctttatcgtgcaagctgaaatcggccagaaggactccgattcgaagctcgtggagaactgtgtctgtctcctcaggaacttgtcatatcaggttcaccgagagatcccacaggcagaaaggtaccaggaagctgcgcctaacgtcgccaataatacaggccctcacgctgccagttgttttggagccaagaaaggaaaaggcaagaaacccatcgaggatcctgctaatgacacggtggattttcccaaaaggacctcgcccgctaggggctatgaactgttatttcaaccagaagtcgttcgcatttatatctcgctactgaaggagagtaaaacccccgctatcctggaggcgtcagctggcgcaatccaaaatctttgcgccggaagatggacatatgggagatatatcagatctgccttgcgacaggagaaagccctgtccgccatcgcggatcttcttaccaatgagcacgaacgcgtggtcaaagctgcctccggagcgctccgcaatctggcggtggacgctaggaataaggagctcatcgggaagcacgccataccaaacctggtcaagaacttgcccggtggtcaacagaacagcagctggaattttagcgaggatacggtgatctctatcctgaatactataaatgaagtgatagcagagaatctggaagccgctaaaaagctgagagaaactcagggaattgagaaacttgtgctgatcaataagtccggaaatcgcagcgaaaaggaggtgagggcagctgccctcgtgctgcagacgatatgggggtataaagagctgagaaaaccactggagaaggagggatggaagaaatctgactttcaggttaatctcaataatgcctcgaggtcacagtcttcccactcttacgatgactctacactgcccctcattgatcgcaatcaaaaaagtgataagaagccagaccgcgaggagattcagatgtcaaacatggggtcgaataccaaaagtctggacaacaattattccactcccaatgagcgtggagaccacaataggacacttgatcgttccggcgacctgggagatatggagccactgaagggaaccactcctctgatgcaaaaaatttag

SEQ ID NO: 217280 - DNA, 2499 bp, Artificial Sequence
  Description of Artificial Sequence: Synthetic coding sequence
atgcaggagcctggacagatagtggagacttacaccgaggaagatccagagggcgcaatgtctgttgttagtgttgagacctcggacgatgggacaacccggaggactgaaacaacagtgaagaaagtggttaagactgtgaccaccaggaccgtgcagcctgttgcaatgggcccagatggcctgcctgtggatgcttcttcagtgtccaataattacattcagacattggggcgagactttcgcaagaatggcaacggaggccctggtccgtatgtcgggcaggccggaacagcaactttgcctcggaatttccactaccctcctgacggatactcccggcattacgaagacgggtacccgggaggttccgacaattacggaagcctgtctcgggttacaaggatcgaggagagatatcggccaagtatggaagggtatagggcgccatcacgccaagacgtgtatggacctcaaccccaggtccgcgtggggggatcgtcagtggacctgcaccgctttcaccctgagccctacggcctggaggatgaccagcgcagcatgggatacgatgacctagattacggcatgatgagtgactacggcaccgcaaggcgcactggcacccctagcgatcctaggcgcaggctccggtcctacgaagatatgattggcgaggaagtacccagcgatcagtactactgggcccctctggctcagcacgagcggggtagcctagcatcactggacagtctgcggaaagggggacccccaccaccaaactggagacagccagagctccccgaagtcattgccatgctgggatttcgcctcgatgcagtaaagagtaacgctgcggcatacttacaacatctgtgctacagaaatgacaaggtcaagaccgatgttagaaagcttaaaggcattcccgtgttggtgggtttgctagatcaccctaaaaaggaggtgcacctgggtgcttgtggtgctctgaagaacattagttttggaagagatcaggacaataaaatagctataaagaactgcgacggcgtgccggcactcgtacgactgctgcgtaaggctcgggacatggacctcacagaagttatcacgggcaccctgtggaacttgtctagccacgacagtattaagatggagattgttgatcacgccctgcacgccctaactgacgaagtgattattccacactcaggatgggaacgagaacccaacgaggactgcaaaccccgacacattgaatgggaaagcgtgcttactaatacagcaggttgccttcgcaatgtgagcagcgagagatctgaggctcgcaggaagttgcgcgagtgtgatggtctggtggatgccctcatttttattgtacaggcagagatcggccagaaggattctgactctaaactggtggagaactgcgtgtgcctgttgcgcaatttaagctaccaggtgcatcgggaaatcccgcaggcggaacgataccaagaggctgcacccaatgtggccaacaacacgggaccccatgctgcctcatgcttcggggctaagaaaggcaaaggtaaaaagccaatagaggatccagccaacgacaccgtggatttccccaaacgaacgagcccagctaggggctacgagttactgttccagcccgaagttgttcggatctatattagtctactgaaggagtcaaaaaccccggcaatccttgaagcctctgcgggtgccatccagaatttgtgtgctggcaggtggacatacgggcgatatataaggtccgccttgagacaggagaaagccctaagtgcgatcgccgacttgttaaccaacgagcacgagcgggtggtgaaagctgccagtggcgctctcaggaacctcgctgtagacgcgcgtaataaagagctgattggcaagcacgcgattcctaacctggtgaagaacctgccgggaggccagcagaattcatcctggaatttttccgaggacaccgtcatctctatccttaacactatcaacgaagttatcgccgagaacctggaggcagccaagaaactgagggagactcagggtatcgagaagctggtgctgattaacaaatcagggaatagaagcgaaaaggaagtgcgcgctgccgctctcgtccttcaaacaatctggggctacaaagaactcaggaagcccctggaaaaagaaggatggaaaaagtctgatttccaggtcaacctgaacaatgcgtctcgctcccaatccagtcacagctatgacgattcaacactcccccttatcgatagaaaccagaagtccgacaagaaacctgatagagaggaaattcagatgtctaatatgggatccaacactaaatcactcgataataattactctacccctaacgaacgcggtgatcataatagaactctggaccgctcaggcgatctcggcgatatggaacccctgaaaggtactactcctctgatgcagaaaatttag

SEQ ID NO: 217281 - DNA, 390 bp, Artificial Sequence
  Description of Artificial Sequence: Synthetic coding sequence
atggccaacggaacacttacccgcagacatcagaacggcagattcgtaggcgacgctgatttggaaagacagaaattctccgacctaaagcttaatggccctcaggaccactcccacttgctgtactccaccatccccagaatgcaggagccgggtcaaattgtcgaaacttacactgaagaggacccggagggcgcaatgtcagtggtgtcggtggagacctccgatgacgggactacaaggagaaccgaaaccactgtaaaaaaagttgttaaaacagtgaccacacgaaccgtgcagcctgtcgccatgggacccgacggactcccagtcgacgcgtcatctgtatccaacaattatatccaaacactggggagagacttccgctag

SEQ ID NO: 217282 - DNA, 2586 bp, Artificial Sequence
  Description of Artificial Sequence: Synthetic coding sequence
atgcaggaacctggccagatcgtggaaacatataccgaagaagacccagagggagccatgtccgtcgtatctgtggagacttccgatgatggaaccaccaggcggactgaaactaccgtgaagaaggtcgttaaaacggtcaccacccggaccgtccagcccgtggccatgggcccagatggtttgcccgtcgatgcctcgtctgtatcaaacaactatatccagactttaggacgggactttcggaagaacggaaacgggggtcccggaccatacgtgggccaggcaggcaccgctacgctgcccaggaattttcattatcctccagatggttactcccggcattatgaggacggatatcctggcggtagcgacaattatggcagtctttctcgagtgactagaatcgaggagaggtaccgaccttctatggaaggatatcgtgcgcctagccggcaggatgtgtatgggcctcagccccaagtgagggttgggggttcatctgtcgatctgcaccgctttcatccagagccttacgggctggaagacgatcagaggagcatgggatacgatgacctagactacggcatgatgagcgattacggcaccgccaggaggacaggtacaccctccgacccacggaggaggctgaggtcctatgaggatatgatcggcgaagaggtaccctcagatcagtattactgggcaccacttgcccaacacgagaggggatctctggccagcctggatagtctcagaaagggtggccctcccccaccaaactggcgtcagcctgagctaccagaggttattgccatgttaggctttcgtctcgacgcagtgaaatcgaacgctgcagcctacttgcagcatctgtgttatcgcaacgacaaggtgaaaacggacgttagaaagttgaagggaatccccgtgctcgttgggctgctggatcatcccaaaaaggaggtgcatttaggggcatgcggggctttgaagaatataagcttcggacgagatcaggacaacaaaatcgcaataaagaattgcgacggggtgcctgcactggtaagactccttcggaaggccagggatatggacctcaccgaagtgatcacaggaactctgtggaatctcagttcccacgacagtattaaaatggaaatagtggaccacgcactgcatgccttaactgatgaggttatcatcccgcactccggctgggagcgtgagcctaatgaggattgtaaacctcgtcacattgagtgggaaagcgtgttaaccaatactgcaggttgccttcggaacgtaagttcagaaaggagcgaagcaaggcgcaagttgagagaatgtgacggtctggtggatgccctgatttttatcgtgcaggccgagattggtcaaaaggactccgattctaaactcgttgagaactgcgtgtgcttgctcaggaacctgagctaccaggttcatagggagatcccacaagccgaacgctaccaagaggcagcacctaatgtggcgaataatacagggcctcatgccgcttcgtgtttcggcgctaagaagggcaagggcaaaaagcccatcgaagaccccgctaacgatactgtcgacttccccaagcgcaccagcccagctcgtggttacgagctgctgttccagccagaagtggtgcggatatatatttccctgctcaaagagagcaagacccctgcgatcctggaggccagtgctggagcaattcagaatctttgtgcagggaggtggacctacggacgatatatcaggtccgccttaagacaagagaaggctttgagcgccatcgctgacctcctgactaacgaacacgagcgggtggtgaaggcagccagcggagctctgagaaacctggccgtggacgcacgaaacaaggaactaatcggtaagcatgccatcccgaatctcgtgaaaaacctacccggtggccaacaaaacagttcttggaatttttccgaggataccgtcataagtattctaaatactatcaatgaggttatagctgagaatctcgaagctgcaaagaagctccgcgaaacacagggcattgaaaagctggtcctaatcaataaatctggcaacaggtctgaaaaggaagtgcgcgcagccgctttagtactccagacaatttggggctacaaagaactgcgcaaaccccttgagaaggaggggtggaagaagtctgattttcaagttaacctgaacaatgcttcacgaagccagagttcccactcctatgatgattctacgctgccgctgatcgaccgcaaccaaaagagtgataagaaacctgacagagaagaaattcagatgtcaaacatggggagcaatactaaatcattggataacaactactcaacccccaacgagaggggggatcacaaccgaactcttgacaggtctggagaccttggcgacatggaacccctgaagggaacaactcccttgatgcaggacgaggggcaagaatctctagaggaagaactggatgtcctggttctcgatgatgagggaggccaggttagctatccaagtatgcagaagatctag

SEQ ID NO: 217283 - DNA, 2658 bp, Artificial Sequence
  Description of Artificial Sequence: Synthetic coding sequence
atggctaatggaactctgacccggaggcaccagaatggcagattcgtgggagacgccgaccttgagaggcagaaattcagcgatcttaaactgaacggaccacaggaccattcacatctgttgtatagtacaatcccacgtatgcaagagccgggtcagatcgtcgaaacttacactgaagaggatcctgagggcgcaatgtccgtcgtgagtgtggagacctcagacgatgggacaacccgcaggactgagacaacggtcaagaaagttgtgaaaactgtaactaccaggaccgtgcaacccgtggctatggggccagatggcctacctgttgatgcctctagcgtgtcaaacaactacatacagacgcttgggagagacttccgaaaaaatggaaacggagggcctggaccctacgttggccaggcgggaaccgctacactgcctcgtaacttccactaccctcccgacgggtattctcggcattacgaggacggttatcctggcggaagcgacaactatggaagcttgtctagggtaacacggatagaggagaggtatcgccctagtatggaggggtacagggctccttctcggcaggatgtgtatggtccccagcctcaggtgcgggttggaggctcgtctgtcgacctgcacaggtttcacccggagccatacggcctggaagatgaccagcgatccatgggatacgacgacttagactatgggatgatgagtgattacggcactgcccgaaggaccggcacaccttccgaccctcgcagacgtcttcgcagctatgaagatatgatcggtgaggaggtcccgtccgatcaatattattgggcgcctctagctcaacacgaaagagggtctctggcaagcctggatagtctgcggaaaggcggacctcctccacctaactggcgacagcctgagctcccagaagttatagcgatgttgggattcaggctggacgccgttaagtctaacgctgcggcttacctccaacacttatgttacaggaacgataaagttaagaccgatgtccgtaaacttaaagggatccccgtgctcgtggggctgctggatcatccgaagaaggaggttcacttgggtgcctgcggggctctcaaaaacatctccttcgggagggaccaggataataagatcgcaatcaaaaattgtgacggtgttccagcccttgtaaggctcctgcggaaagccagggacatggatttgacggaggtgattactggtacactctggaatctttccagtcatgattctattaagatggagattgtcgatcacgccctgcatgcactgaccgatgaggtaatcatcccacacagtggctgggaacgggagccaaacgaggactgcaaaccaaggcacatcgagtgggaaagtgttttaaccaacactgccggatgtctcagaaatgtctcgtctgaacggtctgaggccaggagaaaactgagagagtgcgacggcttggttgatgccctgatctttatcgtccaggctgagatcggacaaaaagattccgatagcaaattggtggagaactgcgtgtgtctactgaggaacctcagctaccaggtgcaccgagaaataccccaggcagaaaggtaccaggaagccgcacccaacgtggcaaataatacaggtccacacgccgcaagttgctttggtgccaaaaagggaaaagacgaatggttctcccggggaaagaagcccatcgaagaccctgcaaatgacactgtggacttccctaagcgcacatcccctgccagagggtacgaattactctttcagccagaggttgtcagaatctacataagcctgctaaaggaaagcaagactcctgcaattctggaagcatctgccggagctattcagaacctctgtgccggacgatggacttacggacgatacatcaggtcagccctaagacaggaaaaggctctttctgccatagccgacctcctaacaaatgaacacgagcgcgttgtcaaagcagcctcaggtgccttgcggaacctggccgttgacgctcgcaacaaagagctgataggcaaacatgcaatcccgaacctggtcaaaaacctgcctggaggccagcagaatagttcttggaatttcagcgaggatacagtcatcagtatcctcaatactatcaacgaagtaatcgctgagaacctggaggccgcaaaaaagttgagggaaactcagggcatcgagaagctcgtcctcataaataaaagtgggaaccggtctgagaaagaggttcgagcagctgctctcgttctccagacgatatgggggtataaggaattacgtaaacccctcgagaaggagggctggaaaaagagcgattttcaagttaacctgaacaatgcctcccggtctcagagcagtcattcttacgacgactctactctcccgctgatcgacagaaaccagaaatccgacaaaaagcccgatcgggaggagatacagatgagtaacatgggctctaacacaaaatctttagataacaattacagtacccccaacgagcgcggagaccacaacaggacattagaccgtagtggcgatttaggggacatggaacctttgaaaggaacaacaccccttatgcagaagatttag

SEQ ID NO: 217284 - DNA, 1920 bp, Artificial Sequence
  Description of Artificial Sequence: Synthetic coding sequence
atgatcggagaagaagtcccgagcgaccagtattactgggctcccttagcccagcacgagagggggtcactggcctcactggacagcttgaggaaagggggacctcctcctcccaattggagacagcctgaactgcctgaggtgatcgccatgctgggctttaggcttgacgcagtgaaaagcaacgcggcagcctatctgcagcatctctgctatcgcaatgacaaggtgaaaaccgatgtgcggaagttaaagggcatccctgtgctggtgggccttctggaccatcccaaaaaagaggtgcatctcggggcttgcggcgcactgaaaaacatctcctttggaagagatcaggacaataaaatcgccattaaaaattgtgacggggtgcctgccctggtacggctgctgcggaaagccagagatatggacctcaccgaggtaattacgggcaccttatggaatctgtcgtcacatgatagcatcaaaatggagatcgtagaccacgcccttcacgccctgacagacgaagtcattatccctcactccgggtgggaacgcgaaccaaatgaagactgcaaaccaagacatattgaatgggagtctgtgctgacgaacactgctggctgtctccggaatgtgagtagcgagagatccgaagctaggcgaaaactgcgggagtgcgatgggctggtggatgccctgatctttattgttcaagccgaaatagggcagaaggactctgattccaaacttgtcgagaattgcgtgtgccttttgcgcaatctgtcataccaagtacacagggaaatcccccaggctgagcggtaccaggaagcagcgcctaatgtagcgaataataccggacctcatgcagcatcttgcttcggggcaaaaaagggcaaggggaagaaacccatcgaggacccagcgaacgatacagtcgactttccaaaaagaacaagccctgcacgtgggtacgaacttctgttccagccggaagtcgtgcgtatatacatatcacttctcaaggaaagcaaaacacctgccatcctggaggccagtgccggagcgatccaaaacctgtgtgcaggacggtggacttatggacgctacatcagaagtgctctgagacaggaaaaggctctgagcgctattgccgatcttctcaccaacgaacacgaacgcgtcgtgaaagccgcttctggcgctctgcggaatctagcagtagacgcgagaaacaaggagttgataggcaagcacgccatacccaatttagttaaaaaccttcccggagggcagcagaattcatcatggaatttctctgaagatactgtaatttccatactaaacacaatcaacgaagtgatcgcggagaatctggaggccgcaaagaaactccgggagacccaaggaatagagaagttggtcctcataaacaagtccggcaaccgctccgaaaaggaggtgcgagctgcggcactggtgctgcaaacaatttggggatataaagaactcaggaagcctctcgagaaggaaggatggaagaaaagtgatttccaggtgaacctcaacaatgccagccgctctcagtctagccactcttatgatgattcaacattacctctgattgacagaaatcagaagagtgataaaaagcccgatcgtgaggaaatccagatgtctaacatggggtccaatacaaagtccctagataacaactacagtactccaaatgagcgaggcgatcataatcggaccttggaccggagtggcgatctgggcgatatggaaccattaaagggtacgacacccctcatgcaggatgaggggcaagagtcactcgaggaggagctcgatgtgctggtgctagatgatgaggggggtcaggtgtcttacccctccatgcagaagatctag

SEQ ID NO: 217285 - DNA, 2499 bp, Artificial Sequence
  Description of Artificial Sequence: Synthetic coding sequence
atgcaggagccaggtcagatagtcgaaacatacactgaagaggaccccgaaggagccatgagcgtggtcagtgtagagacctctgatgatggaacaacacggcgaactgaaacgactgtgaaaaaggtcgtgaagacggtgacgacacgcacagtgcagccagtagctatgggcccagacggattacccgtggacgcaagtagtgttagtaataattacatccaaaccctggggagggatttccgcaagaacggcaacggcggtcccggaccttatgttgggcaggccggtaccgcaaccctacctcgcaatttccattacccccctgatgggtattcgcggcattatgaggatgggtaccctggaggtagtgataattacggatctctgagccgtgtgactcgcattgaggagcgatatcgcccatctatggagggctatagagccccatctcggcaggacgtgtatggacctcagccccaagtgagggtgggaggctcctccgtcgatctgcacagatttcatccggaaccctacggactagaggacgatcagcggtcaatgggatacgacgacctggattacggcatgatgagcgattatggcactgcccgacgcacaggtacgcccagcgatcctcggagaaggctccggtcgtacgaggacatgattggagaggaagtgccgagcgatcagtattactgggcaccactggcgcaacatgagagggggtcactggccagcctggactccctgcgcaaaggaggcccacctccaccgaactggcgtcaacccgaactgccggaggtgatcgcaatgctcggatttcggctggatgcagtaaaaagcaatgcagcggcttacctccagcacctttgttatcgcaacgataaagtaaagacggacgttcgcaaactcaaaggaattcctgtgctggtgggtctgcttgaccatccaaagaaagaagtacacttgggagcctgtggagccctgaagaatatctccttcggcagggatcaggacaataaaatcgccattaagaactgcgacggcgtacccgctctcgtacgcctgctgcgcaaggcaagggacatggacctgacagaagtaattaccggtacactgtggaacctgtcctcccacgacagcattaagatggagattgtggatcatgccctgcacgcactgaccgacgaagtaatcattccacattcaggctgggagagggagccaaatgaggattgtaagccgaggcacatcgaatgggagtcagttcttacgaacactgcagggtgcctgcgaaacgtatcatccgaaaggtcagaggctcgtcgcaagcttagagagtgcgacgggctcgtggatgcgctgatcttcatagttcaggctgagattggccagaaggattcggactctaagttagtggagaactgtgtgtgtcttctgcggaacctgagttaccaggtgcaccgcgaaataccccaggccgagcgttaccaagaagctgcacctaacgtagcgaacaatacggggcctcatgctgccagctgcttcggtgcaaaaaagggtaagggtaaaaagcctattgaggatccggcaaacgataccgtggacttccccaagaggacctcaccagcacgcggatatgagctcttgtttcaacccgaagtggtacggatttatatttcccttttaaaagagtccaaaacgcctgcgatcctggaggcaagcgcgggagctatacaaaacttgtgcgcgggtcgatggacatacgggagatacatccgcagcgcactgcggcaagaaaaggccctctcagccatcgcagacctgttaactaacgagcacgagcgcgttgttaaggccgcttccggcgctctgcgtaacctcgctgtggacgcacgaaacaaagaactaatcggaaaacatgcaatacccaatttagtaaagaacttgcccggagggcagcagaatagttcctggaacttctctgaagatacggtcatttccatattaaacactataaatgaggtgatagccgagaacctggaggccgctaagaaactgcgggaaacacaaggcattgaaaagcttgtgttgataaataagtccggtaacagaagcgaaaaggaagttagagccgcagcactggtcctgcagaccatctggggctacaaagaactaaggaaaccgctggagaaagaaggatggaagaaaagcgacttccaggtcaacctaaacaatgcctcacgcagccaaagctcgcactcttacgacgacagtaccctgcccctaattgatcggaaccagaagagcgacaagaagcccgatcgtgaggagattcaaatgagcaacatgggttctaacacaaagagcttagacaacaattactcaactcccaatgagaggggcgaccataatcgcacattggaccgatcaggcgatctcggagatatggaaccgctaaaggggactaccccgttgatgcagaagatctag

SEQ ID NO: 217286 - DNA, 2499 bp, Artificial Sequence
  Description of Artificial Sequence: Synthetic coding sequence
atgcaggagccgggtcaaattgtagagacttatactgaagaggacccggagggcgctatgagcgtggtgtcagtggagacaagcgacgatggaacaacgaggagaaccgagaccactgttaagaaagttgtgaaaactgtcacaacacggacggtccagcctgtggccatgggaccagatggactgccggtcgacgcttcgtcagtgtctaacaattatattcagacactcggcagagacttccgaaagaacggaaacggcggacctggtccatacgtgggccaggcgggaactgctacgctgcccaggaacttccattatcccccagacggctatagtcgccactatgaggatggctatcccggtggcagcgataattacgggtcactgagccgagttaccaggattgaagagcgttaccgaccatccatggagggctaccgggcacccagccggcaggacgtgtatggaccgcaacctcaggtgagggtggggggttccagtgtcgacctgcacaggttccatcccgaaccctatgggcttgaagatgaccagcgaagcatgggctacgatgatcttgattatggtatgatgagcgattatgggacggctcgtagaaccggcacgccctcagaccctagacggaggctccggagttatgaagatatgatcggagaagaagtgccgtcggaccagtattactgggctcctctcgcccagcacgaaagaggatcattggcttccctggatagtctgagaaaaggcggtcctccccctcccaactggagacaacccgagctaccggaggtcatcgccatgctgggttttagattggatgccgtaaaatccaatgcggctgcttatctacagcacctctgctaccgcaatgacaaggtcaaaacggacgtccgaaagctcaagggcatcccggttctggtcgggttgctcgatcatcctaaaaaggaagtacacctgggtgcttgtggcgctctgaaaaacatcagcttcggcagagatcaggacaataagattgccattaaaaattgtgatggcgtgcccgcactcgttcgcttactgagaaaggccagagacatggacctcaccgaagtgattacaggaacactctggaatctgtccagtcatgactctatcaaaatggaaattgtagaccacgcactccacgcactgactgatgaagtcatcatcccccactctgggtgggagcgcgaacccaatgaagactgcaagccccgacacattgagtgggagtccgtgctgacaaacaccgccggatgtctgcgcaatgtttcctccgagagatctgaggcccgaaggaagttaagggaatgcgatggtttagtcgatgccctcatattcatcgtgcaagctgagatagggcagaaagattcagactcaaaactggttgagaattgtgtttgtcttctgagaaacctgagttaccaggtgcatcgggagataccgcaggcagaacgatatcaggaagccgctcccaatgtggccaacaataccggccctcacgccgcttcatgtttcggggcaaagaaaggaaaggggaagaaaccaatagaggatccagcaaacgataccgtagacttcccgaaacgcaccagtcctgctagaggatacgagctcttgttccaacccgaagtggttagaatttatatcagcttacttaaagagtccaagactccggcaatccttgaggccagtgccggagcaatccaaaatctttgcgctggtcgctggacatacggcagatacattcgcagtgccctccgacaggagaaggcactgtctgcgattgctgatctgttgaccaacgagcacgagagggtggtgaaggctgccagcggagcgttaagaaatctggccgtggacgccaggaacaaagaactgattggcaagcacgcgatccccaatttagtaaagaaccttccagggggacagcagaactcttcttggaatttttccgaggatacagtgatcagcatacttaatactattaatgaggtgatcgctgagaaccttgaagccgctaagaaacttcgcgagactcagggcattgagaagttagtcctgatcaataagtccggcaatcgctctgaaaaagaggtccgcgctgcagctctcgtcctgcagacaatctggggatataaggaactgaggaaacctttagagaaggagggctggaaaaaaagtgattttcaagtgaatcttaacaacgcctctaggagccagtcaagtcattcctacgatgatagcacccttcccttgattgacagaaatcaaaagagcgataaaaagcccgaccgcgaagagattcagatgagcaacatgggctctaacacgaaaagcttagataacaactactccaccccgaacgaacggggagatcacaataggactttagatcggtccggcgaccttggagatatggaacctcttaagggcacaacaccactaatgcaaaagatctag

SEQ ID NO: 217287 - DNA, 2640 bp, Artificial Sequence
  Description of Artificial Sequence: Synthetic coding sequence
atggctaacggcaccctcacacggaggcaccagaatggacggtttgtgggggatgctgatctggagaggcagaaattttcagacctcaagttgaatggacctcaagaccatagtcacctgctgtattcaactattcccagaatgcaggagccgggacagattgtggagacgtataccgaggaagatccagagggcgcaatgtccgtagtctctgtcgagacaagcgatgacggcacaacccggaggacggagaccacagtgaaaaaagtggtcaagactgtcaccacccggaccgtgcagccggtcgcaatgggacccgatgggctgcctgtggacgcatcatcagttagcaacaactatattcaaactctcggccgagactttcgtaaaaatggaaatgggggacctggcccatacgtcggacaggccggaacagccaccctgccccgaaacttccactacccgcctgatggctattctcgccactatgaggacggatacccaggcggaagcgataactatggatccttatcaagggttacccgtatcgaagagagatatcgaccctcaatggagggttatagggctccatcaagacaggacgtatacggaccgcaacctcaggtacgtgttgggggaagctcggtggatctgcatcgttttcaccccgaaccctacggcctcgaggacgatcagaggtccatgggctatgacgatctcgactatggaatgatgagcgactatggaaccgccagaaggaccgggactccttctgatccgagacgcaggctgcggtcgtatgaggatatgattggagaagaggtaccctccgatcaatactattgggctcctttagctcagcacgaacgcggttctcttgcctctctcgatagcttacgtaagggcggtccacctcctcctaattggcggcaacctgaactcccagaagtgatcgctatgcttgggtttaggctcgacgctgtgaaaagtaatgcggctgcctacctacagcacctgtgctaccgcaacgataaagtgaaaaccgacgtacggaagctcaagggtatccctgtgttagttgggctgctggatcaccctaaaaaagaggtgcacttgggagcttgtggcgctctgaagaatatatccttcggtcgcgaccaggataataagatcgccatcaagaactgtgatggtgtgcctgcgttggtcagactgcttaggaaagcgagagacatggacctgactgaggttattaccggaactctgtggaatctttcttcgcacgacagcatcaagatggagatcgtcgaccatgccctgcacgcgttgacggacgaagtcatcataccacacagcggctgggagagagaacctaatgaggactgcaagccacgccacatcgagtgggagagcgtgttgaccaacacggctggatgtcttcgaaacgtctcaagtgaacggtcggaggcccgacggaaactccgcgagtgcgacggcctggtggacgcactaatatttattgttcaagcagaaatcggccagaaagattctgattctaagttggtggagaattgtgtgtgtctactgaggaatctatcatatcaggtacacagggagattcctcaggctgagcggtatcaggaagcagctccaaatgtggcaaataacaccggaccgcacgctgcctcatgcttcggggcaaagaagggtaaggggaaaaaacccatagaagaccccgctaatgacactgtcgactttccaaaacggacttcccccgctaggggctatgagctgctttttcaacctgaagtcgtgaggatttacatctcccttctcaaagagtcgaaaacaccggctattctggaggccagtgcaggcgctatacagaacctgtgcgcgggacgctggacctacggcaggtacatccggagcgccctgagacaggaaaaagcactgagtgcaatcgccgatctgttaaccaatgagcacgagagggtcgtcaaagctgccagtggcgctctgcgcaacctggcagtcgacgcgagaaacaaagagctgatcgggaagcatgctattcctaacttggtgaaaaacctgcccggaggccagcagaattccagctggaactttagtgaggacacagtaatttccattctgaataccatcaatgaagtgatcgctgaaaatcttgaggccgcaaagaaactgcgtgaaacacagggtattgagaagctggtccttattaacaaatccggaaacaggagtgagaaggaggtacgcgcagcagcgttggtcctccagacaatctggggttataaggaactccgtaagccactcgaaaaggaggggtggaaaaagagcgacttccaagtcaatcttaacaatgctagccgatcgcagtctagtcactcgtatgatgactccaccctgcccctaattgatcggaatcagaagagtgataaaaagccggaccgggaggagatccagatgtccaacatgggctccaacactaagagcctggataataattacagtacccccaacgagcggggtgaccataacaggacactcgatcgttccggtgacttgggcgacatggagcctctcaagggcacaacgcccctgatgcagaaaatttag

SEQ ID NO: 217288 - DNA, 2523 bp, Artificial Sequence
  Description of Artificial Sequence: Synthetic coding sequence
atgcaggagcctgggcaaatcgtagagacctacactgaggaagatccagagggcgctatgagcgtggtgagcgtggagaccagcgacgacgggacgacaaggcgaacagagacaactgtcaaaaaagtggtgaaaaccgtgactacaaggaccgtgcaaccagttgccatgggtccggatggattgcccgtggacgctagttcggtgagcaataattatatccagaccctcggacgagactttcgcaaaaatggcaacggtggtccaggtccctacgtggggcaagccggtaccgctactctaccaagaaacttccactatcctcccgatgggtattccaggcattatgaggacgggtacccagggggatcagacaactatggatcattgtcgcgggtgacgcggatagaggagagatacagacccagtatggagggctacagagctccctctcgccaagatgtgtacgggcctcagccacaagtgcgagtcggcggatcttctgtggacttacaccgattccatcctgagccatatggtttggaggacgatcagcgctcgatggggtatgatgatcttgattacggtatgatgtccgattacggcacagcaagacggactgggacacctagtgatcccagaaggagactacgctcatacgaagatatgattggcgaagaagtgccgagtgaccagtattactgggcgccactagctcagcacgagcgtggctcacttgctagtctggattcattacgaaaaggaggcccacctccacccaattggcgccagccagaacttcctgaggtgattgctatgctagggttcagactggatgcggtcaagtccaatgccgcagcatatctgcagcacctgtgctacagaaatgataaagtcaagacagacgtcagaaagctgaaaggcattccagtccttgtgggcctcctggaccatccaaaaaaagaagttcacctcggagcatgtggcgcactgaaaaatatctctttcggacgggaccaggataataaaatagccatcaaaaattgtgacggggtgccggctctggtaagattgctgcgtaaagctcgggacatggatctgaccgaagtgattaccggtacgctgtggaacctcagcagtcacgattctataaaaatggagatcgtggaccacgccttgcatgcccttaccgacgaggtgatcattccccactctggatgggagcgcgagcctaatgaagattgtaagcccagacacatcgagtgggaatctgtcctcacaaatactgccggatgcctgaggaatgtttctagcgagcggtcagaagcccgtaggaagctcagagagtgcgacggactcgtggatgctctgatcttcattgtccaggctgagataggtcagaaggatagtgactccaaacttgtggaaaattgtgtatgtttgctaagaaacctctcgtaccaagtgcaccgggaaatcccccaggccgagcgctaccaggaggcagcaccaaacgtggccaacaatactgggccacacgccgcttcttgtttcggagcaaagaaagggaagggcaagaaacctattgaagatcccgctaatgacacggttgattttcctaagcgaacctcaccagccaggggttatgagctgctgttccagcccgaggtggtgcggatttacatcagtctgttaaaagagtcaaaaacccccgctattctggaggcatcagcaggggctatacagaatttatgtgccggacgatggacttatgggcgttatatcagatcagcactgcgccaggagaaagccctgtccgctatcgctgacctgctcacaaacgagcatgagcgggtcgttaaggctgcaagcggagccctccggaacctcgcagtggacgccagaaataaagagttaatcggcaaacacgctatccctaacctagtcaagaaccttcctggcggtcagcagaacagcagctggaatttctcagaagacacagtaatttctattctgaatacgatcaatgaggttatcgccgagaatctcgaggccgctaagaaattgcgcgaaacccagggtatcgagaagctggtgcttattaacaagagcgggaatagatcagagaaggaagtgcgggcagccgctctagtcctacagactatatgggggtacaaagagctgcgaaaacctctggagaaagagggatggaagaaatctgactttcaggtcaacctgaataacgcttcacgctctcaaagttcacatagttatgacgatagcacgcttcctttgatcgatcggaatcagaaatccgacaataactactctacacccaacgagcggggagatcataatagaaccctggaccggtctggtgatcttggcgatatggagcccctaaagggaaccacacccctaatgcaagacgagggtcaggagtccctcgaagaggaactcgacgtgttggtccttgatgatgagggaggtcaggttagttacccttccatgcagaaaatctag

SEQ ID NO: 217289 - DNA, 2745 bp, Artificial Sequence
  Description of Artificial Sequence: Synthetic coding sequence
atggccaacggcacattgactcgcaggcaccaaaacggccgtttcgtgggggatgccgacctggaacgccagaaattttcagatctgaaactaaacggccctcaggatcattcgcatcttctatactccaccattccccgtatgcaggagcccggacagattgttgagacttacacagaggaggacccagaaggcgcaatgtccgtcgtgtcagtggagacctcagatgacgggacaactcgaaggaccgaaacaactgtgaagaaagtggtcaagaccgtcaccaccagaactgtacagcctgtagctatgggccctgatggcttgcctgttgacgcatcttctgtgagcaataattacatccagacactcggccgtgattttaggaaaaatggaaatggtggtccgggtccttatgttggacaggccggtacagccactctgcctcgcaactttcactacccacccgacgggtatagtagacactatgaggacggctacccaggcggatccgataattatggtagcctgtcacgagtcacgcgtatagaagaacggtacagacccagtatggaaggctaccgggcaccatctagacaagatgtttatgggcctcagccacaggtgagagtggggggatcgtccgtggacttacatcgcttccaccctgagccatacggacttgaagatgaccagcgaagcatgggatatgatgatctggactacggaatgatgagcgattacggcactgccaggcgaactggcacaccctccgatccccgacgtaggctgagatcgtatgaggatatgatcggcgaagaggtgcctagcgaccagtactattgggcccctctcgcacagcatgagcgcggaagtctggcatctcttgactctcttcgcaagggagggcctcctcccccaaattggcgacagccagagctgccagaggtgattgctatgctgggcttcaggctggatgccgtcaagtcgaacgctgcagcgtacctgcagcatctgtgttatagaaacgataaggtcaaaaccgatgttcggaagctgaaaggtatccccgtgcttgttggcctgctggaccaccccaagaaagaagtccatctgggcgcttgcggagcccttaagaatatctcattcggaagggaccaggacaataagatcgctattaaaaattgtgatggcgtgccagcactggtgcggctcctgcggaaggcacgcgatatggatcttaccgaggtcattacgggcacactctggaatctcagctcacacgacagcataaaaatggaaattgttgaccatgctcttcacgcgttaacagacgaagtgatcattccccattcaggttgggaaagagaacctaacgaggattgtaaacctaggcatatcgaatgggagagcgtgttgacaaacactgccggatgcctaaggaatgtttcctccgaacggtccgaagcacgtcgcaaactcagggaatgtgacggcctggtagacgccctaattttcattgtccaggccgagataggccagaaagattctgattctaaattggtggaaaattgcgtgtgcctgctgcggaatcttagttaccaggttcacagggagattccacaggccgaacgataccaggaagctgcacccaacgtggccaacaatacgggacctcatgccgcttcatgcttcggcgcaaagaaaggaaaggatgaatggttcagccgcggtaaaaagccaatagaggatccagccaatgatactgtggatttccccaagcggacgtcacccgcacggggttatgaattactatttcaacctgaagtggtaagaatctatattagcctactcaaagaatcaaaaacccctgcaatcctggaagcctccgccggtgccatccaaaatttatgcgcgggaaggtggacttatgggagatatatccgaagtgccctccgccaggagaaagccttgtccgctattgcggacttgctgacgaacgagcacgagcgcgttgtcaaagccgcatcaggggcactgcggaatctggccgtagatgcaagaaacaaagagctgatcggtaagcacgccatcccaaacctggttaagaatttaccaggcggtcaacagaacagctcctggaattttagcgaagacacggtgatttccatcctaaacacgatcaatgaggtgatcgccgaaaatctggaggcagctaagaaactgcgcgaaacccaaggcatcgagaaactggtgctgattaataaatctggcaatcgttccgaaaaggaggtgcgtgccgcagcgctggtgcttcagacgatatggggctataaggaactccgcaaacctctcgagaaagaaggctggaagaaaagcgactttcaggttaatcttaataacgccagccgatcgcaaagtagccattcttacgatgactccaccctgcccttgattgaccgcaaccaaaaatccgacaagaagccagacagagaggagattcaaatgagcaacatgggaagcaacactaagagtttggataacaactacagcacccccaatgagcggggtgaccataatcgtacattggacagatccggcgacctaggggatatggaacctttgaaaggcactaccccactgatgcaggacgaaggtcaggagagcttggaggaagaacttgatgtgctggtcttagatgacgaaggcggtcaggtgagttacccttccatgcagaaaatttag

SEQ ID NO: 217290 - DNA, 381 bp, Artificial Sequence
  Description of Artificial Sequence: Synthetic coding sequence
atgatcggcgaggaagtccctagcgaccaatactattgggcgccactcgcgcagcacgaacggggatcactggcttccctcgacagtctgcggaagggtggaccaccacctccaaattggcgccaacctgagctcccagaagtaatcgctatgctcggttttcgccttgatgccgtgaagtcgaacgcagctgcctatttacagcacttgtgttacagaaacgacaaagtgaaaacagatgtgagaaaactcaagggcatccctgtattagtcggtttactggaccacccgaagaaggaggtgcacttaggcgcatgtggcgctctgaaaaacatttccttcggacgagatcaggacaacaaaatagccattaagaattag

SEQ ID NO: 217291 - DNA, 2640 bp, Artificial Sequence
  Description of Artificial Sequence: Synthetic coding sequence
atggcaaacggaactctgacaaggcggcaccaaaatggcaggttcgtgggcgatgccgatctcgagcggcagaaattctctgacctgaagctgaacgggcctcaagatcacagccacttgctgtatagtaccattccacgcatgcaggagcccggacagattgtcgagacatatacggaggaggacccagagggagcaatgtcagtggtttcagtagaaacctctgatgatggcactacaagacgaaccgagacaactgtcaaaaaggtagttaagaccgtcacaacgcgaacagttcagcctgtcgcaatgggcccagacggtctgccagtagatgcgtcctccgtgagcaataattatatacaaacattaggaagggacttccgcaagaatggcaacggaggacctgggccatacgtgggacaagccggaaccgccacactgcctaggaacttccactatccgcctgacggctattctcgccactatgaagacggttacccaggtggaagtgataattatggcagtctgtccagggttacaagaatcgaagagcggtataggccttctatggaagggtacagagccccatcacgccaagatgtgtatggccctcagccccaggtgagggtgggcggaagcagtgtagacctgcatagatttcaccccgagccctacggtctcgaggacgaccagaggtccatgggctacgacgaccttgattatgggatgatgagcgattacggaactgcaagacggacaggaacccctagcgatccgaggagacgcctccgcagttatgaggatatgatcggggaggaggttcctagcgaccagtattactgggctccgctggcacagcatgagcgcggaagtctggccagtctcgacagcctgcggaaagggggaccaccacctcctaactggaggcaacccgaacttccagaggtcattgccatgttgggcttcagattggacgcagtgaagtctaacgccgctgcttacctgcaacacctctgttaccggaatgacaaggtgaagacagatgtgcgcaagctgaagggtatccctgttttggtggggttgctcgatcatccaaaaaaagaggttcacctaggcgcatgcggtgctttgaagaatatttcttttggaagggatcaggataacaagatcgcgatcaaaaactgcgatggggtgcctgcactggtacgccttttgagaaaggctagggacatggatcttacagaggtgattacagggaccctttggaacctttcttcccacgactctataaagatggagatcgtggaccatgcactgcacgccttgactgacgaggtgattattccacattcaggatgggaacgagagccgaatgaggattgcaagcccaggcatatcgagtgggagtcagtgttaacaaatacagctgggtgtctcagaaacgtcagctctgaacggagcgaggcacggaggaagctcagggaatgcgatggcctcgtggacgctctcattttcattgtacaggcggaaattgggcagaaagactccgatagcaagctggtcgaaaattgcgtgtgcttgctgcggaacctgtcttatcaggtgcatcgtgagatcccacaagctgaacggtaccaggaggctgctcccaatgtggcgaacaataccggcccacacgcagcttcctgcttcggagcgaaaaaaggcaaagggaagaagccaatagaagaccctgccaatgatacagtggattttccaaagaggactagcccagcgaggggctatgagctgttgtttcagcctgaggtcgtgagaatttacatcagtctgctgaaagaatctaagacccctgccatactggaggcctctgccggagccatccagaacctctgcgcaggaagatggacctacggccgttacatccgcagcgccttaagacaggagaaggctctgagtgccatcgcagatctcttaacaaatgaacatgaaagggttgtcaaggctgcatccggcgctctgaggaacctggccgtagacgcccgaaacaaggaacttatcggaaagcacgccattccaaatcttgtaaagaacttgccagggggtcagcagaatagcagttggaacttctcggaggacacggtgatcagcattctgaacacaatcaacgaagtgattgccgaaaacctagaggctgctaaaaagctcagagaaacacaggggattgaaaaactggtcctgataaacaagtcaggcaatcggtccgagaaagaggtcagagccgctgcgttggtgctgcaaacaatctgggggtacaaagaactgcgaaaaccacttgagaaagaggggtggaaaaaaagcgactttcaagtgaacctcaacaatgcctcaagaagccagtctagccactcttacgacgattccacactacccttaatagacagaaatcaaaagagtgataagaaacccgatagggaggaaattcagatgagcaatatgggcagcaacactaagtccttagataacaactattcgactcccaacgagcggggtgaccacaataggactctggataggagcggagatctgggcgacatggagcccttgaagggcactacacctctcatgcaaaaaatttag

SEQ ID NO: 217292 - DNA, 3678 bp, Artificial Sequence
  Description of Artificial Sequence: Synthetic coding sequence
atgttcgcccgaaaacctccgggtgccgcacctcttggcgctatgcctgtgccagatcaaccatcctcagcttccgaaaagaccagtagcctgtcccctggactcaatacatcaaatggcgatgggtccgaaaccgagactaccagcgccatcctggccagtgtgaaggaacaagagctccagtttgaaaggttgactagggaactggaggccgaaaggcagatagtggcctcccagctcgaacgctgcaaactagggagcgagacaggctcaatgagtagcatgtctagcgcggaggagcaatttcagtggcagtctcaggacgggcagaaagacatagaggacgaattaaccactgggttggaactggtagacagctgcatacgctcgcttcaagaaagtgggatcctggacccgcaggattacagcacaggagagcgaccctcacttctgtcccagagcgcgttgcaactcaacagtaagcctgagggctcctttcagtatccagcaagctaccacagcaatcagaccctagctttaggggagactacacccagtcaactcccagcccgtggcacgcaggctcgggcaaccggacagtctttttcccaagggactacatcccgagcaggacatctcgccggacccgaacctgcccctccccctccaccaccccctagggagccctttgctccatcactaggcagcgcttttcatcttcctgatgcgccaccagccgctgcggctgcagccctatactactcttcatccaccttgcccgcacctccgagggggggaagccctctggccgctcctcagggtggatccccgacaaagctgcagcgaggcggttccgctccggagggtgctacctacgcagccccacgcggttcctctcctaagcagtccccaagcagactcgcaaaatcttactccacctctagtccaatcaatattgttgtgagcagtgcagggctgtcgccaattcgggtgacttcgcctccaaccgtgcagagtacaatttctagttctcccattcatcagctgagctcaacaattggcacctacgccaccctcagccccaccaaacgtctggttcacgcaagcgaacagtattcaaaacatagtcaagaattgtacgcaactgccacactgcagagacccggatccctagctgcaggaagcagagcctcttactcttcccagcacggacatttaggaccagagctaagagctcttcagtcccctgagcaccatatagacccaatctacgaagatagggtatatcaaaagccacccatgcgatctctgagccaaagccagggagaccccctgcccccagcgcacactggtacctacagaactagcaccgcgcctagctcacccggtgtggactcagtgcccttgcagcgaacgggcagtcagcacggaccacagaacgccgcagccgctaccttccaacgggcttcctacgccgctgggccagccagcaattatgccgatccttaccgacagcttcaatattgtcctagcgtggagagcccttattctaaaagcgggccagcgttaccaccagaggggactttggctcgcagcccttctatcgattctatccaaaaagatcccagagaatttggctggcgcgaccctgagctccccgaagttatccagatgctgcagcaccaattcccttccgtacagagtaatgctgcagcatatttgcagcacctctgtttcggtgataataagataaaggccgagattcggaggcagggcggaatccagctgttggtggatctgctggaccatcgcatgaccgaggtgcacaggagcgcatgcggagcgctgcggaatctggtctatgggaaggccaacgacgataataagatcgccctgaagaactgtggaggaattccggcattagtgcgtttgctgagaaagacaacggatctggagatccgcgaacttgtaacaggcgtactgtggaatctcagctcctgtgatgccctgaaaatgccaatcatccaggatgccctggcagtgttgaccaatgcagtgataatccctcactcagggtgggaaaactctcccttgcaagatgacaggaaaatccagctgcacagtagccaagtgctgcggaatgctaccgggtgcctgcggaacgtatcgtccgcgggtgaagaagccagacgaaggatgcgggagtgtgacggattgaccgacgctctcctatacgtgatccagtccgccctgggatctagtgaaatagactctaaaaccgtcgaaaattgcgtgtgcatactccgcaacctgagttaccgattagctgccgaaacgagtcagggacaacacatgggcaccgatgagctggatggcctgttatgtggagaggcaaatgggaaagacgccgaatcgagtggctgttgggggaagaaaaaaaaaaaaaaaaaaagtcaggaccagtgggacggcgttggcccactccccgattgtgccgaaccacctaagggcattcaaatgctgtggcacccttcaatcgttaagccatatctgactttgttaagcgagtgctctaatccagataccctggagggtgccgcaggcgcactacagaacctggccgctggtagttggaaatggtcagtctatatcagagctgcagtgcgtaaggaaaagggcctgccaatacttgttgagctacttcgcattgacaacgatcgggtagtatgtgcggttgcgacagccttaagaaacatggccttagatgtgaggaataaagagttaataggtaaatatgccatgagggatctggtccaccgcctgcccggaggaaacaacagtaacaatactgcctccaaagccatgagtgacgatacggttaccgctgtgtgttgtacattgcatgaggtgatcactaagaacatggaaaatgccaaggccctgagggatgccggtggcattgagaagctcgtgggaatcagcaagtctaagggagacaaacactcaccaaaagtagtgaaggccgcatctcaggtattgaacagtatgtggcagtatcgggacttacgctccctctacaagaaggacggctggtcgcagtatcactttgtggctagtagttctacaattgagagggatcgccagcggccttacagcagctctaggacaccctccatcagtcctgtccgtgtctcccccaataaccgaagtgccagcgcccctgcctccccacgagaaatgatttccctcaaagaaaggaagacagactacgagtgcacaggtagtaacgctacataccacggtgcaaaaggcgaacatacgagtcggaaagatgctatgaccgctcaaaacacaggcatctccacgctgtacagaaacagctacggtgcacccgctgaggatatcaagcataatcaggtcagcgctcagcctgttccccaggagccatctcggaaggactacgaaacctaccagccatttcaaaatagcacccggaactacgacgagtccttctttgaggaccaagtgcaccatcgacctcccgctagcgaatataccatgcacctgggccttaaatccactggcaattatgtagatttttatagcgccgcacgaccgtactctgaattgaactacgaaacgtcacattatcccgcatctcccgactcatgggtgtag

SEQ ID NO: 217293 - DNA, 3504 bp, Artificial Sequence
  Description of Artificial Sequence: Synthetic coding sequence
atgtttgctaggaagcctcccggagcggctcctctcggcgctatgcccgtgcctgaccagccatcaagtgcctctgagaagacatccagcttatcccctggattaaatacgtctaatggggacgggagcgagacagaaacaacctctgctatcctggcatccgtgaaggagcaggaactgcagtttgaaagattgacaagagagctggaggcagagagacagatcgttgccagccaattagagagatgtaagctgggtagcgagacgggatcaatgtccagcatgtcgtctgctgaagagcaatttcaatggcagtctcaggatggacagaaggatatcgaggacgagttgacaactggcttggagctcgtggattcctgcatacggagtctccaggaaagcggcatcttagacccccaagactatagtaccggggagaggccaagcctgctctcccagtccgccctgcaacttaatagtaaaccggagggttctttccaatacccggcatcctaccactctaaccagactctagctctcggcgagaccacccctagccaactgccagccagaggaacccaggcccgagctacaggccagtcttttagccagggtaccacttcccgcgcaggccatctagccggtcccgaacctgcccctccaccgccaccccctcccagggaaccctttgcgccatctctgggatccgcattccatctgccggatgctccaccggcagcagcagccgctgccctttactatagttcatccacactccccgctcccccacggggtggaagtcctcttgccgcaccacaaggcggatcacctacaaagctgcagagaggcggatctgcccctgagggcgcaacatacgccgctccgcgtgggagtagccccaagcagtccccgtctagactggctaaatcctattctactagttcccccatcaacatagtcgtgtcttcagccggactgagcccaatccgggtcacatccccaccgaccgtccagagcacaatctcctcctcacccattcaccagctgtcctctactattggaacttatgccactctctcaccgacaaagcggctcgtgcatgctagcgaacagtattcaaaacactcacaagagctgtacgctaccgcaacactgcagcgcccagggagtttagccgctggatccagggcttcgtattcctctcagcacggacacctgggacctgaacttagggcgctgcagagcccagagcaccatatcgaccctatttatgaagacagagtctatcaaaagccccctatgaggagtctaagtcagtcacaaggtgaccctcttcctcccgcacacaccggtacctacagaactagcacggccccttcctctcctggcgtcgattccgtccccttgcaaaggacaggcagccagcacggcccacagaacgccgcagctgccacctttcagcgcgcatcttacgctgcaggacccgcttctaactacgccgatccatacaggcagcttcagtattgcccttctgttgaaagtccatacagcaagagcgggccagcgctgcctcctgagggaaccttggcaagatcgcctagtatcgactccatccaaaaggatcctcgcgagtttggctggcgcgatcctgagcttccggaagtgatacagatgcttcagcaccaattcccatctgtgcagtctaatgcagcggcttatcttcagcatttgtgctttggtgacaataagataaaagcagaaatccgtcgccagggcggaattcagctgttggttgacttgctggaccatagaatgacagaagtccaccgatctgcctgcggtgccctaaggaatctggtgtatggtaaagcgaacgatgataacaagatagcattgaaaaactgcggcggtatcccagctctggtgcgcctgctacgcaaaaccaccgatctggagattcgtgagctggttaccggtgtcctgtggaatctgagcagctgtgacgcactgaagatgccaattatccaggatgccctcgcagttctgactaatgcggtaataattcctcactcaggctgggagaatagcccactgcaagatgatcgtaagattcagctgcattcatcacaggtcttgcgtaacgccactgggtgcctgagaaatgtgtcaagcgccggtgaggaggccaggcgtcgaatgcgcgagtgcgacgggttaacagacgccctgctttacgtgattcagagtgccctcggctcttccgagatcgatagcaaaacagttgagaattgcgtgtgtattctgagaaacttaagttatcgtctggcggctgagacgagccagggacaacatatgggtacagacgagctcgatggcctcctttgtggggaagccaacggaaaagatgcagagagtagcgggtgctgggggaagaaaaagaagaaaaagaagtcccaggaccaatggtccgtgtatatcagagcagccgtgcgcaaggagaagggcctgccgatcttggtggagctattacgcatcgacaacgacagagttgtctgtgccgtggccacagctttaaggaatatggcactggacgtccgcaataaagaacttattggaaagtacgcaatgcgggacttggtgcaccgactgccgggtggtaataatagcaacaacactgcttcgaaggcaatgagtgatgacaccgtgaccgctgtgtgttgcactctgcacgaggtgatcacaaaaaatatggaaaacgctaaagctctccgcgatgcagggggtatcgaaaaattagtcgggatttctaagtcaaaaggcgacaagcacagtcccaaagtagttaaggctgctagtcaggtgctgaactcaatgtggcagtatcgcgatctaaggtcactttataagaaagacggatggagtcagtatcattttgtggcctcatcgtctactatagaacgcgaccggcagcggccatattcaagcagccggaccccttctatatctcctgtgcgggttagtccgaacaaccgaagcgctagtgctcccgcatctcctcgggagatgatctccttgaaagagaggaagaccgattacgagtgcaccggttctaacgcaacctaccacggggctaaaggtgagcacacaagtcgcaaggacgcaatgacagcacagaataccggtattagtacactgtaccgcaacagctacggggctcccgcagaggacatcaaacacaatcaagtgtctgctcaaccggtgccccaggaaccatcacggaaggactacgagacgtatcagccctttcaaaatagcaccagaaactatgatgagtcttttttcgaggatcaggtgcaccaccggcctcccgcatctgagtataccatgcacttaggcctaaagtcaaccggtaattacgtggatttttatagcgcggcaaggccttattcagaattaaactacgaaacaagccactaccctgcgtctcccgactcttgggtgtag

SEQ ID NO: 217294 - DNA, 2379 bp, Artificial Sequence
  Description of Artificial Sequence: Synthetic coding sequence
atgcgttccctttcccagtctcagggcgatccccttccccctgctcatacagggacctacaggacctccaccgcacccagtagcccaggtgtagatagcgtgcccctccaaaggactggttctcagcacgggcctcagaacgccgctgcagctacttttcaaagggccagctatgcggctgggcctgcttcaaattatgccgacccatatcgacaattacagtactgcccttccgtggaaagcccttattctaagagtgggccagctctccccccagaaggtacactggccagatcccccagcatagattctatccagaaggaccctagggagttcggctggcgagatcctgagttgcctgaagtcatccaaatgcttcagcatcaattcccctccgttcagagcaacgcagccgcatatctccagcacctttgcttcggagacaacaaaatcaaagccgagatcagaaggcagggcggaatccaactcctggtagatttgttggatcacagaatgacggaggttcacagatcagcctgtggggctctacggaacctcgtgtacggcaaggcaaacgacgataacaaaatcgcgctgaagaattgtggcggaatcccagctctagtgcgactgctcaggaagacaactgatctagagatccgtgagctggtgaccggtgtcctgtggaatctgtcatcatgcgacgcactgaaaatgccaatcattcaagatgccctggccgtattgaccaatgccgttatcatcccacattccggctgggagaacagtcctctccaggatgatcggaagatccagcttcattcttcacaagtgctcaggaacgctactggctgcctccggaacgtaagctccgccggagaggaagcacgtcgcagaatgcgagagtgcgacggtctcaccgacgccctattatacgtcatacagtccgcactggggagcagcgagatcgattccaaaaccgtggaaaactgtgtttgcattctgaggaacctgagctaccgactggccgcagagacctcccaggggcagcatatggggacggacgaactagatgggctcttgtgtggggaggctaatgggaaagatgccgaatcaagcggatgttgggggaaaaaaaaaaaaaaaaagaaatcccaggaccagtgggatggggtaggccctctgcccgactgcgccgaacctccgaaagggatacaaatgttgtggcacccaagtattgtgaagccttacctgaccctgctgtccgagtgcagcaatccagatacactcgagggtgctgccggtgccctgcagaaccttgccgcaggtagctggaagtggtctgtctacatacgtgcagccgtacgcaaggagaagggactcccaattctcgtagagctactacgcatcgataacgaccgcgtcgtgtgcgcagttgccacagccctgcgaaatatggccctggatgtgcgcaataaggaactaattggtaagtatgccatgagggatctggtacaccgcctccctggcggaaataactctaataatactgccagcaaagccatgagcgatgacacagtgaccgcggtttgttgcactttgcatgaggtgattaccaaaaatatggaaaatgccaaggccctgagagacgctggaggcatagagaaacttgtggggatcagtaaaagcaagggagataaacacagtcccaaggtcgtaaaagccgcttcacaggtcttgaattcaatgtggcagtacagagatttgcggtctctatataagaaggatggttggtcccagtaccatttcgtagcctccagctcgaccattgagcgggataggcaaaggccctactccagcagccgaaccccttccatatctccagtgcgagtctcacctaataataggtccgcttccgctcccgcttcccctagggaaatgatctcactcaaagagcgtaaaactgactatgaatgtactgggtctaatgccacatatcatggggctaagggggagcatacatccaggaaagatgcgatgaccgctcaaaatacaggaatcagtactctctacagaaactcttacggtgcaccagccgaggacatcaaacacaatcaggtgtcagcacagcccgtacctcaggagccctcccgcaaagactatgaaacctatcagccatttcagaacagcacccggaactacgatgaaagcttcttcgaggatcaagtgcaccatcggccaccagcgtcagagtacacaatgcatcttgggctgaagtctacaggaaattacgtggatttctattctgcagccagaccttactccgagctgaactacgaaacctcccactaccccgcttcacctgattcatgggtgtag

SEQ ID NO: 217295 - DNA, 2667 bp, Artificial Sequence
  Description of Artificial Sequence: Synthetic coding sequence
atgagttctatgagctccgctgaggagcagttccagtggcagagccaggatggccagaaggacatcgaagatgagcttaccactggactggaactggtggattcttgcattcgttctcttcaggaaagtggcatcctggatcctcaggactactccaccggcgagacgggttcccgtgcttcctacagttcgcagcacggccatctgggacccgaactcagagcactccagtcaccagagcaccacattgatcccatttatgaggacagagtttatcaaaaaccacctatgcgtagtttgtcgcagagccaaggggaccccctgcctcctgcccatactgggacttaccgaacgtcaaccgctccctcttctcctggcgtcgattctgtacccctgcagcgcactggatctcagcacggcccacaaaacgccgctgcagcaactttccaaagggcatcgtacgccgctggtccagcatcaaattacgccgatccttacagacagctgcagtattgcccctccgtggaatcgccctactcgaagagtgggcctgctctgcctcccgaaggcaccctggccaggtctccgtctatcgacagcatccaaaaagacccaagagaattcggctggcgcgatcctgaactcccagaggtaatccaaatgctgcagcatcaattcccctcggtgcagtctaatgccgcagcttatctgcagcatttgtgttttggggataacaagattaaagcagagatcagacgccaggggggaatccagttgctggtggacctgctcgaccaccggatgacagaggtgcaccgatccgcctgtggcgctctcagaaatttggtgtatggaaaggccaatgacgacaacaagatcgccttgaaaaattgcggagggatacccgcacttgtgcgcctgttgcgaaaaaccacagaccttgaaatccgagagctcgtcactggagtgctgtggaacctttccagttgtgatgccctaaagatgcctatcatccaggatgctctggctgtgttaacgaacgccgtgatcatacctcacagtggatgggaaaattctcctttgcaggatgatcgaaagatccagctgcatagctcccaagtgctgaggaatgcgaccggatgtctgagaaacgtgagctcagcgggagaggaagcacgtcgacggatgcgggaatgcgacgggctcactgatgcactgctgtacgttatccagagcgccttgggctccagcgagatcgattccaaaaccgtagagaattgcgtgtgcatcctacgtaacctctcataccgtctagcagctgagacaagtcagggacagcacatgggaaccgacgaactcgacgggctcctttgtggggaggccaacggcaaggacgctgaatcttctggttgttggggaaaaaagaaaaaaaagaaaaagtcacaagaccagtgggacggcgtgggcccactacccgattgcgccgagccccctaaagggattcaaatgctgtggcacccaagcatcgttaaaccctacctcaccctgctcagtgagtgctctaaccccgatactctagaaggagccgcaggtgcactccagaacctggctgctggctcctggaagtggtcggtatacattcgcgcagccgtccgaaaggagaagggtcttccaatcctggttgaattattaaggatcgacaatgacagagtggtctgcgcggtggccaccgctttaaggaacatggctctggacgtccgaaataaggaactcatcgggaaatacgctatgcgcgacctggtgcaccgtcttcctgggggtaataactccaataataccgccagtaaagccatgagcgatgataccgtcaccgccgtttgttgtaccttgcacgaagttatcactaaaaacatggaaaatgccaaggctcttcgggacgccggtggcattgagaagttggttggcatttctaaatctaaaggagacaagcactccccaaaagtagttaaagccgcatctcaggtgttaaattccatgtggcagtaccgcgacttgagaagcttgtataagaaggatggttggagtcagtatcatttcgttgccagctctagcaccatcgagcgggatagacagcgtccctatagtagctctcgaacccccagtatttcccctgttagggtcagccctaacaatcgttccgcctccgcccctgctagcccacgcgagatgataagcctgaaggaacgcaaaaccgactatgagtgcactggtagcaatgccacttatcatggcgctaaaggtgaacatactagcaggaaggatgccatgacggcccaaaataccgggatcagtactttgtacaggaactcatatggagctccagcggaggatattaagcacaatcaggtctccgcacaaccagtgccacaggagcccagccgcaaagactacgagacataccagcctttccagaatagcacgcgtaactacgatgagagtttctttgaagatcaggtgcaccatagacccccagcctccgagtataccatgcacctgggactgaagagcacaggaaattacgtggacttctactcagctgcccgtccgtactccgaactgaattatgagactagtcactacccagcatctccagactcctgggtgtag

SEQ ID NO: 217296 - DNA, 546 bp, Artificial Sequence
  Description of Artificial Sequence: Synthetic coding sequence
atgtcttcaatgagctcggctgaggagcaatttcagtggcagagtcaagatgggcagaaagacatcgaggatgagctgacaacagggctggaactggtagattcctgcatccgcagcctccaggagagcgggattttagacccccaggattatagtacaggagaacggccttccctcctaagccaaagcgctctccagcttaactcaaagccagagggaagttttcagtatcctgccagctaccactccaaccagaccctggcgctcggcgaaaccaccccatcacaactcccagccagagggacccaggctcgcgcaacaggacaaagcttctctcagggcaccacctctagagctgggcaccttgctggccctgagcccgcacccccaccccctcccccacccagagaaccttttgctccatcgctgggctcagcattccatctacctgacgctccgccagccgcagccgctgcagctctgtattattcctctagtaccctcccagccccacctcgagggggatccccgctggctgctccctag

SEQ ID NO: 217297 - DNA, 963 bp, Artificial Sequence
  Description of Artificial Sequence: Synthetic coding sequence
atgaccgtgtggtgtgcggtggctacggcactaaggaatatggcactggacgtaaggaacaaggagctgatagggaaatacgctatgagggacctggtgcatcgcctgcccggtggcaacaactcgaataacaccgcttctaaggccatgtcagatgatacggttaccgcagtgtgctgtacactgcacgaagttatcaccaagaacatggagaacgccaaagccttgcgggacgcgggaggtattgaaaagcttgtggggatatccaagagtaagggcgacaaacactctccgaaagtggtgaaagccgcaagccaggttttgaattctatgtggcagtatagagacttaagatcactgtacaagaaggacggctggtctcagtatcactttgtggcctcaagctcaacaattgagagggatagacagaggccctatagcagctccaggacaccctccataagtcctgtgcgtgtgagtcctaacaatcgatctgcctctgctcccgcaagcccgagggagatgatttccctgaaggaaagaaagaccgactatgagtgcacgggctcaaatgccacttaccacggtgccaagggagaacacacctcacgaaaggacgcaatgacggctcaaaatacaggcatctctacgctgtatcgcaatagttatggagcacctgccgaggatatcaaacataaccaagtgtcagcacagcccgtgccccaggaaccctcccgtaaggattatgagacgtaccaacccttccagaactcaacacggaactatgatgagtcttttttcgaggaccaggttcaccataggcctcccgcaagtgaatacactatgcacttaggcttgaaatctacaggtaattacgtggacttctactccgccgcaaggccatactccgagctgaactacgagacctctcattaccccgcttcccctgattcttgggtgtag

SEQ ID NO: 217298 - DNA, 246 bp, Artificial Sequence
  Description of Artificial Sequence: Synthetic coding sequence
atgaatcgtgaaggcgctcccggtaaaagcccagaagagatgtacatccagcaaaaggtacgcgtgttgctcatgttgcgaaaaatgggatccaacctcacagcttcagaggaagagtttctgcggacgtacgcaggtgtagtgaactcacagctgtcccagctgccccctcactccatagaccagggagccgaggacgtggttatggctttttccagaagtgaaacagaagatcgaagacagtag

SEQ ID NO: 217299 - DNA, 246 bp, Artificial Sequence
  Description of Artificial Sequence: Synthetic coding sequence
atgaatcgggagggcgctcctggaaagtccccggaggagatgtatatccagcagaaggtgcgggtgctgctgatgctgcgaaagatggggagcaacctgactgccagcgaggaagagttcttgagaacctacgcaggggtggttaattcgcagctttctcagctcccaccccatagcatcgaccagggcgcagaggatgtggttatggcgttttctcgttccgaaactgaagatcggagacagtag

SEQ ID NO: 217300 - DNA, 246 bp, Artificial Sequence
  Description of Artificial Sequence: Synthetic coding sequence
atgaacagagaaggcgcacccggtaagagtccagaggagatgtacattcagcaaaaggtaagggtgctcctaatgctccggaagatggggtcaaatctgacggctagcgaagaagagtttctaagaacgtacgcaggagtggtgaattcccagcttagccagctcccaccgcattctattgatcagggcgcagaagacgtcgtgatggctttctccaggtctgaaacagaggaccgacggcagtag

SEQ ID NO: 217301 - DNA, 246 bp, Artificial Sequence
  Description of Artificial Sequence: Synthetic coding sequence
atgaacagggaaggcgctccgggaaaatctccagaagagatgtacattcaacagaaggtgcgcgtactgctgatgcttagaaagatgggatctaatctgacagctagtgaggaggagttcctgcgcacttacgctggggtggttaattcccaactgagccagctcccccctcatagcatcgaccagggcgcagaggatgttgtgatggccttttccaggtctgagactgaggatcgacgccagtag

SEQ ID NO: 217302 - DNA, 246 bp, Artificial Sequence
  Description of Artificial Sequence: Synthetic coding sequence
atgaaccgagagggcgctcctggcaagtctcccgaggaaatgtacatccagcagaaagtgcgcgtgctgctgatgcttcgcaagatgggctctaatctgaccgcgagcgaagaggagttcctgaggacatacgccggagtggttaattcccagctgtctcagctcccaccacacagcattgaccagggcgctgaggacgtagtgatggccttttcacggagcgagacggaagacagacgtcagtag

SEQ ID NO: 217303 - DNA, 1692 bp, Artificial Sequence
  Description of Artificial Sequence: Synthetic coding sequence
atggacgttggcgagctgctgagctaccagccgaaccgcggtaccaaaaggcctagagatgacgaggaggaagagcagaagatgaggaggaaacagacagggacaagggagagagggaggtatcgggaagaagaaatgaccgtggtggaagaggctgatgacgacaagaagaggcttctgcagataattgacagagatggggaagaagaggaggaagaggaagagcccctcgatgaatccagcgtgaagaagatgatcctgacattcgagaagaggtcgtataaaaaccaggagctgagaattaagtttcctgacaatccagagaagttcatggaaagcgaactggaccttaacgacatcatccaggagatgcacgtggtggccaccatgccggatctgtaccatctactcgttgagttaaacgcagtccagtcacttctgggcttgctgggccacgacaatactgatgtctcgattgccgtggtggatctgcttcaagaattgacagacattgatacactgcacgaatcggaagagggagcagaagtcctgatcgacgccttggttgacgggcaagtggttgctcttttggtgcaaaatttggaacgcctcgatgaatctgttaaagaagaggcagacggcgtgcataacaccttagctattgtcgagaatatggccgagtttagaccagagatgtgcactgagggggctcagcaaggcctcctgcaatggctgctgaagcgcctgaaggctaagatgcccttcgatgccaacaagctatactgcagtgaggttctggcaatcctgctgcaggacaatgatgaaaatagagagctcctgggtgagctggatggcatcgatgtattactacaacagctgagtgtttttaagcggcataaccctagcaccgcagaagagcaagaaatgatggagaacctctttgacagcctgtgcagctgcctcatgctgtcgtccaaccgggagcggtttctgaagggtgaaggtctgcagctcatgaacctgatgcttcgcgagaagaagatcagccggagctctgcgctgaaagtactggaccacgctatgattggtcctgaaggcacagacaattgtcacaagttcgttgacattttgggcctaagaaccatttttcctctgtttatgaaatccccacgtaaaatcaagaaggtaggcactactgagaaggaacatgaggagcatgtgtgttctatcctcgcctccctactcaggaacctgagagggcagcagcggaccaggctgctgaacaaatttacagagaacgatagtgaaaaggtcgatcgacttatggaacttcactttaaatatctcggagccatgcaggtggcagataagaagatcgagggtgagaaacacgacatggtgcggagaggagagatcatagataacgacacggaggaggagttctatctgagacgacttgacgccggactattcgtactgcagcatatctgctatatcatggctgaaatctgcaacgcaaacgtacctcagattcggcagcgggtgcatcaaattttaaacatgcggggaagctcaatcaagatcgtccggcacattatcaaagagtacgccgagaatattggggacggtaggagccccgagttcagggagaacgagcaaaagcggatcctcggacttttggaaaacttctag

SEQ ID NO: 217304 - DNA, 1611 bp, Artificial Sequence
  Description of Artificial Sequence: Synthetic coding sequence
atgaggcgcaagcagacaggtactagggaacgcggtcgctatcgggaagaagaaatgacagtggtggaagaagcggacgacgataaaaagaggctcttacagatcatagacagagacggcgaggaagaagaggaagaggaagagccgttggatgaatcctctgtgaagaaaatgatactgacatttgagaagcgctcctacaaaaaccaggagcttaggatcaagttccctgataacccggagaagtttatggagagcgaactggatttaaacgatatcattcaagagatgcatgttgtagcaaccatgcctgatctgtatcatttgttagtcgagctcaacgcagtgcagagcttgttaggactgctgggccatgataacacagatgtgtccatcgctgttgtggatctcctgcaggaacttacagatatcgacacactgcacgagagtgaagaaggcgctgaagtgttgatcgatgctcttgttgatggacaggtggtcgccttactcgtccagaatctggaaaggctggatgaaagtgtgaaggaggaagccgacggagtgcacaacacacttgccatagttgagaacatggccgaattcaggccagagatgtgcactgagggtgcacagcaggggttgttgcaatggctactcaagaggcttaaagcaaagatgccttttgacgcgaataaattatattgttccgaagtgctcgctattctgctgcaggataatgatgagaatagagaacttttgggcgagctcgacggaatcgatgtgcttctgcagcagctaagtgtatttaagaggcacaacccttctaccgccgaggaacaggagatgatggagaacctgttcgattccttatgtagctgtctcatgctgtcctcaaatcgggagagattcctcaagggggaggggcttcaattaatgaatctgatgcttcgcgagaaaaaaatttcacgatcaagcgcactgaaagtactcgatcacgccatgatcggcccagagggaactgacaactgccacaaatttgtggacatcctcggccttcgtactatatttccgttgttcatgaagtctcctcggaagatcaagaaggtaggcactaccgagaaggagcacgaggagcatgtgtgcagcattcttgcttcgctccttcgcaatctccgcggacagcagcgaacaaggctgctgaacaagttcaccgagaatgactccgaaaaagtcgatcgcttgatggaactccacttcaaatatctaggagcaatgcaagtggcagataagaagattgagggcgagaaacacgatatggtgcgtcggggtgaaatcatcgataatgatactgaagaggagttctatttaaggagactggacgcaggcctttttgtgctccaacacatctgttacatcatggccgaaatatgcaatgccaatgttccgcagatccgtcagagagttcaccagatcttaaacatgcggggatcatcgataaagatcgttcgtcacattataaaagagtacgcggagaacataggtgacgggagatctcctgagtttcgggagaacgagcaaaaacgaatcctgggactgttggaaaatttctag

SEQ ID NO: 217305 - DNA, 501 bp, Artificial Sequence
  Description of Artificial Sequence: Synthetic coding sequence
atgcgtagaaaacagacgggcaccagggagagaggcaggtatcgtgaggaagagatgacagtggtcgaggaagcagacgatgataaaaaacgattacttcagattattgaccgcgatggagaggaagaggaggaggaggaagaacctctggacgagtcaagcgtgaagaaaatgatccttacctttgaaaaacgcagctacaagaaccaggagcttagaataaaatttcctgataatccagagaagtttatggagagcgaattggacctaaatgatattatccaggagatgcacgtggtcgctacgatgcccgacctgtatcatctgcttgttgaactcaatgcagtccagtctctgttaggtcttctgggccacgataacaccgacgtgtcaatagccgtggtagacctgctccaggagctcactgacattgataccttgcacgaaagcgaggagggcgcagaggtgctgattgatgccctcgttgatggccaggtgtag

SEQ ID NO: 217306 - DNA, 1443 bp, Artificial Sequence
  Description of Artificial Sequence: Synthetic coding sequence
atgattcgtgcagctccccctcccctgttcctgctgttgctcctcctcctgctcctcgtatcgtgggcttcacgcggtgaggcagctcccgaccaggatgaaatccagcggttacccggattagccaagcagccctccttcagacaatacagcggatacttaaagggtagtgggtcaaagcatctacattactggtttgtcgagtctcagaaggacccagagaattcgcccgtggtgctctggctcaatgggggacccggatgttcatcactagacggtctgctgactgaacatggcccatttctggtccaaccagatggcgttaccctggagtacaacccttattcctggaatttgatcgctaacgtgctctacctggaaagcccagctggcgtagggtttagctacagcgacgacaaattttacgccaccaacgacactgaagtggcccagtcaaattttgaggcgctccaagatttcttccggcttttcccggaatataaaaataataagctgtttttgaccggtgagtcgtatgccggaatctacatacccacacttgctgtgctcgtaatgcaggatccttcgatgaacctccaggggctcgcggtgggcaacggcctgtctagctacgagcaaaacgataacagtctggtctattttgcctactatcacgggctcctgggcaacaggttatggtcctctttgcaaactcactgctgctctcagaacaagtgcaatttctacgataataaagacctggagtgtgtgaccaaccttcaggaggtggcaaggatcgtcgggaactctggattaaatatctataacctgtatgccccttgcgccggtggcgtgccttcgcattttagatacgaaaaagataccgtagtagtgcaggacctgggaaatatctttacccggttgccgctgaagcggatgtggcaccaggcactattacgctcaggcgataaagtacggatggatcctccatgcactaacacaactgcggcatccacctatctgaacaacccttatgtgaggaaagctcttaacattccagagcagttaccacagtgggacatgtgtaacttcctggtgaacctccagtatagaagactctaccggagcatgaattcacagtatctgaaactgctttccagccaaaagtatcagattctgctgtacaacggggatgtagatatggcctgcaactttatgggggacgaatggttcgtggacagtctcaatcagaaaatggaagtccaacgtcgaccatggttggtgaagtatggggacagcggtgagcagatagccggttttgtgaaggagttttcccacatcgcctttcttaccatcaagggtgccggacacatggtaccgaccgataagcccctcgccgcttttaccatgtttagtcggttcctgaataaacagccatattag

SEQ ID NO: 217307 - DNA, 1446 bp, Artificial Sequence
  Description of Artificial Sequence: Synthetic coding sequence
atgacgtcgagcccacgggctcctcccggagagcaaggcagggggggagccgagatgatccgggcagctcctcctcccttgttcctcctgttgctgctgctgctgcttctagtgtcctgggcttcccggggagaagccgcacccgatcaggacgaaatccagcgtctgcccggtctcgccaaacaacctagttttcgacagtattccggttatctgaaaggatctggaagtaaacacctacattactggtttgttgaatcccaaaaggatcccgaaaactccccagtggttctgtggctcaatggcggacctgggtgctcctcattggatggactcctcactgaacatggcccatttttgatcgccaatgtgttgtacctggaatcacctgcaggcgttgggttctcttatagtgatgataaattctacgccacaaacgacactgaggtggctcaaagcaatttcgaggccttacaagacttttttcggttgttcccagaatacaagaacaacaaactcttcctgactggcgagagctatgcagggatctacatcccaactctggctgtgttggtgatgcaagaccctagcatgaatctccaaggcctggcggtcggcaatggtcttagttcttatgagcagaatgacaatagcctcgtctactttgcttactatcacggcctgctcgggaaccggctctggtcctctctccagacacactgctgttcacagaataaatgcaatttttatgataacaaggatctggagtgcgtgactaatctccaggaagtggccaggatagtggggaactccggactcaatatttacaatctgtatgccccttgtgcgggaggggtcccaagccattttcggtatgaaaaggatactgtggtagtacaagatcttggtaatatcttcactcgactcccactgaagcggatgtggcatcaggcactgttgagaagcggcgacaaggttaggatggatccaccttgtacgaataccacagccgcttctacatacttgaataacccttacgtgcgaaaagccctgaacattcccgagcagctcccccagtgggacatgtgtaactttttggtaaatctgcagtaccggaggctctacagaagcatgaattctcagtaccttaaacttttaagctcccagaaataccaaattctactttacaatggcgacgtggatatggcctgcaacttcatgggggatgagtggtttgttgacagcctcaatcagaagatggaggtccagcgcagaccgtggctggtcaagtacggggactctggggagcagatagccggttttgtcaaggagttttctcatattgctttcctcaccatcaagggggctggccacatggtccctacggacaaaccgttggccgctttcacaatgttttctcgtttcctaaacaagcagccctactag

SEQ ID NO: 217308 - DNA, 870 bp, Artificial Sequence
  Description of Artificial Sequence: Synthetic coding sequence
atgattagagcagccccaccccctctttttcttctcctcttgctcttactgctcctggtctcctgggcaagccgaggcgaagccgctcccgaccaggatgaaatccagcggctcccaggtctggcaaagcaaccctctttcaggcagtactccggctatctcaaagggagcggatctaagcaccttcattattggttcgtagagtctcagaaagatccagaaaattctccagtggtgttgtggctgaatgggggtcctggctgttcaagtctggacggactcctaacagaacacggcccttttctggtccaaccggatggggttacactggagtacaatccctattcatggaacttgatcgctaatgtgctgtacctggaatccccagcaggagtggggttttcttactccgatgacaaattctatgcaaccaacgacaccgaggtggcgcagtcaaacttcgaggcccttcaggatttctttagactgtttccagagtacaagaacaataagttatttctgaccggggagtcctacgcaggcatttatattccaactctggctgtgcttgtaatgcaggatccatctatgaacctacagggcttggccgtcggcaacggtctgagctcttacgaacagaatgacaatagcttagtttatttcgcatactaccatgggctgctaggtaaccggctctggagtagcctgcagacacactgctgttcccagaataagtgcaatttctacgataacaaagatcttgaatgtgtgaccaatctgcaggaggtagcgaggatagtggggaacagtgggttgaatatctacaatctttacgctccatgtgctgggggagtgccctcccatttctag

SEQ ID NO: 217309 - DNA, 1497 bp, Artificial Sequence
  Description of Artificial Sequence: Synthetic coding sequence
atgacttcttctcctagggctcctcctggcgaacagggaagaggtggtgctgaaatgatccgagccgctccccctccactgtttctgctgttactcctgctcctgttgctcgtgtcctgggctagccggggagaagccgcacccgaccaggatgagattcagcgactgccgggacttgccaaacagccctctttcagacagtactctggatacttgaagggatctggatctaagcatctccactattggtttgtagaatctcagaaagatccagaaaactcaccagtcgtgttgtggttgaatggaggtcctggatgcagctctctggatggcttgctcaccgagcacggtccttttctcgtccagccggacggtgtgactttggaatataacccatattcctggaacttgattgctaatgtcctgtaccttgagtctccagctggggtgggtttctcctattctgacgataagttttacgcaacaaatgacaccgaagtggctcaatccaatttcgaagcactgcaggactttttccgactctttcctgagtacaagaacaataaactcttcctgaccggggagtcttacgctgggatttatattccaactctcgccgtcctggtgatgcaggacccgtctatgaacctgcaaggcctggcagttgggaacggactctcctcctatgagcaaaacgacaattccctggtgtacttcgcatattatcatggcctgctcgggaatcggctgtggtcgtcactgcagacacattgctgcagccagaataagtgtaatttctatgataacaaggatctggagtgcgtgacgaacctgcaggaagttgcacgtattgtgggtaattcagggctgaatatctacaacttgtacgccccatgtgctgggggagtgcccagccacttccggtacgagaaggataccgttgtggtacaggatctaggcaacattttcaccaggcttcctctgaagaggatgtggcaccaggctctgctgaggtcaggcgataaagtgcgaatggacccgccttgtaccaatactaccgccgcaagcacgtatctcaataacccttacgtgagaaaagcgttgaacatcccagagcagttgccccagtgggatatgtgtaattttttagtaaacctgcagtatcggcgtttgtatcgaagcatgaactcccagtacctgaaactgctctcttcccagaagtatcagatactgctgtataacggcgatgtggacatggcgtgtaactttatgggtgacgaatggttcgtggactccctcaaccagaaaatggaagtgcagagacggccttggctggtgaagtatggggatagtggagaacagattgcgggttttgtaaaggagttcagtcacattgcatttctgaccataaaaggtgccggacacatggtcccaaccgataagccactcgccgcttttaccatgttctcccggttcctgaataagcagccatactag

SEQ ID NO: 217310 - DNA, 1038 bp, Artificial Sequence
  Description of Artificial Sequence: Synthetic coding sequence
atgataagggccgctcccccacccctgttcctattgctgctgttgcttcttttacttgtctcgtgggcttctcgtggcgaggctgcccctgaccaagatgagatccagcgtttgccgggacttgccaaacagcctagcttccgccagtacagcggttacttaaagggctcagggagcaagcatttgcactactggttcgttgagtcccagaaggatccagagaattcccctgtggtgttatggctgaacgggggacctggctgctcctctctggacggactgcttaccgagcacggcccattcttgatcgctaacgtgttatacttagagtcgcccgctggcgtggggtttagctatagtgatgataagttttatgcgactaacgatactgaggtggcacagagcaattttgaagcactgcaggacttcttccgcctcttcccagagtacaagaacaacaaactctttctcacaggtgagagctatgccggaatatacattcctactctagcagtgctagtcatgcaggacccgtcaatgaacctacaggggctggccgttggtaatggcctcagttcttatgagcaaaacgataacagccttgtctattttgcctactaccacggcttgcttggaaaccgcctgtggagctctttacagacccattgctgctcacagaacaagtgcaacttctacgacaacaaggatctcgaatgtgtgactaatttgcaagaagtagcccgaattgtcggcaacagtgggcttaatatatataacttgtatgccccttgtgctggcggtgttccatcgcactttcgctacgaaaaggacactgtagtggtgcaggaccttgggaacattttcacccggctaccactgaaaaggatgtggcatcaggctctgctgagatcgggagataaagtgcgcatggaccctccctgtacaaatactacggccgcttctacatatctgaataatccatatgttcggaaagccctcaacattcccgaacagcttccacagtgggatatgtgctag

SEQ ID NO: 217311 - DNA, 1149 bp, Artificial Sequence
  Description of Artificial Sequence: Synthetic coding sequence
atgatgtttcctggactgctcgcacccccagctgggtacccctctctgctgcgcccaactcccactctaacgctgccccagtcactccagagcgccttctccggtcactccagcttcctggttgaagatctcatccggatctccaggccccctgcttatttgcctcgctcggtgccgactgcctctatgtcaccccctcgtcagggggctccgaccgctctcacggacaccggagcctctgacctcggttctcccggtcccggatccaggaggggtgggagtcccccaacagccttttcgcccgcttccgagactacatttctgaaattcggagttaatgcgatactaagctctgggccacgcacagaaacgtccccggctctgctccagagtgttccacccaaaaccttcgcatttccatatttcgaggggtctttccagccctttattcgctctagttactttcctgcctcatcttctgtcgtgcctatccccggtacgttcagctggccgcttgctgctcgaggaaagcctcggagaggaatgctgagacgagcagtcttctccgacgttcagcgcaaggctctggagaagatgtttcaaaagcaaaagtatatctccaaacccgaccggaagaaactcgctgccaaactgggcctgaaggattcccaggacaccgctaggaggactgaaccagctcccgactctaccccacggccacgggcttcccccggagccccagacctcacctcagcatccccttttttctctcccgctggcactttccaggtgaagatttggttccagaacagacgcatgaaatggaggaactcaaaggaacgtgagctcctgtctagtggaggctgcagggagcagactctcccgaccaaactgaatccccacccagatctgtccgatgtgggacagaagggccctggtaacgaagaagaagaggaaggacctggcagccctagccaccgtctggcctaccacgcctccagcgacccccagcatctgcgggatcccagattgccgggacctcttccaccatcacccgctcatagttccagccctggaaaaccctccgacttttctgacagtgaggaagaagaggaaggcgaggaacaggaggagataaccgtgtcctag

SEQ ID NO: 217312 - DNA, 1341 bp, Artificial Sequence
  Description of Artificial Sequence: Synthetic coding sequence
atgggcgcaggcccatcttgcgacacaccagcgaattgcacctacctcgaccttctggggacttgggtgtttcaggtcggttcctctggcagccagcgtgatgtcaactgctccgttatgggacctcaggaaaaaaaggtggtcgtttatctccagaaactcgataccgcttatgacgatctcggaaactcagggcactttactattatatataaccagggcttcgagattgtcctaaatgactataagtggttcgcattcttcaaatacaaggaggaggggagcaaagttacgacttactgcaacgaaaccatgaccggctgggtacacgatgttctcgggaggaattgggcatgtttcaccggaaaaaaagtcggcaccgcttccgagaacgtgtatgtgaatattgctcacctgaagaattcacaggaaaaatactcaaaccggttgtacaaatacgaccacaattttgtgaaagccattaacgcaatccagaagtcatggacagccaccacatacatggagtacgaaaccctgacgttgggagacatgataaggcgctctgggggacacagtaggaaaataccaagacccaagcccgcacccctgactgccgaaatccaacagaagattctgcatctgcccacgagttgggattggcggaatgtccacggcattaactttgttagccctgttagaaaccaagcatcgtgcggcagttgttatagctttgcctccatgggcatgcttgaggcccgtatcaggatcttgaccaataattctcagacgcccattctgtctccccaggaagtggtgagctgctcgcaatacgcacaagggtgcgaagggggatttccttatttgatcgctggaaagtacgcgcaggatttcggacttgtggaagaggcctgttttccgtataccggtactgactccccatgcaaaatgaaggaggattgcttcagatactatagctccgaataccattatgtgggcggattctacggagggtgtaacgaggccctcatgaaattagagctggtacaccatggtcctatggctgtggccttcgaagtgtatgacgactttctccactacaaaaagggaatctaccaccacacaggcctgcgcgatcccttcaatccctttgagttgaccaatcacgccgtgctcctggtgggatacggcaccgactcagcctcaggaatggattactggatcgttaagaattcgtggggcaccggatggggagagaacggatatttccgaattaggcggggtacagacgaatgcgctatcgagtccatcgccgtggcagcgaccccaattccgaagctgtag

SEQ ID NO: 217313 - DNA, 414 bp, Artificial Sequence
  Description of Artificial Sequence: Synthetic coding sequence
atgggcgcaggcccttccctgcttctggccgctttgttgctactcctctccggcgatggggctgtgcgctgcgacactccggctaactgcacatacctggacctgctgggaacctgggtgttccaggtggggtcctccgggagccagagggatgtgaattgctcagtgatgggccctcaggaaaaaaaagtggtggtctatctacaaaagctggacacagcgtacgatgatctgggaaactctggtcacttcacgatcatttacaaccaaggttttgagatcgttttgaatgattacaagtggtttgcctttttcaaggacgtgacagacttcattagtcatctgtttatgcaacttgggaccgtgggcatttacgacttgccacatctgaggaacaagttggtgataaaatag

SEQ ID NO: 217314 - DNA, 426 bp, Artificial Sequence
  Description of Artificial Sequence: Synthetic coding sequence
atgggagcagggccatctctgctgctggctgccctactgctactgctctctggagatggagccgtgagatgcgatacccctgctaattgcacctacctggacctactagggacctgggtattccaggtgggctcatcaggctcacagagagacgttaactgttccgttatgggaccccaggaaaagaaagtggtagtctatctgcaaaagctggataccgcatatgatgacctgggtaactcaggtcatttcactatcatctataaccagggcttcgaaattgttctgaacgactataaatggtttgccttttttaaagatgtgacagatttcatttcccatctcttcatgcaactcggaaccgttgggatctatgacctgccgcacctaagaaataagctggccatgaataggcgatggggctag

SEQ ID NO: 217315 - DNA, 1191 bp, Artificial Sequence
  Description of Artificial Sequence: Synthetic coding sequence
atgaaaacactcttactgcttttactggtgcttctggagctcggcgaggcccagggatcacttcatagagtgcctttgaggaggcatcctagtctgaaaaagaagctgagagcacggtcccagttgtcagagttctggaaaagccataatttggacatgatccagttcaccgagtcatgcagcatggatcaatccgcaaaggagccactaattaactacctagatatggaatactttgggaccatcagcataggttccccaccacagaacttcacggtaattttcgacacaggcagttcgaacctctgggtcccgagcgtctattgtacatcccccgcttgtaaaactcactctcgatttcagccttctcagagtagcacatattcccaacctgggcaatcattcagtatccaatacgggaccggctcacttagcggcatcatcggcgctgatcaggtgagtgtagagggcctaaccgtagtgggtcagcagttcggggagtcagtcacagaaccgggacagactttcgtcgatgccgagtttgatggaatcctgggactgggatacccaagcttggccgtgggcggtgttaccccagtatttgataatatgatggcccaaaacctagtcgatctgcctatgttttccgtatacatgtccagtaatcctgagggcggtgccggtagcgagctgatttttgggggttatgaccattcacatttctccggttcacttaattgggtgccagttacaaaacaggcttattggcagatcgctcttgacaatatccaggttggcggtaccgtaatgttttgttctgagggctgtcaggcaatagttgacacaggcacaagtttgatcacagggccatccgataaaatcaagcaactccaaaatgccattggcgctgcccctgtggatggtgaatacgctgtggagtgcgccaaccttaacgtgatgcccgatgtcacatttactatcaatggggtcccctacactctatcccccacagcctacaccctgttggactttgttgatgggatgcaattctgtagtagtgggtttcagggtttagatatccaccctcccgctgggcctttatggattctcggagacgtcttcatcagacagttttattctgtgttcgacagggggaacaaccgggtggggctggctcccgcagtcccttag

SEQ ID NO: 217316 - DNA, 1092 bp, Artificial Sequence
  Description of Artificial Sequence: Synthetic coding sequence
atgaaaactctgctgctgctcctgctggtgctgctggagttaggggaggcccaaggctcactgcatcgggtgcccctccgacgtcatccaagtttaaagaaaaagctgcgcgcacggtcccagcttagcgagttttggaagtcccataatctggatatgatccagttcaccgaatcttgcagcatggatcagagtgccaaggagcctctgattaattatctcgatatggagtattttggcactattagcatcgggtcacccccacagaactttaccgtgatctttgataccggcagcagcaacctgtgggtgccaagtgtatactgtacatctccggcttgtaagacccactctaggttccagccttctcaatcctccacatattctcagcccggtcagagcttttcaatccagtacggcaccggaagcctgtccggaattatcggcgcagatcaggtgagtgtggagggtctgacagtggtgggtcagcagtttggcgagtccgtaactgagcctgggcagactttcgtggatgccgagtttgatggcatcctgggattagggtatccttccctggcagtcggaggtgtcacccccgttttcgataacatgatggctcagaatctggtggacctgccgatgttctctgtgtatatgtctagtaacccagagggtggggcaggatctgagctgatctttggtggctacgaccatagccatttttctgggagcctgaattgggtgcccgttactaaacaggcctactggcagattgcgctcgataacatgctgtggtctgtgccaacactgacgtcatgtcgcatgagcccgtctccccttaccgagagccccatcccttcagctcagctgcctactccctactggacaagctggatggaatgttccagtgctgccgtcgccttcaaagaccttacttcgaccctgcaactgggacctagcgggagctgggggatgagtagctttgatagtttcacgcagagcctgaccgtaggaattaccgtgtgggattggcctcaacagagcccaaaggaagggccttgcgtgtgtgcatgtctgtcggatcgaccatag

SEQ ID NO: 217317 - DNA, 1206 bp, Artificial Sequence
  Description of Artificial Sequence: Synthetic coding sequence
atgaaaacactgctgttattgttactcgttctattggaacttggggaggctcagggttcccttcatcgggttccgcttcgtagacacccttctcttaagaagaaactgcgagcccgatcccaactgtccgagttctggaaaagccacaacctggacatgattcaattcaccgaatcatgttccatggatcagtctgcgaaggagcccctgattaactacctggacatggagtactttggaacaatctcaatagggtctcctccgcaaaatttcaccgttatcttcgataccggatcttctaatctatgggtgccatctgtctactgtacgtcccccgcttgtaagactcattccaggttccaaccatcacagtcttccacttactcccaaccaggacaatcctttagtattcagtatgggactggctctctgtcgggtattatcggagctgaccaggtgagtgccttctcttatcaggtcgaaggcctgaccgtcgtgggccagcaattcggggaatctgtgacagagccgggtcagactttcgtggatgccgaatttgacgggatcctgggcttagggtatcccagtttagcagtggggggagtgactcccgtgttcgacaacatgatggcacagaacctcgtcgacctgcccatgttttctgtgtacatgtctagcaatccggagggaggggcagggagcgagctgattttcggaggctacgaccactctcatttttccgggtcccttaattgggtgccagtcacaaagcaggcatactggcaaatcgctctggataacattcaggtgggtggaactgttatgttctgctccgagggctgccaggctatcgttgataccggcacctccctgatcacgggtccaagtgacaagatcaaacagctgcaaaatgctatcggcgctgccccagtagacggagagtatgctgtggagtgcgccaatctgaacgtgatgccagatgtgaccttcactataaatggagtgccttatacactaagtcccactgcatacactctgcttgactttgtggacggaatgcagttttgctcttctggcttccagggcctggacatacatccccctgccggacctctgtggatactgggcgacgttttcattcggcaattttatagcgtgttcgaccgcggtaacaatcgtgtgggcctcgctccagctgtgccatag

SEQ ID NO: 217318 - DNA, 867 bp, Artificial Sequence
  Description of Artificial Sequence: Synthetic coding sequence
atggaatacttcggcaccattagtatcggtagccctccgcagaactttaccgttatctttgatacaggatcatccaacctgtgggtcccctcagtctactgtacctctccggcatgcaaaacccacagccggtttcagccgagccagtcttctacatacagccagccaggccagtcatttagtattcagtacgggaccggaagcctgtcaggcattatcggagccgatcaggtgtctgtggaggggctgaccgtggtgggacagcagtttggtgagtcagtcaccgaaccgggacagactttcgtggacgccgaattcgatggaatcctcggactcggatatccttcattagcagttggcggagtgactccggtgttcgacaacatgatggcacagaatctggtggacctgccgatgttttctgtctatatgtccagcaaccctgagggcggtgctggtagcgaacttatttttggaggttacgaccactctcatttcagtggctccctgaactgggttcccgttaccaaacaggcttactggcagatcgcgctggacaacatgctgtggtctgtcccaacactgacgtcatgtcggatgtccccgagccccctaactgagtccccaattccctccgctcagcttcctaccccctactggacttcctggatggagtgcagttccgctgcggtggcgttcaaagacctgacatctactttgcaactggggcctagtggctcctggggcatgtcaagcttcgatagtttcacccagagcctgactgttggcataacggtatgggactggccacagcagtcacccaaggaaggaccctgcgtgtgtgcctgtctgagcgacaggccgtag

SEQ ID NO: 217319 - DNA, 1455 bp, Artificial Sequence
  Description of Artificial Sequence: Synthetic coding sequence
atggcgccttggctccagcttttaagtctgctgggactcctgcccggtgccgttgcagccccagcgcagccccgtgccgcatcattccaagcatggggaccaccgtcccctgagctgttagcacccactaggttcgctctggagatgtttaacagggggcgtgccgcaggcactcgtgcggtattgggactagtccgagggagagtccggagagcaggccagggcagtctctacagcctggaggcgacactggaggaacccccttgtaacgatcccatggtgtgcagactccctgtgagcaaaaaaacgttgctgtgcagctttcaggtgctcgatgagctcggtaggcatgtgttgctccggaaggattgcgggccagttgacactaaagttccgggagctggcgagcctaaaagtgcctttacccagggctcagcaatgattagcagcctgtctcagaaccaccccgacaataggaacgaaaccttcagctctgttataagccttcttaatgaggaccctttgtctcaggacctgcccgtgaagatggccagcattttcaagaactttgtgattacatacaataggacttatgagagtaaggaggaggcaagatggcggctatcagtgttcgtcaacaatatggtccgcgcacagaagattcaggccctagatagaggcacagcacagtacggcgtgaccaagttctccgacctgaccgaggaggagttccgtacaatctatcttaacaccctgctgaggaaggaaccaggcaacaaaatgaaacaggccaagagcgtgggggatctggcccctcccgaatgggactggcgcagcaaaggtgccgtgacaaaggtcaaggaccaggggatgtgtggcagctgctgggccttcagcgtgaccgggaacgttgaggggcagtggttcctcaaccagggcacacttctcagtttgtccgagcaggaacttctggactgtgacaaaatggacaaggcttgcatgggcggtctcccttccaacgcgtactctgccataaagaatttgggcggtctggaaaccgaagacgattatagctatcagggccatatgcaaagctgcaatttctcggccgagaaagctaaggtgtacataaatgactctgtcgagctgagccagaacgagcagaagctcgctgcctggctggccaaacggggtccaataagcgtcgccatcaatgcctttggaatgcagttttaccggcatggaatatctcgccctctgcggccattgtgtagcccttggctcatcgatcacgctgtgctactcgtagggtacgggaaccgaagtgacgtcccattctgggctataaaaaacagctggggcaccgactggggtgagaaaggctattattacctgcatcgagggtccggcgcttgcggagtcaacaccatggccagctccgccgtggtggattag

SEQ ID NO: 217320 - DNA, 675 bp, Artificial Sequence
  Description of Artificial Sequence: Synthetic coding sequence
atggccgcagccgtgccacagcgcgcatggaccgtggagcagctgcggagtgagcagttacccaaaaaggatataattaagttcctgcaggagcatggaagcgacagctttcttgctgaacacaaactcttggggaacattaagaacgtggccaaaactgcgaacaaagaccaccttgtaacagcatacaaccacctgttcgagacaaagaggtttaaggggactgagtccatctccaaggtatctgaacaggtcaagaacgtcaagctgaatgaggataaacctaaagaaacgaaaagtgaggagaccttggatgaaggacccccaaagtatacaaaaagtgtgctgaaaaaaggtgataagactaacttcccaaagaaaggggatgtcgtccattgctggtataccggaacattacaggacggcactgtgtttgatacgaacattcagacttctgcaaaaaaaaagaagaatgctaaacctttgagttttaaggtgggggtaggaaaggtgattcgaggatgggatgaagcactcctcaccatgtccaagggcgaaaaggccaggcttgagattgaacctgaatgggcctatggcaagaaagggcagcccgacgctaaaatcccacctaatgcaaaacttactttcgaagttgaactagtcgatatcgactag

SEQ ID NO: 217321 - DNA, 801 bp, Artificial Sequence
  Description of Artificial Sequence: Synthetic coding sequence
atgagctccgtcttcgggaaacccagagccggttccgggccacagtctgcaccactcgaggtaaatttggcaattctgggccgacgcggtgccggaaaatccgcacttaccgtcaagtttcttacaaagcggttcattagcgagtacgatcccaacctggaagacacttactcgagtgaggagaccgtggaccaccagccagtgcacctgagagtgatggatactgctgatctggatacccctagaaactgcgaaaggtacctcaactgggctcacgcattcttagttgtttattcagttgatagccggcagagtttcgattcttccagctcatatttagagctgttggctcttcacgcaaaagagacccagcggtcgatacctgcgctgcttctgggcaacaaactcgacatggcccagtatcgacaggtgacaaaggccgaaggagtagccctggcaggtcgatttgggtgtctgttcttcgaggtgagcgcttgtctcgacttcgagcatgtgcagcacgtctttcacgaagcagtcagagaagcacggagggagcttgaaaaatctcccttaacacgacctttatttatctccgaggagagggcgctgccccaccaagcccctttaacagcgagacacggtcttgccagctgtacattcaatacactgtccacaataaatctgaaagagatgccaactgtggcccaggccaagttagtgaccgttaagtcctcccgcgcacagagtaagcggaaagcacctaccctgactctccttaaaggttttaagatcttttag

SEQ ID NO: 217322 - DNA, 972 bp, Artificial Sequence
  Description of Artificial Sequence: Synthetic coding sequence
atgtgggccactttgcccctgctttgtgctgccgaactttgcgttaattccctggagaagtttcatttcaagtcctggatgagtaagcacagaaagacttatagtaccgaggagtatcatcacaggctacaaacgtttgcctccaattggcgtaagattaatgcccacaataacggcaaccacacattcaagatggcactgaaccaatttagcgacatgtcgttcgctgagatcaagcacaaatatctgtggtctgaacctcagaactgcagcgcaacgaaaagtaattacctcaggggcacaggtccctatccccctagcgtggactggcgtaaaaagggcaattttgttagcccggtgaagaaccagggcgcttgcggcagttgctggaccttctctactactggtgccttggagtccgcaatcgctatcgcgacggggaagatgctttcactagcagagcagcagctggtggactgcgcccaagacttcaataatcacggctgccaaggaggcctgccctcccaggccttcgaatacattttgtataacaagggaataatgggcgaggacacttacccctatcaggggaaggatggctactgcaagttccagcctggcaaagcaattggttttgtcaaagatgtcgccaatatcacgatatatgacgaggaggctatggtggaggccgtggccctttataacccagtgtcattcgcctttgaagtaacccaggatttcatgatgtacagaacaggcatctattcttcaacgtcctgccataaaacaccggataaagtgaatcatgccgttcttgctgtcggctatggcgagaagaatggtatcccctactggatcgtaaagaacagctgggggccacaatgggggatgaacggatacttcctgattgagcgcggaaagaatatgtgcggcctcgctgcatgtgccagttaccccattccgctcgtatag

SEQ ID NO: 217323 - DNA, 621 bp, Artificial Sequence
  Description of Artificial Sequence: Synthetic coding sequence
atgtgggcaacgctcccgctgctgtgcgctggagcgtggctgcttggagtgcctgtttgcggagctgcggagctgtgtgtcaattcccttgaaaaatttcattttaaaagctggatgtcaaagcaccgaaaaacttacagcaccgaggaataccaccacaggttgcaaacattcgctagcaattggcggaaaatcaatgctcataacaacgggaatcacacattcaaaatggctcttaaccagttttctgacatgagctttgccgagatcaaacataaatacttgtggtctgaaccccagaactgttccgccaccaaaagcaactatttacgtgggactggaccttacccaccatcggttgattggaggaagaaagggaacttcgtctccccagtcaagaatcaagtgtgccttgctatatctatcttgtccttgcagaacggccatactccccgacagtacacaagaaagaataattccaaagggccacagaatcatcacaagcatatacccgcttcagtttcttcccgtcacctgagccctgggaggccctctctgccccagctgcgtgagatctgtgaagggaaaagattgggcgaggcctccgtgaatttaggttag

SEQ ID NO: 217324 - DNA, 990 bp, Artificial Sequence
  Description of Artificial Sequence: Synthetic coding sequence
atgtggggactgaaagtgctgctcctgcctgtagtctccttcgcgctgtacccagaagagatacttgacactcactgggagctgtggaagaagacccacaggaaacagtacaacaacaaagttgatgaaatttcccgacggctgatctgggaaaagaacctgaagtatatttccatccacaacctcgaggccagccttggagtccacacttacgagttggctatgaaccaccttggcgacatgactagtgaagaagtcgtgcagaaaatgacagggctgaaggttccgctctcccacagtcgctccaacgacactctgtacatccctgaatgggaaggcagagccccagattcagttgactatcgcaaaaagggctatgtgacccctgtgaaaaaccagggacagtgcggcagttgctgggcctttagttccgtgggggctttggaaggtcagctcaagaaaaagaccgggaaactgttaaatttatctcctcagaatttggtggactgtgtcagcgaaaatgacggatgcggcggaggttatatgacaaacgccttccaatatgtacagaagaaccgcggtatcgattcggaggacgcatatccctatgtgggccaagaagagtcctgcatgtataaccctaccggcaaagctgccaaatgcagaggttatagggagattccagaaggcaatgagaaagcactgaagcgggctgtcgcccgagttggtccagtttccgtggctattgatgcctctctgacctctttccagttttatagcaagggagtgtattatgatgaatcatgcaatagtgataatctaaatcacgccgttttggccgttgggtatggcatacagaaggggaataagcactggatcattaagaattcatggggagaaaattggggaaacaaaggatatatactgatggcaagaaacaaaaataacgcctgtggaatagccaatctggctagctttcccaaaatgtag

SEQ ID NO: 217325 - DNA, 777 bp, Artificial Sequence
  Description of Artificial Sequence: Synthetic coding sequence
atgcacaaagagaacgaagaaatctataacgtgagcgagaatagaaaacactgcccaatttttccatgtcctctgttaacgcgttctggcaaagtgcccgagtttagacatgaacgagaagagagactggaggagatgatcagacgccagaatctcgacggaaacctctcattcgtgatgtggggattgaaggtattgttactgcctgtcgtaagtttcgccttgtacccagaagagattctagacacgcactgggagttatggaagaaaactcatcggaagcagtacaacaataaagtggacgaaatctcacgaagactgatctgggaaaagaatcttaaatacattagcattcataacctcgaagccagcctgggagtgcatacatatgaactggccatgaaccacctgggggacatgacctcagaggaagttgtgcagaagatgactggacttaaggtacccctttcacactcccgatccaacgatacactgtatatacctgaatgggaaggacgggcacccgatagcgtggattaccggaagaaaggttatgtgacccccgtgaaaaaccagggacaatgcggaagttgttgggcattttcgagtgtgggagctctagaagggcagctaaagaagaagactgggaaactgctgaacctatcgccacagaacctcgtggactgtgtatctgaaaatgatgggtgcggagggggttatatgaccaacgcgtttcagtatgttcaaaagaaccgaggaatcgatagtgaggattag

SEQ ID NO: 217326 - DNA, 1005 bp, Artificial Sequence
  Description of Artificial Sequence: Synthetic coding sequence
atgaatttaagtcttgtgctggctgccttttgtctgggcatcgcaagcgcagtcccaaagttcgatcagaaccttgataccaaatggtatcaatggaaggccacacaccggagactgtacggtgccaatgaagaagggtggagacgagccgtctgggagaagaacatgaaaatgattgaactccacaacggggagtacagccaaggcaagcacgggttcaccatggccatgaatgcctttggtgacatgactaacgaagaattccggcagatgatggggtgttttcggaaccagaagttccgtaagggaaaggttttcagggaaccgctgttcctagatcttcccaagagtgttgactggagaaagaagggatatgtcactcccgtgaagaatcagaaacagtgcgggtcttgctgggcctttagcgcgaccggcgcattagagggtcaaatgtttcgcaaaacaggaaagctcgtatccctgtcagagcagaatctggttgactgtagccgacctcaggggaatcagggctgcaatgggggattcatggcacgggcatttcagtatgtcaaggagaatggcggacttgactccgaggaatcctatccatatgtagcagttgacgagatctgcaaataccgcccagagaactccgtggcgaacgatacaggctttacagtggtggccccaggaaaggaaaaagctctgatgaaagctgttgcgacagtggggcctatctccgtggcgatggatgcgggtcactcgtcgtttcagttctacaaatccgggatttattttgaaccagactgttccagcaagaacctggatcatggcgtgctggttgttgggtatgggttcgagggcgcaaactctaacaattccaagtactggttagttaaaaattcctggggcccagagtggggatcaaatggatatgtgaagatcgccaaggataagaacaatcactgtggcattgctacagccgcttcttatccgaatgtctag

SEQ ID NO: 217327 - DNA, 1005 bp, Artificial Sequence
  Description of Artificial Sequence: Synthetic coding sequence
atgaatctatccctcgtgcttgctgcattttgcctgggtattgcctcggctgttccgaagtttgatcaaaatcttgacacaaagtggtatcagtggaaggccactcaccggagactgtatggagccaatgaggaaggctggagacgggctgtttgggagaagaacatgaagatgatagagctgcataacggagagtactcgcaagggaaacatggttttaccatggctatgaatgccttcggtgacatgaccaatgaggagttcagacagatgatgggctgttttaggaatcaaaaattcagaaaggggaaagttttccgcgagcctttgttcctcgatctccctaaaagcgtggactggcgaaaaaagggatacgtcacacccgttaagaatcagaagcagtgtggctcctgttgggccttcagcgctacaggggcactcgagggtcagatgttcagaaagaccggcaaattagtgtcgctgagtgagcagaaccttgtagattgttctcggcctcaaggaaaccaggggtgtaatggaggatttatggccagagcgttccagtacgtcaaggagaacgggggactagacagcgaggagagctacccctacgtcgctgtggacgaaatctgcaagtatcgcccagaaaactccgtcgccaacgacactggattcacagtcgtggccccaggcaaggagaaagctttaatgaaggctgtggcgaccgtgggccctatcagtgtagcaatggatgccggtcactctagctttcaattctataaatcgggaatttatttcgagcccgattgcagttctaaaaacctggatcacggagtgctcgtcgtcggatacggttttgaaggagcaaatagcaacaattcgaaatactggctcgtgaagaactcgtggggcccagagtggggttcgaatggatacgtgaaaattgctaaggataaaaacaatcattgtggcatcgccactgctgctagctatcctaatgtctag

SEQ ID NO: 217328 - DNA, 996 bp, Artificial Sequence
  Description of Artificial Sequence: Synthetic coding sequence
atgaagagactcgtgtgcgtacttctggtgtgctcgagcgccgtcgcacaactgcacaaggacccaacattggatcatcactggcacctgtggaaaaaaacttatggaaagcagtacaaggaaaagaatgaggaggcagtaagacggctgatttgggagaagaacctgaagttcgtgatgctccacaatctggagcactccatggggatgcactcttacgatttagggatgaatcatctgggcgatatgacaagtgaagaggtaatgtccctcatgagtagcctgcgggtgccgagccagtggcaacgtaatataacctacaagagcaacccgaaccgtatactccctgattccgttgattggcgagagaagggctgtgttacggaagtgaagtatcagggcagctgcggtgcatgctgggccttttccgctgtcggcgcactggaggcacagctaaagctcaagactggcaagcttgtgtctttgtccgcccagaacctggtcgactgttcaacagaaaagtatgggaataaagggtgcaacggaggcttcatgaccaccgcattccagtacatcattgataataagggcatcgatagcgatgccagttatccttataaggcaatggatcagaaatgtcagtacgactccaaatatcgggctgccacctgcagtaaatataccgagctgccctacggccgagaggacgtgctcaaggaggctgttgctaacaaggggcctgtgagtgtcggggtggatgcaagacaccctagcttcttcctctatagaagcggtgtctactatgagccttcgtgcacacagaatgtaaaccacggggtgctagtggtcggctacggcgacttaaatgggaaggagtattggcttgtgaaaaactcctggggacataattttggcgaggaagggtacattagaatggctcgtaataaaggaaatcactgcggcattgctagcttcccgagctatcccgagatttag

SEQ ID NO: 217329 - DNA, 846 bp, Artificial Sequence
  Description of Artificial Sequence: Synthetic coding sequence
atgaagaggctggtgtgtgttttattagtgtgctctagtgcagtggctcagctgcacaaggatcctacgctagaccatcactggcacctgtggaaaaagacgtatggcaagcagtacaaggagaagaacgaagaggccgtaaggcggcttatttgggaaaaaaacctcaaattcgtgatgttacacaatctggagcattccatgggcatgcacagttacgatctgggaatgaatcatctgggcgatatgggatcctgcggtgcatgttgggcgttcagcgcagttggcgcactagaagcccagctgaagctgaagacaggtaaattggtgagcctgtctgcccaaaacttggtggattgttcgactgagaaatatggcaacaagggttgtaacggagggtttatgactactgctttccaatatatcatagacaacaaaggcatcgactcagatgcaagttatccctataaggcgatggaccagaaatgtcagtacgactcgaaatatagggctgccacctgctccaaatacaccgagctaccctacggcagggaagacgtgctcaaagaagcggtggcgaacaagggtcccgttagtgttggtgtggatgctcggcacccgagctttttcttgtacagatccggcgtatactatgagccctcgtgtactcagaatgtgaatcatggggtcttggttgtcggctacggcgacctcaacgggaaggaatattggttagtgaagaatagctgggggcataacttcggcgaggagggctacatccggatggctcggaacaagggtaaccattgcgggatcgccagctttccctcctaccccgaaatttag

SEQ ID NO: 217330 - DNA, 1131 bp, Artificial Sequence
  Description of Artificial Sequence: Synthetic coding sequence
atggctctcacagcccaccctagttgcctgcttgcactcttggtcgccggactggcacaaggaatacggggtccactgcgcgctcaggatctcggaccccaacctctggagttgaaagaagcatttaaactgtttcagatccagttcaatcgctcttacctgtccccagaggagcatgcccatagactcgacatcttcgctcataacctagcgcaggctcaaagactgcaggaggaagacttaggcacagcagaatttggagtaaccccgttctctgacctgacagaggaggagtttggacaactgtatggataccgccgagctgcgggtggtgtgccctctatggggcgagagatcagatccgaggaacctgaagaatccgtgcccttctcctgtgactggcgcaaagtcgcatctgctatcagccctatcaaggaccagaagaattgcaactgttgttgggccatggcagcggcaggcaatatagaaacgctatggcgcatctccttttgggatttcgtggacgtgagcgtgcaagagcttctggattgcgggaggtgtggcgatggctgccacgggggttttgtctgggatgcctttataaccgtcctaaataattcgggcttggcttctgaaaaggattatccctttcaggggaaggtcagggctcatagatgtcacccaaagaagtaccagaaggtggcttggattcaggatttcataatgctccagaacaacgagcaccgcatcgcacagtacttggccacatatggcccaatcacagttaccattaatatgaagcccctgcagttgtacagaaagggggtgattaaagccaccccaaccacctgtgatccccagttagttgaccattccgtcttactggtcggttttgggtccgtgaaaagcgaggagggaatctgggctgaaacagtgtcctcacaaagccagccccagccccctcatcccaccccatattggatccttaagaattcttggggcgcacagtggggcgagaagggatactttcggctacatcgaggctcaaatacttgtggtatcacaaagttccctcttacagcacgggtgcagaaaccggacatgaagcctcgtgttagctgccccccttag

SEQ ID NO: 217331 - DNA, 2679 bp, Artificial Sequence
  Description of Artificial Sequence: Synthetic coding sequence
atgacggaccccttctgcgtcgggggaaggcgactgccaggatcttcaaagagcggccctgggaaggacggctccaggaaggaagtcaggttgccaatgttacatgatcccccaaagatgggtatgcctgtagtcaggggcggtcagactgtaccagggcaagctcctctgtgcttcgatcctgggtcacccgctagcgataagacagagggaaaaaaaaaaggccgacctaaggcagaaaaccaagccttaagggatattcctctgagtttgatgaacgactggaaagacgagtttaaagcccattctagggttaaatgtccaaatagcgggtgttggctggagttccctagtatttacgggctaaaatatcactaccagagatgtcagggaggagctatctccgaccggttggcctttccatgtcccttttgtgaagctgcattcacctcaaagactcagctcgagaaacaccggatctggaaccacatggataggccccttcctgcgtcaaagcctgggccaatctcccggcctgttactatttctcgcccagtgggagtgtcaaaaccgattggcgtttcaaagcccgttacaatcggtaaacctgtgggtgttagtaagcccattggtatttctaagcccgtctccgtcgggaggcccatgccagtgacaaaagcaattccagtcacaaggcccgtgcccgtgaccaagccagttaccgtgagtagacccatgccagtcacaaaggcgatgcccgttaccaaacccattactgttacaaaatcggtgccagtaacaaaacccgtgccggtgaccaaacccatcactgtgaccaagctcgtgaccgtgacaaagccagttcccgtcacgaagcccgtaaccgtgtcacgtcccatcgtggtgtctaagccggtaactgtctcccgcccaatcgcgatatctcgtcacacccccccttgtaaaatggtcttgctcactagatccgagaacaaagcgcctagggccacagggcgaaactctggcaaaaaacgcgcagctgactcccttgatacatgtccaatccccccaaagcaagcaaggccggagaatggcgaatacggaccaagcagcatggggcaatcgtccgccttccagctgtccgccgacacctcatctggttcactctcacccggatcaaggccatctggtggtatggaagccctaaaggcagcaggtcctgcttcaccaccagaggaagaccctgagcgcacgaaacacagacgcaaacagaaaacccccaagaagtttactggggaacaacccagtattagtgggacatttggcctgaagggacttgtgaaagccgaggataaagcgcgagtacatagatccaagaagcaggagggccctggccctgaagatgcacgcaaaaaagtccccgctgcccctatcacagtgagcaaggaagcaccggctcctgttgctcatccagcacccggtggccctgaagaacagtggcagcgcgctatccacgagcggggagaagctgtctgcccaacctgcaatgttgttaccaggaaaactctggtgggcctgaagaagcatatggaggtatgccagaaactccaggatgctctcaaatgtcagcactgccggaagcagtttaaatccaaggcaggcctgaactaccacaccatggctgagcattcggccaagccaagtgacgccgaagcctctgaggggggtgaacaagaagagcgtgaaaggctgcgcaaagtgctgaagcaaatgggccgtttgcgttgtccacaggaaggctgcggggcagcgttttcatcattgatggggtaccagtaccaccaaaggagatgcggaaaacccccatgtgaagtggacagtccaagctttccatgcacgcattgcggcaagacatatcggagtaaggcagggcatgattatcacgtccggtctgaacacaccgcccctccccctgaagaaccaactgataagtctcccgaagcagaggacccccttggtgtcgagagaaccccctcaggacgtgtccgtcgcactagcgcccaagtggcggtcttccatctgcaggaaattgcagaagatgagttggcaagggactggactaaaaggaggatgaaggacgatctcgtgccagagactgccaggttgaactacactcgaccaggactgcccactctaaacccacagcttctcgaagcttggaagaatgaggtgaaggaaaaaggccacgttaattgccctaatgattgttgtgaagctatatattccagcgtgagtgggcttaaggcacacctggcctcctgtagcaaaggggcacatctggcaggcaaatatcgttgcttgctgtgccctaaagaattttcatcagagtccggggttaaataccacatcctcaagacccatgccgaaaactggttcaggaccagcgccgatcccccacctaagcacagatcccaggatagcctcgtcccgaaaaaggagaaaaaaaagaatttggctggcggaaaaaaacggggacgcaagccaaaggagcgcacgcctgaggaacctgtagcaaaactgccacccagacgcgatgactggcctccgggatgcagggataagggcgctcggggtagcactggacgcaaggtcggggtctcaaaggcccctgaaaaatag

SEQ ID NO: 217332 - DNA, 2343 bp, Artificial Sequence
  Description of Artificial Sequence: Synthetic coding sequence
atggatcagaattcagtgcccgaaaaagctcagaatgaagctgataccaacaatgccgacaggtttttccgcagccattctagtcccccacaccatcgccctggtcattctagggctctccatcactatgaattgcatcaccatggagtcccacatcaacggggtgagtcccaccatcctcccgagtttcaagacttccacgatcaggccctcagtagtcacgtgcatcagtcccaccatcactcagaagcgagaaaccacggtcgggctcatgggccaactgggttcggactggccccatcgcagggtgctgttcccagccaccgctcctacggcgaggactaccacgatgaactgcaaagggacggcagacgccaccatgatgggtcccagtacggaggattccaccaacaaagtgattctcactaccaccgtgggagccatcacgggagacctcagtaccttggagagaacctctcccactactcttctggcgtgccacatcatggggaagcctcccatcatgggggatcgtatttgccacatggcccaaatccatactccgagagtttccaccactcggaggccagccacttgtctggtctacagcatgacgagtcccaacaccatcaggtccctcatcggggttggccacaccatcatcaggtccaccaccacggaagatccagacatcacgaggcccaccaacacggcaagtcaccccaccacggcgaaacaatctccccacattcttccgtgggatcttaccagagaggaatctctgattaccatagcgagtatcatcagggagatcaccaccctagcgagtaccaccacggtgaccacccccaccacactcaacatcattaccatcagacacacaggcatagggattatcaccagcaccaggatcatcatggggcttaccacagtagctatctgcacggtgactacgtccagtcaacaagtcaactaagtatacctcatactagtcgatccctcatacatgatgcgcctggacccgctgcatccaggacaggagtgtttccctaccacgtggctcacccacggggaagcgcccacagtatgacgaggtcatcgtccacaattcggagtagggtgacacagatgtccaagaaggtgcacacccaggacatcagcacaaagcattcagaggactggggcaaggaagagggccagttccagaaaaggaagaccgggagactgcaaagaacccggaagaaaggccactcaacaaatcttttccagtggttgtgggagaagttgacctttctcatccagggcttcagggagatgattaggaatctcactcagagcctggcctttgagaccttcattttctttgtcgtctgcctaaacaccgtaatgctagtggctcaaaccttcgcggaggttgagatccggggtgaatggtacttcatggcccttgattcgatattcttctgcatctacgttgtggaggctttgttgaagattatcgccctcgggctgtcctattttttcgatttttggaataatctggacttcttcattatggccatggccgtactcgatttcttactcatgcagacacatagttttgccatttatcaccagtcactctttcgtattcttaaggtttttaaatcccttcgggctcttcgcgctatacgcgtgctgcgacgcctgtccttcctgacgagcgtgcaagaagtcacaggcaccctgggacagagtttgccgagtatagcagccattctaatcctgatgttcacatgcctgttcctatttagtgccgtcctacgtgctttatttcggaaaagcgatcccaagcggttccagaatatcttcaccacaatttttaccctgttcaccctgctcaccctcgacgactggagcctcatctatatggatagccgtgctcagggagcctggtacatcattcctattctagtgatttatattattatccaatattttatattcctgaacttggtcatcacagtactggtggactctttccagacggcactcttcaaagggctggagaaagcaaaacaagagcgtgccgctagaatacaggagaaactgttggaagactccttaacagaacttcgagcagccgagcccaaagaggtcgcttccgaaggtaccatgttaaaaaggttaatcgagaaaaagtttggtacaatgacagagaagcaacaggaactgcttttccattaccttcaactggtcgcctccgttgaacaagaacagcaaaagttcagatctcaggctgccgtaattgatgagattgtggatacaactttcgaggccggtgaggaagacttcagaaactag

SEQ ID NO: 217333 - DNA, 1197 bp, Artificial Sequence
  Description of Artificial Sequence: Synthetic coding sequence
atgtcgcagcatcgccatcagcgccactctcgggtcatcagctccagccctgttgacacaacttcggtaggattctgccctacttttaagaagtttaagaggaatgacgatgagtgtcgggctttcgtgaagcgggtcattatgagcagattcttcaaaatcataatgatctccacggtgactagcaacgctttttttatggcgctgtggacatcttatgacatccgctacagactgttcaggctgcttgaattttcggagattttctttgtgtcaatttgtaccagtgaactttccatgaaggtgtacgtagacccaattaattactggaaaaatgggtacaatcttctggatgtgatcattatcattgtgatgttcctgccatatgctttgaggcaactcatgggtaagcaatttacttacctctatatcgcggatggaatgcaaagcctgaggatccttaaacttattgggtattctcagggaatcagaacccttatcacagcggtgggtcagactgtatacacagtcgcatctgtcctgctactgctgtttctgttaatgtacatctttgcgatcttgggcttttgcttattcggttcaccagacaacggcgatcacgacaactggggtaatttagctgctgctttttttaccctgttctcactagcaactgtcgacggatggactgatctgcagaagcaactggacaaccgcgagttcgcactctcccgagctttcacaatcatcttcattctcctggcctcttttatctttctgaatatgttcgtcggcgttatgattatgcacactgaggactcgattaggaagtttgaacgggagctgatgctggagcagcaggagatgctgatgggagaaaagcaggtgatcctgcagaggcagcaggaagagatctctcgtctcatgcatatccagaagaacgccgactgtaccagctttagtgaactggttgagaatttcaagaagacgctctctcatacagaccctatggtgttagacgacttcggcaccagtctgccatttattgacatctatttttcaaccctggattatcaggatactacagttcataagttgcaagaactgtactatgaaattgtacacgtgctctccctcatgctggaagacttaccccaggagaagcctcagagtctcgagaaggtcgacgagaagtag

SEQ ID NO: 217334 - DNA, 1419 bp, Artificial Sequence
  Description of Artificial Sequence: Synthetic coding sequence
atgcgggataatgagaaagcatggtggcaacagtggactagccatacggggctggaaggctggggagggacacaggaggacaggatggggttcggaggggctgtagcagctcttcgaggtagaccctcacccctccagtctactattcacgagtcgtacggccgtcctgaggagcaggtgctgatcaacaggcaggagatcacaaataaagctgatgcttgggacatgcaggagtttatcacccatatgtacattaagcaattactgcgccaccctgcctttcagctcctgctggccctcctgctggttatcaacgctatcactatcgcgctgcggacaaattcttaccttgaccaaaaacactatgaactgttttctacaattgacgacatcgtccttaccatcctgttgtgtgaagtcctcttaggctggctgaacggcttctggatcttctggaaggatggttggaatatactgaattttattatcgtattcatcctactgcttcggtttttcattaacgagatcaatataccctcaattaactacacattaagggcactgaggctcgtgcatgtatgcatggctgtggagcctctggctcggattattcgcgtcattctccaatctgtgcccgatatggctaatatcatggtcctaatattattttttatgctggttttttccgttttcggtgtaaccctcttcggggcatttgttcccaagcacttccaaaacatacaggtggccctctatactctttttatttgtatcactcaagacggttgggtggacatctacagcgatttccagaccgaaaagagagagtacgccatggagatcgggggagccatctactttaccatttttattacaattggggcttttattgggataaacctgtttgtaattgtggtgacaactaacctagaacagatgatgaaggccggagagcaagggcagcagcagcgcatcacattctcggaaaccggcgctgaggaggaggaagaaaacgaccagcttcccctagtgcactgcgtcgtggcaagaagcgagaagagcggccttttgcaggaaccactagccggaggccctttatctaacttaagcgagaacacttgcgacaacttttgcttagtattagaggccatacaggagaatctgcgtcagtacaaggaaatcagagatgaattaaatatgattgtggaggaggtacgagcaattcgtttcaatcaagagcaagagtcggaagtgctgaaccgacgatctagtacatccggaagcctggaaacgactagctcaaaagacattagacagatgagtcagcagcaggacctgctgtctgcactggtttctatggaaaaggtacacgatagttcatctcagatacttctgaaaaaacacaagagcagccactag

SEQ ID NO: 217335 - DNA, 3351 bp, Artificial Sequence
  Description of Artificial Sequence: Synthetic coding sequence
atggagtctcccctgatctacgtttcagttttgcttctcaatatctttgaattcagttctggcattgtttacaataaagatgacacagaaaagcgattcgcttgcagcaataaggggtttcctcaggaaaatgaaatcattaagctatacctgtttcttgaaaacctaaagattcagtgctttttccagactgaaaacgagattgctagcaaggccatgttatccgtgttcacgtcagggggactggccccttctctaggaatcatgaattccacctataatggcatctttcactttaatctgaccctgttctccgaccgtatactttggttagtcgacattccccgtgagaacatcacacagtccacggacatcgccgcagttgaggagtggttagtgcggattacgctgcaccatggccttaacatctacgccactgagggcacgctgctggatgtaattcgcgagccgatactccagtggaccccaggggatgtcatccctgaaagcgagatctccaagctatacccccatgtggttgatctgaaggtcacaaagtgcccttgcgctaatgacgtcgcgcttctcggtttcattgtggatacaatagttgatggcgtctacattggcattacattcggaggcttttggcatgactatgacacaacctggttcaacatgacacagaccatttatagccagttgcaggaagagtacgaggatctttctctcgtggacatggtgcttaccaatcactttctagtcattctgaccagtcttgggttgttcgtatctgaagacctacggtacccctcccgacacagtctctccttttccagggcagacttttgcggcttcgagagggtcgattacgtaaagggcaaattgtggtacaacgagcgctgctttgctaacagagagcactttgaagtggactacgtgactgtgacttttgagcgtaatagaactctttccgagagcagctcttgcttttactcgcaggaaccttttcttgagtgggttccctgcctaccccacatcttcaaaggaatcaagatttttccaacagtcctaaccttcctggtggaccaggagcggggtactggcgtatacctattttacaataaagttcggaagacagccatcgcgtcagtttcaactttgagaaataacgagccaaattcacagtctaagtttccaatctttagatttccgagttccttttcctcaccagttggcatggtgttccaccctagatctcattttctctacgcgtatggtaatcaaatttggctttcggtcgatggcggtaataccttccaactgatagctaatttccacgacgacataattaagaagaccttccactccttttatacatccgccatcaccttcgtctcgcagagaggaaaggtttattctactaaggctgggatggggagatattcagcagtggggtccgtcactgagaggatcttcacgttgtactatgatcatcttgggttcttgcacaaactgaccctggggagattcgaggccagtgggcctcctaccgcctttggaaactctcgtaatctttttggacagcctcctgacatggggttcgaaaccgccttagcccctcagcatacctccctagatgaaatcattttttttgcttacgttccggaaaatgaaccacaggagacaatatattctaaaaaattcggtaacatccactacgggaaggttatccattccggaaagacaggaagagcctatataaggaaggttttgcagcacactactcccaaggggttcctgtcctcggtaatcgctgagatgaaggagccattcggcctggaagaagtgaacgaaagcagttgtctcagctcctctctgctcatcaacaaggctgggaacgtctacaaattgaccctcgatagccaagtggttcaggccctgtttgaagacactgatattgagaaaaccgtcgttctcccgggttactctagctttttgattacctccatactagataataagaatgcactggcaatcgcaaccatgcctgaaagcgcccctaataatatgaccttcttaaaaagtacttggttcttatacaatttcggccagagaaatggccgaacgtggaagatatattcaaagccatgtaactactggttccaacacgatgacagtccgagcttgaatatcgtgaaatacattgacctgggcaattcatatgttctgaaggcaaaggttatcaggaatgcaaagggctttcggatgctggaaattccgcttctcacagtgttcgtaggaaatcccaacctgttggaagtcaccgcagaggttacctttgacgacactgatagctacgtgattactatctcggccgctagcaaagtccttcaccagggctccacgtctttggctttcatcatgtggtctgcttcaacagagtgcttcgtaactaccatggtaccgactcttaaaagtagttgcagctacctgaggtctatgcatcatattcccagcaagtttatacccttcgaagactggatatcgggagtccataaggactcccagggctttaacttaatcaagaccttaccgatcaactaccgtccaccctcgaacatgggcatcgcaataccacttacagataacttttatcacgccgacccttccaaaccaatccccaggaacatgtttcacatgtcgaagaaaactggcaagttcaaacaatgtgctaatgtttctaccagggaggaatgcaactgtactaaggatcagaagttctctcatgcagtggcattctctgattgcagggaaaaggttccacgttttaaatttccaataacccaataccctgttagtctagagatcatcaatgaggacggacgcgttcctctgcagtcaccttatctggtgactgtgacggaggtgaacatgagacataactggaaacttaagcacaccgtgccagagaacattaagcgcatgaaacagcttgttgagccaattctgggggctgccgtgtacaacccctccgggctgaacctgtctatcaaaggttctgagctctttcactttagggtcactgtgatctccggcgtcaccttctgtaatttaatcgaagagttccaaatttacgtggacgaggcacccctccccttccctggccatacccttatcgcggtagccacagcagtggtactcgggggtctgatctttattgcatttatgttccagctgcagggcattcacccatggcgaacattccagaggtggattaggcggaaccaagaaaagttctcctcaataagtctgtccgaacttatccaccggagcaagtcagaggagtag

SEQ ID NO: 217336 - DNA, 225 bp, Artificial Sequence
  Description of Artificial Sequence: Synthetic coding sequence
atggagtcacccttgatctacgtgagcgtgctgttactgaatatcttcgagttttccagcggtattgtgtataataaagatgacaccgagaagagatttgcctgcagcaacaaggggtttccccaggaaaatgaaattattaagctgtacttatttcttgagaaccttaaaatccagtgcttcttccagaccgagaacgaaatcgcttctaaggccatgttatag

SEQ ID NO: 217337 - DNA, 303 bp, Artificial Sequence
  Description of Artificial Sequence: Synthetic coding sequence
atggagagcccattgatctatgttagtgtgctgctgctgaatatttttgagttctccagtggcattgtgtacaataaagatgacaccgagaagcgctttgcatgctcaaataaggggtttccacaggaaaacgagattatcaagctgtacttgtttctggagaacctgaaaattcagtgtttcttccagacggagaatgaaattgcctcaaaggcaatgctatcagtgtttacgtcgggtgggctcgctcctagcctgggcatcatgaacagtacttataacggcatcttccatttcaattag

SEQ ID NO: 217338 - DNA, 225 bp, Artificial Sequence
  Description of Artificial Sequence: Synthetic coding sequence
atggagtcccccttgatatacgtgagcgtcctgctcctcaatatttttgagttcagctcaggaatcgtctataacaaagacgatacagagaaacggttcgcgtgctccaataaaggctttcctcaggagaatgaaatcataaaactttatctgtttcttgagaacctgaagatacagtgcttcttccagacggagaacgagattgccagtaaggccatgttgtag

SEQ ID NO: 217339 - DNA, 795 bp, Artificial Sequence
  Description of Artificial Sequence: Synthetic coding sequence
atgcataaccctgacggaagcgccagcccaacagcggacccagggtctgagcttcagacactgggacaagcagccaggaggccccctcctccccgtgctggacacgatgcccctcgacgtactcggccatcagcgagaaaacctttatcctgtttttcccgaagacctatgcctacccgcgagccccctaagacgcgtggcagccggggacacctgcacacacacccccctggacccggacccccactccagggactagcccctcgaggtctaaagaccagcgcaccacgccctccctgtcagccccagcctggcccacataaggccaagaccaagaagatcgttttcgaagacgagctcctgtcacaggcgctgctgggagcgaaaaaacccatcggcgctatcccaaagggacacaagccacggcctcacccagttccagactacgaattgaagtatcccccagtcagcagtgaaagagaacggtctcgctacgtcgccgtttttcaagatcagtatggcgagttcttggagctgcagcatgaggtagggtgcgcccaggcaaagcttcgacagctggaagcactgttgtcatcactgcccccaccgcaatcccagaaggaggcacaagtggctgcacgcgtttggagagaattcgaaatgaaaaggatggaccccggatttctcgacaagcaggccagatgtcattatctcaagggtaagctccgccacctgaagacgcaaatccaaaaattcgatgatcagggggactccgagggttcggtgtacttttag

SEQ ID NO: 217340 - DNA, 3480 bp, Artificial Sequence
  Description of Artificial Sequence: Synthetic coding sequence
atgtgtggccctgcaatgttcccagctgggccaccttggcccagagtccgcgttgtgcaagttctctgggcactcctggccgtgctgctggctagttggagactttgggctatcaaagacttccaggagtgtacatggcaggtagtgctaaacgagtttaaacgggtgggcgagagtggcgtgtcagacagcttcttcgagcaagagccggtggacacagtgagctccctgtttcacatgctggttgactcacccatcgatccatcagaaaaataccttggattcccttactatctgaaaataaattactcctgtgaagaaaagccctctgaggacctggtccgcatgggccacttgaccgggctcaaaccattggtgctcgtgacctttcagtctccagtgaacttctatcgctggaaaatcgagcaactgcaaattcagatggaagctgcacctttccggagtaaggaaccttgtatggcagaggaagtctgcagcatgtcctggtatacacccatgcccatcaaaaaaggctcagttgtgatgcgggtggatatttcttctaatggtctgggcacttttattccggataaaaggtttcagatgaatatcaatggcttccttaagcgggatcgcgacaataatatccagtttaccgtcggggaagagctttttaaccttatgcctcagtatttcgtgggcgtttcctcccggcctctgtggcacaccgtcgaccagagcccggtcttaattctgggcggaatccccaacgagaagtatgtcctcatgacggacacgtcctttaaggacttttctttagtggaactttctatcgactcctgttgggtcggcagtttctattgtccccattccgggttcaccgcaaccatctacgatactatagctaccgagagcactttgtttataaggcagaatcagctggtgtactactttaccgggacttacaccacattatatgagcgaaatagaggctccgggtcctggatccgcgtgttagctagcgagtgtatcaaaaagttgtgcccagtgtactttcattcaaatgggtctgaatatatcatggcactgacaaccggaaaacacgaaggttatgtgcacttcggaacaatccgagatgggcaagttagttttgagatgttacccaggcagtggagcgtatgcgagcagatcggggtgacaacgtgttctatcatctggtcggagtatatagccggagagtataccttattgcttcttgtggagagcggctatgggaacgcctccaaacgctttcaggtggtgagctataataccgctagtgacgacctggagctcttgtaccacataccggagtttattccagaagcacgagggttagagttccttatgatcttaggcaccgagtcttatactagcaccgctatggctcccaagggcatcttctgcaatccatacaacaacttaatctttatttggggcaactttttgctgcagagctcaaacaaagagaattttatatacctggctgatttcccaaaagagctgtcaatcaagtacatggcaaggagttttcggggagccgttgctatagttactgagactgaggaaatttggtacctgctggagggatcttaccgggtctaccagctgtttccgagcaaaggctggcaggtgcatatttcactgaaactcatgcagcagagttctttgtatgcatcaaatgaaaccatgctcaccctgttttacgaggactccaagctctaccagctcgtatatcttatgaacaaccagaaaggacagctagtcaaaagactggtgcccgttgagcaattgcttatgtatcaacagcacacgtcccattacgatctagaacgcaagggagggtaccttatgctgtcttttatcgatttctgcccctttagtgtcatgagactacggtccttgccatcaccacagaggtatactagacaagaaaggtaccgggcaaggcctccgcgtgtgcttgagcggtcggggtttcacaatgagaatagtctggcaatttaccagggtcttgtgtactacctgctttggctgcacagtgtgtacgacaaaccttacgcagaccccgtgcacgaccctacctggcggtggtgggccaacaataaacaggaccaagactattacttcttccttgcgagtaactggagaagcgccggaggggtctccattgagatggactcatacgagaaaatatacaatcttgagagcgcctatgagctacctgaaagaatattcctggacaaaggcaccgaatactccttcgcaatttttctgtccgctcagggtcatagcttccggacacagtctgagctaggcactgcttttcagttgcacagtcaggtggacgtcggggttgtgctggccgacccagggtgtattgaggcctccgtgaagcaggaggttctgataaatagaaattctgtgctgttttcaattactctaaaagacaagaagctctgctatgaccagggaatttccggacatcaccttatggaaactagcatgacagtgaacgtcgtgggctcctccggactgtgcttccaagagacccatctcggaccgcacatgcagggtaacctcatggttcccgtgttcatcggctgcccacccggaaagagactggccttcgatattacatacacacttgagtactcgcgcctcaagaacaaacactatttcgactgcgtgaacgttaatccggaaatgccctgctttctgttccgcgatatcttctaccccttctttctgatacaggacctggtgactggagatagcggtagtttccagggttcctatgtgctcctggtggtgggcggaggtcccaccctggattccctcaaagactatagcgaggacgagatctatcggttcaacagtcccttggataaaaccaactccctcatttggaccacacgcaccacgcggaccacaaaggattcagccttccacataatgagccacgaatcacctggaattgaatggctgtgtcttgagaatgccccatgctacgacaacgtgccccagggtattttcgcccctgaatttttttttaaggttctggtttccaatcgtggggtggacactagcacctactgtaattatcagctgacttttctccttcatattcacggcttgccattatccccaaagcgagccttgtttataatcatggtgtcagcatccgtcttcgtgggcctggtcattttctacattgcattctgtctactttggcccctcgtggtgaagggctgtaccatgatccggtggaagattaacaacctcatcgcttccgaatcctattatacctatgcttccatttccggaatttcaagcatgccatcactgcgtcattctaggatgggctctatgtttagctcccggatgaccgaagatcgagctgagcccaaagaggccgttgaacgtcaattgatgacgtag

SEQ ID NO: 217341 - DNA, 3480 bp, Artificial Sequence
  Description of Artificial Sequence: Synthetic coding sequence
atgtgtgggcctgctatgtttcccgctgggccaccatggccccgagtgagagtggttcaagtactgtgggcactgcttgcggtcctcttagctagctggcgcctgtgggccatcaaggattttcaagagtgtacttggcaggtggtgctgaatgagtttaagcgcgtcggcgagagtggagttagcgatagtttctttgagcaagagccagtggatacggtgagctctttgttccacatgctggtggattccccaatagatccatctgaaaagtatcttgggtttccgtactacctcaaaatcaactactcctgtgaggagaagcccagtgaggacctagttaggatggggcatctgacaggcttaaagcccctcgtgcttgtgaccttccaaagtccggtgaacttttataggtggaagattgaacagctgcagatccaaatggaggcagctccctttcgtagcaaggagccgtgtatggccgaggaagtttgcagtatgtcctggtatacccccatgccaataaagaaaggctccgtggtgatgagggtggacatttcttcaaatgggctagggacttttattcctgacaaacggttccagatgaacatcaacggattccttaaaagggaccgggataacaatatacagttcacggtgggtgaagagcttttcaacctcatgccccagtacttcgtgggcgtgtcctctcgccctctatggcataccgtggaccagtccccagtgttaatcctgggcggaatcccaaacgagaaatacgtgttaatgacagacacttctttcaaggatttcagcctcgtagaactgtctatagactcatgctgggtgggctctttctattgcccccatagtggcttcactgccacaatctatgataccattgccacggaatccacactgttcatccggcagaatcaactggtctactattttacaggtacgtacaccaccctgtacgaacggaacagaggttctgggtcctggattcgagtccttgcctccgagtgcatcaagaaactctgccctgtctacttccatagcaatgggtccgagtacataatggccttgactacaggaaagcatgagggatacgtccatttcgggacaatcagggacggtcaggtctcttttgaaatgctgccaaggcaatggtccgtgtgcgaacagatcggagtgacgacctgctctatcatttggagtgaatatattgccggagaatacacactgctgcttcttgttgagtcaggatatgggaatgcgtcgaaaagattccaggtggtctcttataacacggccagcgacgaccttgaactcctctaccacatccctgagtttatacctgaggccagaggactcgagtttctgatgatcctgggaaccgaatcttatacgagtactgctatggctcccaagggtattttctgcaacccctataataacctcatttttatctgggggaacttcctgcttcagtctagtaacaaggagaattttatctatctcgcggacttccctaaagaactttccattaagtacatggccagaagttttcgaggcgctgtggcaattgtgacagaaaccgaggagatatggtacctgcttgagggaagttatcgcgtttaccagctattccccagcaagggttggcaggtccacatttcactgaaactgatgcagcagtcatccttgtatgcttccaacgaaacaatgttgacccttttctacgaagacagcaagctgtatcaactggtgtacttgatgaacaatcagaaaggacagttagtgaagaggctggtccctgttgaacaattgctcatgtaccagcagcataccagccactacgacctggagaggaagggcggatatctaatgctttcatttatcgacttctgcccctttagcgtgatgcggctgaggtccctcccatcacctcagagatataccaggcaggaaagataccgagcacgtccacccagggtactggagagaagcgggtttcataatgaaaactcactcgccatttaccagggcctcgtatactatctcctttggctgcattccgtgtatgacaagccctacgcagatccagtccacgatccaacctggaggtggtgggccaacaacaaacaggaccaggattattactttttcctggcatctaactggcgaagtgcagggggagtctctattgagatggacagttatgagaagatctataacctcgagagcgcatacgagttgcccgagcgcatcttcttagataaaggcacagagtacagttttgccatctttctgagtgcgcagggccactctttccggacccagtcagaactgggcaccgccttccaactccattctcaagtggacgtcggcgtggttttggcggacccagggtgtatcgaagcatctgtaaaacaggaggtactgattaacagaaactctgtcttgtttagcataactctcaaagataaaaagttgtgctacgatcaggggataagtggccaccaccttatggagacttcgatgacagtgaatgtcgtgggttctagcggattgtgtttccaggagacacacctcggtccccacatgcagggaaacctgatggttccagtttttatcggatgcccgccaggcaaacgcttggcctttgacataacatatacattggaatattcaagacttaagaacaagcactatttcgattgcgttaatgtgaaccccgagatgccttgtttcctcttccgggatatcttttacccttttttcctgattcaggacctggttacgggggattctgggtctttccagggttcttatgtgttattagttgtcgggggagggcctacccttgacagcctcaaggactattcagaagatgagatctacagattcaattcaccattggacaagactaatagtctgatctggacgactagaactaccaggacgaccaaggattccgcgttccacatcatgtctcacgagagccctggaatcgagtggctgtgcctggaaaacgcaccttgttatgacaatgtgccccagggcatctttgcaccggagttcttcttcaaggttttagtatccaataggggggtggacacttccacgtattgtaattaccagttgacatttttattgcatatccacggccttcctctgtcacccaagcgcgcactgttcataatcatggtgtctgcaagcgtctttgttggactggtgatattctatatcgccttttgtctgctgtggccgctcgttgtaaaggggtgcacaatgatccggtggaagattaataatctcattgcctcagagagctattacacctacgcctcaatttctggcatcagctccatgcccagtctgcgacattctaggatggggagcatgttcagctccaggatgacagaggatagggccgaaccaaaggaagccgtagaaaggcagctgatgacatag

SEQ ID NO: 217342 - DNA, 1983 bp, Artificial Sequence
  Description of Artificial Sequence: Synthetic coding sequence
atggacgtcctcgtaagcgaatgctcagccagactgctacagcaagaagaagaaattaaatctctgaccgctgaaatcgaccgcctcaaaaactgcggttgtcttggggctagtcctaatctagagcaattgcaggaggaaaacctcaaattgaagtacagactgaacatattacgcaagtctctgcaggccgaaagaaataagccaacaaaaaacatgatcaatatcataagcaggctgcaggaggtctttggacacgcaattaaggccgcatatcctgacctcgaaaacccaccgctactggttaccccttctcagcaggccaagttcggggactaccaatgtaattcagctatgggcatctcacaaatgctgaagaccaaggagcagaaagtcaacccgagggaaatcgccgagaacatcacaaagcatctccccgacaacgagtgtatcgagaaggtggagattgcgggtcctgggtttattaacgtgcacctgcgaaaagatttcgtgagcgagcagctgacaagtctgttggtcaacggggtgcagctgccagccttgggagagaacaaaaaggtaattgtcgatttttctagcccaaatatcgccaaagagatgcacgtggggcacctgagatctacgattatcggagaatccatctcaagactctttgaatttgcagggtacgacgtcctgcgcctgaaccatgtcggggattggggcactcaattcggaatgctgatcgcacatttacaggataaatttccagactatctgacggtctcaccaccaataggagatttgcaagtgttttacaaagagagtaagaaaagattcgacacggaggaggaatttaaaaagcgcgcttaccagtgcgtcgtgctgctgcagggaaagaaccccgatattacaaaagcttggaagcttatatgcgatgtgagtaggcaggaattgaacaaaatttacgacgctctggacgtgtctctaatcgaacgcggtgaatctttttatcaggaccggatgaacgatattgttaaggagttcgaggacagaggatttgtccaggtcgacgatggcaggaaaatcgtgttcgtgcccggatgcagcatacccctgacaatcgtgaagtcagatggcggttatacatatgacacatcggacttagccgctatcaagcagaggctttttgaggagaaggccgacatgataatctacgtcgtggacaatggacagtcagttcactttcagactatctttgcagccgctcaaatgatcggctggtacgaccccaaggtgacccgtgtgttccacgccggattcggagttgtcctgggtgaggataagaagaaattcaaaaccagaagcggtgaaaccgtgcggctcatggaccttttgggcgaggggctaaaacgatccatggacaagctgaaggagaaggagagagacaaggtgctgaccgctgaagaactgaatgccgcacagacttccgtggcctatggctgcatcaagtatgcggatctgtctcataaccgactcaatgactacatttttagttttgacaaaatgctagacgaccgcggaaacaccgctgcttatctgctctatgcctttaccaggattagatctattgctcggctagcgaatatcgatgaagaaatgcttcagaaagcagcaagggagaccaaaatcctactggaccacgagaaagagtggaagctgggtagatgtattctcagatttcccgagatcctgcagaagattcttgacgatctgtttctgcatactctctgcgattatatctatgaactcgcaacagcctttactgagttttacgacagctgctactgcgtcgagaaagacagacagaccggcaagatccttaaggtgaatatgtggcgcatgttactgtgtgaagcagtcgccgctgtaatggccaaaggctttgatatcctcgggatcaagcccgtgcagcggatgtag

SEQ ID NO: 217343 - DNA, 465 bp, Artificial Sequence
  Description of Artificial Sequence: Synthetic coding sequence
atgtgctggactcgcattcggccaggtacaccgtctagccccggtgctcagcggccaactccctacgagtggatgcgtaggtccgtagcagctggaggcggaggtggcagcggcaaaacccggaccaaggacaaatacagagtggtatacaccgaccaccagcgcctggaactcgagaaagaatttcactattccaggtacattacgattcggaggaagtcggagctggcggctaacctgggcttgacggaacgacaggtgaagatttggttccagaatagacgggctaaagagcggaaggtgaataagaaaaagcagcaacaacagcagccccctcagccaccaatggctcacgatatcacagccacgcccgcaggacccagcttgggaggtctgtgtcccagtaatacgtccctgttagccaccagctctccaatgcccgtgaaggaagaattcctgccatag

SEQ ID NO: 217344 - DNA, 183 bp, Artificial Sequence
  Description of Artificial Sequence: Synthetic coding sequence
atgaggggaggtcctcgcggacaccacgtctgtgggctgtgtgccggacaaggctttgctcgggtaccgagaccctctcaggcctcgcagcctcggcctggaccagcatctctttgcccaagcaatacaagcttgctagccactagcagccccatgcctgttaaggaagagtttttaccttag

SEQ ID NO: 217345 - DNA, 942 bp, Artificial Sequence
  Description of Artificial Sequence: Synthetic coding sequence
atgtacgttagctacctgttggacaaagacgtctccatgtacccatcctctgttcgtcactcagggggtctgaatctcgccccacagaattttgtgtcaccccctcaatatcccgattatggtggctaccacgtggccgctgctgccgcagcggcagctaatctggactctgcgcaatcacccggtccttcttggccggctgcttacggagcccctcttagagaagactggaacggctacgcacccggaggcgcagctgcagccgctaatgcagtcgcccatggattgaacggcggttcgccggcagctgcgatgggctattcgagccccgctgattatcatccacatcaccatccacaccatcatccccaccaccccgcagctgcaccttcttgcgcaagtgggttattacagacactgaaccctggcccacccggaccagccgctaccgctgcagcagaacagctgagccctggagggcagcgccgtaacctctgtgagtggatgaggaaaccagcccagcaaagtctcggaagccaggtgaaaactaggacgaaagacaagtaccgcgtggtatacactgatcaccagcggcttgagctggaaaaggaattccactattcacgttatataaccatcaggaggaaggctgaactcgctgcaacactcggcctgtcggaaagacaggttaagatctggttccagaatcgacgggctaaggagcgcaaaattaacaaaaagaagctccagcagcagcagcagcaacagccaccgcagcctcctccaccacctcctcagcctcctcagccccagccgggaccgctacggtcagtacctgaacctctttctccagtgagcagcctgcaggcatcagtaccagggtctgtgccgggtgtgcttggccctacaggaggagtcctgaaccctaccgtgacacagtag

SEQ ID NO: 217346 - DNA, 855 bp, Artificial Sequence
  Description of Artificial Sequence: Synthetic coding sequence
atgtatggctcttgtctgctcgaaaaggaggcgggaatgtaccccggtactctcatgagccccggaggagacggaacagccggaaccggtggcaccggcggtggcggaagcccaatgcctgcgtctaactttgcggctgcccctgctttctcccactacatgggatatccacatatgccctccatggatccacattggccatcccttggtgtctgggggtccccctactccccaccacgagaagactggtccgtgtacccgggaccttcttcaacaatgggaacagtacctgtgaatgatgtcaccagtagcccagcagccttctgttccactgactattccaatcttggtccagtaggcggagggaccagtggaagttctctaccaggccaggccggaggtagcctggtgcctaccgacgccggagcggcaaaagcttcatccccttcaagatctagacattctccctatgcctggatgcgaaagacagtccaggtgacgggaaaaacacgaacaaaggaaaagtacagggtggtttacaccgaccatcaacgccttgaactagagaaagaattccactgcaatcggtatatcaccatccagaggaaatccgaactggcagtcaatctggggctgtcggaaaggcaggtgaaaatctggtttcagaatagacgagctaaagaaagaaagatgataaagaagaagatttcacagtttgaaaactctgggggttcggttcagtcagacagcgacagtatttcgccaggggagctacctaacacattcttcaccaccccgtctgctgtcagggggttccagcccattgagatccagcaagtaatcgtatcagagtag

SEQ ID NO: 217347 - DNA, 456 bp, Artificial Sequence
  Description of Artificial Sequence: Synthetic coding sequence
atgatggctgaagagcacacagacctggaggcccagatcgttaaggatattcactgtaaggaaatagatttagtgaatagggacccaaaaaacattaatgaagacatcgtgaaagtggacttcgaagacgtcatagcggaacctgtgggtacctacagttttgacggtgtttggaaagtgagctacacgacattcacagtctcaaagtactggtgttacaggcttctctccactctcttgggcgtgccgctggccctcctgtggggattcctattcgcctgtatctccttttgtcacatatgggccgttgtgccttgtatcaagtcatatttgattgaaatccaatgtatctcacatatctactctctgtgtatcagaacgttctgtaaccctctctttgctgctttaggacaagtctgctcatctatcaaagtggtcctaagaaaagaggtgtag

SEQ ID NO: 217348 - DNA, 456 bp, Artificial Sequence
  Description of Artificial Sequence: Synthetic coding sequence
atgatggcggaagaacatactgatctggaggctcagattgtcaaggatatccattgtaaggaaatcgaccttgtcaatagagatcccaaaaatattaacgaggatattgtgaaggtcgacttcgaagatgtgatcgctgaacctgtcgggacatattccttcgacggtgtttggaaggtttcctataccacattcacagtgtcgaaatattggtgctatcgcctcttgagcacactacttggagtgcctctcgcactcctgtggggattcctgtttgcttgcatttccttctgccacatttgggcagttgtcccttgcatcaaatcgtacctgatcgagattcagtgtatcagtcatatttatagcctctgcatcaggacattctgtaatccactgttcgccgcactggggcaggtatgctcttctatcaaagtcgtcctgcggaaggaggtgtag

SEQ ID NO: 217349 - DNA, 813 bp, Artificial Sequence
  Description of Artificial Sequence: Synthetic coding sequence
atggctgaccacatgatggcaatgaatcacggtcgttttcccgacgggactaacgggctgcatcatcatcccgctcataggatgggaatgggacaattcccaagtccacatcaccaccagcagcagcagccacagcacgccttcaacgctcttatgggcgagcacatacactatggtgccggaaatatgaatgctacctctggcattaggcatgccatggggcctggtacggtgaatgggggtcatcctcctagcgcgttggctcctgctgcaagattcaacaacagccagtttatgggccctccggtagcctcccaagggggatcactccccgcttccatgcaactgcagaagctcaataatcagtactttaaccaccacccctatccacataaccattatatgccagatctacatcccgcagccggtcaccagatgaacgggaccaatcagcactttagggactgtaatccgaagcactcgggaggtagtagtactccagggggatcagggggaagctctacccctggcggttcgggtagttctagcggaggtggagcagggtcctccaattccggcggagggtctggctctgggaacatgcccgctagcgtggctcatgttcctgccgctatgctcccgccaaacgtgatcgacactgatttcattgacgaagaggtccttatgagcctggtgatagaaatggggctggaccgaattaaggaacttccggaactctggttggggcaaaatgagtttgacttcatgaccgatttcgtatgtaagcagcagccctcccgggtgtcttgttag

SEQ ID NO: 217350 - DNA, 645 bp, Artificial Sequence
  Description of Artificial Sequence: Synthetic coding sequence
atggcggaccatatgatggcgatgaaccacggccgattcccagatggtactaacggcctgcatcatcacccagcccacaggatgggtatgggacaattcccgtctccacaccaccaccagcaacagcaacctcagcacgctttcaatgccctcatgggggaacatatacactatggcgcaggtaatatgaatgccacttctggaatcaggcacgcgatgggacctggcactgtgaacgggggacatccaccttccgctctggctcccgctgcccgtttcaacaattcccaatttatgggccctccggtcgcttcgcagggcggatcgcttcctgcaagcatgcaattacagaagctgaataaccaatattttaatcaccacccttacccccataaccactatatgccggatctgcacccggctgcaggtcatcagatgaatggtactaaccaacatttccgagactgtaaccctccaaacgtcatcgacacggatttcattgatgaagaggtgcttatgtctcttgtgatagaaatgggcctagacagaataaaagagctgccagaactgtggttaggccagaacgagtttgacttcatgactgatttcgtatgcaaacagcagccaagtagagttagttgctag

SEQ ID NO: 217351 - DNA, 813 bp, Artificial Sequence
  Description of Artificial Sequence: Synthetic coding sequence
atggctgaccacatgatggccatgaaccacgggagatttccagacggaactaatgggctgcaccatcacccagcccatcgcatggggatggggcaattccccagtccgcatcatcaccagcaacagcagcctcagcacgcattcaacgcactaatgggcgagcacattcattacggtgccggtaatatgaacgctacctctggcatacgccatgctatgggacctggtacggtcaatggaggacatcctccttctgccttagcccctgcagccagattcaataatagccagttcatgggccctcccgtggcctcccagggaggctctctgcctgcgtccatgcagctgcagaaactcaacaaccagtatttcaaccaccacccctaccctcataaccattacatgcccgatctgcaccctgcagccggtcaccagatgaacggcacaaatcagcacttccgggactgtaatccaaagcatagtgggggatcttccaccccgggtggatctggaggctcttcaactcctgggggatctgggagttcatcaggaggaggagctgggtcttccaactcgggaggtggcagcgggagcggtaatatgcccgcatcagtagcccatgtgccggcagcgatgctccctccaaatgtgatcgataccgattttatcgatgaagaagtgctcatgtccttagtgatcgagatgggcttggataggatcaaggaattgccggagctgtggctgggccaaaacgaatttgattttatgaccgacttcgtttgcaaacaacagcctagccgggtgagctgttag

SEQ ID NO: 217352 - DNA, 813 bp, Artificial Sequence
  Description of Artificial Sequence: Synthetic coding sequence
atggccgaccatatgatggctatgaaccacggccgattcccggacggcaccaacggcctgcaccatcaccctgcccaccgcatggggatggggcaattcccgtctccccaccaccaccagcagcagcagccccagcacgcatttaatgcactgatgggcgagcacatccattatggcgcaggaaacatgaacgctacttccggcatccgccatgcaatgggcccaggcacagtgaacggtggacaccccccatccgctctagcacccgctgccaggttcaataattcacagttcatggggccacctgtggcaagccagggagggtcccttcctgcaagtatgcagcttcagaagctgaataatcagtacttcaaccaccatccgtacccacataatcactacatgccggacttacaccctgccgctggccaccaaatgaatgggactaaccagcattttagggactgcaaccccaaacacagtggagggtctagcacccccggaggttccggtggcagctcgactcccggagggtctggctcatccagtggcggaggtgccggatcctctaatagtgggggtggctcgggctccggtaacatgcctgcgagcgtagcccatgtgccagccgctatgctgcccccaaacgtaattgataccgattttattgatgaagaagtgctgatgtcccttgttatcgaaatggggctggacagaataaaggaattaccagagttatggctcgggcagaacgaattcgactttatgactgactttgtgtgcaagcaacagccaagcagagtgtcttgctag

SEQ ID NO: 217353 - DNA, 1797 bp, Artificial Sequence
  Description of Artificial Sequence: Synthetic coding sequence
atggagaatagttctgcagccagcgcttcctctgaagcagggtcctcacggtctcaggagatcgaggagctagagagattcatagacagctacgtgctcgaataccaggttcaaggtttattggcggacaagactgaaggagatggcgaatcggagcggacccagagccacattagccagtggactgcagactgcagcgaacctctggattcatcctgcagcttctcacgcggtcgtgcccctccccaacagaacggatccaaagacaactccctggatatgctgggaaccgatatctgggccgcaaataccttcgactcatttagcggggctacatgggacctccagcctgagaaactggacttcacacaattccaccggaaggtgcgacacacccccaaacagcctctaccccatattgaccgcgagggatgtggcaaaggcaagttggaggacggagacggaataaacctgaatgacatagagaaggttctgcctgcttggcagggctatcatccaatgccccatgaggttgagatagcacataccaagaaattattccgaaggcggcgaaacgaccgtcgccgacagcagcgacccccagggggaaataagccacagcaacacggagatcaccagcctggctctgccaagcataacagagatcaccagaaatcttaccagggaggttcggcccctcatccctctgggagacctacgcaccatggctatagccagaataggcggtggcaccacgggaatatgaagcatcctccaggagataagggcgaggccggtgcacacagaaacgccaaggagactatgacaatcgagaatccaaagctggaggacaccgcaggagataccgggcacagttcactggaggctcctaggagccccgacaccttggccccagtcgcgtcagagcggctcccacctcaacagtcaggagggccagaggtggagacaaagcgcaaggattcaatactgcctgaaagaattggcgaacggcctaaaatcaccctgctccagtcttctaaagaccggctccgcagaaggctcaaagagaaggacgaagtcgccgtcgagacaactaccccccaacagaacaagatggacaaactcatcgaaatcctcaacagcatgcgcaataatagttctgacgtggatactaagctcaccacttttatggaagaagcgcaaaattcaacgaactccgaggaaatgttgggagaaatcgttcgtacaatttatcagaaggcggtaagcgatcggtcttttgctttcacagccgcaaagctgtgtgacaaaatggctctgttcatggtggaaggcactaaatttcgcagcctcctgctgaatatgctgcaaaaggacttcacagtgagggaggagctgcagcagcaagatgttgagcgttggcttgggttcatcacctttctgtgtgaagtattcggaacaatgagaagtagtaccggcgagccatttagggtactggtttgtccaatttatacatgtctgcgcgagttattacagtctcaggatgtgaaggaggacgctgtcctgtgctgttctatggaacttcagagtaccggaaggctgcttgaggaacagctcccagaaatgatgaccgaactattggcgagtgcaagagataaaatgctttgtcctagcgaatccatgcttactcgctccctgctgcttgaagtaattgagctccacgctaattcttggaaccctctcactccccctatcacccagtattacaatagaaccatccagaaactaacagcctag

SEQ ID NO: 217354 - DNA, 1803 bp, Artificial Sequence
  Description of Artificial Sequence: Synthetic coding sequence
atggaaaattcgtccgccgctagtgcttcatctgaagccggttcttctcgctcacaggagatcgaggagttggagcgcttcatcgatagctacgtactggaatatcaagtgcagggccttctggccgataagaccgaaggagacggcgagtctgagcggactcagtcccacatctctcagtggaccgcagactgttccgaaccactggattcctcttgctccttctctagaggacgcgctccaccacaacagaatggatccaaggataactcactcgacatgctcggtactgacatatgggccgctaacacttttgactctttcagcggggctacctgggatctgcaaccagagaaactcgactttacacagtttcacaggaaagttcgacacacccctaagcagcctctgcctcacatcgacagggaaggatgtgggaagggaaagctggaggatggcgatgggatcaatctaaacgatatcgagaaagttctgccggcttggcaggggtatcaccctatgccacatgaagtcgaaatcgcacatactaaaaagttgtttaggcgaaggcggaacgataggaggcgacaacaacgaccaccgggaggcaataagccccagcagcacggagatcatcaacctgggtcagcaaaacacaacagagaccatcagaagagttaccaaggaggtagcgccccacaccctagcggacggccaacacaccatggttatagccagaacaggagatggcaccatgggaacatgaaacacccgcctggtgataagggcgaagccggtgcccaccggaatgctaaagagacaatgaccatagaaaaccccaagctggaagacaccgctggggacacagggcactcgtccctggaagcccctcgtagtcctgacacattggcgccagtagcaagtgagcggcttcctccccagcagagcggcggacctgaggtggagacaaaacgcaaggactccatcttgcccgaacggataggcgagcgcccaaaaataactcttctccagtcgtcaaaggacagactccgtcgcagactcaaggagaaagtgccagatgaagtcgcagtcgaaactacaactcctcagcagaataagatggacaaactgatcgagattctgaacagcatgcggaacaactcctctgacgtggacacaaagctcaccacattcatggaggaagcccagaattctaccaacagcgaagaaatgcttggagagatagtccggacaatttatcagaaagccgtttcggatagaagctttgctttcactgcagcgaagctatgtgacaagatggccctgttcatggtggaagggacaaagtttaggtccttgcttttaaacatgctacagaaggatttcaccgtaagggaagagctacagcagcaggatgttgagcggtggctggggtttataacatttctgtgcgaagtgttcgggacaatgcgctcttctaccggcgaaccctttcgggtgctcgtgtgtccaatttatacctgccttagagaattactgcaatctcaggacgtgaaagaggacgcagtgttgtgttgttcgatggagcttcagtcaaccggccgtctactggaagaacagttacctgagatgatgaccgaattgctggcctctgccagagacaagatgctgtgtcctagtgaatccatgcttacgcgctccctgttgcttgaggtcatcgagctgcatgctaactcctggaacccgctgactccaccgataactcagtattacaaccgcactatccagaaattaaccgcctag

SEQ ID NO: 217355 - DNA, 1947 bp, Artificial Sequence
  Description of Artificial Sequence: Synthetic coding sequence
atgggcaggctgccctgtgggccactgcctggacagtggacggcagattgcagtgagcctcttgattcctcatgcagctttagtaggggacgggctcctcctcagcagaacggttcgaaggacaatagcctcgatatgctggggaccgacatctgggctgcaaatactttcgatagcttcagcggcgctacctgggacttgcaaccagagaaactggatttcactcaattccaccggaaagtgagacatacacctaagcagccactaccccacatcgaccgagagggatgcggcaagggaaagctggaggacggagatggaattaacctcaacgatatcgagaaagttctgcccgcttggcaggggtaccatccaatgccacatgaagttgaaattgcacacactaagaagttgtttcggagaagacgaaacgaccgacggcgacaacaaaggccccctggcggaaataaaccccagcagcatggcgaccaccaaccaggctcagcgaaacataatagggaccaccagaagagctatcaggggggttcagcccctcacccctcaggacgtcccacccaccacggatacagtcagaataggcggtggcatcatggcaacatgaagcacccacccggagacaagggggaagccggagcccatcgaaatgccaaagagaccatgactattgagaaccccaagctggaggatactgccggtgatacgggtcacagctctcttgaagccccacggagtcctgatacactggcaccggtggcttccgagaggctgccacctcagcagtccggtggccctgaggtggagactaagagaaaagatagtattctgcccgaacggatcggagagcggccaaaaatcacgctgctccagagttccaaagatcgactccgccgacgcctaaaggagaaggatgaggtagcggtcgagacaacgacaccacagcaaaacaagatggataaattgatcgagattcttaactctatgcgtaataattcctccgacgtggacaccaagctcactacctttatggaggaagcacagaacagtacgaactctgaagagatgctcggagagatcgtgcggaccatctaccaaaaggcggttagcgataggagcttcgcctttactgcagcaaaactttgcgataaaatggcccttttcatggttgaagggactaaatttcgtagcttactcctgaatatgcttcagaaggattttacggtccgagaggaactccaacagcaggacgtagagcgatggctcggcttcattacatttttatgcgaggtctttgggaccatgcggtctagtaccggtgagcccttccgcgttctcgtgtgtcccatctacacgtgcctccgcgaactactccaatctcaggatgttaaagaggacgcagtgctgtgctgctctatggagctgcagagcacaggcagacttctggaagagcagctgcctgagatgatgacggagcttttggcaagcgccagagacaagatgctctgtccgtcagagagcatgcttaccagatctcttcttctcgaggttattgagctccacgcaaatagttggaatcagggagcatggcaggccgctcacggccagctgggtccttggtgcactggcccagacggccaggcaggtggacaaggctggccttggcgggagaaagaaatgggcagaagggccggtcgcgtgggcggacagtctggcgctagagcctgtaaactgacacccatccgtgaggcgtgtttctttttcctggtagctctggccctccccttcctaaccccagcctctccgctaccaatccgtccaatcccacacggggcattatgtgaaggaagccacagatgcgacagttcggaaactttggccgcttcccatgccggtgccccactaggtagcgagcgaacttctgaaggctag

SEQ ID NO: 217356 - DNA, 1077 bp, Artificial Sequence
  Description of Artificial Sequence: Synthetic coding sequence
atggaatccgccgatttttacgaagccgaaccccgtccaccaatgtcaagtcatttgcagtctccacctcacgcaccatcatccgcagccttcggatttccacggggtgcagggcctgctcagcctcctgccccacctgccgcacctgaacccttgggaggaatatgtgagcatgaaacaagcatcgacataagtgcatacattgacccggcagcctttaatgacgagttcctggctgatctctttcagcatagtcgacaacaggaaaaggctaaggccgctgtgggtccaaccggtgggggaggcggtggcgactttgactaccctggagcgccagccggacccggaggagccgtgatgccgggaggcgctcacggtccaccccctggttatggatgcgccgcagctggctacttagacggaaggctggagcccctttacgagcgggtgggcgctccagccctccgccctctcgtcatcaaacaagagccaagagaggaagacgaggctaagcagctggccctcgccggactatttccctatcagccaccccctccgccaccccctagccatccccatcctcatcctccgcctgcgcacctcgccgctccgcatctgcagtttcaaattgcccattgtggccagactaccatgcatctgcagccaggccatcccaccccccctccaactcctgtgccgagtcctcacccagcccctgcactgggggctgcgggactcccgggaccaggctcagccctgaaaggactcggggctgctcacccagacctcagagcatctgggggtagtggtgccggaaaggcgaagaaatctgtggacaagaacagcaacgaatacagggtccggagggagagaaacaatattgccgtaaggaaaagcagggacaaagctaaacagaggaacgtcgaaacacaacaaaaagtgcttgaactgacatccgacaacgaccgcctgagaaagagagttgagcaactttccagagagttggacacattgaggggaatctttcgacaacttcccgagtcttccctggtgaaggccatgggcaactgtgcctag

SEQ ID NO: 217357 - DNA, 810 bp, Artificial Sequence
  Description of Artificial Sequence: Synthetic coding sequence
atgtctgcagccctcttcagcctcgacggccctgcgagaggcgcaccttggccagccgagccagcgccattctatgagccagggcgagctggtaagcccggtcgtggagccgagccaggagccctgggcgagcctggagcagcagccccagccatgtatgacgatgaaagcgcgatagatttttcagcttatatagatagtatggccgcagtgcctaccctcgagctttgccatgacgaattgtttgccgatttgtttaacagtaaccataaagcagggggtgcgggtcccctggagctattgccaggaggccctgcacggccattggggcctggacccgcagcgccacggctgctgaaacgcgaaccggattggggcgacggagatgctcctgggtctttgctgcctgcccaagtcgcagcctgtgcccagacggtagtgtccctggcagccgcagggcaaccaaccccacccaccagcccagaaccccctcgctcgtcccctcgacaaacaccagcccctgggcctgcacgcgaaaagtctgccggaaagaggggcccagatcggggatcgcctgagtataggcagcgaagggaacggaacaacattgcagtcagaaaatcccgggataaagctaagcgccgtaatcaggaaatgcaacagaaactggtggaactgtcagctgaaaacgagaaacttcaccagagagtggagcaattaactagggacctggcaggacttaggcaattttttaagcagctgccttctcctccatttttaccagctgccggaacagccgactgtcggtag

SEQ ID NO: 217358 - DNA, 402 bp, Artificial Sequence
  Description of Artificial Sequence: Synthetic coding sequence
atgtctgcagctcttttttccctcgacggaccagccaggggagccccttggcctgctgaacccgctccattttatgagccagggagggctggcaaacctggcagaggagcagagcccggagctctgggagagcccggagctgccgcaccggctatgtacgatgacgagtctgctatcgacttctccgcttacattgacagcatggcagcagtcccaacactggaattatgtcatgacgagctctttgcagacctgtttaactcaaaccacaaggccagagctccttgggcccgtgcccttccactaccagcgtgctcaagcgcaagcccaacaggagccactgccacccgcccagccaggtgttgccccaggcgctggccgagggcgcacagaccatggtag

SEQ ID NO: 217359 - DNA, 1092 bp, Artificial Sequence
  Description of Artificial Sequence: Synthetic coding sequence
atggccagtggcgacttttgtagccctggagagggcatggaaatccttcagcaagtgtgttcaaaacaactcccgccttgtaatctttccaaagaagacctgctgcagaacccatactttagcaagttattgttaaatctatctcagcacgtggacgaatctggcctatccctgacactggcgaaggagcaggctcaggcctggaaagaggtacggctccataagactacttggttgcgctcagaaatccttcaccgcgtgattcaggaactgctggttgattattatgttaaaattcaagatacgaatgtcacctctgaagacaagaagttccatgagactcttgaacagcgcctgctggttaccgagttgatgagacttctgggcccatcgcaagagcgggaaatacctcctctgctcggtctggagaaagcagacctgcttgagctgatgcctttgagcgaagatttcgtgtggatgcgcgcacgtctgcagcaggaagtcgaggagcagctgaaaaaaaagtgctttaccctcctctgctattatgaccccaactcagacgccgactccgagaccgttaaggcggctaaggtatggaagctggccgaggtgctggtcggcgagcagcagcagtgccaggatgctaagtctcagcagaaggaacagatgctattattagagaagaagtctgcggcatactcacaagttttgcttagatgcttaacacttctccagagactgctgcaggagcaccgccttaagacccagtctgaactggatagaatcaacgcacagtacttggaggttaaatgtggtgcaatgatcctcaagcttaggatggaagagcttaaaatcctgagcgatacctatacggttgagaaagtcgaagtccatcgcttgatacgggaccgtcttgaaggcgctattcacttgcaggagcaggacatggagaatagcagacaggttcttaatagctacgaagtgctgggcgaagaattcgacagattagttaaagagtacactgtgctaaagcaggccaccgagaataaaagatgggctcttcaggagttctccaaagtgtatcgctag

SEQ ID NO: 217360 - DNA, 1359 bp, Artificial Sequence
  Description of Artificial Sequence: Synthetic coding sequence
atgggctcatcgcagtccgttgaaatacccggagggggaactgaaggttaccatgtccttcgggtgcaggaaaattcccctgggcatagagccggattagaacccttttttgatttcattgttagcattaacggcagccgcctgaataaagacaacgatacacttaaggacctgctgaaggccaacgtggagaaaccagtgaagatgctcatctatagcagcaagacgttagagctccgtgagaccagcgtcaccccttctaatctgtggggagggcaggggctgctaggagtgtctatccggttttgcagcttcgacggggctaacgaaaatgtatggcacgtgctagaggtggagtctaacagcccagcggctctcgcaggcctgcgtccccatagcgattatattatcggcgcagatacggtgatgaacgagtctgaggacctgttttccctgatcgagactcacgaagctaagcctctgaagctgtatgtgtacaatacagacaccgacaattgtcgcgaagttattattacccctaatagcgcctggggcggtgagggaagcctcggctgtggcataggctacgggtaccttcacaggatccctactcggccatttgaagagggcaaaaaaattagcttgcctgggcagatggccggaacaccgataactcccctcaaggacggattcaccgaggttcagctctcctccgtgaatcccccatccctgtcgccccctgggacaacaggcattgaacagagcctgaccgggttatcaatttccagtaccccaccggctgtctcttccgtcctcagcactggagttccaacagtccccttgcttccacctcaagtcaaccagtcactcaccagtgttccaccgatgaacccggctaccactctcccaggccttatgcctttacctgctggcctaccaaacctgccgaacctgaacctgaacctacccgcaccacatataatgcccggagtcggactgcccgagctggtgaacccgggactcccacccctccccagcatgcctcctagaaatcttccaggcatcgcacctctgccactgcctagcgagtttctcccttcttttcccctggttcccgaatccagctccgcagcatcaagcggagaattattgtcctcgctgcctccaacatcaaatgcccctagcgaccctgcaaccaccacagccaaggccgacgccgcaagttcccttaccgtggatgtcacccccccaacagccaaggcccctaccacagttgaggatcgggtgggagactcaactccagtgagtgagaaaccggtaagcgcagctgtggatgctaatgcgtctgagtccccctag

SEQ ID NO: 217361 - DNA, 2997 bp, Artificial Sequence
  Description of Artificial Sequence: Synthetic coding sequence
atggccgctgttaaggagcccttggaatttcacgcaaaaaggccttggagacctgaggaagctgtcgaagacccagacgaagaggacgaggacaacaccagcgaagcagaaaacggctttagcctggaagaagtactccggctcggcggaactaagcaggattatctcatgttggccactcttgatgagaacgaggaagtgattgacgggggaaaaaaaggtgctatagacgatctgcagcagggcgaactcgaggcttttattcagaatctcaacctagctaaatacactaaagctagcctcgtggaagaagatgagccagctgagaaagagaactcgagcaaaaaggaagttaaaattcccaaaattaacaataaaaataccgcagagtctcaaagaaccagcgttaataaggtgaagaataagaaccgcccagagccccactccgacgaaaatggctctaccacacctaaggtgaagaaagataagcagaacatctttgagttcttcgaacgtcagaccctcctcttaaggcccggtggcaagtggtatgatctggagtattcaaatgaatactcccttaagccacagccgcaggatgtcgtatccaagtacaaaaccctggctcaaaagctttatcaacacgagatcaacctgtttaagagtaaaacgaacagtcagaaaggcgcatcctcgacctggatgaaagcaatcgtctcttcaggaacactgggagataggatggctgctatgattctccttatccaggacgacgcggtgcacactctacagtttgttgaaacattggtgaatctcgtcaaaaaaaaaggcagcaaacagcagtgccttatggcccttgacacctttaaggagctgctcattactgatctcctgcccgacaatcggaagctgagaattttctctcaaaggcctttcgataaacttgagcagctgtcatccgggaataaggactcacgtgaccgccgactgattctgtggtatttcgaacatcagcttaaacacctcgtggccgaatttgtgcaggtcctggagactctgtcccacgatactctagtgactacaaaaacccgcgctctgaccgtggcgcatgaactcctgtgcaacaagcccgaagaggaaaaggcacttctggttcaggttgtgaacaagctcggcgatccccaaaatagaatagcaactaaagccagccaccttctagaaaccctgttgtgtaaacatcctaacatgaagggcgtcgtcagcggagaggtggaacggctgttattcaggtcgaatatctcatccaaggctcagtattacgccatctgctttctaaaccaaatggcactgtctcacgaggagtctgaactggctaataagctgataacggtgtacttttgttttttcagaacatgtgtgaagaagaaggatgtggaaagtaaaatgttgagcgctctcttaaccggcgtgaacagagcctacccctactcccaaacaggcgatgataaggtgagagaacagatcgataccctgtttaaggtgctgcacatcgtcaactttaatacatccgtccaagcgctcatgctcttatttcaggtgatgaactcgcagcagactatttccgaccggtactatacagccctttacagaaagatgctggatcctgggcttatgacctgctccaagcaggctatgtttctcaacttggtgtacaagtctctgaaagctgatatagtattgcgcagggtgaaagcctttgtaaaaaggctccttcaggttacatgccagcagatgcccccttttatttgcggggcactttatctggtcagcgaaattcttaaggctaaacctgggctgaggtctcagctggacgaccaccctgagtcagacgatgaggaaaactttatcgatgccaatgacgatgaggatatggagaaattcacggatgcggacaaggaaactgaaatcgtgaagaaattggagaccgaggaaaccgttccagaaacggacgtagaaactaaaaagccagaggtcgcctcttgggttcacttcgataacctcaaaggtgggaagcagctgaacaagtacgaccctttctctcgaaatcccttgttctgcggagctgaaaacacatctttgtgggaattgaagaagctaagtgtgcatttccatccttctgtcgctttgttcgcaaaaaccattttgcagggcaattatatccagtacagtggggatcctttgcaggatttcacacttatgagattcctcgacaggtttgtgtaccgtaacccaaagccacataagggcaaagaaaataccgattccgtggttatgcagcccaagagaaagcactttattaaggacatccgacatctgcccgtaaacagcaaggagtttcttgcgaaagaggaaagccagattcccgttgacgaagtgttttttcatcgttactacaagaaagttgcagtgaaagagaaacagaagcgggatgcagatgaggaatccattgaggacgttgacgatgaggaattcgaggagcttatcgacacatttgaggacgataactgcttttcaagtggaaaagacgatatggattttgcgggtaacgtgaaaaaacgaacaaagggagcgaaggataacactctggacgaagattcagagggaagtgatgatgaacttggcaacctggacgatgatgaagttagcttaggatcaatggacgatgaggaatttgctgaagtcgatgaggatggcggaacttttatggatgtgctggatgatgaatcagaaagcgtccctgagcttgaagtgcacagtaaggtttccacaaaaaagagcaagcgaaaaggcactgacgacttcgatttcgccggatcgttccagggcccacgcaagaagaaaaggaacttgaacgactcttccctgtttgtgagtgcagaggagttcggtcacttattagacgagaacatggggtctaaatttgacaacattgcctag

SEQ ID NO: 217362 - DNA, 1992 bp, Artificial Sequence
  Description of Artificial Sequence: Synthetic coding sequence
atggctgccactgagatatccgtgttgtccgagcaatttacgaagatcaaagagctcgagctgatgccggaaaaaggcctcaaagaagaggagaaggatggcgtttgccgcgagaaagatcatagatccccatccgagctggaggcggagagaacgtccggggcatttcaggattcggttctggaggaggaagttgaactggtcctggccccaagcgaggaatctgagaaatatatcctgactctacagactgtacattttacaagcgaggccgtagagctgcaggacatgtctctcctgtccattcaacagcaggaaggagtgcaggtagttgtgcagcaacctggacctggtcttttgtggctggaagaggggcctcgtcagtcactccagcagtgcgttgccatctccattcagcaagaactctacagccctcaggaaatggaggttctgcagttccacgccctcgaggaaaatgtgatggtggcgtcggaggattccaagctggccgtctccctagctgagacaacaggcctgatcaaactcgaagaggagcaagagaaaaaccagttgcttgctgaacgaaccaaagagcagctgttcttcgtcgaaacaatgtcaggggatgagcgctctgacgaaatagtgctgacggtgagcaattctaacgtggaggagcaagaagatcagcccacggccggacaggctgacgctgaaaaggccaaaagcaccaagaaccagcgcaagactaagggagcgaaaggcacattccattgcgacgtttgtatgtttacctcgtctaggatgagctcctttaaccggcacatgaaaacccataccagcgaaaaaccccatctatgtcacttatgtcttaaaacctttagaaccgtgactctcctccggaaccacgtgaacacacacacaggtacacgcccttataaatgtaacgattgcaacatggcctttgtgaccagtggcgagctggtcagacaccggcgttacaagcacacacatgagaagcccttcaaatgctctatgtgcaagtacgcaagcgttgaggcttccaaactcaagcgccacgttagatctcatacaggggaacggccttttcagtgctgccaatgctcttatgcttctcgcgatacttacaagctgaagaggcacatgcgaacccacagtggtgaaaagccatatgaatgtcatatttgccacacccggtttacccagtctgggaccatgaagattcatatcctacagaaacatggcgagaatgtccccaaataccagtgtcctcattgtgcgactattatcgccagaaagagtgatctgcgcgttcacatgaggaatctacatgcctattcagccgctgagctcaaatgccgctattgctctgccgtatttcacgagcggtacgccctgatccagcaccagaaaacccacaagaacgagaagcgtttcaaatgtaagcactgcagctacgcttgtaagcaggaacgtcatatgacagcccatatcagaacccacacaggcgagaaacccttcacttgcctttcatgcaataagtgctttaggcagaaacagctgttgaacgctcattttcgcaaataccacgacgcaaacttcatccctactgtgtacaaatgctccaagtgtggaaagggtttcagccgctggataaatttgcacaggcactccgagaagtgcgggtccggggaggccaagtccgccgctagcggcaaggggcgaaggaccaggaagaggaagcagacgattctgaaggaagccacgaagggacagaaagaggccgcaaagggctggaaagaggcagccaatggcgacgaggccgcagcggaggaggcttctacaacaaaaggagaacagttcccgggtgaaatgttccccgtggcttgccgcgaaacaacagcgagggttaaggaggaggtcgatgaaggggtaacctgcgagatgctgttgaatacaatggataagtag

SEQ ID NO: 217363 - DNA, 1992 bp, Artificial Sequence
  Description of Artificial Sequence: Synthetic coding sequence
atggctgctactgagattagcgtcctgagcgaacaatttaccaagatcaaggagctcgaattgatgcctgaaaaaggtttgaaggaggaggagaaggacggcgtttgtcgcgagaaagatcacagatcaccatctgagcttgaggccgagagaacttccggggcatttcaagacagtgtgctcgaggaagaagtggaactggtgttggccccttcggaggaaagtgagaaatatattctcaccttgcagaccgtgcactttacctctgaggccgtggagctccaggacatgtctctgctttcaatccagcagcaagagggtgttcaagttgtagtgcagcaaccaggcccaggcttgctgtggctggaggagggtcccaggcagtcactgcagcagtgtgttgccataagcatacagcaagagctgtattccccccaagaaatggaggtgctgcagtttcacgctctggaagagaatgtgatggttgcatccgaagattcgaaactggcagttagcctggccgagaccactggcctaattaaactggaggaggagcaagaaaaaaaccaactgcttgccgagaggaccaaagagcagttgttcttcgtggagacaatgtctggggacgaacgctccgatgagatcgtgttgacagttagcaacagtaacgtggaagaacaggaggaccagccaacagctggccaagcagacgccgagaaagccaagtcaacgaaaaatcagcgtaaaacaaaaggggctaagggcacctttcattgtgatgtttgcatgttcactagttcgcgcatgagcagctttaaccgtcacatgaaaacgcacacctctgagaaaccacacctgtgtcacttatgtctcaaaactttccgcacggtcacactcctgcggaaccacgtgaatactcacaccgggaccagaccatataaatgtaatgactgtaatatggccttcgtgacaagtggcgagttagtgaggcaccggcgatataaacatacccacgaaaaacctttcaagtgtagcatgtgcaagtacgctagcgtggaggcctccaagttgaaaaggcacgtgcggtctcacaccggcgagcggccattccaatgctgtcaatgctcttacgccagcagagacacttataagctgaaaagacacatgcggacacattctggcgaaaaaccctatgagtgccacatttgtcatactcgctttacccaaagcggaaccatgaaaattcatattttgcaaaagcacggagagaatgttcccaagtatcagtgcccccactgcgccactatcatcgccaggaaaagcgacctgagagtccacatgcggaacctccatgcttattccgctgccgaattaaaatgtaggtattgctctgccgtgttccatgagcgctacgccctcatccagcatcaaaagacgcacaaaaatgagaagaggtttaagtgcaaacactgctcatacgcatgcaagcaagagcggcacatgactgcgcatattcggacccatactggtgagaaacccttcacttgcctgtcttgcaacaaatgtttccgacagaagcaattattgaatgcacactttaggaaataccacgatgccaattttatcccaacagtttataaatgttccaaatgcgggaagggcttttcacggtggatcaatctgcacagacactcagagaagtgcggaagtggtgaggcgaagagtgcggcttctggcaaaggtagacgcactagaaaacgcaagcagactatccttaaagaagcaaccaaaggccaaaaggaggctgcaaaagggtggaaagaggcagctaatggagacgaggccgctgccgaggaggcctccactactaagggcgaacaatttccaggtgagatgtttcccgtcgcctgtcgagaaacaactgctcgggtgaaggaagaagtagacgaaggagtgacatgcgaaatgctcctgaatactatggacaagtag

SEQ ID NO: 217364 - DNA, 1284 bp, Artificial Sequence
  Description of Artificial Sequence: Synthetic coding sequence
atggcggctacagagatatcggtcctgtcagagcagttcaccaagattaaggagctcgagctgatgccggagaagggtttgaaagaggaggagaaagacggggtctgtagggagaaagaccaccgcagtccctccgagctagaggcggagcggacttctggagcattccaagactctgtcttggaggaggaagtggaactagtcctggcgccttcagaggaaagtgagaagtacatcctgacactgcagacagtgcacttcacttcagaagctgtggagctgcaggatatgtccctgctctcaattcagcaacaagaaggcgtgcaggttgtggtgcagcagccaggtccaggactactgtggctggaggaagggcctcggcagtccctgcagcagtgtgtggcaataagcattcagcaggagttgtacagccctcaggagatggaagtcctgcagtttcatgccctggaagagaatgtgatggtggcatcagaggacagcaaacttgccgtttccctggctgagacaaccggactcattaagctcgaggaagagcaggagaagaatcagctgttagctgagaggaccaaggagcagctgtttttcgtggagacgatgagtggggacgagagatccgacgagattgtactgaccgtgtcaaacagtaacgtggaagagcaggaagatcagccgacggcagggcaggcagatgcagaaaaggccaaatccaccaaaaatcaaaggaaaaccaagggtgctaagggcacgtttcattgcgatgtgtgcatgtttaccagcagccggatgtctagctttaacagacacatgaagacccacacaagcgaaaagccccacctgtgccatctgtgtctaaaaacattccgcacagtcactctgttgcggaatcacgtgaacactcacaccgggactaggccgtacaagtgtaacgactgtaatatggctttcgtgaccagcggagaactggttcgccatagacggtacaagcacacgcacgagaaaccattcaaatgtagtatgtgcaaatatgcaagcgtggaagcctcaaaacttaagcgtcatgttcgttctcacaccggcgaaaggccattccagtgctgtcagtgctcatacgccagcagggatacgtacaaactaaagcggcacatgcgaacgcattcagaagccacatctaagcgcagcctgcaagaaatccctaggtgcaagtttcatcccgactgtttgcagatgttgcaagtctggcagcgactgttccccttggattag

SEQ ID NO: 217365 - DNA, 1722 bp, Artificial Sequence
  Description of Artificial Sequence: Synthetic coding sequence
atggccgcaaccgagatcagcgtgctaagcgagcagtttactaaaatcaaagaactagaactcatgccagagaaaggcctgaaggaagaggaaaaagacggagtgtgccgagagaaagatcacaggtctccctcagagctggaggccgagcggacttccggcgcatttcaggattcagtgctcgaggaggaggtggagctggtcttagccccttccgaggagagcgaaaaatacatactcacacttcagaccgtacacttcacatcagaagccgtggagttgcaggacatgtctttgctttcaatccagcaacaagaaggtgtccaggtagtcgtgcagcagcctgggcctggcctcttatggctggaagagggacccagacaatccctccaacagtgcgtggctatctcaatacaacaggagttgtattctcctcaggagatggaggttttgcagttccacgccctcgaagaaaatgtcatggtggcttctgaagactcaaagctcgccgtgtctctagctgagaccactggattgataaagttggaggaagagcaggagaaaaaccaattattggctgagcgcacaaaagagcagctctttttcgtcgaaactatgtccggcgatgaacgatcggacgagattgtattgactgtgtccaactccaacgttgaggaacaggaagaccagccgactgccggtcaggccgacgctgagaaggcaaagtcaacgaagaaccagagaaagacgaaaggagccaaagggacattccactgcgacgtgtgcatgtttactagctcccgaatgagtagtttcaaccgccacatgaagacccatacttccgagaaacctcacctctgtcacctatgcctgaagacctttcgcacagtgaccctcctcagaaaccatgttaatactcatactggaacgaggccatacaaatgtaacgattgcaacatggccttcgtaacctcaggcgagttagttcgacataggagatacaagcacactcatgaaaaaccattcaagtgcagtatgtgcaaatatgctagcgtggaagctagcaagctgaagcgccatgttcggagtcacactggtgagcgcccatttcaatgctgtcagtgttcgtatgcgtctcgagacacatacaaacttaagcgacacatgagaacacactcgggcgagaaaccatatgagtgccacatctgtcatacacgctttacacaaagtgggactatgaagatacacattctacagaagcatggagaaaacgtgcctaagtatcaatgcccgcactgcgccaccatcatcgcccgaaaaagtgacctgcgagtacacatgaggaacttgcatgcctacagtgccgctgagctcaaatgtcggtactgttccgccgtattccatgagcgatacgccctgatccagcatcaaaagacccacaaaaacgaaaaacggtttaagtgtaagcactgttcgtacgcttgcaagcaggaacgccatatgacggcacacatcaggacccataccggcgaaaaaccatttacctgtctcagttgtaacaaatgtttccggcagaaacaactgctcaacgctcattttcgcaagtaccatgatgccaattttatccccactgtttataaatgcagcaaatgtggtaaaggcttttctcgctggataacatccaaatggtctggccttaaacctcagacattcattacctag

SEQ ID NO: 217366 - DNA, 2103 bp, Artificial Sequence
  Description of Artificial Sequence: Synthetic coding sequence
atggcagccacagaaatttccgtgctttccgagcaatttaccaaaataaaggagctagagctgatgcctgagaaaggccttaaagaggaggagaaggacggcgtctgcagggaaaaggaccaccgttcccctagcgagctagaagctgaacgtacgtccggcgctttccaagacagcgtcctggaggaggaggtagagctagtgttggcccctagcgaggaatccgagaagtatattctgaccctgcagaccgtacactttacatctgaagccgtggagctgcaagatatgtcattgctttccattcagcagcaggagggcgttcaggtggttgttcagcagcctgggccaggcctgctctggctcgaggaaggcccacgacagtccttgcagcagtgtgttgccatctcaattcagcaggaactgtattctccccaggagatggaggtgctccagttccatgccctggaagagaacgtaatggtcgccagcgaagatagcaaacttgccgtgtccctggctgagaccaccggcttgattaaactagaagaagaacaggagaagaatcagctgctggccgagcgaactaaggagcagctgttttttgtggagacgatgagtggagatgagagatccgatgagattgttctcacggtctccaactctaatgtggaggagcaggaggatcagcctactgcgggtcaggcggatgccgagaaagccaagagcactaagaaccagcggaaaactaagggggcaaaaggtacattccattgcgacgtttgcatgtttacctcttcaagaatgtccagctttaataggcacatgaagactcacacctcagagaaaccccacctgtgccacctgtgcctgaagactttcagaactgtgactctattacggaaccacgttaatacacacacaggtacccggccatacaaatgcaatgactgtaatatggcctttgtgacttccggtgagctggtaaggcatcggagatacaaacatacacacgaaaagccatttaagtgcagcatgtgtaagtacgcatcagtggaggcatcaaagttaaaaagacacgtgcgctctcataccggggagcgcccttttcagtgctgccagtgcagctatgcctcaagagacacatacaagttaaagcggcacatgaggacgcacagcggcgagaagccttacgaatgtcacatttgccatactcgattcacacagtcaggcactatgaagatccacattctgcaaaagcatggcgaaaacgtgcccaagtatcaatgccctcactgcgccactatcattgccagaaagtccgacctgcgggtccacatgaggaatctgcacgcctattccgctgccgaactcaagtgtcggtattgctctgctgtgtttcacgagagatacgctcttattcaacatcagaaaacccataagaatgaaaagcgttttaagtgcaagcactgcagttacgcgtgcaagcaagaaagacacatgacagcccacatacgtacacacacgggggagaagccgttcacatgtctttcttgcaacaaatgtttccggcagaagcagctgttgaacgctcactttcgaaagtatcacgatgccaattttataccaacagtgtataagtgcagcaagtgcgggaagggattcagccgctggattaatttacacagacatagcgaaaaatgcggatcaggggaagcaaaatctgcagcatccggtaaaggaaggcgcactcgcaagcgtaagcagaccatcctcaaggaggccaccaaaggccagaaagaagccgctaaggggtggaaagaggccgctaatggcgacgaggctgctgctgaagaagccagtaccacaaagggggagcagttccccggagaaatgttccctgtcgcatgccgggaaactactgctagagttaaagaggaggtggatgagggagtgacatgtgagatgttgctgaatactatggataattcagccggatgtacaggacgaatgatgcttgtgtctgcgtggttattaggtcgaccccaggagacttacaaccagggcagaagacgcagaggatcacgacgggtgacatggtag

SEQ ID NO: 217367 - DNA, 1356 bp, Artificial Sequence
  Description of Artificial Sequence: Synthetic coding sequence
atggcagcaacagaaatctctgttctgtctgaacaatttaccaaaatcaaagagttagaactgatgcccgagaagggcctaaaagaagaagagaaggatggggtgtgccgtgagaaagatcatcgctctccatcagaattagaggccgagaggacttccggggcttttcaggacagcgtactagaagaagaggtggaattggttctggctccgtctgaagagagtgagaagtatatcctcaccttacagacagtgcacttcacctctgaggcggtcgaactgcaggatatgtccctactcagtatccaacaacaagagggagtccaggtggtggtgcagcagcccggtcctggacttctgtggttggaggagggccctcgccaatcactgcagcaatgcgttgctatttctatccagcaggaactctactcgcctcaggaaatggaggtcctgcagtttcacgcactggaggaaaacgttatggtggcgtcggaggactctaagcttgctgtgagcctcgccgagaccacaggcctaattaaattggaggaagagcaggaaaaaaatcagttacttgcagaaagaaccaaagaacagctgttcttcgtagagacaatgagcggagacgagcgctcagatgagattgttttaacagtctctaattccaacgtcgaggaacaggaggaccagcctaccgcagggcaggcagatgccgaaaaagcaaagtcaactaaaaatcagaggaagacgaagggcgcaaagggtacatttcactgtgacgtttgtatgttcacatcatctcgaatgtcatctttcaaccgacacatgaaaacacacacttcagagaagccccatttatgccacttatgtctgaaaacgtttaggaccgtgactctactgcgcaatcacgttaatacccacaccggcaccagaccatacaaatgcaatgactgcaatatggcgttcgttactagcggtgagctcgtgagacaccggcgatataagcatacccacgaaaagccctttaaatgctccatgtgcaaatatgcctccgttgaggcatctaagcttaaaaggcacgtgcgtagccacaccggcgagcggccttttcaatgctgccagtgttcttacgccagtcgggacacatacaaactgaagaggcacatgagaacacatagcggggaaaaaccatatgaatgtcatatttgccatacaagatttacccagtcgggaactatgaagattcacattctgcagaaacatggggagaatgtgccaaagtaccagtgtccacactgtgccaccatcattgcacgcaagtcagatctgcggttcctaggcctaccatttccctag

SEQ ID NO: 217368 - DNA, 1842 bp, Artificial Sequence
  Description of Artificial Sequence: Synthetic coding sequence
atggcggctactgaaatcagcgtgctttcagagcaatttactaaaatcaaagaactcgaattaatgcctgagaaggggcttaaggaagaggagaaggacggagtttgtagggagaaagaccaccggagtccaagcgagctggaggccgaacgcacctctggagctttccaggacagcgttctggaggaggaggtggagctcgtcctcgcaccatcagaggagtcggagaaatatatcttgaccctgcaaacagtccattttacaagcgaagccgtcgagctgcaagatatgtcgctgctctccattcagcaacaggaaggtgttcaggtcgtggtgcagcaacccggacccggtttgctctggctcgaggagggcccacgtcagagcttgcagcagtgcgtggctatttctatacagcaggaactgtacagtccacaggagatggaagtcttacagtttcacgccctggaagaaaacgtgatggttgcgagtgaggattcaaaactggccgtgtctctggcggaaaccaccggattaataaagttagaagaagagcaggagaagaaccaattactggctgaacgcaccaaggaacaactcttctttgtggagaccatgtcaggagatgagcgctccgacgaaattgtcttgaccgtgtccaattctaatgtcgaggaacaggaggaccagccaactgctggacaggctgacgctgagaaggcgaagagtacgaagaaccagcgtaagacaaaaggagctaaaggcacgttccactgcgacgtttgtatgtttaccagtagtagaatgtctagtttcaacagacacatgaagactcacactagcgagaagccccatctctgccacctttgtctgaagactttcagaacggttaccctgctgcggaaccacgtaaatacacacactggcactcggccatacaagtgtaatgactgcaatatggctttcgtcacgtcaggcgagctggtgaggcaccgtagatataagcacacacacgaaaagccctttaagtgtagcatgtgtaagtacgccagtgtagaggcgtcaaagttaaaaagacatgtgcggagccacactggcgaacggccatttcaatgctgccagtgctcttacgcgagcagggatacctacaagctgaagcgccatatgagaacacattccggcgtccacatgcgcaacctccatgcgtacagcgccgctgagctgaaatgtcggtactgctccgccgtttttcacgagagatatgcattgattcaacatcagaaaacccacaagaatgaaaagagatttaagtgcaagcactgcagttatgcgtgcaaacaagagcgccacatgacggcccatatccgcacacataccggggagaagccctttacttgcctatcatgcaacaagtgctttaggcaaaaacagctcctaaacgcacactttagaaaataccatgacgctaatttcattcctaccgtctacaaatgctcaaaatgtggaaagggcttcagtcggtggatcaacctccatcggcacagtgaaaagtgtggatccggggaggctaagtccgctgccagtgggaaaggacggagaacacggaaaaggaaacagacaatactgaaggaagctactaagggccagaaggaagctgctaagggctggaaagaggccgcaaatggagacgaggcagccgcagaagaggcctctaccacgaaaggggagcaatttcccggagagatgttccctgtagcttgccgggaaaccaccgccagggtgaaagaggaagtcgatgagggggtgacttgcgaaatgctgctgaataccatggataagtag

SEQ ID NO: 217369 - DNA, 1452 bp, Artificial Sequence
  Description of Artificial Sequence: Synthetic coding sequence
atggccgcaacagagattagcgtacttagtgagcaattcactaagatcaaggagctcgagcttatgccagaaaagggtctgaaggaggaggaaaaagatggcgtgtgtagggaaaaagatcacaggtccccaagcgagcttgaagcagagcgcacttccggcgctttccaggacagcgtgttggaggaggaagtagagctcgtgttggcaccaagtgaagaatcagaaaagtacatcctgacccttcaaacggtgcactttacctcagaagccgtggaactacaagacatgagtctactttccatccaacaacaagaaggcgtgcaggtggtggtccagcagcccggtcctggacttctgtggctagaggagggccctaggcagtccctgcaacagtgtgtggccatcagcattcagcaagagctgtactcccctcaggagatggaggtgctacaattccatgctctggaagaaaacgtgatggtggcgtctgaggacagtaagcttgccgtaagtctggctgagacaacaggactgattaaactggaggaggaacaggaaaagaatcaactgcttgccgaaaggaccaaggaacaactatttttcgtggagacaatgtccggggatgaacgctccgacgaaatcgtgctcaccgtgagtaactccaacgtcgaggaacaggaagaccagcctaccgctggtcaggccgatgctgaaaaggccaaatcaacaaagaatcagaggaagacaaagggcgctaaagggacttttcattgtgatgtgtgtatgttcactagttcccgaatgagtagcttcaaccgacacatgaagacccatacctctgaaaaaccccacctttgccacctctgcctgaagactttccggacagtgacccttttaagaaatcacgttaatacgcacactggaacacgcccatataagtgcaatgactgtaacatggcgtttgtaaccagcggcgagttagtgaggcatcggaggtataaacatacgcacgaaaagcccttcaagtgcagcatgtgtaagtatgcatccgtggaggagagacatatgaccgcccacatacgcacccacacgggggagaagccctttacctgtctgtcctgcaacaaatgtttcaggcagaagcagctgctgaacgcccattttcgtaagtaccatgacgctaatttcatcccaaccgtgtacaagtgcagtaaatgtggcaagggcttttctcggtggatcctgtgggtgggcaatagcgaagtcgctgagctggggggaccaggctcgggaccattactgcggctgcagtccgggtgtcctcccggactacaccatccaaaagccggactcggccctgaagatcctctgcctggccagctgcgtcataccactgccggtacgggcttgagctccctgctgcagggcccattgtgtagagcagcctag

SEQ ID NO: 217370 - DNA, 1998 bp, Artificial Sequence
  Description of Artificial Sequence: Synthetic coding sequence
atggctgccaccgaaatttccgttctcagtgaacaattcacgaagattaaggaactggaactgatgccagagaagggactcaaagaggaggagaaggacggtgtatgtagagagaaagaccatcgttcaccctcggaactagaggctgaacgcacctccggcgcatttcaggattcggttctggaggaggaggtcgagctcgtgctagctcccagtgaggagagcgagaaatacatcctgactctgcagacagtccatttcacatctgaggcagtggagctgcaggacatgtcccttctaagcattcagcagcaggagggcgtacaggtcgttgtgcagcagccaggcccagggctgttgtggctggaagagggccctcggcagagcctgcagcaatgcgtcgctatcagcatacagcaggagctgtacagcccccaggagatggaagtcctccagttccacgccctggaggagaatgtcatggtggcttcagaggacagcaagctcgccgtgtccttggccgaaactaccggcctgattaaattagaggaggaacaggaaaagaaccaactgttagcggagcggacaaaagaacagctgttcttcgtcgagaccatgtcaggagatgagcgatctgatgagatcgtcctgaccgtcagcaatagcaacgtggaggagcaggaagaccagcccacggctgggcaagctgacgccgagaaggccaagagcacaaaaaaccagcggaaaaccaaaggggcaaaggggacttttcattgcgacgtgtgtatgttcaccagcagccgcatgtcgtcattcaatcgccacatgaaaacgcatactagtgaaaaaccacatttgtgtcatctgtgcctcaaaacttttaggaccgttactcttctccgcaatcacgtgaatactcacacgggtacaaggccatacaaatgcaatgactgcaacatggccttcgtgacatcaggtgagctcgtgagacatcggagatataagcacacacacgaaaagccatttaaatgctccatgtgtaagtacgcatcagtagaggcctccaaactcaaacgacatgtcagatcccataccggggagcgcccatttcagtgctgtcagtgcagttatgctagtcgagatacatacaaactgaagaggcatatgagaacacatagcggagaaaagccatatgaatgtcacatctgccacactcgcttcacccagtcagggaccatgaaaattcatatccttcaaaagcacggtgagaacgttccaaagtatcagtgtccgcattgcgctaccattatcgcaagaaaatcagatctgagggtgcatatgcgcaacttgcacgcatactcagcagctgaattgaagtgtaggtattgttctgccgtgttccatgagagatacgcccttattcagcaccagaaaacacataaaaacgaaaagagatttaaatgtaaacactgttcttatgcctgcaagcaggaacgccatatgactgcccacataagaactcacaccggcgagaaacctttcacatgtctgtcatgtaacaaatgcttcagacagaagcagctgctgaatgcccacttccgaaaataccatgatgctaacttcatacccactgtttacaaatgctccaaatgtggtaagggcttctctcgatggattaacctccacaggcatagcgaaaaatgcggatctggagaagcgaagagtgcagcttccgggaagggcagacggacaagaaaaaggaagcaaaccattctcaaagaagccacgaaggggcagaaggaggcagctaagggctggaaggaagccgcaaatggagacggagtgatctcagcccatcgcaacctgtgtctattgggctcatcagactcccatgcctcagtgagtggcgcaggaattacagatgcaagacaccacgcgtggttaattgtgctcctgttcctggtggaaatgggtttttaccacgtttcccattcatag

SEQ ID NO: 217371 - DNA, 1212 bp, Artificial Sequence
  Description of Artificial Sequence: Synthetic coding sequence
atgttcaccagcagccgaatgagcagcttcaaccgacatatgaagacacatacgtccgagaaacctcacttgtgccacctctgtctgaaaacttttagaacagtcacgcttctcagaaatcatgtcaacactcatacaggcactcgaccatataaatgtaatgactgcaatatggcctttgtgacaagcggggaactagtccggcaccgacgctacaaacatacccacgaaaagcctttcaaatgctctatgtgtaaatacgcttcagtggaagcctctaaacttaagaggcacgtgcgtagccacacaggggaacgtccattccagtgctgtcaatgttcatacgccagtagagacacatacaagctgaaaagacacatgcggactcattctggagagaagccatacgaatgccacatctgtcatacacgattcacacagtccggtaccatgaagatacatattctgcaaaagcacggagagaatgtgcccaaatatcagtgtccccattgtgctacaatcattgccagaaagtcagacttacgcgtccacatgcggaatctgcatgcttatagtgctgcagaactgaagtgtagatactgctctgccgtgtttcatgagagatatgctctgattcagcaccagaaaactcataagaatgagaagagatttaagtgcaagcattgctcttacgcttgcaagcaggagcggcatatgacagcccacatccgcactcacaccggtgagaagccttttacctgcctgagctgtaacaagtgttttcggcagaaacagctcttaaatgctcattttcgaaagtaccacgacgcgaactttattcctactgtatataaatgcagtaagtgtggaaaaggcttttctaggtggatcaacctgcatcgacattcagagaagtgcggctcaggcgaggccaagtctgctgcttcaggtaaaggcaggcggacccggaagcgtaaacagaccatccttaaggaggcgactaaagggcagaaagaggctgcgaagggctggaaagaggcagcgaatggagacggcgttatttctgctcatcgcaacctctgccttttgggaagcagcgattcccacgcctcagtgagcggagcagggatcaccgacgcacggcatcatgcctggctcatcgtactgttatttctggtggagatgggtttttatcacgtgagccattcttag

SEQ ID NO: 217372 - DNA, 1269 bp, Artificial Sequence
  Description of Artificial Sequence: Synthetic coding sequence
atgtcgggagacgagcgatcagatgagatagtactgactgtctccaatagcaatgtggaagagcaggaagatcagccaaccgctggtcaggctgacgcagaaaaggccaagagcacaaaaaatcaaaggaaaacgaaaggcgctaaggggacttttcactgtgacgtatgtatgttcacgtcctcgcggatgagctcctttaaccgccacatgaaaactcatacctctgaaaaaccccatctgtgtcatctgtgcttaaagacatttaggaccgtgacattgttacggaaccatgtcaacacacatacaggtacacgcccatataagtgtaacgactgcaacatggcttttgtgacaagtggagaactcgtcagacaccggcgttacaagcatacccatgagaagcccttcaaatgtagcatgtgcaaatatgcctcagtcgaggctagtaagctgaaacgacacgtcagaagccatactggcgagcgcccatttcagtgctgccagtgttcttatgcgagcagagacacttacaagcttaaaagacatatgagaactcacagcggggaaaagccgtacgaatgccatatctgtcacacgcggtttacccagtcaggcactatgaagatccacattctccagaaacacggggagaatgtcccaaagtatcagtgcccccactgcgccacgataatcgctcgcaagagcgaccttagagtgcatatgcgaaaccttcatgcctattctgccgctgaattaaagtgtcgctattgtagtgctgtatttcacgaacgttacgctctgatccagcaccaaaaaactcacaagaatgagaaacgctttaaatgtaagcattgttcctacgcctgtaaacaggagcggcatatgacagcacatatccggacccacactggtgaaaagccttttacctgcctcagctgcaacaaatgttttaggcagaagcagctgctgaacgcacacttccgtaagtaccacgacgcgaactttataccaactgtctataagtgtagtaaatgtggcaaaggcttctctcgatggatattatgggtggggaattctgaggtcgccgagctaggagggcctgggagtggaccccttctccgcctacagtctggttgccccccagggctccatcatcccaaggccggtctggggcctgaagatccacttcccggacaattgagacatacaaccgctggtaccggcctttcaagcctcctccagggacctctctgcagggcggcttag

SEQ ID NO: 217373 - DNA, 1296 bp, Artificial Sequence
  Description of Artificial Sequence: Synthetic coding sequence
atgttccattctccacggcgtctctgttctgcactgctgcagcgagacgcacccggacttagacgacttcctgctcctggtctgcggcgtccacttagtcctcctgccgcagtcccaaggcccgctagcccaaggctgttggcagccgcaagcgccgcttctggggctgcgagaagttgttctcgtaccgtttgctccatgggtaccggcacctcacggctgtacagcgcactcgccaagaccttgaacagcagcgcggcaagccagcaccctgagtacctggtctctcccgatcctgaacacctggagcccatcgacccgaaagagctgctggaggagtgccgggctgtactccacacccggccaccgaggtttcaacgagactttgttgaccttaggaccgattgtccctctacccatcctccaataagggtgatgcaatggaacatcctggcacaggccttgggggagggtaaggacaattttgtgcaatgtcccgtggaagccctgaaatgggaggagaggaagtgcttaatcttggaagagatcctggcttaccaaccagacattctgtgcctacaggaagtggatcactattttgacacttttcagcccctgctgagtcgactgggctatcagggcaccttctttccgaagccctggtcaccctgcctggatgtcgaacacaataacggcccagatggctgtgccctgttttttctacagaatcggttcaaattggtgaacagcgccaacatcagactcacagccatgacacttaaaaccaatcaggtggctatcgctcagaccttagaatgtaaggaaagcggtaggcagttttgcatagcagtgacccatctgaaggcacgcactggttgggaacgttttaggtccgcccagggatgcgaccttctacagaacctgcagaatatcacacaaggtgcaaaaatccctttgatcgtatgcggggactttaacgccgagcctactgaggaggtatacaaacatttcgccagttctagcctcaatttgaatagcgcctataagctgctttcggcagacggacaaagcgaacccccttacaccacgtggaagattcgcaccagcggtgagtgcaggcatacactggattatatttggtacagcaagcacgctctgaatgtgcggtcagctctggatcttctaactgaggagcagataggcccaaaccgactgcccagtttcaactatccctcagatcacctgtctctggtgtgcgacttctcatttacggaggagtcagacggtctgagctag

SEQ ID NO: 217374 - DNA, 2133 bp, Artificial Sequence
  Description of Artificial Sequence: Synthetic coding sequence
atgtctcggtcaccagacgcgaaggaggacccagtcgaatgtccactctgcatggagcccctagagatcgatgacatcaacttcttcccctgcacttgcggttatcagatttgcaggttctgttggcaccgtatccgtacagacgagaacgggctgtgccctgcctgcagaaaaccttatccagaggatccggcagtctacaaacctctcagtcaagaagagctccagcggatcaaaaacgaaaaaaagcagaaacagaatgagaggaaacagaagataagtgaaaacagaaagcatctggcaagcgtcagggtcgtgcagaagaatctggtcttcgtggtcggccttagccagagactggctgaccccgaggttctgaaaagacccgaatacttcgggaagttcgggaagatccacaaggtggtcattaataactctacctcatacgctggatcacagggaccaagcgcctcagcatacgtgacctatatccgcagtgaagatgcgctacgggctattcagtgcgtgaacaacgtggtagtggatggtagaacactaaaggcatctttgggcacaactaagtactgctcttattttctaaagaatatgcaatgcccaaagccagattgcatgtacctgcacgagctgggcgatgaagctgcctcttttactaaagaggagatgcaggccggaaaacaccaggaatacgagcaaaaactcctccaggagctttacaagcttaaccccaacttccttcagcttagtacaggaagtgtcgacaaaaataagaacaaggtaactcccctgcaatcgcctatcgataaaccttctgattccctcagcattggcaacggagacaattctcagcagatttccaattcagacacaccgagtcccccacccggtttgtcaaagtctaaccccgtgattcctatcagttcatccaaccacagcgccaggtccccattcgagggcgcagtcacagagtcacagtccctgttctctgacaatttcaggcaccccaaccccatcccctccggtcttccgccatttcccagcagccctcagacctcctccgattggccgacagctccagagccccaatcactgtttacttcggaaacaattccagtgtcatcgtcaacagactggcaggccgcatttggattcgggtcctcaaaacagcctgaggatgatctgggctttgaccctttcgatgtgaccaggaaggcactcgcggatcttattgaaaaggagctgagtgttcaggaccaaccctcactatcccccactagcctccagaatagttcatctcataccaccactgccaaagggcctggcagcggatttttacatcctgccgctgcaaccaatgccaactcactgaattcgacttttagcgtgttgccacagagattccctcagttccagcagcaccgcgcagtttataactcattttctttcccaggtcaggccgctcgttacccttggatggccttcccgcgtaacagtataatgcacttgaaccacactgccaacccaacttccaacagcaattttctcgatcttaatctgccgcctcagcacaatactggtctcgggggtatccctgtggccgataactccagtagtgtggagagtctgaacatgaaggaatggcaggacggtctgcgggcattgctacccaatattaatatcaactttggcggtctacccaacagctcgtcaccctccaacgccaatcattcagccccaacttcaaacaccgcaactaccgattccctgagttgggattccccaggatcgtggactgacccggctatcatcacgggcatcccggcaagcagtgggaactctctcgatagtcttcaggacgataaccctcctcactggcttaaatctctacaggcgcttaccgaaatggacggccctagcgccgcacctagtcagactcaccatagcgccccttttagcacgcaaattcctctgcaccgtgcctcttggaacccctacccccctccaagcaacccaagctcttttcatagcccccctcccggattccaaactgcttttagaccaccttcaaaaacacctactgacttgctccaatcaagcacgttagacaggcactag

SEQ ID NO: 217375 - DNA, 3684 bp, Artificial Sequence
  Description of Artificial Sequence: Synthetic coding sequence
atgactcaaaaagtcgaagagctgaaagaaaccgtgaaggaggagtttatgccttgggtttcacaatatctagtcatgaaacgcgtctccattgagcccaattttcacagcctctacagtaactttctcgatactttaaaaaacccggaattcaacaaaatggtgctgaacgaaacatatcggaacattaaagatctggatgtgaaatcactgctcctcgaagcatatgtgaaaggacaacaagagttgttgtacgtagtgccatttgtggccaaagtgctggaaagcagcatccggtcagtggtatttcgtcctcccaacccatggacaatggctataatgaacgtgctggccgagctccaccaagagcatgatctaaagctgaacctgaagttcgaaattgaggttctatgcaaaaacttggccctggacatcaacgaacttaaacctggaaatcttctgaaagacaaggaccgtctcaagaacttagatgaacaattaagtgcaccaaagaaagacgtgaagcagcctgaagaattaccaccaattacgacgaccacgacttccaccactcctgcgaccaacaccacctgcacggccaccgtgcccccacagccccagtacagctatcatgatataaatgtctatagcctcgcaggccttgcacctcatatcacattgaatccaaccattccgctctttcaagctcaccctcagctgaagcaatgcgttcgacaggcaattgagcgggctgtgcaggaactagtgcaccccgttgtcgaccggtccataaagattgccatgacaacatgcgagcagatcgtccgcaaagatttcgctcttgatagtgaggagtcccgtatgcgaatcgccgctcatcatatgatgcgcaacctgaccgccggtatggctatgattacctgtagggagcccctgctgatgagcatcagcaccaacctgaagaatagctttgcgagtgctctgcgcactgccagcccccagcagagggagatgatggaccaggccgcagctcagcttgctcaagataactgtgaactggcctgctgcttcattcagaaaacggcagtagagaaagctggaccagagatggacaaaagactggccaccgagtttgaactcagaaagcatgccaggcaggagggcaggaggtactgcgatcctgttgttttgacctaccaagcggagcgcatgcccgagcagatacggctgaaggtggggggtgtcgacccaaagcaattggctgtctatgaagaatttgcgcgaaacgtgccgggttttctgcctaccaacgacctatctcagccgactggttttcttgcgcaacctatgaaacaagcatgggccacagacgacgtggcccagatatatgacaagtgcataaccgaactggagcagcacctacatgcaataccacccaccctggccatgaatccccaggcccaggctcttaggtctcttctcgaagtggtggtgttatcaagaaattcccgagacgcaattgcagccctgggcctcctccagaaagccgtggaaggactgcttgacgcaaccagcggggctgatgccgacctgctgctgaggtacagagagtgccacttgctggtgctgaaagctctgcaggatggcagggcttatgggtctccctggtgtaataagcagatcaccagatgtcttatcgaatgccgggacgagtacaagtacaacgtcgaggccgtcgagcttttaattagaaatcatctggttaacatgcagcagtatgacctccaccttgctcagagcatggagaatggattaaactatatggcggtcgctttcgctatgcagctggtcaaaatcttgcttgtcgacgagcggtctgtggcccacgtgaccgaagctgatctgttccacaccatagagactctgatgagaataaatgcccacagtaggggcaatgcccctgagggactcccccagctcatggaggtggtcagatcgaattatgaagccatgatcgaccgtgcccacggagggccaaactttatgatgcactccggtatatctcaagcgagcgagtacgatgatccccctggattacgagaaaaagcagaatacctacttagggagtgggttaatttgtaccattccgctgccgctggaagagattcaacgaaagcattctctgccttcgtcggacagatgcaccagcagggcatactaaaaacagacgacctgatcacgaggttctttcgcttatgtaccgagatgtgcgtggaaataagttatcgtgctcaggccgaacagcagcataaccctgcggcaaaccccaccatgattagggccaaatgttaccacaatctggacgcctttgtgcggctcatagccctgctcgtgaaacatagcggcgaagcaacaaacacggtgacgaagatcaatctgttaaataaggtgctcggaattgtggtcggcgtgcttctgcaggatcatgatgtgaggcaatcagaatttcagcagctgccatatcacaggatctttattatgctgctgctggagctcaatgctccagaacacgtcctggagacaataaacttccagacgttgacggccttctgtaatacattccatatcctgcgccctacgaaggcgccaggattcgtgtatgcatggcttgaactaatcagccaccgcatcttcattgcccgtatgttggcacacacaccgcagcagaaaggctggccaatgtacgcccagctgcttatcgaccttttcaagtatttagccccattcctgcggaatgtagagctcaccaaacctatgcagatcttgtacaaaggaactttgcgggtgttactggtcctcctacatgattttcctgagtttctgtgtgactatcactatggcttctgcgatgtgattcccccaaactgcatccaactgcgcaacttgattctgagcgccttcccccgtaatatgcggcttccggatccattcactccgaaccttaaagtggacatgctatctgaaattaatatcgcccctaggatacttactaactttactggagtgatgccccctcagttcaaaaaggatctggacagctaccttaagactcgatccccagtcaccttcctaagtgatctcagatcgaacctgcaggtgtccaatgagcctggcaatcggtacaatctgcagttgattaacgcactggtgctatacgtgggcacccaagcaatagcgcacattcataataaggggtctacgccatctatgtccaccatcacccattctgcccacatggatatattccagaacctggccgtggatctcgacacagaaggccgatacttatttctcaatgctatcgccaatcagcttcgctatccaaattcccatacccactatttcagctgcacaatgctgtacctgtttgcagaggccaacactgaggccattcaggagcaaataacccgggtgctacttgagcggttaatagtgaataggccccacccttgggggcttctgattacattcatagaactgattaagaacccagcttttaaattctggaaccatgagtttgtgcattgtgcacccgagattgaaaaattgtttcagagcgtggctcaatgttgtatgggccagaaacaggcgcagcaggtcatggaaggaaccggggcaagctag

SEQ ID NO: 217376 - DNA, 7130 bp, Artificial Sequence
  Description of Artificial Sequence: Synthetic coding sequence
atgaacttggattccctatctctggcgctgagtcagatctcatacttagtggataaccttactaaaaagaactatagagccagtcagcaggagattcagcacatcgtcaatcggcatggacctgaggcagatcgccacctactcagatgcctttttagtcacgtggacttttccggagacggcaaatcttccggtaaagattttcatcagacccagttcttaatccaggaatgtgcccttttgattaccaagcccaatttcatttcaacattaagttatgcgatcgacaatcctcttcattatcagaaatctttaaaacctgccccacatctgtttgcacagctgagtaaagtccttaagctgtctaaggtgcaggaagttatctttggactggcactgctcaactccagttcatctgacctccgaggttttgccgcacagttcatcaagcagaaactgccagacctccttaggagctacatagacgcagatgtgtcaggaaatcaggaggggggtttccaagacatcgcgatcgaagtcctgcatctcctactctcacacctgctgttcggtcagaaaggtgcctttggtgtcggacaagagcagatcgacgcttttctgaaaaccctgcgcagagacttcccccaggagagatgtcccgtcgttcttgcccctcttctctacccagagaagcgggacatcttgatggatcgcattctgcccgactccggcggtgtggcaaagaccatgatggaaagctcgttggccgattttatgcaagaggtcggttatggattttgcgcgtcaatagaggaatgtcgaaatatcatagtgcagtttggcgtgcgtgaagtgactgctgcccaggtcgccagggtgctgggtatgatggccaggacacatagcggcctcactgatggtatccccctgcaatctatctccgccccagggtcaggtatctggtccgatggaaaggataagtccgacggtgctcaggctcacacatggaatgtggaggtgctaatcgacgtgctgaaagagttaaacccctctttgaactttaaggaagtaacatatgaattggaccacccaggattccaaatccgggactcaaaaggtctccacaacgtagtttatggcatccagagaggcctcgggatggaggtcttccctgtggatttgatttatagaccatggaaacatgctgaaggtcaattatcattcatacaacatagcctcattaaccccgagatattttgtttcgctgattacccatgccacacagttgctacggacattcttaaagctccaccggaggatgataacagggagatagccacttggaaaagcctggacttgatcgaatcactcttgcgattggccgaggttggtcagtacgagcaagtaaagcaactgttctcatttcccattaagcattgcccggatatgctggtgctggcgctgctgcaaatcaatacgtcctggcataccctgcggcacgaattgatctctactttgatgccaatttttctggggaaccatccaaacagcgcaattatattgcactatgcgtggcacggccagggtcagtcacccagcatccgacagctgattatgcacgccatggcggagtggtacatgcggggagagcaatacgaccaggcaaagctgagtcggatcttggacgtggctcaggacctcaaggctctttcaatgcttttgaatggcactccattcgccttcgtaatcgatctggctgccttggcaagccgcagagagtatcttaaattggataaatggttaacagacaagattcgagagcatggcgaaccatttatccaggcctgtatgacttttctcaagcgtcggtgcccatcaatcctcggagggctcgcacctgagaaggatcagccaaagagtgcccaactgcctccagaaacactcgcaaccatgctcgcatgcttgcaagcatgtgctggttccgtgagccaggaactatccgaaacaatcctgacaatggtggctaactgttccaatgtcatgaataaggcgcgacagccccctcccggtgtgatgccaaaggggaggccccctagcgctagctctctagacgccatatctcctgtgcagattgacccactggccggaatgaccagtttgtctatagggggaagcgcagctcctcacacacagtccatgcagggcttcccacctaacttagggtctgctttctcaaccccacaaagccccgctaaggcttttcctccgctgtcaacaccaaaccagacaactgctttctccggcatcggaggcttgtccagccagctgccagtgggcggacttggtacaggaagtctgacgggtattggcaccggtgcgttgggactgcccgcagtcaataacgaccccttcgtacagagaaaattgggaacatcaggcctgaaccaacctaccttccagcagtcaaaaatgaagccaagcgatctgtcacaggtgtggcctgaggcgaatcagcattttagcaaagagattgacgacgaggccaatagctattttcagaggatatataaccatcctccccacccaacaatgagcgtggacgaggtcctcgagatgctgcagcgctttaaagattcaaccattaaaagggaaagggaagtgttcaattgtatgctgaggaatctgttcgaggagtacaggttctttccacagtaccctgacaaggaactgcatatcaccgcatgcctattcgggggaataatcgagaaaggattggtcacatatatggctctcggccttgcactgcgttacgtcttggaagccctgaggaagccttttgggtctaaaatgtactatttcgggattgctgcactggatcgctttaagaaccgtcttaaagattacccccagtactgccagcacctcgcctccatctctcacttcatgcaatttcctcatcacctgcaggaatacattgaatatggacagcagtccagggatccccctgtgaaaatgcagggatctattaccactccagggtccatcgccttagcccaagcgcaggcacaggcccaggtccccgcaaaagccccactggcgggtcaggtgtccaccatggttacaacctctactactaccaccgtggcgaaaaccgttacggtgaccaggcctacgggggttagtttcaagaaagatgtgcctccatccatcaatacgacaaacatcgatacgcttcttgtggctactgatcagacggagagaatcgttgagccacctgaaaacatacaggagaaaattgccttcatctttaataacctgtcacagtctaacatgactcagaaggtggaggagctcaaagagaccgtcaaagaagagtttatgccctgggtgagtcaatatcttgtgatgaagagagtcagcattgagccgaactttcacagtctgtattcaaatttcttggataccctgaaaaaccccgaattcaacaaaatggtgctgaatgagacctatcgaaatattaaagttttgctcactagtgataaagctgccgcaaacttctcagatcgaagtctgttgaaaaatctgggccactggctcggaatgatcactctcgcaaagaataaaccaattctccacactgacctggatgtgaagagcttgctacttgaggcctacgttaaggggcaacaggagctcctgtacgtggttcccttcgtcgccaaagtgctggaaagctctattcgctcggtggtgttcaggccgcctaacccatggaccatggccatcatgaacgtcctggccgaactccaccaagagcacgacctaaagttgaacctcaagttcgaaatcgaagtactgtgtaaaaacctcgctttggacataaacgagcttaaacctggaaacctgttaaaagacaaggacagactgaagaatctcgatgagcaacttagcgcccctaaaaaggacgtcaagcagcccgaggaacttcccccaatcacgacgaccaccacctcgactactcccgctaccaacaccacttgcactgcaactgtgccacctcagccacagtacagctaccatgatataaatgtgtattctttagccggtctcgccccacatatcaccctgaatcctaccatcccgctgttccaggcgcatccacagttgaaacaatgcgttaggcaagccatcgaaagagccgtgcaagaacttgtacatcctgtggtcgaccgctctatcaaaatcgcgatgacaacctgcgagcagattgtgcgaaaggattttgccctggattctgaggagtcaaggatgcgaattgccgctcaccacatgatgcgcaatttgacagcagggatggccatgattacatgtcgggaacccctgctcatgagtatcagtacaaatcttaagaactcattcgcttccgcgttgcggactgcctcccctcagcagcgcgaaatgatggatcaagccgcagctcagctggcacaggataactgtgagctcgcatgctgcttcattcagaagacagcagtagagaaagcagggccagaaatggacaagcgcctcgctaccgagttcgagctgagaaaacatgccaggcaggagggccgacgctactgtgatcccgtggtgctgacataccaggctgaacgtatgcccgagcaaatccgccttaaggtcggcggtgtggaccctaaacaactagctgtttacgaagagtttgcacggaacgtgcctggatttttaccgaccaacgacctatcgcagcctacaggttttctcgcccagccgatgaagcaggcctgggccaccgatgatgttgcccagatctacgacaaatgcatcaccgagctggagcagcatcttcacgctatcccccctacactagccatgaatccacaggcacaggccttacggagcctccttgaagtggtagtactgagtaggaattcacgcgacgccatcgcggcacttggcctgttgcagaaagccgtggagggcctcctcgacgctacatcaggagcggacgcagacctgctgttgagatatagagagtgccacctcttagtgctcaaagccttgcaagacggtcgtgcctatgggtccccatggtgcaataaacagatcaccagatgcctcatagaatgtagagacgaatacaagtataacgtggaggcagtcgaattgttgatcaggaatcatctcgtcaatatgcagcagtacgaccttcacctggcccagagtatggaaaacgggctcaattatatggcagtcgcttttgcaatgcaactggtgaagatcttacttgtggacgaacggagcgttgcacacgtgacggaggcggacctattccatacaatcgagacactcatgaggatcaacgctcacagccgcggtaacgccccagagggactgccacagctgatggaagtggtgcgctccaattacgaggctatgatcgaccgcgctcacggaggccctaactttatgatgcactcaggcatcagtcaagctagcgaatatgacgatccacccggattacgtgaaaaagctgagtatcttctgcgtgagtgggtcaacctgtatcattcggctgctgcaggccgagactcaacaaaagcattttccgcattcgtcggccagatgcaccagcagggaatcctcaagacagacgacttgattactaggttttttcggctttgcaccgaaatgtgcgtggaaatctcatatcgggcacaagctgaacagcagcacaatcctgcagctaatcctaccatgatacgcgctaagtgctatcataacctggatgcgttcgtgagactgatcgccttgctcgtgaagcattcaggtgaagctaccaataccgtgaccaagataaacctgctgaataaagttcttggaatcgttgtgggtgtgctgctgcaggaccatgacgtaagacagagtgaatttcaacagctcccataccataggattttcatcatgctgttattggaattgaacgctcccgagcatgtgctggaaaccatcaatttccagaccctgacggcattctgcaacactttccacatcctgaggcccaccaaggcccctggatttgtgtatgcctggctcgaacttatctctcaccgtatttttatagcccgaatgttagcccacacccctcagcagaaggggtggcccatgtatgcccaactgctgatagatctgttcaagtatctcgctccgttcctgcgcaacgtggagctcacgaagccgatgcagatactttacaaggggactttacgggtgcttctggttctcctgcacgatttccctgaattcctttgcgattaccattatgggttctgcgacgtgattccccctaattgcatacaactccggaatctgattctcagtgcttttcctcggaatatgagactgcctgatcccttcaccccgaatctgaaagtggatatgctctctgagatcaacatagcccctaggattcttaccaactttacgggcgtaatgcctccacagtttaagaaagacttagactcttacctgaagactagaagtccggtgacgtttctgagcgatctccggagcaatctgcaggtctcaaatgagccgggaaatagatacaacctgcagctgattaacgcactcgttctgtacgttggcacccaggctatagcacacatccataacaagggatccactccaagtatgtcaactatcactcactcagcacatatggacatctttcagaacctggcagtggatctggacactgagggccgatatttgttcttaaacgccattgccaatcagctgcgatatcccaactcgcatacacattatttctcttgcacaatgttgtatctgttcgccgaagctaataccgaagctattcaggaacagattacgcgagttctcctcgaaagactgattgtgaatcgccctcacccttggggccttctgattacttttatcgagcttatcaaaaaccccgcttttaagttctggaatcatgagtttgttcattgcgccccagaaattgagaagctcttccagtctgtggcccaatgttgtatggggcaaaagcaggcccagcaggtgatggaaggcacgggtgcatctta

SEQ ID NO: 217377 - DNA, 6452 bp, Artificial Sequence
  Description of Artificial Sequence: Synthetic coding sequence
atgaatttggactctttgtctctggctctctctcaaatttcctacctggtggacaacctgaccaaaaagaactacagggccagccagcaggagatacaacacatcgtcaacaggcatgggcctgaagccgaccggcatctgttgagatgccttttttctcacgtggacttttcaggggacggtaaaagttccgggaaggacttccaccaaacgcaattcctgatccaggaatgtgccctgctgataacaaaaccaaactttatctctaccctctcttacgcaatcgacaatccactgcattatcagaagtctttgaagcccgctccccacctttttgcccaactgtccaaggttctcaaattatctaaggttcaggaggtgatttttggccttgccctgttgaactccagctcgagcgacctcaggggctttgccgcacagtttattaaacagaaattgccagacctgctccgatcttatatcgatgccgacgtctccggtaaccaggaggggggtttccaagatatagcgatcgaggttctgcacctgctgctgagtcacctgctgttcggccagaaaggtgccttcggcgtgggccaggaacagattgacgctttcctgaaaaccctccggagggatttcccacaggagcgatgtcccgtggttctggctcctctgctctatccggaaaagcgagatattttgatggaccggatcttgccggactctggaggagtcgccaagactatgatggagagttccttagccgattttatgcaagaagtcggttacgggttttgtgcctctatcgaagaatgtcggaatattatcgtgcagttcggtgtaagagaggtaacagcagctcaggtggctcgagttctgggaatgatggccagaacccattctggcttgaccgatggtatcccattacagtctatctccgccccaggtagcggcatctggtctgatggtaaggataagagcgatggggctcaggcccatacctggaacgtcgaggtgcttatcgatgtgttgaaggagctgaatccctctctgaatttcaaggaagttacttacgagctggaccaccccggatttcagattcgcgattccaaggggctgcacaatgtagtgtacggtattcagcgcggactgggtatggaggtctttccagtggatcttatctatcgtccgtggaagcacgccgagggccagctgtcttttattcagcactcgttgatcaaccccgaaatcttttgtttcgctgactatccctgtcacactgtggctacagacatcttgaaggcaccccctgaggacgacaacagggaaattgcgacctggaaaagcctggatctgatcgagtccttgctcagactggccgaagtggggcaatacgagcaagttaagcagctcttttccttccccattaagcactgccctgacatgcttgttcttgctttgctccaaattaacacgtcctggcacaccttacgtcatgaattgatctctactctcatgcctatcttcctcggaaaccacccaaactcagcaatcatcttgcactatgcctggcatgggcaaggacagtcaccttcaataagacaactgataatgcatgccatggccgaatggtatatgcgcggagagcagtatgaccaggctaaattatcaaggattctggacgttgcccaagatttgaaagccctgagcatgcttttgaatgggacaccttttgctttcgtcatcgatttggcagcgctggcctctcggcgagaatacctgaaattggataaatggctgacagacaagattcgagagcacggcgaaccttttatccaggcatgcatgacttttcttaagagaaggtgcccttctatcctgggaggactcgcccctgagaaggatcaacccaaaagcgcacagctgccccctgaaacgctggccacaatgctagcatgcttgcaggcctgtgccggtagcgtcagtcaggaactctcagagactattttgactatggtggccaattgtagcaatgtgatgaacaaggccagacagccacctccaggggtaatgcccaaaggtaggcctcccagcgcctcttcgctggacgcaattagtcctgtgcagattgacccgctcgctggtatgacttctctcagtatcggcggatccgccgcaccccacactcagagcatgcagggctttccgccaaatttgggttcagctttctctaccccccaatcaccagccaaagccttcccccctctatcgacacccaaccagactacagccttcagcgggatcggagggttgtcaagtcaactgcctgtgggcggacttggcacagggtcgttaaccggaattgggacaggggctctaggccttccagctgtaaataacgatccatttgtgcagagaaagctgggaacctccggtctgaaccagcccaccttccagcaaactgacctttcccaggtttggcctgaagcgaatcagcacttctccaaagagatcgatgacgaagccaactcttactttcagcgcatctacaatcatcctccccacccgacgatgtctgttgatgaggttctggaaatgctgcagagattcaaagactccacaatcaaaagggagagagaagtcttcaactgcatgttgagaaacctgtttgaagaatatcgattcttcccccagtacccagataaggaactgcatatcaccgcatgcctgttcggcggtattatcgaaaagggattggtgacgtatatggctctaggcttagccctgaggtatgttttggaagccttgcggaaaccattcggctcgaagatgtattacttcgggatcgccgcactggatcgctttaaaaacagattgaaagactatccgcagtattgtcagcacctggcctctatcagtcatttcatgcagttccctcaccatctgcaggagtacattgaatacggtcagcaaagtcgcgacccccctgtgaagatgcaaggttcaattacaacacctggatccatagccctcgctcaggcccaagcgcaggctcaagtgcccgctaaagctcccctagccggtcaggtaagtacaatggtcaccaccagtaccaccactactgtggccaaaacggtgacggtgacaaggccgacaggggtgtccttcaaaaaagacgtccccccttcaatcaatactacaaatattgacacactcttagtggccactgatcagactgaacggattgttgaacctcccgaaaacatacaggaaaaaatagccttcatcttcaacaatctatcacagagtaatatgacacagaaggttgaggaactgaaggagacagtgaaagaagaattcatgccatgggttagtcagtacctcgttatgaagagagtgtctatcgagcccaatttccactccctttattccaactttctcgacacgttgaaaaaccccgaattcaacaagatggtcttgaatgaaacatatagaaacatcaaagtgctgttgactagtgataaagccgctgctaactttagtgacagatcgctgctcaaaaatcttgggcactggttgggcatgattacactcgccaaaaataaaccgatcctgcatacagacctggacgtcaaatcccttctgctcgaggcctacgtgaaagggcagcaggagctgctttatgtcgtgccctttgttgctaaagtactcgaatcttcgattcgttccgtagtgtttaggcccccaaatccctggaccatggctatcatgaacgtattggctgaattacaccaggagcacgacctgaaattgaacctgaagttcgagatcgaagttctgtgtaaaaaccttgctctggatattaacgaactgaagcctggcaacctgcttaaggacaaggatcgcttgaagaatctcgacgagcagctgagcgcacccaaaaaagatgtgaagcagcccgaggagctgcctccaataaccaccacgactacttctacaaccccagccacgaacacgacctgtaccgccaccgtgcctcctcagccccagtattcctaccatgacatcaatgtttacagcctggcaggtcttgcccctcacattaccctgaaccccaccatcccacttttccaagcacatccacagctgaaacagtgtgtacggcaggccatcgaacgcgctgtgcaggagctggtacaccctgtagtcgacaggtctatcaagattgccatgaccacctgtgagcaaattgtccggaaggacttcgccctagactccgaagagagcagaatgcgtattgccgcacatcacatgatgcgcaaccttaccgctggaatggctatgattacttgcagagagccgctgcttatgagcataagcacaaatctgaagaactcgttcgcttctgccttgaggacagcgtctccacagcagagggagatgatggatcaggctgccgctcaactggctcaagataattgcgagttggcttgttgtttcattcagaaaacagctgtcgaaaaagccggtcctgaaatggacaaacggttagccacggagttcgagctgcgtaagcacgctcggcaagaggggaggcggtattgcgatcctgtagtcctgacttaccaggctgagaggatgcccgaacagatccggctgaaagtgggcggagtggatccaaagcaactagccgtgtatgaggaattcgcgagaaacgtgcctggattcctgcctaccaacgacctgtcacagcccacaggttttcttgcccaaccaatgaagcaggcctgggctacagacgacgttgcccagatctacgataaatgcattaccgagctagagcaacacctgcacgctatcccccctacattagcaatgaatccacaagctcaggccttacgctccctgctggaagtggtagttttgtcccggaactcccgcgatgccattgcagccttgggactgctccagaaggcggtcgagggactattagatgcaacatctggcgctgatgcggatcttctcctgcgctaccgggagtgtcatcttctggtcttgaaggcactgcaggatggcagggcatacggctctccttggtgcaataaacagattacacgctgcctgatcgaatgccgcgatgagtataaatataacgtggaagccgtggaacttttgatacgaaaccatctggtgaacatgcagcagtatgatctccacttagcacagtccatggagaacggcctgaattacatggccgtggcattcgcaatgcagctagttaagattctgctcgtcgatgagaggagcgtggcacatgtcacggaggccgacctctttcatactattgaaacgttaatgagaattaatgcacatagccgcggtaatgcccctgaggggttaccccagcttatggaagtggtgaggagcaactacgaagccatgatcgatagagcccacggaggtcctaactttatgatgcattcgggtatttcccaggccagcgagtatgatgaccctcccggattgcgcgaaaaggcagaatacctgctaagagaatgggtcaatctgtaccactctgctgctgccggaagggacagcacaaaggccttctctgcatttgtggggcagatgcatcaacagggaatccttaaaactgatgatctcattacacgatttttcagactctgcactgaaatgtgcgtcgaaatttcctaccgcgctcaggctgaacaacaacataatcccgctgccaaccccactatgattcgcgctaaatgctaccataaccttgacgctttcgtgaggctcatcgcccttctggtaaagcactcaggcgaggcaactaatacagttaccaaaatcaacctgctcaataaggtccttggtatcgtcgtgggcgtgttgctgcaggatcatgatgtccgccagtccgaattccagcagcttccttaccaccggatctttataatgcttctcttagaactgaacgccccagagcatgtcctagagactatcaactttcagaccttaacagccttttgtaacactttccatatattaagacctacgaaggctcccggttttgtttatgcctggctggagctcatttcccatagaatctttatagctaggatgcttgctcacactccacagcaaaaaggctggcccatgtacgcacaactgctgatcgatcttttcaaatatctggctcctttcctgaggaatgtcgaactgaccaagcctatgcagatcctctataaaggcacccttagggtgctgttggttcttctgcacgacttccctgaattcctctgcgactaccactatggcttttgcgacgtgatcccccctaattgtatccaacttaggaaccttatcctttctgcgttcccacgtaacatgcggctgccagatccattcacgccaaacttgaaagaaatcatgctcta

SEQ ID NO: 217378 - DNA, 3213 bp, Artificial Sequence
  Description of Artificial Sequence: Synthetic coding sequence
atgctgctcaatgggaccccttttgcttttgtaatagacctggcagcgcttgcctctcggagagagtacttaaagctggacaagtggctcaccgataaaatccgcgaacacggcgagccctttatccaagcgtgcatgacctttctcaagagaaggtgccccagcatactgggcggtttggcccctgaaaaggatcagcccaaatcagctcagctgccgccagaaaccctcgcaacaatgctggcctgtctgcaggcttgcgctgggtccgtaagtcaggaactgagcgaaaccatcctcaccatggttgcaaattgtagtaatgttatgaataaggccagacaaccaccgccaggcgtgatgccgaaagggagacctccatccgccagcagcttggatgctattagccccgtccaaatagatcctctggcgggtatgacctccctcagcattggaggaagcgctgcgccacatacacagtctatgcagggttttccccctaatttggggtcagctttctcaaccccccagtctcccgctaaagcttttccacccctgtctacgcctaaccagacaaccgcatttagcggaatagggggactgtcttcacaattgccagtgggaggcctaggcacaggatctctaactggaatcggtacaggagccctcggactcccagccgtaaataacgacccattcgtccagagaaagttggggacgtccggactcaaccaacctacatttcagcagtcaaagatgaagcctagtgatctatcccaagtgtggccggaggccaatcagcacttcagtaaagagatcgacgacgaagccaactcctactttcaacggatttacaaccaccctccgcaccccaccatgtctgtggacgaagtactcgagatgcttcaacggttcaaggattctacaatcaagcgggagagagaggtgtttaattgcatgctgcggaacctgttcgaagaatacagattttttccacagtatcccgacaaggagctccacatcacagcttgcctattcggaggaatcattgaaaaaggcctggtcacttacatggccttaggactggctctgaggtacgtcctagaggcccttagaaaaccttttggcagcaagatgtactattttggcatagctgccttagataggtttaagaacaggctcaaggactatccgcagtactgccagcacctagcatccatttctcacttcatgcagtttccacatcatctgcaggagtatattgagtatggccagcaatcccgagatccaccggttaagatgcagggctcaatcacaactcccggttccattgcactggctcaggcccaggctcaagcccaggtcccagccaaagcccctcttgcagggcaggtgtctacgatggtcaccacaagcacgacaactacagtggcaaagaccgtgacagtgactcgccctacaggcgtgagcttcaagaaggacgtcccgccttcaattaacacaaccaatatcgacacacttctggtcgcaaccgaccaaaccgagagaattgtggagccacccgagaacattcaggaaaagattgcatttatttttaataacttgtctcagagcaacatgacgcagaaagtggaagaacttaaagaaaccgtcaaagaggagttcatgccttgggtcagccagtatctcgttatgaaacgcgtgagcatcgagccgaattttcattctctgtactccaattttctcgataccctgaaaaacctgattacccgattcttccgcctgtgcaccgagatgtgcgtggagatctcttacagggcccaagctgaacagcaacataacccagcagctaatcctacgatgatacgcgcaaaatgttaccacaacctggacgccttcgtgcgacttattgccctcctggtgaagcactccggcgaagccaccaacaccgtgactaaaatcaatctcttgaataaagttttggggattgtggtgggagtgctgctgcaagaccacgatgttaggcaatccgaattccagcaactgccctaccaccggatcttcattatgctattgctggaactaaacgcaccagagcatgttttagagacaattaattttcagacgctgaccgccttttgcaatactttccatatcttgcggcctaccaaagctcctggatttgtttacgcatggctagagttgatttcacataggatctttatcgcacgtatgcttgcccacacacctcaacaaaaaggatggccgatgtacgcacagctcttgatcgatctgttcaagtacctggcccctttcttgaggaatgtcgagctgacaaagcccatgcagatactgtataaagggacactccgcgtgcttctcgtgctattgcatgactttcccgagttcctgtgcgactatcactatggattttgtgatgtgatccctcctaattgtatccagttgaggaatcttattctgtcagcattccccagaaacatgaggctgcctgatcctttcacgccgaacctgaaggtggacatgttaagcgagattaatattgctcccagaatcttaaccaatttcacgggcgtcatgccgccacaattcaagaaagaccttgactcttatttgaagactcggtcacccgtgaccttcctgtccgatctccgctctaatctgcaggtatctaatgaacctgggaatagatacaatctgcagctcataaatgccctagtgctgtacgtgggcacccaggctatcgcccacattcacaataaaggatctacaccatctatgtcaaccataacacactctgcccacatggatatctttcagaacttggccgttgacttggacaccgagggcagatacctattcctgaatgctattgccaatcagctgcgttatcctaacagtcacactcattatttttcctgtacgatgctgtaccttttcgccgaggccaacactgaggcaatacaggaacagataactcgcgtgctgctggaacggctcatagtcaacagaccacacccttggggattgttgatcacttttattgagctcataaaaaatccagcttttaagttctggaaccatgaattcgtgcactgtgcccctgaaatagagaagcttttccagtccgttgcacagtgttgcatgggacagaaacaggcacaacaggtcatggaaggcaccggagcaagttag

SEQ ID NO: 217379 - DNA, 4656 bp, Artificial Sequence
  Description of Artificial Sequence: Synthetic coding sequence
atgaaccttgacagtctgagcctggcactaagtcaaatcagctacctggtggacaatctgactaagaagaattaccgtgcctcgcaacaggaaatccaacacatcgtcaatagacatggtccagaagcagacaggcacttactgcgctgtcttttcagtcatgtcgatttctccggcgacggtaaaagttctggcaaggactttcaccaaacccaatttttgattcaggagtgcgctctgctaatcacgaaacctaattttatctcgaccctgtcctacgccatcgacaaccccctacactaccaaaagtctctgaagccagctccccacctattcgctcagctttctaaagtgctgaaactgagtaaagtccaggaggtgatctttggcctggcacttttgaactccagctcctctgacctccggggatttgccgctcagtttataaaacagaaactgcctgatctgctccgctcctacatcgacgctgatgtgtctggcaaccaggaagggggatttcaggacatcgcaattgaggtactgcacctgctcctgtctcacctgctgttcggtcagaaaggcgcatttggcgtcggccaggaacagatagacgctttcttgaagacgctgcggcgtgatttcccacaggagcgatgccctgtcgtgttagctcccttgctgtaccccgaaaaacgggacatcctgatggaccgcattctgcccgactctgggggagtggctaagactatgatggagtcatccctggccgacttcatgcaggaagtgggttatgggttttgcgcaagtattgaggagtgccggaacattatcgtccaattcggcgttcgtgaagtgactgcggcacaggtggcaagagttctaggcatgatggcaagaacacactccgggcttactgatggcataccacttcagtccatctccgcgcctggttcaggcatctggtcggatggtaaggataaaagcgacggagctcaggcccatacctggaacgtggaggttctgatcgacgtgctgaaggagctaaatccctctctgaattttaaggaagttacctatgagttggaccaccccggattccagatccgcgacagtaaagggttacataacgttgtgtatggcattcagcggggattgggaatggaagtctttcctgtggatcttatatacaggccatggaaacatgccgaggggcaattatcctttatacagcacagtctgatcaatcccgagattttctgctttgccgactatccttgccacaccgtggcgactgacatcttgaaggcaccacccgaggatgataatagggagattgcgacatggaaatcactcgacctgattgagtccctgctgcgtctagctgaggtaggtcagtatgaacaggtgaaacaattattctcattccccataaagcactgtcccgatatgctggtgctggcgctgctacagattaacaccagttggcacacactgcgacatgaattgatctctacactcatgcctatcttcctcggtaatcacccaaactcagccattatcttgcactacgcttggcacggccagggtcagtccccatcaattcggcaactcatcatgcacgctatggctgagtggtacatgcgcggagaacagtacgatcaagcaaaactttctcgcatactcgacgtggcccaagatcttaaagccttgtccatgctgctgaatgggaccccctttgcgttcgtgatcgacctggccgctctggcctctcgcagagaatatctgaagctggacaagtggctaaccgacaagattcgggagcacggcgaaccttttatacaggcctgtatgacatttcttaagcgcaggtgtccatccatcttaggcggtctcgcacccgagaaggatcagccaaaatctgctcaactgccaccagagaccctcgccaccatgctcgcatgtctgcaggcatgcgccggatccgtgtctcaggaactcagtgagacaatcctgaccatggtggcgaattgctcaaacgttatgaataaggcacggcagccaccgcctggggtgatgccaaaaggtcggccaccgtctgctagctctctggacgcaatttcccccgttcagatagacccattagctggcatgacatcacttagcatagggggatctgccgctccccacacgcaatccatgcaggggtttccgcctaaccttggcagtgccttctctacaccccagtcccctgccaaagcctttccaccactcagcacgccgaaccagaccacagccttttcgggaatcggaggcctttccagccagttgcctgttggtggtttaggaaccggcagtttgaccggaattggaactggggctctcggcttgccagccgtgaataatgaccccttcgtccagcggaagctgggaaccagtggactaaaccagcctacgtttcagcagagcaagatgaagccaagcgacctgtctcaagtgtggcccgaggccaatcagcatttttccaaggaaattgatgatgaggcaaatagttacttccaacggatctacaatcacccccctcacccaacaatgagtgtggatgaggtgctggaaatgctccaaagatttaaagactctactattaaacgtgagcgcgaagtgtttaactgcatgctcaggaaccttttcgaggaatatcgcttttttcctcaataccctgacaaagagctccacataacagcttgccttttcggcggaattatagagaagggcctggtgacgtacatggcacttggccttgctctgcgttacgtgctggaagccctgcggaaaccgtttgggtcaaagatgtactactttggaattgccgcactggacaggtttaaaaacaggctgaaagattatccccagtattgccaacacctcgctagtattagccacttcatgcagtttccacaccatctacaagaatacatcgagtacggacaacagagcagggatcccccagtcaaaatgcaggggagcattactacgccagggtcaatagccctcgcccaggcccaggcacaggctcaggtgcctgcgaaggccccactcgctggccaggtcagcacaatggttacaacctctaccacaacaactgtggctaagaccgtgacagtaacgagacctacaggcgtgtcctttaaaaaggacgttcccccttctataaatactaccaatattgatacactgctcgtggccacagaccagacagaacgtattgtggaacctccagagaacattcaggaaaaaattgccttcatcttcaataatctgtcacaaagcaacatgacacaaaaggtcgaggaactcaaagaaacagtgaaggaggagtttatgccgtgggtttctcaatatctggtcatgaaacgagtgagtatcgaacctaactttcactcactttattctaatttccttgatacactgaagaacccagaatttaacaagatggtgctcaacgaaacctacagaaatattaaggtgttgctgacctctgataaggcagcggctaacttttcagatcgcagcttgttgaaaaacctgggacattggctgggcatgattaccctggcaaagaataagccgatcctccatacagatctagatgtgaagtctttacttctggaggcatacgtaaaaggtcagcaggagctgctgtacgtggtgccttttgttgccaaagtcctagaaagctccataaggtccgttgtcttccggcctcccaatccctggactatggcgatcatgaatgtgcttgctgaattgcaccaagagcacgacctgaaacttaacctgaaattcgagattgaggtcctgtgcaagaatctcgctttggacatcaacgagttgaaacccggtaatctcctaaaggataaggaccgactgaaaaatctggatgagcagttgagcgcaccaaagaaggatgttaagcagccggaggagctcccccctattaccactactacgaccagcaccacgccagctacaaacacgacctgtacagccaccgtgcccccacagcctcagtattcctatcatgacatcaatgtctacagcttagccggtctagcacctcatataaccctgaaccccacgattcccctgtttcaggcacatccgcagctcaagcagtgcgtgaggcaggcaatagagcgcgctgtgcaggaacttgtccaccccgtagtcgatagatctatcaaaatagctatgaccacttgtgagcagatagtgaggaaggatttcgctctagactcagaggagagcaggatgaggatagcagctcaccatatgatgcgaaaccttactgccggtatggctatgatcacctgtagggaaccccttttgatgtctatcagcactaacttaaaaaactccttcgcaagcgcacttcgtgtgtcttggctgtttccatggtatagatataaaacttattactgtctgtcagtgattatcttctttttcgtctacatatggcattgggccctgcccctgattttaaacaatcatcacatatgtctcatgtcttccatcatcctggactgtaactcggttcggcagtcgattatgtctgtgtgttttttctttttcctactttattctcagcatgacgtgtag

SEQ ID NO: 217380 - DNA, 951 bp, Artificial Sequence
  Description of Artificial Sequence: Synthetic coding sequence
atgctcctgctggaactgaatgcaccagagcatgtcctcgagacgataaacttccagacactgaccgctttttgtaacacgttccacattttgaggcccactaaggcccctggcttcgtgtatgcctggctcgaactgatttcccaccgcattttcatcgccaggatgctagctcatacaccgcaacagaaagggtggcctatgtacgcccagctgttgattgaccttttcaagtatttggctcctttcttgcggaatgtggaacttaccaagcccatgcagattctctacaagggcacccttagagtgcttctggtcctgctgcacgactttcctgaattcttgtgcgattaccactatggcttttgtgatgtgatacccccaaactgcatccagctgcgtaacctgatcttgagcgccttccccagaaatatgcggttaccagatcccttcacccccaatcttaaggtcgatatgctgtctgaaatcaacatcgccccaagaatacttaccaacttcaccggggttatgccaccacagttcaagaaggatcttgactcatacctgaagactcggtctcctgtcacttttttgtccgaccttagaagcaatctccaggtttctaatgagccaggtaataggtataacctccagcttattaacgcccttgtgctttacgtcgggacgcaggcaatcgcacacatccacaataagggatctactcccagcatgagcaccataacccactctgctcatatggacatcttccagaacctcgcagtggacctggatactgaaggcagatatctattccttaatgcaatcgccaaccaatcagggacacaaattgccaccttgacaacatctgtcgccccatgttgtacgttcctgcagcgacccattcgtaagccaagcaaaaaccggagccaggaattctcatggaatgggtag

SEQ ID NO: 217381 - DNA, 2778 bp, Artificial Sequence
  Description of Artificial Sequence: Synthetic coding sequence
atggatcggtctgggtttggtgagatctcttcaccagtgattagggaggccgaagtaacgcggaccgctaggaagcagtccgcacagaaacgagtccttctccaggcctctcaagatgaaaactttggcaacacaacaccacggaaccaagtaatccctcgaaccccctcctcgtttcgtcagccatttacaccaactagccgctccctcctgagacagccagacatatcgtgtattctgggaacagggggaaaatccccgcgactcacccagagctcaggtttcttcggcaacctgagcatggtgacgaatctggatgatagcaactgggccgcagctttttcctcacagcgctcaggactgtttacaaacaccgagccacacagtattactgaagatgtgacaattagcgcagtcatgctgagggaggatgatccgggagaagccgcatcaatgagcatgttctcggacttcttacaatcattcctgaagcattcttctagtacagtgtttgacctggtcgaagagtatgagaatatttgtgggtcgcaagtgaacattttgagtaaaatcgtaagccgtgctaccccaggactgcagaagttcagtaaaaccgcttcaatgctttggttgcttcagcaggagatggtgacttggcggttgttggcgtcgttgtaccgagatcgcatccaatctgccctggaggaggaatccgtgtttgccgtcactgcggtcaatgcctccgagaaaacagttgtggaggctcttttccagagagacagcctagttagacagtctcagctggtggtagactggctggagagcatcgccaaggatgaaatcggtgaattttctgacaatatagaattctacgctaagtcagtctactgggagaacaccttgcacacgctaaagcagagacaactgacgtcttacgtcggctctgtgagacctctcgtgaccgaacttgaccctgatgcgcctatacggcaaaagatgccactggacgatttggatcgtgaggacgaggtcaggttactcaagtacctgttcaccctcatccgtgccggtatgaccgaggaagcccaaaggttatgcaagaggtgcgggcaggcctggagggctgcaacactggagggctggaaactgtaccatgatcccaacgtcaacggaggaactgaactagaacccgtggaaggaaatccgtatagacggatttggaaaataagctgttggagaatggctgaggatgagctttttaaccgctacgaaagagccatttacgctgccctgtcagggaacttgaaacagctgcttccagtgtgcgacacgtgggaggatactgtctgggcatatttccgtgtgatggtagacagcctcgtggagcaggagattcaaacatcagttgcaacgctggatgagactgaggagctccccagggagtatctgggggctaattggaccttggaaaaagtattcgaggaattgcaggcaaccgacaagaaacgagtactcgaagagaaccaagaacattaccacattgttcaaaaatttctcattctcggtgatatcgacggactgatggacgagttcagtaagtggctcagcaaatcccgcaacaatttgcctggacatctactcagattcatgacccacctgattctgttctttcgcactttggggctgcagacaaaggaggaggtgtctatcgaagtgctgaagacatatatccagctgctcataagggaaaaacacaccaacctgattgctttttacacgtgtcatctgccccaagacctggcagtggcccagtatgcgctgttcctggaatcagtgacggagttcgagcagcggcatcattgccttgaactagccaaggaagccgacctggatgtggctactatcacgaaaaccgttgtggagaacatacggaaaaaagacaacggagaattcagtcaccacgacctggctccagcgctagatactggcactaccgaggaagatcgcttgaagatcgacgttattgactggctggtgttcgacccagcccagagggccgaggcactgaaacagggaaatgctataatgcggaagtttctggccagcaaaaagcacgaagctgcaaaggaggtgttcgtgaaaatcccacaggactcaatcgcagagatctacaatcagtgtgaggaacaaggaatggaatccccactcccagccgaagacgataacgccattcgagaacacttgtgtatcagagcctatctcgaagctcatgaaacctttaatgagtggttcaagcatatgaattctgtgccacagaagcccgcactgatccctcagccaactttcaccgagaaggtcgctcacgaacacaaagaaaagaaatatgaaatggactttggaatctggaaggggcacctagacgccctgacagcagatgtgaaagagaagatgtacaatgtcctgctattcgttgacggcggttggatggtagatgtgcgagaagacgccaaggaggatcatgagaggactcaccagatggtacttctacgcaagctgtgtctgcctatgctctgtttccttctccatactattttgcacagcactggacagtatcaggagtgtctccagctcgccgatatggtctctagtgagagacataagctgtatctcgtcttctcaaaggaggaacttcgtaagctcctccagaagctgagggaatccagcctcatgttgctagaccagggcctggaccccctcgggtacgagatccagctgtag

SEQ ID NO: 217382 - DNA, 1623 bp, Artificial Sequence
  Description of Artificial Sequence: Synthetic coding sequence
atggtgcggacagatggacacaccctctccgaaaaaagaaactaccaagtcactaacagcatgtttggcgctagccgcaagaaattcgttgaaggagttgatagtgattatcacgatgaaaatatgtattacagccagtcgtctatgttcccacatcgaagcgagaaggacatgctcgccagcccttctacctccggacagctgagccagtttggagcttctctgtacgggcagcagtccgcactgggcctgccgatgagaggaatgtccaacaatactccccagttgaatcggtctttgtctcaggggacccagctgccctctcacgtgacacctaccactggcgtccctaccatgtctcttcatacaccaccgtcccccagccgcggtatacttccgatgaatccacgaaatatgatgaaccacagccaagtgggccagggtattgggatcccttcgagaactaattcaatgagcagctccgggttggggagcccaaaccgctctagcccctcaatcatttgcatgcctaagcagcaaccatcccgtcagcctttcacggtcaacagcatgtctggatttggtatgaatcgcaaccaggcttttggaatgaacaacagcttgtcgagtaatatctttaacggaacagatggaagcgaaaatgtgaccggactggacctcagtgactttccggcactggccgatcgcaaccgtagagaggggagtgggaacccaactccattgattaacccccttgccggaagagctccctacgtaggcatggtaacaaagcctgccaatgaacaaagtcaggacttcagcatccataacgaggactttccggcacttcctgggagtagctacaaagacccaacaagtagcaacgatgattccaagtctaatctaaatacatcaggtaaaactacatcctcaactgatggaccaaagttccctggtgataaatcctctactacccagaataacaaccagcaaaagaaggggatccaggttcttccagacggaagagttactaacatccctcaggggatggtgacagaccagttcgggatgatcggtctgctcacctttatccgagccgcagagacagaccctgggatggtacatctggccctcgggtctgatctcacaacgctcggcctcaacttgaacagccctgagaacttgtatcccaaattcgcctctccttgggcaagtagcccatgcagaccccaagatatcgatttccacgtcccctcagagtatttgaccaatattcatattagggataaactggccgctatcaagttaggtcggtacggtgaggaccttctcttctacctgtattacatgaacggcggagacgtgctgcagttgctcgccgcagtagaactgttcaatagggattggcgctatcacaaggaggagagagtgtggattaccagggctcctggcatggagccaactatgaagacaaacacatacgagagggggacttactatttttttgactgcttgaactggcgtaaagtggcgaaggaattccacttagaatacgacaaactggaagagagaccacacttgcctagcacatttaattacaaccctgcacaacaagcattttag

SEQ ID NO: 217383 - DNA, 78 bp, Artificial Sequence
  Description of Artificial Sequence: Synthetic coding sequence
atggtgcggaccgacgggcacactttgtcagagaaacggaactatcaggttacaaattccatgttcggcgcttcatag

SEQ ID NO: 217384 - DNA, 552 bp, Artificial Sequence
  Description of Artificial Sequence: Synthetic coding sequence
atggtgcgcacggatggccacaccctctcagaaaaacgcaattaccaggtgactaactcaatgttcggggcttctagaaaaaagtttgtcgaaggagtcgacagcgattaccacgacgagaatatgtactactcacagagctccatgttccctcacaggagtgagaaagatatgctagcgtcgccttcaacatctggacagctgtcgcaattcggcgcaagtctgtacggacagcagtccgccctgggactgccaatgagggggatgtcaaacaataccccgcagctgaataggtccttgagtcaaggtacgcagctccccagccacgtgacaccaactaccggcgtgccgacaatgtccctgcatacaccccctagcccaagccggggaattctcccaatgaaccctaggaacatgatgaaccactcccaagttgggcaaggcatcggaatcccctcacgtacaaattcgatgagctctagcggactcgggtccccaaaccgctccagtcccagcattatttgcatgcctaaacaacagccaagtaggtag

SEQ ID NO: 217385 - DNA, 1623 bp, Artificial Sequence
  Description of Artificial Sequence: Synthetic coding sequence
atggtacggactgatggccataccctgtcggagaagaggaattaccaggtgacaaacagcatgtttggggcatctcgcaaaaaatttgttgagggcgtagattcggattatcacgacgaaaacatgtactattcccaaagtagcatgtttccccatagaagcgagaaggatatgctggcttcaccaagtacctccgggcagcttagccagttcggagcatctctttacggacaacagtccgcgcttggtctgcccatgagaggaatgagtaataatacaccccagcttaaccgatctctgagccaaggaactcaactcccaagtcatgttaccccaaccaccggcgtgcctaccatgtccttgcacacaccaccctcgccttcccggggtattttacccatgaaccctcggaacatgatgaaccacagccaggtcggccagggaataggaattccatctcgtactaattccatgagcagctccgggctgggatcgcccaaccggtcctctccatcaattatctgtatgccgaaacagcagcccagccggcagcctttcacagtcaactctatgtcaggctttggaatgaacagaaatcaagcgttcgggatgaacaacagcctgtcaagcaatatcttcaatggcaccgacggaagcgaaaatgtgacaggactggacctcagcgacttccctgcattggcagatagaaacagacgggagggctccggaaacccaaccccgcttataaaccccctggccggacgagccccttacgtaggtatggtcaccaaacctgcgaacgagcagagtcaggatttcagtatacataatgaggacttcccagctcttccgggttcatcctacaaggatccgacaagcagcaacgatgattctaagtctaatctgaacacctccggtaagactacgtcaagtacagacggtccaaagttccctggcgacaagagctcaacaactcagaacaataaccaacagaagaaagggatccaggtcctgccagatgggagagtgacaaacattccacagggcatggtgactgaccagtttggaatgatcgggctgctgacatttataagagccgctgagactgatccaggtatggttcatctagcattagggtcggaccttacaacgcttggactcaatctcaactcccccgagaacctgtatccaaagttcgccagcccctgggctagtagcccatgccgcccacaggacattgacttccatgtgccatcagagtatcttactaatatacatatacgcgataaacttgcagcaataaaactcggtcggtatggcgaagacctgctgttctatctttactacatgaatggaggcgacgtgctacagctgctcgccgcagttgaactcttcaatcgcgactggcgctaccacaaggaggagagagtgtggattacccgggcaccgggtatggaaccaacaatgaaaactaatacctacgaaagaggtacatattatttttttgattgcctgaattggcgcaaagtggccaaggagtttcatctcgaatacgataaactggaagagcgaccccatctgccatcaacattcaactataaccccgctcagcaggccttttag

SEQ ID NO: 217386 - DNA, 576 bp, Artificial Sequence
  Description of Artificial Sequence: Synthetic coding sequence
atggtcaccgatcaatttggcatgatcggactgttgacatttatccgagctgcagagacagatcctgggatggtgcacctagcacttgggagcgatctgactacactcggcctcaatctgaattctcctgagaacctctatcccaaattcgcaagcccatgggctagcagcccttgtcggccacaggatatcgacttccacgtgccatccgaatacttaaccaacatccatattcgcgataagctcgctgctattaagttaggccgttatggggaggacctgctattttacctgtattacatgaatggaggcgacgtgcttcagttgctcgcagccgtggagctattcaatcgggactggcggtaccacaaagaggaacgcgtctggatcacacgggcaccaggcatggaacctacaatgaagactaatacctatgagagagggacttactatttcttcgactgtctaaattggaggaaagtggccaaagagttccatctcgaatatgacaagctcgaggagcgacctcaccttccctctaccttcaattacaaccccgctcagcaggccttctag

SEQ ID NO: 217387 - DNA, 966 bp, Artificial Sequence
  Description of Artificial Sequence: Synthetic coding sequence
atggtacgtacagacggccataccctgtctgagaaaagaaactatcaggtgactaacagcatgtttggggcttctcgcaagaagttcgtggaaggcgttgactccgactaccacgacgagaacatgtactactctcagtcaagcatgtttccacacagatctgagaaagacatgctggcatcaccgagcaccagcggacagttatctcaattcggagccagcctgtacgggcagcagtcagcgctcggcttaccaatgcgaggcatgagcaataacacaccccagctgaatcgcagcctcagtcaggggactcagctaccgagtcatgtgactccaactaccggcgtgcccaccatgtcgctacacacgccaccctcaccctcgagaggaatattgcctatgaatcctcgcaatatgatgaaccatagtcaagttggacaagggatcggcatcccgtccagaactaattccatgagctcctctggcctcgggtcacccaaccgttctagcccatccataatctgtatgccaaagcagcagccctctaggcagcccttcaccgtcaacagtatgtctggtttcggcatgaatcggaaccaagcttttggaatgaataattccctgtcttctaacattttcaacggaacggacggatccgaaaatgtgactggcctcgacctgtctgactttcccgcattggcagacaggaacagaagagaagggtccggcaatcccaccccccttattaaccccctcgcgggacgagcaccttatgtgggcatggttaccaagcccgctaatgagcagagccaggatttcagcattcacaatgaagatttccctgccctccctgggtcctcatataaggatcccacctcctcgaacgatgacagcaagtcaaaccttaacacctccggcaagacaacttctagcacagatgggccaaagttccccggtgacaagtag

SEQ ID NO: 217388 - DNA, 978 bp, Artificial Sequence
  Description of Artificial Sequence: Synthetic coding sequence
atgagcacagctagggaacagccgatctttagcactagggcacatgtttttcaaatagaccctgcaacaaaaaggaactggattcccgcagggaagcacgctctaactgtctcttatttttacgatgccacaagaaatgtgtaccggattatatcaatcggaggtgccaaggccattattaacagcactgtcactcctaacatgacgttcaccaagacctcccaaaaatttggccaatgggccgatagtcgggcaaatacagtgtacggactcggatttgcctctgaacagcacctgacacaagtgccccctagccccctggttagtgctaacggccctggagaggagaagttgttcagatctcaatctgcagatgcccctggacccacggagagagaaagattgaaaaaaatgctctcagagggaagtgtcggtgaagtgcaatgggaggccgagtttttcgccttacaggattcgaataacaaactcgcaggcgctctccgggaggccaatgcggcagccgcacaatggcgccagcagctcgaagctcagagagctgaggctgaacggctgagacaacgggtggccgagctggaagcacaagcggcaagtgaagttacccccacaggggaaaaggaaggtttgggccaagggcaaagcctggagcaactggaggcactcgtgcagactaaggatcaggaaatccagacgctcaagagccagaccggcggacccagggaggctctggaagccgcagagagggaagaaactcagcaaaaggtccaggatctggagaccaggaatgccgaattggagcaccagctacgcgcaatggagcggagtctggaggaggccagagcggagcgtgaacgggcacgagctgaagtgggacgggcagcgcagctgttagacgtaagtctctttgaactctctgaactgcgagagggattagcgcgactggctgaagcagcgccatag

SEQ ID NO: 217389 - DNA, 1716 bp, Artificial Sequence
  Description of Artificial Sequence: Synthetic coding sequence
atgctggagacaatcttacgaatgcttgacaatgactctattctagtcgacgctatccggaagattaaggacgatgtggaatattatgttgactcgtcccaagatccagatttcgaggagaatgaattcctgtatgatgaccttgatctggaggatattccccaagctctcgtcgccacctcaccaccatctcactcccacatggaagacgagatcttcaatcagtcctcctccacgcctacttccactacttcatccagccctatccctccttctcccgctaactgcacaacagagaatagcgaagatgataagaaacgtggcaggagtacagacagcgaggtcagccagtcaccggcaaaaaacggcagcaagccagtgcactcaaatcagcacccccagtcgccagcagtcccccctacctatccatccggtcccccaccagcggctagtgcactgagtaccactcctggtaataacggagtaccagccccagccgcacctcccagtgccctgggacccaaagcaagccctgccccatctcacaactccgggacacccgcaccgtatgcccaagcggttgcacctccggctccttcaggcccttccactacgcaaccgagaccccctagcgtacaacctagcggcggagggggaggtggtagcgggggaggaggcagttcaagctcctcaaatagctctgccggtgggggagctggtaagcagaacggagcaacttcctacagttccgtggtggcggattcccctgccgaagtcgcactgagctcctctggtggcaataatgcgtctagccaggcactgggacctccctccgggccacataacccgcctccaagtactagcaaggaaccatctgctgcagcacccacaggtgcaggcggtgtagcccctggcagcggcaataacagtgggggtcccagcctgcttgtaccgctacctgtgaatcctccttcgagtcccaccccaagtttctccgatgcaaaggcagctggggctctattgaacggtccaccacagttctccactgccccagaaattaaagccccagaacccctcagttccttgaagtcaatggcggagcgcgcagccatatcctctggcatcgaggacccggtgcctaccttacatcttacagagagagatattattctgtccagcacgagcgccccaccagccagcgcccaaccgcctttacagttgtccgaggtgaacattcccctgagtctgggggtttgccccctgggccctgttccattaacaaaagagcagctctaccagcaggctatggaagaggccgcttggcatcatatgccacacccaagcgactctgaacgcatcagacagtacctcccccgtaatccttgtccaactccgccatatcatcaccaaatgccacctccacacagtgatacagtagaattctaccagaggctgagcaccgagactctcttctttatattttactaccttgagccccgtgacgtgcggacagcttgggtagacagcgaggccggtccgttgagacacacgtctgcaccactccctgtagcccattggttgactcggggtccttccccagcccttctgcagcagcctcagtcacgaccaaccccattatgcagctcagcgcatagccaagcctctctggagaccaccggcgaactaagctccccactgcccacacccctactgtag

SEQ ID NO: 217390 - DNA, 2262 bp, Artificial Sequence
  Description of Artificial Sequence: Synthetic coding sequence
atggccgacaagcgaaaattgcagggtgagattgaccgctgcctgaagaaggttagcgagggcgtcgagcaatttgaagacatttggcagaagctccacaatgccgctaatgccaatcaaaaggaaaagtacgaggccgacttaaagaaagaaatcaagaaattgcagagactgagggatcagattaagacatgggttgcctctaatgagatcaaagataagcgccagctgattgacaacagaaagttgatcgaaacacagatggagaggtttaaagtggtagaaagagagacaaagactaaggcttatagtaaagaggggcttggactggcccagaaagtggatcctgcacaaaaagaaaaagaggaagtgggccagtggttaaccaacactatagacacacttaatatgcaggtggatcagtttgaaagcgaagtcgagagtctcagcgtgcagacccgtaaaaagaaaggcgataaggataagcaggaccgaattgagggtctgaagcgccatattgagaaacatcgatatcatgtgaggatgctggaaacaatcctgcgcatgctcgacaatgactctattctggtggacgccatccggaaaatcaaggatgatgtggagtattacgtggattctagccaagatcccgactttgaagaaaacgagttcctatatgatgatctcgatctagaagacatcccgcaggccctggtggctacttctccaccctctcactcacacatggaggatgaaatctttaaccaatcatcctccactcctactagtactacatccagctcaccaattcctccctcccctgccaactgtactacagaaaactccgaagacgacaagaagcggggtcgttctacagactcggaggtcagccagtcacctgcaaaaaatggcagcaagcccgtacattcgaatcagcacccgcaaagccccgcagtcccacccacctatccttccggtcctccacctgctgcctcagctctatccactacaccgggtaacaacggggtgcctgccccagcggctccaccttccgctctgggacctaaggcatccccagccccatcacataattcagggactcctgccccatatgctcaagctgttgcccctcctgctcccagcgggccttcaactactcagcctcgaccaccttccgtgcaacccagcggcggtggcggtggagggtctggtgggggaggatcatcaagctcttctaattcttcagcaggagggggtgctggtaaacagaatggcgctacgtcttatagctcagttgtcgccgacagtccggctgaggtggcgttgtccagcagtggcggaaataatgccagttcccaggccttgggacctccatcgggaccccacaaccccccaccctctactagtaaggagccaagcgccgctgcgcctacgggggcagggggagtggcacccggaagcggcaacaactctggcggtccatcactgttggtccctctccccgtcaaccctccatctagtccaacaccgtctttctctgatgccaaggccgctggagccctgctgaatggaccaccacagttcagcaccgccccagagattaaggccccagaacccttgtccagcctgaaatccatggcagaacgagcagcaatctcttcgggaatcgaagatcccgtaccaacgctccacttaacagagagggatatcattctgtcttctacttctgctcccccagcttctgctcagccccctctacagctctccgaagtgaacataccactttcccttggagtttgcccccttggccctgtgcccctgacaaaggagcaactgtaccaacaggccatggaggaagctgcttggcaccatatgccccacccctctgattccgagcgcatcagacagtacctgccgaggaatccgtgccccacccccccatatcatcaccagatgccacccccacactcagacaccgtggaattttaccagcgcctgtcaactgagactttgttttttatattctactatctggaagggactaaggcacagtatttggccgctaaggcactcaagaagcagagctggcgtttccataccaagtacatgatgtggttccagaggcatgaggagcctaagaccatcactgatgagtttgaacagggtacatatatctacttcgactacgagaagtggggacagcggaaaaaggaaggcttcacattcgagtacagatacttagaggatcgcgatctgcagtag

SEQ ID NO: 217391 - DNA, 867 bp, Artificial Sequence
  Description of Artificial Sequence: Synthetic coding sequence
tgaaaggaaccctccgctgccgcaccaacgggagctgggggtgttgccccaggttctggaaacaatagtgggggaccttcacttctggtccccctgccagttaacccaccttcctctcctaccccaagtttcagtgatgcgaaggcagcaggagccctcttgaatggtcctccacagttttcgaccgccccagagattaaggcccctgaacccctgagttcactgaaatcaatggcagagagagcggcaatttcctcaggcattgaggacccagtgcctacccttcacctcacagagagggacatcatcctgtccagtactagtgcacctccagccagcgcccagccaccgttgcaattgtccgaagtgaatattccactgagccttggtgtttgtcccctggggcctgttcctttaacaaaggagcaattgtatcagcaggccatggaagaagcagcttggcaccacatgccgcatccatctgactcagaacggatccgacaatatctgccccgaaacccatgtccgacacctccttatcaccaccagatgcctcctccacactctgatacagtcgagttctatcagaggctttctaccgagactctgttttttatcttctactatctggaaggcacgaaagcccagtaccttgcagcaaaggcacttaaaaagcagtcatggagatttcatacgaaatacatgatgtggttccagagacacgaagagccaaagaccattacagatgagtttgagcagctggcccagagtcttagtctcactaagtattcctccctctggctttcagcccagcctggaacccccccttcacatccaccgctgggacagctgctaggcctgctgtag

SEQ ID NO: 217392 - DNA, 2304 bp, Artificial Sequence
  Description of Artificial Sequence: Synthetic coding sequence
atgtctaggagccctgacgccaaggaggatcccgtggaatgcccgttgtgtatggagcctctggaaatcgacgacatcaacttctttccctgcacatgtggctatcagatctgtcgcttctgctggcataggattcgcacagacgagaatgggctctgccccgcttgcagaaagccataccctgaggatccggcagtctataagccactgagccaagaggaactccagagaatcaagaacgagaagaagcagaagcagaacgagagaaagcaaaagatatcagagaataggaaacacctggcctccgttcgggtcgtgcagaagaacctagtttttgtggtgggtctgagccagagactcgccgatccagaagtcctcaagagacccgaatacttcggtaaatttgggaaaatccacaaagttgtgatcaacaacagcacctcttacgcgggtagccagggcccatcagcaagcgcctacgtcacgtacatccgctcggaggatgccctccgagctatccagtgcgtaaacaacgtggtagtggatggcagaactttaaaggcttctctgggcactactaagtattgttcctactttctcaagaatatgcagtgccctaaacctgattgtatgtacctacacgagctgggtgatgaggccgcttctttcaccaaggaggaaatgcaagcaggtaagcaccaggagtacgaacaaaagctacttcaggagctgtataagctcaaccctaactttcttcagctctctactgggtctgtagacaagaataaaaacaaagtaaccccccttcagagatatgacacaccaatagacaagccatctgactccctctcaattggaaacggggacaattctcaacagatctccaattctgacactccctcacctccacccggacttagcaaatctaaccctgtaatccccattagctcgtcaaaccactccgctcggagcccatttgaaggtgccgtcaccgaaagccaatccctattctccgacaactttcgccatcccaatccaattccgtcaggtctaccaccttttccgagttctccacaaacaagttctgactggcccacagctcccgagccgcaatcgttgtttacctctgagaccattccagttagttcctcaaccgattggcaggcggcttttgggttcggcagctccaagcaacccgaggacgatctaggcttcgatcccttcgacgttacacgcaaagccctggcagacctgattgagaaagagctgtcggtgcaggaccagcctagcctctcgcctacaagcctgcaaaatagtagctcacataccacgacggctaaggggcctgggtctgggttccttcatcctgccgctgctacaaacgccaattccctgaactccaccttcagcgtgttaccacaacgtttcccacagtttcaacagcaccgcgctgtgtacaactccttcagctttcccggacaagccgcaaggtacccttggatggcttttccaagaaatagcatcatgcacctcaatcacacagcaaaccctacaagcaattcaaatttccttgacctgaatttgccccctcagcacaacactggccttggtggaatccccgtagctgacaattcctcgtccgtcgaatccttaaatatgaaagagtggcaggacggcctccgagcactgctccctaacatcaacatcaactttggtggacttccaaattccagtagtccctccaatgcaaaccatagcgcccctacctctaacaccgccactactgattccctgtcttgggacagtccgggatcgtggactgatcctgccatcatcaccggtatccctgcctcctccggcaattcgctggattctctgcaggatgataacccaccccactggctgaaaagcctgcaagcgctgacagagatggatgggcctagtgccgctccatctcagacacaccactccgccccattttcaacgcagattcccctccatcgagctagctggaatccgtatcctccccctagtaacccaagtagttttcatagcccccctcctggtatttattatcgagtccagcattggaccgctatcagacagcgaggcgcaacgatacggaaatgtcgaatctgccccacactgttttcccctagccagccgacaacccatagtagtctgttgattagctacgtgcttaaaaaccccgttcctgatcaatttttcttctcgttaacccctgacgccatgcgctctcagggacattaccaccttttcattaattgcaagaacttttgttag

SEQ ID NO: 217393 - DNA, 1728 bp, Artificial Sequence
  Description of Artificial Sequence: Synthetic coding sequence
atgtcccgcagccccgacgccaaggaagatccggtcgagtgtccattgtgtatggagccattagagatagacgacattaacttctttccttgcacctgtggataccagatttgtaggttttgttggcatagaatcaggaccgacgagaacggactctgccctgcttgtagaaaaccgtatcccgaggaccctgcagtgtataagcccctgagccaggaagaactgcaaagaataaagaacgaaaaaaagcaaaaacagaatgaacgaaagcagaagatctccgagaatcgcaagcacctcgcttccgttcgggtggtgcagaagaatctggtttttgtggtagggttaagccaaagactggccgaccccgaggtactcaagcgcccagagtatttcggcaagttcgggaaaatccacaaggtcgtgattaacaattccacaagctacgctggctcacagggtcctagcgcttccgcatacgtgacatatattcgttccgaggatgccctgcgggcaatccaatgtgtcaataatgtggtggttgatgggcgaacacttaaggccagccttggaacaaccaagtattgtagttatttccttaaaaacatgcaatgccctaaacccgactgtatgtatctccacgagctgggtgacgaggcggcatccttcactaaagaagaaatgcaggcaggaaagcatcaggagtacgagcagaagctgttgcaggaactgtacaagttaaacccaaattttttgcagctgtccacagggtcggtggataagaacaaaaacaaagtgacccccctgcaaaggtatgacacacccatcgacaaacctagtgacagtctctccattggaaacggagataacagtcaacagatctccaacagcgatactcccagtcctccacccggactctctaaatcgaatcctgtcatacctatttcgtcgagcaatcattccgcgaggagtccctttgagggtgctgttaccgagagccaaagtctcttttccgacaactttcggcacccaaaccctattcctagcggactcccaccgttcccctccagccctcagacctcctctgactggccgactgcccctgaaccccaatccctgtttacttccgaaaccatccctgtcagctccagtaccgattggcaagccgcattcggatttggttcgtccaagcaacccgaagacgacttagggttcgaccccttcgacgtgacgaggaaagccctcgccgacctcatagagaaagaactcagcgttcaagaccaaccatcgctgtctcctacttctctacagaactcctcgagccacaccaccaccgccaaaggacccggttccgggtttctccaccccgcagccgctacaaacgctaactctttaaacagtacgttttccgtgcttccgcaacgcttcccccagttccagcagcatcgggctgtttataacagtttcagctttcccggtcaggcagccaggtacccctggatggccttcccacgcaactccattatgcacctgaaccatacagctaatcctacctccaacagcaactttttggatctaaacctgcctccacagcataacacaggcctaggcggaatacccgtcgctggggaggaggaggtaaaagtatccactatgccactgtcgacgagcagccattcgttgcaacaaggccaacagcctaccagcctacacaccactgtagcttag

SEQ ID NO: 217394 - DNA, 1302 bp, Artificial Sequence
  Description of Artificial Sequence: Synthetic coding sequence
atgtctagatctccagatgcaaaagaagatcccgtggaatgtcccctctgcatggagccactggagatcgatgacatcaacttcttcccatgtacctgtgggtaccagatttgtcgcttctgctggcatcgaatacggactgacgaaaatgggctttgcccagcatgccgtaagccatacccagaggacccagctgtgtacaaacctctgagtcaggaagaactccaacggatcaagaacgagaagaaacaaaagcagaacgagcggaagcaaaagatttccgagaacaggaagcacctcgcatccgtgcgcgtggtgcagaaaaatctcgtctttgtagtgggcttgtcccagaggttggccgatcccgaggtcctgaagaggcctgaatactttgggaaatttgggaaaatacacaaagtcgtgatcaacaatagcacttcctacgccggatcacagggccctagtgcttctgcgtatgtgacttacatccggagcgaggacgcccttcgcgcaattcagtgcgtcaacaacgttgtggtggacggccgaaccttgaaagctagcctcggcacaacaaaatattgcagctattttttaaagaatatgcagtgcccgaaacccgattgcatgtatttgcatgagctgggcgacgaagcagccagctttactaaagaggagatgcaagccggaaagcaccaagaatacgaacaaaaactgttgcaagagctctataaattaaacccaaatttcctgcagctgtctactgggtctgtggacaagaataagaacaaagtgacgcctctgcagcggtatgacactccgattgacaagccatctgattccctatctatcggtaacggcgataattcacaacagatctccaacagtgacaccccatcccctccgccagggttgtcaaagtccaatcccgtcatcccgatcagttctagcaatcattccgctcgctctccattcgagggtgccgtcacagagtcgcagagcctgttttcagataacttccgccatccgaacccaattccttccggcctacctccatttcccagctcaccccagaccagttccgattggcctaccgctccagaacctcagagcctcttcacatctgagacaattcctgtgtctagtagcacagactggcaagctgcctttgggttcggatcgtccaaacagcccgaagacgatcttggcttcgatccattcgatgtgacacgcaaagccctggctgatctaaccgagccaatcgaacggaaacggttagcggtcttaaaaagacggtag

SEQ ID NO: 217395 - DNA, 1920 bp, Artificial Sequence
  Description of Artificial Sequence: Synthetic coding sequence
atgagtaggtcacctgatgcgaaggaagaccctgtggagtgccctttatgcatggagccactcgagattgatgacatcaattttttcccctgtacatgcggttaccagatttgtcggttctgctggcatcgaattcggacagacgagaacggcctctgccccgcatgccgcaagccgtaccccgaagacccagcagtgtacaaacctctctctcaggaggagctacaaaggatcaagaacgaaaaaaaacagaaacagaatgagagaaaacagaagatctccgagaaccggaagcacttggccagtgttcgcgtggtccaaaagaatctcgtgtttgtcgtgggcctgagccaaaggctggccgaccccgaagttctgaagcgccctgagtattttgggaagttcggaaagatacacaaggtggtgattaataattctacctcttatgcagggagccaaggtcctagtgccagtgcttacgtcacttatattaggtcagaggatgctctgagagctatccagtgtgtcaacaacgtggtcgtggacggtaggaccttgaaagcatctcttggcaccaccaaatactgttcttacttcctgaagaacatgcaatgccctaaacctgactgtatgtacctacatgagctcggggacgaggcagccagcttcacaaaggaggaaatgcaggccggaaagcaccaagagtacgagcagaagttactccaagagttgtataagctcaatcccaactttctgcagctcagcaccggatcagtcgacaaaaataagaacaaggtcacccccttgcagagccctatcgataagcccagcgattccctatctatcggtaacggcgataattcacaacaaatctccaattccgatacgccctctccaccgccaggcctctctaaaagtaatcctgtaatccctattagctcttccaaccacagcgctaggtctccttttgaaggtgctgttactgaaagccagtccctattttccgacaatttccgccatcccaaccccataccttctgggttgcccccatttccatcctcgcctcagaccagttctgattggccaaccgcccctgagccccagtccctgtttacctcagagacaatcccggtgagctcctcgaccgattggcaggctgctttcgggtttggtagtagcaagcagccggaggatgacttaggattcgatccctttgacgtcactcgtaaggctttggcagacttaatcgaaaaggagctgtcagtgcaggaccagccctcactgagtcctacttccctgcagaattcatcctctcacactaccacagctaaggggcctgggagtgggtttctacatcctgccgctgctacaaatgcaaatagtctgaatagcactttctcagttctgcctcaacggtttccccagttccagcaacaccgggctgtgtataattccttctccttccctggccaagctgcgcgttacccttggatggcctttcctagaaattccattatgcacttaaaccacacggcaaaccccaccagtaattccaacttcctagacctgaacctgccccctcaacataataccgggctgggcggaattccagtggcaggcattcccgctagcagcggcaacagcctggattcactacaggatgacaaccctcctcattggctgaagtctctccaggcattgacagagatggatggcccatccgctgctcccagccaaacccaccattcggcgcctttctcaactcagatacctctgcatagggcgagctggaatccctaccctccaccatccaatccttctagttttcactccccgcctcctggcttccagacagccttccgtcctccaagcaagaccccaaccgacctgctgcagagtagtaccctggatcgccactag

SEQ ID NO: 217396 - DNA, 1302 bp, Artificial Sequence
  Description of Artificial Sequence: Synthetic coding sequence
atgtcaagatctccggacgccaaagaggacccagtggagtgccctctgtgcatggaaccattggagatagacgacatcaattttttcccgtgcacatgtgggtaccagatctgccggttctgctggcaccgcatccgaaccgacgaaaacggcctctgtcctgcttgccggaaaccttatcctgaagatcctgccgtttacaagcctttgtctcaagaggaactgcagcgcataaagaacgaaaaaaaacaaaagcaaaacgagagaaagcagaaaatctccgaaaacagaaaacacctagctagcgttcgggtggtgcagaagaacttagtatttgtggtcggcctgagccagaggctggcagacccagaagtcctgaagcggcctgaatactttggaaagtttggtaagattcataaagtcgtcattaataactcaaccagttacgccggatcgcagggtcccagtgcgtccgcgtatgtgacctacattcgttctgaggatgccctgcgcgcaattcaatgcgtaaacaacgtggttgtggacgggagaaccttaaaagccagcctcggcactaccaaatattgctcctacttcttaaaaaatatgcagtgcccaaaacccgattgtatgtatctgcatgaactgggtgacgaggccgcaagttttacaaaagaggaaatgcaggccggtaaacaccaggaatatgagcaaaagctgctccaggagctctacaaactgaaccccaatttcttacaactgagcacagggtccgtagataaaaataaaaataaggtgacacctctgcagaggtacgacacacccatcgacaagccctctgacagcctaagtattggaaacggagacaattctcagcagatttctaatagcgatacccctagcccacccccaggactttcaaaaagcaaccccgtgattccaataagctcgtctaaccactcggctaggagccccttcgagggagccgtgaccgaaagccagagtctctttagtgataatttcagacacccaaacccgataccatccggtctgcccccttttccgagttccccccagacctcttcggactggcccacagcaccagagccacagagcctctttactagcgagaccatccctgtcagcagctccaccgattggcaagccgcatttggtttcggttccagtaaacaaccggaggatgatctaggcttcgaccctttcgacgtcacccgcaaggcactggctgacctaaccgaacccattgagcgtaagcgcctcgcggtcctcaagaggcgctag

SEQ ID NO: 217397 - DNA, 1929 bp, Artificial Sequence
  Description of Artificial Sequence: Synthetic coding sequence
atgtccagatctcctgatgctaaggaggatccagtggagtgccctctttgtatggagcccctggagattgacgatatcaatttctttccctgcacttgcggctaccagatctgtagattttgctggcaccgcattaggactgatgagaacggcctgtgccccgcatgcaggaaaccctaccctgaggacccggctgtatacaagccactgtcgcaagaagagctccagagaataaaaaatgagaagaaacagaagcagaatgagagaaagcagaaaatcagtgaaaaccgcaaacatctggcgtctgtcagggtggttcaaaagaatctagtgttcgtggtgggactgtcccagcgacttgccgacccggaggtcctgaaaaggccagaatacttcggaaaattcgggaaaatccacaaggttgtgattaacaatagtacctcatatgctgggagccagggccctagcgcgtcagcttatgttacatatattcgtagcgaagacgcactacgggctatccagtgcgtgaacaatgtggtggttgacggcaggactctgaaagctagccttggtaccaccaaatattgctcttattttctaaagaatatgcagtgtcctaaacccgactgtatgtacctacatgaactcggtgatgaagccgcatcatttacaaaggaggagatgcaggcgggtaagcatcaggaatatgagcagaagttgctccaggaactgtacaaactgaatcctaactttttgcaattgtcaacggggtctgtggacaagaataagaacaaggtcacacccttacaaagatacgacacaccaatcgataagcctagcgactctctcagtattgggaatggtgataattcccagcagatctccaacagtgacacaccttctcctccacctggcctaagcaaaagtaatcctgttattcccatcagctcttctaaccactccgctcgctccccctttgagggcgctgtaaccgagtctcagtcactcttcagtgataatttcagacatcccaaccccattccctcaggtttgcctcctttccccagcagtccacagacatcttctgactggccaacagccccagagccccaaagcctgttcacatccgagacaatacccgtgagcagtagcaccgattggcaagccgctttcggtttcgggagttccaaacagccggaggatgatctgggcttcgacccatttgatgtcaccaggaaggccctcgccgacctaatagagaaggaactcagtgtgcaggaccaaccatctttgagtcccaccagcttgcagaatagcagttcccacacaactaccgctaaaggacccggaagcggctttctgcacccagccgcagcgactaacgcaaattccctgaattcaacttttagcgtcttgcctcaaagatttccccagttccaacagcaccgggcagtctataacagtttttcctttcctggccaggcagcccgatacccctggatggcctttccaagaaactcaatcatgcatctgaaccatacagctaacccaacatctaactctaactttcttgatttgaatctgccaccccaacataatactggcttgggaggcattcctgtggccggaattccagcgagcagcggaaattccttagacagtttacaagatgacaatccccctcattggcttaagtccttgcaggcactgaccgaaatggatggcccatcagccgcacccagccagacccaccactcagccccatttagcacacagataccactacatagagcctcctggaatccttaccctccacccagtaatccatctagtttccattcacccccacctggttttcagacagcatttcggccacccagcaaaacacccacagacttgctccaatcaagtacactggaccgacactag

SEQ ID NO: 217398 - DNA, 1719 bp, Artificial Sequence
  Description of Artificial Sequence: Synthetic coding sequence
atgagtagaagtcctgacgccaaggaagatccggtggaatgtccattgtgtatggagcctctggagattgacgatataaacttcttcccgtgcacatgtggctaccagatttgtaggttctgctggcaccggatccggacggatgagaatggcctctgcccagcttgtagaaaaccctacccagaagaccctgcagtgtacaagcctctgagccaggaagaactccaaagaatcaagaacgaaaagaaacagaagcaaaacgaacgcaaacaaaaaatcagcgagaaccgtaaacacctggcgagtgttcgcgtggtgcagaaaaacttggtgttcgtggtgggactaagccaacgcctggccgatccagaggtgttgaaacgccctgaatactttggtaagtttggcaagattcacaaagtggtcatcaacaactctacttcctatgcgggaagccagggacccagtgcgagcgcttatgtgacatacatccggtcagaggatgctttgcgagccatacagtgcgttaacaacgtagtcgtagacggccgaactttgaaggcttcactagggaccaccaagtactgtagctatttcctgaagaatatgcagtgccccaagcctgactgtatgtatctccatgagcttggggatgaggctgcttcctttaccaaggaagaaatgcaagctggcaagcaccaggagtacgagcagaaactgcttcaggaactgtataagctgaatcctaattttctgcagctttcaacgggttcagtggacaaaaacaagaacaaggtgactccccttcaaagccccattgacaaaccgagtgacagtctgagcattggcaacggcgataattcacagcagatcagcaactccgatacaccctctccccctcctggccttagtaagtccaatccggtgattcctatctcctcctctaatcatagtgcccgttcgccatttgaaggcgcagtgacggagtctcagtccctcttctcagataattttaggcacccaaaccccattcccagcggtcttcctccatttccatcatctccccagacaagctctgactggccaaccgctcccgagccccaaagcctgttcacctccgagactatccccgtctcaagctccacagattggcaggccgcatttggctttggatcctcgaagcaaccggaggacgacctgggatttgaccctttcgatgtgacccgaaaagccttggccgacctaatcgaaaaggaactgtctgtgcaagaccagccgtctttaagtccaacctccctacaaaactccagtagtcatactaccacagccaaaggtcctgggtctggattcttacaccccgcagccgcaacaaatgccaattctctgaattcgactttctcggtcctgcctcaacgtttcccccaattccagcagcatcgagccgtctacaattcttttagttttcccggacaggcagcacggtatccctggatggcttttccacggaactccatcatgcacttgaatcacaccgctaatcccacctctaactccaattttctcgacctgaatctgccccctcagcacaataccggcctcggcggaatccccgtcgctggtgaggaagaagtaaaggtcagcaccatgccactttctacctcttcacactctctccagcagggccagcagcctaccagtctccatacaacagtcgcctag

SEQ ID NO: 217399 - DNA, 2142 bp, Artificial Sequence
  Description of Artificial Sequence: Synthetic coding sequence
atgagccgctctcccgatgccaaggaggatcccgtggaatgtcctctatgcatggagcccctcgaaatagacgatattaacttcttcccatgcacctgtggctatcaaatatgtcgcttctgttggcatcggatacgcactgacgagaacggactgtgtcctgcctgtcgcaagccgtatcctgaagaccctgctgtttacaaaccactttcccaggaggagctccaacgcatcaaaaatgagaagaagcaaaaacagaacgaaaggaagcagaaaatctcagagaatagaaagcatctcgctagcgtgcgggtggtccaaaagaacctggtgttcgttgttggcctgtcgcagcgcctcgctgatccggaagttctaaagagaccagaatatttcggaaaatttggtaagatccataaagttgttatcaacaactcgacgagctatgccggatctcagggccctagcgcgtcagcatacgtgacctatattcgtagtgaagatgcattgagggccatccagtgcgtcaacaacgtcgtggtggacgggaggacgctgaaggcaagcttagggaccacaaagtattgttcctacttccttaagaacatgcagtgccctaagcccgactgtatgtacctgcatgagctcggcgatgaggcagcttcattcacaaaagaggaaatgcaggctgggaagcaccaggagtacgagcaaaaactactccaggagctgtataagctcaaccccaacttcctgcagctgtcaacgggcagcgtggacaagaacaagaataaggtaaccccgcttcagaggtacgacacacccatagataaacctagcgatagtctgtcgattggcaatggagacaattcgcaacagatctccaacagcgatacaccttccccaccaccaggactcagcaagtccaacccagtcattccgatctcatcctccaaccattctgccaggtcccctttcgagggcgctgttacggagtctcagtcgctgttctcggataattttcgacatcccaaccctattccctccggcttgccgccttttcccagcagcccccagaccagctctgactggccaactgctcccgaaccccaaagtctcttcacctcagaaacaatccctgttagcagttccacagactggcaggctgcctttgggttcggcagtagtaagcagccagaagatgatttgggcttcgatccctttgatgtgactcggaaggccttggctgatctaattgaaaaggaactgtcagtgcaggatcaaccatcgctaagccccaccagcctgcagaacagtagctcccatactaccactgctaaggggcctggctcaggctttttgcacccagccgcagccactaatgctaattcattaaacagcacatttagcgtgttgccacagcgcttccctcagttccagcagcaccgggcagtatataatagcttctcttttccgggacaagcagccagatatccgtggatggcttttcccagaaacagtattatgcacttgaatcacacagcaaaccccacctctaattccaactttctggacctgaatctgccgccacagcacaacacaggactgggcggtattccagttgccgacaactcttcaagtgtggagagtttgaacatgaaagagtggcaggatggcctgagggctttgcttccaaatataaacatcaactttggcggtcttccaaacagttctagcccttctaatgcgaatcatagcgcccctactagcaacaccgcaacgacagatagcttaagctgggacagtcccggatcctggacagacccagccataattactggaattccggcttcaagcgggaatagcctggattctctgcaagatgacaacccaccccactggctgaagtccctgcaagcactgaccgagatggacggaccatccgccgcaccatcccagacacatcacagtgcaccattttctacgcagatccccctgcatcgcgctagctggaacccatatcctccgccttcgaacccatcttccttccactctccgcctcccggattccaaaccgcgtttcgcccaccaagtaaaacccctaccgatctgcttcaatccagcaccctggataggcactag

SEQ ID NO: 217400 - DNA, 1674 bp, Artificial Sequence
  Description of Artificial Sequence: Synthetic coding sequence
atgcccaaggaaaagtacgaaccaccggacccgaggaggatgtacaccataatgtcttcagaggaagctgccaacggaaaaaagtcccattgggctgagctagaaatcagcggcaaggtaaggagcctgtccgcgtcactctggtccttgacccacctgaccgcattgcatttgtccgacaattccctgtctaggattccatctgacatcgcaaagctgcataacctggtgtatctcgacctgtcgagcaataaaattcgcagcctgcctgccgagctgggaaacatggtaagcctgcgcgagctgcatctgaataacaacctactgagagtcttaccatttgagctcggaaagctctttcagctgcagacattggggttgaaggggaatccacttactcaggacatactcaatctgtatcaagagcctgatggcaccaggagactgctgaattacctgcttgataacctaagcggcactgccaagaggattaccacagagcagccgcctcccaggagctggattatgctgcaggaaccggataggaccaggcccacagccttattcagcgtcatgtgctacaatgtgctgtgcgacaagtacgccacacggcagctgtacggttactgcccttcttgggctttaaactgggattaccgcaagaaggccatcatccaggagattctgagttgtaacgcggatatcgtgagcctgcaggaggtggagaccgaacagtactacagtttcttcctggtggaattgaaggagagaggatacaacgggtttttttctcccaagtcccgggctcgcacaatgagcgagcaggaaagaaagcatgtggacggatgtgccatcttctttaagaccgagaagtttaccctggtgcagaagcatacggtcgagtttaatcagttggctatggccaattcagaaggcagcgaggcgatgctcaatagagtcatgaccaaggacaatattggagtagctgtattgctggagcttcggaaggaatctattgaaatgccatcgggtaagcctcacctgggcactgagaaacagctgatcctcgttgcaaacgcccacatgcattgggatccagaatacagcgatgtaaaactggttcagacaatgatgtttctgagcgaggtaaaaaatatcattgataaggcttccaggaatctgaaaagttccgtgctcggcgaatttggtactatcccccttgtgttgtgtgccgacctgaatagtttgcctgatagtggggtcgtggagtacctgagtactggtggggtagagacaaatcataaggacttcaaggagctcagatataatgagtctctgacaaactttagctgtcacggcaaaaacgggacgacaaacggcaggataacccacggctttaagctccagtcagcctatgagtccggtttgatgccctacacaaattacacatttgactttaagggcattatcgactacatcttttattcaaaaccccagctaaacacactcggaatcctgggacctttggaccaccattggctggtggaaaataacatttcaggctgccctcatccgctgatccctagtgaccacttcagcctctttgctcagctggagctccttctaccctttcttcctcaggtaaacgggattcatctacccggaaggagatag

SEQ ID NO: 217401 - DNA, 1674 bp, Artificial Sequence
  Description of Artificial Sequence: Synthetic coding sequence
atgccaaaggagaagtatgagcctccagaccctcggagaatgtataccattatgtccagcgaggaagccgcaaatggcaaaaaaagccactgggccgaactcgagataagcggcaaggtccggtccctgtcagcctcattgtggagcctcacacacctaaccgccctgcacctctcagataattcgctgtcgaggattccatccgacattgcgaagttgcacaacctggtttacctggacttgagcagcaacaagattagaagtctccctgcggaactcggaaacatggtttcactgagggagctgcacttgaataacaacctgttacgcgtgctgcctttcgagctgggaaagctctttcaactgcagacactcgggctcaagggaaaccccctgacgcaagatattctcaatttgtatcaggaaccagacggaacccgaagactgctcaactaccttctggacaacttgtcggggaccgctaagaggattaccactgaacagcccccacctcgctcttggataatgctgcaggagcctgacagaacaagaccaacagccctgttcagcgtgatgtgttataatgtcttatgcgacaaatacgcaactcggcagttgtatgggtactgcccatcctgggctctgaattgggactaccggaagaaggctataatacaggagattctgagttgcaatgccgacattgtgagccttcaggaggttgaaacagagcagtattactctttttttctggtggagctcaaagagcgtggatacaacgggtttttctcaccaaagagccgagccaggacaatgtcagaacaggagcgcaaacacgtggatggttgcgccatcttttttaaaacagaaaaatttacacttgttcagaagcacaccgtagagttcaaccaactggctatggctaatagcgaaggatcagaggcgatgctcaatagggtgatgactaaagataacatcggcgtggccgtgcttctggagctccgaaaggaatccatcgaaatgccatctggaaaaccacacttgggcactgaaaagcaactgatcctggtggccaatgcccacatgcactgggatccagaatactccgatgtcaagctggtgcaaaccatgatgttcctaagcgaagtgaagaatattatcgacaaggctagccgcaatctcaagtccagcgtcctgggagaattcggcacgattcccctggttttgtgtgccgatctgaatagtctccctgactccggcgttgtagaatatctgagtacagggggagtggagaccaatcacaaggatttcaaagaactgagatataacgaatctctgactaactttagctgtcatggtaagaacggaactactaatggaaggatcacacacggatttaagctgcagagcgcctacgaatccggccttatgccgtacactaattatacttttgactttaaagggatcattgattatatcttctactcgaagccacaattgaacacgttggggattctcgggccacttgaccatcattggctcgtggaaaacaacatctccggctgtccgcaccctcttatcccatctgaccatttctcactgtttgcacagttggagctgttgctgccattcctgccacaggtcaacggcattcatctgcccggaagacggtag

SEQ ID NO: 217402 - DNA, 858 bp, Artificial Sequence
  Description of Artificial Sequence: Synthetic coding sequence
atgccagcagccacggtcgatcattcccagagaatctgcgaggtctgggcttgtaacctggatgaggaaatgaagaaaattcgacaggtgatcaggaagtataactatgtggctatggacaccgaatttcctggtgtcgtggccaggcctattggagagtttcgttccaacgccgattatcagtaccagctgctcagatgtaacgtggatttgttgaagatcatccaactaggtttaacattcatgaatgaacagggcgaataccccccaggaacctccacatggcagtttaacttcaaatttaatctcacggaggatatgtatgcacaagatagtatcgaactcctgaccacaagcgggatacagttcaaaaagcatgaggaggagggaattgaaacacagtacttcgccgaacttcttatgactagtggtgtggtgctgtgcgaaggtgtgaagtggctaagctttcactcggggtatgattttggctatttgattaagatactgaccaactctaacctacctgaggaagagctggactttttcgagattttgcggctattcttccccgtgatctacgacgtgaagtacctgatgaaatcctgcaaaaacctcaagggagggctccaggaggttgctgaacagttggagctcgagcggattggtccgcagcatcaggctgggagcgatagcctcctaaccgggatggcctttttcaagatgcgggagatgttcttcgaggatcatatcgatgacgctaaatattgtggccatttgtacggcctagggtctggctctagctacgtgcagaatgggacaggaaatgcatatgaagaagaagctaataagcagagttag

SEQ ID NO: 217403 - DNA, 126 bp, Artificial Sequence
  Description of Artificial Sequence: Synthetic coding sequence
atgcctgctgcgacagtcgaccactctcaaaggatttgcgaggtgtgggcttgtaatctcgacgaggagatgaagaagatcagacaggtgattcggaagtataactatgttgcaatggatacatag

SEQ ID NO: 217404 - DNA, 735 bp, Artificial Sequence
  Description of Artificial Sequence: Synthetic coding sequence
atgcctgccgcaaccgtggatcacagccaacgcatttgtgaggtctgggcttgtaacctcgatgaagagatgaagaagatccgacaggtaatacgtaaatataattacgtggcaatggatacggagttccctggagttgttgcacgaccaattggggaattcaggagcaatgctgactaccaatatcagcttctgcggtgtaatgtggatctgttgaaaattatccagctgggtttaacattcatgaacgagcaaggagaatatcccccaggaacttccacatggcagttcaatttcaagttcaatctcaccgaagacatgtatgcccaggactccattgaactgctgacgacatccggaatacagtttaaaaaacatgaagaagaaggtatagaaacccagtactttgccgagctgcttatgaccagcggggtagtcctgtgtgagggtgtaaagtggctcagttttcatagtggctacgacttcggatacttgattaaaatattgacaaattcgaacttgcccgaggaagagctagacttctttgaaatcctccgactgttcttccccgtcatttatgatgtcaaatacttgatgaagtcctgtaaaaatctgaaaggtggacttcaagaggtcgctgagcagctcgagttggagcggattggcccacagcaccaggccggatctgattccctgttgacaggtatggctttttttaaaatgcgggaggtgtag

SEQ ID NO: 217405 - DNA, 444 bp, Artificial Sequence
  Description of Artificial Sequence: Synthetic coding sequence
atgcccgctgcaactgtggatcatagccaaaggatatgcgaagtgtgggcatgtaacttagatgaggagatgaagaagattaggcaggtcatacgcaagtacaactacgttgcaatggacacagagtttccgggagtggttgcacgcccaattggcgagttcaggtccaatgctgattaccagtaccagttgctccgctgtaatgtggatctcttgaagatcattcagctggggttgacctttatgaatgaacaaggggagtacccacccggtacatctacgtggcaatttaatttcaagtttaatctgaccgaagatatgtacgcccaggattccatcgagctgcttaccacaagcggtatccagtttaaaaaacacgaggaggagggaattgaaacccagtattttgcagagttactgatgacttccggagtggtactttag

SEQ ID NO: 217406 - DNA, 879 bp, Artificial Sequence
  Description of Artificial Sequence: Synthetic coding sequence
atgccagctgctctcgtcgagaactcacaggtgatatgtgaagtgtgggcatccaatttggaggaggaaatgcgaaagatcagagaaatcgtcctttcctattcgtacatcgccatggacactgagtttccaggggtagtagttcggccaattggagagtttagatcatctatcgactaccagtatcagctcctccgctgcaacgttgatctcctgaaaataatccaactggggcttacatttaccaacgagaagggggaatacccttctggaataaatacctggcagttcaattttaagtttaatctaacagaagatatgtactctcaagacagcatcgatcttctcgccaactctggcctgcagtttcagaagcacgaagaggagggcatcgatactctgcatttcgcagaactgctgatgacctctggtgtggttctttgcgacaatgtgaaatggctgtcattccattctggctacgactttggctatatggttaaactgttaacagattccaggctccctgaggaggaacatgaattttttcacattctcaatctcttcttccccagcatctacgatgtaaaatatctcatgaaatcatgtaaaaacctgaaggggggtcttcaggaagtcgctgaccaactggacttacagaggatcggaaggcagcatcaggcaggatcagactccctactcactggaatggcctttttccgcatgaaagagctctttttcgaagattccattgacgacgccaaatattgtggccgactgtacggcctcggcacaggtgtggcacagaagcagaatgaggacgtcgattctgcccaggagaaaatgtctatcctcgcaatcatcaataacatgcagcagtag

SEQ ID NO: 217407 - DNA, 879 bp, Artificial Sequence
  Description of Artificial Sequence: Synthetic coding sequence
atgcccgctgcacttgtcgagaactcccaggtgatttgcgaggtgtgggcgtcaaacctggaggaggagatgagaaagatcagagagatagtcctatcatactcttatattgccatggataccgagttcccgggtgtggtcgtgaggcctatcggcgaatttcgttcatccatcgattaccagtatcaacttctcaggtgcaacgtggatcttctgaagatcatccagcttggccttacctttactaacgagaagggagagtaccccagcggcatcaatacttggcagttcaacttcaaattcaatctcaccgaggacatgtactctcaggacagcattgatctgctcgcaaattctggcctccaatttcaaaagcacgaagaggaaggcatcgatacattgcatttcgctgaactgctaatgacatctggggttgtgttgtgcgataacgtgaagtggctgagctttcactccggctatgattttggatatatggtaaagttgctgactgactcacggcttcctgaggaagaacatgaattcttccatatactgaatctgtttttcccttcaatctacgatgtgaagtatcttatgaaatcttgtaagaacctgaaaggtgggcttcaggaagtggccgaccagttagacctgcagagaattgggagacagcatcaggccggaagcgattctctgcttacaggaatggctttcttcaggatgaaagaacttttcttcgaagactcaattgatgacgccaagtattgcggaagattatacggtctcggcactggggtggcgcagaaacagaatgaggacgttgactctgcacaggaaaagatgagtatcttggctatcattaacaacatgcagcagtag

SEQ ID NO: 217408 - DNA, 357 bp, Artificial Sequence
  Description of Artificial Sequence: Synthetic coding sequence
atgcccgcagccttggtggaaaacagccaagtgatttgcgaggtttgggcaagcaacctggaagaggagatgagaaaaatccgggaaatagttttgtcctattcatacattgcgatggacaccgaattccccggagtggtggtcagacccattggcgaatttaggagctcaatcgactaccagtatcagctgctaagatgcaacgtagatctgctgaagatcatacaattgggactcaccttcacaaatgagaagggggagtacccttccggaataaatacatggcagtttaattttaagtttaacctcactgaggacatgtacagccaggacagtattgacctcttagccaattag

SEQ ID NO: 217409 - DNA, 879 bp, Artificial Sequence
  Description of Artificial Sequence: Synthetic coding sequence
atgcccgcagcgctcgtagagaactcccaggtgatttgtgaggtgtgggcaagtaatctagaggaggaaatgcgcaagataagagagattgtactctcatactcatatattgccatggacacagagtttccaggcgtggtagtcagacctattggagaatttcggagcagcatcgattatcagtaccagctgctccgatgtaacgtggacttgttgaagattatacaactgggattaactttcacaaatgaaaaaggtgaatacccttctggcatcaatacctggcagtttaattttaagtttaacctgaccgaagacatgtactcccaagactctatcgacctgctagccaactccgggttacagtttcagaagcacgaagaggaggggattgacaccctgcacttcgccgaactccttatgacatccggcgtggttttgtgtgataacgtgaagtggctgtcttttcactctggatacgattttggttacatggtgaagctgcttacagactcccgccttcccgaggaagagcatgagttttttcatattctgaaccttttttttcccagtatctacgacgtcaagtacctgatgaagagctgtaagaacctgaaaggagggctgcaagaagtggcagaccagctagatctccagaggattggtcggcaacatcaggcgggatccgactcattactgacgggtatggctttctttcgcatgaaagagcttttcttcgaggacagcatcgacgacgccaagtattgcggtcgactctatggactaggcacaggagtcgcgcagaagcaaaatgaggacgttgactcagcccaggagaagatgagcattctggccatcataaataacatgcagcagtag

SEQ ID NO: 217410 - DNA, 168 bp, Artificial Sequence
  Description of Artificial Sequence: Synthetic coding sequence
atgcccgcagccttagttgagaacagccaggtgatttgtgaggtgtgggcctcgaatcttgaagaagaaatgcggaagattcgggagatagtcctttcatatagttatatcgctatggatactgagttccctggggtagtggttagaccaatcggcgagtttagatag

SEQ ID NO: 217411 - DNA, 678 bp, Artificial Sequence
  Description of Artificial Sequence: Synthetic coding sequence
atgccagccgctctggttgaaaactcacaggtcatttgtgaggtatgggccagcaacctcgaggaagaaatgcgcaagattagagaaatcgtgctcagctacagctatatcgccatggacacagagtttcccggagtcgtcgtgagacctattggcgagttccggagtagcatcgactatcagtaccaactgttacgatgtaatgttgatctgctgaagatcattcagctgggccttactttcacaaacgaaaaaggggagtatccaagtgggatcaatacctggcagtttaactttaaatttaacctgaccgggtacgacttcggatacatggtgaagttattgacagactcccgcctacccgaggaagaacacgaattttttcacattctgaacctcttctttccttctatttacgatgtcaaatatttgatgaagagttgtaagaatctgaaggggggactacaagaagtcgccgatcaactggacctgcagaggattggtcgccagcatcaggctgggtcagatagcctgttgacaggtatggcctttttcaggatgaaggagttgttttttgaggattccatagacgacgctaaatactgcggcagactttatgggttggggacgggcgtggctcagaaacagaatgaagatgtcgattccgcccaggaatag

SEQ ID NO: 217412 - DNA, 360 bp, Artificial Sequence
  Description of Artificial Sequence: Synthetic coding sequence
atgccagctgctctggtcgagaattctcaggtgatttgtgaggtgtgggcctccaatctcgaggaggagatgcgaaaaattagagagattgtgcttagctactcttacatagccatggatacagaattccctggcgtagtcgttagacccattggcgaatttcggtcaagtattgactaccagtaccagcttttacgctgcaatgtagatcttttaaagatcatacagctgggtttaaccttcacaaatgagaagggggaatacccctccgggattaatacatggcagtttaatttcaaatttaacttaaccgaggatatgtattctcaggacagcatcgatctcctcgccaattcttag

SEQ ID NO: 217413 - DNA, 717 bp, Artificial Sequence
  Description of Artificial Sequence: Synthetic coding sequence
atgccagcagcattagtggagaactctcaggtgatttgcgaggtgtgggcaagcaacctggaagaagaaatgaggaaaatcagggaaatcgtactctcatattcctatatagccatggacacagagttccctggcgtggtcgtaagacctatcggcgaatttaggtccagcatcgactaccagtaccagctactcagatgtaatgtggacctgttgaaaattatccaactggggctcactttcacgaacgaaaagggtgaataccctagcggcattaacacctggcagttcaactttaaatttaacctgactgggtacgactttggttatatggtgaagctgttgacagattccagattacccgaagaggaacacgagtttttccatatcctgaatttgttctttccatcgatttacgatgtgaagtatcttatgaagagctgcaagaatctgaagggcggactccaagaagtggcagaccaattagacctgcaaagaatagggcgtcagcaccaggccggttccgactccctgctgacgggaatggctttctttcggatgaaagaattgttctttgaggactccatcgacgacgctaagtactgtgggaggctgtacggcctcggcactggggtagcccaaaaacagaacgaagacgttgactctgcccaagagaagatgtcaattctcgccatcataaataacatgcagcagtag

SEQ ID NO: 217414 - DNA, 168 bp, Artificial Sequence
  Description of Artificial Sequence: Synthetic coding sequence
atgccagcagcactggtagagaattcgcaggtcatctgtgaggtgtgggcatctaaccttgaagaagagatgaggaagattcgggaaatcgtcctttcttactcttatatagctatggacacagagttcccaggtgtcgtcgtacggccaattggcgagtttcgttag

SEQ ID NO: 217415 - DNA, 258 bp, Artificial Sequence
  Description of Artificial Sequence: Synthetic coding sequence
atgtattcacaggatagcatcgacctcctggctaacagcgggttacaatttcagaaacacgaagaggaaggtatcgacacattacatttcgcggagttgctcatgacctccggagtcgttctctgtgacaacgtgaaatggcttagctttcactccggctacgatttcggttacatggttaagctccttacagattcaagactacccgaagaggaacacgaattctttcacattctgaacctgttcttcccatcttag

SEQ ID NO: 217416 - DNA, 402 bp, Artificial Sequence
  Description of Artificial Sequence: Synthetic coding sequence
atgccggctgccttggtagagaattctcaggtgatctgcgaagtgtgggcctctaatttggaggaagagatgcggaaaattcgggaaattgtgctgtcatactcatacatagccatggacacagagtttccaggagtcgtcgtccgccctatcggagaattcagaagctccatcgactaccagtatcagctgctgagatgcaacgttgacctattaaagatcatacagctgggcctgacctttaccaatgaaaaaggggagtatccctctggaattaacacttggcagtttaacttcaaattcaaccttactgaggatatgtattctcaggattccatcgatttactggcgaattccgggcttcagtttcagaagcatgaagaggaaggcatcgatacttag

SEQ ID NO: 217417 - DNA, 561 bp, Artificial Sequence
  Description of Artificial Sequence: Synthetic coding sequence
atgtacagtcaggactccatcgacctgttggcaaacagcgggctacaatttcagaagcatgaagaggagggcatcgacacattgcacttcgccgaactgctgatgaccagcggcgtggttttgtgcgacaacgtaaagtggctaagctttcacagtggatatgactttggctatatggttaaactgctcaccgactcccgcctgccagaggaagagcatgaattttttcacattttgaatctcttcttcccgtccatttacgacgttaagtatctgatgaagagctgtaagaatctgaagggcggactacaggaggttgcagaccagctagacctccagcggattggcagacagcaccaggcgggtagcgacagcctccttacaggaatggcattcttccgcatgaaagaattgtttttcgaagactctatagatgatgccaagtactgcggacggttatatgggctgggcacgggcgtggcccagaagcagaatgaggacgttgatagcgcgcaagagaagatgtctatcctggctatcatcaacaacatgcaacagtag

SEQ ID NO: 217418 - DNA, 561 bp, Artificial Sequence
  Description of Artificial Sequence: Synthetic coding sequence
atgtattcacaggactccatcgacctgttagcaaacagcgggttacagtttcaaaaacacgaggaggagggcatagataccctacactttgcagagttgctcatgacttccggtgttgtactctgcgataatgttaaatggttgtcattccatagtgggtatgacttcggctacatggttaaactgctgacagattcgcgcctgccagaagaggagcacgagttctttcacatcctgaacctttttttccctagcatttacgatgttaagtacctcatgaaaagctgcaagaatctcaaagggggattgcaggaagtagccgatcagctggacctgcagagaatcggaagacagcatcaagccggttccgactccctgctgactggtatggccttcttcagaatgaaggaattatttttcgaggattccatagatgacgcaaagtactgcggtcggttatacgggctaggcacgggggtcgcccaaaagcagaatgaagatgtcgattccgcacaggaaaagatgagcatattggcgatcatcaacaacatgcagcagtag

SEQ ID NO: 217419 - DNA, 561 bp, Artificial Sequence
  Description of Artificial Sequence: Synthetic coding sequence
atgtatagccaggactctatcgatctactggcaaactccggacttcaatttcagaagcacgaggaggagggcatcgacactctgcacttcgcagaactcctcatgacatctggcgttgtgctgtgcgacaacgttaaatggctgagcttccactcgggatacgattttgggtatatggtcaaactgctgaccgacagccgacttcctgaagaagagcacgaatttttccatatactgaatctgttttttccaagcatttacgacgtgaagtacctgatgaaatcatgtaaaaatcttaaaggcggactgcaggaggtggccgaccagcttgacctgcaacgcatcggcagacagcaccaagcagggtcagatagtcttttgaccgggatggcgttctttagaatgaaagagctgtttttcgaggatagtattgacgatgcgaagtactgcggacgactctacgggctcggcacaggtgtggcccagaagcaaaatgaagatgtcgactctgcccaagaaaagatgtctattctggccataattaacaacatgcaacagtag

SEQ ID NO: 217420 - DNA, 366 bp, Artificial Sequence
  Description of Artificial Sequence: Synthetic coding sequence
atgcccgcagctttggtggagaattctcaagttatatgcgaagtgtgggcgtcaaacctcgaggaggagatgcggaagattagagagattgtgttatcctatagctacatagctatggatacagagtttcctggagtggtggtgagacccatcggcgagtttcgatcatcaattgattaccagtaccagctgcttaggtgcaatgtcgacctgctgaaaatcattcagctgggcttgacatttacgaacgaaaagggcgaataccctagcggcatcaacacctggcagttcaattttaaattcaacttgaccggttatgacttcgggtatatggtaaaattgctgacagatagtcgattgccatag

SEQ ID NO: 217421 - DNA, 561 bp, Artificial Sequence
  Description of Artificial Sequence: Synthetic coding sequence
atgtactctcaagactctatcgacctgctggccaacagcggcctgcagttccagaaacacgaggaggagggtatcgacactcttcatttcgccgagctgctgatgacaagtggcgtggtgctctgcgataatgtcaaatggttgagctttcattcgggatatgacttcgggtacatggtgaaactgctcaccgactcaaggctgccggaagaagaacacgagttcttccatattcttaatctgttctttccttcaatctatgatgtcaagtacctgatgaaatcatgtaagaacctgaaggggggtctgcaagaggtggccgatcagctggacctgcagaggattgggaggcagcatcaagccggttctgattccctgctcacagggatggctttttttaggatgaaggagctcttctttgaggattcgattgatgacgccaaatactgtggccgactctatggactcgggacgggagtcgctcagaaacagaatgaagacgtggactctgctcaggagaagatgagcatcctggcaataatcaataacatgcagcagtag

SEQ ID NO: 217422 - DNA, 387 bp, Artificial Sequence
  Description of Artificial Sequence: Synthetic coding sequence
atggtgaaactgctcaccgatagtagattacccgaggaggaacatgagttcttccatattctgaacctgtttttcccctccatatatgacgtgaagtacttgatgaaaagttgtaaaaacttaaaaggtggactgcaggaggttgcagatcagctcgaccttcagaggataggcagacagcaccaagctggtagcgactctctcttaacagggatggccttcttccgaatgaaggaactgttttttgaggacagtatcgatgacgctaagtactgcgggaggttatacggacttgggactggagtcgctcagaaacaaaacgaggacgttgacagtgcgcaggaaaaaatgtcgatactagccattatcaataacatgcaacagtag

SEQ ID NO: 217423 - DNA, 810 bp, Artificial Sequence
  Description of Artificial Sequence: Synthetic coding sequence
atgcgcaagatacgcgagatcgtgctaagctacagttacattgcaatggacacagagtttcctggcgtggttgtgcggccaattggcgaatttaggagtagtattgattatcaatatcagttattgcgatgcaatgtggatctcctgaagatcatccaactgggtttgacctttactaatgaaaagggtgaatatccgtctgggatcaatacatggcagttcaatttcaagttcaatttaaccgaggatatgtatagtcaagacagtatagacttgttagcaaattctgggctgcaatttcaaaaacacgaggaggaggggattgatacactgcacttcgccgagctgctgatgacttcaggcgtggtgctgtgtgacaatgtcaagtggctgtcatttcattccggttacgactttggctatatggttaaattgctgactgattctagactaccggaggaggagcacgaattttttcacattttgaatttgttttttcccagcatatacgacgtcaaataccttatgaaaagctgcaaaaacttgaaaggcggactacaggaggttgctgaccagctagatttgcaaaggatcggacgccaacatcaggccggaagcgactccctgttaaccggcatggctttttttagaatgaaggagctgttcttcgaggactctatcgatgacgccaagtactgtggcagactctacggtctggggactggggtagcacagaagcagaacgaggatgtggatagtgcgcaggagaagatgagcatcttggctatcatcaataatatgcaacagtag

SEQ ID NO: 217424 - DNA, 4338 bp, Artificial Sequence
  Description of Artificial Sequence: Synthetic coding sequence
atgcaaggcccaccactccttacagccgcacacctcctgtgcgtctgtaccgccgctttggctgtagcgccagggcctagatttctcgtgactgcaccaggaatcattagacccggagggaatgttacgataggtgtggagctgctcgagcattgtccctctcaagttacggtgaaggctgagctcctgaagacagcgagtaacctcaccgtcagtgttctcgaggccgagggggtttttgagaaaggaagctttaaaacacttactttgccttcactccctctgaattccgcggatgagatttatgaactccgggttacagggagaacccaggatgaaattctgttttcgaattctacaaggttgagtttcgagactaaacgcatctctgtattcattcagaccgataaggccttatataaacctaaacaagaagtaaagtttcggattgttactcttttctccgactttaaaccatataaaaccagtctgaacatccttatcaaggaccctaaatccaatctcatccagcaatggttaagccagcagtcggatctcggtgttatctccaagacatttcagctatcctcacaccccatcctgggcgactggagtatccaggttcaggtgaacgaccaaacatactatcagagtttccaagtgtctgagtatgttctacccaagttcgaggttaccctacagactccattgtattgcagtatgaattcgaaacacctgaacggcacgattacagcaaaatacacctacggtaaacccgtgaagggcgacgtgacattgacctttctcccgctctccttctggggcaaaaagaagaacatcaccaaaacattcaagataaacggaagcgccaactttagcttcaatgatgaggaaatgaagaacgtgatggatagctcgaacggcctttctgaatacctcgacctgtcgtcccccggacccgttgaaatcctcaccacggttacagagagtgtgacagggattagtcgtaatgtttctacaaacgtcttttttaaacagcatgattatattattgagtttttcgattatacaaccgtcctgaaaccatctttgaactttaccgcaaccgtcaaggtcactagggccgatgggaaccagctcacactcgaagagcgcaggaataacgtggtgataacagtgacacagagaaattataccgaatattggtcaggcagcaatagcgggaaccaaaaaatggaggccgtccagaaaattaactacactgtgcctcagagcggtacattcaaaattgagttccctatccttgaggacagcagcgagttacagctgaaggcttacttcttgggcagcaaatcctccatggccgtccattcccttttcaagagtccatccaagacctacattcagctcaagactcgagatgaaaatatcaaggttggctcaccgtttgaattggtggtcagtgggaacaaacgcctcaaagagctgagttacatggttgtctcccggggacaactcgtcgccgtcgggaaacaaaattctaccatgttctcgttaactcctgaaaactcctggacccccaaagcgtgtgtcatcgtttattacatcgaggacgacggagaaatcatcagcgacgttctgaaaataccggtacaactggtgttcaaaaacaaaatcaagctgtattggtccaaagtgaaggctgaaccctccgaaaaggtgagtctacgcatcagtgtcacccagccagactccatcgtggggatcgttgccgtggacaagtcggtgaaccttatgaatgcgagcaacgatatcaccatggagaacgtggtccacgaactagagctgtacaatacaggctattatctggggatgtttatgaacagcttcgcagtgttccaagaatgtggactgtgggtgcttaccgatgccaacttaaccaaagattacattgatggggtctacgacaacgcagaatacgctgaaaggttcatggaggagaacgaggggcacatagtcgatattcacgactttagccttggcagtagcccccatgtgcgtaaacatttccccgagacatggatctggcttgacaccaatatgggatatcgcatttatcaagaatttgaggttacagtccctgactctattacgtcttgggttgctacaggcttcgtcatctccgaggatctcggactgggattgaccactacgcctgtcgagctacaggccttccaaccattcttcattttcctgaacctcccttacagcgttatacgtggagaggagtttgccctggaaatcacaatcttcaactatttgaaggatgccactgaggttaaggtgatcattgaaaagtccgataagttcgacatcctgatgacctccaacgaaatcaatgctaccggccaccagcagacacttctagtgcccagcgaggatggagccactgtgctctttcctatcaggccaacacatcttggcgaaatacctattaccgtcactgctctgtcccccaccgccagtgatgccgttactcagatgatactggtgaaggcagaaggcattgagaaatcatactcccagagtatcctgttggatctgactgacaaccgcctacagtctaccttgaagaccctgtccttcagcttccctccaaacaccgtaacagggagtgagcgcgtccagatcaccgccataggcgatgtcctgggcccatctatcaatggcttagcatctctaatacgaatgccatacggttgtggcgagcagaatatgataaattttgcccctaatatatacattctggattacctcacaaaaaagaagcaacttactgataatctaaaagagaaagctctgtccttcatgcgtcagggttaccaaagagaactactgtatcagcgggaggatggaagctttagcgctttcggcaactatgatccatctgggagtacgtggctgtccgcctttgttctccggtgttttctggaagctgacccatacatcgacatcgaccagaacgttttgcatagaacctacacgtggttaaagggccaccagaagtccaacggcgaattctgggaccccggtagagtaatccacagtgagctccaggggggaaataaaagcccggttaccttgactgcatatatcgttaccagcctgctgggttatcggaaataccaacccaacatagatgtgcaggagtctattcatttcctggagtcagagttcagcagaggcatctcagacaactatactctagctctgattacatatgcacttagctcagtcggatcccccaaagccaaagaggcgcttaatatgctgacttggcgcgctgagcaggagggcggaatgcagttctgggtctcaagcgagagtaagttaagtgacagctggcaacccagatcactggacattgaagttgcggcttatgctttgctgtcccatttcctccagtttcagacatccgaaggaattcccattatgaggtggttgtccaggcagcggaacagtctgggcggttttgctagcacacaggacaccaccgtggctctgaaagctctatccgaatttgccgctttaatgaacacagaaaggaccaacatacaggtcacggtgaccggaccttcatccccgtcacccgtcaagtttcttatcgatacacacaatcggctgctgctccagacagccgagctcgccgttgttcagcctacggccgtgaatattagcgccaatgggttcggcttcgcaatatgccagctgaatgtggtgtacaatgtgaaagcatctgggtcgtcccggaggcggcgtagtatacagaatcaggaggctttcgacctcgatgtagctgtcaaagaaaacaaagacgacttgaaccatgtggacttgaatgtctgcacgtccttctctggacctgggcgatcaggcatggccctcatggaggttaatctgctttccgggttcatggtgccaagcgaggcaatctctctgtctgaaacagtgaagaaagtagagtatgatcatggaaagctgaatctgtatcttgattctgtgaatgagacccagttctgcgtcaatattccggctgtgagaaactttaaggtgtcaaacacccaagacgcatctgtaagtatcgtggattattacgagcccagacgtcaggccgttcgttcttacaattcagaagtaaaactgtcaagctgtgacctgtgctcagatgtccagggatgtaggccctgcgaagacggcgcttcaggatctcaccaccattcttccgtgatcttcatcttttgctttaagttgctgtacttcatggagttatggctgtag

SEQ ID NO: 217425 - DNA, 4107 bp, Artificial Sequence
  Description of Artificial Sequence: Synthetic coding sequence
atgcaggggccaccattacttacagctgcccacttactgtgcgtgtgtaccgcggctcttgcagtggctccagggcctcgcttcctcgtgacagcccctggcattatccgccctggcggaaacgttactataggcgtcgagctgctcgaacattgcccctctcaggtcactgtaaaagcagagctgctgaaaacggcctctaatcttactgttagcgtgctggaggcggagggtgtctttgagaaagggagtttcaagacactgacattaccatcagatcctaagtctaatctgattcaacaatggctcagccagcagagcgacctgggcgtcatctcaaaaacgttccagctctcaagtcatcctattctgggggattggtctattcaggtgcaggttaacgatcagacctactaccagtcctttcaggtgagcgagtatgtgctgcctaagttcgaagtcacgctccagacaccactgtactgctccatgaatagtaaacacctgaacggtacgatcactgcgaagtacacctacggaaaacctgtgaaaggcgacgtgaccctcacgttcctgcccctgagcttttggggcaaaaagaaaaacattaccaaaacttttaaaattaacggatctgccaacttctcctttaatgatgaagagatgaaaaacgtgatggactcatctaacggcctcagtgaatacctggatctcagctctccaggccctgttgagatcttgacgacagtcacagagagcgtgaccggaattagccggaatgtatcaaccaatgtattctttaagcagcatgattacattatagaatttttcgactatacaactgtgctcaagccttccctgaatttcactgcaacagtgaaagtgactcgggctgacggaaaccagctgacattggaggagcgacgcaacaacgtcgtgattactgtgacgcagcggaattataccgagtactggtccgggagtaattcaggtaatcagaaaatggaggcggtccaaaaaataaactatactgtccctcagagcggcacattcaagattgagtttcccattttagaagattcaagtgagctacaactcaaagcgtacttcttggggtcgaaatctagtatggctgtgcacagtttgttcaaatccccgtcaaagacgtatatccaattgaagacccgcgacgaaaacatcaaggtcgggagtccgttcgagctagtggtgagcggcaacaagagactaaaagaactgtcgtacatggttgtgtccaggggacagttagtggccgtggggaagcagaattcgactatgttctccctaacgccggaaaatagctggacccccaaggcttgtgtgatcgtgtactacattgaggacgatggcgagatcatctcagatgtgctcaagatccctgtgcagttagtgtttaaaaataagattaagttatactggagcaaagttaaagcagagcccagcgaaaaagttagcctgagaatcagcgtgactcagcctgactctatcgtgggaattgtcgccgtcgataaatccgtgaatctaatgaacgcgtctaatgacatcacgatggagaacgttgtacacgaactcgaattatataatacgggctactatctggggatgttcatgaattcctttgccgtcttccaggaatgcggactgtgggtcctgacagacgctaacctgacaaaggactatatcgatggggtttatgacaatgcagaatacgccgagcgctttatggaggagaacgagggtcacatcgtggacatacatgattttagtctgggttctagtcctcatgtgcgaaagcatttccctgagacatggatttggttggatactaatatgggctatcgtatctatcaggagttcgaagtgactgtccctgactcaatcacgtcttgggtggccaccggtttcgtcatctctgaggacctcggcctgggactgactactactcccgtcgaactgcaggcatttcaaccattcttcatcttcctaaacctgccatactctgtcataagaggcgaagagtttgcgctggaaatcacaatcttcaattacctgaaagacgcgacagaggtcaaggtaatcattgagaagtcagacaaatttgatattctgatgacttcaaatgaaatcaacgccaccggccaccagcaaacgctgctggttccgtccgaggacggagccactgtactgtttccaattaggcccacccatctgggcgaaattccaattaccgtgacagcactgagccccacagcaagtgacgcagtaacgcagatgatattggtgaaagctgaagggattgagaagagctacagccagtcaatactgctcgatctgactgacaatcggttacagagtaccctcaagaccctctcattttcttttcccccaaacactgtgacaggaagcgagcgcgtgcagataacagccatcggggatgtcctgggcccatcaattaacggtctggccagtctcatcagaatgccctacggatgcggagaacaaaatatgatcaattttgctcccaacatatatatccttgattatctgaccaagaaaaaacagctgaccgacaatttgaaggaaaaagctttgtcattcatgaggcagggttaccagcgagaactattgtaccagcgagaggacggcagcttctccgcttttgggaattatgatccatcgggctctacctggttatccgcgttcgtgctgagatgctttttagaagccgacccatacattgatattgaccaaaatgtgctgcatagaacctacacttggctaaagggccatcaaaaaagcaacggggagttttgggatcctggccgagtaattcattctgaactgcaaggcggaaacaagtcaccagtgaccttaacagcttacattgttacaagcctgctaggttaccggaagtaccagcctaacatcgatgttcaggaatccatccacttcctagagtcagaattcagtagggggattagcgacaattataccctcgcccttataacatatgcactttcttctgtggggtcaccaaaagctaaagaggctcttaacatgctgacctggcgtgctgagcaggaggggggaatgcagttctgggtaagtagcgagtcaaaactctccgattcttggcagcccaggagtttggatatagaagtggcagcatacgctctgctgagccattttctgcagtttcagacaagcgagggaattcccattatgcgatggctttcacggcagagaaatagccttggtgggtttgcctccacccaggacacaaccgtggcgctgaaggctttaagtgagtttgccgcactcatgaacaccgagcgtaccaatatccaggttacagtgacgggtcccagctccccctccccggttaaatttctgattgatacacacaataggttgttgctccagactgcagagctcgctgtagtgcagcctactgcagtgaatatttcagccaatgggttcggcttcgcaatctgtcaactgaacgttgtctataatgtaaaagcatccggcagttctcggagaagacgtagtatccagaaccaggaggcatttgacctggatgtcgcggtgaaggagaataaagatgacctgaaccacgtggatctcaatgtctgcacctcattctctggcccagggcgtagtggcatggccttgatggaagtcaacctgctgtcggggttcatggtcccctccgaggctatttcactgtccgagacggtcaaaaaagtggaatacgatcatggaaaactaaacctgtatcttgattccgtgaacgaaacccagttctgcgtgaacatacccgcagtacgcaactttaaagtctcaaatacgcaggacgccagcgtttctattgtggattactacgaacctcgacggcaagccgtgaggagctataattctgaggtgaaactctcaagttgcgacctgtgctctgacgtgcaagggtgtcgcccttgcgaagacggagcatcaggctcccatcatcactcaagcgtcatctttattttttgcttcaaactgctttactttatggagttgtggctgtag

SEQ ID NO: 217426 - DNA, 4287 bp, Artificial Sequence
  Description of Artificial Sequence: Synthetic coding sequence
atgcaaggccctccgttacttacagcagcccacctcctgtgcgtatgtaccgctgctttggccgtcgctcccggacctagattcctggttactgccccaggtattatccgccctggtgggaatgttaccatcggggtcgagctcctggagcactgccctagccaagtgaccgtcaaagcagagcttctcaagacagcatccaatctgaccgtgtctgtcctcgaggccgagggagtgttcgaaaagggcagctttaagactctgacactgccttccttgccgctaaacagcgctgacgaaatatacgagctccgtgtcacgggccgtacacaagatgagatactgttctccaatagcaccaggttgtcttttgaaaccaagagaataagcgtcttcatccagactgacaaggctctgtacaagccaaaacaagaagtaaaatttcgaatcgttacgctattcagcgacttcaagccatacaagactagtctgaacatcctgatcaaagacccgaagtccaacctgattcagcagtggctctcccagcagtccgacttgggtgtaatttccaagactttccagctgtcatcccatcccatcctgggtgactggagcattcaggtgcaggtcaacgatcagacttactatcagagcttccaggtctccgagtacgtgctccctaaattcgaggtaactttacaaacgcctctctattgctccatgaacagcaagcacttaaacgggacaatcactgccaagtacacttacggaaagcccgtgaagggagatgtgacgttgaccttcctgccattaagcttctggggaaaaaagaaaaacatcaccaaaaccttcaagataaacggaagcgcaaatttctccttcaatgatgaagaaatgaagaatgttatggattcgagcaacggcctgagtgaatatctagatttgagtagtccagggccagtcgagattctgacaactgtgacagaaagtgtgacaggaattagcagaaatgtcagcaccaacgttttcttcaaacagcacgattacatcattgagttcttcgactatacaaccgtgttgaaaccctccctgaatttcaccgccaccgtcaaagtaacgagggctgacggaaaccagctgacattggaagagaggagaaacaacgtggtaatcactgttacacagcgcaattataccgaatattggagcggaagcaactccggtaatcagaagatggaagctgtacagaaaatcaattacacggttcctcagagtggtacgttcaaaattgaattcccaatactagaagatagcagcgagctgcaattgaaagcatattttttaggctccaaatccagcatggcagtccacagcctgttcaaaagcccaagcaaaacctatattcagctgaaaacgcgggacgaaaacattaaagttgggtctcctttcgagctggtggtgtccggtaacaaacgcttgaaggagctgtcatacatggtggtcagtagggggcagctcgtcgccgttgggaaacagaacagtaccatgttctcactcactcctgagaactcctggacccccaaggcctgtgtgattgtgtactacatcgaggatgatggagagattataagtgatgtgttaaagattcccgtgcagctggtattcaagaacaagattaaattatactggtctaaagtaaaggccgaaccgtcagagaaagtaagtctgcggatttctgtcacacagccagacagcatcgtgggcatagtggcagtagacaagtctgtcaaccttatgaacgccagcaacgacatcactatggagaacgtggtgcacgaactagaactgtataacactggctactatctgggtatgtttatgaactcattcgcagtcttccaggaatgcggactgtgggtactgactgacgccaacctcaccaaagattacatagatggtgtctatgataacgccgaatatgctgagagattcatggaggaaaatgagggacatatagtagatatccatgacttctccctaggctcatccccacatgttagaaagcactttccagagacttggatctggctggatacaaatatgggatatcgaatctaccaagaattcgaggtcactgtccccgattcgataacttcttgggtggctacagggttcgtaatcagcgaggacctgggtctggggctgacgaccacccctgttgagctccaggctttccagcccttttttatttttctgaatctcccttacagcgtgatcagaggggaagagttcgcgctggagatcactatattcaactacctgaaagacgcaaccgaggtgaaggtaataattgaaaagagtgacaagttcgatattctgatgacctcaaacgaaatcaatgcaactggtcaccagcagacactgctggtgccttccgaggacggagccaccgttctgtttcctattcgcccaactcatctgggtgagatacccattaccgtgactgctctgagccctaccgcgtctgacgctgtcacgcagatgattctggtgaaagcagaggggattgagaagtcttactcccagtccatcctgctcgacctgacggataacagactgcagtcaacgctgaaaaccctcagtttcagctttcccccaaatacggtgacagggagtgagcgggtgcagatcaccgcaattggggacgttctgggcccttccattaatggcctggcatctctgatccgaatgccctatggctgtggagagcagaatatgattaactttgccccaaatatatatattctggactatctgacaaaaaagaagcagctaacggacaacctgaaggagaaggcactaagttttatgaggcagggttatcaaagggaactgctgtatcagagagaagatggctcgttctctgccttcggcaactacgatccatcgggctccacatggttatccgcctttgtactgagatgtttcctcgaagccgatccttatattgatattgaccagaacgtcttgcacagaacttatacatggctgaagggtcaccagaaatcgaacggcgagttttgggaccctggcagagtcattcactccgaattgcagggtggaaacaaatcgccagtgacacttacagcctatatcgtgacatctctcctcggctacaggaagtatcagcctaatatcgatgttcaagagagtattcactttttagagagtgagttttcacgtggcatctctgataattataccctggcattaattacttatgccctctcttccgtgggctctccaaaggctaaagaagccctcaacatgctcacatggagagcagagcaggaaggaggcatgcagttctgggtctccagtgagtcgaagctgtctgattcttggcaaccgagaagcctggatatagaggtggcagcctacgcgcttcttagccacttcctccagtttcagacctccgaaggaatcccaatcatgagatggctctctcgccagcggaacagtctcggcggatttgcctctactcaggacacaacagttgccctgaaggctctgtccgagtttgcagccctcatgaacaccgagcgcaccaacatccaggtcaccgtgaccggcccttcttctccatcccctttagcagttgtccaaccaacggccgttaacataagtgccaacgggtttggttttgcaatctgccagttaaatgtggtgtataatgtgaaagcatcagggtcgtctcgacgccgtagaagcatccagaatcaggaagctttcgatttggatgtcgcggtcaaggagaacaaggacgacctgaatcatgtcgacctgaacgtctgtaccagtttttcagggccaggtcgtagtgggatggccttgatggaagttaacctgctgagcggattcatggtgcccagcgaggccatcagtttgagtgaaactgttaagaaagtcgagtacgatcacggtaaactgaacctctatctcgattcagtgaacgagacccagttctgcgtgaatattcccgctgttaggaactttaaggtttccaatactcaggatgccagtgtgagcattgtagattactacgagccgaggcgacaggccgtccggagttataactcagaggttaaactgtccagctgtgatttgtgcagtgacgttcagggttgtcgcccttgcgaagatggcgcttctggctctcatcatcacagttcagtgattttcatattttgtttcaaacttctgtactttatggaattgtggctctag

SEQ ID NO: 217427 - DNA, 762 bp, Artificial Sequence
  Description of Artificial Sequence: Synthetic coding sequence
atgggggaattcaacgagaagaaaacaacttgtggcaccgtctgtctgaaatacctgctcttcacatataattgttgtttctggctggcaggcttagcagtcatggcagtcggcatttggacgctggcactgaagtcagactacatctcactgttagcgagcggcacttatcttgcaaccgcctatatcctggtagtggccggaacagtggtgatggtcacgggggtcctggggtgctgtgctacattcaaggagcgcagaaatttactgagactgtacttcatccttctgctaatcatatttctcttggaaatcatcgccggtattctggcgtacgcgtattatcagcagcttaacaccgagctaaaggaaaacctcaaggatacgatgactaagcgctaccatcagcctggccatgaggccgtgaccagcgccgtggaccagctccagcaggagttccactgctgtgggtccaacaattcccaggattggcgggattctgaatggatacgctcccaggaggcgggtgggagagtcgttcctgactcatgctgcaagacagtcgtggccctctgcggtcagcgtgaccatgcaagtaacatttacaaggtggagggcggatgcattaccaaattagaaacttttatccaggagcatttgcgggttataggggctgttggaatcgggatcgcctgcgtgcaggtgttcgggatgatttttacctgctgtctgtatcggtcgttaaaattggaacattattag

SEQ ID NO: 217428 - DNA, 762 bp, Artificial Sequence
  Description of Artificial Sequence: Synthetic coding sequence
atgggagagttcaatgaaaagaagaccacctgtggtaccgtctgcctgaagtatctgctatttacatataattgttgtttctggctggcagggcttgctgttatggctgtggggatctggaccctagcgctgaaatctgactacatttcactgctggcctcgggtacatatctggccacggcatacatcctggtcgtagccggaacagtcgtcatggtgactggggtgttaggctgctgtgccacatttaaagagaggcggaatctcctccgtctgtatttcatcctcctgctgatcattttcttattagaaatcatcgccggtatcttggcatacgcctactaccaacagttaaacactgaactgaaagagaatctgaaggatacaatgacaaaacgctaccatcagcccggacacgaagccgtgacgagcgccgtggatcagctgcagcaggagttccactgctgcgggtcaaataattcgcaggactggagggattccgaatggatccgcagtcaggaggcaggaggcagagtggtgccggacagctgctgcaagactgtcgtggccctgtgcgggcagagggatcacgcttcgaacatttacaaagtggagggagggtgcatcacgaaactggaaacctttattcaggaacacctgcgagtcattggtgcagtgggaattggcattgcttgcgtgcaagtgtttgggatgattttcacctgctgcctataccgatcgctaaagctagaacactactag

SEQ ID NO: 217429 - DNA, 762 bp, Artificial Sequence
  Description of Artificial Sequence: Synthetic coding sequence
atgggggaattcaacgaaaagaagacaacatgtggtactgtgtgcctgaagtaccttttgttcacttacaactgctgcttttggctggcagggctcgccgtgatggcagttggcatctggaccctggctcttaagtctgactacatcagcttgttagccagtgggacatacttagcaactgcatacatcctggtggttgcaggcactgtggtaatggtcactggagtcctggggtgttgcgccacatttaaggagaggcgcaatctgctgcggctgtactttatccttctgctcattatatttctgttggagatcattgctgggatcctggcttatgcctactatcagcagttgaatactgagctgaaagaaaacctaaaggacaccatgaccaagcgatatcatcagccgggtcacgaagccgtgacgtcagcagttgaccaactgcagcaggagttccactgttgtggatcaaataatagtcaggactggagagactctgagtggatcaggagccaggaagccggtggacgtgtcgttcctgactcttgttgcaaaacagtggtggcactgtgcggccagagagaccacgcgtcgaatatatataaggtggaaggaggatgtattacgaaactggaaacttttatccaggaacacctcagggtgattggagccgtcggaattggtattgcctgcgtccaggttttcggaatgatattcacttgctgtctctacagaagcctcaaactggaacattattag

SEQ ID NO: 217430 - DNA, 543 bp, Artificial Sequence
  Description of Artificial Sequence: Synthetic coding sequence
atgggcgagtttaatgagaagaagaccacttgtggcacagtgtgcttgaaatatctgctgttcacatataattgctgcttctggctcgctggcttagccgtgatggcggtgggcatttggactttagccttgaagtctgattacatttccctcctggcgtctgggacttaccttgccactgcctatatcctcgtggtagccggtacagtcgttatggtgactggtgtgctgggctgttgcgcaacgttcaaggagcgcaggaacctgctgcggttatatttcattctccttctaatcattttcctgctggagataatcgcagggattttagcttacgcttattaccaacagctgaacactgagctgaaggaaaatctcaaagacacgatgaccaagagataccaccagcctggccatgaagccgttaccagcgctgtggatcagctgcagcaggaatttcactgctgtggaagcaacaattctcaagactggcgcgacagtgagtggatacggtcccaagaggctggcggaagagtagtgtag

SEQ ID NO: 217431 - DNA, 240 bp, Artificial Sequence
  Description of Artificial Sequence: Synthetic coding sequence
atgggtgaatttaacgagaaaaagactacctgcggtactgtgtgtttgaagtatttgctattcacctataactgctgcttttggttggcaggccttgctgtgatggcggtgggaatctggaccctcgcgctcaaaagtgactatatcagtctattagccagcggtacatacctggctactgcatacattctagtggttgccggaactgtggttatggtcactggagtcttaggatgttag

SEQ ID NO: 217432 - DNA, 279 bp, Artificial Sequence
  Description of Artificial Sequence: Synthetic coding sequence
atgggggaatttaatgaaaaaaagacaacatgtgggaccgtgtgcctgaaatatctgctgttcacatataactgttgtttttggctggccggactggccgttatggccgtgggtatttggaccctggctctgaaatccgactacatttctctgttggcttccggcacctacctggccactgcctatattttggtggtagccggaaccgtcgtgatggtcactggcgtgctgggatgctgcgcaaccttcaaggaacgtcgaaacctgctaaggctgtag

SEQ ID NO: 217433 - DNA, 198 bp, Artificial Sequence
  Description of Artificial Sequence: Synthetic coding sequence
atgggggagtttaacgagaagaagacgacctgcggtaccgtctgcctcaagtatcttctctttacatacaattgctgtttttggcttgctggcctcgctgtcatggccgtaggtatctggacgctggctctgaagtctgattatattagtctactcgcgagtggaacctacctggccactgcctacattctggtgtag

SEQ ID NO: 217434 - DNA, 531 bp, Artificial Sequence
  Description of Artificial Sequence: Synthetic coding sequence
atgggagagttcaatgaaaaaaagacaacatgtggcaccgtgtgtctgaagtacctgttatttacgtataattgttgtttctggctggcaggcttggccgtcatggcggtgggaatatggaccttggcactcaagtcagattatatctccctgcttgcctcaggcacctatttggctacagcgtatatattagtggtggctgggacagtcgtgatggtgactggcgttctgggctgttgtgcaacatttaaggagcgacgcaacctgctccgcctctattttattctcctgctcatcattttcctgctagaaatcatcgcaggcatcctggcctatgcatactatcaacagctgaatacagagcttaaagaaaacctgaaagacaccatgacgaaacggtaccatcagcccggacacgaggctgttaccagcgctgtcgaccaattacagcaggagttccactgttgtggaagtaacaatagccaggactggcgagacagtgagtggatcagatcgcaggaggctggttag

SEQ ID NO: 217435 - DNA, 543 bp, Artificial Sequence
  Description of Artificial Sequence: Synthetic coding sequence
atgggagagttcaacgagaaaaaaaccacttgcgggaccgtatgtctaaaataccttctgttcacctacaactgttgcttctggctggccggactggcggttatggccgtgggcatctggacactagccctgaagtcagattacatatcattactggcttctggcacctatctcgctaccgcatatatcctcgtcgtggccggaacggtggttatggtgactggagtgctggggtgctgtgccacatttaaggagcggaggaacctgcttcgactgtacttcattctgcttctgataatttttctccttgagatcatagcaggcatcttggcctatgcctactaccagcagctgaatactgaattgaaggaaaatctgaaagataccatgacaaagaggtatcaccagcccggacatgaagccgtgacctccgcggtagatcagctgcagcaggagttccactgttgcgggtcaaataacagccaggattggagagacagcgagtggatcagatctcaggaagcagggggaagggtcgtctag

SEQ ID NO: 217436 - DNA, 273 bp, Artificial Sequence
  Description of Artificial Sequence: Synthetic coding sequence
atgggcgagtttaatgaaaaaaagactacctgtggtaccgtgtgcctcaagtaccttctgtttacgtacaactgctgtttttggctggcgggtctggccgtaatggctgtcgggatctggaccctggcccttaaaagcgactatattagcctgctggcatccgggacctacctggccaccgcctacatcctagtagttgccggtacggtggtcatggtgacaggtgtgctcggatgctgcgcgacatttaaagagaggaggaatctgctgtag

SEQ ID NO: 217437 - DNA, 513 bp, Artificial Sequence
  Description of Artificial Sequence: Synthetic coding sequence
atgggggagttcaatgagaaaaaaaccacctgtgggacggtgtgtttaaagtatctgctgttcacttacaattgctgtttctggctcgcgggtctggccgttatggctgtcggcatctggactttggccctgaaatccgactatatcagccttcttgcatctgggacttaccttgccactgcatacattctggttgttgccggaaccgtggttatggttaccggggtgttagggtgttgcgcgacattcaaggagcgccgaaacctgctgcggctatacttcattctgctactcattatttttctcctcgaaattatcgccggtatcctcgcctatgcctactaccaacagctgaataccgaacttaaagagaacctcaaagatactatgacaaaacggtatcaccagccaggccatgaggccgttacctccgccgtggaccaactgcagcaggagttccactgctgtgggtccaacaactcccaagactggcgggacagcgagtggatttag

SEQ ID NO: 217438 - DNA, 762 bp, Artificial Sequence
  Description of Artificial Sequence: Synthetic coding sequence
atgggggaattcaatgagaagaaaaccacatgcggcacagtgtgcctcaaatacctgctgttcacatataactgctgcttctggttggcagggctcgccgtgatggccgtgggcatctggacactggctctcaaatcggactacatctcgctgttggcatctggcacttacttagctacagcgtacatactcgtggtcgccggaaccgtggtgatggtgacaggcgtgctgggctgttgcgctacgttcaaggaacgccgtaaccttttacggctatatttcattctcctactcatcatctttctattagaaattatcgctggcattcttgcgtatgcgtattatcagcagctaaacaccgagttaaaggagaatctgaaagatacaatgactaaaaggtatcaccagccaggacacgaggccgtgacatccgccgtggatcagctgcagcaggaattccactgttgtggctccaataatagtcaggactggagggattccgaatggatccggtcgcaggaggcaggtggcagagtagtgcccgacagctgctgcaaaaccgtagttgccttgtgtggccaaagggatcatgcttccaatatttacaaagtggaaggtgggtgcattaccaaactggagactttcatacaagagcaccttcgagtcatcggagctgtgggaattggtatcgcctgtgtccaggtgtttggtatgattttcacatgctgtttgtaccggtctctgaaattggaacattactag

SEQ ID NO: 217439 - DNA, 3471 bp, Artificial Sequence
  Description of Artificial Sequence: Synthetic coding sequence
atgtctaagctgcgaatggtcttactagaagattccggcagcgccgactttagacgccattttgttaacctgtccccttttacaattaccgtggtcctgctcctgagtgcgtgctttgtgacctcaagtctcggcggaacggacaaagaactgcgcctggtcgatggggagaataaatgcagcggtagagtggaggtgaaagtgcaggaggaatgggggacggtctgcaataatggatggtctatggaagcagtgtccgtgatctgcaatcaactgggttgcccaaccgctattaaagcaccaggctgggctaactcttctgctggctctgggcgaatctggatggaccacgtgtcttgtagagggaacgagtccgccctttgggattgtaagcatgacggttggggaaagcacagcaattgtacacaccagcaggatgccggtgtgacctgctccgacggctctaatctggagatgagactaacaaggggcggtaatatgtgcagcggtcgcatcgaaatcaagtttcagggtcggtgggggaccgtctgtgacgacaattttaacattgatcacgcaagtgtaatttgtaggcagctggaatgcggcagtgctgtgtctttcagtggctctagcaatttcggagaagggtccggacccatatggtttgacgatttaatttgcaacggtaacgagtcagcgctgtggaactgtaagcaccagggctggggcaaacacaattgcgaccatgccgaggatgccggtgtcatttgctccaaaggagccgatttatccctgcgcctcgttgatggagtcacagagtgttcaggcaggttagaagtaaggtttcaaggggaatggggcaccatctgtgatgatggatgggatagctacgacgctgccgtagcttgcaaacagctcggctgtccaaccgccgttacggccataggaagagtgaatgcaagcaagggattcggtcatatctggctggattccgtctcatgccagggtcatgagccagctatctggcagtgtaagcaccatgaatgggggaagcactattgcaaccacaatgaagatgccggtgtcacatgctccgatggttcggatcttgagttgagattgcgcggaggcggttcccgttgcgcaggcactgtcgaggtggaaatccaaaggttgcttgggaaggtgtgcgacaggggttggggcctgaaggaagctgatgtggtctgtcgacagcttgggtgcggctccgctcttaagacaagctatcaagtctactcaaagatccaggcaaccaatacctggctattcctatcctcatgcaacgggaacgaaacatcactgtgggactgcaaaaactggcagtggggtgggctgacatgtgatcattacgaagaggccaagatcacctgttcagcacatagggagccacggctcgtggggggagacataccctgttctggcagggtagaagtcaagcacggggacacatggggctccatttgcgactccgatttcagcttagaggctgccagtgtcctttgtcgggaactgcagtgtgggaccgttgtgtccatcctgggaggcgcacacttcggtgaaggtaacggccagatttgggccgaagagtttcagtgcgagggccacgaatcgcacctatcactatgccctgtggcacctcgtcccgagggaacgtgttcccatagccgcgatgtgggcgtcgtttgctcccggtataccgaaatcaggctcgtgaatggtaagactccatgcgaggggagagtggagctgaagacgcttggcgcttggggcagcttgtgcaattctcactgggacattgaagacgcacacgttttgtgtcaacaactaaagtgtggcgtggctctgtccacccccggaggtgcgaggttcggaaaaggaaatgggcagatatggagacacatgtttcattgcactggtaccgagcaacacatgggcgattgccctgtcaccgctcttggcgctagcctctgccctagtgagcaagtggccagcgttatttgctctggcaaccaatcccaaaccctctcatcctgtaacagcagctcgctgggccctacaaggccaaccattcctgaggaaagtgctgtggcttgcattgaaagcggacagctcagactggtgaatggtggtgggcgatgtgccggaagggtcgagatctaccatgaaggaagttggggtacaatatgtgatgacagctgggacttgtccgacgcgcacgtcgtgtgccgccagctgggctgcggagaggcgatcaacgcgactggctcggctcacttcggcgaaggcactggtcctatctggcttgacgagatgaagtgcaacggcaaagagtcaaggatttggcagtgtcattcccacggctgggggcagcagaactgcaggcacaaggaagatgccggagtgatttgttcggagttcatgagtttgaggttaacttccgaagctagcagagaggcctgcgccggtcggctcgaagttttctacaatggcgcttggggaactgtaggtaagagcagtatgagcgagaccaccgtgggcgtggtctgcagacagttaggttgtgctgacaagggcaagattaatccagcatcactggacaaggcgatgagcattccgatgtgggtcgacaatgtccagtgccccaagggccctgatactttatggcagtgcccctcctccccttgggaaaagagactggcaagcccaagcgaagaaacatggatcacgtgtgataacaagattagattgcaggaggggccaacttcttgctcgggtcgggtggaaatctggcacggaggttcatggggtacagtttgtgatgatagttgggatctggacgacgcccaagtcgtctgtcagcagctggggtgtggacccgctcttaaggccttcaaggaggctgaattcggacaagggaccgggcctatctggctgaacgaggttaagtgcaaaggaaacgagtctagcttgtgggattgtccagcgagacgttggggccacagcgagtgcgggcacaaggaggatgcggcagtcaactgcacggatattagcgtccagaagaccccacagaaagcaacaactggacggagctcgaggcagagtagcttcatcgctgttggcatccttggcgtggtgctgctggccatattcgttgctctgttttttctaaccaaaaaacggcgtcaacgacagagactggccgtgagctccaggggggagaacttggtgcatcagatccaatatagggaaatgaattcctgtctaaatgcggatgatctcgatttaatgaactcttctgagaactcccatgagtccgccgacttctctgcagctgaactaatttccgtgtccaaatttctgcccatatctggcatggagaaagaagctatactctctcacaccgagaaggagaatggcaacttgtag

SEQ ID NO: 217440 - DNA, 3465 bp, Artificial Sequence
  Description of Artificial Sequence: Synthetic coding sequence
atgagcaaattgcgtatggtcctcctcgaggacagcggctctgccgattttagacgccatttcgtaaatttgagcccgttcactatcacagttgtcctcctcctgtctgcctgtttcgtgacatcatcactgggtgggacagacaaagagttgaggcttgtggacggtgagaacaaatgcagcggaagagtagaagtcaaggtccaggaggaatggggtacagtatgtaacaacggttggtcaatggaagccgtaagcgtgatctgtaaccagcttggatgcccaacagccatcaaggctcccggatgggctaactcaagcgctggttccggtaggatctggatggatcatgttagttgccggggtaatgaatccgcattatgggactgcaagcatgacggctgggggaaacatagtaattgcacgcaccaacaggacgctggagtgacctgttccgacggctctaacttggaaatgaggctgaccaggggcggaaacatgtgcagtggccgaatcgagatcaagtttcagggccgatggggtacagtgtgcgatgataactttaacatcgatcacgctagcgtcatttgcagacagctggagtgtggctcagcagtatccttctctggctcttccaactttggagaaggttcgggcccaatttggttcgacgacctgatctgtaatgggaatgaaagtgctctctggaattgcaagcatcagggctggggcaagcataactgtgaccatgctgaggacgctggtgtcatttgttcaaagggcgcagacctatctctcaggctagttgacggagtgactgaatgtagtgggagactcgaagtgcggttccagggcgagtggggcacaatctgcgacgatgggtgggattcctatgatgcagctgtcgcatgcaaacagctgggctgtcctaccgcagtgactgccatcggccgtgtcaacgcctcgaaaggatttggtcacatttggctggattctgttagttgtcaaggacacgagcctgcaatctggcagtgcaagcaccacgagtggggcaagcattactgtaaccacaatgaggacgcaggcgtgacctgttcagacggcagcgacttagagctgcgcctgcgcggaggaggatctcgctgcgccggaaccgtggaagttgagattcaacggttgcttggaaaggtgtgtgatcggggatggggtctgaaagaggcagacgtggtgtgcaggcagctgggatgtggttccgcgttaaagacgtcctaccaggtgtattctaagatccaggctaccaatacctggctgtttctaagttcttgcaatggaaacgagacttcattatgggattgtaaaaactggcagtggggaggcctcacttgtgaccactacgaagaagccaagatcacctgctccgcacacagggagccccgactcgtcgggggtgacattccttgttcaggccgtgtcgaagtaaaacatggggacacatggggctcaatttgtgactctgatttttcactcgaggcggcaagcgtcctctgccgcgaactccagtgcggaactgtggtctccatcctcggcggagctcactttggcgagggcaatggacagatttgggccgaggagttccaatgcgaaggccacgaatctcatttaagcctttgcccagtcgctcctcggcctgaaggtacttgtagccatagtagggacgttggagttgtgtgctcctctaagacacaaaagacctctctgattggatcacataccgtgaaggggacagggttggggagtcattcttgcctctttctcaagccttgccttctccccggttacactgaaatcaggttggtgaacggcaagaccccgtgtgaggggcgagtagagctaaaaactcttggagcttgggggtccctctgtaactctcactgggacattgaagatgcccacgttctgtgccagcaactgaagtgtggtgtcgcactgtcaacccctggaggggcaagattcggcaagggaaatgggcagatctggcgccacatgttccattgcacaggaactgagcagcacatgggcgactgccctgtcacagcgctgggagcatcactatgcccgtccgagcaagtcgcgtctgtcatttgttccgggaatcagagtcagaccctaagtagctgtaactccagttcactgggcccaacccgtcccaccattccagaggagagcgccgtggcatgcatagagtcagggcaactgcggctcgtgaatggaggcggtcgctgtgctgggcgtgtggagatttatcatgagggctcctggggtacaatctgtgacgactcttgggatctgtcagatgctcatgttgtctgtcgacagctcgggtgtggtgaggccataaatgctacagggagtgcccatttcggggaagggactggcccaatttggctagatgagatgaagtgcaacggaaaagagtcaagaatctggcagtgtcactcgcacggctgggggcagcagaattgccggcacaaagaggatgctggcgtgatctgcagcgaatttatgtctctgcgcttgactagcgaggctagccgcgaggcctgcgccggtaggctggaagtgttctataacggagcttgggggaccgttgggaagagcagcatgagcgagacaactgtcggggtcgtctgccgccagctgggttgcgcagacaaagggaaaatcaacccagccagcttagacaaagcgatgtccatacccatgtgggtagacaacgtacagtgcccaaaaggacccgacacactttggcagtgcccgagcagtccgtgggagaagcgcctggctagcccgagcgaagagacatggatcacatgtgacaacaagatcaggctgcaggagggtcctacctcctgtagtggcagagtggaaatctggcatgggggatcatggggtacggtttgtgatgatagctgggatttagacgatgcccaggtcgtgtgccagcagcttggctgcgggcctgctcttaaggcgtttaaggaagcggaattcggccagggcacgggccctatttggcttaatgaggttaagtgcaagggcaatgaaagttccttgtgggattgccccgcacggaggtgggggcactctgaatgtgggcacaaagaagacgctgccgtgaattgtacagacatctcagtccaaaagacgccgcaaaaagccacaacaggcagatcatccaggcaatcctcattcatcgcagtcgggattctgggcgtggtcctgcttgccatctttgttgctttgttcttcctgacaaagaagcggcgacagcgccagaggcttgccgtatctagtcgcggtgaaaacttggtccaccagatccagtaccgtgaaatgaattcctgcctgaacgccgacgacctggacctaatgaatagttcagggggacatagcgagccacattag

SEQ ID NO: 217441 - DNA, 3366 bp, Artificial Sequence
  Description of Artificial Sequence: Synthetic coding sequence
atgtctaagttacggatggtgctccttgaggattctggcagtgctgacttccgacggcatttcgtcaatctatcgccatttacaatcaccgtggtcttgctcctaagcgcatgttttgtcacatcaagtttgggaggcactgacaaggagctacgcctcgttgatggagaaaataagtgctccggtagagtggaagtgaaagtccaggaagagtggggtaccgtgtgtaataatgggtggagcatggaagccgtgagcgtcatctgtaatcagcttggctgtcctaccgccattaaagcccctgggtgggctaatagttccgcaggctctggcagaatatggatggatcacgtctcttgccgcggaaacgagagcgccctgtgggactgcaaacacgatgggtggggaaagcatagtaactgtacccatcagcaggacgctggcgtgacttgttcggacggaagcaatctagagatgagactgacccgagggggaaatatgtgttctgggagaatcgagataaaattccaggggaggtgggggactgtttgcgacgacaattttaacatagaccacgcctccgtgatctgccgccagctggaatgtgggtccgcggtttcttttagtgggtcctcaaattttggcgaagggagcgggcctatctggtttgatgacttaatctgtaacggaaatgagagcgccctttggaactgcaagcatcaaggctgggggaaacataattgcgatcacgccgaagatgccggtgtgatatgctctaagggggctgatttaagcctcagacttgtagatggcgttactgaatgctcaggaagactcgaggtgaggtttcagggcgaatgggggacaatttgcgacgacggctgggattcatacgacgctgctgttgcttgtaagcagcttggctgtccaactgcagtcactgctatcggtcgcgtgaatgcttccaaaggctttggtcacatttggttggattcagtttcctgccaaggccatgaaccggctatctggcagtgcaaacaccacgaatggggaaagcactattgcaaccataatgaggatgctggggtgacgtgtagtgacggttcagacctcgaactgcggctgagaggagggggatcaagatgtgccggaacagtcgaagtggagatccagcggcttttaggtaaagtctgcgatcggggttggggactgaaggaggccgacgtcgtgtgcaggcaactcggctgtggcagcgccctaaagaccagctaccaggtgtacagcaagattcaggccaccaatacttggctcttcctttcaagttgtaacggcaatgagactagtctttgggactgcaaaaactggcagtggggtggcctgacctgtgatcattacgaggaggctaagattacgtgttccgcacacagggagccacggctcgtcggaggtgatattccttgttcgggaagggtggaagtcaaacatggcgacacctggggctctatctgcgattctgacttctcactggaggccgctagtgtgttatgccgtgaattacagtgcggcactgtggtatccattctcggtggggctcactttggcgagggcaatggacagatttgggccgaggaattccagtgcgagggccacgaatctcatctcagcctgtgtccagtggctcctagacccgaaggcacctgttctcacagcagggacgtaggcgtcgtgtgcagtcgatacacagagattaggttagtgaatggcaaaactccttgtgagggtagagtcgagctcaagacactgggcgcatggggctcactctgcaattctcactgggacattgaagatgctcatgtcctgtgccagcaactcaagtgtggagtcgccctgagcaccccaggaggggctcgcttcggcaagggcaacggtcagatctggcgccacatgtttcattgtaccggaacagaacagcatatgggcgactgtcccgtgacagctttgggcgctagtttgtgccccagcgaacaagttgcctcggtgatttgctctggcaatcagtcccagacactcagtagctgtaatagttccagtctgggcccaaccaggccgaccatccccgaagagtctgcagtcgcttgtatcgagtccggacaattgcggctcgtaaacgggggtggacgctgtgccggaagggtcgagatttatcacgagggctcatggggcactatttgcgacgatagctgggatctgtccgacgcccatgtcgtgtgtcgccagctgggctgcggggaggctataaacgcaaccgggtctgctcatttcggcgaggggaccgggccaatctggctcgacgagatgaagtgcaatggaaaagagagcaggatttggcagtgccacagccatggctggggtcagcaaaactgtcggcacaaggaggacgctggcgtgatctgtagcgaatttatgagtctgagactgacctctgaagcctcaagggaagcctgtgccggtcgcttggaagtgttctacaacggcgcttggggcacagttgggaagtcttccatgtctgagacaactgttggcgttgtctgtaggcagttaggctgtgccgacaagggtaagatcaatccagcaagcctggacaaggccatgtctatccccatgtgggttgataatgtccagtgtccaaagggtccagataccctgtggcagtgccccagttcaccctgggagaaacgcctagcatctccctcagaagaaacatggatcacctgcgacaacaagattaggctgcaggagggccctaccagctgctccggccgagtcgaaatctggcatggaggcagctggggtactgtatgtgatgacagctgggatttggacgacgcccaggtggtgtgtcagcagctagggtgcggcccagccttgaaagctttcaaagaagccgagttcggacaagggactgggcctatctggctcaacgaagtgaagtgtaaggggaatgagtcttctctatgggactgtcccgcacgcaggtggggccactcagagtgcggacataaggaagacgctgctgtgaattgcactgatatatcagtccaaaaaactccccaaaaggcaactactggacgttctagtaggcagtccagctttatcgctgtgggtattcttggagtcgtccttctggcaattttcgtggctctgttcttccttacaaagaaacggagacaacggcagaggttagcagtttcaagccgcggagaaaatctcgtgcatcagattcagtaccgggagatgaatagttgtcttaacgctgatgacttggacctgatgaactccagcggaggtcatagcgagccacactag

SEQ ID NO: 217442 - DNA, 555 bp, Artificial Sequence
  Description of Artificial Sequence: Synthetic coding sequence
atgtcccgactgagtcgtagtctgctgtgggctgccacttgtctgggcgtactgtgtgtcttgagcgccgataaaaacacaacgcagcacccaaacgttactactctggcaccaatcagcaacgtcaccagcgcacctgttactagcctgccactggtcactactccagcgcctgagacttgtgagggacggaactcttgtgtctcatgtttcaatgtgagcgtggtgaatacgacctgtttctggattgagtgcaaggatgaaagctattgttcacacaatagtacagtgagcgactgccaggtaggcaacacaacagacttttgtagcgcaaagccgaccgtccagcccagtccaagcactacttcgaaaacagtgacaacgtcaggcacaaccaataatacagtgactcccacgtctcagccagtcagaaagtcgacattcgatgctgcttcattcattggcggaatcgtcctcgtcttaggagttcaggcagttatattctttctatacaaattttgcaagagcaaagagcgaaactaccacaccctgtag

SEQ ID NO: 217443 - DNA, 594 bp, Artificial Sequence
  Description of Artificial Sequence: Synthetic coding sequence
atgtcacgcctcagcagatctttactgtgggcagccacgtgcttgggtgtattgtgtgtcctgagcgctgacaagaatacgacccaacaccctaacgtgactacactggctccaataagtaatgtaacctctgccccagttacttccctaccacttgtcacaactccggctccggagacctgtgaaggacgcaactcgtgcgtgagctgcttcaatgttagcgtggtaaataccacctgcttttggatagagtgcaaggatgaatcctactgcagccataactccaccgtctccgactgccaagtcgggaacacgaccgacttctgcagtgtgtctacagctacaccagtcccaacagccaattccacagcaaagcctactgtccaaccatctccatcgaccacttccaaaaccgtgacgactagcggaacaacgaataacactgtcacaccaacaagccagcctgtgcggaaatcaacctttgacgcggctagcttcatcggtggaattgtactggtgcttggagtgcaggcagtcatctttttcctttacaaattctgtaagtcaaaagaaagaaattaccacacactgtag

SEQ ID NO: 217444 - DNA, 537 bp, Artificial Sequence
  Description of Artificial Sequence: Synthetic coding sequence
atgtctcgactctcccgaagtttgctatgggctgcaacatgtctcggcgtcttgtgtgtgctgtcagcagacaagaatactacccagcatcctaacgtgactacactggcccctataagtaatgtaacctctgcacccgttacgtctctgccattggtgacaacccctgccccagagacctgcgaaggtaggaactcttgtgtgtcctgttttaatgtttccgtggtcaatacgacctgcttttggattgagtgcaaggatgaatcttactgctcacataatagtaccgtctctgactgccaagttggcaacactacagatttttgtagcgtgagcaccgccacacctgtacctacagcaaatagcactgggactaccaataatacagttactccaacctctcaaccagtgagaaagtctacattcgacgccgcttctttcattggagggattgtcctggtcctcggtgtgcaggctgtaatctttttcctctacaagttctgtaagtcaaaagagcgcaactatcacacactgtag

SEQ ID NO: 217445 - DNA, 498 bp, Artificial Sequence
  Description of Artificial Sequence: Synthetic coding sequence
atgagccgcctctccagaagtttactctgggccgctacatgtcttggggtcctttgcgtcctttctgcagataaaaacaccacacaacaccccaacgtgaccaccttagccccaatctcaaacgttaccagtgcacccgtgacaagcctgccactggtgactacacctgcaccggagacctgtgaaggacggaacagctgtgtgtcttgcttcaacgtctccgtggtgaataccacgtgcttctggatcgagtgtaaagatgaaagctactgcagccataactctacggtgtcggactgccaagtggggaatactacagacttctgctctggtactacgaataacaccgtaacgccgacaagtcagcctgtccgcaaaagcacattcgatgcagcttcctttatagggggaatcgtgctggtcctgggagtgcaagccgtgatctttttcctgtataaattttgcaaatccaaagagcgcaattatcacacgctctag

SEQ ID NO: 217446 - DNA, 570 bp, Artificial Sequence
  Description of Artificial Sequence: Synthetic coding sequence
atgtctcggctgagcagatctttattgtgggcagcaacatgtctgggcgtcctttgtgtcttgagtgctgacaagaacacaactcagcacccgaacgtaacaacccttgccccaatatccaatgtaacatctgcccctgttacatctcttcctctggtgactactcctgcccctgagacctgcgaaggcagaaactcatgcgtgtcgtgctttaacgtgtccgtggttaatactacttgcttttggattgagtgcaaggatgaatcttactgctcccacaactctacagtctccgattgccaggttgggaatacaacggatttttgctccgtgagtacagctacccctgtgccaaccgccaacagtacagccaaacccacggtgcaaccaagcccatcaactacttccaagacagtgacaacttccggcactaccaacaatacggtgacgccaacaagccaacctgtgagaaaaagcacctttgacgctgcgagttttatcgggggtatcgttctggtgctagagataaggtgccacacacgcaactatatccctgacctcaaaaaatag

SEQ ID NO: 217447 - DNA, 474 bp, Artificial Sequence
  Description of Artificial Sequence: Synthetic coding sequence
atgtcaaggctgagccgatccctgttgtgggccgctacttgccttggagttctttgcgtgctgtctgccgataaaaacaccacccaacatcccaacgtgaccacacttgcccctatttctaacgtgacatctgcacctgtcacctctctaccactggtaaccactccagctccggaaacttgcgagggccgaaactcctgcgtcagctgtttcaacgtgtctgttgtcaacacaacttgcttttggatcgagtgcaaagatgaatcatactgttctcataattccaccgtgtcagactgccaggtcgggaacaccacagatttctgttcggtgtccacggcgacaccagtacccactgccaactccactgctaaaccaacagttcaaccatctccttcaacgacgtcaaagaccgtgacaacctcagaaataagatgtcacacgcggaattacattcctgatctcaagaagtag

SEQ ID NO: 217448 - DNA, 747 bp, Artificial Sequence
  Description of Artificial Sequence: Synthetic coding sequence
atgagtgcagtgttactgcttgctctgttgggttttatactacctcttcccggtgtgcaagctctgctgtgccagtttggcacagtgcagcacgtgtggaaggtgtctgacttaccacgccaatggacaccgaagaatacatcctgcgatagcggtcttggctgccaggataccctcatgctgatcgaaagcggaccgcaggtcagtctggtgctctccaagggatgtaccgaggctaaggatcaagagcctcgcgtgacagaacataggatgggtcctggcctaagtctgatttcctatacttttgtgtgtaggcaggaagacttctgcaacaatttggtaaatagcttgccgctttgggccccacagccaccagccgatccagggagccttagatgccccgtctgtctgtcaatggagggctgtctggagggtactacagaagaaatctgccccaagggcaccactcactgttatgatggtttactccgcctgcgaggcggaggaattttctccaatctccgcgtgcaagggtgcatgccgcaacccgtttgcaacctccttaatgggacccaggagataggacccgtcggtatgaccgaaaattgcgacatgaaggatttcctgcagctcaagcctgtgggcctgctggaagaacacaacgttggggaaaaggagagaggccaggggcagcaccagtgcgtgcagctcgattggcaaaaacgtgcagccacagggatattctag

SEQ ID NO: 217449 - DNA, 438 bp, Artificial Sequence
  Description of Artificial Sequence: Synthetic coding sequence
atgagcgctgttctgctgttggcactgctgggatttatactgccactgccgggtgtgcaggctttgctatgtcagttcgggaccgtccagcacgtctggaaggtaagcgacctgccgaggcagtggactccgaagaacaccagctgtgactccgggctaggatgtcaggatactctcatgcttatcgaatcaggccctcaagtgagccttgttctttcaaagggctgcaccgaagccaaggatcaggagccgagggtaaccgagcatcggatggggcctggactgagtctgattagctataccttcgtctgtcggcaagaagacttttgtaacaacctcgtgaattcactgcctctctgggcgcctcagcccccagctgatcccatgatgggtgcagccgagggtccatttggcaaggccgagcaagtagattcatag

SEQ ID NO: 217450 - DNA, 438 bp, Artificial Sequence
  Description of Artificial Sequence: Synthetic coding sequence
atgagtgccgtacttctcctcgccctcctcgggtttattttacctttgcccggagtgcaggccctgttgtgccagtttgggactgtacagcatgtttggaaagtctccgatcttccgcgacaatggacccctaaaaacacatcatgcgattccgggctggggtgccaggacaccttgatgctgatcgaatccggccctcaggtctccctcgttctatccaagggctgcaccgaggccaaggaccaggagccccgtgtaaccgagcatcgaatgggtcccggtttgtcactgatcagctacacatttgtgtgccgtcaggaagacttctgcaacaatctggtgaatagcctgccactatgggcacctcagcctcctgcagatcctatgatgggggctgctgagggcccatttggtaaagccgagcaggtcgattcttag

SEQ ID NO: 217451 - DNA, 1671 bp, Artificial Sequence
  Description of Artificial Sequence: Synthetic coding sequence
atgccccctccgagactcttgttcttcctgctgttcttgacccccatggaggtcaggccagaagagccgcttgtggtcaaggtcgaagagggagacaacgccgtgctgcaatgcttaaagggcacttcagatggacctacgcagcagctgacctggagtcgtgagtcccctttgaagccgtttttgaaactgtcactggggctgccaggacttgggatacatatgcggccactggccatctggctgtttatttttaatgtgagtcagcagatgggtgggttctacctgtgccagccagggcctccttcggaaaaagcatggcagccaggatggacagtcaatgtggagggctccggagagctcttccgatggaacgttagcgacttaggcggtttgggctgtggattgaagaacaggagttctgagggcccaagctctccctccgggaagctgatgtctcctaaattatacgtgtgggctaaggatcggcctgagatctgggaaggggagccaccctgcctcccgcctcgtgacagcctgaatcagtcactgagtcaggatctgacgatggctccaggttcgacgctgtggctgtcctgtggagtccctcctgactcagtgtctcggggacctctgtcatggacacatgtacaccccaaggggccaaaaagccttctatccctggaactaaaagatgatagaccagcccgagatatgtgggtgatggagacaggactgctgttgccccgagccaccgcccaggatgcaggaaaatactactgtcatcgcggaaacttaactatgagctttcatctcgagatcaccgccaggccagttctgtggcactggctgctgcggactggaggatggaaagtttctgcagtcacccttgcttatctgattttttgcctgtgctccttggtggggattcttcatctccagagggccctggtcctccgtagaaaaagaaaacggatgacagatcccaccagaaggttctttaaagtgactcccccacccggaagcggcccacagaaccagtatggaaacgtgttgtccctgcctaccccaacctctggactgggaagggctcaacgttgggcggcaggattagggggtaccgctccttcatatgggaatccttcctctgacgtgcaggcagacggcgctctagggagtcggagccccccaggtgtaggacctgaagaagaagagggggagggatacgaagagcctgatagtgaggaggactccgagttttatgagaacgattcaaatctcggacaggaccaactgtcacaggatggctcagggtacgagaatcctgaagatgagcccctggggcctgaagacgaggactcattctccaacgccgaatcttatgaaaacgaagatgaggaactgacccagccggtcgcccgaaccatggatttcctgtctcctcatgggtctgcatgggaccccagtcgcgaagccacgtctcttggaagccagtcctacgaggatatgcgaggcatcctttatgctgcaccccagcttcggtccatccggggacagccaggccctaaccatgaagaagacgcagatagttatgaaaacatggacaatcccgacggccctgaccccgcttggggcggaggcggaagaatgggtacatggagtactcggtag

SEQ ID NO: 217452 - DNA, 1092 bp, Artificial Sequence
  Description of Artificial Sequence: Synthetic coding sequence
atggaagttcgacctgaagagccactggtggtgaaggtggaagaaggcgacaacgccgtgttgcaatgcctaaagggcacaagcgatggccctacccagcagctgacatggtcacgcgagtccccactaaagccattccttaagctgtctttgggcctaccgggacttggcatacacatgcgcccactgggaaaatactattgccaccggggaaacctgacaatgtcatttcatctagagattaccgccagacccgttttgtggcactggttgctcagaacaggtggttggaaggtatctgccgttacattagcctacctgattttctgcctgtgctccttagttggcatcctacatttgcagagggccttagttctacgccgtaagagaaaaaggatgacagaccctacacgacgcttctttaaggtcaccccacccccaggcagcggaccacaaaaccagtatggcaatgtgctgtctctgcctactcctaccagcggtctgggacgcgcacaacgttgggccgcaggactggggggtaccgctccaagctatggcaacccgagttccgacgtgcaggcggatggagccctgggcagccgttcccccccaggagtgggccctgaggaagaagagggggagggttatgaggagccggattccgaggaggactcagagttctacgaaaacgactcgaatctcggccaggatcagctttcccaggatgggtcggggtacgagaatccggaggatgagccactgggaccggaggacgaggacagctttagcaacgccgaaagctatgaaaacgaagacgaagagctgacacaaccagtggcaaggactatggatttcctgtctccacacggaagcgcttgggaccccagccgcgaagctacatcccttggcagccagtcttacgaggacatgcgcggtattttatatgctgcgcctcagctcagaagcattcggggacagccgggaccaaaccacgaggaggacgcggacagttatgagaatatggataatccagatgggccagatcctgcatggggtggcggaggacgaatggggacatggtcaactcgatag

SEQ ID NO: 217453 - DNA, 1218 bp, Artificial Sequence
  Description of Artificial Sequence: Synthetic coding sequence
atgtctccgaagctgtatgtttgggccaaagatcggcctgaaatctgggaaggagaaccaccttgtctgcctcctcgtgattccctcaaccagagcctgtctcaggacctgaccatggccccaggctcaaccttatggctttcttgtggtgtgccaccagactctgtatctcggggacccttaagttggacccatgtacacccaaagggtccaaagagccttcttagcctggaacttaaggacgataggcccgctagagacatgtgggtcatggagaccggtctcctgttgccaagggcaacagctcaagatgccggaaagtactactgtcatcgcggaaacctgactatgtcgttccatctggagattacggctaggccggtactctggcattggctattgaggactggtggctggaaagtttccgcagtcactcttgcctacctaatcttctgcctctgcagtttggtggggatcctccatctccaacgagctttagtgctaaggcggaagagaaagaggatgaccgaccctacccgacgtttcttcaaagtcaccccacccccaggttcaggtccacaaaaccaatatggaaatgtcctttcactccctacccctacctccggtttgggccgagctcaacggtgggcagccggtctcgggggtaccgccccatcctatggaaacccgagttctgacgtacaagcggacggcgcactgggttcacgctcgccgcctggagtgggccctgaggaggaagagggcgagggctacgaagagcctgattcagaggaggactcagagttctacgagaacgactctaacttgggacaggatcaactctctcaagacggatcggggtacgaaaatccagaagacgagccattgggccctgaggacgaggatagtttcagtaatgccgaatcctacgagaacgaagatgaggagctcacccagcccgttgcaagaacaatggacttcctctcaccccacgggtcggcctgggatccatctcgggaagctactagtctgggttcacagagttacgaagacatgaggggaatactttatgcagcacctcagttgagatccatcagggggcagccaggcccaaatcacgaggaggatgcagatagttacgaaaacatggataacccagatggacctgaccctgcgtggggaggcggagggaggatggggacttggtctacaaggtag

SEQ ID NO: 217454 - DNA, 1674 bp, Artificial Sequence
  Description of Artificial Sequence: Synthetic coding sequence
atgccaccaccgcgactgttgttctttttgctgtttcttactccaatggaggtgaggccagaggaacctcttgttgtaaaagttgaagagggagataacgctgtgcttcagtgtctgaagggaacttccgacggacctacacagcaactcacgtggagccgcgagtctcctcttaaaccattcttaaagttgtcccttggcctgcctggactagggatacacatgagacctctggcaatctggctgttcatctttaatgtgagccagcagatgggaggtttctacctgtgccagcccggacccccttctgagaaagcttggcagcccggatggaccgtgaatgtcgaaggaagcggggaactctttcgctggaatgtatccgacctaggaggtctcgggtgtggactgaaaaatcggtcatccgaaggacccagttcacccagtgggaaactgatgagtcctaagctctatgtgtgggcaaaagatcgccctgaaatatgggagggcgagcccccatgcctacctccacgcgattcattgaatcaaagcttgtcccaggacttgacgatggcccctggaagtaccctatggttgtcctgcggcgtgcccccagactccgtttccaggggaccactgtcgtggacgcacgtgcaccctaaaggtcctaagtctctgctcagtcttgagcttaaagatgaccgccctgccagggacatgtgggtgatggagaccggcctgctgctgcctagggccactgcccaggatgcaggtaaatattactgccaccggggaaatttaacaatgtcctttcacctagagattaccgccaggccggtcctctggcactggctgctgcgaactgggggttggaaagtttccgcagtgaccctggcttaccttatattctgtctgtgcagcctggtgggcatcctgcatctgcagagggccttggtattgaggagaaagcgcaaaaggatgacagaccctacccggagattcttcaaggtgacacccccacccggaagtggccctcagaatcagtatgggaatgtgttgtcgctgcccacacccacctcgggcctcggacgagcccagagatgggcagccggactgggcggtacagcgccaagctacggtaatccgtcatcggacgtgcaagccgatggagcactgggctctaggtcaccgccaggggtcgggccagaggaagaggaaggggagggctatgaggaaccagatagcgaggaggattccgaattctatgaaaatgactctaatctgggtcaggatcaactttcacaggacggatctggatatgagaatcctgaagacgagccactggggccagaggatgaagacagcttcagcaacgctgaaagctatgagaacgaggacgaggaactcacacaacccgtcgctagaacaatggattttcttagtccacacggcagcgcatgggatccttcaagggaggccacgagtctggccggaagccagagttacgaagatatgcgagggatcctctatgcggctcctcagcttagatccattagaggacagcctgggccaaaccatgaagaggacgcagattcatatgagaatatggacaatcctgacggcccagatccagcctgggggggagggggtcgcatggggacatggtcaaccaggtag

SEQ ID NO: 217455 - DNA, 984 bp, Artificial Sequence
  Description of Artificial Sequence: Synthetic coding sequence
atgctctttctgctgttgcctctgctcgctgtccttccaggagacggcaatgctgatggcctgaaggagcccctgtctttccacgtgacatggatcgccagtttttacaatcactcctggaaacagaaccttgtgtcaggatggctcagcgacttacagacccacacatgggattcaaattcgtccacaatagtcttcctctgtccatggagccgcggaaacttttcaaacgaggaatggaaagagttagagacgctcttcagaattcgcaccatacgctctttcgagggaattcgacggtatgctcatgagcttcagtttgagtatcccttcgagattcaggtgactggtgggtgcgaactccattctggcaaggtgtctgggagcttcctgcagttggcctatcagggtagtgattttgtctcattccagaataatagctggctgccctatccagtcgctggcaatatggctaagcacttttgcaaggtgctaaatcaaaatcagcatgaaaacgacataacccacaacttgctctctgatacttgtcccagattcatcttggggctgctggatgccggaaaggcccacctacaaagacaggttaaacccgaagcttggctgtcccacgggccatcgcccggaccgggacacctgcaactagtttgtcatgtcagcggattttatcccaagccagtatgggtgatgtggatgaggggcgaacaagaacagcaaggcacacagcgtggggacatcctcccctccgccgacggaacttggtacctccgggctaccctcgaggtcgcagctggagaggctgctgatctgtcatgtcgggttaagcacagcagcctggaagggcaagatatcgtcttatactgggaacaccactcttcagtaggattcataatactcgcggtgatcgttcccctactgctgcttattggcttggccttatggttccggaagcgctgcttttgttag

SEQ ID NO: 217456 - DNA, 1002 bp, Artificial Sequence
  Description of Artificial Sequence: Synthetic coding sequence
atgctcctcctaccattccaactgctagcagtcctgttccctggtggcaattccgagcacgcgttccagggaccaacctcttttcatgtgattcaaacatccagtttcactaactccacctgggcgcagactcaggggtccgggtggctcgacgacctgcagattcacgggtgggattccgactctgggaccgccatttttttaaaaccttggagtaagggaaatttctctgataaagaggtcgcggagcttgaagagattttcagagtctatatcttcgggttcgcaagggaggtgcaggacttcgccggtgattttcagatgaagtatcccttcgaaattcaggggattgcgggatgcgagctgcattcggggggtgccattgtctcttttctcagaggggcacttggcggactagactttttatcggttaaaaacgcttcttgtgtcccctcccctgagggagggagccgcgctcagaagttctgcgccctgatcatccaataccagggcatcatggagaccgttcgtatccttctgtacgagacatgtccccgatatttgctcggggtgctgaatgcaggcaaggccgatctgcaaaggcaggtcaaacccgaggcctggctcagctctggaccttcacccggtccgggaaggctgcagctagtttgtcatgtctctggtttttatccaaagccagtgtgggtgatgtggatgagaggtgaacaagaacagcagggcacccaattgggcgacatccttcccaacgcaaactggacctggtatctccgcgcaaccctggatgtggccgacggtgaggcggctggtctgagttgccgtgtgaagcacagctccctagaaggtcaggatatcattctttactggaggaaccctaccagtattggtagcatcgtgttggccatcatagttccgagtctgctcctcctgctgtgtctggccttatggtatatgagaaggcggtcctaccagaacattccttag

SEQ ID NO: 217457 - DNA, 741 bp, Artificial Sequence
  Description of Artificial Sequence: Synthetic coding sequence
tgaagctccttcactaacagcacttgggcacagacgcagggtagcggctggcttgacgacctccaaattcacgggtgggatagcgactccggaactgcaatcttccttaaaccttggtctaaggggaacttcagcgacaaagaggtcgccgaacttgaggagatctttagggtgtacattttcggattcgccagggaggttcaggacttcgcaggggatttccagatgaagtacccttttgagattcaaggtatcgctggatgcgaactgcactccggcggagccattgtgtcctttcttaggggggcacttggcggattagattttcttagcgtcaagaatgcctcctgcgtgccctcacctgagggaggctcacgcgctcagaaattttgcgctctgattatccagtaccagggaattatggagactgtgcggatccttctgtatgaaacctgtcctagatatttgctgggggtgctgaacgcgggaaaggccgacctgcagcgccaggtgaaacctgaagcgtggctgtccagcggaccctcaccgggtccaggaagactgcagctggtgtgccacgttagcggattttatcccaagcccgtgtgggtgatgtggatgaggggcaacccaacctcaattggaagcatagtgttggctatcattgttccctctctgctgttgctcctgtgtctggcgttatggtacatgagacgacggagctaccagaacatcccctag

SEQ ID NO: 217458 - DNA, 1041 bp, Artificial Sequence
  Description of Artificial Sequence: Synthetic coding sequence
atgctcttcctgcaattcctgcttttagccctcctgctaccaggcggagacaacgccgacgccagtcaggaacacgtgtcatttcacgtgatccagattttttcgtttgttaaccaatcatgggcgagaggccagggcagtggatggctggacgaattgcaaacccatgggtgggatagcgagtctgggacaattatcttccttcataactggagcaagggtaacttctctaacgaggagctctctgacctggaattgctctttagattttatctgttcggtctgactagggagatccaagaccacgcctcccaggactactcaaaatatcctttcgaagtccaggtaaaggccggatgcgagctccactcaggcaagagtcctgaggggttcttccaagtcgcgttcaacggcctggatctcctgagctttcaaaacacaacttgggtgcccagcccaggctgtggcagtctcgcccagtctgtatgccacctgttaaaccaccaatacgaaggtgtcactgaaaccgtgtacaatctgattcgcagtacgtgtccacgcttccttctgggtctcctcgacgcaggtaagatgtacgtccatagacaggtgcgtcccgaggcctggctgtcgtctcgcccatccctcggcagcgggcagctgctgctagtctgtcacgctagcggcttttaccctaaaccagtgtgggttacctggatgaggaatgaacaggagcagttgggaaccaaacacggagacattctgcctaacgctgatgggacctggtatcttcaggtgatcctggaagtagccagtgaggagcctgcaggtctgtcctgccgcgtcagacactcttctttaggtgggcaagacatcattttatactgggcacatatacgcacgtcttgtgagaccctgcccccagatagtccaattgtactgcgcacccaacagccgagaagcctggtgcaatactccgatgccatcccctccacactccatctcaactgtttttccttttgtatcatcaatatttgttag

SEQ ID NO: 217459 - DNA, 1002 bp, Artificial Sequence
  Description of Artificial Sequence: Synthetic coding sequence
atgctcttcctgcagttcttactcctcgcattgcttctgccaggcggagataatgctgacgcttcccaggaacacgtgtcgttccacgtgattcagatcttctccttcgtgaaccagagctgggcccgtggccaagggtctggctggttggatgagctgcagacacacggctgggactctgaatcagggactataatcttcctgcacaattggtccaaggggaactttagtaatgaagagttaagcgatctggaactcctttttaggttctacctcttcggcctgacgagggaaatccaagaccatgcgagtcaggactactctaagtacccgtttgaagtccaggtgaaggcgggatgtgagctgcactcaggaaaatcgccagagggcttctttcaagtggccttcaatggactcgacctcttaagctttcagaataccacctgggtgccaagcccgggatgtgggtcgctggctcaaagcgtctgtcatctactcaatcatcagtacgagggagtcacagaaaccgtctataacttgattagatcaacgtgtccacgctttctgctcggactgctggacgcaggtaagatgtatgtccaccgacaagtgcgccctgaggcatggctctcatctagaccatccttggggagtggccagctgctcctggtttgccatgcatcagggttttaccccaaacccgtttgggtaacgtggatgcggaacgagcaggagcagcttggcactaagcacggggatatcctccctaatgctgacggaacttggtacctgcaggtgatcttggaggtggcttccgaggaaccagccggactttcttgccgggttcgccactctagtctgggaggccaggacatcattctgtactggggccaccacttctctatgaactggattgcactggtggtcattgtcccccttgtgatcctgatcgtccttgtgctgtggttcaaaaaacattgctcctatcaggacatcctttag

SEQ ID NO: 217460 - DNA, 846 bp, Artificial Sequence
  Description of Artificial Sequence: Synthetic coding sequence
taatttttacacaattggtcaaagggaaacttcagcaacgaagagttgagcgacctggagctgctttttcgtttctacctttttggcctgacccgggagatccaggaccatgcctcccaggactactcaaagtacccttttgaggtgcaggtaaaggccggatgtgagctgcatagtggcaaatcccctgagggtttctttcaggtagcctttaacggtcttgatctgctcagctttcagaatactacctgggtgcctagtccaggttgtggctctctagctcagtctgtttgtcatttgctaaaccaccagtatgaaggtgtaactgaaacggtttataatctgatccggtctacttgtcctcgcttcctactgggcttgctagatgcaggcaaaatgtatgtgcaccgtcaggtgagaccagaggcctggttgagctcacggccaagcctcgggagtgggcagcttctgctggtctgccatgcctccggcttctaccccaaacccgtgtgggtgacctggatgcgaaacgaacaggagcaactaggcaccaaacatggagacattctccccaacgccgatgggacctggtacctgcaggtcatcttagaagtcgctagtgaagagccagccggattgagctgtagggtgaggcactctagcctggggggtcaagacatcattctgtactgggcacatatcagaacctcctgcgagacactaccacccgactcccctatagttttgagaacccagcaacccagaagcctggtgcagtactctgacgccattccctctacattgcatttaaactgtttcagcttttgcatcattaacatctgctag

SEQ ID NO: 217461 - DNA, 411 bp, Artificial Sequence
  Description of Artificial Sequence: Synthetic coding sequence
atgtatgtgcacaggcaggtgagacctgaagcttggctttcgtccaggcctagtctgggcagcggccagttgctcctggtgtgccacgcctcgggattctatcctaaacccgtgtgggtgacgtggatgagaaacgaacaggaacaattggggaccaagcacggcgacatcctgcccaacgccgacggaacatggtacttacaggtgattctggaggtagcatctgaggaaccagctggcttatcctgtagagtccgccatagtagtcttggtgggcaggatatcatcttgtattggggacaccatttctccatgaattggatcgctttagtagtgatcgtgccactggtcattctgatcgtactggtgctctggttcaaaaagcactgtagctatcaggatattctctag

SEQ ID NO: 217462 - DNA, 1008 bp, Artificial Sequence
  Description of Artificial Sequence: Synthetic coding sequence
atggggtgtttgctgtttttgttgctctgggccctcctccaggcgtggggttcggctgaggtaccccagaggttgttccccctcaggtgcttgcagatctcttccttcgcaaatagcagctggactaggacggatggactcgcttggcttggggagctccaaacacactcctggtcaaacgattccgatacagtcaggtcattaaagccatggtcccaggggaccttcagtgatcagcaatgggaaacccttcagcatatatttcgcgtgtatagaagtagctttactcgagacgtcaaggagttcgctaaaatgctcaggctatcataccctctcgaattgcaggtctctgctggatgcgaggtgcaccctggaaatgcctctaataacttttttcatgttgctttccagggcaaggatatcctctctttccaggggacctcatgggaaccgactcaagaggctccgttatgggtgaatctggccatccaggtgttgaatcaagataaatggacccgggagactgtgcaatggctgttaaacggcacctgcccccagttcgtgtctggattactggagtctgggaaatcagagttaaagaagcaggtcaagccgaaagcttggctctcccgaggcccttctccagggccagggagactgctgttggtttgccacgtgtccggcttttaccccaaacccgtgtgggtgaagtggatgcgtggggagcaggagcagcagggcacccagcctggcgacattctgcccaatgccgacgagacctggtatctgcgcgcaactttggatgtggtagccggagaagccgcaggtcttagctgccgggtcaagcacagcagcctggaaggccaggatattgtgctgtactgggggggttcctacacctccatgggcctgattgccctcgcagttctggcgtgcctcttgtttctgttaatcgtgggttttaccagcagattcaagagacaaacaagctatcagggagttctgtag

SEQ ID NO: 217463 - DNA, 435 bp, Artificial Sequence
  Description of Artificial Sequence: Synthetic coding sequence
atgctgctgctgtttctgttatttgagggtctctgctgtccaggagagaacaccgccgtgaaaccggaggcttggctgagttgtgggccatctccgggtccgggaagattgcagttagtgtgtcatgtgtccggtttttatccgaagcctgtgtgggtaatgtggatgcggggaggttactcaatcttccttatactgatatgtctcaccgtgatagtgacgctcgtcatcctcgtggtcgtggattctcgcctcaagaagcagagttccaacaaaaacatcctttccccccacacacctagtccagtgtttctcatgggagccaacactcaggacactaaaaactcacggcaccagttttgtcttgcacaggtcagttggatcaagaacagagtgttaaaaaagtggaagacaagattaaaccagctctggtag

SEQ ID NO: 217464 - DNA, 696 bp, Artificial Sequence
  Description of Artificial Sequence: Synthetic coding sequence
atgctgctcctgttcctgctcttcgaaggactgtgctgccccggagaaaacacggccgcaccccaagcattacaatcttaccacttagctgccgaagagcaactttcgtttcgcatgttacagacatcaagcttcgccaaccacagttgggcccacagtgagggctcaggctggttgggtgatctgcagacccacggctgggacactgtgttgggaaccattaggtttctcaagccgtggtctcatgggaatttcagcaagcaagagctgaagaacctccagagtctgtttcagctatattttcactctttcatacagatcgttcaggccagtgccggacaatttcagctcgaacttaaacccgaggcgtggctgagttgtggccctagtccaggtcccggacggctgcaactggtctgccacgtgtccggattttatccaaaacctgtgtgggtaatgtggatgagaggagggtatagcatcttcttgattctcatctgcctgactgtaatcgttactctggtgatcctggtggttgtggactctagactgaaaaagcagtcccccgttttccttatgggggcaaacacacaagatacaaaaaatagccggcaccagttctgccttgcacaggtcagctggatcaaaaaccgggtgctgaagaagtggaaaacgcggctcaaccagctctggtag

SEQ ID NO: 217465 - DNA, 861 bp, Artificial Sequence
  Description of Artificial Sequence: Synthetic coding sequence
atgttactcctgttcctcctttttgaaggactgtgctgccccggagagaatactgccgcaccccaggcgctgcagagctatcatctagcagctgaggagcagctgtcttttcgaatgctgcagacatcaagtttcgcaaaccactcatgggcccattcggaagggagcgggtggttgggcgacctgcagacacatgggtgggatacagtcctagggaccatccggtttctgaaaccgtggagtcatggaaatttcagtaaacaggagctgaagaacctacagtccctcttccagctgtatttccattccttcatccaaatcgttcaagctagcgcgggtcagtttcagctggagttgaagcctgaggcttggctgagctgcggtccaagccccggacccggtcgcctacagcttgtgtgccacgtgtctggtttttacccaaaacctgtgtgggttatgtggatgcgaggcgagcaggaacaacgaggcacccagcggggtgatgtgctccctaacgcagacgagacctggtatctccgcgcaactctcgacgtcgctgcgggagaggctgcagggctctcgtgccgcgttaagcacagctccctgggagggcatgacttaattatacactggggaggttattcaatttttcttatactcatctgcctgaccgtcatcgttaccttggtgattctagtggtggtcgactcaaggcttaaaaaacagtcgcccgtgtttctgatgggcgctaacacccaggacactaaaaacagcagacaccagttctgtctcgcccaggtgtcctggattaaaaatagagtgttgaagaagtggaagacgaggcttaaccagctatggtag

SEQ ID NO: 217466 - DNA, 399 bp, Artificial Sequence
  Description of Artificial Sequence: Synthetic coding sequence
atgttactgctgttcctgttattcgagggattatgttgtcccggtgaaaatacagccgtgaagcctgaagcctggctctcatgtgggcctagcccaggacccggtcgactgcagctggtatgccatgtctcagggttctatcctaagccagtgtgggtaatgtggatgcggggtgggtacagcatctttctgattctaatctgtctcacagtgatcgtcacgttggtaatcctcgtggttgtggattcccggcttaagaaacaatccccagtgttcctgatgggggctaacacccaggataccaagaacagcagacatcaattttgtctggcccaagtgagctggattaagaacagagtgttgaagaagtggaagacacggctcaatcagctctggtag

SEQ ID NO: 217467 - DNA, 1131 bp, Artificial Sequence
  Description of Artificial Sequence: Synthetic coding sequence
atgcttctgctgtttttgttattcgagggtctgtgttgtcctggtgaaaataccgctgccccacaagcattgcagagttaccacctggcggcagaggagcaactgagcttccgcatgctgcagacctcctcatttgcaaatcattcttgggcccacagcgaagggtctggctggcttggagatctccagacacatggctgggatactgtcctgggaaccattcgatttctcaagccgtggtcacacggaaatttctccaaacaggagctgaaaaatcttcagagtctgtttcaactgtacttccattccttcatacagatcgtgcaggcctctgccggacagtttcaattggaatacccattcgaaatccaaatattagccggttgccggatgaacgcccctcagatttttctgaacatggcctatcagggctccgacttcctgtcattccaaggaatcagctgggagccttcaccaggtgctggcattcgggcacagaacatctgtaaggtgctaaatcggtatctggatatcaaggaaattctgcaaagtctcctgggccacacgtgcccgcgattcctcgccggactcatggaggccggagagtctgagctgaaaaggaaagttaagcctgaggcctggctcagttgtggcccatcacccggtcccggaaggttgcagctggtgtgtcatgtatcaggcttttaccccaaaccagtgtgggtaatgtggatgcgcggtgagcaggaacagcgcggtactcagagaggtgatgtactgccaaacgcagatgaaacatggtatctgagagcaaccctggacgtagctgctggcgaggccgcaggtctctcttgcagggtgaagcatagcagtctgggcggtcacgatttgataatccactgggggggttattcaatctttctcattctcatctgccttacagtgatcgtgaccctggttattttggtcgtagtcgacagcagactgaagaagcagtctccagtctttttgatgggcgcaaacacgcaggataccaagaacagccgacaccaattttgtctggctcaggtgtcatggataaagaacagggtcctcaagaaatggaagacacggttgaatcagctgtggtag

SEQ ID NO: 217468 - DNA, 873 bp, Artificial Sequence
  Description of Artificial Sequence: Synthetic coding sequence
atgctgctgctgtttctgttgtttgagggcctgtgctgccctggagagaacaccgcggctccacaagcccttcaatcttaccacctggccgcagaggagcagctgagctttcggatgctacagacttcctcctttgcaaatcactcctgggcgcatagcgagggctcaggctggctgggggatttgcagacccatgggtgggacacagttctgggcaccatcaggttccttaagccttggtcccatggcaacttcagcaagcaagaactgaagaacctgcagtccctgtttcagctgtactttcacagctttattcaaattgtccaggcctcagcagggcaatttcagctcgaataccccttcgaaatccagatcctcgccggatgtaggatgaatgccccacagatatttcttaacatggcttatcaaggcagcgacttcttaagctttcaagggatctcatgggagccgagtcccggagccggaatccgcgctcagaacatctgcaaggtgctcaacagatacctggatatcaaggagatcctgcagtccctgcttggccacacatgtcctcgcttccttgccggtttgatggaggccggtgaatctgaactgaagaggaaggtaaaaccagaggcatggctgagctgcggccctagcccaggaccaggccgactccaactcgtctgccacgtgagcggcttttatccgaagcccgtatgggtcatgtggatgcgcggagagcaagaacagcgcggaacccagcgtggcgacgtgctgcctaatgccgatgagacctggtggatcttccacctgagccaccccgatttatttgactgcgattcatatccaggtcatattggatgcagctag

SEQ ID NO: 217469 - DNA, 183 bp, Artificial Sequence
  Description of Artificial Sequence: Synthetic coding sequence
tgagtgtcaggattctatcctaagcccgtatgggttatgtggatgagaggcgagcaagagcaaagaggcacccagcggggtgatgtgcttcctaatgcggatgaaacttggtggatattccacctcagccacccagatctgtttgactgtgattcgtacccaggccatatcgggtgttcatag

SEQ ID NO: 217470 - DNA, 966 bp, Artificial Sequence
  Description of Artificial Sequence: Synthetic coding sequence
atgctgcttttatttctgctgttcgaaggactctgctgcccgggtgaaaacaccgccgcaccacaggctctgcaatcgtatcatctggctgctgaggaacaattaagcttccgaatgctgcaaacctcctcctttgcaaaccactcctgggcgcattccgaaggatccggctggttaggcgacctccagacacacgggtgggacactgtgctggggaccatacgattcttaaaaccatggtctcacggaaattttagtaagcaagaactcaagaacctgcagagcctgtttcagctctattttcactccttcatacagatagttcaggcaagcgccggtcagtttcaattggagtaccctttcgaaattcagattctggctgggtgtcgaatgaatgcaccccagatctttttgaatatggcttaccagggaagcgactttctgtcctttcagggcatcagttgggagcccagcccgggagcgggtattcgggcacaaaacatctgtaaagttttgaaccggtacctcgatatcaaagagatcctgcaaagtctgctaggccacacctgtcccaggttcctcgccggactcatggaggctggcgaatctgagctgaagcgtaaggtgaaaccagaagcctggttgagttgtggcccttcacccggacccggacggctccaattagtttgtcacgtttccggcttctatccaaaacccgtttgggtaatgtggatgaggggcggatactccatcttcctaatactgatctgcctgactgtgatcgtcacacttgtaattctcgtggttgtggatagtaggctgaagaagcagtcacctgtgttccttatgggggctaatacccaggacacaaagaacagccgtcaccaattctgcctggctcaagtttcctggattaagaaccgtgtgctgaaaaagtggaaaacacgattgaatcaattatggtag

SEQ ID NO: 217471 - DNA, 306 bp, Artificial Sequence
  Description of Artificial Sequence: Synthetic coding sequence
atgcttttgcttttcctactgtttgaagggctttgctgccctggtgagaataccgctgtcaaaccggaggcttggttgtcctgcggtccgtctcccggacctggcaggctgcagcttgtttgccacgtgagtgggttctatcctaaacctgtgtgggttatgtggatgagaggtgaacaggagcaacggggtacacagcgcggagatgtattaccaaatgcggacgaaacatggtggatttttcatctcagtcaccccgatctgttcgactgtgactcctaccctggacacatcgggtgttcctag

SEQ ID NO: 217472 - DNA, 897 bp, Artificial Sequence
  Description of Artificial Sequence: Synthetic coding sequence
atgcttctcctcttcctgctgttcgaaggcctttgttgcccgggtgagaacactgccgctcctcaggctctgcaatcttatcatctcgcagccgaggagcagctgagcttcaggatgttgcagactagtagtttcgcgaaccatagctgggcccacagcgagggatcagggtggctcggcgacctgcagactcacgggtgggatacagtcctgggtaccattagattcctcaagccctggtcccatggaaatttcagcaagcaggagcttaaaaacctgcagtcactgtttcaattgtatttccacagtttcatacagattgtccaggccagcgctggacaattccagctggaattgaagcctgaggcctggctgtcgtgtggtccttcccccggaccaggaagattgcagcttgtctgtcatgtttccggattctaccctaaacccgtgtgggtaatgtggatgagaggtgagcaggaacagaggggaacacagcgaggcgacgtcctgcctaacgccgatgaaacctggtatcttagggccacgttagatgtcgctgctggtgaggccgcaggcctgtcttgccgtgtcaagcatagttcgctcggtggccacgatctcataatccactggggtggctactctatctttttaatccttatctgcctcacggttattgtaacacttgtgattctggttgttgttgactccagactcaagaaacaatcctccaacaagaatatcctgtcgccacacacaccttctcccgtgtttctgatgggggcaaatacgcaggacactaagaactccagacaccagttttgcttggcacaggtcagctggataaaaaatcgagtgctgaagaagtggaagaccaggttaaaccagctgtggtag

SEQ ID NO: 217473 - DNA, 564 bp, Artificial Sequence
  Description of Artificial Sequence: Synthetic coding sequence
atgctactgctgttccttctttttgaaggcctctgttgtcccggagagaacactgcagtcaagcccgaggcctggcttagttgtggcccaagcccaggtcccggaagactccagctggtgtgtcatgtctctggtttctacccaaaacctgtttgggttatgtggatgcgcggagaacaggagcagagaggaactcagagaggtgacgtgctgcctaatgccgatgaaacatggtacctaagagcaacactggatgtcgctgctggcgaggcggctggattgtcttgccgtgtgaagcactcatccctcggaggccacgatctgatcatccattggggaggttacagcatattcttgatcttgatttgcctgacagtgatcgtgacattggtgatattagtcgttgtggactctagactgaagaaacagagtcccgtctttctcatgggggcaaatacgcaagacacaaagaacagcaggcatcaattttgccttgcacaggtgagctggatcaagaaccgcgtgctgaaaaaatggaagacacgcctgaatcagctatggtag

SEQ ID NO: 217474 - DNA, 1167 bp, Artificial Sequence
  Description of Artificial Sequence: Synthetic coding sequence
atgctgctcctttttctcctgtttgagggactatgttgtcccggtgaaaatacagccgctccccaggccctccagagctatcacctcgccgcagaggagcagttgagttttcggatgttacagacctcgtctttcgcaaatcattcttgggcacactccgaaggcagcggctggctgggggatttgcaaacccatggatgggacaccgttttggggacgataagatttctgaaaccttggagtcacggcaactttagcaagcaggaactgaagaatctgcagtctctgtttcagttgtactttcatagcttcattcaaatcgttcaggcttcagctggtcagttccagctggagtatcctttcgagatccagattctggccggatgtcggatgaatgcccctcagatcttccttaatatggcttatcaggggtcagacttcttgtccttccaggggataagctgggagccctcgcccggagctggcatcagggcccagaatatatgcaaggtgcttaatcgatacctggacattaaggagatcctccagtccctcttgggccatacctgccctagattcctagctggattaatggaggccggagagtctgagctgaaaagaaaggtgaaacctgaagcttggctttcctgcgggccatccccgggacccggacggttgcagttagtgtgccatgtcagcggtttttacccaaaacctgtatgggtaatgtggatgcggggagaacaggagcagcgcggaacccagcgcggtgatgtgctgcctaacgccgacgaaacatggtatctgcgagctaccctggatgtcgccgctggggaagccgctggcctctcctgccgggtcaaacattccagccttggaggccatgacctcattatccactggggcggttacagtatctttctgattctgatctgccttacggtcatcgtgaccctagtgattctcgttgttgtggattcccgcttgaaaaaacagagtagcaataaaaacatccttagtccccatacacctagccccgtgttcctgatgggcgctaatacccaggacaccaagaacagcaggcaccaattctgtctggcccaggtctcttggattaaaaacagggttcttaagaaatggaagacccggctcaatcaactatggtag

SEQ ID NO: 217475 - DNA, 1023 bp, Artificial Sequence
  Description of Artificial Sequence: Synthetic coding sequence
atgatcaaaagcagagtgaaaaggtaccgccgaagacgtggttcccagagagctccccaggcccttcagtcttaccatctggctgctgaggaacagctctccttccgcatgcttcagactagctcctttgccaaccacagctgggctcattcggagggatcaggatggcttggggatctccagacacatggttgggatacagtcctggggacaattagatttctcaagccatggagtcacggcaattttagtaagcaggagctgaaaaacttgcaatcattgtttcagctgtacttccatagcttcatccagattgtgcaggcgagcgcgggacagtttcagcttgagtatccctttgagatccagatactggctggctgcagaatgaacgcaccacagatctttctcaacatggcatatcagggatctgatttcttatccttccaaggcatctcctgggaaccctcacccggtgccggaatccgggcacaaaacatctgcaaggtgctgaaccgttatctggatattaaagagattctgcagtctttgctggggcatacatgccctaggtttcttgcgggactgatggaggcaggggaatccgagctgaagcggaaagtcaaacctgaggcttggctgagctgcggtcctagtcctggacctggcaggcttcagttagtctgccacgtgagcgggttctacccaaagcctgtgtgggtcatgtggatgcgtggggagcaggaacagcgtgggacccagcgcggagatgtcctacccaatgctgatgaaacatggtacctgcgggcaacattagacgtggccgcaggggaagctgctgggctgtcctgtagggtgaagcatagtagcttggggggacacgacctgataatccattggggggaaaagcagctacggttgtgctgggaaatcatgaagatcgccctgggactgctgtctgtgggactgcgcaaatgggtgggtatgctgggcaccagaagggtcaaattgggccagagtaaatag

SEQ ID NO: 217476 - DNA, 870 bp, Artificial Sequence
  Description of Artificial Sequence: Synthetic coding sequence
atgctcctgttattcctgctgtttgaaggattgtgctgcccgggtgagaacacagctgatccatttgagatccaaattctcgcaggctgccgcatgaatgcacctcaaatatttcttaatatggcctaccaggggtctgatttcctgtccttccagggcataagttgggagcctagccccggtgcagggatcagagcgcagaacatctgtaaggttctgaatagatacctggatatcaaggagatcttgcagtctcttttaggccacacttgccccaggttcctggcgggactcatggaagccggtgagagcgagctaaaaaggaaagtcaagcctgaagcgtggctgtcttgtgggccaagtcctgggccaggcaggctgcagctggtgtgccacgtcagcggattttatcctaagcccgtgtgggttatgtggatgcgaggagaacaggaacaacgcggtactcagcggggtgatgtccttcctaatgcggatgaaacctggtatctgcgagcaaccctggatgttgctgctggtgaggccgctggattgtcctgcagggtgaaacattcctccttgggtggacatgacctcataattcactggggaggatattccatttttctgatactgatttgtctgactgttatcgttactcttgtgattctagtggtcgtggactctcgcctgaaaaagcagtcgagcaacaagaacatactgagccctcataccccatcacccgtctttctcatgggtgccaacacacaggacactaagaactctagacatcagttttgtcttgcacaggtgtcttggatcaagaatagggtactgaaaaaatggaagacaagacttaaccagctttggtag

SEQ ID NO: 217477 - DNA, 600 bp, Artificial Sequence
  Description of Artificial Sequence: Synthetic coding sequence
atgttactcctgtttctgctgtttgagggcctctgctgtccaggcgagaacacagcagttaagcccgaggcctggctgtcctgtggccctagccccggtccaggccgtctccaattggtatgccacgtgtcaggattctacccgaagcccgtttgggtgatgtggatgcgaggggagcaagagcagcgcggtactcagcgcggagatgtattgccgaatgccgacgagacttggtatctccgtgccaccctggatgtggcggcaggggaggcagcaggactgtcgtgtagagtaaagcactccagccttggtggccacgacctcataattcattggggcggatatagtatcttcctgatcctgatctgcctgaccgtgattgtgactcttgtgattttggtggtggtggactcacgcctaaagaagcagagttccaataagaatatcctgagccctcatactccctctccagttttcttgatgggggcaaacacgcaggatacgaaaaacagcagacaccagttctgcctggctcaggtgtcatggatcaaaaacagggtgctcaaaaagtggaaaacccgactgaaccagttgtggtag

SEQ ID NO: 217478 - DNA, 1047 bp, Artificial Sequence
  Description of Artificial Sequence: Synthetic coding sequence
atgctatgcccctggagaacagctaacctcgggctcctgttaatcttgaccatcttcctggtggccgaagctgagggcgctgctcagcctaataacagcctgatgcttcagacatccaaggagaaccacgcactcgcatccagttctctctgcatggatgagaagcagattacccagaactacagcaaagtactggcagaagttaatactagttggccagtaaaaatggccaccaacgctgtcctttgctgtcctcctatagctctgaggaaccttatcattattacctgggagataatattgcgaggacagccgtcctgtactaaagcatacaagaaagaaaccaatgaaactaaggaaacaaactgcactgatgagcggataacctgggtgtccagaccggatcaaaatagcgacctgcaaatcaggacagttgcaataactcacgacgggtattataggtgtataatggtcacgccagatggcaactttcaccgaggctatcatctgcaggtgttggttactcccgaggttaccctattccagaacaggaaccgtactgcagtgtgcaaagccgttgcaggaaagcccgctgcacacatatcctggatcccagagggggattgcgctaccaagcaagaatactggtcaaatggaacagtcacagtaaaaagcacctgccactgggaggtacacaacgtgtctaccgtgacgtgtcacgtgagtcacttgacaggtaataagtccctgtatatcgaactcttgcctgttcctggagccaaaaagagcgccaagctgtatatcccctatattatattgacgatcattattctgaccatcgtcggctttatttggctccttaaggtgaacggctgtcggaagtacaaacttaacaagacagagtcaacgcccgtcgtggaagaggatgagatgcagccatatgcctcctacacagagaagaataatcctctatatgacactaccaacaaggtgaaggcgagcgaggctttgcaaagcgaggtcgataccgacctccatacactgtag

SEQ ID NO: 217479 - DNA, 567 bp, Artificial Sequence
  Description of Artificial Sequence: Synthetic coding sequence
atgctgtgtccatggcgtacggcaaacctcggcctgctgctcatcctgacaattttcctcgtggccgaagctgaaggtgccgcacagccaaataattctttaatgctgcagactagcaaagaaaaccacgctctggcttcaagcagcctgtgcatggacgaaaagcagatcactcagaattacagtaaggtcctggctgaggtgaacacaagctggcctgttaagatggctaccaacgccgttctgtgctgcccaccaatcgccctaagaaatctcataattatcacctgggagattattctgagaggtcagccttcctgtactaaggcttataaaaaggaaaccaatgaaacaaaagagaccaattgtaccgacgaacgtataacctgggtgagcaggccggatcagaattccgacttgcaaatccgcacggttgctattacccacgatggctattaccgatgcatcatggtgacccctgacggcaatttccaccggggttatcatctgcaagtgctgggaaaggaacaccatattctgcgatacttcaccagccctgatttatag

SEQ ID NO: 217480 - DNA, 978 bp, Artificial Sequence
  Description of Artificial Sequence: Synthetic coding sequence
atgttatgcccttggcgaacggcaaatttaggcctgcttctcattttgaccatttttctcgtggccgctagctctagcctgtgtatggatgaaaagcaaattacgcagaactattcgaaggtgctggccgaggtaaatacctcttggccagtgaaaatggctactaacgccgtgctgtgctgcccacccatcgctttaagaaatctgataataatcacctgggaaattattctccgtggccagcccagttgcacaaaggcatacaagaaagagaccaacgagaccaaagagaccaattgtacagatgagcggatcacatgggtgtcaaggcccgaccagaacagtgacctccagatcagaacggttgccatcacacatgacggatactaccgttgcattatggtaacccccgacggcaactttcatcgaggctaccacctacaagtcctagtcacacctgaggtaactttattccaaaacaggaataggacggcagtttgtaaggccgtcgccggaaagccagccgcacacatcagttggattccagagggcgattgtgccactaagcaggaatactggtccaacggcaccgttactgtaaaatccacttgtcattgggaggtgcacaacgtttctaccgtgacgtgtcatgtcagccaccttaccggcaataagtctctctatatcgaactgttgcccgtcccaggggctaaaaagtccgcgaagctgtacatcccgtatatcatacttactattatcatcctaacaatcgtcggtttcatctggcttctgaaagtgaatggctgccgcaagtataaattgaacaagacagagtctacacctgtggttgaggaggacgagatgcagccatacgccagctatacagaaaagaataatcctctttatgacaccacgaacaaggtcaaggcatcagaagctctgcaaagtgaagtggacacagacctccacaccctttag

SEQ ID NO: 217481 - DNA, 498 bp, Artificial Sequence
  Description of Artificial Sequence: Synthetic coding sequence
atgttgtgtccctggcgcacagccaatctcggcctgctactcatactcaccatcttcctagtggccgcatcaagctcactatgtatggacgagaagcagatcactcaaaattactctaaagtcctcgccgaagtgaatacttcttggcccgtgaaaatggctactaacgccgtgctttgctgccccccaatcgctctacggaatctcattattattacctgggagatcattcttaggggccagccctcatgcaccaaggcgtataaaaaagaaaccaatgagacaaaggagaccaactgcacagacgaaaggattacctgggtgagcagaccagaccaaaactcggacttacagatcagaaccgtggctattacccacgatggatactacaggtgcatcatggttactcccgatggcaactttcaccgcggatatcacctgcaagtgctgggtaaagaacatcacattttacggtactttaccagccctgacctctag

SEQ ID NO: 217482 - DNA, 987 bp, Artificial Sequence
  Description of Artificial Sequence: Synthetic coding sequence
atgacggtggagaaggaggcccctgatgcccatttcacagtggacaaacagaatatctctctgtggccaagggaacctccccctaagtcaggaccctcgttggtcccagggaaaacacccactgtcagggcagccctgatatgtctcaccctggtcctggtggcctcagttctgctgcaggccgtcttgtacccgagattcatgggaacgatcagcgacgtgaagacaaatgtacagttgttaaagggacgcgtggacaacatctcgaccttagactccgaaatcaaaaaaaactctgatggtatggaagcagccggagtgcagattcagatggtcaacgagagcctaggttacgtccgcagtcagttcctgaagctcaaaacgtccgtggaaaaggccaacgctcagatccagatactcactagatcctgggaagaggtttccaccctgaacgcccagattcctgaactcaagagtgatctcgagaaggcctcggcactgaataccaaaattcgtgctctgcagggatcactggaaaacatgtccaagctgctgaaacggcagaatgacattctccaggtagtgtcacagggatggaagtatttcaagggcaatttctattacttcagtctgatcccaaagacttggtatagtgccgagcaattctgcgtgagccgaaactcgcacttgacatctgttacctccgagtctgaacaggagttcctgtacaaaactgcaggaggactgatctactggatcggcctgactaaggctggtatggaaggcgattggtcctgggtagacgacacaccattcaataaggtgcagagcgtcagattttggattcccggagaacccaacaatgcaggcaataacgagcactgtgggaacatcaaggccccaagcctgcaggcgtggaatgacgccccatgtgacaaaacttttcttttcatttgtaaacggccatatgtgccctccgagccctag

SEQ ID NO: 217483 - DNA, 4497 bp, Artificial Sequence
  Description of Artificial Sequence: Synthetic coding sequence
atggatggggcttccgccgagcaggatgggctacaggaagatcggtcccacagcggaccaagcagtcttccagaggccccacttaagccacctggcccactggtgcctcccgatcagcaggacaaggtccagtgcgccgaagtgaacagagcatcaactgaaggggaatctccagacgggccaggccaaggaggattgtgccagaacggcccaacccccccattcccggatcccccatcgtctcttgacccaaccacctcacccgttgggcctgacgctagcccaggcgtggccggatttcacgataacctcagaaagagtcagggcacatcagctgagggctccgtccggaaggaggccctgcagtcattgagactctcactaccgatgcaagaaacgcaactgtgctctaccgacagccctctgcccctggagaaagaggagcaggtgaggctgcaggcgcgtaagtggctggaagagcagctgaaacagtacagagtcaagcggcagcaggaacgctccagccagccagcgactaaaacacggctcttttctacccttgacccggagctgatgctcaaccctgagaacctgccgcgagcaagcacacttgccatgaccaaggagtacagtttcttgcgcaccagcgtgcccagaggaccaaaagtgggttctctcggtcttcctgcccatcccagagaaaaaaagacatccaagtcatccaaaatccggtccttagctgattataggacagaagactccaatgcgggtaattctgggggtaacgtccccgctccggacagtactaagggctctctgaagcaaaatagatcgagcgctgcaagcgtggtaagcgagatttcgcttagccccgacaccgacgaccgcttggagaatacgtcacttgctggggattcagtcagtgaagtggatgggaacgatagcgatagtagttcctactccagcgccagtacccgcggaacctatggcatattgtctaaaacggtaggcacgcaggacacaccctacatggtaaacggccaggagattcccgctgataccctcggtcagtttcccagcatcaaggatgtgctgcaggccgctgcagccgagcaccaggaccagggccaggaagtcaacggcgaagtccgttcaaggcgcgacagcatctgttccagtgtatcactggagtccagcgcagccgagactcaggaagaaatgttgcaggtcctgaaggagaaaatgagactcgaggggcagttggaggccctctctcttgaggccagccaggctttgaaagagaaggccgagctgcaggctcaactggccgcactttcaaccaagcttcaggcccaggtcgaatgtagccacagttcccagcaacggcaagatagccttagctctgaggtggacaccttgaagcagagttgttgggacctagagcgtgcaatgaccgatctacaaaatatgctcgaggcaaaaaatgcttcgctggccagctcaaataatgatcttcaggttgccgaagaacagtatcagaggctcatggccaaggtggaggacatgcaacgatccatgctttcaaaggataatactgtgcatgacctacgccagcagatgacggcacttcagagtcagctgcagcaagtacaattagagagaacaacactaacgtctaaacttaaagcatcacaggccgagattagctcgctccagtctgtgcgccagtggtatcaacagcagttggcactggcacaggaagctagggttcgattgcagggcgagatggcccatatccaggtcgggcagatgacccaggccggacttctcgagcacctcaagctggagaacgtgagcctttcacaacagttgaccgagacccagcaccggtctatgaaagaaaagggccgaattgccgcacaacttcaaggcattgaagcagatatgttggaccaggaagccgcttttatgcaaattcaggaggccaagactatggtggaagaagacctgcagcggaggctggaagagttcgagggagagcgcgagcgtctgcagagaatggcagattctgctgcgagcctggagcaacagctcgaacaagtcaaacttacactgttacagagggaccagcagctggaggccctccagcaggagcaccttgacctgatgaagcagctgaccctgacccaagaggccctccagagcagggagcagtccctggatgctctgcagacacattacgatgagcttcaggccaggctgggcgagttgcagggggaggcagcttccagagaggacaccatttgtttactgcagaatgagaaaattattcttgaggctgcactccaggccgcaaaatcgggcaaggaggaactggatcgcggtgctagaaggcttgaggaggggacagaggaaacaagcgaaactctagaaaagctccgcgaggaactcgccatcaaatctggacaggttgaacacctgcagcaggaaacagctgcgcttaaaaaacagatgcaaaagatcaaggagcagttcctgcagcagaaggtgatggtggaagcatatcgacgcgatgcaacatctaaagaccagctcatttctgagctgaaggcaacacggaaacgcctggattctgaacttaaggagctgcggcaggaactgatgcaggtgcatggtgagaaaagaacagcggaggcagaattgtctagactccacagagaggttgctcaggttcgccagcacatggctgatcttgagggccaccttcagtctgctcagaaggagagagacgagatggaaacgcacctgcaatccctgcagttcgacaaagagcaaatggtcgccgttacagaagcaaatgaagccctgaagaagcagatagaggaactccagcaagaggcgcgaaaggcgataacggagcagaagcagaaaatgcgtcgtctaggcagcgatttaacatctgcccaaaaagagatgaagaccaagcataaagcatacgagaatgcagtcggcattctctcccgtagattgcaagaggccttagccgcaaaagaggctgccgacgctgaattagggcagctacgggctcagggtggctcaagcgacagctccctggctctccacgagcgaatacaggcactggaagctgaactgcaggcagtgagccattcgaaaacactgctggaaaaagagctccaggaggtgattgccctcaccagccaagaactggaggagtctagggaaaaagtgctggagctggaggatgaactccaagaatcaaggggttttagaaagaaaatcaagcgcctggaggagagcaacaaaaaactagcacttgagctcgagcacgagaaaggaaagctcacaggtctgggccagagtaatgctgccctccgtgagcacaatagtatcctagagactgccctcgctaaacgcgaggctgatctcgtccagctgaatcttcaggtgcaggccgtccttcaacggaaagaggaagaggataggcagatgaagcatctggttcaggccctacaggcctccttggaaaaggaaaaggagaaagtcaacagcctgaaggaacaggtggctgcggctaaggtagaagctggacataatcggaggcactttaaggccgcttccctggagttatctgaggtcaaaaaagagcttcaggcgaaagagcacttggtgcagaagctacaggctgaggccgatgacctgcagatcagagagggcaaacactctcaggagatcgcacagttccaagctgagctggccgaggctagggcccaactccagttactacagaagcaactggatgaacagcttagcaagcagccagttggaaaccaagagatggagaatctaaaatgggaagtggatcagaaagagagagagatccaatcattaaaacagcagctcgatctgactgagcaacagggaaggaaggaattagaaggcctccagcaactcctccagaacgtgaagagcgagttagagatggcacaggaagatctttctatgacccagaaggataaatttatgctgcaggctaaggtgagcgaactgaagaataatatgaagacccttttgcaacagaatcagcagctcaaactggatctgcggagaggggctgcgaaaacaaggaaggaacccaagggagaggctagctcctctaatcccgcaaccccgattaagatacccgactgccctgtcccagcctccctccttgaggagctgttacggccaccccctgcagtgtccaaggagcctttgaaaaatttgaactcctgcttgcagcaactcaaacaggagatggattcattgcaaaggcagatggaagaacatgcactcacggtgcatgagtcgctctcttcctggacgccactggaacctgccacagcatctccagtgccgccagggggacatgcagggcctcggggagaccctcaacgccactctcaatctagagcctctaaggaagggccaggcgagtac

SEQ ID NO: 217484 - DNA, 807 bp, Artificial Sequence
  Description of Artificial Sequence: Synthetic coding sequence
atgagcgatagcaaagagccccgactgcagcaattaggactgctggtgagtaaagtgcctagcagcatttctcaggagcaaagccggcaagacgcaatctaccaaaacctgactcagctgaaagctgctgtcggggaactgagcgagaagtccaagctgcaagaaatctatcaggagctgacacagctgaaggctgccgtgggggagctccctgagaagtccaaactgcaggaaatctatcaggaacttacacggctcaaggccgctgtgggagagttaccggaaaaatcgaaacagcaggagatctaccaggagctgactcagctcaaggcggcagtcgagaggttatgccacccttgtccatgggagtggaccttttttcagggcaattgctattttatgagcaactctcagagaaactggcatgactcaattacagcctgtaaggaagtgggcgctcagcttgtggttattaaatctgccgaggagcagaactttctgcagctgcagtccagtaggagcaaccggttcacatggatgggcctcagcgaccttaatcaagagggcacttggcaatgggtcgatggcagtcctctgctcccctcattcaagcagtactggaaccggggtgagccaaacaacgttggagaagaggactgtgctgagttttctggcaatggatggaacgatgataagtgcaacctcgccaagttctggatctgtaagaaatccgcagcctcctgtagtagagatgaagaacagtttctgtcacctgctcctgccactcctaatccacctccagcgtag

SEQ ID NO: 217485 - DNA, 1143 bp, Artificial Sequence
  Description of Artificial Sequence: Synthetic coding sequence
atgtccgactcaaaggagccgagattacagcaactcggcctgttggaggaagagcaactgcgtggcttagggttccgtcagacccgcggatacaagtccttggcagtcagcaaggtgccttcgagcatttcacaggagcagtctaggcaggacgctatctaccagaacctgacccagctgaaggctgctgtaggcgaactcagcgagaagagtaagctccaggagatctaccaagagctgacccagctgaaagccgctgtcggagagctgcctgaaaaaagtaaactgcaggagatttatcaagagctaacaagacttaaggccgcagtgggcgaattacccgagaagtcaaagctgcaggaaatatatcaagagctcacgtggttaaaggcggcagtcggggagctcccagaaaaatctaagatgcaggaaatttaccaggaactcacccgccttaaagccgctgtaggggaactcccagagaaaagcaagcagcaggagatttatcaagaactcaccaggctcaaggctgcagtgggagaattacccgagaaatcaaagcagcaggaaatctaccaggaactcactcggctaaaagcagccgtgggcgaactgcctgagaagagcaaacagcaggaaatttaccaggaactaacacagctgaaagccgctgttgaacgcctgtgtcacccctgtccatgggaatggacatttttccaaggtaactgctatttcatgtctaactcccagcgcaactggcatgattccatcacagcttgcaaggaagtgggagctcagctcgtcgttatcaagtctgccgaggagcagaattttcttcaactgcagtcctcccggtctaacaggtttacctggatggggctcagcgatcttaaccaggaaggtacttggcagtgggtggacgggtctcctttgttgccctctttcaaacagtactggaacagaggtgaacccaacaacgtgggtgaagaagactgtgcggaatttagcgggaatgggtggaatgacgacaagtgcaaccttgcgaagttctggatctgtaagaagtctgccgcttcgtgcagcagggacgaagagcagtttctgtctccagcccctgctaccccaaacccgccacccgcttag

SEQ ID NO: 217486 - DNA, 1215 bp, Artificial Sequence
  Description of Artificial Sequence: Synthetic coding sequence
atgtctgactctaaagaaccacgcttgcagcagttaggcctgttggaggaggaacaactaagagggcttggtttccggcagacccgcggttataagtccctggccggatgtctggggcatgggccattggtcctacagttattgagtttcacgctgttagcaggcctgcttgtgcaggtgtccaaggtgccttcaagtatctcccaggagcagagtcggcaggacgcaatatatcaaaacctgactcagctcaaggcagctgttggggaactgtcagaaaagtctaagctacaggagatctaccaggaattgacacagcttaaagcagcggtgggagaattgccggagaaatctaaactgcaggagatctaccaggagctgacccgcctcaaggccgcagtcggcgagttacccgagaaaagtaaattacaagagatataccaagagcttacttggttgaaggctgccgtcggcgagctccccgagaaatcgaagatgcaagagatttatcaggaattgactcgcttgaaagccgcagttggcgagctgcccgaaaagagcaagcagcaggagatttatcaggagctgaccaggctcaaagctgccgtgggggagctacccgaaaaaagcaagcagcaggaaatttaccaggaactaaccaggcttaaggcggctgtgggggaattgcctgagaagtcaaagcaacaggagatctatcaggaattaactcaacttaaggcagctgttgagcgcctctgtcacccatgtccctgggaatggacattcttccaaggtaactgttacttcatgtcaaattcacagcgaaattggcatgattcaatcacagcctgcaaggaggttggggctcagctcgtcgtgatcaaatccgctgaggaacagaacttcttgcagttgcagagcagtaggtctaatcgattcacatggatggggctcagtgacctgaatcaggagggaacctggcagtgggtggatggctctcctttgttaccctctttcaaacagtactggaaccgcggagagcccaataatgtgggagaggaggattgcgccgagttcagcgggaacggttggaacgatgacaagtgcaacttggctaagttttggatatgcaagaagagcgccgcttcatgctcccgcgacgaggaacagtttctaagcccagcacccgctacacccaatcccccacccgcttag

SEQ ID NO: 217487 - DNA, 1197 bp, Artificial Sequence
  Description of Artificial Sequence: Synthetic coding sequence
atgtccgacagcaaagagccaagactgcaacaacttgggctgctcgaagaagagcagctgcgcggtctgggattcagacagacgaggggttacaagtcacttgccggatgcctgggacacggtcccctagtgttacaattattgtccttcacccttctcgcaggcctgcttgtccaggtgtctaaggttccttctagcatctcacaggaacagtcacgacaggacgctatctaccagaatctgacccagttgaaagctgcagtcggagaactttccgagaaaagcaaactgcaggagatataccaagagctgactcaattaaaagccgcagtgggagagctgccagaaaaaagcaagctccaggaaatataccaggagcttacaagactgaaggccgcagtgggagaactacccgaaaagagtaagcttcaggagatataccaagaacttacgtggttgaaggctgctgttggagagctcccagagaagagcaagatgcaggagatttatcaggagctgactaggttgaaagctgcagtgggagaattacccgagaagtcaaaacaacaggaaatctatcaggagctgacccggctaaaagccgcagtgggtgagctgcctgaaaagtctaagcagcaagagatttaccaggagttgaccaggctcaaggccgctgtgggggagctgccagagaaaagtaaacagcaggaaatatatcaggagctcacccaactgaaagctgctgtcgagcggctttgccacccatgcccctgggaatggacattctttcaaggaaactgctactttatgagcaactcccaacgcaattggcacgatagcataacggcttgtaaagaggttggagcccaactcgttgtgatcaagtcggccgaggaacagtctagtcggtctaatagattcacatggatgggtctgtccgacctgaatcaggagggcacctggcagtgggtcgacggctcaccactgcttccttcattcaaacagtattggaatcgcggtgagccaaacaatgttggagaggaagactgtgcagaattcagcgggaacggatggaacgacgataaatgtaacctggctaaattctggatttgcaaaaagtcagcggcttcgtgctcgagggatgaagagcagttcctgtcccctgccccagccaccccaaatcccccacctgcttag

SEQ ID NO: 217488 - DNA, 507 bp, Artificial Sequence
  Description of Artificial Sequence: Synthetic coding sequence
atgagtgattcaaaggaacctcgactgcaacagctggggctgctggaagaagaacagctccgaggtttaggattcagacagacccgtgggtacaagtctctggcaggttgcttgggccacggccctctggtactccagctgttatctttcacacttcttgccggtctgcttgttcaggtatcaaaagttcctagctccatctcacaggagcagtctagatccaaccgattcacttggatgggcctaagcgatttaaaccaggaagggacctggcagtgggtggatggatcacctctgcttccgtcctttaagcaatactggaatcgtggagagcccaataatgtgggagaggaggactgcgccgaatttagtggcaatgggtggaacgatgataagtgcaatttagctaaattttggatctgcaagaagtccgctgctagttgttccagggatgaggaacaattcttgtcgcccgcacccgctacacctaatccccctcccgcatag

SEQ ID NO: 217489 - DNA, 939 bp, Artificial Sequence
  Description of Artificial Sequence: Synthetic coding sequence
atgtccgactctaaggagccaagattgcaacagctgggattgctggaagaggagcagctccgcggattaggatttaggcagactagaggatataaatccctcgccggatgtctcggccatgggccacttgtacttcagctgctgtcctttacactattggccggactcctcgtgcaggtgtctaaagtcccaagcagcattagtcaggaacagagtagacaggacgccatataccagaaccttacccagctgaaggctgctgtgggggaactgagcgaaaaatccaagttgcaggaaatctatcaggaacttacccagcttaaagcagccgtgggggaactgcccgagaagtcgaaattacaggaaatttatcaagagcttacccggctgaaagccgctgtgggcgaactcccagagaaaagcaagcttcaagagatttatcaagagttgacatggctcaaagccgcagtcgaacggttgtgccacccatgtccatgggagtggacattctttcaagggaattgttacttcatgtccaatagtcagcgcaactggcacgatagtataacggcctgcaaggaagtgggagcacaactggtggtgattaagtcagccgaggagcaaaacttcctccagctccagtcttcaaggagcaacaggttcacctggatgggcttatcggacctgaaccaggagggtacatggcaatgggtcgatggatctccactgctaccctctttcaagcagtattggaacagaggtgaacctaacaacgtgggggaagaagactgcgccgagtttagcggaaacggatggaacgatgataagtgtaacctggctaaattttggatctgcaagaagagcgccgctagctgctctagggatgaggagcagttcttgtctcctgcgccagcgacccccaatcctcctcccgcatag

SEQ ID NO: 217490 - DNA, 105 bp, Artificial Sequence
  Description of Artificial Sequence: Synthetic coding sequence
atgtctgattctaaggagccaaggctgcagcaactgggcctgctcgaagaagaacaactccggggactgggcttcagacagaccaggcggaatcagaaatgctag

SEQ ID NO: 217491 - DNA, 855 bp, Artificial Sequence
  Description of Artificial Sequence: Synthetic coding sequence
atgtctgactctaaagagccgaggctccaacaactgggtctacttgggtgcctaggtcacggccctctggtgttgcaactgctctcatttactctgcttgccggtctcttggtacaggtgctcggacccgtgtcaaaggtgccgtcaagtatttcgcaagaacagagccgccaggacgccatttaccaaaacctgacccagctgaaggcggcagtgggcgagctttcagagaagtccaaacttcaggagatctatcaggaacttacgcaacttaaggcagccgtgggcgagctacccgaaaagtcaaagttacaggagatctaccaggaactgacacgcctaaaggccgcagtcggtgaactgcctgaaaaatccaagctccaagagatctaccaggaactgacttggctgaaggctgccgtcggcgaactgcccgagaaaagtaaaatgcaagagatctaccaagagctgactaggctgaaggctgccgtaggagagcttcccgagaaaagcaaacagcaggagatctatcaggagcttaccaggctgaaagctgctgttggtgaattgccggagaagtctaagcagcaggagatttatcaggagcttacacgccttaaagctgctgtcggagagctgccagagaagtccaagcagcaggagatctatcaggagttaactcagttgaaagctgctgtggagaggctatgccatccctgcccatgggaatggacattttttcaggggaactgttacttcatgagtaacagccaaagaaattggcacgattccattacggcttgcaaggaggtcggcgcacagttggtggtgatcaaatcagctgaagaacagtag

SEQ ID NO: 217492 - DNA, 939 bp, Artificial Sequence
  Description of Artificial Sequence: Synthetic coding sequence
atgtccgactctaaagaacctcggttgcaacagctaggacttctggaggaagagcaactacgcggactgggtttccggcagacaagaggatacaagtcattggctggctgcctcgggcatggccctctggttttgcagctgttatcgttcacactgctcgctgggctcttagtgcaggtgtccaaagtgccatcttcaatcagccaagaacagagccggcaggatgccatctatcaaaacctgacccaactcaaggctgcggtaggagagctctctgagaagtccaagttacaagagatttatcaggaacttacccaactgaaggctgccgtgggcgagctgcccgaaaaatccaagcttcaggagatctatcaggaactcacgagactgaaggccgctgtgggtgagttaccggagaaaagcaaactccaagagatctatcaggagctgacttggctgaaagcagccgtggagaggctctgccatccttgcccatgggaatggaccttctttcagggcaattgttattttatgtcgaattctcagcgcaactggcacgacagtatcactgcctgcaaggaggttggggctcagctcgtggtaataaaatccgcagaagaacagaacttcctgcagctacagtctagcagaagcaataggtttacatggatgggtctgagtgacctgaaccaggaaggaacatggcagtgggtggacggatccccgctgttgcccagtttcaaacagtattggaacagaggggaacctaataatgtcggggaggaagattgtgcagagtttagcggcaacgggtggaacgacgataagtgcaacctggccaaattctggatctgtaaaaagtcagccgctagctgttctagggacgaggagcagtttttgtcaccagcaccggcaacacctaatcccccacctgcctag

SEQ ID NO: 217493 - DNA, 1011 bp, Artificial Sequence
  Description of Artificial Sequence: Synthetic coding sequence
atggattatcccaccttgctgctcgcgcttctgcacgtgtatagggcgttatgcgaagaagttttgtggcacacaagtgtgccatttgcagagaatatgtccctggaatgtgtatatccctcaatggggatcctgacacaggttgaatggtttaagatcggaactcagcaggatagcattgccatattttctcctacccacggtatggtgatacggaaaccctacgcagaaagagtatattttcttaacagcaccatggccagtaataacatgacattattctttagaaatgcctctgaagatgacgtcggatactacagctgttccctatacacctatccacaggggacctggcagaaggtaatccaggtggtgcagtctgactcctttgaggctgcagtgccttctaatagccacatcgtctctgagcctgggaagaatgtgaccctcacctgtcagcctcaaatgacctggcctgtgcaggctgtaaggtgggaaaagattcagcccagacagattgaccttctgacatattgcaacctcgtccacggaaggaatttcacatcaaagtttccacgccaaattgtgagcaactgcagccacggcaggtggagtgtgattgtgataccggatgtgaccgtctccgattctggactgtatcggtgctacctgcaggcctctgcaggcgagaatgagacattcgtgatgcggctgaccgtcgctgagggaaaaacagataatcagtacacactgttcgttgccggagggactgttcttctgttactcttcgtaattagcattacaacaattattgtcatttttcttaaccgcagaaggcggcgtgagcgcagggatttgttcacggagagttgggatacccagaaggcccctaataactatcgctcccccatttccacctctcagcctacaaatcagagcatggacgacacccgcgaagatatctacgtcaattacccaactttttcacggaggcccaagacccgcgtctag

SEQ ID NO: 217494 - DNA, 822 bp, Artificial Sequence
  Description of Artificial Sequence: Synthetic coding sequence
atgctggggcaggtcgtgactttgattctgttactgctgttgaaagtttaccagggcaagggatgccagggctcagctgatcatgtggtctctattagcggcgtcccgctccagctgcagcccaattcaattcagactaaagtggactctatagcttggaagaagctactgcccagtcaaaacggcttccaccacatactcaaatgggaaaacgggtctctcccttccaatacctccaacgacaggttttctttcatcgttaagaacctgtcgctgctaataaaagccgctcagcagcaggattctgggctctactgtctggaggtgactagtatctcgggcaaagttcagacagcgaccttccaagtctttgtatttgaatttcgcttctggccatttcttgtaatcatcgtaattctgagcgccctgttcctgggaactctcgcgtgcttctgtgtgtggcggaggaagaggaaagagaagcaaagtgaaacatcacccaaagagtttctcactatatacgaggatgtcaaggacctcaagacgaggaggaaccatgagcaggagcaaacgttcccaggtggcggatcgaccatctactctatgatccagagccaatcttccgctccaacttcccaagagcccgcttatactttgtattccctgattcagcctagcaggaaaagcgggtcaagaaaaagaaatcactctccatctttcaattccaccatttatgaagtgattgggaagagtcagcccaaagcccagaatcccgctcgcctgtctcggaaggaactcgagaatttcgacgtatactcctag

SEQ ID NO: 217495 - DNA, 990 bp, Artificial Sequence
  Description of Artificial Sequence: Synthetic coding sequence
atgttaggccaggtcgtgacacttattctgctgttgctgctgaaggtctatcagggaaagggatgccagggatcagcagaccatgttgtatcgatctccggcgtacctctgcagcttcagccaaactctatccagaccaaggtggacagcatcgcttggaagaagttgctcccgtcccagaatggctttcatcatatcctcaagtgggagaatgggagcttaccctcaaacactagcaacgaccgattcagttttatcgtcaagaatctcagtctacttattaaggcggctcagcagcaagattcgggtctatactgtcttgaagtgactagcatctctggaaaagtacagacagctacctttcaggtcttcgtctttgacaaggtcgaaaaaccacgcctgcagggacagggaaagatcctcgacagaggcaggtgccaggtggccctgtcttgtttagtgagtagagacggcaacgtgagctatgcctggtacagaggatctaagctgatccagacggctggaaacctgacatatttggacgaagaggtggacattaatggcacccacacgtatacatgcaatgtcagcaaccccgtgtcctgggagtctcacactctgaacctgacccaggattgtcagaatgcccatcaggaattccggttctggccatttctggtgatcattgttatcctgtccgccctgtttcttggcacgctagcctgcttttgtgtctggcgccgaaaaagaaaggagaaacagagcgaaaccagccccaaggagttccttacaatatatgaggacgtaaaagatctcaagaccagacggaaccatgagcaggagcagacattccctggcggaggcagcactatttactctatgatccagagccagtcaagcgcaccaactagccaggaaccagcctataccctgtattcgctcattcagccctcacggaagggggatagattttacagtttctctggttag

SEQ ID NO: 217496 - DNA, 1113 bp, Artificial Sequence
  Description of Artificial Sequence: Synthetic coding sequence
atgctagggcaggtggtgaccctaatcctgctcctcttgctgaaggtttatcaaggcaagggatgtcagggcagcgcagatcatgtggtctcaatttccggcgtgcctctgcagctgcagccaaacagtatccaaacaaaagttgactctattgcgtggaagaagctcctgccctcccagaatggcttccatcacatacttaaatgggagaacggcagtttaccatccaacacttccaacgataggttcagcttcatcgtcaaaaacctgagtttgctgatcaaggcagcacagcagcaggactcaggactgtattgtctggaggttaccagcattagcgggaaagtgcagacggcaacctttcaggttttcgtattcgaaagtctccttcccgacaaagttgaaaaacctaggttgcagggtcagggcaagatcctggatcgcggacgctgtcaggtagcgctgtcttgcctggtctccagagatggaaatgtcagttatgcctggtatagagggtccaaactgatccagaccgccggaaacttgacctaccttgacgaagaggtagatatcaacggtactcacacatacacttgcaacgtgagtaaccccgtctcctgggagagtcacactttgaatcttacccaggattgccaaaatgcccaccaggagttcagattttggcccttcctggtcatcatcgtgattttgagtgctcttttcctgggcactctggcttgcttctgcgtgtggaggagaaagaggaaggaaaagcagagtgagacgtcacctaaagagtttcttactatttatgaggacgtcaaggatctaaaaacgaggaggaaccacgagcaggaacagacgttccccggagggggatccaccatatacagcatgatacagtcacagtcgagtgctccgacttcacaggaacccgcttacacattatacagcctgatacagcccagcaggaaatcgggctccaggaaacgtaatcatagtccctcattcaactccacaatctacgaggtgatcggcaaatcccaacccaaagcccagaacccggctcggctgagccggaaggagctcgaaaattttgacgtttactcctag

SEQ ID NO: 217497 - DNA, 1098 bp, Artificial Sequence
  Description of Artificial Sequence: Synthetic coding sequence
atgctgggtcaggtagtcaccctcatcctcttgcttctcttaaaagtctatcagggtaaggggtgccagggtagtgccgaccacgtggtctctatcagcggagtgcccctgcaactgcagcctaactccatccaaacaaaagtagatagcatcgcgtggaagaaactcctgccctctcagaatgggttccaccacatactcaaatgggagaatggctcgcttccctccaatacatctaacgaccgattttcttttattgtaaaaaatttatctcttctgattaaggccgcacaacagcaagactcgggcctctactgtttggaggtgacgtccatcagtggtaaggttcaaaccgctacctttcaagtgtttgtctttgataaggtcgagaagcccaggttacaaggacaaggcaaaattctggaccggggtaggtgtcaggttgctctgtcatgcttagtcagccgggacggcaacgttagctacgcttggtatcggggtagcaaactcattcagacggcgggtaacctaacatacctcgatgaggaagtggatattaatgggacacacacctacacgtgcaacgtgtcaaatccagttagctgggaaagccatacgttaaacctgacccaggattgtcagaacgcccaccaagagtttcgtttttggccatttctcgttattatcgtgatcctctccgctttatttcttggaacacttgcttgtttttgtgtctggcggaggaagaggaaggagaaacagagcgaaacaagtcctaaggagttcctgacaatttatgaggacgtaaaggacctaaagacccgcaggaaccatgagcaggagcagacttttcccggaggcggatccacaatctattctatgatccagtcacagagttccgctccaactagccaagagccggcttacacactgtattccctgatacaaccatcacgcaagtctggatctagaaaaaggaaccactctcctagctttaattctactatctatgaagtcatcgggaaatcgcagccgaaagcccagaatcccgcacggttaagccggaaggagctggagaacttcgacgtgtactcctag

SEQ ID NO: 217498 - DNA, 495 bp, Artificial Sequence
  Description of Artificial Sequence: Synthetic coding sequence
atgaaatggaaggctctgtttacagctgcaatactccaggcgcagctccctatcaccgaagcccagagctttggactgctcgatcctaagctgtgttatctgctggatggtattctgttcatctacggcgtcattctgacggccttattcctgcgggtgaagttttctagatcagctgatgccccagcgtaccagcagggccagaaccagctgtataatgaacttaacctgggcagaagggaggagtatgatgttttggataaaagacgcggacgtgatcccgaaatgggcggtaagcctcagagaaggaagaacccacaggaaggattgtataatgagttgcagaaggataagatggcggaggcctactccgaaattggaatgaagggtgaacgcagacggggaaagggccatgatggattgtaccagggactatccaccgcaacaaaagacacgtatgacgcgctgcacatgcaggcgctgcctcctagatag

SEQ ID NO: 217499 - DNA, 492 bp, Artificial Sequence
  Description of Artificial Sequence: Synthetic coding sequence
atgaaatggaaggccttgttcacagccgctattcttcaggcacagctccccattacggaagctcagtccttcggtcttcttgatccaaagctctgttatttgctcgatgggatcctgttcatatacggtgttattcttaccgccctgtttttgagggtgaaatttagccgcagcgctgatgctcctgcttatcagcagggacagaatcagctgtacaatgagttgaatctcggtcgcagggaggaatacgacgtgcttgataaacgacgaggacgagatcccgagatgggaggcaaacctcgtaggaagaacccacaagaggggctctacaatgaattgcagaaggacaagatggcggaggcctacagcgagattggaatgaaaggagaaagacggcgaggtaagggccacgacggactctatcaggggctctctacagccaccaaagacacatacgatgcactgcacatgcaggccctgccacccaggtag

SEQ ID NO: 217500 - DNA, 2274 bp, Artificial Sequence
  Description of Artificial Sequence: Synthetic coding sequence
atgttgctgagacttttgctcgcatgggcagccgcaggaccgaccctgggccaggatccttgggcggctgagccgagagcggcttgcggaccatcctcgtgctatgcgttgttccctcggcgtcggaccttcttggaagcatggagggcatgtcgcgagttaggtggcgatttggccacgcccaggacaccagaggaggctcagagagtggactctctggtcggggctggcccagcgagccggctgctgtggattggcctccagcgccaagcaagacagtgccagcttcaacgacctctacgcggattcacctggaccacaggggaccaagacactgccttcaccaactgggctcagcccgcaagtggaggaccttgcccggcacagagatgcgtggcactggaggcatccggcgagcaccggtggctcgagggttcttgtaccttggcagttgacggatacctctgccagttcgggtttgagggagcgtgtccggcactgcaggatgaggccggtcaggctgggcctgccgtgtacaccacgccctttcatcttgtgtccacagagtttgaatggctgccgtttggaagcgtcgccgctgtccaatgccaggcgggtaggggggcatccttgctgtgcgtgaagcaacctgaaggcggagtcggctggagcagagctgggccactctgcctgggcaccggatgcagccctgacaacggaggctgcgaacatgagtgcgtggaggaagtagacggccatgtgagctgtcgctgtactgagggctttcggctcgcagctgatgggaggagttgcgaagatccttgtgctcaggcaccctgtgagcagcaatgtgaacccggtgggccacagggctactcatgccactgccggttgggatttagaccagccgaggatgatcctcaccggtgtgtagacacggatgagtgccagattgcgggagtgtgtcagcaaatgtgcgtgaactacgtaggaggttttgaatgctactgttctgagggccatgaactcgaggccgacggaataagctgttctcctgccggagcaatgggggcacaggcttcacaggacctcggagacgagctactggatgacggcgaagatgaagaagatgaggatgaggcctggaaggcctttaacggaggctggactgagatgcctgggattctctggatggaaccaacacaacccccagactttgctcttgcttaccggcctagtttcccggaggatcgtgagccccagattccctaccctgaacccacctggccacctcccttgtctgcccctagagtgccttatcacagctctgtgctctctgtgacacgtcccgtggtggtcagcgccacacatcccacactgccttctgcccaccagcccccagttatccctgctacccatcccgcactgtcccgcgatcatcagattccagtaatcgcagccaattatccggatctcccttccgcataccagcctgggatactgtctgtctcacactctgcccagccccctgcccatcagccaccaatgatctcaactaaatatccagaactatttcccgcacatcagtctcccatgttccccgatacgagagtcgcaggaacccaaactactacacacctgcccggaatccctcctaaccatgctccactcgtgactacactcggagcgcagttgcctccccaggcccctgatgccctggtactgcgtacacaagccacacagctgcctattatacccactgcccagccctccctgacaacaacctcacggtcacccgtcagcccggcacaccagatttctgtcccagctgcaacgcagcccgcagctctgccaacattgctgccatcccagtccccaactaaccagacgagtccaatctcccccactcatccacacagcaaagcacctcagatccctagagaagatgggccttctccaaaactggctctgtggctaccatcacccgcacctacagccgctccaacggcactgggcgaggccggtctggctgaacactctcaaagagatgatagatggttgctggtggctctgctggtccctacatgtgttttcttggtcgtactgttagctctcggcatcgtgtactgtacaaggtgtggtccgcacgcacccaacaaacggattacagactgctaccggtgggttatccatgcgggttcaaaatctccaactgaaccaatgcccccacggggttccctgactggcgtgcagacctgtaggacttccgtgtag

SEQ ID NO: 217501 - DNA, 951 bp, Artificial Sequence
  Description of Artificial Sequence: Synthetic coding sequence
atgcttcggaggagaggctctccaggcatgggcgtacatgtcggcgcagcgctgggcgctctatggttttgccttaccggcgcattggaggtgcaggtgcccgaggaccctgtcgtggccttggttggcactgacgcgacactctgttgtagtttttctcctgagcctggctttagtctcgcacagctcaatctcatttggcagctgaccgacactaagcagcttgtgcattcctttgccgagggacaggaccaggggagcgcttacgcaaatagaaccgccttgtttcctgacttgctggctcaggggaacgcatcgctgagactgcagagagtacgcgtagccgacgaagggtcctttacctgtttcgtgtcaatccgcgacttcggttctgcggctgtcagcctgcaagtcgctgctccttacagtaaaccttcaatgaccttggagccaaataaggacctgcgcccaggtgatacagttactattacgtgttcgagctacaggggatacccagaggcagaagtgttttggcaggacggccagggcgtacctctgaccggcaacgtgacaacgagccagatggcaaatgaacaggggctgttcgacgttcattctgtcctccgggtggtactgggagccaatggcacttatagctgcctggtgaggaatccagtgcttcaacaagatgctcatgggtccgtgaccattaccggccagcctatgaccttcccaccagaagccttatgggttactgttggtctgtctgtgtgtctaatcgccctcttggttgctttggcatttgtttgctggaggaagatcaaacagtcttgtgaggaagagaatgcaggcgctgaagaccaggatggagagggggagggctctaaaactgccctccagcccctgaaacactctgacagcaaagaggacgacgggcaggaaatcgcttag

SEQ ID NO: 217502 - DNA, 1605 bp, Artificial Sequence
  Description of Artificial Sequence: Synthetic coding sequence
atgctgcggagacgcggtagccccggtatgggcgtccacgtgggtgcggcactcggagccctttggttttgtcttaccggcgcattggaagtgcaagtgccagaggatcccgtggtagctctggtcggcacggatgctaccctttgttgttccttcagcccagagcccggattttcattagcacagttgaatctgatctggcaactcacagacaccaaacaactggtgcactcgttcgcagaaggccaagaccagggatctgcatacgcaaatcgcaccgctctgtttcctgatctcctggcacaggggaacgccagcctgaggttacagcgagtccgagtggcagacgagggttcatttacttgcttcgtgagcatcagagacttcgggtccgccgctgtgtccctccaagtggccgctccatactccaaacccagcatgacattggaacctaacaaagatctgcgacccggagacactgtgaccattacctgctcatcctaccaaggctaccctgaggccgaggtcttctggcaggatgggcaaggagtccctctgactggaaacgtaacaaccagccagatggcaaacgaacagggcctctttgacgttcacagtatcctccgggtggtgctcggggctaatgggacctattcatgcctggtgcggaaccccgttcttcagcaagatgctcatagttcagtaaccatcacaccacaaagatcaccaaccggcgcagttgaggtgcaggtaccagaggaccctgttgttgctctcgtgggtaccgacgccacgttaagatgttcattctctcccgagccagggttttctctcgctcaacttaacttaatctggcaactgactgatacaaaacagctcgtccatagttttacggaaggtagggaccagggaagcgcttatgcaaaccggacagccctatttcccgatctcttggcgcagggaaacgcttctctccgcctgcagagagtgagggtggcagacgaaggatcattcacttgttttgtctccatccgggattttgggagcgctgcggtgtcattgcaggtggctgccccatatagcaagccaagcatgactctagaacctaataaagacttgagaccgggtgacaccgtgacaataacttgctcttcataccggggatatcccgaggccgaagtgttctggcaggatggacagggtgtgccgctgaccggtaatgtgactacatcccagatggccaatgaacagggcttattcgatgtccacagcgtcctgagagttgtgctcggagcaaacggcacctacagctgcctagtccgcaatcctgtgctgcagcaggacgcccacgggagtgtgaccatcaccggacagccaatgacattcccacccgaagccctgtgggtgaccgtgggcttgtccgtgtgcctgatcgccctccttgtggcactcgcatttgtctgctggcgcaaaatcaagcaatcttgcgaggaagaaaacgctggtgcagaggatcaagacggcgaaggcgagggaagcaagaccgccctccaacccctaaaacattctgacagcaaggaagatgatggacaggaaatcgcctag

SEQ ID NO: 217503 - DNA, 1482 bp, Artificial Sequence
  Description of Artificial Sequence: Synthetic coding sequence
atgctgagaaggcgaggatctccaggcatgggcgtccacgtcggggctgctttaggcgcactctggttttgtctgaccggggcattagaggttcaggttccggaagaccccgttgttgctctcgtgggtaccgacgctactctctgttgcagcttctctcctgaacccggtttctccctggctcaactaaatctgatctggcagctgacagataccaagcagctcgttcatagtttcgctgaagggcaggatcaaggaagtgcctacgccaaccgaacagccctgtttccagatctgttggcccaaggaaacgcatcccttagactccagcgagtacgggttgcagacgagggctcttttacatgttttgtcagtatccgcgattttggaagtgcggctgtgagtctacaggtggcggcaccatattctaagccaagcatgacactggagcctaataaggaccttcgtccaggcgataccgttacaatcacatgttcctcgtaccagggatatcctgaagcagaggtcttttggcaggacggccagggcgttcctttgacagggaatgtcacaacttcacaaatggcaaacgaacagggcttatttgatgtccattccatattgcgggtggtccttggtgccaacgggacatattcttgcttagttaggaaccctgtcctgcaacaggacgctcattcatccgtgacaattacaccccagagatctccgacaggggcagtggaggtccaggtgcccgaagacccagtcgtcgctttagtggggacagacgcaacattgaggtgctccttcagccctgaacccggtttcagcctcgcccaattgaatctcatatggcagcttactgatactaaacagctggtacactcattcaccgagggacgggatcagggctctgcctatgcaaataggacagccctatttcccgacctgctggcccaagggaacgcttccctccggttacaacgagtaagggtggccgatgaggggtcatttacatgcttcgtgtccatccgggatttcggcagtgcagcggtaagtcttcaggtggctgctccctactctaagcccagtatgactttggagcccaacaaagatttgcgccctggagataccgtgactatcacctgtagctcttacagaggatacccagaagccgaggtcttttggcaggatggtcagggtgtccctctgaccggcaacgttacaacaagtcagatggcaaatgagcaggggctattcgacgtgcattcagtgcttcgcgtagtgctgggcgctaatgggacctatagctgcctagtccgcaaccccgtgttacaacaggacgcacacggatcagtcaccatcacggggcagccgatgacatttccccctgggcctgcttcatccgctgtcccactgtctcccgctcatcctccacatgggagtatgtgctggtcccactggttcagcagaggactgtag

SEQ ID NO: 217504 - DNA, 423 bp, Artificial Sequence
  Description of Artificial Sequence: Synthetic coding sequence
atgctgaggcgccgaggctctcccggaatgggcgtgcatgtgggggctgccctaggcgctctttggttctgtctgactggagccctggaggtccaggtgccagaagatcctgtcgtggctttggtcggcactgacgccaccttgtgctgctccttctccccagaacccggattttcactggctcaactcaacctcatttggcagctaacggacacaaagcaactcgtccactctttcgctgaaggccaggaccagggctctgcctacgccaaccgaacagccctgtttccagatcttcacagagcggcatatgacatccctcctagagggccagtgggagacaggggcgcagtatgtctgagccactgtactgcgggtggcccaggtttcagagtgctggagaaagaccagactgagttatag

SEQ ID NO: 217505 - DNA, 411 bp, Artificial Sequence
  Description of Artificial Sequence: Synthetic coding sequence
atgcttcgcagacgcggttccccaggaatgggagtgcatgttggagccgcactgggggctctatggttctgtctgacaggtgctttggaagtgcaggtgccagaagatcctgtcgtcgcacttgtcggaacagacgcaaccttatgctgtagcttcagcccagagcccggattttccctcgcacagctgaatctgatatggcaactgaccgacaccaaacaactggtgcattcatttgccgaggggcaggaccagggctcggcctacgccaatcgcactgcattgtttcctgacctgttggctcagggaaacgcatccttacggctgcaacgggttcgcgtggcagacgaaggatcattcacctgtttcgtttctatccgcgacttcggaagcgccgcagtgagtctctag

SEQ ID NO: 217506 - DNA, 402 bp, Artificial Sequence
  Description of Artificial Sequence: Synthetic coding sequence
atgctgcggcgtcggggttcccctgggatgggggtccatgtcggggctgcactgggagcactgtggttttgcctcacgggagccctggaggtgcaggttccggaagatcccgttgttgcgctggtgggcacagacgccactctgtgctgttcatttagtccagaaccgggtttctccctggcgcagttgaacctaatttggcaactgacagatactaaacagctggtacattcatttgccgagggtcaggaccagggatccgcctatgcaaacagaacagcactgtttccggatctcctcgctcaaggcaacgccagcctgaggctccagagagtgcgtgtggctgatgagggctcgttcacttgttttgtctccattagagatttcggctcggctgcgtag

SEQ ID NO: 217507 - DNA, 1602 bp, Artificial Sequence
  Description of Artificial Sequence: Synthetic coding sequence
atgctgaggcggagggggtctccgggtatgggcgttcacgtgggagccgctcttggagccttgtggttttgcctgaccggggctctggaggttcaggtacccgaggaccctgtcgttgcactcgtcggcacggatgccactttatgttgctccttctctccagaacccggattttctctggcacagctgaatctcatttggcagcttaccgacaccaaacagcttgtgcacagctttgccgagggccaggatcaggggagcgcttatgcaaatcgcacggccctgtttcctgacctgctcgcccagggcaacgccagcctccggctgcaacgagtccgggttgcagacgaaggatccttcacctgtttcgtgtccatccgggactttggaagtgcggcagtctccctgcaggttgcggcaccatatagcaagccatcgatgacgctcgaaccaaataaggacctgcgtccaggggacacggtgactatcacatgcagttcctatcaagggtaccctgaggcagaggtattttggcaagatggtcagggggtgccccttaccgggaacgtgacaacctctcagatggccaatgaacaaggactgttcgatgttcatagtatcctaagagttgtgttgggtgccaatggcacctactcctgtttggtgaggaaccctgttttacaacaggatgctcactctagcgtgacgattacccctcaacggtcccccaccggcgcagtggaagtccaggttcctgaggacccagtagtggctctcgtgggaactgacgctacacttcgatgtagcttttcccccgaacctggattctctctcgcccagttaaatctcatctggcaactgacggacacgaaacagttggtccactcatttacagaggggagggatcagggctcagcctacgcaaataggactgcccttttccctgatctgctggcccaaggaaacgcaagtctgcgtttacagagagtgcgcgtggcggacgaaggaagtttcacctgctttgtgtctattcgcgatttcggttccgccgctgtgagcctgcaagttgcagcaccatattccaagccttctatgacactcgaacccaacaaggatctccgccctggcgatacagtaaccattacctgctcgagttatcggggataccctgaggccgaggtcttctggcaggacggccagggggtccccctgaccgggaatgtgacaacctcccagatggccaatgagcaaggtttattcgacgtccatagtgtcctccgcgtggtcttgggagccaatgggacttacagctgccttgtccgaaaccctgtgctgcagcaggacgctcacggctccgtgactattacgggtcagccaatgacattccctcccgaggccctttgggtgactgttggtctctctgtctgtctgattgctttgctcgtggccttagccttcgtctgctggcgcaaaataaagcaatcctgtgaggaagagaatgccggagccgaggatcaggacggtgagggcgagggatccaaaacggcactgcagcccttaaaacattccgattcaaaggagggtaaagacacatgggcttag

SEQ ID NO: 217508 - DNA, 498 bp, Artificial Sequence
  Description of Artificial Sequence: Synthetic coding sequence
atgttgcggcgtaggggttctccgggaatgggggtccacgtgggggcagcactgggggcactctggttctgcttgactggggcattggaagttcaggtaccagaggaccccgtcgtcgcactcgttggtacagatgctaccctttgctgctccttctcaccagaacctggctttagtctcgctcagctcaatctgatctggcagctaactgacaccaagcagcttgttcactcttttgcagagggtcaggaccaggggtccgcgtatgctaaccgcacagcacttttcccagatctgctggcacaggggaatgccagcctgaggcttcagagggtgcgggtggccgacgaggggagcttcacttgttttgtaagtatcagggactttggaagcgctgccgtgagcctgcaagtggcggctccttactctaagccgtccatgacactggagcccaacaaggaccttcgacccggtgatacagtgaccatcacttgttag

SEQ ID NO: 217509 - DNA, 156 bp, Artificial Sequence
  Description of Artificial Sequence: Synthetic coding sequence
atgttgaggcgccgaggaagcccaggcatgggcgttcatgtgggggctgcactcggagctctatggttctgcttgacaggcgcactggaggtccaggtgcctgaagacccagtggttgctttagtgggtaccgatgctacgctatgttgcagctag

SEQ ID NO: 217510 - DNA, 663 bp, Artificial Sequence
  Description of Artificial Sequence: Synthetic coding sequence
atgttgaggctgctcctcgcacttaatctgtttcctagtattcaagtaacgggcaataaaatcctggtgaagcagtccccgatgctggtggcatatgacaatgccgtcaacttgtcgtgtaaatattcgtacaatctgttctcacgggaatttagggcttccttgcacaaaggcctggactccgccgttgaagtatgtgtagtgtatggcaactattcgcagcaactgcaggtgtactcgaagacggggtttaattgcgatggcaagctgggcaatgagagcgtgactttctacttacaaaacctgtatgtgaatcagacagacatatatttctgtaagattgaggtgatgtaccccccaccctatttggacaacgaaaagagcaacggaaccatcatacacgtgaagggaaagcatctgtgtcccagcccccttttcccgggaccaagcaagcccttctgggtcctcgtagtggtgggcggtgttttagcttgttatagtttactcgtgactgtcgcctttatcattttttgggtcagatcaaaacgtagcagactgctgcactcagattatatgaatatgaccccccgaaggccgggtccaacaaggaagcactatcagccgtatgctcctcctcgcgactttgcggcttaccgttcctag

SEQ ID NO: 217511 - DNA, 306 bp, Artificial Sequence
  Description of Artificial Sequence: Synthetic coding sequence
atgctgaggttgctgctggctctgaacttattcccatcgatccaagttacaggaaaacacctctgccccagcccactgttccccggaccatcgaagccgttttgggttttggtggtggtgggtggtgtgctcgcatgctacagtttgctggtgacggtggcatttatcatattttgggtccggtctaagaggtcacgattgttgcattctgattacatgaatatgaccccacgcaggccgggtccaaccagaaagcattatcagccctacgctccgcctcgcgattttgccgcttatagatcatag

SEQ ID NO: 217512 - DNA, 411 bp, Artificial Sequence
  Description of Artificial Sequence: Synthetic coding sequence
atgctgcgtcttctgctggccctgaacctcttccctagcattcaagtaacaggtaacaaaattctcgtgaagcagagccccatgctggtggcttatgataacgcagttaacctgagctataacgaaaaatccaacggcacgataatccacgtgaaaggaaagcatttgtgccccagcccactgttccccggtccctccaagccattctgggtacttgttgtggtgggtggagtactcgcctgctacagtctgttggttacggtggcattcataattttctgggtaaggagtaagcgttctaggctgttgcacagtgattacatgaacatgacaccgagacgtcccggacctacaaggaagcattatcagccttatgctcctccccgagatttcgcggcataccggtcttag

SEQ ID NO: 217513 - DNA, 705 bp, Artificial Sequence
  Description of Artificial Sequence: Synthetic coding sequence
atgccgtgcgggcttagcgccctgataatgtgcccaaagggaatggttgccgtggtcgttgcggtggacgacggagattcgcaggctctggccggtaacaaaatcctcgtcaaacagtccccaatgcttgtggcttatgacaatgccgtgaacctctcctgtaagtactcatataacttgttttcgcgggaatttcgggcttctctccataagggactggatagcgcagtggaggtgtgtgtggtgtacggaaactactcccagcagctgcaggtttattctaaaactggctttaactgtgacggcaagttaggtaatgaatcggtgacattctacttgcaaaatctatatgtcaatcagactgatatctatttctgcaagattgaagtaatgtatcctccaccctacctggataacgagaagtccaatggcactataatccacgtcaagggcaagcacctgtgcccctcccctctgtttcctggcccttccaaacctttttgggtgcttgtagtcgtcgggggtgtactggcgtgctattccctcctggtcacagttgcattcattattttctgggtgcggagcaaaagatctcgcctgctccacagcgattacatgaacatgacccctcgtaggcccggtcccacccgaaaacactatcagccttatgctccgccacgggactttgccgcttaccggtcttag

SEQ ID NO: 217514 - DNA, 1920 bp, Artificial Sequence
  Description of Artificial Sequence: Synthetic coding sequence
atggtcgattatatcgtggagtatgactatgacgcagtccatgatgatgagttaacaattcgcgtgggcgaaatcattcgaaatgtgaagaaactacaggaagaaggttggttggagggagagctcaatgggcgtcgagggatgttcccggataattttgtcaaggagatcaagcgcgagaccgaattcaaggacgatagcctaccaattaaaagagaacggcatggaaatgttgccagtctcgtacagagaatttcaacatacggactaccagctggcggaattcaaccgcatcctcagacaaagaacattaaaaagaaaacaaaaaagcgccagtgtaaggtgctcttcgaatacataccccaaaatgaagatgaactggaactgaaagttggggacatcattgacataaatgaggaggttgaagagggctggtggtcgggcacgctgaataataagttgggattatttccgtctaacttcgtgaaagaactcgaggtgacggatgatggcgaaacgcatgaggctcaggacgattctgaaacagtcctagcaggacctacctcccctatcccttcattaggcaacgtctccgagacagcttccggcagcgtcacccaacccaagaagatccgtgggatcgggttcggggatatttttaaggaggggtcagtgaaactgcggaccaggacctcttctagcgagaccgaagagaagaagccggaaaagccgctgattttgcagagcctcggacccaagactcaaagtgtagagatcactaaaactgacacagaaggcaagattaaggccaaggaatattgtagaaccttattcgcatatgagggcacaaacgaggatgaactgactttcaaggaaggggagattatccatctcatttcaaaagaaacaggggaagctgggtggtggaggggagaactgaacggcaaggagggcgttttcccagacaactttgcggtccagatcaatgaacttgacaaagactttcccaagccgaaaaagccaccaccacctgccaaggcaccagcacctaaacccgaattaatcgccgctgaaaagaagtacttcagtctaaagcccgaggagaaggacgaaaagagcacattggagcagaaaccctcgaagccagccgctccacaggtcccgccaaagaagccaaccccacctactaaggcctccaacctgctccgctcaagtggtaccgtgtatcctaaacggccagaaaagcctgtcccaccgcctccccctatcgccaaaatcaatggagaagtgagctctatttcatcaaagttcgagaccgagcctgtgtccaagctgaagctagattccgagcaactgcctttgaggcccaaatctgtggacttcgactctctgacagtccggacctccaaagaaactgacgtagtaaacttcgacgatatcgcatccagtgaaaacctactgcatttaaccgcaaatcgccctaagatgcctgggcgtagattgcccggtcggtttaatggcggtcattccccgacgcatagtccagaaaagattctgaagcttccaaaagaggaagactccgctaacttaaaaccctctgagctcaagaaagacacctgctactcccctaagcctagcgtgtacctctctactccttcaagcgcctccaaagcgaacacaaccgcatttttaacaccgctcgagataaaagccaaagtcgaaaccgacgacgtcaaaaagaacagcttggacgagcttagggctcagataatcgaactactttgcatcgtggaggcactaaagaaggatcacggcaaggagctggagaaattgcgcaaggatcttgaagaagaaaagactatgcggtctaacctcgaaatggagatagaaaagttgaagaaggccgttttatcatcatag

SEQ ID NO: 217515 - DNA, 717 bp, Artificial Sequence
  Description of Artificial Sequence: Synthetic coding sequence
atgtgcagacgttgtaaacctgagctgaggcaaaactttcagtctgcctctgggatctgtatttgtcactggttgcagatcaggcgtactcgaagtagggaggggcgagctatgtggctgcctcccgctctcttgttactgagtttgagcgggtgtttctcgatacaaggtccagagtcagtccgcgcacctgagcaggggtcgttgactgtgcagtgccactacaaacagggctgggagacctacattaagtggtggtgtagaggggtacgttgggatacttgcaagatcctgattgaaaccagaggctctgaacaaggtgaaaagagcgacagggtgtccatcaaagataatcagaaagatcgcacattcacagtgacgatggaaggtttgaggcgcgatgatgcggacgtctactggtgtggcatcgaacgtcggggacctgacttagggacccaggtgaaagtaatcgtggatccagaaggcgctgcatctaccactgcatcttctccgaccaactcaaacatggctgtttttatcgggtcgcataagagaaaccattacatgctactggtctttgttaaggtccccatcttactgatcttggttactgctatcctgtggctgaagggtagccaaagagtcccagaggagcccggagaacagccaatctatatgaatttttctgagccactgaccaaggatatggcaacctag

SEQ ID NO: 217516 - DNA, 606 bp, Artificial Sequence
  Description of Artificial Sequence: Synthetic coding sequence
atgtggctgcctcctgccctcctcttgttatctctcagcggctgcttctccattcaaggaccagagagcgttcgagccccagaacagggaagcctcacagtccagtgtcattacaaacagggttgggaaacctacattaagtggtggtgtcgaggggtccgctgggacacctgtaagatactcattgaaactcgaggctccgagcagggcgagaagagcgaccgggtctccataaaagacaatcaaaaggatagaacgttcactgtcacaatggaagggcttaggcgagacgacgctgacgtgtactggtgcggtatagaacggagagggcctgacctcgggacccaggtaaaagtgatagtcgatcccgagggcgcagcatcgacaacagccagctcccccaccaactcaaacatggcagtcttcataggctcacataagagaaatcattacatgctcttagtcttcgtaaaggttcccatccttttaatactggtcactgctattctctggctcaagggatctcagcgtgttccagaggagccaggcgagcagccgatctacatgaatttcagcgaacccctaaccaaggacatggcgacgtag

SEQ ID NO: 217517 - DNA, 735 bp, Artificial Sequence
  Description of Artificial Sequence: Synthetic coding sequence
atgccactcctcaccctctatctcttacttttctggctgtccggatactccatcgttactcagatcactgggccaaccacagtgaacgggctggaacggggttctcttactgtgcagtgcgtgtacagatcagggtgggagacgtaccttaagtggtggtgccgaggggcaatttggcgcgattgtaaaatactggttaaaaccagtggcagcgagcaggaggttaaacgtgatagagtgagtataaaagataaccagaaaaacaggacattcaccgtaacaatggaagacctgatgaagacggatgccgacacttattggtgcgggattgaaaaaacgggaaacgacctcggagtgactgtgcaggttacgatcgatcctgctccagtgactcaagaagagacatccagctcacccacccttactgggcaccatttggacaacaggtctgagggctctcaagctgcaaactaccggcctgcagcacatcaggcacaagcccctgaggcccagtgcccacccgctcctcatctacatcacatcgccgctgccttcggtggtagactgacccttggtttagaggacgacgaggtgccagcagagtcgtcacgagacgtgcccagggccggaactgctgcaccaggtggaaggcctctcctgtgtagacccgacccagccgctggaagaaatctgcctgcaaaaggctaccacgaagcattcttgtgccccggatag

SEQ ID NO: 217518 - DNA, 873 bp, Artificial Sequence
  Description of Artificial Sequence: Synthetic coding sequence
atgcctttactgactctgtatttgctgctattctggctgtctggttattcgatcgtcacccagatcaccggtcccactaccgtcaacggactcgaacggggtagtctgacagtgcagtgtgtatatcggtctggctgggaaacctaccttaaatggtggtgtaggggggcaatttggagggattgcaaaatcctggtgaagacgagcggatcagaacaggaggtgaaaagagacagggtgagcatcaaggataaccagaagaacaggacttttaccgtaaccatggaagaccttatgaaaaccgacgcagacacttattggtgtgggatcgagaaaactggtaatgacctcggggtcaccgtgcaggttaccatcgaccctgccccagtgacccaggaggagacgagctcatcacccaccctgaccggccaccatctggacaaccgtcacaagcttctcaagctatccgtgttgctccccctgatatttactatcctgctgttattgctagtggccgctagtctactggcctggagaatgatgaagtatcagcaaaaggctgctgggatgtccccagagcaagtgctacagcctctagaaggcgacctctgctacgcagatctgactctgcagctcgcagggacgtcaccccagaaagccaccaccaagttatcctcagctcaggtggaccaggtggaggtggagtatgtcaccatggcttctcttcccaaagaggacatcagctacgcgtcattaaccctcggagcggaagaccaggaaccaacgtactgcaatatgggacacctgtccagccatctgcccggtagagggcctgaggagcccacagagtactccacgatctcgaggccatag

SEQ ID NO: 217519 - DNA, 585 bp, Artificial Sequence
  Description of Artificial Sequence: Synthetic coding sequence
atgtggctccctcagctggacttgatgcgggtaattagcgcaaaatcccagggatattccatagtaacacagataaccgggcctacaaccgtaaatggactggagagaggaagtctgacagtccagtgcgtataccgtagcggttgggaaacatatttgaagtggtggtgtcgaggcgcaatatggagagactgcaaaatccttgtgaagacttcgggcagcgaacaggaggtcaaacgtgaccgcgtctcgatcaaagacaatcagaagaacagaaccttcaccgtgaccatggaggatctgatgaagaccgatgccgatacctattggtgtggcattgagaagacaggcaacgatctgggcgttaccgtgcaggtcacgatagatccggcaccggtcacccaagaggaaacaagctcatcccctacgttgaccgggcaccatctagacaattcatcccgagacgtgccgagagccggtaccgccgctcctgggggtcggcctcttctatgtcggccagaccctgccgctggcaggaacctgccagcaaagggttatcatgaagcttttttgtgccccggatag

SEQ ID NO: 217520 - DNA, 720 bp, Artificial Sequence
  Description of Artificial Sequence: Synthetic coding sequence
atgtggttgccgcaattagacctcatgagggtgatttcagcaaaatcacaggggtacagtatagtgacacagatcaccggccctaccacagtcaatggcctagagcgagggagcctcactgtgcaatgtgtatacagaagcggatgggaaacttacctcaaatggtggtgtaggggggcaatttggagagattgcaaaattctggtaaagacttccggcagcgagcaggaggtgaagagggaccgtgtatctatcaaagacaatcagaagaatcggaccttcactgtgactatggaggacctgatgaaaaccgacgctgatacgtattggtgcgggatcgagaaaaccggtaatgatctgggagtgacggtccaggttacaatcgatccagcaagcactcccgctccaaccactccaacctccacaacttttaccgcaccggttactcaagaggagacaagctcttcacctacgctgaccggacatcacctggacaatagacacaaattgctgaaattatctgttctgctgcccctaatctttacaatcctgttgttgctccttgtagccgcatcattgctggcatggcggatgatgaagtaccagcagaaaggcacggccgcacccggtggacgccctctcctctgtcgccctgaccctgctgccggacggaatctcccggcaaaaggttaccacgaggctttcctttgtccaggttag

SEQ ID NO: 217521 - DNA, 699 bp, Artificial Sequence
  Description of Artificial Sequence: Synthetic coding sequence
atgctccgagcagccttgccagccctgctgcttcctctgctcggtctggcagctgctgccgttgccgactgcccaagtagtacatggattcaattccaagattcgtgctatatctttttacaggaggcaattaaggtggagtctatcgaggacgtgaggaatcaatgcactgatcacggcgctgatatgattagcatacacaatgaggaggagaatgccttcatacttgacacccttaagaaacagtggaagggccctgacgacattctgctcggcatgttctatgatacagatgatgctagcttcaagtggttcgataacagcaatatgaccttcgataagtggacggatcaagacgacgatgaggatctcgtggacacatgtgcctttctgcatattaagaccggcgagtggaaaaagggcaactgtgaggtcagctcggtggagggcacactctgcaaaaccgccattccatacaaacggaagtacctgtccgacaatcatattctcattagcgctctcgtgatcgcctcgacggtgattctcacggttctcggtgccattatctggttcctctacaagaagcatagcgattctcgcttcactaccgttttcagcacagcccctcagagtccctataatgaggactgtgttctcgtagttggagaagaaaatgaataccctgtccaattcgactag

SEQ ID NO: 217522 - DNA, 525 bp, Artificial Sequence
  Description of Artificial Sequence: Synthetic coding sequence
atgctgagagcggcactgccagcactattattacctttgctgggcctggctgcggctgcagttgccgactgcccatcaagtacctggatacaatttcaagattcctgctacatcttcctgcaagaagctatcaaggtcgagtctatcgaggacgtcagaaaccagtgtacggatcacggggctgacatgattagtattcacaatgaagaggaaaacgcatttattttagacaccttgaagaaacagtggaagggccctgatgatatcctgctgggtatgttctacgatactgacgttccatataagagaaaatacctctccgataatcacatcttgatctctgccctcgtaatagccagcactgtcatactgacggtacttggtgccattatttggtttctctacaagaaacatagtgacagccgtttcactactgtcttttccacagcccctcagtctccatataacgaagactgtgtccttgtggtgggcgaggagaatgagtaccccgtacaatttgactag

SEQ ID NO: 217523 - DNA, 849 bp, Artificial Sequence
  Description of Artificial Sequence: Synthetic coding sequence
atgtccgggggatggatggcgcaggtgggcgcttggcgcaccggtgccctcgggctggccctgttgctgctgctgggtctgggtttaggcttagaggccgctgccagtcccctgtctactcctacatccgcacaggccgctggaccctcaagcggtagttgtccgccaaccaaatttcaatgtaggaccagcgggctgtgtgtgcctcttacctggcgttgtgacagggatctggactgtagtgacggcagcgatgaagaggagtgcaggatagagccctgtacacagaaaggccaatgtccgcctccccctggcttgccttgcccttgtactggtgtgtccgattgttcagggggtactgacaagaagctgcgcaattgctctagattggcttgccttgctggggagttaagatgtactctgtctgatgactgcatccctttgacttggagatgtgatggtcatcccgattgtcccgatagcagcgacgagctgggctgtgggaccaacgagatactccctgagggggacgccacgactatggggccacccgtaactctcgaaagcgtgacaagtcttagaaatgccaccacaatgggcccaccagtcacactggaatccgtgccaagcgtcgggaacgctacttcctcctcagctggtgaccaatctggtagtcctactgcttatggtgtcatcgctgcagcagccgtattgagcgcctcattggtaacagcaaccctcctcctgttgagttggctgagagcgcaggagcgtctaaggccactcggcctgctggtagccatgaaggagtctctgctcttgagtgagcagaagacatccctgccgtag

SEQ ID NO: 217524 - DNA, 606 bp, Artificial Sequence
  Description of Artificial Sequence: Synthetic coding sequence
aacgaaatcctgccagagggcgatgctaccacaatgggtcccccagtgacacttgagtctgtgacaagcctgcgcaacgccactactatgggccctccggtgactctagagtctgtccccagtgttggaaatgccatcctgctatgtagacgaccggtctggaagcccaactgtctgtggggctattgctcgtgctgcggcgctcagtgcaaacccggacaccgacatccgccaccattcgttttggcaccgtctcctggggcaccccctccaaccggggtgacaggcggacatgaaggcgtgcctgctgctgtgaggacggaggacttggccgctctccgcacgtcaacctgccatcatcggcactcagcactcggagttgcaggccaggaagaatcctcagatgccgatggttaccctggcacccctgccctacgcgatttgagctcatcaggccacgtggagcccaggacacgtgctcccgctgaggtggcattagagattgaggggccatggaccctccccatggaaatccgtggagcgcgtatggggaaccttcctcagccggaactgcggggttggccccaggctgccccacgtggatag

SEQ ID NO: 217525 - DNA, 723 bp, Artificial Sequence
  Description of Artificial Sequence: Synthetic coding sequence
atgagcggcggatggatggctcaggtcggagcatggaggactggtgctctggggctagctctgctgctcctgctggggttagggctcggcctggaagccgcagctagtcctttgtcaactccgacttcagcgcaggctgctggaatcgaaccctgcacccaaaagggccagtgccccccacctcccggattgccatgcccttgcaccggcgttagtgattgcagcgggggtaccgacaaaaaattgcggaattgttcccggttggcttgcttggccggtgaattgcgctgtactctcagtgatgattgcattcccctgacttggcgctgcgatggccaccccgactgtccggattcaagcgacgaactcgggtgcggaaccaatgagattctgccagaaggagatgcaaccaccatgggccctccggtgaccctcgagtcagttaccagtttgcgcaatgccaccacaatgggccctcctgtgacccttgagtccgtaccttccgtgggaaacgcaacctctagctccgccggtgatcagtcgggatcgcccaccgcctatggcgtaattgcggcagcggctgtcttatcagcatcgctggtgaccgccacccttcttctgctttcatggctgcgagcccaggagagattgcgccctctggggctccttgtcgctatgaaggagtctctactcctcagcgaacaaaagactagcctcccctag

SEQ ID NO: 217526 - DNA, 1095 bp, Artificial Sequence
  Description of Artificial Sequence: Synthetic coding sequence
atgcccctcttgctgttacttcctctcttatgggcaggcgctctggcgatggaccccaacttttggctgcaggttcaggaaagcgtcaccgtccaggagggcctctgtgtgctggtgccgtgcacgttctttcatcctatcccttattatgacaaaaactctccggtccacggatactggttccgagagggggctataattagtagagactcccctgtggcgacaaataagctggaccaggaagtgcaggaagagacacagggccgattcaggctgctgggagacccatcgcgcaacaactgtagcctttctatcgtcgatgcacgcaggagagataatggaagttacttctttcggatggagcgtggcagtaccaagtacagctataaaagcccgcagctttcagtccatgtgacagatctcactcacagacctaagattctcattcccggaactctcgaaccgggacattctaagaaccttacatgctcagtgtcctgggcgtgtgagcagggaacccctcccatattctcctggttgagcgcagctccaaccagcctcggaccaaggaccacacacagctctgtcttgatcatcaccccaagaccacaggaccacggcaccaatctgacttgccaagtgaaatttgcaggggcaggcgtgaccaccgaacgcaccattcagttaaatgtcacgtatgtgccacagaaccccacaactggaatattccctggtgacggatccggaaagcaggaaacccgcgcaggggtcgttcacggggctatcggaggagccggtgtgacagccttgctcgccttgtgcctctgcctgattttttttatcgtaaaaacccatcggaggaaggcggcaaggactgcagtgggcaggaatgacacacaccctacaacaggttccgctagtcccaagcaccagaaaaagtcaaaactgcacgggccaacagagactagttcatgttccggtgcagctcccaccgtcgaaatggatgaagagcttcactatgcctcactgaattttcatggtatgaatccctcgaaagacaccagcactgaatactctgaggtgcggacgcaatag

SEQ ID NO: 217527 - DNA, 933 bp, Artificial Sequence
  Description of Artificial Sequence: Synthetic coding sequence
atgccactgttgctgctgctgcccttactctgggctggggctttggccatggaccccaatttttggcttcaggtccaagaaagtgtgacagtgcaagagggcctgtgtgtgctggtaccctgcaccttcttccatccaattccatactatgataagaattcccctgtgcatggctactggtttcgagaaggagctattatttcacgtgacagccctgtggctaccaataaactggaccaagaggttcaggaggaaacgcagggcagattcaggctcttgggagatccaagtcgcaacaactgcagcctgtccatcgttgacgccaggagacgcgacaacggtagctactttttcagaatggagcgaggttccaccaagtatagctataaaagcccccagctgtctgtgcacgtcaccgacttaacacacaggccaaagatcctcattcctggaaccctggaaccagggcactccaagaacctgacttgtagcgtgtcttgggcatgcgaacagggaactcctcccattttcagttggctgagtgcggctccaacttctcttggccctagaaccactcactcatctgtgctgatcataaccccccgaccacaggaccacgggaccaaccttacatgtcaggtgaagttcgctggcgctggagttaccacagaaaggaccatccagttaaatgtgacctacgtgccccagaatccaaccactggcatctttcctggcgatgggagtggaaagcaggagactcgcgctggagtggtgcacggagctattggtggggcaggcgtgactgcgctgctagccctgtgtctatgtttaatttttttcatcgtgaaaactcatagacggaaggccgctcgcacagccgtcggcagaaacgacactcatcctactacggggagtgccagtcccgtgcggtag

SEQ ID NO: 217528 - DNA, 714 bp, Artificial Sequence
  Description of Artificial Sequence: Synthetic coding sequence
atgcctctcttgctgctgctccccctgctctgggctgatttaactcatcgcccaaaaatcctgatccccggtaccctggaacctgggcactcaaaaaatctgacctgttcagtgagctgggcttgcgaacaggggacgcctcctatcttttcctggctctcggccgcacccacctctctgggccctcgtaccacccactcctcagtgttgatcattaccccaaggccacaggatcatggaacaaacctgacttgccaggtgaagtttgccggagccggtgtaacaaccgagaggaccatacaactgaatgtaacctatgtccctcagaatcccaccacaggtatctttccgggtgacgggagcggcaagcaggaaaccagagctggggttgtgcatggagccattggcggagccggagtgacagcactgctggccttgtgcctgtgcctgattttcttcattgtcaagacccaccgcaggaaggcagctcggaccgccgtcggtcggaatgatactcaccccaccaccggtagcgccagtcctaagcaccagaagaaatcaaaactccacgggccaacagaaacgagtagttgcagtggcgctgctcctacagtggagatggatgaagagcttcattacgcaagtcttaatttccacggcatgaaccccagtaaggataccagtacagagtattctgaagtgaggacccagtag

SEQ ID NO: 217529 - DNA, 639 bp, Artificial Sequence
  Description of Artificial Sequence: Synthetic coding sequence
atgccactgttacttctgctccctctgctttgggcggatctgacccataggcccaagatcctgattccgggaacattggagcctggacacagcaagaatttgacttgttctgtttcctgggcttgcgagcagggtacccctcctatatttagctggttgagcgccgctcccaccagcctggggccaagaactacgcattcctcagtccttataattaccccaaggcctcaagaccatgggaccaatttgacctgtcaggtgaagttcgccggtgcaggggtgaccaccgagcgcaccatccaactcaatgttacttacgttccacaaaatcctaccacaggtatctttccgggtgacggttcaggaaaacaggagaccagggccggtgtcgttcacggagccattggcggagctggcgtcactgctctcctggccttatgcctgtgtctgatcttcttcatcgtgaaaacgcaccgtcgtaaagcagctcgcaccgccgtgggcaggaatgacacccacccaacaaccggaagtgcgtcaccagtgtcagacggggcttcgtggcatccagtttgcccagcagatacctcttctcagtgcggccctccttcctgccccatacagcatttccaaaattag

SEQ ID NO: 217530 - DNA, 1419 bp, Artificial Sequence
  Description of Artificial Sequence: Synthetic coding sequence
atgggatgtgaccgcaattgcgggcttatcgcaggcgctgttatcggggctgtgctggccgtctttggtggcatcctgatgcccgtcggcgaccttctgattcagaaaaccattaaaaaacaggtggtgctcgaagaggggacaatcgctttcaagaattgggtgaagacaggaactgaggtctaccgccaattttggatattcgatgttcaaaacccacaagaggtgatgatgaactcttctaacatacaagttaaacagcgtgggccatatacatatagagtccgcttcttggccaaggaaaatgtgactcaggatgccgaagataatacggtttcctttttacagccaaatggtgccatcttcgaaccgtcactgtctgtaggcacagaagcagataatttcacagtcctgaacttagccgtggccgcagctagtcatatttaccagaatcagtttgtgcagatgatcctgaattctcttattaataaaagtaagtccagcatgtttcaggtacgcactctgcgggaactgctctggggctaccgagatcccttcctgtcacttgtcccatacccagtgactaccaccgtggggctgttttacccttataacaacaccgctgacggagtctataaagtgttcaatggcaaagataacattagcaaggtggcaatcatcgatacttacaaggggaaaaggaacctgagctactgggaatcccattgcgatatgatcaacgggacagatgcggctagtttcccccctttcgtagaaaaaagtcaggtcctacagtttttcagtagcgatatctgtcggtctatctacgctgtattcgagtcagacgtcaatctgaagggtattccggtctaccgctttgttctcccctccaaggctttcgcatcacctgtagagaacccagataactactgtttctgcactgagaaaatcattagtaagaactgcacgtcctacggcgtgctggacatttccaaatgtaaagaaggccgtccggtctatatttctcttccacatttcttatatgctagcccggacgtgtctgagcctatcgacgggctgaacccaaacgaggaagaacatcgcacctatttggacatcgagcccatcacggggtttacactgcagtttgccaagagacttcaggtgaacctgctcgttaagccaagcgaaaagatccaggtgctgaaaaatctgaagcgcaactacatcgtccctattctatggctgaacgagacaggtacaattggagatgaaaaggcgaatatgttccgcagccaggtgacaggaaaaatcaaccttctcggcttaatcgagatgatcctgctgtccgtgggtgtggtaatgttcgtggcctttatgatatcttactgtgcatgtagatccaaaactattaagtag

SEQ ID NO: 217531 - DNA, 1419 bp, Artificial Sequence
  Description of Artificial Sequence: Synthetic coding sequence
atgggttgcgaccggaactgcggcctgatcgctggggctgtcattggtgccgtgctggccgtcttcggtggcatcctgatgccagtgggggatttactcattcagaaaaccataaagaaacaggtggtcctggaggagggtaccatcgccttcaagaattgggttaaaacaggaaccgaggtgtacaggcaattttggatatttgacgtccagaatccccaggaagttatgatgaactcctccaatatccaggtgaagcaacgcggaccctatacatatagggtcagattcctggccaaggaaaatgtgacacaggatgccgaggacaacactgttagcttcctgcagccgaacggggcaatattcgaaccgtcactgtcggtggggaccgaggcggataacttcacagtgctgaacctggctgtggccgctgcatctcacatctaccagaaccagttcgtccagatgatcctgaactctctgataaacaaatctaagtcgtccatgttccaggtgcgtaccctgagggaactgttatggggctatcgcgatccctttctatctttggtcccttaccctgtcacaactaccgtcgggttattctatccatacaacaacacagccgacggcgtgtacaaggtcttcaacggcaaggacaacatttctaaagtcgctattattgatacatataagggcaagaggaacctgtcatattgggaatcccactgcgacatgattaatggtacagacgcagctagtttccccccttttgtggaaaagagtcaggtgctacagttttttagctccgatatctgcagaagtatatacgccgtgtttgagagcgacgtgaatctgaaggggatccccgtgtacaggtttgtgttgccttcaaaggcattcgcctcaccagtggagaaccctgacaactactgcttttgcacagagaagataattagtaagaactgcaccagctacggggtgctagatattagcaagtgtaaggagggcaggccagtttacatctctcttcctcattttctgtatgcctctcctgacgtctcagaacccattgatggattgaaccctaatgaagaagagcacaggacgtacctcgacatcgagcccataactgggttcaccttgcagtttgctaaacggctgcaggtaaatctgttggtcaaaccaagtgaaaagatacaggtcttgaagaacctgaaacgcaactatatcgtgccaattctatggctcaacgagacagggaccatcggggacgagaaagcgaacatgttccggtcacaggtcactgggaaaattaacctgctgggacttatagagatgatcttattgtcagttggggttgtcatgttcgttgcctttatgatttcttattgtgcttgtcgcagtaaaaccatcaagtag

SEQ ID NO: 217532 - DNA, 612 bp, Artificial Sequence
  Description of Artificial Sequence: Synthetic coding sequence
atggggtgcgaccggaactgtggtttaattgcgggagccgtcataggggctgtactggcggttttcgggggtatcctgatgcccgtaggagatctgctcattcaaaagaccatcaaaaagcaggtggtgctggaggagggaactattgcttttaagaattgggtcaaaacggggacagaggtgtataggcagttttggatctttgacgttcaaaacccgcaagaagtgatgatgaacagctccaacattcaggtcaagcagcgcggaccctacacttaccgcgttaggtttctagcgaaagaaaatgtgactcaggacgccgaggataacacagtttcctttttacagccgaatggggcaatattcgaaccctccctgtccgtggggacagaagctgacaatttcaccgtactgaacctggcagtggctgctgctagtcacatctatcagaaccagtttgtccagatgatcctcaattcccttatcaacaaatctaaatcttctatgtttcaggtgcggaccctccgtgaactgctctggggctaccgggaccccttcctttccctggtgccatatcccgtgacaactacagtggggttattctacccttag

SEQ ID NO: 217533 - DNA, 1392 bp, Artificial Sequence
  Description of Artificial Sequence: Synthetic coding sequence
atggggtgcgaccggaattgcggtctcatcgcgggtgccgtgattggcgctgttctcgctgtttttggcggtatcctcatgcccgtaggcgaccttcttattcagaaaaccataaagaagcaggtcgtgttggaggagggaacaattgcctttaagaactgggttaagacaggaacagaagtctaccggcaattttggatatttgatgttcagaaccctcaggaggtgatgatgaattcctccaacatacaggtgaagcaaagaggcccatatacataccgagtgcggtttctggcaaaggagaatgtaactcaggatgccgaggataacactgtgtcctttttacagcctaatggtgcgatcttcgagccaagcctctcagtcggaaccgaagcagacaactttacagtgttgaaccttgccgtagcagccgctagtcacatctaccagaaccagttcgtgcaaatgatcctgaatagtttgatcaataagtccaagagtagtatgttccaggttaggaccttacgcgaacttttgtgggggtacagggatccctttctgtcactggtcccctaccccgtgaccactactgtcggcctgttctacccttacaataataccgctgacggcgtctataaggttttcaacggcaaggataatatatctaaagtggccattatcgacacgtataagggcaagaggaacttgtcctattgggaaagccactgcgatatgatcaacgggacagacgccgcatcttttccgcctttcgtcgaaaaatctcaggtcctccaattcttttcgtcagatatttgccgatcaatatacgcagtatttgagagcgatgttaacctgaagggcatccctgtgtaccgattcgtgctgccctctaaagctttcgcgagtccagtggaaaatcctgataattactgtttttgcacagagaaaattatttctaagaactgcactagttatggggtgctggatatttctaagtgtaaagagggcagacccgtgtacatctcactcccacatttcctgtatgcttctccggacgtgtctgagcccatcgatggacttaatcctaatgaggaggaacaccgtacgtacctagatatcgagcccattacaggatttaccctgcagttcgccaagaggctccaggtcaatctcctggttaagccgagtgagaaaatccaggtgttaaagaatctcaaaagaaactacatcgtccccatcctctggctgaacgaaaccggtaccatcggtgatgagaaggctaacatgttcaggtcccaagtgacaggcaaaattaacttgctgggactgatagagatgatcctgctgagcgtcggagtggttatgttcgtggcgtttatgattagctattag

SEQ ID NO: 217534 - DNA, 447 bp, Artificial Sequence
  Description of Artificial Sequence: Synthetic coding sequence
atgggatgtgaccgaaattgcgggcttattgctggagccgtgatcggcgctgtgttggctgtgtttggcggaattcttatgcccgtcggtgaccttctcattcaaaagacaatcaagaagcaggttgtcctggaggagggaacaatcgctttcaaaaattgggtaaaaacgggcaccgaggtttataggcaattctggattttcgacgtacagaatccacaggaggtgatgatgaactcctccaacattcaggttaagcaaagagggccatacacctatcgcgtgcgattcttggctaaggaaaatgtgacccaggacgcagaagacaatacagtctccttccttcagcctaatggggctatcttcgaaccttctctgagtgtggggacagaagccgataattttactgttctgaacctcgcagtggcagccgcttcacacatttag

SEQ ID NO: 217535 - DNA, 282 bp, Artificial Sequence
  Description of Artificial Sequence: Synthetic coding sequence
atgggttgcgatcggaattgcggcctcattgccggtgccgtcattggggcagtgctggcagttttcggcggtatcttaatgccagtcggcgatcttctaattcagaagaccatcaaaaagcaagtggtcttggaagaaggtacaatagcgttcaagaactgggtcaaaacggggaccgaggtgtacaggcagttctggatcttcgatgtccagaacccacaggaggtaatgatgaattctagcaatattcaggtaaaacagcgtggcccatacacatattag

SEQ ID NO: 217536 - DNA, 1419 bp, Artificial Sequence
  Description of Artificial Sequence: Synthetic coding sequence
atgggatgcgatcggaattgtggactcatagctggtgcagtgatcggcgctgtgctcgctgtattcggaggaattttgatgcccgtgggtgacctgctgatacagaagacaattaagaagcaggtggtcctggaggaaggtaccatagcttttaagaattgggttaagacaggaacggaagtgtacagacagttttggatctttgacgtgcagaatccacaggaggtcatgatgaactcttctaatatacaggtcaaacaacggggtccatatacctatagggtgaggttcctggctaaggagaacgtcactcaagacgcggaggataatactgtctcctttctccaacccaacggcgcaatatttgaaccctccctgtcagtggggaccgaggccgacaacttcacagtcctcaacttggcagtggctgccgcttctcacatctaccagaaccagttcgtgcagatgattctcaactctcttattaacaagagcaagtcttccatgtttcaagtgaggactttacgagaactcctgtggggatatcgcgacccctttctgagcctggtgccttaccccgtgaccacaactgttggccttttctatccatacaacaacacagccgacggcgtctataaagtgtttaacggtaaagataacatatctaaggtcgctatcatagacacatacaaggggaaacgaaaccttagttactgggagagtcactgtgacatgattaacgggaccgatgcagccagcttccccccttttgtcgagaagagccaggtcctccagtttttcagctctgatatatgcagatccatttacgccgtctttgagtcagatgtgaacctcaagggtatcccggtgtacaggttcgtactgccctcaaaagccttcgcaagccctgttgagaacccagataactactgcttttgtacagaaaaaattatcagcaagaactgcacctcctatggcgttctggatatctccaagtgcaaggaaggtcgccctgtctacattagcttgccccacttcttgtatgcctcccctgacgtgagcgaacctatcgacggactgaatccaaacgaggaagaacatcgaacgtatcttgacatcgaaccgattaccggcttcacgctccagttcgccaaaagactgcaggtcaacttgctggtgaaaccctccgaaaagatccaggtgctcaaaaacctgaagagaaactacatagttccaatcctgtggctcaatgagactggcactataggggatgaaaaagcaaatatgtttcgctctcaggtgacagggaaaatcaacttactgggcctcatcgagatgatcctcctttccgttggggtcgtaatgttcgtggctttcatgatttcttactgcgcatgcaggagcaagacaattaagtag

SEQ ID NO: 217537 - DNA, 1302 bp, Artificial Sequence
  Description of Artificial Sequence: Synthetic coding sequence
atgggatgtgaccgaaactgcgggttgattgcaggggctgtaatcggtgccgtactggctgtgttcgggggtatcctgatgccggtaggggatcttctgatccagaaaactatcaaaaaacaggtggtcctggaggaagggacaattgctttcaagaactgggtcaaaactggcacggaggtgtacagacagttctggattttcgacgtgcaaaacccacaagaagtgatgatgaattcttcaaatatacaggttaaacagcgtgggccatacacatatcgggtgagatttcttgccaaggaaaacgtaacccaggatgccgaagataacaccgtgagctttttacagccaaatggcgctatattcgagccctccctctcggtgggtaccgaagcagataactttactgttttaaaccttgccgttgccgcagccagtcatatctaccagaaccaatttgttcagatgattctgaattctcttattaacaagtcaaaatcttctatgttccaggtgagaaccctacgagagctgctatggggatacagggacccattcctctctctggtcccttatcccgtcaccaccaccgtggggctgttttatccatataataatactgctgatggagtgtataaggttttcaacggcaaagacaatatttccaaagtcgccatcatcgacacctacaagggtaagagatccatttatgccgtcttcgaatctgacgtgaacctgaaaggaattccggtgtacagattcgttctcccatccaaagccttcgctagccccgtggaaaaccccgataactactgcttttgtaccgagaaaattataagcaagaattgcacctcatacggcgtcctggatattagcaaatgcaaggaaggacggcctgtgtacatcagcctcccacatttcttgtacgcttccccggacgtgagtgaacctatcgacggcctcaatcctaacgaggaagagcatcgcacatacctggatatcgaacccatcactgggttcacgctccagtttgctaagagactgcaagtcaacctgttggtgaaaccaagcgagaaaatccaagttctgaagaatctgaagaggaattatatagttcccatcctatggctcaatgagaccgggacgattggagacgagaaggccaatatgttccgttcccaagtgacggggaaaataaacttactcggactaatcgagatgatcctcctgagcgtgggggttgtgatgtttgtggcattcatgatttcctactgtgcttgtaggtccaaaactatcaagtag

SEQ ID NO: 217538 - DNA, 1419 bp, Artificial Sequence
  Description of Artificial Sequence: Synthetic coding sequence
atggggtgcgatcgaaactgcgggctgatcgcgggagcggtcattggcgctgtcctggcagtgttcggcggaatcctcatgcccgtgggcgacctgctcatccagaagacgatcaagaaacaggtagtactggaggaaggcacaatcgcctttaagaactgggtgaagaccggtacggaagtttaccgccagttttggatctttgatgtgcagaatccccaagaagtgatgatgaactcatcaaatattcaggtgaaacagaggggtccctacacttaccgcgtgcgcttcctggccaaggaaaatgttacccaagatgccgaggacaacactgttagttttttacagcccaatggcgctatttttgagccctctttatctgtcgggacagaggctgacaattttacagtgctcaatctcgccgttgctgcggctagccatatataccaaaaccagtttgttcagatgattctgaacagtctgatcaacaagtctaaatcgagtatgttccaggtgaggacactgagagagcttctgtggggttaccgggatccattcctctccctggtcccttaccctgtgaccaccacagtggggttgttctatccatataataacaccgccgatggcgtgtataaggtctttaatggaaaagataacatctctaaagtggccatcatcgacacttataagggcaaaagaaacctgtcttactgggaatctcactgcgacatgatcaatggaactgacgcagccagtttccctcctttcgtggagaaatcacaggttttgcagtttttctcatctgacatttgcagatctatttacgctgtgtttgaatccgatgtgaatctcaagggtatcccagtatataggttcgttctgcctagcaaagcatttgcttcacccgtggagaaccctgacaattattgtttttgcactgagaagattatttctaagaattgcacatcctacggggttcttgatatctccaagtgtaaagagggaagacctgtatacatcagcttgccgcactttctctatgctagccctgacgtgtcggagcctatcgatggtcttaacccaaacgaagaggagcatcgcacatacttggacattgaacctatcactggattcacactccaatttgctaaacgccttcaggtgaatctcctcgttaagcccagcgagaaaatccaggtcttgaagaatctgaaaaggaactacatcgtgccgatcttgtggttgaacgaaactggaactattggcgatgaaaaggccaacatgtttaggagccaggtgactgggaaaataaatttattgggtctgatcgagatgatactgctgtcagttggggtcgtgatgttcgtggcatttatgatctcttactgtgcctgccggagcaagacaattaagtag

SEQ ID NO: 217539 - DNA, 282 bp, Artificial Sequence
  Description of Artificial Sequence: Synthetic coding sequence
atgggctgcgaccgaaactgcggcctgattgccggtgccgtcatcggtgccgtgctggccgtttttggcggtattctcatgccagttggcgaccttttaatccagaaaactattaagaagcaggtggttctggaagagggtactatagccttcaagaactgggtcaaaacaggaacagaggtatataggcaattctggattttcgacgttcagaacccacaggaagtaatgatgaattcatccaatatccaagttaagcagcggggtccttatacctactag

SEQ ID NO: 217540 - DNA, 432 bp, Artificial Sequence
  Description of Artificial Sequence: Synthetic coding sequence
atgggctgtgatcggaactgtgggttgatcgccggtgccgtgatcggggctgtcttagctgttttcgggggaatcttaatgcctgtgggagacttgcttattcagaaaactatcaaaaagcaggtggtgcttgaggaaggtaccatcgccttcaagaactgggtaaagacaggcaccgaagtctaccggcagttttggattttcgacgtgcagaatccacaggaggttatgatgaactccagtaacattcaggttaaacagcgcggtccttacacctatagggtgagattcctggctaaggagaacgtgacccaggacgccgaggacaacaccgtatcattcttacagcccaatggggcaatcttcgaaccttctctgagtgtgggcactgaggccgacaacttcactgtgctcaaccttgccgttgcatag

SEQ ID NO: 217541 - DNA, 1419 bp, Artificial Sequence
  Description of Artificial Sequence: Synthetic coding sequence
atgggttgtgaccgcaattgcggactcattgccggagccgtcatcggcgctgttctggctgttttcgggggtattttgatgcctgtgggcgacttactgattcagaaaacgataaagaaacaggtggtcctcgaagagggcactattgcctttaaaaactgggtgaagaccggtacagaagtgtatcggcagttctggatctttgatgtgcagaacccacaggaggtgatgatgaactcctctaacatccaagtcaagcagcggggaccatatacatatagagtgaggttcttggccaaggaaaacgtgacccaggacgcggaagacaatacagtgtcttttttgcaacccaatggagccatattcgagccatcactcagcgtcggaacagaagccgacaatttcaccgtcctgaacctcgccgtcgcggctgcttcccatatttaccagaaccagtttgttcagatgatcctgaactctctcattaacaagagtaagtcctccatgttccaggtgcgcactctccgtgaactcctttggggctacagggaccctttcctgtctctggtgccgtacccagtcactacgacggtcggccttttttatccctacaacaacacagctgacggcgtgtacaaggtgttcaatggcaaggataacatctcaaaggtggccattatcgacacctataagggcaagcgcaacttatcttactgggagtctcattgtgatatgatcaacggtactgacgcagcatctttccctccttttgtggagaagagccaggttctgcagttctttagtagtgacatttgccgttcaatctacgctgtgttcgagtctgatgtgaacctgaaaggtatacccgtgtacaggtttgtgctgccaagcaaggcatttgcaagtccagttgaaaacccagataattattgcttctgtactgaaaaaatcattagtaagaattgtaccagctacggggtgttagacatcagcaaatgtaaagaggggaggcccgtgtatatttcgttgcctcatttcctgtatgcctctcccgacgtcagtgagcccatcgatggactgaacccaaatgaagaagaacataggacatatctcgatattgagcccatcaccggattcaccctccaattcgccaaaagactgcaggttaatctattggtgaaaccaagcgagaagattcaggtgctaaagaatctgaaacgtaattatatagttcccattctttggctgaacgagactggcacaattggcgacgagaaagccaatatgttccgcagccaggtgacaggcaaaataaacctccttggcttgatagagatgatccttttaagcgtaggcgtggtgatgttcgtggcattcatgataagctactgtgcctgcaggagtaaaacaatcaaatag

SEQ ID NO: 217542 - DNA, 198 bp, Artificial Sequence
  Description of Artificial Sequence: Synthetic coding sequence
atgggctgcgacagaaattgcggcctcattgctggggctgtaatcggggctgtgctcgccgttttcggtgggattctaatgcctgtcggggacttactaatccagaaaaccatcaagaagcaggtggtgttggaggaaggaaccattgcatttaagaactgggtcaagacaggcaccgaggtgtatcggcaattctag

SEQ ID NO: 217543 - DNA, 1191 bp, Artificial Sequence
  Description of Artificial Sequence: Synthetic coding sequence
atgatgaattcgtctaatatacaggtgaagcaacgcggtccctacacctacagagtgaggttcctggccaaggaaaatgtaactcaggatgccgaagacaacactgtgtctttcctccagccaaacggggctatcttcgagccaagcctttccgtcggtaccgaggccgataacttcaccgttctgaatcttgccgttgccgctgccagtcacatatatcagaaccaattcgtgcagatgatactgaattctttgatcaataaatccaaatcctctatgtttcaagttagaacattgagggagcttctttggggttatcgcgacccgtttttgtccctggtgccctatccagtgaccacaactgtgggactgttttacccctacaacaacactgccgacggcgtctataaggtgtttaatggtaaagacaatatcagtaaagtggctatcatcgacacctataaggggaagcgcaacctcagttactgggagtcacattgcgatatgattaatggcaccgatgctgcgtccttcccccctttcgtcgagaaatcacaggtgctccagtttttctccagtgacatttgccggtccatatatgcagtgttcgagtccgatgtgaacctaaaaggaatccccgtatatcgctttgttctgcccagcaaggcctttgcctccccagtggagaaccctgataactattgcttctgcacagagaagatcattagtaagaactgcacctcctacggggtattggacatatctaagtgcaaagaagggaggccagtgtacattagcttgcctcattttctgtatgcgtccccagatgtgagcgagcctattgatgggctgaacccaaatgaagaggagcataggacatacctcgacatcgagccaatcactgggtttaccctccaatttgccaagcgtcttcaggtgaatctactggtaaaaccatctgagaagattcaagtgctgaagaatctcaaaagaaattacatagtgccaattctctggttaaatgagaccggaacaataggcgacgaaaaagccaacatgtttagaagtcaagttaccgggaaaatcaatttgctaggacttatcgagatgatcctgttgagtgtaggtgtggtgatgttcgtggcttttatgatatcatattgcgcctgccggagcaaaaccatcaaatag

SEQ ID NO: 217544 - DNA, 1239 bp, Artificial Sequence
  Description of Artificial Sequence: Synthetic coding sequence
atggggtgtgatcgtaattgtggccttattgcaggggctgtgatcggcgcagtcctcgctgtatttggcggaattttgatgcctgtgggggacttgctgattcagaagacaattaagaagcaagtggtgctggaggagggaactatagcatttaaaaactgggttaaaactggcactgaagtgtataggcagttttggatctttgatgtgcagaacccgcaagaagttatgatgaattcctccaatatacaggttaaacagcggggaccctacacatatcgggttcggttcttggctaaagaaaacgttacacaggacgctgaggataacaccgtcagcttcttgcaacctaacggcgcaatcttcgaaccctccctgtccgtcggcaccgaggcagacaacttcactgtgctgaatctagccgtggcctataataacaccgccgatggggtgtacaaagtgttcaacggcaaagacaatatttctaaagtcgctatcatcgacacatacaaggggaagcgcaatctgtcatattgggagtcacattgtgatatgatcaatggcaccgatgccgctagctttccgcctttcgtcgaaaagagccaggtcctccagtttttctcttctgacatttgtagatcaatctacgctgtgttcgaatccgacgtaaatctgaagggcataccagtctaccggttcgtgctgccaagcaaggcctttgcctcaccagttgaaaatccagataattactgcttctgcacagaaaagattatcagcaagaactgcacatcctatggggtccttgacatctccaaatgtaaagaaggcaggcccgtctatattagcttgccccacttcctgtacgcatcccctgatgttagtgagccaatcgatgggttgaaccccaacgaggaggagcaccggacctacttggatattgaaccaatcactggattcacactgcaatttgcaaagagactgcaggtgaacttacttgtgaaaccaagtgaaaagatccaggtgctaaagaacttgaaacgtaactacatcgtccctattctctggcttaatgaaaccggaactatcggcgacgagaaagcaaacatgtttcggagtcaggttaccggcaaaataaatcttttgggtttgattgagatgatattattgagtgtcggcgtcgttatgtttgtggccttcatgatctcatactgtgcctgcaggagtaagactatcaagtag

SEQ ID NO: 217545 - DNA, 867 bp, Artificial Sequence
  Description of Artificial Sequence: Synthetic coding sequence
atgggttgtgaccgtaactgcggactgatagccggagcagtgattggggctgtcttggccgtctttggtgggatcctgatgcctgtgggggacctcttaattcagaagactattaagaaacaggtggttctcgaagagggtactatcgcttttaagaattgggtcaagaccggaactgaagtttacaggcagttctggatttttgatgtgcagaacccccaggaggtcatgatgaatagttccaacattcaagtgaagcaacgcggtccctatacctacagagttcggttcttagctaaggaaaacgtgacccaggatgccgaggacaatactgtgagctttctgcaacctaacggagccatatttgaaccctcgctgtccgtcggaaccgaggccgataattttacagtgctgaatctggctgttgcggcagcctcacatatttaccagaaccagtttgttcagatgatcctcaactcactgattaataaatcaaaatcatcaatgtttcaggttcgcactcttagggagcttctctggggctacagagacccttttctgtctcttgtgccatatcccgtgacgacaaccgtgggcctattctacccatataataatactgccgatggagtgtacaaggtgtttaatggaaaagacaatatctctaaagttgctattatcgatacctacaaaggcaagcggaacctctcctactgggagagtcattgcgatatgattaatgggaccgacgccgctagctttcctccattcgtggagaagagccaagtgctgcagttcttctcctctgacatatgcagagagacatgtgtgcatttcacctcctccttttccgtgtgcaaatcttag

SEQ ID NO: 217546 - DNA, 846 bp, Artificial Sequence
  Description of Artificial Sequence: Synthetic coding sequence
atgtccgcccaggaaagttgcctatctcttataaaatactttctgttcgtgtttaatctgttcttttttgtcctcgggtcgcttatattctgcttcggaatttggattctcatcgacaagacttcatttgttagcttcgtcggcttagcatttgttcccctgcagatctggagtaaagttctcgcaattagtgggatcttcacgatggggattgctttactgggctgcgtgggcgctttaaaggaactgagatgcctgctgggtttgtactttggtatgctcctcttgctgttcgctacgcagatcaccctgggcatcctgatctccactcagcgggcacaactggaaaggtctctgcgcgatgtggtggagaagaccatccaaaagtatggaactaacccggaggagacagctgccgaagagagctgggactacgtccaatttcagctgcgatgctgtggctggcactatccccaggactggttccaagttctcatcctgagagggaatggctctgaagcccaccgcgtgccatgcagttgttataacctatccgcaaccaacgattccacaatcttagataaagtgattttgccacagctgtcccggctcggccacctagcgcgatccaggcactctgcggatatctgcgccgtcccagcagagtcgcacatttatcgcgagggatgtgctcaggggctccagaagtggttgcacaataacctcattagcattgtgggtatctgtctgggggtgggcttgctggagttgggttttatgactcttagtatattcctgtgccggaatttggatcatgtctacaataggttggcgaggtaccgctag

SEQ ID NO: 217547 - DNA, 471 bp, Artificial Sequence
  Description of Artificial Sequence: Synthetic coding sequence
atgagcgctcaagagtcatgcctgagtctgattaaatactttctgttcgtttttaacctctttttctttgtattggggtccctaatcttctgctttggcatctggatactgatcgacaagacgtccttcgttagcttcgttgggctcgcttttgtgcctctgcagatctggtccaaagtactggcaatcagcggaatcttcactatgggtatcgccttgctgggctgcgtgggagccctgaaggaactgcggtgtctcctcgggctttattttgggatgcttcttttactgttcgcaacacaaattactctcggtatcctcattagtactcagagagcccaaaaggacactcctacatggacaaagggggatcggcacaagcagctccagcgcgagactcatggcaaaaagcgcgagcaggagaaggagattgacgcactgaaagaggagacagaaacatacgagccatag

SEQ ID NO: 217548 - DNA, 642 bp, Artificial Sequence
  Description of Artificial Sequence: Synthetic coding sequence
atgggtatcgcgcttttaggatgtgttggagccctgaaggagctcagatgcctgctgggcctctacttcggcatgcttctgcttcttttcgccacacaaatcacgttaggcatcctcatctcaacacaaagagcccaactcgaaaggtcattgagagatgtcgtcgagaagaccatccagaagtacggcaccaaccccgaagaaacagccgctgaggaaagctgggattacgttcaattccaattacgatgttgtggttggcactatccccaagactggttccaggtcctcattctcagaggcaacggcagtgaagcgcaccgcgtgccatgctcgtgctataatctgtctgccaccaacgactctacaatactggataaggtcatccttccacagctgagcagattgggtcatctcgccagaagccggcattcagcagacatctgcgccgtgcccgctgagtcccacatatatagagagggctgcgcccaaggtttgcagaaatggctccacaacaacttgattagtattgtcggcatatgcctgggtgtggggcttcttgagttgggttttatgacactgtcaattttcttgtgcagaaacctggaccatgtgtacaatcggctggcgcgatatcgttag

SEQ ID NO: 217549 - DNA, 813 bp, Artificial Sequence
  Description of Artificial Sequence: Synthetic coding sequence
atgtctgcccaagaaagttgtctctccctgatcaaatactttctctttgtctttaatttatttttcttcgtgttgggaagcctcatcttctgttttgggatttggattctgatcgataagactagcttcgtttctttcgtcggcctcgcctttgtcccccttcagatatggtctaaggttctagccatctcgggaattttcaccatggggattgccctccttggctgtgtaggcgctcttaaggagctccggtgtctgctggggttgtacttcggtatgctgttgttgctctttgctacccaaattactctgggtattttgattagcacccagcgcgctcagctggagcggagtctccgcgacgtggttgagaagacaatacagaagtacgggacaaaccctgaagagaccgcagctgaagagtcttgggactatgtccagttccagctgcgctgctgtgggtggcactacccccaggattggtttcaggtcctgatcttacgcggtaacggttctgaggcccaccgggtcccctgctcatgctataatttatccgccacaaatgatagtacaattcttgataaagtaattctcccccagctcagtaggctgggacatcttgctcggtcccgccactcagccgatatatgcgccgttcctgctgagtcacatatctatagagaaggttgtgcgcagggccttcaaaagtggttacacaacaatttgatttctattgtcggaatttgcttgggtgtcggactgcttgaagttatttggcctaggccacaccctagaagcgccctcaacccatag

SEQ ID NO: 217550 - DNA, 1095 bp, Artificial Sequence
  Description of Artificial Sequence: Synthetic coding sequence
atgccgcactcataccccgcactgagcgccgagcaaaaaaaagaactgtctgatatcgctctgaggatcgtggcccctggtaagggcattctcgccgcagacgagtcagttgggtctatggcgaaacggctctctcagatcggagtggaaaataccgaagagaatcgtcgcttgtatcgccaggtcctcttttctgctgatgaccgggtgaaaaagtgcattgggggtgtcatctttttccatgagacactgtaccagaaagatgacaatggggtgcccttcgtcagaacaatccaggacaaaggaattgtcgtgggcatcaaagtggacaagggcgtggtaccacttgccggaactgacggggagacaacgacgcaagggttggacggtctgtccgagcgctgcgcccagtacaagaaggacggggctgatttcgcaaaatggaggtgcgtcttgaagataagtgaaaggacgccctccgctctggcaatcctcgagaacgcgaatgtcttagccagatatgcctctatttgccagcagaatgggatcgttccgatcgtggagccagagatacttccagatggcgatcacgatttgaagcggtgccagtatgttacagagaaggtgctggctgccgtgtataaagcattaagcgatcaccatgtgtacctggaagggacactgctgaaacccaatatggttacccccggtcatgcttgtcccatcaagtacacccctgaggagattgccatggccaccgtgaccgcactgcgcaggactgtgccaccagccgtgccaggtgtcacgtttctttccggagggcaaagtgaggaggaggcctctttcaaccttaatgcgatcaacagatgtcctctgccacggccttgggctctaacgttctcctatggacgcgcactgcaggccagcgctctcaacgcgtggaggggccagcgggataacgccggagccgcaaccgaggaatttatcaagcgggctgaggtgaatgggctggccgcacaaggcaaatacgaaggctcaggcgaagatggtggggctgccgctcagagcttatacattgcaaatcatgcctattag

SEQ ID NO: 217551 - DNA, 483 bp, Artificial Sequence
  Description of Artificial Sequence: Synthetic coding sequence
atggcaaactgcgagttttcccccgtgtcgggcgataaaccatgctgtaggctgagcaggcgagcccagttgtgtctgggagtttccattctcgtgctgattctggtggtggtactggcggtcgtcgtgcctcgctggagacagcagtggtctggccctggtacaactaagcggttccccgagactgtgctggccaggtgtgttaagtacaccgagatacaccccgagatgcggcatgtggattgccagtctgtgtgggatgcctttaaaggagcttttatatcaaagcatccttgtaatattacagaggaagactaccagccactcatgaaactgggaactcagaccgtcccttgtaataaaaatgagactatcaatcttgctcagacaggggagcgcaccgccgcaacgaccttgtttcagtattctggaaagcggttccccgcaggcctgcagaagttgcccgtcatgtggtctatgtag

SEQ ID NO: 217552 - DNA, 624 bp, Artificial Sequence
  Description of Artificial Sequence: Synthetic coding sequence
atgcagtctggcactcactggagagtcctgggactttgtctgttatcagtgggtgtgtggggacaggatggtaatgaggaaatgggcggaattacccaaacaccttataaggtgagcatttccgggacgaccgtgattcttacttgccctcagtaccctggctcagagatcctctggcaacacaatgataagaacattggtggagacgaggacgacaagaacatcggctctgatgaggaccacctttctctcaaggagttcagcgaactggagcagtccggctattacgtctgctaccctaggggatccaaacccgaggatgcaaacttttacctctatttgcgagctagggtgtgtgaaaactgcatggagatggatgtcatgtccgttgctacaattgtgatcgtggatatttgcattaccgggggtttgctcttgcttgtgtattattggtccaagaatcggaaagctaaggcaaaacccgtcacaaggggagccggagccggagggagacagaggggtcagaacaaagagcgccctcctcccgttccaaatcctgattacgaaccaattcgtaagggacagcgggatctgtacagcgggctcaaccaacgaaggatttag

SEQ ID NO: 217553 - DNA, 606 bp, Artificial Sequence
  Description of Artificial Sequence: Synthetic coding sequence
atgcagtccggcacacattggagggttcttggcctttgcttactcagcgtcggagtgtggggacaggacgggaacgaggagatggcctacaaggtttctatcagtggaacgactgttattttgacatgtccccagtacccgggatctgagatcttgtggcagcataatgataaaaatattggtggggatgaggacgataaaaatattggatctgacgaggatcacctgagcttgaaggaattcagcgagctcgagcagtccggatactatgtgtgttaccccagaggaagtaaacccgaggacgcgaatttttatctctacctccgagcacgggtctgcgagaattgcatggagatggacgtgatgtctgtggccaccattgtgattgtggatatctgcataacaggtggtcttctgctcctggtatactattggagcaagaatcggaaggccaaggccaaacctgtcaccaggggcgctggcgcaggagggagacaacgcggacagaataaggaacgaccaccacctgtccccaatccagattatgagccaatcagaaagggccagcgcgacttatatagtggccttaaccagcggcgaatatag

SEQ ID NO: 217554 - DNA, 237 bp, Artificial Sequence
  Description of Artificial Sequence: Synthetic coding sequence
atgatcggttttcttaccgaggacaaaaagaagtggaatcttgggtcaaacgccaaggatcctcggggaatgtaccaatgtaagggctctcaaaataagtccaagcctttacaggtctattacagaacttcggacaaacaaactttgctgcccaatgaccagctctatcagccactgaaggatcgagaggatgaccagtactctcaccttcaggggaaccagttgcgacggaactag

SEQ ID NO: 217555 - DNA, 549 bp, Artificial Sequence
  Description of Artificial Sequence: Synthetic coding sequence
atggagcaagggaagggcttagcagtgctcatcctggccatcattctgctacagggaacattagctcagtcgattaaagggaaccatctagtcaaggtctatgactatcaggaagatggttctgttctattgacttgtgacgcagaggcgaaaaacatcacttggtttaaggacggtaagatgatcggatttcttacggaggacaagaagaagtggaatctaggaagcaatgccaaggatcctagaggaatgtaccagtgcaaagggtcgcaaaataagtccaagcctttgcaggtatactacagaatgtgtcaaaactgtatcgaattaaacgctgctaccatcagtgggttcctgtttgccgagatcgtgagcatctttgtgctagctgtgggagtttactttatagcaggacaggacggcgtgcgccaatctcgcgctagcgacaagcagacactgttgccgaatgatcagttgtatcagccgctgaaagacagagaagatgatcagtatagccacctgcagggtaatcagctgagacgaaattag

SEQ ID NO: 217556 - DNA, 1200 bp, Artificial Sequence
  Description of Artificial Sequence: Synthetic coding sequence
atggagcccccaggtagacgggaatgtccgtttccttcctggaggttccctggccttctgctcgctgccatggtgctgttactgtatagcttcagcgatgcttgtgaagagcccccaacattcgaggcaatggagcttataggtaaacccaagccctattacgagattggcgaacgtgtcgactataagtgcaaaaagggttacttttacatccctcctttagccacccacacaatctgtgataggaatcacacttggctgccggtatctgatgatgcttgttatcgagagacctgcccttacattcgcgatccgctgaatggtcaggctgtcccagccaatggcacttatgagttcggctatcagatgcacttcatctgtaacgaaggttattacctgataggggaagagattctctattgtgagctcaagggctcagtcgccatatggagtgggaaacccccaatctgcgagaaggtcttgtgcaccccccctccaaagatcaagaatgggaagcacactttctccgaggtggaggtgttcgaatacctggacgcggtgacctactcttgcgatcccgctcctggccctgaccccttttctctgattggtgaatctacaatctattgtggcgataattcagtgtggagccgagcagccccagagtgtaaggttgtgaagtgtcgattccccgttgtggagaatggaaagcagattagtggcttcgggaaaaagttctactacaaagctacagttatgttcgagtgcgacaaggggttctacttggacgggagtgataccattgtttgcgacagcaatagtacttgggatcctcccgtgccgaaatgcctaaaagttctcccccctagcagtacaaaaccccctgcgctgtcacatagtgtctcaacatcaagtaccaccaagagtcctgcctcatctgcatctggtccgagaccaacctacaaaccccctgtgagtaactaccccggttaccctaaacccgaggaggggatcctcgacagtcttgacgtgtgggtgattgccgtgattgttatcgctattgttgttggggtggccgtcatttgcgtggtgccttacaggtacctgcaaagaaggaagaagaagggaaaagcagacggcggagccgaatatgcaacttatcaaactaagagcacaactccagccgagcagcggggatag

SEQ ID NO: 217557 - DNA, 1050 bp, Artificial Sequence
  Description of Artificial Sequence: Synthetic coding sequence
atggagcccccaggtcgtagggaatgcccgttcccgtcttggcgttttccgggactgctgcttgcggctatggtcttgcttctttactcctttagcgacgcttgtgaggagcccccaactttcgaagcaatggagttaatcgggaagcctaagccttattatgaaattggagaacgcgtggactacaaatgcaagaagggatatttctacattcctccactggcaacacacacaatttgcgatcggaatcacacttggcttccagtgtcagatgacgcatgctatcgcgaaacgtgtccctatatacgggatccactgaatgggcaggcagtgcctgctaatgggacgtatgagttcggctatcagatgcattttatctgcaatgagggctactatctgattggggaggaaatcctgtactgcgaactcaaaggcagcgtggccatatggtccggcaaaccgcctatctgtgaaaaggtcctgtgtacaccacctcccaaaatcaaaaatgggaagcacacattctcagaagttgaagtattcgagtatctggacgctgtcacttatagctgtgacccagcaccaggccctgacccctttagtctgatcggcgagtccactatttactgcggtgacaactctgtgtggtctagagccgctccggagtgtaaagtggtcaagtgcagatttccagtcgtagaaaacggaaagcaaatatctgggtttgggaagaagttctattataaagctactgtgatgttcgaatgcgataaaggattttatctcgacgggtcggacactatcgtgtgcgatagcaactctacatgggaccccccagtccccaagtgtctgaagggccctcgcccaacttataagcctcccgtgtccaactaccctggttaccccaaaccggaggaggggattctggacagccttgatgtgtgggtgatcgctgtcatagtgatcgccatcgggaagcagatggttgagctaaatatgccactcactaggctgaaccagcccctccagcaaagccgggaagcagagtag

SEQ ID NO: 217558 - DNA, 1155 bp, Artificial Sequence
  Description of Artificial Sequence: Synthetic coding sequence
atggagcctccaggtcgtagggagtgcccgttcccttcctggagattccccggacttttactggccgcaatggtgctcctcctttattcattcagcgacgcctgtgaggagccgccaactttcgaggccatggagcttatcggaaaaccaaagccatactacgaaatcggcgagcgggtggactataagtgcaaaaaggggtacttctatattccgcctctagccacacatacgatttgtgatcgtaatcacacatggctgcctgtttccgacgacgcctgttacagggagacctgcccttatattagggaccccctaaacggccaggctgtgcctgctaacggtacgtacgaatttggataccagatgcattttatctgtaacgagggatactatctgatcggagaggaaattctgtattgcgagctcaagggctccgtagcaatctggagcggaaaaccgccaatatgcgaaaaggtactgtgcacccctcccccaaaaatcaaaaatggcaaacacacgttctccgaagttgaagtcttcgagtacttagacgctgtgacttacagctgcgatcctgccccagggcctgatccattttcactgattggggaatcgacaatttactgtggcgacaactccgtgtggtccagagcagcgcctgagtgcaaagtggttaaatgtagattcccagtcgtcgaaaacggaaagcaaattagcggttttggaaagaagttctattataaggctaccgtgatgtttgaatgcgataaagggttctacctggacggatccgatacaattgtgtgcgactcaaactccacttgggacccaccagtgccgaagtgcctgaaggtatcaacatcttccacaaccaagtctcccgcttcaagcgcttcagggccaaggcccacatataaaccaccagtttctaattaccctggatatccaaagccagaagagggtatcctggacagtctcgacgtatgggtcattgcggtcattgtgattgcaatagtggtgggggtggcggtgatttgcgtagttccctaccgctacctgcaacgcagaaaaaagaagggcaaagccgacggcggtgccgagtatgcaacttatcaaaccaaatccactactcctgctgaacaacgtggttag

SEQ ID NO: 217559 - DNA, 1110 bp, Artificial Sequence
  Description of Artificial Sequence: Synthetic coding sequence
atggaaccaccgggacgacgcgaatgcccatttccatcttggcggtttcctggactgttgttggcagctatggtactgttactgtactctttcagtgacgcctgcgaagagcccccaacgttcgaggccatggaactgatcggtaaaccaaaaccctattatgaaattggcgaaagagtggactacaagtgcaagaaaggctacttctacatccctcccctggccactcacacgatttgcgaccgtaaccatacatggttgccagtgtcggacgacgcctgctaccgagaaacctgtccatatatcagggatcctctgaacgggcaggccgttccagcgaatggtacttatgagttcggttaccagatgcactttatttgcaacgaggggtactatcttattggcgaggagatcttgtactgcgagctgaaaggatctgtggccatctggagtggcaaaccaccaatctgcgagaaggtgctctgtaccccacccccaaagattaaaaatggaaagcacaccttcagcgaggtcgaggtgttcgaatacctcgacgcggttacctactcttgcgaccccgcacctggcccagatccttttagcctgattggagagagtactatctactgtggggacaacagtgtgtggtcacgcgcagcaccagagtgtaaagtcgtaaagtgtcggttccccgtggtggaaaatggtaagcagatcagcggctttgggaaaaaattttattacaaagccacagtgatgttcgagtgcgataagggtttttacctcgatggatccgataccattgtctgcgacagcaattctacctgggaccctccagtccctaagtgtctaaaggggcctcgaccgacttacaaacccccagtgtccaactatcccggataccctaagccagaagaaggaattctggactctctggatgtctgggtgattgctgtaatcgtgatagccatcgtagtcggtgtagcggttatctgtgttgttccttatagatatctccaaagaagaaagaagaagggtaaagccgacgggggagccgaatatgcaacataccagacaaagtcgacaacccccgcagagcagaggggttag

SEQ ID NO: 217560 - DNA, 1179 bp, Artificial Sequence
  Description of Artificial Sequence: Synthetic coding sequence
atggagcctcctggcagaagagaatgccccttccctagctggagatttcccggactgctgcttgctgcgatggtgttgcttctgtacagcttttccgacgcttgcgaagagccccctacattcgaggcaatggaactgatcggcaagccaaaaccctactacgagattggagaacgggtagactacaaatgtaaaaaggggtacttttacataccaccacttgccacacacacaatttgcgatagaaaccacacttggctgcccgtctccgacgacgcttgctaccgcgaaacctgtccatacattcgggaccctcttaatggacaagctgtgcccgctaatggaacatacgaatttggctaccagatgcacttcatctgcaacgaaggctattacctcataggcgaagagatactctactgtgagctgaaggggtctgtcgctatctggtccggtaaacctcccatttgcgaaaaagtgctgtgcactcctccacccaaaattaagaacggaaagcatacattttccgaggtcgaagtctttgaatacttggacgccgtcacgtattcctgcgaccctgctcctgggcctgacccttttagcttaattggtgaatcgaccatttactgcggtgataactccgtttggtcacgggctgcgcctgagtgcaaggtcgtgaaatgccgtttccctgtagtcgaaaatggcaaacagatatccgggtttggcaagaaattctattataaggccactgtgatgttcgagtgtgataaaggcttttacctggacggatctgataccatcgtctgcgatagcaactctacctgggatccgccagtgccaaaatgccttaaggtgttgcctccctcctccaccaaaccacccgctctctcgcactccgtctctacgtcttcaaccacaaagagccccgcttcctccgctagcggcccaagacctacatataagcctcccgtgtctaactatccgggatacccgaagcctgaggaaggaattctggatagcctggatgtttgggtgatcgccgtcatcgtgattgccatagtggtcggggttgctgtcatttgtgtggttccgtaccggtaccttcagcgacggaaaaaaaaagggacctatctgaccgatgagacacatcgagaggtgaagtttacttctctgtag

SEQ ID NO: 217561 - DNA, 1068 bp, Artificial Sequence
  Description of Artificial Sequence: Synthetic coding sequence
atggaaccaccgggacgtcgcgagtgcccttttccttcttggcgcttccccggtctattgttggccgctatggtcctgcttttgtacagcttttccgacgcttgcgaggagcctccaaccttcgaggccatggagctgattggaaaacccaagccttactacgaaattggtgaaagagtcgactataagtgcaaaaaaggatacttttacatccctcctttagctacacacactatctgcgaccgaaaccatacttggctgcccgtcagcgatgacgcctgttatagagaaacctgcccatatattcgcgatccgctcaatggtcaggcggtgccagcaaacgggacatacgagttcggataccagatgcactttatctgcaatgaaggttattatctgattggcgaggagattctgtactgtgaactgaagggaagcgtcgctatctggtcagggaaacctcctatctgcgagaaggtcctatgtacaccacccccaaagatcaaaaacggcaagcacaccttctctgaggtagaggtgttcgagtatcttgatgccgtcacatatagttgcgatcctgcgcctggacctgacccatttagcctcatcggcgagtcaaccatttactgcggagataactcagtgtggtcacgcgctgctcccgagtgtaaggtggtcaagtgcaggttccccgtggtcgaaaacggtaagcagatctctgggttcgggaaaaaattctactacaaggcaactgtgatgttcgagtgcgataaaggcttttacttggatggttccgataccatagtgtgtgattctaattccacctgggaccctccggtgccaaagtgcctgaagggctaccctaagcctgaagaaggcattctggatagtctggatgtttgggtgatcgccgtgattgttatagctatcgttgttggtgttgccgttatctgcgtggtgccctacagatacctgcagaggagaaagaaaaagggcaaagcagacggcggtgccgagtacgccacgtaccagaccaaaagcaccacccccgcagaacagaggggctag

SEQ ID NO: 217562 - DNA, 1158 bp, Artificial Sequence
  Description of Artificial Sequence: Synthetic coding sequence
atggaacctcccggacgcagagagtgtcctttcccaagttggcggttcccaggactactgctggctgccatggttctgctgctgtattccttcagcgatgcgtgcgaggagccgccaaccttcgaagccatggaactgatcggaaaacctaagccctattacgaaattggggaaagagtcgattataagtgcaagaaaggatatttttacattcctcctctcgcaactcacactatttgtgacagaaaccatacttggctgcctgtcagcgacgatgcatgctatcgcgaaacctgcccttacataagagatccactcaacggacaagcggtgccagccaacggtacctacgagtttgggtaccagatgcatttcatttgcaatgagggctactacctgatcggagaggagattctgtactgcgagctcaaaggttccgtggctatctggtccggcaagcccccaatttgtgagaaagtgctctgcactccgccacccaagatcaagaatgggaaacacacgttttccgaagtggaggtattcgagtatctggatgcggtgacctatagctgcgatcctgcacccggaccagaccccttttccctcatcggtgagagtactatctattgcggagacaattcagtgtggtcacgcgctgccccagagtgcaaggtggttaaatgccgttttcccgtagttgagaacggaaaacagatatcaggcttcggtaaaaagttctattataaggcaacggtgatgttcgaatgcgataagggtttctaccttgatggctctgatactatcgtttgtgacagcaatagcacctgggacccaccagtgcccaagtgtctgaaggttctcccaccaagctctaccaagccacctgccctgagtcattcagtctcaactagcagtaccaccaagagtcccgcatctagcgcctctggataccccaagcctgaggaaggcatactggattcccttgatgtgtgggtgatagccgtgatagtgatcgccattgtggtgggcgtagctgttatatgcgttgtcccatatagatatttgcagcgcaggaaaaagaagggcaaagcggacggtggcgctgagtatgccacctaccagacaaaatcgactacaccggcagagcaacgaggatag

SEQ ID NO: 217563 - DNA, 1089 bp, Artificial Sequence
  Description of Artificial Sequence: Synthetic coding sequence
atggaaccacccggacgacgggagtgtcctttcccgtcctggagattcccaggcctgctcttagccgctatggtcctgttgctatactccttcagtgatgcctgcgaagagccacctacctttgaggcgatggagctcatcgggaaacccaagccttattacgagataggagagcgggttgattacaaatgtaagaagggctacttctatatccctcctttggctacgcacaccatctgcgatcgcaatcacacctggctgcctgtcagcgacgacgcatgttatagggaaacgtgcccatatatccgagacccccttaacggccaggcggtgccagccaatgggacatacgaattcggctaccagatgcatttcatttgtaacgagggatactatctgatcggggaggagatactctactgcgaactgaagggttctgtcgcaatctggtctggtaagcctccaatctgcgagaaagtgctctgtacaccccctcctaagatcaagaacggtaagcacacattcagcgaagttgaagttttcgaatatctcgacgctgttacttactcatgcgatcccgctccgggacctgacccttttagtcttattggcgagtcaaccatctattgcggggataacagtgtgtggtcccgcgctgccccagagtgtaaggtggttaagtgtagatttcccgtggttgagaatggcaagcaaatcagtgggtttggcaaaaaattctactacaaggctacggtaatgttcgagtgcgacaaaggtttttacctggacggatctgacaccattgtttgcgactcaaattcaacgtgggacccaccggtccccaaatgtttgaagggtcccagacctacctataaaccacctgtgtcaaactatccgggataccctaagccagaagaaggaatcttggactccttagacgtctgggtaattgcagtgattgtcatagccatagtcgtgggagtggccgtgatttgtgttgttccctatcgctacctgcagcgacgcaaaaagaaaggtacgtacctgactgacgagactcatcgcgaagtcaaattcaccagcctctag

SEQ ID NO: 217564 - DNA, 1134 bp, Artificial Sequence
  Description of Artificial Sequence: Synthetic coding sequence
atggagccgccaggaaggcgggagtgtcccttcccttcttggcgattccctgggctgctgttggccgctatggtcctcctcctctattccttttcagatgcgtgtgaagaacccccaacctttgaggccatggaactgatcggaaagcctaagccctattatgagataggagagagggtcgattataaatgcaagaaagggtatttctacatccccccactggccacccacaccatctgcgatcgcaaccatacctggcttcctgtgtcagatgacgcctgctacagggagacctgcccctacatcagagaccctctcaacggacaagcggttccagcaaatgggacctacgaatttgggtaccagatgcactttatctgtaatgaaggatactatctgataggcgaggagatcctgtattgtgaattgaagggatcagtggcaatctggtctggtaagccaccaatctgcgagaaggtgctctgcacacccccacccaagataaaaaacggcaaacatactttctccgaggttgaggttttcgaatatctggacgcagtaacttattcatgcgatcctgcccctgggcctgacccatttagcctgattggtgagtctaccatctactgtggagataactctgtctggagtagggctgctccggagtgcaaagttgtgaagtgccggtttcctgtggtagaaaacggcaagcagatctcagggtttggcaaaaagttctactacaaggccacagtgatgtttgagtgtgataaaggcttttacctcgacgggtctgacaccatagtgtgtgattccaacagtacgtgggaccccccagtgcctaaatgcttaaaagtgtccactagctctactacaaaatcacctgcctcgagcgctagtggccctaggcccacatacaaaccacccgtgtcaaactatcctggatatcctaagcccgaagagggcatcctcgattcattagacgtctgggtcatcgcagtgattgtgatcgccatcgtggtcggcgttgccgtgatctgcgttgtgccgtataggtacctgcagaggcgaaagaagaaaggtacatacctcactgatgaaacccatcgagaagtaaagttcacatcactctag

SEQ ID NO: 217565 - DNA, 1011 bp, Artificial Sequence
  Description of Artificial Sequence: Synthetic coding sequence
atggagccacctgggagaagggagtgccctttcccctcatggcgatttcctgggttgctcctggccgctatggttcttctattatattcatttagcggagaaacatgcccatatatccgggatccactgaatggacaagctgtgcctgcaaatggaacatacgaattcggctaccagatgcatttcatctgtaacgaagggtactacttaatcggcgaggaaatcctttactgcgagctcaagggtagcgtcgcaatctggtcaggtaagcctcccatctgtgaaaaggtcctgtgtactccgccaccgaaaataaagaacgggaagcataccttctcggaggtggaggtgtttgagtatttggatgccgttacctactcctgcgatcccgcaccgggtccagaccccttttcactgattggggaaagtactatttactgcggggataacagtgtttggtcacgagccgcacctgagtgcaaagtcgtcaaatgccgattccctgtggtcgaaaatgggaaacagatatcggggtttggaaaaaaattctactataaagccacggtgatgttcgagtgcgataagggattctacctggacggttcagataccattgtatgtgattctaactccacatgggatccgcctgtccccaagtgcctgaaagtcttaccaccatcaagcaccaaaccaccagccctgtctcactcagtgtctacgagctccaccactaagtcgcctgcttcctcggctagcgggccaaggcctacctataagcctcctgtaagcaactaccccggatatcctaagccagaggaggggattctggactctctcgacgtctgggtaatcgccgtgatcgtcatcgcaatcgtcgtgggcgtcgccgtcatctgtgttgtgccctacaggtatctgcagcgcagaaagaaaaaaggcaaagccgatggtggagcagagtacgcaacctaccagacaaaatctactacccccgctgaacagagaggctag

SEQ ID NO: 217566 - DNA, 1095 bp, Artificial Sequence
  Description of Artificial Sequence: Synthetic coding sequence
atggaaccgccagggaggagagaatgcccattcccatcttggcggtttcctggcctgttgctcgcggctatggttttgttgctctactcattctccgatgcctgtgaggagcctcccacattcgaagctatggagttgattgggaagcccaagccctattatgaaatcggcgaacgtgttgactacaagtgtaagaaggggtacttttatataccacccctggcaacacataccatatgtgatcgtaatcatacatggctcccagtgtcggacgatgcatgttacagagagacctgcccctatattcgcgatccccttaacggacaggccgtgcccgcaaacggaacctacgagttcggctaccaaatgcacttcatctgcaacgagggatattacctgatcggagaggagatattatattgtgaactgaaagggagtgtggcaatctggtccggaaagcctccgatctgcgagaaggtgctgtgtaccccaccaccaaagatcaagaatggcaagcacaccttctctgaggtggaggttttcgagtacctagatgctgtgacatactcctgcgaccccgcacctggacctgacccgttcagcctaataggggaatccactatctactgcggcgataactccgtgtggagcagggcagcccctgagtgtaaggtggtgaagtgtcgctttcccgtggttgagaatggaaagcagattagcggctttgggaaaaagttttattataaagccaccgtgatgttcgaatgcgacaagggattttatcttgacggctctgataccatcgtctgtgattccaatagcacctgggatccgcctgttcccaagtgcctgaaagtatcaacgtcctcaaccacgaagtctccggcatcttctgcatctggacctcgacccacgtacaagccacccgtcagcaattatcccggataccctaaacccgaggagggcatcctagactctctggacgtgtgggtgatcgcagtgattgtcattgcgatcgggaagcagatggtagagctgaacatgccactgacaagactgaatcagccactccaacagtcaagggaggcagagtag

SEQ ID NO: 217567 - DNA, 1113 bp, Artificial Sequence
  Description of Artificial Sequence: Synthetic coding sequence
atggagccacccggacgtagagagtgcccttttccatcatggagatttccaggcttacttctagcggctatggtgctgttgctttacagcttctcagacgcatgcgaggagccacctacctttgaggctatggagttgattggcaagccaaaaccctactacgagatcggtgagagggtggattacaaatgtaaaaagggttacttttacattcccccattggccacgcatacaatctgcgacaggaaccatacctggctaccagtttcagatgatgcctgttacagggagacctgcccatacatcagagatcccctgaatggtcaggcagtgccagccaacggaacatacgagttcggatatcagatgcacttcatctgcaacgaggggtactatctcataggtgaagagattctgtactgcgagctgaagggctccgttgccatctggtccgggaaaccacctatttgcgagaaggtcctttgtacgcctccaccgaagataaaaaacggaaagcatactttttcagaagtggaggttttcgaatacttggatgccgtgacctattcttgcgacccagctcccggtcccgacccattttccctgatcggcgaatccacaatctattgcggtgataactcagtgtggagtagagcagcaccggagtgtaaggttgtcaaatgtcgcttccccgttgtggagaacggcaagcagataagcgggtttggcaaaaagttttactacaaggctactgtgatgtttgaatgtgacaaagggttttatctggatggctcagataccattgtctgcgactcaaactctacatgggaccccccagtgccaaaatgcttgaaggtttcaaccagctcaacaaccaagtcaccggcatcttcggcatcaggatatccaaaacccgaggaaggtattcttgattcgctcgatgtgtgggttattgccgtcatagtgattgcaattgtcgtgggggttgctgtcatctgtgtagtaccctatagatatctccagcggcgaaaaaaaaagggcaaggccgatgggggagctgagtacgcaacctaccaaacaaaatctactactcccgcagagcagaggggctag

SEQ ID NO: 217568 - DNA, 510 bp, Artificial Sequence
  Description of Artificial Sequence: Synthetic coding sequence
atgtgctcgcgcggttgggatagctgcttggccctcgaactattgctgctgcccttgtcactgctggtaacctctatccagggacatctcgttcacatgactgtcgtgtccgggtccaatgtgaccctgaacatatcagaatcgcttcctgaaaactataaacagctcacatggttctacactttcgaccagaagattgttgagtgggacagcaggaagagcaagtatttcgagtcgaaattcaagggccgtgtgagactggatcctcagagcggcgctctttatattagcaaggtccagaaagaggataattctacatatatcatgcgggtgctcaaaaagaccggtaatgagcaggaatggaaaatcaagctccaagtcctgggtgagtcgggcgagccaaaaagtaagagtccattacagtggccccaaatggatcattgcagagcctcatgggaagcttggggcaccctgggggaggaagaacgcaaaacgagcgggcaggtatag

SEQ ID NO: 217569 - DNA, 732 bp, Artificial Sequence
  Description of Artificial Sequence: Synthetic coding sequence
atgtgtagccggggatgggactcatgcttggccttagagctgctcctacttcctctgagccttctcgttacgtccattcaaggacacctggtgcatatgacagtcgtgagtggttcaaacgtgacgctaaacattagcgaaagtttgccggagaattacaaacagctaacttggttctacaccttcgatcaaaagatcgtcgagtgggattcccgcaagagtaaatactttgagtccaagtttaagggaagggttaggcttgatcctcaatctggcgcactgtacattagcaaagtccagaaagaggacaattcaacctatatcatgcgggtattaaagaagacaggaaacgaacaggagtggaagattaaactgcaggttctggaccccgtgcctaagcctgtgatcaaaatagagaagattgaggacatggacgacaattgttatctgaagctcagttgcgtcattccaggcgaaagtgtaaactatacttggtacggagataagcgtccgtttcccaaggaactgcagaatagcgtactcgaaaccacactgatgcctcacaactacagtcgatgttatacatgtcaggtcagcaatagtgtcagcagtaagaacggaaccgtttgtttatcccccccatgcacattggcacgctcattcggtgtggaatggatagcttcctggctggttgtgacagtgccaactatcctcggcttactcctaacttag

SEQ ID NO: 217570 - DNA, 1044 bp, Artificial Sequence
  Description of Artificial Sequence: Synthetic coding sequence
atggcccttctgttttcgctgatcctggccatctgcacaagacctggattcttggcttctccatctggcgtgagattagtggggggtttgcacaggtgcgagggtagagttgaggtcgaacagaaaggccagtggggcacggtctgtgatgacggttgggacattaaagatgtggccgtattgtgtcgggaactcggctgcggcgcagcctctggcacaccgtcaggcattctgtacgaacctccagctgaaaaggagcagaaggtgctgattcaatcagtcagttgtacgggcaccgaggacactctggcccagtgcgagcaagaagaagtttacgattgctcccacgatgaggatgccggtgcgtcctgcgaaaaccccgaatcaagcttttcgcctgttcccgagggggtccgtcttgccgatggcccaggacattgtaaggggagagttgaagttaaacatcagaatcaatggtacaccgtatgtcagacagggtggtccctccgggctgcgaaagttgtctgcagacaattggggtgtgggcgagcagtgctcacgcagaaacgatgtaacaaacacgcttacggccgtaagcccatctggctgtcccagatgagctgcagcgggcgagaagccactttacaggattgccctagcggcccatgggggaaaaacacgtgcaatcatgatgaggatacctgggtcgaatgcgaggatccattcgatctgaggcttgtgggcggagacaacctgtgtagcgggaggctcgaagtgctgcataagggcgtgtggggctccgtttgcgatgacaactggggggagaaggaagaccaggtggtgtgtaagcagctggggtgcggcaaaagcctcagcccctcattccgagatcggaaatgttacggtcccggagtggggcgtatctggctcgacaatgtgagatgcagcggagaagaacagtctctggagcagtgtcaacacagattctggggcttccatgactgtacacaccaggaggatgtagccgtcatttgcagcggatag

SEQ ID NO: 217571 - DNA, 660 bp, Artificial Sequence
  Description of Artificial Sequence: Synthetic coding sequence
atggggatgagcagcctcaagctcttgaagtacgttctgtttttcttcaatctgttattttggatatgtggttgctgcatcttggggtttggtatttatctgttgattcataacaactttggcgtgcttttccacaatttgcccagtctcacattgggaaatgtttttgttattgtagggagcataatcatggtggttgcctttctgggctgtatgggcagcatcaaagaaaataagtgcttgcttatgagtttttttatcctgctgctaatcatcctgctggcggaagtgacactcgcaattttgctgttcgtctatgagcagaagttgaacgaatatgtagcaaaaggactgaccgacagtatccataggtatcacagtgacaattcaacaaaagccgcatgggacagcatacaaagttttcttcagtgctgtggaatcaatggaacctccgactggacctctggcccacccgcatcatgcccctcagacagaaaagtagagggctgctatgcgaaagctcgcctgtggtttcacagtaatttcctctacattggtatcatcactatatgtgtgtgtgtgattgaggtcctgggtatgtcctttgccctcacactgaactgtcagattgacaagacttctcagacaatcggcctctag

SEQ ID NO: 217572 - DNA, 483 bp, Artificial Sequence
  Description of Artificial Sequence: Synthetic coding sequence
atgggaatgagttcactgaaactcttgaagtacgtgcttttttttttcaatctgttgttctggatttgtggatgttgtattcttggtttcggaatttacctgctaatccataataattttggcgtattatttcacaacctgcctagcctcacccttggtaatgtttttgtgattgtgggctccatcattatggtcgtggcattcctgggctgcatgggtagcatcaaggagaacaagtgcttgctgatgagcttcttcattctactgttgatcatcctgttagccgaggtgaccctggctatactgctttttgtatacgagcagaagggctgctatgcgaaggccagactctggtttcacagcaattttctgtatatcggcattataaccatctgcgtttgcgttatagaggttctgggcatgtcatttgcactgacattgaattgtcagatcgacaagacttcccagaccatcggactctag

SEQ ID NO: 217573 - DNA, 1323 bp, Artificial Sequence
  Description of Artificial Sequence: Synthetic coding sequence
atgacagttgctcggcctagcgtacctgcggcactgccactcctcggagaactcccacgattgcttctgctggttctgttgtgtctccctgctgtttggggcgattgtggtcttcccccagacgtgcccaatgcacagcccgcactggagggaagaacaagttttcccgaggataccgtcatcacctataagtgtgaggaatccttcgtgaaaattccaggggagaaggactctgtcatttgcctgaagggtagtcagtggtcagacattgaggaattttgcaatagatcttgtgaagtaccgacaagactgaactcggcaagcctaaagcagccatacataacccagaattactttcctgtggggaccgtggtggaatacgaatgcaggccaggctacagacgcgagccatccctttcgcccaagctgacctgtctgcagaacctgaagtggtctacagcagtcgagttttgtaagaaaaaatcttgccctaatccaggagaaatcaggaacggccagatcgatgtgcccggagggattcttttcggcgcaaccatttccttcagctgcaataccggttacaagctgttcggatcgacttcttcattttgcctgatcagtggatcatccgttcagtggagcgatccactgccagagtgccgggagatttattgccccgcaccaccccagatagacaacggaatcatacaaggcgaacgggaccactacggttacagacagtcagtgacttacgcttgcaataaggggtttaccatgattggagagcactccatatactgtacggtgaataatgacgagggagagtggtcgggtccccctcctgaatgccgtggaaaatctcttacaagtaaggtccctcccacagtgcagaaacctaccacagtgaatgtccccaccacagaagtgtctccaacatcccaaaaaactaccactaaaactacaacacccaatgcccaagcgacccgcagtaccccagtctctaggacaacgaaacacttccacgaaaccacaccaaacaaggggagtggaaccacgagcgggaccacacgcctgctcagcggctcacgacccgtcacccaggccggaatgcgatggtgcgatagatcatccctgcaatctcgaacccctgggttcaagaggtcgttccatttttcattacccagtagctggtattacagagcgcacgtatttcatgtggacagattcgcctgggacgcaagtaaccatggtctggccgaccttgcaaaagaggagcttaggaggaaatatacacaggtgtaccgtctgtttctggtaagctag

SEQ ID NO: 217574 - DNA, 1095 bp, Artificial Sequence
  Description of Artificial Sequence: Synthetic coding sequence
atgactgtggcaaggccatctgtccctgcggctctgcccctcttgggcgaactgccacgactgttacttctagtgctcctctgcctgcccgctgtatggggcgattgcggcctgcctcccgatgttcccaatgcgcagcctgccctggaggggagaaccagcttcccagaggacacagtgatcacctataagtgcgaagagtcctttgtgaaaatcccaggagagaaggattccgtcatttgcctgaagggttcacagtggagcgacatcgaagagttttgtaacagaagttgcgaagtgcctacaagactgaatagcgccagtctgaagcagccttatataacacaaaattattttcccgtgggcaccgtggtcgagtatgagtgcagacccggatataggagagaaccttctctttcaccaaagttgacctgtctccaaaacctgaagtggtccaccgccgtggaattctgtaaaaaaaagtcttgcccaaatcccggagagatcagaaacgggcagatcgacgtgccaggaggcatactattcggggctaccattagcttctcatgtaatacaggctacaagctcttcggcagcacaagtagcttctgtctcataagcggatctagtgttcagtggagtgatcccctgcccgagtgtcgagaaatatactgtcctgcgccaccgcaaatcgacaatggcattattcagggagaacgcgaccactacggttaccgtcagagcgtaacgtacgcctgcaataagggattcaccatgattggtgagcactctatatactgtactgtgaacaatgatgaaggagaatggtcaggaccaccacccgagtgtcgaggtaaaagcctgacatccaaggtgccacctactgtacagaagccaactaccgtcaatgtgcctaccaccgaagtgtcccctacgagccagaagactactaccaaaaccaccacccctaatgcgcaggccactaggtctacccccgtcagcagaaccaccaaacacttccatgagacaacccccaacaaggggtctggaactacttccggaacaacccgtctgctgagcgttctgttcatgtag

SEQ ID NO: 217575 - DNA, 1146 bp, Artificial Sequence
  Description of Artificial Sequence: Synthetic coding sequence
atgaccgtggcccgacctagtgtgcccgctgctcttcccctgcttggcgaactccctagactactgctactggttctgctttgtcttccggctgtgtggggggattgtggccttcctccagatgttcctaatgcccagcccgcactcgaggggagaacctcttttcctgaagataccgtgattacctataagtgcgaggaaagctttgtgaaaatacctggggaaaaggactcagtcatctgtcttaaagggtctcagtggtccgacatcgaggagttttgtaacaggtcgtgtgaggtccctactaggcttaactcagcctcccttaagcagccctatatcacccagaattactttcccgtaggaaccgttgttgagtatgagtgccggccagggtacaggagggagccgtccttatcgcccaagctgacttgtctgcaaaatttaaagtggtctactgcagtcgagttctgcaaaaaaaagtcttgcccaaatcctggagaaatcagaaacggccagatcgatgttccgggtgggatcctctttggggctaccatctctttttcatgtaacacggggtacaaactgttcggttccacctccagtttctgtctgatcagtgggtcctccgttcagtggtctgaccctctgcccgagtgtcgcgaaatctactgccccgctccccctcagatcgacaatggtattatccagggcgaaagagaccactatggttacagacaaagcgtgacatacgcttgcaacaagggctttacgatgatcggcgaacacagcatttactgtacggtaaacaatgatgagggagagtggtcagggccacctccagagtgccggggtaagtctcttacttccaaagtgccacccacagtgcagaagcccaccacagtgaacgtgcccaccacagaagtgtctcctacaagccagaaaacaacgactaagaccaccactcctaacgctcaagctacaagatctacaccagtctctaggaccacaaaacactttcatgagactactccaaataagggttctggaacaaccagtgggactacacgcctgctgtctggacacacttgctttacccttacgggtctcctgggcacactcgtgactatgggactccttacctag

SEQ ID NO: 217576 - DNA, 1320 bp, Artificial Sequence
  Description of Artificial Sequence: Synthetic coding sequence
atgaccgtggcccgtccttctgttcccgctgctttgccgttactgggggaactgccccgtctgttgctgttggtgcttctgtgtcttccagcggtgtggggggattgtggccttccacccgacgttcccaacgctcagcccgctctggaaggtcgtacttcgttcccagaagacaccgtgatcacatacaaatgcgaagaaagctttgtgaaaatccctggcgaaaaggactcggttatttgtctgaaagggagtcagtggagtgatatcgaggagttttgcaataggtcttgtgaggtccctacccgtttgaatagcgctagcttaaagcagccctatatcacacagaattatttcccagttggaacagtcgtggaatatgagtgcaggccgggataccgaagggagccttctctcagtcccaagttgacatgccttcaaaacttgaagtggtccaccgcagtagaattctgtaaaaaaaagtcttgccctaaccctggtgagattagaaacggacagatcgatgtaccaggaggaatcctttttggggcaactatctcatttagttgcaacacggggtataaattgtttggcagtaccagttccttttgtttgatctctggaagcagcgtgcagtggtcggacccgctgccagagtgtagggagatttactgcccggcaccaccacagatcgataatgggataatacagggagaaagggatcattacgggtatagacagtccgtaacgtatgcctgtaataagggattcactatgatcggagaacactccatctattgcaccgtgaataatgacgaaggtgaatggtctgggccacctcccgaatgcaggggcaaaagcctgacatccaaggttcctccaaccgtacagaagcctactaccgtgaatgtgcctactacagaggtgagtcctacgtcacagaaaactacaaccaaaactactacacccaacgcccaggctactagatccacgccagttagcagaacaaccaagcatttccacgagacaacaccgaacaaaggaagtggcacaactagtggcacaacacggctcctgagcgaaacagtcttccaccgggtgatccaggatggcctcgaccttttggcttcccgatcagcatgcttaggcttgcctaaatgttgggactacaggagggagccacctcatttagctagagctcatgtgttccatgtcgaccgattcgcctgggatgcgagtaaccacggactggctgatctagctaaggaagagctgagacgcaagtatacacaggtctatcggctgtttctcgtttcatag

SEQ ID NO: 217577 - DNA, 390 bp, Artificial Sequence
  Description of Artificial Sequence: Synthetic coding sequence
atgaccgttgcccgaccatccgtgcccgctgccctccccttgctcggagagttaccgaggttgttgctacttgtactcctgtgtctgccagctgtttggggagattgtggattgccaccagacgtgccaaacgcacagcctgcattggagggtcggaccagcttcccggaggataccgtgatcacctataagtgcgaggaatcttttgtgaaaattccgggtgagaaagattccgtgatctgtctcaagggaagtcagtggtccgatatagaagaattttgtaataggagttgcgaggtccctaccagactgcagaagaggacctttagcataactaaaacgaatctgcctagtgagttcaaaatggttcattccagccgcatcctctag

SEQ ID NO: 217578 - DNA, 1155 bp, Artificial Sequence
  Description of Artificial Sequence: Synthetic coding sequence
atgacggtggcaaggccatcggtgccggctgctctccctcttctcggtgagctgccaaggctcctgctcctggtgctcctgtgcctgcctgcggtttggggcgattgcggcttgccccctgatgtccctaacgcccagcctgcccttgagggtcgcactagcttccccgaggacaccgtaataacttataagtgcgaggaatctttcgtcaagatccctggggaaaaggactctgtaatttgcctgaaagggtcacagtggagtgatattgaggaattttgcaaccgctcctgtgaggtgccgacgaggctcaactctgcatcgttgaaacaaccgtatataacacagaactactttccggttggcaccgtcgtggagtatgagtgtcggccaggatataggagggagccttctctgagtcccaagctgacttgtctccagaacttgaaatggtccaccgccgtggagttttgtaagaaaaagagttgtcccaatcccggtgagatcaggaacggacaaatcgatgtgcctgggggtattctgtttggcgcaactatatcattttcttgcaataccggctacaaactgtttggatccacttctagcttctgtcttatttctggctcttcagtccagtggtctgatccgctccccgagtgccgggaaatctactgccctgccccacctcagatagataatggcatcattcagggtgaacgagaccactatggttatagacagtctgtcacctatgcgtgcaacaagggcttcaccatgatcggcgagcattccatatactgcactgtgaacaatgatgaaggtgagtggagcgggccacctccagagtgtcgcggtaaatccctgacctccaaggtacccccaaccgtgcaaaagccaaccacagtcaatgtccccacaacagaagtgtcccccactagccaaaagactacaacgaagactaccacccctaatgcgcaggccacccggtcaacccctgtatcccgaactacgaagcatttccacgaaacgactccaaacaaggggagcggcacaacatcaggtactacaagattgctctccgctctgcaagtcagaccttttgaagtatcgggatcgtctcacatttcttctaagaagatgatgtgcatcttatag

SEQ ID NO: 217579 - DNA, 954 bp, Artificial Sequence
  Description of Artificial Sequence: Synthetic coding sequence
atgacagtggctcggccttcagtgcccgcagcactccccctcctgggagagctcccacgtctgctcctgttagtgctgctgtgcctgccagcggtttggggtgattgcggccttccccctgacgttccgaacgcccagcccgcactagagggtcggaccagtttccccgaagacaccgttataacctataaatgcgaagagtcattcgtaaagatccctggtgagaaagactcagtcatctgtttaaagggctcccagtggtccgatatcgaggaattttgcaatcaaaaaagctgccccaatcccggtgaaatccgcaacggccaaatcgacgtgcccggtggaatcctgttcggtgctacaattagcttttcttgcaataccggatacaagctattcgggtctacatcgtctttttgtctgatcagcgggtctagtgtgcagtggagcgatcccctgcctgagtgtagggagatttactgccctgcccctccacagattgacaatggaattattcagggagagcgcgatcactacggatatcggcagagcgtgacatacgcttgtaacaagggatttacaatgatcggcgagcacagcatttattgtacggtgaataatgatgaaggggaatggtcgggccctccccctgagtgcaggggcaagtccctcactagcaaagtgccacctactgtgcaaaaaccaactactgtgaatgtacccaccactgaggtaagccccacctctcaaaagaccaccacgaagactaccacacctaacgctcaagccacccgcagcacccctgtgtcccgcaccacaaaacacttccatgagacgaccccaaacaagggatcaggaaccacaagcggacagttgacgctctttagcggccacacgtgcttcacgctgaccggacttcttggcacactggttaccatggggctgctcacatag

SEQ ID NO: 217580 - DNA, 753 bp, Artificial Sequence
  Description of Artificial Sequence: Synthetic coding sequence
atggtggccggatctgatgcgggacgagcactgggggtgctgagcgtggtctgtctgttacactgcttcggcttcatttcctgtttttcccagcagatctacggcgtggtctatggcaatgtaacctttcacgtaccttccaatgtcccactgaaggaggtgttgtggaaaaaacagaaggataaggtggccgaattggagaatagtgagttcagagctttttcctcatttaaaaaccgggtctatctggacacagtttcaggatcccttactatctacaatctgacatcatctgacgaagatgaatatgaaatggagagccctaacatcaccgatacgatgaagttctttctctacgttctggagagcctcccttctccaacgcttacatgcgccctgacaaatggctctatcgaggtgcagtgtatgattccagaacactacaacagccacagggggctgattatgtacagctgggactgccccatggagcaatgtaagcggaattctacctcgatttattttaagatggagaatgacctaccacagaaaatccagtgcaccttgagcaatcctctgttcaacaccaccagcagtattatcctaactacctgcattccgagtagcggccatagccggcataggtatgccctcatccccattcccctcgcagtaatcacaacttgtatcgtgctgtacatgaacggtatccttaaatgtgatcggaagccggatcggacgaattccaactag

SEQ ID NO: 217581 - DNA, 747 bp, Artificial Sequence
  Description of Artificial Sequence: Synthetic coding sequence
atggtggccggtagtgacgcgggtagagccctaggcgtgctaagcgttgtctgtcttctgcattgcttcggcttcatcagctgctttagtcagcaaatttacggagtcgtttatggcaacgtaaccttccatgttccatctaacgttccattgaaagaagtgctgtggaaaaagcagaaagacaaggtggccgagctcgaaaattcagaatttagagccttctccagcttcaaaaacagggtgtacctggatactgtttctggatccctgactatctataacctaacctcttctgacgaggacgaatacgaaatggaatctccaaatatcacggataccatgaaatttttcttgtacgtcttggagtccctgccttcccctacattgacctgcgcccttacaaatggtagcattgaggtccaatgtatgattcctgaacattataacagccatcgaggtctaatcatgtattcttgggactgtccaatggagcaatgtaagcggaattcaacttcaatctattttaagatggagaatgaccttcctcagaagatccagtgcacactgagcaacccgttgttcaacactacaagcagcatcattttgacaacctgtattcccagctcaggacattccaggcatcggtacgctttgatccccatcccactcgctgttatcaccacgtgtatagtgttatatatgaacgggattctaaagtgcgataggaaacctgaccgtacgaaatag

SEQ ID NO: 217582 - DNA, 387 bp, Artificial Sequence
  Description of Artificial Sequence: Synthetic coding sequence
atgggtatccagggtggatcagtgcttttcgggctgctgcttgtgttagctgttttctgtcactccggacactctctccagtgctacaattgtcctaatcccacagccgattgtaaaacagccgtcaactgttctagcgatttcgacgcatgcctcataaccaaggccggactccaggtatacaacaagtgttggaagtttgaacattgtaacttcaatgatgtgacaacgcgcctgagagagaacgagctcacctactattgctgtaagaaagatctctgtaacttcaacgagcaattggagaacggaggcacctcattgtcagagaagacagtgctgttactggtgaccccctttctggccgctgcttggagcctgcatccttag

SEQ ID NO: 217583 - DNA, 387 bp, Artificial Sequence
  Description of Artificial Sequence: Synthetic coding sequence
atggggattcagggaggctccgtcttgtttggtctccttctggttctcgccgtgttctgtcactcaggccatagcttacaatgttacaactgcccgaatccgacagctgattgtaaaacagcggtgaattgctccagcgacttcgatgcatgtctgatcaccaaagcgggattacaggtgtacaataagtgttggaagttcgagcactgcaactttaacgatgttacaacgagactgagggagaatgaattaacctactactgctgcaaaaaagatctgtgcaatttcaacgagcaacttgagaacggcggaacctctctatctgagaagacagtgctgttactagtcacccctttcctggccgctgcatggagtctgcacccatag

SEQ ID NO: 217584 - DNA, 387 bp, Artificial Sequence
  Description of Artificial Sequence: Synthetic coding sequence
atgggcatccagggcggatctgtgctgttcgggctgcttcttgtcttggcagttttctgccactctggccattctctacagtgttataactgcccaaaccctaccgcggattgcaaaacggctgttaactgcagttcagactttgatgcctgtcttattaccaaagcaggacttcaggtgtacaataagtgttggaaattcgagcactgcaattttaacgacgtaactacgcggttacgcgaaaacgaactgacttactactgttgtaaaaaagatctttgtaattttaacgaacagctggagaacgggggaacctccctttcagaaaaaacagtcctgctcttagtcacccccttcctggctgccgcatggagccttcacccctag

SEQ ID NO: 217585 - DNA, 387 bp, Artificial Sequence
  Description of Artificial Sequence: Synthetic coding sequence
atgggcattcaaggcggttcagtcctgttcggcctcctcttggtgctggccgttttttgccacagcggtcattcgctccagtgctataattgccccaaccccacagccgattgcaagacagcggttaattgctcctccgactttgacgcatgtctgattactaaagctggtctccaggtctacaacaaatgttggaagttcgaacactgcaactttaacgacgtaactaccaggctacgcgagaatgaactgacatactactgctgcaagaaggatttgtgtaacttcaacgagcagctggaaaacgggggaacctctctgagtgagaagactgttttgctcctggtgacaccgttcttagctgcagcatggagcttacacccatag

SEQ ID NO: 217586 - DNA, 387 bp, Artificial Sequence
  Description of Artificial Sequence: Synthetic coding sequence
atgggcattcagggaggctcagtgctcttcggcctgttgctggtgctggccgtcttttgtcactctggacacagccttcagtgttataactgccccaatcctaccgcggactgtaagaccgccgtgaactgttcctcggactttgacgcgtgtctcataaccaaggccggacttcaagtctacaacaaatgctggaagttcgaacattgtaacttcaacgacgtgactacgcgcctacgagagaatgaactgacttattactgttgcaagaaggatctatgtaactttaatgaacagttagaaaacggcggtacctctctctcagaaaaaaccgtgctgttgttagtaacaccctttctggctgctgcatggtccctgcacccatag

SEQ ID NO: 217587 - DNA, 387 bp, Artificial Sequence
  Description of Artificial Sequence: Synthetic coding sequence
atgggtatccaaggaggctctgtactctttggtcttctcctggtattggctgtattctgccactctgggcactcgctgcaatgctataactgtcccaatcccacagctgattgcaagaccgccgtcaactgttcgtccgattttgacgcctgtctgattaccaaagccggactccaggtgtacaacaaatgctggaaatttgaacactgcaacttcaatgacgtaacaactcgtctacgcgagaacgaactcacttactactgctgtaaaaaagacctctgtaatttcaatgaacagctggaaaatgggggaaccagcctctccgaaaagaccgtgctccttctggttacccccttccttgctgcggcttggtccctccatccgtag

SEQ ID NO: 217588 - DNA, 387 bp, Artificial Sequence
  Description of Artificial Sequence: Synthetic coding sequence
atgggcatccagggcggaagtgttttgtttggactcttactcgttcttgcagttttttgtcatagcggccactccttacaatgctataactgccctaaccctaccgctgattgcaagactgccgtcaactgttcctcagatttcgatgcgtgtctaattaccaaggcgggactgcaggtttacaataaatgctggaagttcgagcattgtaacttcaacgacgtgactacccggctgcgggagaacgagctgacttactactgttgcaagaaggacctttgtaattttaacgaacaactggaaaatggcggtacctctcttagtgagaaaacggtgctgcttctagtgacaccgttcctggctgctgcatggtcccttcatccatag

SEQ ID NO: 217589 - DNA, 387 bp, Artificial Sequence
  Description of Artificial Sequence: Synthetic coding sequence
atggggatccagggaggatccgtgctcttcggcttactcctggtcctggcagtgttttgccactcgggacattcactgcaatgttacaattgcccaaatcccactgctgattgtaaaaccgcagttaattgttcttccgacttcgacgcctgcttgatcacaaaggccggactccaggtctacaataaatgctggaagttcgaacactgcaattttaacgacgtgacaaccaggcttagagagaacgagttgacgtactattgctgtaagaaagatttgtgcaattttaatgaacagctagagaatggcggaactagtctgagcgagaagacagtgctcctgctagtgacccccttcttggcggcagcctggtcccttcatccatag

SEQ ID NO: 217590 - DNA, 387 bp, Artificial Sequence
  Description of Artificial Sequence: Synthetic coding sequence
atgggtattcagggaggaagcgtactattcggtcttctcttagtgcttgctgtgttctgtcactcaggtcacagccttcagtgttacaactgtcccaatcccacagcagactgcaagactgctgtgaattgtagttccgactttgatgcctgtctgattacgaaagccggtttgcaggtatacaataagtgctggaagttcgagcactgcaattttaatgacgtaaccactcgcctgcgtgagaacgagctcacatactattgttgcaaaaaagatctctgcaattttaatgaacagctcgagaacggtggcacgtccctctccgaaaagactgtgctgctgcttgtcaccccctttctggcggctgcctggagtctccatccatag

SEQ ID NO: 217591 - DNA, 2007 bp, Artificial Sequence
  Description of Artificial Sequence: Synthetic coding sequence
atgtggcttttcttcggtattaccgggttgctgactgccgctctctcagggcacccgtcacccgctccacctgaccagctcaatacaagtagcgccgagagcgaattatgggagccaggtgagaggttaccagttagactcacaaacggcagtagctcctgtagtggcacagtggaggttaggctcgaagcctcatgggagcctgcctgcggggcactatgggattcaagagcggctgaagcagtttgtagggccctgggctgtgggggtgcagaggctgccagtcagttggcacctcccactccggaactgccccctcctcctgccgcaggcaacacctcagtcgccgctaatgctacgctggcgggtgccccagccctgctgtgtagtggagctgaatggcgactgtgcgaggtggtggagcacgcttgcaggtctgacggcagacgcgctagggtgacctgtgccgagaatcgagccctgcgactggtagacgggggaggggcatgcgccggaagggttgagatgcttgaacacggcgagtggggctcagtttgtgatgacacatgggaccttgaagacgcacacgtcgtctgtaggcagcttgggtgtggatgggctgtccaggcactgccaggacttcactttacaccaggccgagggccaatccacagagatcaggtaaactgcagcggggctgaagcctacttgtgggattgtccagggctgcctggccaacactattgcgggcacaaagaggacgccggagcagtgtgctctgaacatcagtcctggcggctgacaggcggagcagatcggtgtgaaggacaggtagaggtgcacttcaggggagtatggaataccgtgtgtgactccgagtggtatccatccgaagccaaggtgctatgccagtcacttggctgcggaacagccgtggaacgacctaaaggcctccctcacagcctctcaggcagaatgtattacagctgcaatggagaagaattgaccctgtccaattgcagctggaggtttaacaattctaacctctgttcccagtccctggccgcacgggttctttgctcagcatctcgcagtctccacaacctgagcacgccggaagtgcctgcctccgttcagaccgtaactatcgaatcatccgtgacagtgaagatcgagaacaaggaaagtagagagctgatgttactcattccaagtatcgtccttggcatcttgttactcggaagtctcatctttattgcttttatcctcctgcgaatcaagggaaaatacgcactccccgtaatggtaaaccaccagcacctgccgactactatcccagcgggttccaatagctaccaacccgttcccattaccattccgaaagaggttttcatgctgccgatccaggtccaagcccctcctcctgaagactcggattcaggcagtgatagtgattacgagcattacgacttcagcgcccagccacctgtcgccttgaccacattttacaatagccaaagacacagggtgaccgatgaggaagtgcagcagagtcggttccagatgcccccactggaagagggcctcgaggagctccatgcaagtcatataccaacagctaaccctgggcattgtatcaccgatccaccaagcttgggccctcagtatcaccctcggtcaaacagcgagagtagcactagctctggagaagactattgcaattcacccaagtccaaattgcccccttggaatcctcaggtgttcagcagcgagagaagttccttcctggaacagccacccaatctagaacttgccggaacgcaacctgccttctccgccggaccaccagctgacgactcttctagcaccagctccggtgaatggtatcagaacttccagcctccaccacagccaccaagcgaagagcaattcgggtgtcctggaagccctagccctcagcccgatagtacagacaacgacgattacgatgatatctctgctgcgtag

SEQ ID NO: 217592 - DNA, 1911 bp, Artificial Sequence
  Description of Artificial Sequence: Synthetic coding sequence
atgtggctgtttttcggtataacgggactcttaactgccgcactgtccgggcatccctcccctgcccctcccgatcagctaaacacttcgtctgccgaatcggaactgtgggaaccgggagagaggctgcctgtcaggttaaccaatgggtcttcctcctgttccgggacagtggaagtgcgcctagaagcctcatgggaacctgcatgcggagccttgtgggatagtcgcgcagccgaggccgtatgccgcgctttggggtgcggcggagcagaagccgcttcacagttggcgcctccgactccggaactgccgccaccccctgccgcaggcaatacatcagtggctgctaatgcaaccttagcgggtgcacccgcactgttgtgttctggagccgaatggcgcctctgcgaagttgtcgagcacgcttgtcgctcagacggaagaagggcaagagttacatgcgcagaaaacagggctctgcggcttgtagatggtgggggagcctgtgccggacgggttgaaatgctggagcacggagagtggggcagcgtgtgtgacgatacatgggatctggaggacgcccacgtggtatgccgccagcttggctgcggctgggctgtgcaagccctccccggactccatttcactccaggcagaggcccaatccacagggatcaggtgaactgtagtggtgcagaagcctatctgtgggactgtcccggtctcccgggtcagcattattgcgggcacaaagaggacgccggagcagtgtgctccgagcaccagtcctggagactcaccggcggtgccgaccggtgcgagggccaggtggaagtacactttaggggcgtgtggaacaccgtgtgtgattccgagtggtaccccagtgaagctaaagtcctgtgtcaaagccttggctgcggaacagcggtggaaagaccaaagggtctgcctcattcattatccggtaggatgtactattcatgtaatggggaagaactgaccctgagtaactgctcatggaggttcaataactccaatctgtgctcccagagtttggcagcgagggtcctctgctccgcctctcggtccttacacaatctcagtactccagaagttccggcaagcgtccagacagtcactatcgaatcttcagtgacggtgaagatcgaaaataaagaaagccgggaactgatgctgttaataccgagtatagtcctggggatcctgctgcttgggtccctaatttttatagcgtttatactattgcggatcaagggtaagtatgtgtttatgttaccgattcaggtgcaggccccaccaccagaggatagtgacagcggtagcgactcagattatgaacattacgatttttccgctcaacccccagtagcgttgaccaccttttataactctcaacgccacagagtgacagacgaagaagtgcaacagtcgcgattccaaatgcccccactggaggagggcttagaggagctgcacgcctcccatatccctactgccaaccctgggcattgtataactgatcctccatccctcggaccgcaatatcatcctcggtccaatagcgaaagctcgactagctctggagaggattattgcaattcccccaagtccaagctcccaccttggaatccgcaggtgttcagtagtgagaggagtagcttcctggaacagcccccaaatctcgagctggccggaacacagcctgcattttccgctggcccacccgctgacgactcaagctctacatcgtccggcgaatggtaccagaatttccagccccctccacagcctccaagtgaggaacagtttgggtgcccaggaagcccctctccccagccagacagcactgataatgatgactacgacgatatatccgccgcatag

SEQ ID NO: 217593 - DNA, 1788 bp, Artificial Sequence
  Description of Artificial Sequence: Synthetic coding sequence
atgtggctcttcttcggcattaccggacttcttacagctgctctgtcgggccatccttctcctgcgcctccagatcagcttaatacttcttcagctgagagtgaattatgggaacccggagagaggctgcccgtgcgcctgaccaacggctcatcaagctgcagcgggactgtggaggtccgcctcgaggcgtcttgggagcctgcatgcggggcactgtgggattcacgtgctgccgaggcggtctgccgtgcccttggctgtggcggtgctgaagctgctagtcagctggcccctccaactcccgagctgccccctcctccagccgcaggaaatacctcagtggccgctaacgcaaccttggcaggtgccccagcacttttgtgttctggcgctgaatggagactgtgcgaggtggtggagcacgcctgcagatctgacggccgaagggcacgcgtcacatgcgctgagaacagggctctgagactggtcgatgggggtggcgcatgtgctgggcgtgtagaaatgctggagcacggggagtgggggtctgtttgcgacgatacttgggacctggaggatgcccatgtcgtgtgtcggcaattgggatgcggatgggctgtgcaggcactgcccggattacacttcactcccggtagggggccaatacaccgcgatcaggttaattgctccggagctgaggcatacttgtgggattgccccggactgccaggacagcattattgcggccacaaggaagatgctggcgcagtctgcagcgaacatcagtcgtggcgactcaccggcggtgctgacagatgcgagggacaagtcgaagtgcacttcagaggggtgtggaacacggtgtgtgattccgaatggtatccttccgaggccaaggttctctgtcagtctctgggttgcggaaccgccgtggagcgccctaagggcctgccccactctctctctggtcgcatgtattactcttgtaacggcgaagaacttactctgtccaactgtagctggcggtttaacaattcgaatttatgcagccagtcactggccgcaagggttttgtgcagcgcgagccgctcactccacaatctgtcaacgcctgaagtgcccgcatctgtccagacagtcactatcgagtccagcgtgacagtgaaaattgagaataaggagagccgagagctcatgcttctaattccatctattgtcctcggtatcctccttctcggctcactaatttttatcgcattcatcttactccgtattaaggggaagtacgatagccaacgtcacagggtgactgatgaggaagtccagcagagcaggttccaaatgcctcctcttgaagagggcttggaggagctgcacgcaagccacatcccgaccgctaacccaggccattgcatcaccgatcccccttccctcggcccacagtatcacccccgatccaactctgagtcttccaccagtagcggggaggactactgtaacagtcccaaaagtaagctccctccctggaatccccaggttttttcctctgaaagatcgagctttttggaacagccaccaaatctggagttggcaggaacccagccagccttctccgcaggtccaccagcagacgattccagctctacttccagtggggaatggtatcaaaacttccaacccccaccacagcccccttcagaggagcagtttggctgccctggttctcctagccctcagcctgactctaccgataatgacgactacgacgacattagtgccgcatag

SEQ ID NO: 217594 - DNA, 1806 bp, Artificial Sequence
  Description of Artificial Sequence: Synthetic coding sequence
atgtggcttttcttcggtatcactggacttctgaccgcagcactgtcgggtcatcccagtcctgctccacctgaccagctgaatacttcctccgcggaatccgagttgtgggagcctggagaacgtctgcccgtcagactcacgaacggttcatccagctgtagcggcaccgtcgaggtgcgcctcgaggcttcctgggaacccgcatgcggagcactgtgggactccagagccgcagaggccgtctgtcgggctctgggatgtggaggggcagaggcggcaagccaactagcgcctccaacccccgaactccctccgcctccagctgcagggaatacatcagtcgctgctaatgccaccctcgcaggggctcctgccctgctctgcagcggggcagaatggcgactgtgcgaggtggtggagcacgcctgtaggtctgacggccgtagggccagggtaacctgcgccgagaatagggcactgcgattggtggacggcggtggcgcatgcgctggcagagtcgagatgctggagcatggcgagtggggtagtgtgtgtgacgatacatgggacttggaagatgcgcacgtggtatgcaggcagctggggtgcgggtgggcggttcaagcactaccaggccttcacttcaccccaggccgaggccctatacatcgggatcaagtgaactgtagcggtgctgaagcatatctctgggactgtccaggcctgcctgggcaacactactgcggacataaagaagatgctggtgctgtgtgcagtgagcaccagtcatggcgactgaccggaggcgcagatcgctgcgagggacaagtggaagtgcacttccgcggagtgtggaatactgtgtgtgattccgagtggtacccaagcgaggcgaaggtcctgtgccaaagtctggggtgtggcacagcagtggaacgaccgaagggtcttccgcactctcttagcggacggatgtattatagttgcaacggcgaggagctcacactcagcaattgtagttggagattcaataattctaacctgtgtagtcagagtttagctgctagggtcctgtgttcagctagtcgttccttacataacttgtcaacgcccgaagtgccagcctcagtccagactgtcacaatcgagtctagtgtgaccgtaaaaattgagaataaagagagccgagagctgatgttgttgataccaagcattgtgcttgggatccttcttctgggtagcctgatttttatcgcttttatcttgctcaggattaagggcaaatatgtgtttatgctgcctatccaggtgcaggccccacctccggaagattctgatagcggcagtgattccgactatgagcactacgacttcagtgctcagccgccagtggcactgacgacattttataattcccaacggcacagagtgaccgatgaggaggtgcagcagagccgattccaaatgccacctttggaagagggcctggaagaactccacgccagccatattcctaccgcgaatcctggtcactgtatcaccgatccgccttcactgggtcctcagtaccaccctcggtccaattcagagagtagcactagcagtggcgaagattactgtaattctcccaaatccaagctacccccatggaatccacaagtgttttcatccgaacgaagcagcttcctggagcagccaccaaacctggagctggcgggtacacagcctgccttttctgggtcaccgtcaccacagccagactccacggacaatgacgactacgacgacatcagcgcagcatag

SEQ ID NO: 217595 - DNA, 1779 bp, Artificial Sequence
  Description of Artificial Sequence: Synthetic coding sequence
atgtggctatttttcggtattactggtttactcactgcggcactgtctgggcaccccagccccgcaccacctgaccaactcaatacatcttcggccgagtctgaattatgggaacccggagagaggctcccggtgcggttgaccaacggtagctcaagttgctccggcaccgtagaggtaaggctggaggcgtcatgggagcccgcttgtggagcgttgtgggattcgagggctgccgaggccgtgtgcagggctctgggttgtggcggtgctgaggccgcttcacagcttgctccgccaactccagagctgccacctcctccagccgctggtaacaccagcgtcgccgctaatgcgacgcttgctggtgccccagcactcctctgtagcggcgctgaatggcggctgtgcgaggttgttgagcatgcttgcagatctgatggacgcagagctcgagtcacatgtgccgaaaatcgggcattacgattagtggacggcggtggagcgtgtgccggacgagtcgagatgctggaacacggggagtgggggagcgtgtgcgacgatacatgggacctggaagacgcccacgtcgtatgtaggcagctgggctgcggctgggcagtgcaagctcttccaggactacattttacaccagggcgagggccaattcatcgcgaccaggtgaattgtagcggagccgaggcatatctgtgggactgtccgggactcccaggtcaacattactgcggtcataaggaagatgcaggcgctgtgtgctccgaacaccagagctggcggctgaccggcggagctgaccggtgcgaaggacaggtggaggttcactttcggggagtgtggaataccgtttgcgactctgaatggtaccccagcgaggcgaaggtattgtgccaaagtcttggctgcggaacggcagtggagcggcctaagggactgcctcattctctgagtgggaggatgtactactcttgtaacggagaggaactgaccctgtccaactgtagctggcgcttcaacaatagtaatctctgcagtcagagtttggctgcccgagtgttgtgctccgcatcaaggtcattacataacctgagcaccccggaggtgcctgcatctgtacagacggtcactattgagtccagcgttaccgtcaagatcgagaacaaggagagccgggagctgatgctgctaatcccgtccatagtcctgggtatcctcctgctcgggagcttaatcttcatcgcattcattctacttcgaataaagggaaaatatgccctgccggtgatggtcaaccatcagcatctgcctacaaccatccctgctggctccaacagctaccagccagtaccaattactattcctaaagaagatagccagaggcaccgtgtcacggacgaggaagttcagcaatcgaggtttcaaatgcccccactagaggagggcctagaggagttgcacgcctctcacattcctaccgccaaccctgggcattgtattacagaccccccatccctagggccacaataccaccctcgatctaactctgagtcttcaacgtcaagtggcgaagactactgtaattccccaaagtcgaagttgccaccctggaacccccaggtgttttcctccgagcgctctagttttctcgagcagcctcctaaccttgagctggccggaacacagccagccttttccggcagccccagtccccagcctgactctaccgataatgacgactatgacgatatcagcgcagcatag

SEQ ID NO: 217596 - DNA, 717 bp, Artificial Sequence
  Description of Artificial Sequence: Synthetic coding sequence
atggctgtggaaggaggtatgaagtgcgtcaaatttctcttgtacgtgctgctcctcgctttctgcgcgtgtgccgtcggactgatcgcagttggggtgggtgcacaactggtcctgagtcagaccattatccagggtgctaccccgggtagcctgcttcctgtcgtgatcatagccgtcggagtgtttttatttctagtagcgttcgtggggtgttgcggcgcttgcaaagagaactactgcctgatgatcacattcgctatctttctctctctgatcatgctcgtagaagttgccgcagctattgcagggtatgttttcagggacaaagtgatgtccgaatttaacaacaactttaggcagcagatggagaactatcctaaaaacaaccacacagcctctatcctagaccgaatgcaagcggacttcaagtgctgtggggctgcaaattacacagattgggaaaaaatccctagcatgagtaaaaacagggtcccagactcctgttgcatcaatgttacagtggggtgtgggatcaactttaacgaaaaggccatccataaggaaggatgcgtcgagaaaatcggcggatggttgcggaagaacgtcctggtggtcgccgctgccgcactcgggatagcctttgttgaagtcctgggcattgtttttgcttgttgtctcgtgaagtctattaggagtgggtatgaagtgatgtag

SEQ ID NO: 217597 - DNA, 711 bp, Artificial Sequence
  Description of Artificial Sequence: Synthetic coding sequence
atggccgtggaagggggaatgaaatgcgtcaaattcctgctgtatgtgctcttgctggccttttgcgcatgcgctgttgggctgatcgccgtgggggtgggagcccaactggtactttcccaaacgatcatccagggtgctacccctggtagtctcctccccgtcgtgatcatcgccgtcggcgtgtttctctttctagtagcgttcgtgggatgttgtggtgcttgcaaagagaactattgtctgatgataacttttgctatctttctcagcttgatcatgctcgtcgaggttgcggcagctattgcaggctacgtgtttcgcgacaaggtcatgtcagagtttaataataattttaggcagcagatggagaactaccccaaaaacaatcatacggccagtattctggaccgcatgcaggccgatttcaagtgctgtggagcggcaaactacactgattgggaaaagatcccatcaatgtcaaagaaccgggtgcccgatagctgctgcataaatgtaacggtgggctgcggaatcaattttaacgaaaaggcaatccataaggaggggtgtgtggagaaaatcggcggatggctgcggaaaaacgtcttggtagtggccgctgccgctctggggatcgcattcgtgttaggaatcgtattcgcctgctgcctggtgaaaagtattcggagcggctatgaggtaatgtag

SEQ ID NO: 217598 - DNA, 402 bp, Artificial Sequence
  Description of Artificial Sequence: Synthetic coding sequence
atggccgtagaaggtggaatgaaatgcgtaaagttcctgctgtatgtgcttctcctggccttttgcgcatgcgccgttgggctcatagcggtaggagtgggggcacaactggtgttatcgcagacaatcattcagggtgccacgccaggttcactgctacctgtggtgatcatcgcggttggtgtctttttattcctcgtggcattcgtcgggtgctgcggggcttgcaaggagaactactgtcttatgattacattcgccattttcctgtccctgattatgttggttgaagtcgcagccgctatcgcgggatatgtgttcagagacaaagtgatgagtgagtttaacaataatttccgccaacagatggagaattaccctaagaataatcatacagcttag

SEQ ID NO: 217599 - DNA, 717 bp, Artificial Sequence
  Description of Artificial Sequence: Synthetic coding sequence
atggctgttgaaggaggaatgaaatgcgtcaagttcttgctgtatgtgctcctcttagccttttgcgcatgcgcggtcggactaatcgccgtgggtgttggcgctcagctcgtgctctcccaaaccattatccagggtgctactccaggaagcctgctccctgttgtcattattgccgtgggcgttttcctgtttcttgtagctttcgtgggatgctgcggtgcctgtaaggagaactattgcctaatgattaccttcgcaattttcctgagcctcataatgttggtggaggtggccgcagctatagcgggatacgtgtttagagacaaagtgatgagtgagtttaacaataactttaggcagcagatggagaattatcccaaaaataatcacacggccagtattttggacaggatgcaagccgactttaaatgttgcggggcagccaactacacggactgggaaaaaatccccagtatgtctaaaaaccgcgttcctgacagttgttgtattaacgtcaccgtcggttgcgggatcaacttcaacgaaaaagccatccataaagaggggtgtgtggaaaagattggtggctggctgcggaaaaacgtcctcgtcgtagctgcggctgcacttggcattgcttttgtggaggtgctcgggatagtcttcgcctgctgtctggtcaagtctatcagatccggctacgaagtgatgtag

SEQ ID NO: 217600 - DNA, 648 bp, Artificial Sequence
  Description of Artificial Sequence: Synthetic coding sequence
atggcagtggagggaggaatgaagtgcgttaagttcctgctttatgtgctcctcctggccttctgcgcctgtgccgtcggtctgatcgccgtgggagtaggggctcagctcgtgctgtcccagactatcattcaaggtgctacaccagggtctctcttgcctgtggtcataatagccgtaggcgtgtttctgttcttggtagcatttgttggttgctgtggtgcctgtaaggagaattactgccttatgataactttcgccatatttctgtccttaattatgctcgttgaggtagcagctgccatcgccggttacgtctttagggataaggtgatgagtgaatttaataataatttccggcagcagatggaaaactaccctaaaaataatcatacagccagcatactggacaggatgcaggccgacttcaaatgttgtggcgcagctaactataccgattgggagaagatcccctcaatgagcaagaacagggtgcccgatagctgctgcataaacgtcaccgtgggttgcggcattaactttaacgagaaggccatccataaagaaggttgtgtcgagaagatcggtggatggttgcggaagaatgtactcgttgtcgcagccgctgcactgggcatcgctttctag

SEQ ID NO: 217601 - DNA, 654 bp, Artificial Sequence
  Description of Artificial Sequence: Synthetic coding sequence
atggcggtggagggaggcatgaagtgcgtcaaattcctcctgtacgttttgttactcgcgttctgtgcctgtgcagtgggcctcatcgccgtgggcgtcggagcacagcttgtgttaagtcagactattattcaaggcgcaacacccggtagtctgcttcctgtcgtcattatcgcagtcggagtcttcctgttcctcgtcgcttttgtcggctgttgtggcgcatgtaaagagaattactgtctgatgattacctttgctattttcctgtccctgatcatgctcgtggaggtggcggctgcaattgcagggtacgttttccgtgacaaggttatgtctgaatttaataacaactttaggcagcagatggagaattaccccaaaaacaatcacacggcttctattttggaccgtatgcaggcagatttcaaatgctgtggcgctgcgaactacaccgactgggagaaaatcccgagcatgtctaagaaccgagttcccgatagctgttgcatcaacgtgactgtgggttgtgggataaatttcaatgagaaggctattcacaaggaaggatgcgtggaaaaaatcgggggatggctgcgcaaaaatgtgctggtcgttgccgctgctgcactcggcatcgctttcgtcgaatag

SEQ ID NO: 217602 - DNA, 717 bp, Artificial Sequence
  Description of Artificial Sequence: Synthetic coding sequence
atggccgttgaggggggaatgaagtgcgtcaagttcttactctacgttttgctgctggcgttctgcgcatgcgctgtcggtctaatcgcagtgggagtgggcgctcagcttgttctttctcaaacaataatacaaggagctacacctggttcactgctgccagtggtgataatcgccgtgggggtgtttctgttcttagtggcttttgttgggtgttgcggtgcttgtaaagaaaactactgccttatgatcacgtttgctattttcctgagtctgatcatgctggtggaggtggcagcagccatcgcaggctacgtattccgtgataaggtgatgagcgaattcaacaataactttcgacagcagatggaaaactacccaaaaaacaatcataccgcctctattctggatcggatgcaggccgactttaagtgctgcggtgctgccaattataccgattgggagaagatcccatccatgagtaagaacagggtgccagactcttgctgtataaatgtcactgtgggatgcggtatcaattttaacgaaaaggcgatccataaagaggggtgcgtggaaaagattgggggatggctgcgcaagaacgtgcttgtggtggctgctgcagccctgggaatcgcattcgtggaggtgctcggcatagtgttcgcttgctgcctcgtcaagagcatacggagcggttatgaagtgatgtag

SEQ ID NO: 217603 - DNA, 648 bp, Artificial Sequence
  Description of Artificial Sequence: Synthetic coding sequence
atggccgtcgagggaggcatgaaatgtgtcaaatttctactgtatgtcttactcctcgccttctgtggggctactcctggcagtctcctgccagttgtaataatcgccgtgggggtcttcctgttcttggtggctttcgtaggttgttgcggcgcatgtaaagagaactattgtttaatgataacattcgcaatatttctttctctaatcatgttggtggaagtggctgctgccatagccggatacgtcttcagggacaaggtcatgtcagagttcaacaataacttcaggcagcagatggaaaattaccccaaaaacaaccacacagcatccatccttgatcggatgcaggccgatttcaagtgctgcggcgcagccaattataccgactgggaaaagatcccctccatgagcaaaaatcgagtgcctgactcctgttgcatcaacgtaactgttgggtgcggcatcaactttaatgagaaggctatccacaaagaaggatgcgtggagaagatcggaggttggctgcggaaaaatgtcctcgtggtcgcagccgctgctttgggaattgctttcgtggaagttctcggcattgtgttcgcatgctgcctcgtcaagagcatccggtcaggatacgaagtgatgtag

SEQ ID NO: 217604 - DNA, 471 bp, Artificial Sequence
  Description of Artificial Sequence: Synthetic coding sequence
atgatcactttcgcaatctttctaagcctgattatgctggtcgaagtcgctgcagccatcgccggttacgtcttcagagacaaagtgatgtcagagttcaataacaattttcgtcaacagatggagaattatccaaagaacaatcacacggctagcatcctcgatcgtatgcaggcagactttaagtgctgcggagcagcgaactataccgattgggaaaagattccctctatgtctaaaaacagggtgccggactcctgttgcattaatgtgaccgtcggatgtggtattaacttcaatgagaaagcgatccataaagaagggtgcgtggaaaagatcggcggatggttacgaaaaaacgtgttggtggtggccgcagctgctctcggcatcgcatttgtggaagtgctgggcatcgtgtttgcctgctgtttggtcaaaagtataaggtccggatacgaagtaatgtag

SEQ ID NO: 217605 - DNA, 471 bp, Artificial Sequence
  Description of Artificial Sequence: Synthetic coding sequence
atgatcactttcgccatttttttgagtctgatcatgctcgttgaagttgcagcggcaattgctggctacgtcttccgggataaggttatgtcggagtttaataataatttccgacagcaaatggaaaactaccccaagaacaaccacacagctagcattttagatcgcatgcaggctgactttaagtgctgcggtgccgctaattacactgactgggagaaaatcccatcgatgtcaaaaaaccgggtgccagatagctgctgtataaacgtaacagtgggatgtggaatcaactttaatgagaaggcaatccacaaagagggctgcgttgaaaaaattgggggttggctgagaaagaatgtgctggtcgtagctgctgccgctctgggcatcgcctttgtggaggtgctgggcatcgtgttcgcatgttgtctggtaaaatccattcgctccggctatgaggtaatgtag

SEQ ID NO: 217606 - DNA, 1065 bp, Artificial Sequence
  Description of Artificial Sequence: Synthetic coding sequence
atgcggctggccgtcctgttttcaggcgctcttctcgggctgctggctgcacagggaacgggaaatgattgtccccacaagaagtcggctacgttactgccaagtttcacagtgactcccacagtgacagagagtacaggaacaactagccataggaccacaaaatcacataagacaactacacatagaactacaactacgggcacgacctcacatggtcccaccaccgccacccacaatcctacaaccacatctcatggaaacgtgaccgtgcatcccacgagtaactccactgcaaccagtcaaggcccttccactgccactcactcacccgctacgacctcacacggcaatgcaacggtccacccaacatccaatagcacagctacttcacccggattcacatcttctgcccaccctgagccaccccctccatctccttcccccagccccacatctaaggaaacaataggggactacacttggacgaatgggagtcagccatgtgtccatctgcaggctcagatacaaataagagtgatgtataccactcaggggggaggcgaagcatggggcatctcagtgctgaatccaaacaagactaaagtgcaaggaagctgcgagggagcccacccacacctgcttttgagcttcccgtacggacacctcagctttggctttatgcaggatctgcagcaaaaagttgtttacttatcttacatggcagtcgagtataatgtgtccttccctcacgccgcacagtggactttcagtgctcagaacgcatctctgcgagacctccaggccccactcggacaatcattctcttgttccaactcctcgatcatcctttccccagccgtgcatttggatctgctgagcctacgcctgcaagccgctcagttaccccacaccggggtgtttgggcagagcttctcctgtccgagcgaccggtctatcctccttcccctgatcattggactgatactcttgggcttgctggctctagtgcttatcgcattttgtatcattaggcgcagaccatctgcctaccaggctctgtag

SEQ ID NO: 217607 - DNA, 894 bp, Artificial Sequence
  Description of Artificial Sequence: Synthetic coding sequence
atgagactcgccgtgcttttttctggcgctctccttgggcttctagccgagtctaccggcacgactagccatcgtaccactaagtctcataaaaccaccactcacaggactactacaaccggcacgacaagccacggacctacgaccgcgacccacaatccgaccacaacatcccacggcaatgccactgtgcaccccacaagcaattctacagcaacctcaccgggtttcaccagctcagcacaccctgagccccctcctccctcccccagcccctcccctaccagcaaggagacaattggcgattatacatggacgaacggcagccagccttgtgtccatttgcaagcacagattcagattagagtcatgtacactacccaaggtggtggcgaagcatggggcatcagcgtgctcaatccaaacaagacaaaggtacaaggtagttgtgagggggctcacccacatctcttactctctttcccttacggacacctcagttttgggtttatgcaagatctgcagcagaaagtggtctatctgagctacatggcagtcgaatataacgtgtcatttccccatgctgcccagtggaccttcagtgcccagaatgcatcgctcagggacctgcaggcgcctttaggacagtcgttctcttgcagcaactcctccattattttatcccctgccgtccatctagatctcctgagtttacggttacaggctgcccagctgccacatacaggcgtgttcggtcagtcctttagttgccccagcgaccgatctatccttctccccctgataattggcctcatccttctggggctgctcgccctggtgctgattgcgttttgtattatcagaagacgtccctccgcttaccaagcactctag

SEQ ID NO: 217608 - DNA, 3018 bp, Artificial Sequence
  Description of Artificial Sequence: Synthetic coding sequence
atgatgagcgacgcctccgatatgttggcggcagcactggagcaaatggacggcataattgcaggctctaaagccctggagtattcgaacgggattttcgattgccagtctccaacttcacccttcatgggcagccttcgcgcactgcatttagtcgaggacctgcgagggttacttgagatgatggagacggatgagaaggaagggctgaggtgtcagatacccgattccacggctgaaacactggtagagtggcttcagtcccagatgacaaatggtcatctgcccggtaatggtgacgtttaccaggaaaggcttgccagactcgagaacgataaggagagcttggtcctgcaagtgtccgtgttgacggatcaagtcgaggcccagggggaaaaaattcgggacctagagttctgccttgaagaacatcgcgagaaagtaaatgcgaccgaggaaatgctgcaacaggagctgctgtctcggacctcgctggaaacccagaagcttgatctcatggctgagatcagtaatctgaaactcaagttgactgccgtagaaaaggacaggttggactacgaggacaagttccgagacaccgaggggcttatacaagagatcaatgacctgcgcttgaaggtgagtgaaatggattccgagcgccttcagtatgaaaaaaagcttaagtctactaaggatgagctggccagcttgaaagagcagctggaggagaaggagtccgaagtgaaacgtctgcaggaaaagctcgtgtgcaagatgaagggagaaggagttgagattgtcgacagagacgagaactttaaaaagaagctgaaggagaagaacattgaagtccagaagatgaaaaaagctgtcgagtcattaatggccgcaaacgaggaaaaagatcgaaaaattgaagacctgcggcagtgcctcaataggtacaaaaagatgcaggatacggtggtgctggcccaaggcaagaaggggaaagatggagaatatgaagaactgctgaatagcagttcaattagctccctgctggatgcccagggtttctccgacctggaaaaaagcccatccccaacccctgtaatgggttccccgtcgtgtgatcccttcaacacatcagtgccggaagagtttcatacaacaattctccaagtgtcaataccatctctactgccagcaacagtgtccatggagacatccgagaaaagtaaactgactccaaagcctgagacaagctttgaggagaatgacggcaacattattctgggcgctacagttgacacacagctatgtgataaactgcttaccagtagcctgcagaagtcaagctcactcggtaatctaaagaaggaaacctcggatggcgagaaagagaccattcaaaaaacaagcgaggacagagccccagctgaatcaaggccatttgggacgcttccgccacggcctcccggacaggatacaagcatggacgataaccctttcggcacaagaaaggtcagatcttcatttggaagggggttctttaaaattaaatctaacaagcgcacggcctccgcacctaacctggatcgaaagaggagcgctagcgccccaaccttagctgaaaccgaaaaggagaccgctgaacacctcgacctagccggagcttcaagtcggccaaaagatagccagcggaattctccatttcagatcccacctccctcccccgacagtaagaaaaaatctcgtgggatcatgaaattatttggtaagctccggaggtcccagagcaccacatttaaccccgatgatatgtcggaaccagagttcaagcggggaggtacaagagccaccgcagggcctagattaggctggagcagagatttggggcagagcaatagcgacttggacatgcctttcgcgaagtggactaaggagcaggtgtgtaactggctgatggagcagggcttaggtagctacttgaactccgggaagcactggattgccagtgggcagacgttactgcaggccagccagcaggatctggaaaaggagttaggaatcaaacattctctgcaccgaaaaaagctccagttggccctacaagctttaggcagtgaggaagagactaaccatggcaagttagacttcaattgggtgacgagatggcttgacgacattggactgccacagtacaagacccagttcgatgaagggcgagtggacggtagaatgctccattacatgaccgtggacgatctgttgtctctgaaggtcgtgagtgtgttgcatcacttatctattaagcgggcaattcaggtattgcggatcaacaattttgaaccaaattgcctccggagaaggcccagcgacgagaatacaattgccccatccgaggtacagaagtggacgaatcatagagtcatggaatggctccgcagcgtggacttagcagagtacgcacctaacttgcggggtagtggagtgcatggagggttgatggtactggaacctagatttaatgtcgagacaatggcccagctgttgaacataccgccaaataagacactcctcaggcgccacttagctacccatttcaacctgctaattggcgctgaggcccaacaccagaaaagggatgccatggaactccccgattatgtgctgttaaccgccacagcaaaagtcaagccaaagaagctggctttctctaatttcggtaaccttaggaaaaaaaagcaggaggacggagaagaatatgtatgcccaatggagctgggacaggcctctgggtctgcttcgaagaagggatttaaacctggcttggacatgcggctgtacgaggaggacgatctggaccgcttggagcagatggaggactccgagggtactgtccgacagataggtgcttttagtgaggggattaataatctgacccacatgcttaaagaggacgatatgtttaaggacttcgcagccagaagtccaagcgcttcaattaccgacgaagatagcaatgtatag

SEQ ID NO: 217609 - DNA, 495 bp, Artificial Sequence
  Description of Artificial Sequence: Synthetic coding sequence
atgagctccgaaaactgttttgtggcagaaaactccagcttacatcctgaatcaggccaggagaacgacgcgacgtcgccgcacttctcaactcgacacgagggcagcttccaagttccagttctctgcgcagtgatgaatgtggtgttcataacgatactgattatagccctgattgcactcagcgtggggcagtataactgccccggtcaatacacattctcaatgccttccgactctcacgtctcctcatgcagtgaagactgggtaggataccagcgtaagtgctatttcataagtacggtgaagcggtcctggacctctgcccagaacgcctgtagtgagcacggtgccactctggccgtgatagatagcgagaaggacatgaatttcctaaagcggtacgccggaagagaggagcactgggtggggctgaagaaagagcctggccatccttggaagtggtcaaatggaaaggagttcaataactggtag

SEQ ID NO: 217610 - DNA, 723 bp, Artificial Sequence
  Description of Artificial Sequence: Synthetic coding sequence
atggccggaccaccccgtttgttactgctgccattactgctcgccctcgcgagagggctccctggagctttagcagcccaggaggtgcaacagtcaccccactgcaccactgtcccagttggggctagcgtgaatatcacgtgctccacctccggcggactgagggggatttatctgagacaactgggacctcagccccaggatataatatattatgaagatggagtggttcccactacggacaggaggtttcgaggacggattgatttctccggcagccaggacaatctcaccattacaatgcatcggctgcagttgtccgatacagggacctacacctgccaggcaatcacagaagtgaatgtctacggtagtgggactctggtcttagtgactgaggaacagtcccagggttggcaccggtgcagcgatgctccacctcgcgcttctgctctcccagccccacctactggtagcgccctgcccgaccctcaaactgcttctgctcttccagatccaccagccgcttctgctctgcctgccgcacttgccgtaatctccttcctgttaggacttggactgggcgtcgcttgtgtgctggctagaactcagattaagaaactttgctcctggagggacaagaactccgctgcgtgcgtggtctacgaggacatgagccactcaagatgtaatacgctgtcttctccaaaccagtaccagtag

SEQ ID NO: 217611 - DNA, 1080 bp, Artificial Sequence
  Description of Artificial Sequence: Synthetic coding sequence
atggccgaggccattacctacgcagaccttaggtttgtgaaggccccactcaagaagagtatctcatctagacttggacaggatccaggggctgatgacgacggggagattacatatgaaaacgtccaggtaccggctgtgctcggcgttccttcctccctggcaagcagcgtcttgggagacaaagccgctgttaagtctgaacaacccacggcttcttggcgcgctgtcacctctcccgctgttggaaggatactaccttgccggactacctgcctcaggtacctgctgttgggcctgctgcttacctgcctgctgctgggcgttactgcaatctgtcttggcgtgcggtaccttcaggttagtcaacagctgcagcaaaccaatcgcgttttggaggtgactaacagcagcctgagacaacagctaaggcttaagattacccaattgggacagtctgccgaggatctgcagggctcaaggcgagagcttgcacaaagccaagaggccctgcaggtggagcagagagcccaccaagctgctgaagggcaactgcaggcttgtcaggcggatcgccaaaaaacaaaagagacgttgcagagtgaggaacagcaaagaagggccctggagcaaaaactgtcgaacatggaaaaccggctgaagccctttttcacctgtggctccgctgatacctgttgtcctagtggctggataatgcatcagaagtcctgcttctatatttccctgactagtaaaaactggcaggaatcgcagaagcagtgcgagacgctgtcgtcgaagttggccaccttcagcgaaatttatccccaaagccactcttactacttcttgaatagtttactgccaaatggcggatcgggaaattcatactggactggactttctagtaacaaagattggaaacttaccgatgacacccagaggacccgcacctacgcacagagcagcaagtgcaacaaagtgcacaagacgtggtcctggtggacactagagtctgagagctgccgctcttctttaccatatatttgtgaaatgactgccttccgatttccagactag

SEQ ID NO: 217612 - DNA, 363 bp, Artificial Sequence
  Description of Artificial Sequence: Synthetic coding sequence
atggcggaggccattacttacgccgacctccggtttgtgaaggccccactgaaaaagtccataagtagcaggttgggccaagacccaggcgcagacgacgacggtgagataacttacgagaacgtccaagtgcccgcagttttgggggtgccttcttcacttgcaagtagtgtgctcggagacaaagccgctgtgaagagcgaacaacctaccgcctcatggagagccgtgacgagtcccgcagtgggccgaatacttccttgcgagtgcgcctgcgcgggacaaccgaggggacaggtgctggccccagtacccgcagctgatggagctggtccacgaggtgtccagctactccccggttag

SEQ ID NO: 217613 - DNA, 360 bp, Artificial Sequence
  Description of Artificial Sequence: Synthetic coding sequence
atggctgaggctatcacctatgcggacctgcgcttcgtgaaggccccactgaaaaagagtatttccagtcgccttggccaggacccaggcgcagatgacgatggagagattacttatgaaaatgtccaagtcccggctgtcctcggcgtcccatcatctcttgccagttccgtcttaggtgacaaggcagccgttaagagcgagcagcccacggcctcatggagggccgtaacgagcccagctgtgggacgaatacttccatgcagaaccacatgcctccggtaccttttactggggttactcctaacttgccttctcctgggtgtgactgcgatatgtcttggcgtcagatgcgagtag

SEQ ID NO: 217614 - DNA, 1080 bp, Artificial Sequence
  Description of Artificial Sequence: Synthetic coding sequence
atggccgaggctatcacctacgcagatctccgctttgtcaaggcacccctgaagaagtctatcagcagcaggctgggacaggaccccggtgcagacgatgatggggagatcacgtacgagaacgtgcaagtgccagctgtgctaggcgtcccttctagtttagcatcttctgtgcttggggacaaggccgcagtgaagagtgagcagcccacggcatcctggcgggcagtaaccagccctgcggttgggcgtatcctgccgtgccgcaccacatgtctccgctatctcctgctggggctgttgttgacgtgtctcctcttaggggttaccgctatctgtttgggtgtccgctacctccaggtgtcacagcagctgcagcagacaaacagggtgctggaggtgacaaattccagcctgaggcagcagctgcgccttaagatcacacagcttggacagagtgccgaggacctccagggaagtagaagagaactcgctcagtcccaggaggctctgcaggttgagcagcgcgctcatcaagctgcagagggccagctgcaggcttgtcaggcagatagacagaagacgaaagaaacccttcagagtgaggagcagcaacggcgagcactggagcaaaagctttcgaatatggagaaccgattgaaaccattcttcacatgtggctcggcagatacgtgttgtccgagtgggtggatcatgcatcaaaaatcctgtttctacattagtttgacatcaaagaattggcaggaatctcagaagcagtgtgagactttgtctagcaaactggccactttcagcgagatttatccacaatcacactcatattattttctaaattcgttgctccctaatggtggctccgggaactcttactggacaggcctgagttcaaataaggactggaagctgactgacgatacacaaagaacgagaacttacgcccagagcagcaaatgcaataaagtccacaagacatggtcttggtggaccctcgaatcagagagctgccgctcttctctcccttacatttgcgagatgacagcttttaggttccctgactag

SEQ ID NO: 217615 - DNA, 1080 bp, Artificial Sequence
  Description of Artificial Sequence: Synthetic coding sequence
atgcagacccgcaacccacagagccacggagagaacggcgctagtccatggtcctggggtgacaggctcgggccaggtcctgatccgggagcagacgatgacggtgaaataacctacgagaatgttcaggtgcccgcagtactcggtgttccctcatccctggccagcagtgtgctgggagacaaagcagcagtgaagagtgaacagcccactgcctcctggagagcggttacttctcctgcagtcggtcgaattctgccctgtaggacgacatgccttcgctatctgctcttgggactcctccttacttgcctattactgggcgttacagcaatctgcctcggtgtgaggtatctccaggtatcacagcaacttcagcagaccaaccgggttctggaagtgaccaactcctcattaaggcagcagctgaggttgaagatcacccagctgggccaatccgccgaggacctccaaggtagccgcagagagttggcgcaaagtcaagaggccctgcaggtcgaacaacgggctcatcaggcggcagaagggcaactacaagcttgtcaagcggatcgacagaaaacgaaagagactctccagtctgaggaacagcagagacgggctctggagcagaaactctcaaacatggaaaaccgacttaagccattcttcacttgtggatcagccgacacctgttgccccagtggatggatcatgcaccagaaatcatgcttttacatttcgcttacatccaagaattggcaggagagccagaaacagtgcgagacactgtccagcaagcttgccaccttctccgagatctatcctcagtcgcatagttattatttccttaattctctcttgcccaacggtggctcaggcaactcttactggactggactctcctccaacaaagactggaaactcactgacgatacccagcgtacaagaacctatgcgcagtcgtcaaaatgtaacaaagtccacaagacctggtcatggtggacattagaatcggaatcttgtcgcagctccctgccgtacatttgcgaaatgacagccttcaggtttcctgactag

SEQ ID NO: 217616 - DNA, 891 bp, Artificial Sequence
  Description of Artificial Sequence: Synthetic coding sequence
atgcaccgtcgtcgatctcgcagttgccgggaggaccagaagcccgttatggacgatcagagggatcttatttctaacaacgagcagctacccatgctcggcagaaggcctggggctccggagtccaagtgcagtcgtggcgctctgtacaccggcttcagtatactagtgactctgctactggcaggccaagctacaactgcatattttctgtaccagcagcagggacgccttgataagctgacagtcaccagccagaatctgcagctcgagaacctgaggatgaagctgcccaagccccctaagcctgtttccaagatgcgaatggccacgcctctgttaatgcaggcacttcctatgggggctctgcctcaaggcccaatgcagaatgccaccaagtacggaaatatgacagaggatcatgtgatgcacctcttgcaaaatgctgacccattaaaagtgtacccgcctctgaaagggagcttccccgagaatctccggcatctcaaaaacaccatggagacgatcgactggaaggtcttcgaaagctggatgcatcactggctgctgtttgagatgagccgacactcactggagcagaagcccacagacgccccaccaaaggttttgaccaagtgccaggaggaggtgagtcacatacccgctgttcatcctggctccttcagaccaaagtgtgacgagaacggcaactatctcccactccagtgttacggcagcatcgggtactgttggtgtgtgtttccaaatggtaccgaagttcccaatactcgcagtagggggcaccacaattgctctgaatccctggaactcgaagacccttcaagcggactgggcgtgacaaaacaggacctcggaccagtccccatgtag

SEQ ID NO: 217617 - DNA, 699 bp, Artificial Sequence
  Description of Artificial Sequence: Synthetic coding sequence
atgcatagaaggcggtcgcgaagctgcagagaggatcaaaaaccagtgatggatgaccagagggatctcatatctaacaatgagcagctccctatgctgggccgtaggcccggagcccctgaatcaaagtgttctcggggagccctgtatacaggcttctcaattctcgtgaccctgttgctggctggccaggctaccacagcttactttctctatcagcaacaaggcagactcgacaagctgacagtgacgagccagaacctgcagctggaaaatttacgtatgaaactgccaaagccgcctaagcccgtctccaaaatgcggatggcgaccccactgttaatgcaagcactgcccatgggggcactgccgcaaggaccaatgcagaacgcaacaaaatacgggaatatgacagaagatcacgtgatgcatctgcttcaaaatgctgatcccctgaaggtttacccccctctcaaagggtcttttcccgagaatcttcggcatctgaaaaacaccatggagaccattgactggaaggtcttcgaaagctggatgcatcactggctgttgtttgagatgagtcggcattcccttgaacagaaacccactgacgccccacctaaagagtcgctggagttggaggatcctagcagtggcctgggcgtcaccaagcaggacctaggcccagtacccatgtag

SEQ ID NO: 217618 - DNA, 483 bp, Artificial Sequence
  Description of Artificial Sequence: Synthetic coding sequence
atgcatcggagaaggagcaggtcgtgtagggaagatcagaagcctgtaatggacgaccagagggacctcatctcaaataatgaacagctgcctatgctgggtcgcagacccggtgcgccagaatcgaagtgctcacgaggcgctctgtataccgggttctccatacttgttaccctcttactagctggccaagcaaccacagcctatttcctttatcagcagcaggggcgactcgacaagctcaccgtgacgtcacagaatcttcagctagaaaacctgcggatgaaactcccaaagccacctaaaccggtttccaaaatgcggatggccacacctttgcttatgcaggcattgcccatgggagccctgccacagggccctatgcagaatgctactaagtacggaaacatgacggaagatcacgtgatgcacctccttcaatctcattggaattggcggacccgtctcttgggctgggtgtag

SEQ ID NO: 217619 - DNA, 951 bp, Artificial Sequence
  Description of Artificial Sequence: Synthetic coding sequence
tgacggtcctgccgcgaagatcagaaacccgttatggatgaccagcgagatttgatctcaaataatgaacagctaccaatgctgggtcgccgtcccggagcacctgagtcaaagtgttcccgtggcgcactgtacacaggattctccatcctggttaccctgcttttggccggacaggccacaaccgcttacttcctataccagcagcaggggagactggacaaactgaccgtgacatcccagaatctccaattggagaatttgcggatgaagcttccgaagccaccaaaacctgtatccaaaatgagaatggctactcctttgctgatgcaagctctgcccatgggtgccctgccacagggacccatgcagaatgcgaccaagtatggaaatatgaccgaggaccacgtcatgcacctcctgcagaatgctgatccgctgaaggtgtatccacccctgaaggggtctttccccgagaatcttaggcacttgaagaataccatggagaccatcgattggaaagtgttcgagtcatggatgcaccactggttgctgtttgagatgtcaagacattctctggaacaaaaaccgacggacgcccctcccaaggtgctaaccaaatgccaagaagaggtgagccacatcccagccgtacacccaggcagcttccggccaaagtgtgacgagaacggtaactatctgccgcttcagtgctacggttctattggttattgttggtgcgtctttcctaatggtaccgaagttccaaacacccgcagtcgcggtcatcacaattgcagcgagagcctggaattggaagaccccagtagcggtctaggcgtaaccaagcaagatctggggccaggtaaagggcttgctgagggtcatctggtgacctctagttcctctccggcaggacctgccccactttgggccggagaaggcgtgtag

SEQ ID NO: 217620 - DNA, 369 bp, Artificial Sequence
  Description of Artificial Sequence: Synthetic coding sequence
atgcacagaaggcgatcacgctcttgtcgggaggaccagaagcctgtgatggacgaccagcgtgatttgatcagcaataacgagcagcttccgatgctcggtagaagacctggcgctcccgagagtaaatgctcgcgaggcgcattatataccggctttagtattttggtgactctgcttctcgccggacaagcgaccactgcctattttttgtaccagcaacaggggagactcgataagttgacagtaacctcgcaaaacctccaactagaaaacctgcgaatgaagctgcccaaacctcatgctgagtgccatcaggtgtggcagcacgacagagggccatgcgatgccccagcacccgaatgctag

SEQ ID NO: 217621 - DNA, 459 bp, Artificial Sequence
  Description of Artificial Sequence: Synthetic coding sequence
atgcatcggagaagatcccggtcttgccgggaggaccagaaaccggtgatggacgaccagagggacctgatctccaacaacgaacaattgcctatgctcgggcgtcgacctggtgcccctgaatctaagtgttcccgcggagccctctacaccggcttcagtatcctggtcactctcctgctggccggtcaagccacaaccgcctatttcctgtaccagcaacaaggtcgccttgacaaattgaccgtaacatcccaaaacctacagctggagaatctgagaatgaaactccccaagcctccaaagccggtatccaagatgagaatggcaacccctttactgatgcaggccttacccatgggagccctgccacagggccctatgcagaatgccacaaaatacggtaacatgactgaggatcatgtgatgcacctattacaggaggttgctaaaagctag

SEQ ID NO: 217622 - DNA, 690 bp, Artificial Sequence
  Description of Artificial Sequence: Synthetic coding sequence
atggcgcgtctcgcattatcacctgtgccctcacactggatggtggcgcttttgctgttactgagcgccgaacccgttcccgcagcgcgatcggaagatcggtaccgcaacccgaaagggagcgcatgctccagaatatggcaatcaccccgtttcatcgctcgtaagaggggattcacagtcaagatgcactgctacatgaatagcgccagtggcaacgtgtcctggctttggaagcaggagatggacgagaatccccaacaactaaagcttgaaaaaggtcgtatggaggaaagccaaaatgagtccctcgccaccctcacaattcagggtattagattcgaggacaatggcatctacttttgccagcagaagtgtaataacacaagtgaagtatatcaaggatgtggcacagagttaagggtgatgggcttcagcactttggcgcagctgaaacaacgcaacacgctgaaagacggtatcatcatgatccagactttgctgatcattctgtttatcatcgtgccgatcttcctgctgctagacaaggacgactccaaagcgggaatggaagaggatcacacctacgagggactggacatcgatcagacagccacctatgaagacatcgtgacactccggacaggagaggtcaaatggtccgttggagagcaccctggtcaggaatag

SEQ ID NO: 217623 - DNA, 378 bp, Artificial Sequence
  Description of Artificial Sequence: Synthetic coding sequence
atggcaagactcgcactctctccggtgccctcccactggatggtggccttgctccttctcctcagtgctgagcccgtgcccgctgccagaagcgaggacaggtataggaaccccaaaggctttagcacgctcgcgcaactgaagcagaggaacacactaaaggatgggatcattatgattcagacccttttaatcatcctctttatcatcgtgccgatatttctgctactggacaaggacgattccaaggccggaatggaagaggaccacacctacgaaggtcttgacatcgaccagactgccacttacgaagacatcgttactctgcgaactggagaggttaagtggtcagtgggggagcacccaggccaggagtag

SEQ ID NO: 217624 - DNA, 693 bp, Artificial Sequence
  Description of Artificial Sequence: Synthetic coding sequence
atggctcgattagccctgtcccccgtgcccagccactggatggtcgcgctgttactcctactgtccgccgcagaacctgtacccgcagctcgctcagaagatagatatcgcaacccaaaaggctctgcttgctctaggatttggcaaagtccccgtttcatcgcaagaaaacgcggattcacagtcaagatgcattgctatatgaattccgctagcggcaacgtcagctggctgtggaagcaggaaatggacgagaacccccagcagttgaagttggaaaaagggagaatggaggagtctcagaacgagtctctagccacactgactatacagggcatccggtttgaagataacggaatatatttttgtcagcaaaagtgcaacaacacaagtgaagtctatcagggatgcggcaccgaactcagggtgatgggtttttccacattagcacagcttaagcagagaaacaccttgaaagatggcataattatgatccagaccttgctgattatcctgttcattatcgtcccgattttcctgttgttagataaggacgacagcaaggctggtatggaagaggaccatacgtacgagggcctggatattgatcagaccgccacctatgaggacattgtgacactgcggaccggagaagtgaaatggagcgtaggcgaacaccccggacaggaatag

SEQ ID NO: 217625 - DNA, 711 bp, Artificial Sequence
  Description of Artificial Sequence: Synthetic coding sequence
atgggggtggaggggtgtactaagtgcatcaagtatctcttgttcgtctttaacttcgtcttctggctggccggaggggtgatcctgggcgttgccctttggctcaggcacgatccccagaccacaaaccttctttatctagagctgggcgacaaaccagcccctaacacgttctacgtgggcatatatatcctgatcgctgttggcgctgtgatgatgtttgtgggctttttagggtgctacggcgctatccaggaaagccaatgcttactcggcactttctttacatgtctggtcatcttgttcgcgtgtgaagtagccgcaggaatctgggggttcgtcaataaggaccagattgcaaaagacgtcaagcagttctacgaccaggccctacagcaggctgtagtcgatgacgatgcaaataacgccaaagccgtggtgaagacgtttcacgaaactctcgattgctgcggttcttctacacttacagccctaacaacatctgtcctgaagaacaacctgtgccctagcggatcgaatatcatcagtaacctgtttaaggaagactgtcatcagaagatcgatgatctgttcagcgggaagctgtatctaatagggatcgccgcaatcgtggtggctgtgattatgatctttgagatgattcttagtatggtgttgtgctgtggcatccgaaattcatcagtatactag

SEQ ID NO: 217626 - DNA, 618 bp, Artificial Sequence
  Description of Artificial Sequence: Synthetic coding sequence
atgtctagaggcctacaactccttctgctttcatgcgcgtacagcctggccccagctaccccagaggtgaaagtcgcttgtagtgaggatgttgacttgccttgcacggccccttgggacccccaagtgccctacacagtctcatgggtaaaactccttgagggcggagaagaacgtatggagacccctcaggaagaccatctgagaggacaacactaccatcagaagggtcagaacggctcatttgacgctccaaatgaacggccatatagcctgaagattagaaacactacctcttgtaacagtggcacctacaggtgcactctacaagacccagatggccagcggaatctaagcggcaaggtgatcctgagggtcaccggatgccctgctcaacggaaggaagaaaccttcaagaagtatcgggctgaaatcgtcctgcttctagcccttgtaattttctatctaactctaattatatttacctgtaaatttgcccgtttgcaatcaatattccctgattttagcaaagccggaatggaacgagccttcctgcccgtgacctcgcctaataagcatctggggctcgttacgcctcacaagaccgaattggtgtag

SEQ ID NO: 217627 - DNA, 351 bp, Artificial Sequence
  Description of Artificial Sequence: Synthetic coding sequence
atggatccgcaatgcacaatgggcctgagtaatatcctgttcgtcatggcctttctactgtcagagctggaggatcctcagcctccacccgatcacattccctggataacagcagttctgcccaccgttattatttgcgtaatggtgttttgtttaattctgtggaaatggaagaaaaaaaaacggcctcgcaacagttacaaatgcggtaccaacaccatggagcgggaggaatccgaacagacaaaaaagagagaaaagattcacatccccgagcggtctgacgaggcccagagggtttttaagtcatctaaaactagttcctgcgataaatccgatacgtgcttttag

SEQ ID NO: 217628 - DNA, 990 bp, Artificial Sequence
  Description of Artificial Sequence: Synthetic coding sequence
atggatccccaatgtacaatgggtctgagcaacattttattcgtgatggcatttcttctgtccggcgcagcacccctcaaaattcaggcctacttcaatgaaacagccgacctgccgtgccagtttgccaattctcaaaaccagtcactcagtgaacttgtggtcttttggcaggatcaggagaatctagtgcttaacgaggtgtatctcggaaaggaaaagtttgactctgttcacagtaagtacatgggtcggacatccttcgatagcgacagttggacgctacgcttgcacaacctccaaataaaagacaaagggttgtaccagtgcattatacaccataagaaacctaccggtatgatcagaattcaccagatgaactccgagctatcagtcctggctaatttttcacagcccgaaatcgtacctatttccaacatcacagaaaatgtatacatcaatctgacatgttccagtatacacgggtaccccgaacctaaaaagatgtcagtcctgttaagaactaaaaactctactattgagtatgacggcgtgatgcagaaaagccaggacaacgtgacagaactgtatgacgtctccatttctctgtcggtgagctttcctgacgtcacaagtaacatgaccatattttgtatcctcgagactgataaaacccggcttctgtccagccctttcagtatcgaactcgaagacccccagccaccaccggaccacataccatggattactgctgtcctgccaaccgtgatcatttgcgtaatggttttctgtctgattctctggaagtggaagaagaaaaagagaccacggaactcatacaagtgtgggacaaataccatggagcgtgaagagagtgagcagaccaagaaacgcgagaagattcatataccggagcgcagcgatgaggcacagcgcgttttcaagtcaagcaagacctcttcctgcgataaaagtgacacatgcttctag

SEQ ID NO: 217629 - DNA, 972 bp, Artificial Sequence
  Description of Artificial Sequence: Synthetic coding sequence
atgggactttcaaatattctgttcgtgatggcctttttgctctcaggtgcagccccactcaaaattcaggcctacttcaacgagactgcggacctgccttgccagtttgccaacagtcagaaccaaagcttaagcgaattggtggttttttggcaggaccaggagaatcttgtattaaacgaggtgtacctcggtaaggaaaaatttgatagcgtccacagcaaatatatgggcaggactagcttcgactccgatagttggacactgaggctacataatctgcagatcaaggacaagggattgtaccaatgtatcatccaccacaaaaagcctaccggaatgattaggatccatcagatgaactcggagttatctgtgctagctaatttctcacagcccgagatagttccaatctctaacattacggagaatgtttacattaatctgacgtgctccagcattcatggataccccgagcctaaaaagatgtccgtattactccgcacaaaaaattctaccattgaatacgacggtgtcatgcaaaaatctcaggataatgttaccgaactgtacgatgtgagtatatctctgtcagtgagtttcccggacgtgacaagcaatatgacgatcttctgcatcctggagactgataagactcggctcttgagcagcccattttccatcgagctggaagatccccagccccctccagatcatattccctggataaccgctgtgttacctaccgttattatctgtgtcatggtgttctgtctgattctgtggaaatggaaaaagaaaaagcgcccaagaaattcatataagtgcggcactaataccatggaacgcgaggagagcgaacaaaccaagaagcgtgaaaagatacatatccccgagcggtccgacgaagctcaaagagtctttaaatccagcaaaaccagctcttgtgataaaagcgacacatgcttctag

SEQ ID NO: 217630 - DNA, 504 bp, Artificial Sequence
  Description of Artificial Sequence: Synthetic coding sequence
atgggcctatccaacatcttattcgtgatggccttcttgctgagcggggctgcccctttgaagatccaggcgtatttcaacgaaaccgccgatctcccttgccagttcgctaatagccagaatcagtctctgtctgaactcgttgtgttctggcaggatcaagaaaacctagtattgaacgaggtatacttaggcaaagagaaatttgactctgtgcacagcaagtacatggggagaacctcttttgactccgatagctggacccttcggctgcataatctccagatcaaggataaggggctgtatcagtgcattatccaccacaaaaagcccaccggtatgattcggattcaccagatgaactctgaactgtccgttttagcaaacttctctcagcccgagatcgtgcccatcagcaacattacagagaacgtctacatcaaccttacatgcagctccattcacggttaccctgagcccaaaaagatgagtgtgctgctttag

SEQ ID NO: 217631 - DNA, 744 bp, Artificial Sequence
  Description of Artificial Sequence: Synthetic coding sequence
atgggccgaacaagttttgacagcgacagctggacgctgagattgcacaatctccagattaaagacaaggggctctaccagtgtatcattcaccacaagaagccgacgggcatgattcgcatccatcagatgaattccgaactatcagttctggctaacttcagccagccagagattgtgccgatttctaacatcacggaaaacgtgtatatcaaccttacctgcagttccatccatggttatcccgaaccaaagaagatgagtgtgcttctgaggacaaaaaactctacaattgagtatgatggcgtaatgcagaagtcacaggacaacgtcacggaactctacgacgtctcaatctcactatctgtgagcttcccagatgttacatcgaacatgacgattttctgcattctcgagactgacaagacaagactattaagctcccccttttccatcgaactagaggacccgcagccacccccagaccacatcccgtggatcaccgccgtcctccccacagtaatcatttgtgtgatggtcttttgtttaattctgtggaagtggaagaaaaaaaagcgccctagaaatagctacaaatgtggaacaaacacaatggagagggaagagtccgaacagacaaaaaagagagaaaagattcacatcccggagaggtctgatgaggctcagcgcgtgttcaagagtagtaaaacaagctcatgcgacaagtctgatacctgcttctag

SEQ ID NO: 217632 - DNA, 654 bp, Artificial Sequence
  Description of Artificial Sequence: Synthetic coding sequence
atggacccgcagtgcaccatgggcctcagtaatattctgtttgtgatggcatttcttctgtccgccaacttcagtcagcccgagattgtcccaatctccaatattactgagaacgtgtatattaatctgacctgttcatctatacacggatacccagagcccaaaaagatgtctgtgcttttacgtacaaaaaactcaacgattgagtacgacggcgttatgcagaagagtcaagacaacgtgaccgaactttacgacgtctccatctccctctccgtgtctttccctgatgtgacaagtaacatgaccatattttgtatcctcgagacagacaaaacccggctcctcagctctcccttctctatcgagctggaggatccccagcctccccctgaccacattccatggattacggccgtactgcccactgttataatttgcgtcatggttttctgtctgattctctggaaatggaaaaaaaagaaacgtcctcgcaactcttacaagtgcgggacaaataccatggagagggaagaaagtgaacagactaagaagcgcgaaaagatccatattccggaacggtcggacgaggcacagagagtgtttaagtccagcaaaacctcctcttgtgacaagagcgatacatgcttctag

SEQ ID NO: 217633 - DNA, 732 bp, Artificial Sequence
  Description of Artificial Sequence: Synthetic coding sequence
atgcggccaagactctggctgctgctggccgctcagctaactgtgctgcacgggaattccgtcctgcagcagacaccagcatatatcaaggtgcagaccaacaaaatggttatgctgagttgcgaagccaaaatttcgctaagcaatatgaggatctactggttgagacagcgacaggccccatcgagtgactcgcaccacgagtttctggccctgtgggattccgccaagggtacgattcacggcgaggaagttgaacaggagaagatagccgtgttccgtgatgcctcccgttttattcttaacctcacctctgtgaagccagaggacagtggtatatacttttgcatgatcgttgggtccccagaacttactttcgggaagggtactcaactgagcgtggtggacttcctgccaactacagctcagcccaccaagaaatcaactcttaaaaagagagtttgtagactgccgcgtccagagactcagaaggggccactgtgtagcccaatcacactaggtcttctggttgctggggtgctcgtgctgcttgtcagtttgggagtggccattcacctctgctgtcgccgacgtcgcgctaggctgcggttcatgaaacagccacaaggggaaggtataagtggtacgtttgtgccccagtgtctgcatggttattactcaaacactaccacctcccaaaaactgctcaatccatggattcttaagacctag

SEQ ID NO: 217634 - DNA, 642 bp, Artificial Sequence
  Description of Artificial Sequence: Synthetic coding sequence
atgaggccaaggctctggctgctgctggcggctcagctgaccgttctgcacggcaattcagtcctgcagcagacccccgcatatatcaaggtccagactaataaaatggtgatgctctcctgtgaagcaaagatctccctctcgaacatgcggatatattggctgagacaacgccaagcaccctcctccgacagccaccacgaatttctagccttgtgggatagtgcaaaaggcaccatccacggcgaggaagtggaacaagaaaaaattgctgtgtttagagatgctagtaggttcatcctgaatctgactagcgtaaaacctgaagactctggcatctacttctgcatgatcgtaggctcaccagagctgacctttggcaaaggcacccagctgagcgtcgtggatttcctccctactacagcacaacccactaagaagagcacccttaaaaagcgtgtctgtcggctgccccgacccgagacccagaagggacgaagacgtcgcgcaaggctgaggttcatgaagcagccccagggtgaagggatttccgggacttttgttccacagtgcctgcacggctactatagcaacacaacaacgtcccagaaactgctgaacccttggatcctcaaaacctag

SEQ ID NO: 217635 - DNA, 633 bp, Artificial Sequence
  Description of Artificial Sequence: Synthetic coding sequence
atgaggccccgattatggttgcttctggccgcacaactcaccgttcttcatggaaactcagtcctgcaacagaccccagcctacatcaaagtgcaaacaaataaaatggttatgctgtcatgcgaggccaagattagcctcagtaatatgcgaatttactggctgagacagcgccaggccccatcaagtgactcccaccatgaatttctcgcactgtgggacagcgcgaaaggtacaatccatggtgaggaagtcgaacaggagaagatcgctgtcttccgcgacgcctcccggtttattttgaatctgacttctgttaagccagaagattcaggaatttacttttgtatgatcgtcggttcacccgaattgacgtttggcaagggcacccagcttagtgttgtagacttcctgcctactaccgcccagccaacaaaaaagtctaccttgaaaaagagggtgtgcaggttgcccaggcccgaaactcagaaaggaccgttgtgtagtccaattacactcggcctgttggtggccggtgtcctggtgctgctggtttcccttggggtggctattcacttgtgttgtagaagacggagggccaggcttaggttcatgaagcaattctacaagtag

SEQ ID NO: 217636 - DNA, 666 bp, Artificial Sequence
  Description of Artificial Sequence: Synthetic coding sequence
atgcggcctaggctctggctactgcttgccgctcaactgacggtactacacggcaactccgtactccagcagacacccgcttatatcaaagttcagaccaacaaaatggttatgctaagttgtgaagctaagatctctctgtctaatatgcggatatactggctccggcagcggcaggcgcctagttcagattctcatcatgaattcttggctctctgggacagcgccaaaggtacaatccacggcgaggaagtcgaacaggaaaagatcgcggtgtttcgggacgcgagccggttcatccttaatctgacttccgtgaaaccagaggatagcggcatttacttctgcatgatcgtggggtcacctgagctgacattcggaaaaggcacgcagctgagcgttgtcgatttcctccccacgaccgcgcagcccactaaaaaaagcaccctgaaaaagcgggtctgtcgactgcccaggcccgaaacacaaaagggaccgctctgcagcccaatcaccctcggtctgttagtggcaggggtcctggtattactcgtgtcattaggggttgccattcacttgtgctgccgcaggcggcgtgctagactccggttcatgaagcaacttaggttacatcccctggaaaaatgttctagaatggactattag

SEQ ID NO: 217637 - DNA, 597 bp, Artificial Sequence
  Description of Artificial Sequence: Synthetic coding sequence
atgcggcctagactctggcttttgttggccgcacaactgaccgtactgcatggcaattccgtgctccagcagacgccagcctacatcaaggtccaaactaataagatggtgatgttgagttgtgaggctaagatcagcctctcaaatatgcgcatctattggctgaggcaacggcaggcgccatcttctgactcccaccacgagtttcttgccctttgggatagtgctaaggggacaatccatggggaggaagtggaacaagagaaaatcgccgtgttccgtgatgccagccggtttattttgaacttaactagcgtcaaacctgaagactccggtatctatttttgcatgatcgtcggatctcctgagcttactttcgggaagggcacgcagctgagcgtggtcgattttctgccaacgaccgctcagccaactaagaagagcacacttaagaagagggtgtgcagacttccacgaccagagacccagaagggcctcaagggcaaggtgtatcaagaacccttatcacccaacgcctgtatggacacaaccgccatactgcagcctcacaggagctgcctaacccacggaagctag

SEQ ID NO: 217638 - DNA, 93 bp, Artificial Sequence
  Description of Artificial Sequence: Synthetic coding sequence
atgcggcctaggctctggttgctgctggccgctcagctgacaggcagaagacgccgagcgaggttacgattcatgaagcagctgtacaaatag

SEQ ID NO: 217639 - DNA, 624 bp, Artificial Sequence
  Description of Artificial Sequence: Synthetic coding sequence
atgcggccaaggctttggctgctgctggcggcacagctcaccgtgctgcacggaaattccgttctacagcaaactcccgcttatatcaaggttcagaccaacaaaatggtcatgctttcctgcgaggccaagatctctttaagcaacatgagaatttattggctgcgacagagacaggcccctagctccgattcacatcacgagttcctcgctctgtgggacagcgccaagggaactattcatggtgaagaggtggaacaggagaagattgctgtgttcagggacgcttctcgtttcatacttaatctgactagcgtgaagcccgaagacagcgggatttatttctgtatgattgtgggaagccccgagctgacttttgggaaaggaactcagttaagcgtcgtggactttctccccaccaccgcccagcccactaagaagtccactttgaaaaagagggtttgcaggctaccacggccagaaacacagaaggggcctctatgcagcccaattacgttgggcctgttggttgcgggagtcctggtcttgttggtgtctctgggagtcgccattcatctgtgctgtcgacgcaggcgagccagattgaggtttatgaaacagtag

SEQ ID NO: 217640 - DNA, 153 bp, Artificial Sequence
  Description of Artificial Sequence: Synthetic coding sequence
gagcgcggaagggagagaagagtcaagttgcgcttctcagctcggcctcagggagaaggaatcagcggaaccttcgttccacagtgtctacacgggtactactccaatactacaacatctcaaaagctgctaaacccctggatcctcaaatag

SEQ ID NO: 217641 - DNA, 687 bp, Artificial Sequence
  Description of Artificial Sequence: Synthetic coding sequence
atgcccgtgaagggcggaaccaaatgcattaagtacctgctcttcggatttaatttcattttttggttagccggtattgcggtcctggcaataggactctggttgagatttgattcccagacgaagtccatctttgagcaggaaaccaataataacaacagtagcttctacaccggtgtgtacattctcatcggagccggagccctgatgatgctggtgggcttcctgggttgctgcggcgcagtacaggaatcacaatgcatgctgggtctattcttcggttttctcctggtaatcttcgctatcgaaattgccgcagcaatttggggttacagccataaggacgaggtgataaaagaagtccaggagttttataaggacacttacaacaagctaaagacaaaagacgaaccacagagagaaacactgaaagccattcattatgccctgaattgctgcggacttgctgggggagtcgagcagtttatcagtgatatatgcccgaagaaggatgtactggaaacatttaccgtaaaaagctgtccagacgcaatcaaagaagtcttcgacaacaagttccatatcatcggcgcagtcggaattggaatcgcagttgtgatgatctttggcatgatcttctccatgatactttgctgtgcgattcgaagaaatagggaaatggtgtag

SEQ ID NO: 217642 - DNA, 480 bp, Artificial Sequence
  Description of Artificial Sequence: Synthetic coding sequence
atgatgctcgtaggcttcctgggctgctgcggagcagtgcaggagagccaatgtatgcttgggttgtttttcggcttccttctggtaatcttcgctattgaaattgctgcagccatctggggctacagccataaggacgaggtcattaaagaagtccaggagttctataaggatacatataataaattgaagacgaaagacgaacctcagcgcgaaacgttgaaggctattcactacgcactgaactgttgtggcctagctggcggtgtggagcagttcattagcgacatttgtccaaagaaagacgtgctggaaaccttcaccgtgaaatcctgtcccgacgcaatcaaagaagtcttcgacaacaagttccacattattggtgccgttggcattgggatagcggtggtgatgatatttggcatgatttttagtatgatcctgtgctgcgccatcagaaggaacagggaaatggtgtag

SEQ ID NO: 217643 - DNA, 687 bp, Artificial Sequence
  Description of Artificial Sequence: Synthetic coding sequence
atgcctgtgaagggtggtacaaagtgtatcaaatacttgctcttcggttttaacttcatcttttggttagctggcatcgcagtcttagccattggcctgtggcttcggttcgactctcaaactaagagtattttcgaacaagagactaacaataacaactctagtttttatactggtgtgtacatcctgattggagcgggagccctgatgatgctcgtggggttcctagggtgctgtggcgctgtgcaagagagccagtgcatgcttggcctcttcttcggatttttactcgttatcttcgccattgaaattgctgcagctatttggggctatagccataaggatgaggtgatcaaggaagtgcaggaattctacaaagacacatacaataaactgaaaaccaaagatgagccgcagagggagactttaaaggcaattcattatgccttaaattgctgcggcttagctggcggtgtggagcagtttatctcagatatctgcccgaagaaagatgttttagaaacgttcacggtcaagagttgtcccgacgccattaaagaagtgtttgacaacaagttccacatcatcggtgcagtgggcatcggaattgctgtagtgatgatctttggcatgattttcagcatgatcctttgctgcgcgattcgtcgtaaccgggagatggtgtag

SEQ ID NO: 217644 - DNA, 687 bp, Artificial Sequence
  Description of Artificial Sequence: Synthetic coding sequence
atgccagtgaaaggcggtaccaagtgcatcaagtacctgctatttggctttaacttcatcttttggcttgctggaattgccgtcctcgccattgggctgtggctgcggtttgattcacaaaccaagagcatcttcgagcaggagacgaataacaataacagttctttttacaccggcgtctatatactaataggggctggagctctgatgatgcttgtaggctttctgggatgctgcggcgctgtccaggaatcacagtgcatgctgggactcgcaaccaaacggacgatgttcccccctttcctagaggaccatgtgtgttttttctcactgaacccccagtttttcggattcctcctggtcattttcgcaattgaaatagccgctgctatctggggctattcacacaaagacgaggtaattaaggaagtgcaggaattctataaagacacttacaataagctcaagaccaaagatgagccccaaagggaaacgctgaaggccattcactatgccttaaactgttgtggactcgccggaggcgtagaacagttcatctcagacatatgtccgaaaaaggatgtactcgagaccttcacagtgaagtcttgcccagatgccattaaagaagtcttcgacaacaaattccatatcatcggagctgtggggatcggcatcgcagtttag

SEQ ID NO: 217645 - DNA, 546 bp, Artificial Sequence
  Description of Artificial Sequence: Synthetic coding sequence
atgcctgtaaagggtggaacaaaatgcattaaatatctgctcttcggctttaacttcattttctggctggccggaatcgcggtgctcgcaatcgggctttggttacggttcgattcgcagaccaaaagtatctttgaacaagaaactaacaataacaactcctcattttacaccggcgtgtacattctaatcggtgccggtgcccttatgatgttggtcggatttcttggatgctgtggggcagtgcaggaaagccagtgtatgctaggactcttctttggctttctcttagtgatattcgccatagaaatcgcggctgcaatttggggctacagccataaagatgaggtgatcaaagaggtccaggagttttataaggatacctataataagctgaaaactaaggacgagccccagagggagaccctcaaagccattcactacgcgctcaatctgtggttcggctgggggcgtggcaccgtgtatttgagacacttaccccaggagggcagaaccaggaatctacatagggaggtcctgagttag

SEQ ID NO: 217646 - DNA, 426 bp, Artificial Sequence
  Description of Artificial Sequence: Synthetic coding sequence
atgctggggttgttctttggattcctgcttgtgatctttgcaattgagattgccgcagccatctgggggtacagtcacaaagacgaagtcattaaggaggtgcaggaattctacaaggacacgtacaataagttaaagaccaaagacgagccgcagagggagaccctgaaggcaatccactacgccctaaactgctgcggccttgcgggtggggtagagcagttcatctcagatatttgcccaaaaaaggacgtactggagacgttcaccgtcaaatcctgcccagacgctataaaggaagtctttgacaataagttccacatcatcggcgctgtcggaattggcatcgcagtcgttatgattttcggtatgatttttagcatgatcctgtgttgcgcaattaggagaaatagagaaatggtctag

SEQ ID NO: 217647 - DNA, 1758 bp, Artificial Sequence
  Description of Artificial Sequence: Synthetic coding sequence
atggaaaaaaagtggaagtactgtgcagtgtactatataatccagattcactttgtcaaaggagtgtgggaaaagacagtgaatacagaggaaaatgtttatgctaccctggggagcgatgttaacctgacatgtcagacccagaccgtcggcttcttcgtgcagatgcagtggtctaaggtcacaaacaaaattgacttgatcgcggtgtaccacccacaatacggtttctactgtgcctacggacgtccttgtgagagcctggtgacatttaccgagacacctgaaaacgggtccaaatggaccttgcaccttaggaatatgagctgttcagtgagcgggcgatatgagtgcatgctcgtgctataccctgagggaattcagacaaagatctacaacctgctcattcagacacacgtaaccgccgatgaatggaactccaaccacaccatcgaaatcgaaatcaaccagacgctggaaattccctgttttcagaactccagcagcaaaatttcaagtgagtttacatacgcctggtccgtcgaaaactcatccaccgattcctgggtgctgctcagcaaaggaataaaggaggataacggcacacaggaaaccctcatctcgcaaaaccatctgatcagtaactcaacccttttaaaggatagggtcaagttgggtaccgattaccgcctacacctgtcccccgtgcagatattcgacgatgggcgaaaattttcatgccacattagagtcggccctaacaagatccttcgttcaagcacaaccgtgaaagtctttgccaagccggaaattccagttatagtggaaaacaattcaaccgatgtgcttgtcgaaagacggtttacatgcctactgaagaacgtgtttcctaaagccaatataacttggttcattgatggaagctttctgcacgacgaaaaggaaggcatctatatcaccaatgaggagcgcaagggcaaagacggatttctggagttaaagagcgttctcacgcgtgtgcatagcaataaacccgcacagtcagacaatctgacaatctggtgtatggcattatcacccgtacccggtaataaggtgtggaatatcagctctgagaaaattacatttttgctgggctcggaaattagtagtaccgaccccccactctctgtgaccgaatcgaccctggatactcagccgagtcctgcctctagcgtgagccctgcccgttacccagctacatcatccgtaactctggtggatgtgagtgcactgcgtccaaatacaactcctcagcccagcaatagcagcatgactactcgtggctttaattacccatggacatcctctggtacagacaccaagaagtccgtctcaaggatcccttctgagacctattcttctagcccatccggtgccggatctacgttacacgacaacgtgtttaccagtacggctcgagccttttccgaagtccccacgactgccaatgggtccacaaagaccaatcacgtccacatcactggcatcgtagttaataagccaaaggacgggatgtcctggcctgttatagtcgcagcccttctgttctgttgcatgattctatttggccttggtgtgagaaaatggtgtcagtatcagaaggagatcatggaacgccctccaccctttaagccccctccaccacctatcaaatatacgtgcatccaagaacccaacgaaagtgatctcccttaccacgagatggagacgctgtag

SEQ ID NO: 217648 - DNA, 1710 bp, Artificial Sequence
  Description of Artificial Sequence: Synthetic coding sequence
atggagaagaaatggaagtattgcgccgtctactacattatccaaatccactttgtaaagggagtgtgggagaaaactgttaataccgaggagaacgtgtacgctacactcgggagtgacgtcaatctgacctgccagacccagaccgtggggttctttgttcagatgcaatggtcgaaggtgacaaacaaaatcgacctgatcgctgtgtatcacccccaatacggattttactgcgcctatggacgaccctgcgagtcgcttgttaccttcaccgaaacccctgagaatggatcaaaatggactctgcaccttaggaatatgagttgcagcgtttctggacgatatgaatgcatgctcgtgctctatcccgaaggcatccagacaaaaatctacaacctccttatccaaacccacgtgacagctgacgaatggaatagtaatcacaccattgaaatcgagattaatcaaacactggaaatcccctgttttcagaattcttcgtccaagatctctagtgagtttacttacgcctggagcgtcgaggacaacgggacccaggagactctgatcagtcagaaccacctcatttccaatagcacactgctgaaggatcgcgtgaagctgggaaccgattaccgacttcacctctcacccgtacaaatcttcgatgacggtagaaaattcagctgtcacatcagggtaggccctaataagattctgcgatcatctactacggttaaggtgtttgcgaagcccgaaatcccagtaattgttgagaacaactccactgacgtgctcgtggagcgtcggtttacctgcctgctgaagaacgtgtttcccaaagcaaatatcacgtggttcattgatggtagttttttgcacgacgaaaaagagggcatttatatcactaatgaagagcgcaagggcaaagatggctttttagagctcaaaagcgttttgacgagagttcattctaataaacccgcacagtcggataacctcactatatggtgtatggccttaagtccggtacctgggaataaggtatggaatattagttcagagaagatcactttccttctgggcagtgaaatcagctccaccgaccccccactttctgtaacagaaagtaccctggacacgcaaccgagtccagcctcttccgtctcccctgctcggtatccagccacttccagcgtgaccctggtggacgttagtgcactgcgaccaaacactaccccacagccatccaattccagcatgacgacacgaggtttcaattatccatggacaagctcagggacggatacgaagaagtcagtgtccaggataccttcagaaacctactcaagcagcccctcaggcgctgggtcaaccctgcatgataatgtgttcacgtcaaccgcccgagcctttagcgaggtccccacgactgccaacggcagcacaaagacaaaccatgttcatatcacgggtattgtggtgaataaacctaaggacggcatgtcttggcctgtcatagtcgccgcactgcttttctgctgcatgatccttttcggcctcggagtgagaaagtggtgccaatatcagaaggaaatcatggaaagacccccacctttcaagccaccacctccccctattaagtatacctgtattcaggagccaaacgagagcgacctgccataccacgaaatggagacgttatag

SEQ ID NO: 217649 - DNA, 2508 bp, Artificial Sequence
  Description of Artificial Sequence: Synthetic coding sequence
atgggaggtagagtgtttctcgccttttgcgtatggctgaccctgccgggtgctgagacacaggatagcagaggctgcgcacgctggtgtccccagaactcttcctgtgttaatgctacggcctgcaggtgcaaccccggattttcgtccttttctgaaattataaccacaccaacggaaacctgcgatgatattaacgaatgtgccaccccctccaaggtgtcatgtgggaaattctcagattgttggaataccgagggctcttatgattgtgtgtgttcacctgggtatgagccggtgtcaggagctaaaacctttaaaaatgaatcagaaaacacctgtcaagacgtggacgaatgccaacagaatccacggctgtgtaaatcctatggaacctgtgttaatacactcgggagctatacctgtcagtgcctgcccggattcaaattcatccctgaggatcctaaagtctgtaccgatgtgaatgagtgcacctcaggtcagaacccctgccatagttccacgcactgtctgaacaacgtcggcagctatcagtgtcgctgcaggcctggctggcagcctattcccggatctccaaacgggccaaacaacactgtgtgtgaagacgtggacgaatgcagcagcgggcaacaccaatgcgatagctctactgtgtgtttcaacaccgtggggagttacagttgccggtgccgtcccggatggaaacccaggcacgggatcccgaacaaccagaaagataccgtgtgcgaagacatgacattttcaacatggacgccaccgccaggggtgcactctcaaacactgagtaggttcttcgataaggtgcaggatctaggccgagatagcaaaacgtctagcgcagaagtaactatacaaaacgtcatcaagttggtggacgagcttatggaggccccaggagacgtggaggcccttgcaccccctgtgaggcacctgatagctactcagctgctcagtaacctggaagatattatgaggatcttggccaagtccctaccgaaagggcctttcacgtatatctccccttcaaacactgaactaaccctcatgattcaagagcggggagataaaaacgtcacgatgggtcagagctctgctagaatgaagctgaactgggccgtcgccgctggagctgaggatccaggaccggcagtagccggtatactgtccatacaaaatatgaccacactgcttgccaatgcgtctttaaacctgcattccaaaaagcaggcggagttagaagagatctacgagtcttcaatccgcggagtccagttacggaggctgagcgcagttaactccatttttctttcacataataatactaaggaactgaatagtcctatcctattcgcattctcccatctcgagtcaagcgacggagaagccggtagagatcctccggcaaaggacgtcatgccgggtccgagacaggaactactttgcgcattctggaagtctgacagcgatcggggtgggcattgggctacagaagggtgccaagtgcttgggtccaagaacggctccaccacatgtcaatgttcacatctaagtagctttgcaattttgatggcccactatgatgtcgaagattggaagttgactctgattaccagggttggcttggctcttagtctgttttgtttgctgctgtgcatcctcacgtttctcctggttcggccaatccagggaagcagaacaacaatccatctacatttgtgtatctgtctgttcgtcggctccacaattttcctggcgggaattgaaaatgaggggggacaggtaggcctgaggtgccgattggtggcgggtctcctgcattactgttttttggctgcattctgctggatgagcctggagggcctcgaattgtactttcttgtggtgcgcgtcttccaggggcaaggcctgtccacacggtggctgtgcttgattgggtatggcgtgcctctgctgattgttggtgtcagcgctgcaatttattccaaaggttatggaagacctagatactgttggttagactttgagcaaggctttctttggagtttcttaggtcctgtgacctttattatcctgtgtaatgctgtcatctttgtcacaacagtatggaagttaactcagaagttcagtgagataaatcccgatatgaaaaaacttaagaaggcacgagcactgacaattaccgccatagcgcagttatttctccttgggtgtacctgggtcttcggtctgttcattttcgatgacaggtcgttggttctgacctacgtgttcacaatactcaattgtttgcaaggcgctttcctgtacctgcttcactgtctgcttaataagaaagttcgcgaggagtatcgcaagtgggcttgtctggttgctgggggaagtaaatattcggagttcacttcaaccacctctggcacaggccacaaccaaacccgcgctctcagagcctccgagtctggtatctag

SEQ ID NO: 217650 - DNA, 2361 bp, Artificial Sequence
  Description of Artificial Sequence: Synthetic coding sequence
atgggaggcagagtgttcctggctttttgcgtctggctgaccctgcctggggctgagacacaggattctcggggatgcgccagatggtgcccccagaatagtagttgcgtcaacgcaactgcttgtcgctgtaatcccggtttctcttccttttcagaaatcataactacgccaaccgaaacatgcgatgatatcaacgagtgcgctactccctccaaggtgagttgcgggaagttctccgactgttggaacacagaaggcagctacgattgtgtctgctctcccggatacgagcccgtttccggagccaaaacattcaagaatgagtccgaaaacacttgtcaagatgtggacgagtgtcagcagaatccacgactgtgtaagtcctatggcacctgcgtgaacacactgggatcatatacatgccaatgtcttccaggcttcaaattcataccggaagatcccaaagtgtgcacagatgtggacgaatgtagcagtggccagcaccagtgtgattcatctacggtctgttttaatactgtcggatcatactcctgccggtgcagacccggatggaagccaaggcatggcattcccaacaatcaaaaagacacagtgtgcgaggacatgaccttttctacgtggactcccccaccaggcgtgcactcacagacacttagccgcttcttcgacaaggtccaagatctgggacgcgacagcaaaacatcctccgccgaggtgacaatacaaaatgtaatcaagctcgttgacgagctgatggaggcacctggggatgtcgaagcattggcgcctcccgttagacacctgatcgccacccaactgctgtcaaacctagaggacatcatgcgcatcctggcaaagtctctgccaaagggcccttttacctatatttctccttctaatacggaactaacgctgatgatacaggagcgcggagataagaatgtgaccatgggacagtctagtgctcggatgaaactaaactgggccgtggcagctggcgcagaagatcccggtcccgcagtggctggaatactgtcgattcagaatatgacaacgctgctggctaacgcaagtctgaatcttcatagcaaaaaacaagccgaactagaggagatttacgagtcttccatccggggagttcaactgaggcgactcagcgccgtcaattcaatttttttgtctcataataacactaaagaattgaactcccctatcctttttgctttctctcacctggagtcaagtgacggcgaggcgggacgagatcctccggcaaaggacgtcatgcccggacccagacaggagcttttatgcgctttttggaagagcgactcagaccgtggcggacactgggctacagagggctgtcaggtgctggggtccaaaaacggtagcaccacctgtcagtgtagtcacctaagcagttttgcgatcctgatggcgcactatgacgtagaggattggaagctgacactgattactcgcgtcggattagcattgtctttattttgccttctactttgtattctcactttcctgctcgtccgccctatccagggaagtagaacgacgattcacttacacctttgtatctgcctcttcgtcgggagcacaattttcctcgctggtatcgagaacgaggggggtcaggtgggcctgcgctgccgcctggtcgcgggtctcctgcactactgctttctcgctgcattctgctggatgtctctagagggactcgagctgtattttctggttgtgcgtgtgttccagggccagggtttgagcaccaggtggttgtgtttgatagggtacggggtccccctcctgatcgtgggagtttcggccgctatttactctaaaggttacggcagacctcggtactgctggctggatttcgaacaggggtttctctggtctttcctgggcccagtgacattcatcatcttatgtaacgccgttatctttgtgactactgtgtggaagttgactcagaagttctccgagattaacccggacatgaagaagttgaagaaagccagagctcttactatcactgccattgctcaactcttcctgctgggctgcacatgggtgtttggattgtttatctttgatgacagaagtttggtgctcacatacgtctttactattttgaactgcctgcaaggagcttttctgtacctcctccactgtctcctcaacaaaaaggtgcgggaagagtatagaaagtgggcctgtctggtagcagggggtagcaaatactcggaatttaccagtaccacttcaggtacaggccacaaccaaacacgcgctctaagagcatccgagtccggcatttag

SEQ ID NO: 217651 - DNA, 2229 bp, Artificial Sequence
  Description of Artificial Sequence: Synthetic coding sequence
atgggagggagggtattcctcgctttctgtgtttggctaacccttcccggagccgagacccaagacagcaggggctgcgcaaggtggtgtccccagaattcttcctgcgtgaatgccacagcctgtcgctgcaaccccggattttctagttttagtgagattataactacaccgactgaaacatgcgacgacattaacgagtgcgccactccctcaaaggtctcatgtggcaagttcagcgattgctggaatacagagggcagttatgattgcgtgtgctccccgggatacgagccagtgtctggagcaaaaactttcaagaacgaatctgaaaacacttgtcaagatgtggatgagtgttccagcggccagcaccaatgcgattcctcaacggtgtgtttcaacactgtcgggtcttatagttgccgttgtcgccctgggtggaaacctcgacacggaatacccaataatcaaaaggacacagtgtgtgaggacatgactttctctacctggactccacccccaggcgtgcattctcagactttatctagattcttcgacaaggtgcaggacctgggtcgcgactccaagacatccagcgcggaagtgacgatccagaacgtgataaagttagtggacgagttgatggaggcgccaggagacgtggaggccttggcccctcccgtgaggcacctgatagctacacagctgctgtctaaccttgaggacatcatgagaatcctggccaagtccctgcctaagggcccattcacgtacatttctcccagtaataccgagttgacactgatgattcaggaacgtggagacaagaatgtgacaatgggtcaaagctccgctcggatgaaattaaactgggcagtggccgcaggagccgaggatcccggaccggcagtcgccggaattctgagcattcagaatatgactactcttctggcaaacgcgtcactcaacctgcatagtaagaagcaagccgagctagaggaaatctacgagagttccattaggggtgtccaattgcggagactctccgctgttaactctatctttctgtctcataataacactaaagaactgaactcaccaatactgtttgctttttctcatctggaatcttcagacggcgaggctgggagggaccccccagcgaaggatgtgatgcccggtccacgacaggaactcctctgcgccttctggaagtcagactcggatcggggaggtcactgggccaccgaagggtgtcaggtgttggggtctaagaacggctcaacaacatgccagtgtagccatctcagctcctttgccattctgatggcacactacgacgtggaagactggaaattgactctcatcacgcgcgtcggcctcgcccttagcctcttctgtctgctgctctgtatactgacattcctattggtgcggcctatccagggaagccgaacaaccatccacctgcatctgtgcatctgtctgttcgtcggtagtacgatcttcctcgctggaattgagaatgaaggcggtcaggtgggtctgcggtgcaggctggtggctgggctcctccattattgcttccttgcagctttttgctggatgtccctcgagggtctcgagctgtactttctggttgtgagggtttttcaagggcagggcctctcaacacgctggttatgccttattggctatggcgtgccgttgctcatcgttggagtcagcgcagccatctattcgaaaggctacggacgacctagatactgctggctggacttcgagcagggatttttgtggtcattcctcggccctgttaccttcatcattctctgtaacgctgttattttcgttactacggtctggaaactcacccaaaaattctcagagatcaatcccgacatgaaaaagttaaaaaaagcacgcgctctgacaatcacagccattgcgcagcttttcctactcggttgcacctgggtgttcggacttttcatattcgatgatcgctcacttgtgctaacgtacgtttttacgatcctgaactgtttgcagggggcattcctgtacctgctgcattgtctgttaaataagaaggtgcgcgaggaatatcggaaatgggcctgcctggtggccggaggttccaagtactccgagtttacatctaccacttccgggacaggacacaaccagaccagggccttgcgtgcctcagagagcggtatctag

SEQ ID NO: 217652 - DNA, 2358 bp, Artificial Sequence
  Description of Artificial Sequence: Synthetic coding sequence
ggaggtcgaattatgagagcgttctgcgtctggttgacactcccaggcgcagaaacgcaagactcccggggttgcgcaaggtggtgcccgcagaactcaagctgtgtgaatgccaccgcttgtcgctgcaatccaggctttagttcgttctctgagataatcaccactcccaccgaaacctgcgacgacatcaatgagtgtgctacaccttctaaggtgtcgtgtgggaagttcagcgattgctggaatacagagggtagctacgattgtgtgtgcagccccggatatgaacctgtgtccggcgctaagacgttcaagaatgaaagtgagaacacttgccaggatgttgacgagtgtcagcagaatcctagactctgtaagtcttacggaacctgcgtcaatactctgggtagctatacttgtcagtgcttgcccggattcaagtttattcctgaggatcctaaagtgtgcactgatgtcgatgaatgtagtagtggacagcatcagtgtgattcgagcactgtttgtttcaatacggtgggtagttactcgtgccgctgcagacccggatggaagccgaggcacggaatccctaataatcagaaggatactgtgtgtgaggatatgacattcagcacatggacaccccctccaggggtacactctcagactctgtcacgtttcttcgacaaggtgcaagatctcggacgggattctaagacgagttcagctgaggtgaccattcaaaacgtgatcaaactggtagatgagctaatggaggccccaggtgatgttgaggcactggctcctccagtccgtcatctgatagcaacacagctgctgtccaatctggaggacatcatgaggatccttgctaaaagtctcccaaagggaccttttacatacatctctcccagcaacactgagctgactctgatgatccaggagagaggggacaagaatgtcacaatgggacagagcagcgcaagaatgaaactcaactgggctgttgcagctggggctgaggacccagggcctgccgtggccggtatattgtccatccagaacatgaccacgctcctggctaatgccagcctcaatcttcactcaaagaaacaagctgagctggaagagatctacgagagctcaataaggggcgtccagctccgcagactaagcgccgtgaattccatattcctctcgcacaataacacaaaggagctcaactccccaatactttttgctttctcacacctggagtcttcggatggcgaggcaggcagagacccccctgccaaagacgtgatgccaggaccgagacaagagcttctctgcgctttttggaaatccgacagtgacagaggaggtcattgggctacagaggggtgccaagtgttgggaagtaagaatggcagtactacttgccagtgttcccacctctcgtctttcgccattctgatggctcattatgatgtggaggactggaaactcacactgatcacacgcgtgggcctcgccctctccttgttctgcctgctgctgtgtatactgacctttcttttagtccggccaatccaggggtccaggacaactatccatttgcatttgtgcatctgcttgtttgtgggatccaccatttttctcgcaggaattgagaacgaaggaggccaggtgggcttacgctgcaggctcgtggccggtctgttgcactactgcttcctggccgctttctgctggatgagtctggagggactagagttgtattttcttgtggttcgcgtcttccaggggcaggggttgtccacccgttggctgtgtctgattgggtatggcgtcccactgttgattgtcggggtgagcgcagccatttacagcaagggctatgggagaccaaggtactgttggctggattttgagcaaggcttcctatggagctttctcggaccagtgactttcattatcctgtgtaacgccgtgatcttcgtaaccacagtgtggaagcttactcaaaagtttagtgagattaatccggatatgaaaaagctgaagaaggccagggcgctgacaataaccgctatcgcacagctattcctgttgggatgcacttgggttttcgggctattcatcttcgacgacagatcccttgtgctgacatacgtgttcactatcctcaattgcctccagggcgcattcttatatctcctgcactgtctgctgaataaaaaagtgcgagaggagtaccggaagtgggcttgtttagtggccggtggctctaagtatagcgaattcacatccactacttccggtactggacacaaccagaccagggcgctgagagccagcgagtccggaatttag

SEQ ID NO: 217653 - DNA, 297 bp, Artificial Sequence
  Description of Artificial Sequence: Synthetic coding sequence
atgagcgtgagacttcacgttccatcgggtagtcgcggatcagaattatccgcgttgatacaggccatcggagcatccacctctgggaaacccaaatgcttcgtctgcatcctaagaagcggtctgagcgtggcgctgtctctgagcgtgtactttctactgctatttagcagaactcgcggaggtggacatggagaaccaccggagtgtcagcgcagagcatcttgctccgcgtattcattcagggagattgaagattgcaggcagaagcagcctcgtagatggcagcaaggatag

SEQ ID NO: 217654 - DNA, 231 bp, Artificial Sequence
  Description of Artificial Sequence: Synthetic coding sequence
atggctcgcggagctgcgttagctctgctcttattcggcctgctgggagtgctggttgccgcacccggttttggtgacctgaggctccaagcagcaaggggaggcaggccaggcgtggcctgtcacagtcacgccctgaggcccggtcccaaatttgggatcgcccgatcccttcgtccaggatggtggggtgaagggaaagaaaaacttgagaagaattttgaaccttag

SEQ ID NO: 217655 - DNA, 534 bp, Artificial Sequence
  Description of Artificial Sequence: Synthetic coding sequence
atggctaggggcgctgcactggcactgctgcttttcggcttgctgggcgttctggtggccgctccagacggaggcttcgatctctccgatgcactgcctgataatgagaataagaaaccaaccgccatccccaagaagccctcagccggagatgacttcgacctcggggacgctgtagtggacggggagaacgatgaccccagacctccaaacccccctaaaccaatgcctaaccccaaccctaaccacccgtcatcatcgggaagtttttcggacgccgatcttgccgatggggttagtgggggtgagggcaagggcggatctgacgggggagggagtcaccggaaggagggcgaggaggccgacgctccaggcgtgattccaggcatcgtgggcgcagtcgttgtggcggttgctggggctattagtagctttatcgcctatcaaaaaaaaaagctgtgcttcaaagagaacggccagcttgcaggttcccttggtccatgcattggcatcagaagagaagctgacggctag

SEQ ID NO: 217656 - DNA, 510 bp, Artificial Sequence
  Description of Artificial Sequence: Synthetic coding sequence
atggctagaggagccgctttagccttgttattgttcggactgctgggcgtccttgtcgccgctcccgacggtggttttgacctctccgacgccctgcccggagatgatttcgatcttggcgacgcggtagtggatggggagaatgatgatccacgccctccaaatcccccaaagcccatgcccaatccaaaccctaaccatccatcttcctcgggatctttttctgacgccgacctggcagatggagtgtctgggggagagggaaagggaggtagtgacggtggtggctcacatcggaaggagggcgaggaggccgatgcgccaggggtgatccccggaatcgtaggcgcagtggtggtggctgtggctggggcaattagttcattcattgcctaccagaagaagaagctgtgtttcaaggagaatgccgaacaaggcgaagttgatatggaatcccatagaaacgccaatgccgaacctgccgtacaacgcacactgctggaaaagtag

SEQ ID NO: 217657 - DNA, 558 bp, Artificial Sequence
  Description of Artificial Sequence: Synthetic coding sequence
atggcacgcggtgccgctctcgcactgctcctgttcgggttattgggcgtactggttgccgctccggacggagggttcgatctcagcgatgccctgcccgataatgagaacaaaaaacccactgctatccctaaaaaaccttccgccggtgacgattttgacctaggagacgctgtggtggacggtgagaatgacgatcctcgccctcctaacccgcctaagcccatgcccaatcccaacccaaaccatccatctagtagtgggagcttctctgacgccgatctagcggacggagtgtctggcggagaaggtaagggaggttctgacggcggaggctctcaccgcaaggagggtgaagaagcagacgctccaggtgttatccctggcattgtgggtgccgttgtggtggccgtggcaggagcaatctcttcatttatagcataccagaagaagaagctttgttttaaggagaatgctgagcagggcgaggtggacatggagagccaccgtaacgcgaacgctgaacctgctgtgcagcggacgctgttagaaaagtag

SEQ ID NO: 217658 - DNA, 606 bp, Artificial Sequence
  Description of Artificial Sequence: Synthetic coding sequence
agacgctggggacggcctgccggaactcccggagcttcatccctgcccggtcggacgcgatgcgcacacggtggcccaggtccagaggaggcacctactttcagccccacactgtttcttgagccatttcagagggagaagagcgcatttgttgttggggtggccaatagctacatgtggggcggactaggtagagacggcggatttgacctttccgatgcgctccctgacaatgagaacaaaaagcccactgccatacctaagaagccatcagcgggagacgatttcgaccttggagatgccgtcgtcgacggtgaaaacgacgaccctaggccccctaacccgcctaaaccaatgcctaacccgaatcccaaccacccaagcagcagcggctcctttagcgacgcagaccttgcagacggtgtgagtgggggtgaaggaaaaggagggagcgacgggggtgggtcccatcgaaaggagggggaggaggccgacgcccctggcgtgattccagggatcgtcggcgctgttgtcgtcgccgttgctggcgcaatctctagctttatcgcataccagaaaaaaaaattatgcttcaaagagaactag

SEQ ID NO: 217659 - DNA, 438 bp, Artificial Sequence
  Description of Artificial Sequence: Synthetic coding sequence
atggtcgcttggaggagcgcgtttctcgtctgtcttgcctttagtctggctaccctggtgcaaaggggatcaggggatttcgacgatttcaacttggaagatgcggtaaaagagaccagtagcgtgaagcccgcactgggaatgtatcacaagctagacgggttaaaacagcagaattttatcctgagtctgttctggatgcttgaagtgttataccaaggtgtgggctgggccaccttttctcttaaggccctggggaagaatctgagtctgacctttccgacttccggaggctccaggtgtagcctggtctgtggttgcattacacctatcagcgcatccgtggtcacatggtgttcccccttctgtgtctcactgttgtcgttgacaaagatgctggtgagcggtttcaaagcacacctcgataatcccggatag

SEQ ID NO: 217660 - DNA, 573 bp, Artificial Sequence
  Description of Artificial Sequence: Synthetic coding sequence
atggtcgcctggaggagtgcgttcttagtttgtctggcatttagcctggccaccctggtgcagcgcggatctggagatttcgatgattttaacctggaggatgctgtcaaggaaacctcttctgtaaagcgaaatgacttcgatctggctgatgcacttgacgatcgcaacgatagagatgatggcaggcgtaagccaatagccggaggtggcggattcagcgacaaagacctcgaggatatcgtgggtggtggggaatataagccagataagggcaagggggatggaagatatgggtctaatgacgatccaggctctggaatggttgcagaacccggtaccatcgcaggcgtcgcctcagccctcgctatggccctcatcggggctgtgtcttcctatatttcatatcagcaaaaaaagttttgttttagcatccagcaggggctcaatgcagattacgttaaaggagagaatctggaagcagtggtgtgtgaagaaccacaggtgaaatatagtacactgcacacccaaagcgcagaacctcccccacccccagagccggctcggatttag

SEQ ID NO: 217661 - DNA, 789 bp, Artificial Sequence
  Description of Artificial Sequence: Synthetic coding sequence
atggttgcctggcggtctgcctttctggtctgcctcgccttctctctggctactctggtgcaacggggatcaggtgacttcgatgacttcaaccttgaggacgctgttaaggagacgtctagcgtcaaacaaccatgggaccacaccaccaccaccacaacaaatcgtcctggcaccacaagagcacctgctaagccccctggaagcggccttgatctggccgacgccctggatgaccaagatgacggaagaagaaagcccggaataggaggcagagagcggtggaaccatgtgaccacaacaactaaaaggcccgtgacgacacgtgcgcctgctaataccctgggaaatgacttcgatctcgccgacgcattggatgatcgcaacgaccgggatgatggtcgcagaaagcctatcgctgggggaggtggttttagcgacaaggacctggaggatattgtcggcggaggcgagtataaacctgacaagggaaaaggcgatggcagatacggctccaacgacgatccaggatccggtatggtggcagagccaggaactattgccggagtggcatctgccctggcgatggccctgattggagcggtttccagctacattagctatcagcagaagaagttctgttttagtattcagcagggtctgaacgctgactatgtgaagggcgagaacttagaagcagtcgtatgcgaagagccacaggtaaaatatagcaccctgcacactcagtccgccgagccccctcctcctccagaaccggctagaatctag

SEQ ID NO: 217662 - DNA, 474 bp, Artificial Sequence
  Description of Artificial Sequence: Synthetic coding sequence
gagacaagctctgtcaagcagccttgggatcataccaccactacaacaactaacagacccggaaccactagagcgcctgccaagcccccagggagtggcctggaccttgccgacgccttggacgatcaagatgatggcagaaggaagccaggtataggtggacgggagagatggaaccatgtgaccacaactactaaaaggccagtgactaccagagcccctgccaatacacttggaaatgattttgatctggcagacgcccttgatgatagaaacgacagagatgatggcagacgcaagcccatcgcgggtggaggaggcttctcggataaggacctggaggatattgttggcggtggtgagtataagcccgataagggtaagggggatggccgatacggcagtaatgacgacccaggatctggcggtttcttgaaccccgaggctccagtaggccacgtaaaggggaagtag

SEQ ID NO: 217663 - DNA, 570 bp, Artificial Sequence
  Description of Artificial Sequence: Synthetic coding sequence
atggtcgcctggcggtccgctttcctggtgtgtctggcgttctccctcgctaccctggtccagagaggtagcggagacttcgatgacttcaacctcgaggacgccgtgaaggaaacctctagtgtcaagcagccatgggaccatactaccaccacgaccaccaacagacctggcaccacgcgggctccagctaagccacctggatccggacttgatctcgccgacgcccttgatgatcaggatgacgggagacgaaaaccaggcattggtggccgtggcgatggtcgatatggttctaatgatgaccctggatccggcatggtagccgagcctgggacaatcgcaggggtggcatctgccctggccatggcactgatcggagctgtctcctcctacatcagctatcagcagaagaagttttgctttagtatccagcaagggttgaacgcggactacgtcaagggggaaaatctggaggctgtggtctgcgaggaaccgcaggtgaagtacagcacacttcatacccagtccgcagagccgccaccgcctccagagcctgcacgcatctag

SEQ ID NO: 217664 - DNA, 819 bp, Artificial Sequence
  Description of Artificial Sequence: Synthetic coding sequence
atggttgcttggcgatccgcttttctggtatgcctggcttttagcctcgccaccctggtgcagagaggatccggggattttgatgacttcaatttagaagatgcagtgaaagaaactagttccgtcaaacaaccttgggaccacaccaccactacaacaaccaataggcccggaaccacaagggcccctgctaagcctcccggaccaacagagggctccgggctggacctggccgatgcattggatgatcaggatgatggaaggagaaaaccaggaattggcggaagggagaggtggaatcacgtgacgaccactactaaacgaccagtgactacaagggccccagccaacacacttgggaatgacttcgatctcgctgatgccctcgacgaccgtaacgacagggacgatggtaggagaaagccaatagcgggaggtggtggcttttccgacaaggacttggaagacattgtcggtggcggagagtacaagcctgataagggcaagggagatggcagatacggatctaacgacgatcctggttctgggatggtggcagaaccaggaacaatcgctggcgttgctagcgccctcgctatggccctgattggagctgttagctcttacatatcttaccagcagaagaagttctgtttttccatccaacacgctgcagccggacaggaaggtctcaacgccgattacgtaaaaggtgagaacctcgaggccgttgtgtgcgaggaaccacaagtcaagtactctactttgcacacgcagtctgcagaaccccctccacccccagagcctgccagaatatag

SEQ ID NO: 217665 - DNA, 642 bp, Artificial Sequence
  Description of Artificial Sequence: Synthetic coding sequence
atggtcgcctggcggtcagcgttcctggtgtgcttagcattcagtctggcaacacttgtgcaaagaggctccggcgacttcgacgatttcaacctcgaggatgccgtgaaagagaccagcagcgttaaacaaagatggaaccatgtgaccaccacaactaaaagaccagtgactacccgggctccggctaatactctgggaaatgactttgacttggctgacgctctggacgatcgaaatgaccgagacgacggtcgcagaaagccaatcgctggcggtggcggattttccgacaaagatctcgaggacatcgtgggtggcggagagtataagcctgacaagggaaaaggcgacgggcgttacggctccaacgacgacccaggctcgggtatggtagcagaaccaggaacgattgcgggagtcgccagcgcgttggccatggctttgatcggggctgtctccagttacatttcctaccagcagaagaaattctgcttttcaattcagcagggactgaacgccgattatgtcaagggagagaacttagaggccgttgtttgcgaggaaccccaggtgaagtatagtacccttcacacccagtcagccgaacccccaccaccaccagaacccgctaggatatag

SEQ ID NO: 217666 - DNA, 1785 bp, Artificial Sequence
  Description of Artificial Sequence: Synthetic coding sequence
atggctgccgagtcaggtgaactgatcggcgcttgtgagttcatgaaggaccgcctctactttgcaactttgcggaataggccgaaatctaccgttaatactcactatttttctatcgatgaagaacttgtgtacgagaacttttacgctgacttcggaccactcaatctagccatggtatatcgatattgctgtaaactgaataagaaactgaaatcatatagcctgtcacgcaagaaaattgtgcactacacctgctttgaccagcggaaaagagcaaacgcagcatttctgatcggcgcatatgctgtcatctatctgaagaagactcccgaggaggcgtatcgagcactgttgagcggctccaaccctccttatttaccatttagggacgccagcttcggcaactgtacctacaacctcaccatcctcgactgccttcaggggatcaggaagggactccagcacgggttttttgactttgagacctttgacgtggatgaatacgagcattatgaaagagtggaaaatggagacttcaactggattgtgcccggtaagttcctggctttctcaggtccgcatcctaaatctaagatcgagaatggctacccccttcatgcacccgaggcatactttccatattttaagaagcacaatgtgactgcggtcgtccgattgaacaaaaagatttatgaggccaagaggttcacagacgctggcttcgagcactacgatttattttttattgacggcagtacccccagcgataatattgtgcgaaggtttctcaacatttgtgagaatacggagggcgcaatcgccgttcattgtaaggccggattaggcagaacggggaccctgattgcctgttatgtgatgaaacattacaggttcacacatgccgaaattattgcgtggatacggatctgtcggccaggctctatcatcggtccccaacagcactttcttgaggagaaacaggctagtttgtgggtccagggtgatatctttcgatccaagttaaaaaatcgaccctccagtgagggatccatcaacaagatattatccggacttgatgacatgtccataggaggaaacctctccaaaacccagaacatggagcggtttggcgaggacaacctggaggacgatgacgtagaaatgaagaacggcattacgcagggtgacaaattgagagctcttaagagtcagcggcagccacggacatcgccttcctgtgcctttaggtcagatgacacaaagggccacccaagagcagtctcacagccttttaggctgagctcctctctgcaggggagcgctgtaactttgaagacaagtaagatggctctctccccaagtgcaactgctaagcgcatcaatagaacttcccttagtagcggagctacagtcaggagctttagcatcaacagcagacttgcctcttccttaggcaatcttaatgccgcaaccgacgaccccgaaaataaaaaaacaagttcctcctctaaagctggttttactgccagtccttttactaacctgctaaacggatcatctcagccaaccaccaggaactacccagagcttaataataaccagtataacagatcctctaactctaacggcggaaaccttaattcaccccctgggccacactctgctaaaaccgaagagcatacaacaatactgcgaccatcttatactgggttgagctccagttcagctaggttcctctcacggagtatcccatccctgcagagcgagtacgttcactactag

SEQ ID NO: 217667 - DNA, 1872 bp, Artificial Sequence
  Description of Artificial Sequence: Synthetic coding sequence
atggccgcagagagcggagaactgatcggggcttgtgagtttatgaaagatcgcctgtactttgccactctccgcaacagacctaagagcactgttaacactcactacttcagtatcgacgaagagttggtgtacgagaacttttacgctgacttcggccctttgaaccttgccatggtctatagatactgttgcaaactgaataagaaacttaagtcctactctctttcccggaaaaaaatcgtccactatacctgctttgatcagcgcaagcgggctaacgcggcattcctgattggggcttacgcagtgatatacctgaaaaagacacctgaggaggcctacagagccctcctcagcgggtctaacccaccatatctaccatttagagacgcctccttcgggaactgcacatataacctcacaattctggactgtcttcaagggatccgaaagggtttgcaacatggattctttgatttcgaaacgttcgacgtggacgaatatgaacattacgagagagtggaaaacggggattttaactggatcgtcccaggcaagtttcttgccttttcagggccacaccctaaatccaaaatagaaaacggatacccccttcacgctccagaggcttattttccatacttcaagaaacacaacgtgactgcggtcgtcagactcaacaagaagatctatgaagccaagcgcttcaccgacgctggtttcgagcactatgatctttttttcatagacggctcgactcccagcgacaacatcgttcgccgtttccttaatatatgcgaaaacaccgagggagccatcgctgtccattgcaaggccggtctgggcagaactggtactttgatcgcctgctacgtgatgaagcattaccgcttcacccatgccgaaattattgcctggatcaggatttgtaggcccggatccattatcggaccccaacagcattttctcgaagagaaacaggcctccctgtgggtccagggcgatatctttagaagcaaattaaagaacagaccttctagcgaggggtctatcaataaaatcctgtcagggctggacgatatgtccattggaggcaatctgtcaaaaacacagaatatggaaagatttggggaggacaatttggaagatgacgacgtagaaatgaagaatggtatcacccagggcgacaaacttagggccctcaaatctcaacgccaacctcgcacgtctccatcctgtgcctttcgatcggacgatacaaaaggacaccccagagccgtcagccagccctttcgcctctccagttccctgcagggatccgcagttacattgaaaacatcaaagatggctctgagccccagcgctactgctaaacgcataaaccgcacctctctctcctctggggcaaccgtgcgatcattttcgatcaatagccgcctggccagcagcctaggtaacctgaacgctgccacggacgaccctgagaacaaaaaaacatcctcatcaagcaaggcagggttcactgcgagtccgtttaccaacctgcttaacgggtcttcacagccaactactcgtaactaccctgaacttaacaataaccagtacaatcgttcctctaatagtaacgggggaaatctgaatagcccacccggtcctcattccgccaaaaccgaggagcatactaccattcttaggccatcttacaccggcctttcctcttcctccgctcgcttcctgtcacggtccatccctgtctcagctcagacgcccccacctggaccccagaaccctgagtgcaatttttgcgcgctgccgagccagccccgtctcccacccaaaaaattcaactcagctaaggaagctttctag

SEQ ID NO: 217668 - DNA, 1152 bp, Artificial Sequence
  Description of Artificial Sequence: Synthetic coding sequence
atggccgctgaatccggcgagctcatcggcgcttgtgagttcatgaaagatcgactctacttcgcaacgctgagaaacagacctaagagcactgtgaatactcactatttctcgatcgatgaggagctcgtttatgaaaatttttacgcagactttggccctctaaaccttgctatggtgtacaggtattgttgcaagctaaataagaagctgaaaagctactccctctcacggaaaaagatcgtccactacacatgcttcgaccagcggaagagagcaaatgctgctttcctgattggagcctacgcagtcatctacttgaagaagactccggaggaggcctacagagctctgctgtccggatctaaccccccttacctgcctttcagggatgcatctttcggtaattgcacttataaccttactatcctggactgccttcagggaatcaggaaagggctccaacatgggttctttgatttcgaaacattcgatgttgatgagtatgagcattacgagagggtggagaatggagacttcaattggattgtgccagggaagttcctagccttctctggaccccacccaaaaagcaagattgagaacggctaccctctccacgcacctgaagcctactttccttatttcaagaaacataacgttactgctgttgtacgactcaataagaagatctacgaagcaaaacggttcacggacgctgggttcgagcattatgacctgtttttcattgacggcagcacgcccagtgataacatcgtccgtcgattcttgaacatatgcgaaaacacagaaggagccatagctgtccactgcaaagccggactcggcaggacaggaactcttattgcttgctatgtgatgaagcactatcggttcactcatgctgagataattgcctggattcggatctgcaggcctggttctattatcggccctcagcagcactttctggaggagaagcaggcctcactctgggtccagggcgatatcttcagatcgaaactcaagaatcggccaagctctgaggggagtataaacaagatcctttctggtctagatgacatgtctatcgggggaaacctgtcaaagacacaaaatatggagcgatttggcgaagtcagctttccatag

SEQ ID NO: 217669 - DNA, 576 bp, Artificial Sequence
  Description of Artificial Sequence: Synthetic coding sequence
atggcagccgaaagtggagaactgatcggggcatgtgagttcatgaaagatcggctgtatttcgccacgcttcgcaatagacccaagtctacagtaaacactcattacttctcaattgatgaagaactggtatacgaaaacttttacgcagacttcgggcctctcaatctggccatggtgtaccgctattgctgtaagctgaataagaaactgaaatcgtactccctatctaggaaaaagattgtgcattacacatgcttcgaccagcgaaagcgcgctaacgcagctttcctcataggcgcatatgccgtgatttatctgaaaaagacaccagaagaagcctatcgtgccttgctcagcggatctaatccgccttatctgcctttccgggacgcctctttcggaaactgtacatacaatctcacgattctggactgtctgcagggaattcgtaagggcctgcaacacgggtttttcgacttcgaaacttttgacgttgacgagtatgaacattatgaagtcatcctgttcaccccactcaagccaacatttctgatttcaaagagtattatgtag

SEQ ID NO: 217670 - DNA, 822 bp, Artificial Sequence
  Description of Artificial Sequence: Synthetic coding sequence
atggggaattttctgagcagagaaaacaaagttcaggtcatttctgagtcagatcgactgtactttgccacactaagaaaccggcctaagtccaccgtgaacacacactacttttccattgacgaggaattggtttacgagaacttctatgctgatttcggaccccttaatctggccatggtataccgctactgttgcaagttgaataagaagctcaagtcttattccctgagccgaaagaagattgtccattacacctgttttgatcagcggaaacgcgctaatgctgccttcctgattggtgcctatgcagtgatatatctgaagaaaacccccgaggaggcctaccgagctctgcttagtggcagtaaccccccatacctcccattcagagacgcttcttttggaaactgtacatataatctgactattcttgattgcctccaggggatccgtaaggggttgcagcacgggttcttcgacttcgagaccttcgacgtggatgaatatgagcactacgaaagagtggaaaacggagacttcaattggatcgtgcctggaaaattcctagcattcagcggacctcacccaaagtcaaagatcgagaacgggtatcccctgcatgcccctgaggcctactttccgtacttcaagaagcataacgtcacagccgtggtgcgactgaataaaaaaatatatgaagctaagcgttttacagatgccggatttgaacactacgacctattcttcatagacggctccactccgtcagacaatatcgtgcgccgattcctcaacatttgcgagaataccgaggggtag

SEQ ID NO: 217671 - DNA, 1698 bp, Artificial Sequence
  Description of Artificial Sequence: Synthetic coding sequence
atggtgtaccgctactgctgtaaattaaataagaaactgaaatcgtattccttatcacgaaagaagatcgttcattatacctgtttcgatcaaagaaaacgcgcaaatgccgcattcctgataggtgcttacgctgtgatctaccttaagaagactcccgaagaggcctatcgggctttgttaagtggctcgaatcccccttacttaccttttcgcgacgcgtcctttgggaattgtacatacaatttaaccattcttgattgtctgcagggtataaggaaaggactgcagcacggcttctttgactttgagaccttcgacgttgatgaatacgagcattacgaacgcgtggagaacggagactttaactggatcgtcccaggcaaattccttgctttcagcgggcctcacccaaagagtaagattgagaacggatatcctttgcatgctccggaggcctattttccctacttcaagaagcacaacgtgacagctgtggttcgcctcaataagaaaatttacgaggccaagcggttcacagatgccggatttgagcactacgatttgttctttattgacggttctacacccagcgataatatcgtacggcgtttcctgaacatctgcgagaacaccgagggtgccatagctgtgcactgcaaagccggtctcggaaggacagggacgctcattgcttgctacgtcatgaagcactataggtttacccatgccgaaatcatcgcctggattagaatctgccgaccgggttccatcattggtccacagcagcacttcctcgaagaaaagcaggcttccctttgggtgcagggggacattttccgatctaagctgaaaaatcggccatcatccgaaggttccattaataagatcctgtctgggctggatgacatgtctataggtggcaacctgagcaaaacccagaatatggagagatttggagaggacaatctggaggacgatgacgtggagatgaagaatggcattactcagggcgataaactgagagccctgaagtctcaaaggcaaccaaggacaagccctagctgtgctttccgctccgatgataccaagggacacccaagggcagtgtcacaaccattcaggctgtcttcctctctgcaaggctccgcggtgacgctaaagacctccaaaatggcactaagtccatccgctactgctaaaaggatcaacaggacttctctttcttccggcgcaacagtccgctccttctcaatcaattctcgactagcttcctccctgggaaatctgaatgccgcaactgacgacccagaaaacaaaaaaacgagcagctcaagcaaagctggctttaccgcctctccctttaccaacctgctgaacggctctagccagcctacaactcgcaattaccccgaactgaacaacaaccagtataataggtcttctaacagcaacgggggaaacctgaactccccaccagggccacattccgcgaaaacagaggagcatacaacaatcctacggccatcctataccggcctgtcatccagttcagctagattccttagcaggagcatccctgtttcagcccaaactccccctcctggtccccagaaccccgaatgtaacttctgcgccctcccgtctcagccgaggctgccaccaaaaaaatttaattctgccaaggaagccttttag

SEQ ID NO: 217672 - DNA, 1833 bp, Artificial Sequence
  Description of Artificial Sequence: Synthetic coding sequence
atggctgccgagtctggcgaactgatcggtgcttgcgagttcatgaaggacaggttatacttcgcgacactgcgtaacaggcctaaaagcacagttaacacgcattacttctctatcgacgaggaactagtgtatgaaaacttttacgctgactttggcccactcaatctggcaatggtgtacaggtattgttgcaagttaaacaagaagctcaagagctattccctgtcccggaagaaaatcgtgcactacacttgtttcgaccagcgcaagcgagccaacgccgcttttctgatcggcgcttatgctgtaatttatcttaaaaaaacaccagaagaggcgtatagggctctgctgtcaggaagtaaccctccttatctcccttttcgagacgcaagttttggaaattgtacctataatctgacaatccttgactgcttacagggcatccgtaaaggactacagcatggctttttcgattttgagacattcgatgtggacgagtatgagcattacgagagggttgagaacggtgacttcaactggattgtgccagggaaattcctggcttttagcggtccccatcccaaaagtaagatcgagaatgggtaccccctgcatgcaccagaagcctacttcccctacttcaaaaaacataacgttaccgccgttgtgcggcttaacaaaaaaatttacgaagccaagcgctttacagacgccggatttgagcattatgacctgtttttcatcgatggatcaaccccttccgataatatcgtaaggcgatttctgaatatatgcgaaaacacagagggcgcaattgcggtgcactgtaaagccggtctggggagaacagggactctgatagcatgctacgttatgaaacactatcgcttcacccatgccgagatcattgcttggatccgaatctgtcgcccaggatccatcatcggtccgcagcagcactttctggaggagaagcaggcctctctctgggtgcaaggcgacatttttcgttcgaagctgaagaacaggccctcttccgaaggctcgattaacaaaattctcagcggtctcgacgacatgagcatcggagggaatttgtctaagacgcagaacatggagcgttttggggaggataatctcgaggacgatgacgtggaaatgaaaaacggcattactcagggtgataagttgcgggcactgaagtcccagcggcagcctagaacctctccgtcctgcgcctttcggagtgacgacacaaaaggtcacccacgcgcagtatcacagccgttcagactctccagttccttacaggggtcagccgtgacactgaaaacgtcaaagatggccctgtcacctagcgcaaccgcaaagcgaattaatcggacaagcttgtcttccggtgccacggtcaggtcctttagcatcaattcccggctggcctcttcacttggcaacttgaatgcggctactgacgatcctgaaaacaaaaagaccagttcatcatccaaagcaggatttactgcgtcgccgttcacgaatctgctcaatggatcctcacagcctaccaccaggaattaccccgaactgaacaataatcagtacaatcgttcttccaatagtaacggaggtaatctgaattcaccaccagggcctcattcggctaagaccgaagaacacaccaccatcctccggccttcttacacaggtctcagctcttcctcagctcggttcctgtcacgcagcatcccatgttcctgccttctcctggtcttcagaaagccatttctcggttccccccttctcagtctaccgataagtcacctgtag

SEQ ID NO: 217673 - DNA, 1416 bp, Artificial Sequence
  Description of Artificial Sequence: Synthetic coding sequence
atgaagcgaaagtcggagagaaggagctcctgggccgctgcccctccttgttctcgtcggtgttcctctacaagcccaggcgtcaagaaaattcgatcctcaacccaacaggacccaagaagaagggatcctcaggatgacgtgtatctcgatatcactgatcgtctgtgctttgctattctgtattcaaggcctaagtctgcatccaacgtgcattattttagtatcgataacgaactcgagtacgagaacttctatgcagactttggccctctcaacctagctatggtgtatagatactgctgcaagattaataaaaagctaaaaagtattacaatgctccgcaagaaaatagtgcattttactgggtccgaccagagaaaacaggccaatgccgcttttctggtaggatgctacatggtcatctatctggggcgtacgcctgaggaggcttaccgaattcttatcttcggtgaaacgtcctatatcccattcagagatgccgcatatggctcgtgtaacttttatattacacttcttgattgtttccacgcagtgaagaaggcaatgcagtacggtttcttaaatttcaattccttcaacctagacgagtatgagcactatgagaaagccgagaacggtgatctgaactggatcattcctgaccggttcatcgcattttgcgggccacatagccgagctaggcttgaaagcggctatcaccagcatagccctgaaacatacattcagtacttcaagaaccacaacgtgaccacaataattaggttaaataagcggatgtatgacgctaaaagattcactgacgcgggtttcgatcaccacgatctcttttttgccgacgggagcactcccacagacgccattgtaaaggagtttcttgatatctgtgagaatgctgagggagctatcgcagtgcattgcaaggcaggcctgggccgtaccgggaccctgattgcttgctacattatgaagcattaccggatgacggccgcagagaccatcgcctgggtgagaatctgtcgtcctggctcagtaatcggtcctcagcagcaatttctggttatgaaacaaactaacctgtggctagaaggggactacttcaggcagaaactgaagggtcaagaaaatgggcagcatagggcagccttctccaagctgctgagtggtgtggatgacatttccataaacggcgtcgagaatcaggatcagcaggaacccgaaccctacagtgatgatgatgagattaacggtgtcacccaaggcgacaggcttagagcacttaagtcacggaggcagtcgaagaccaatgctattccgctgactgatggatggctgagtcaggcagtgacattcctggatcgccttctaatatggctcggaatccacaaagactag

SEQ ID NO: 217674 - DNA, 1458 bp, Artificial Sequence
  Description of Artificial Sequence: Synthetic coding sequence
atgaagaggaaatccgagaggcgcagctcttgggccgcagcccctccatgttccagacggtgctcgtcaacctctccaggcgttaaaaaaatccgcagcagcacccaacaggaccccagacggcgtgacccccaggatgatgtatacttagatattacagataggctatgttttgccatcctttatagccggccaaagagtgctagcaatgtgcactactttagcatcgacaacgaactcgagtatgagaacttctatgctgactttgggcctctcaatctagcaatggtctatcggtactgctgcaagattaacaagaagctcaagtcaatcacaatgctccgtaaaaagatagtccatttcacaggctctgatcagcgtaaacaggccaacgcagcattcctggtggggtgttacatggttatctacctgggccgaaccccggaagaagcttacaggatcttgattttcggagaaacatcctatataccgttccgagatgcggcatacggtagctgtaatttttatatcacgctgctcgactgttttcatgccgtcaagaaagctatgcagtatggctttttaaactttaacagcttcaatctggatgagtatgaacactacgagaaagccgagaatggggaccttaactggatcatcccagaccggttcattgccttctgcggccctcacagccgggctcgactggagtccggataccaccaacacagccctgagacttatattcagtattttaagaaccacaacgttactacgattattcggctcaataaaagaatgtacgatgccaagcgctttactgacgctggctttgatcatcacgacttgtttttcgcagacgggagcactcccacggatgccattgtaaaagagttcctcgatatttgcgagaatgccgagggcgctattgcggtccattgcaaagcaggactggggaggactgggactctcattgcatgctatatcatgaagcattacaggatgactgctgccgagactatcgcctgggtgcgcatctgcagacccggatctgtcattggccctcagcaacagtttctagttatgaagcaaaccaatctttggttagagggtgattattttcggcagaagttgaagggacaggagaacggacagcatagggcagctttcagtaaactgttgtccggagtggatgacatctctattaacggggtcgagaatcaagaccagcaggaaccagagccctattctgatgacgatgaaatcaacggggtgactcagggggaccgcctccgagcactcaaatcccgacgccagagcaagaccaacgccatacccctgacatgccctcttgccgtgctgactagcgccctctgctcagtagttatctggtggatcgtctgcgattacatcctgcccatacttctgttctgtcttgacggattccgaactcaatag

SEQ ID NO: 217675 - DNA, 1380 bp, Artificial Sequence
  Description of Artificial Sequence: Synthetic coding sequence
atgaagaggaagtctgagaggcgcagtagctgggccgcagctcccccttgctctcgcaggtgcagcagcactagccccggagttaaaaagattaggtcctcaacccaacaggacccgagacgaagagatccgcaggatgatgtgtatctggatatcaccgaccgcctctgtttcgccattctctactcccgcccaaagagcgcctccaatgtgcactacttctccatagacaacgagttagaatacgagaacttttatgccgatttcggacctctgaatctggcaatggtgtatcggtattgttgcaaaatcaacaaaaagcttaaatctataaccatgttacgaaaaaagattgtgcattttactggatctgaccagcgcaagcaggccaatgccgcatttcttgtagggtgctatatggtcatctatttaggaaggacacccgaagaggcataccgaatcctgatctttggagaaactagctacattccttttcgggatgctgcatacggatcttgcaacttctacataaccctccttgattgctttcacgccgtcaagaaggccatgcagtatggtttcctgaacttcaatagctttaacctggatgagtatgaacactacgagaaagccgaaaatggcgatctcaactggattattcctgataggttcatagccttttgcgggccacattcgcgagctcgtctggaatctggttatcatcagcacagcccagagacctacatccagtattttaagaaccacaacgtcactactattatacggctgaataagagaatgtatgacgcgaagaggttcactgacgcgggttttgatcaccacgacttgttcttcgccgatgggagcacccccacagacgctatagtgaaggaattcctggatatctgtgaaaacgcagaaggggcaatagctgttcattgtaaagcagggctgggtaggaccggaaccctgatcgcctgttacattatgaagcactatcgtatgacagccgctgagaccatagcttgggtaagaatctgcaggcccggttcggttatcggcccacagcagcagttcctggtcatgaagcaaactaacctgtggcttgagggagactactttaggcaaaagctaaagggacaggagaatggtcaacatagagctgcattttctaaattgcttagcggggtagatgatatcagcattaatggagtcgaaaatcaggaccagcaggaacccgaaccctattccgatgacgacgagattaatggcgtcacccagggggaccgtctaagggccctcaagagccggaggcagagcaagactaacgctatcccactgactctgagcataagccgtacgaagactgtgctccgctag

SEQ ID NO: 217676 - DNA, 1497 bp, Artificial Sequence
  Description of Artificial Sequence: Synthetic coding sequence
atgaagagaaagtccgaaagaagatcttcatgggccgctgctccaccatgtagcagaaggtgtagcagcacatctcctggtgtcaaaaagatacgatctagtacacagcaggatccacgccgacgcgaccctcaggatgacgtttacctggacataactgatagactgtgtttcgcaatcctttacagcagacccaagtcagcatcgaatgtgcactatttctccattgacaatgaactcgagtatgaaaacttttacgcggacttcggtccactgaatttagccatggtttaccgctactgctgtaaaattaacaagaagctgaagtccattacgatgttgcgtaaaaagattgtgcattttaccgggtcggatcaaaggaaacaagccaatgccgcttttttggtgggatgctatatggtgatttacctcggaagaaccccagaagaggcataccgtatcctgatcttcggagagacctcttatatacctttcagagatgccgcttatgggagctgcaatttctatatcaccctccttgattgtttccatgcggtgaaaaaagcgatgcaatacggatttctgaactttaattcttttaatctcgacgagtatgagcactatgagaaggcagagaacggggacctgaattggattatccctgaccggttcattgccttctgcggcccacattcccgggctcggttagaatctgggtatcaccaacattctcctgaaacctatattcaatactttaagaaccataatgttactaccattatccgcctcaataaaagaatgtatgacgctaaacgattcaccgatgccggttttgatcaccatgatctattttttgctgatggatcgaccccaaccgatgcgattgttaaagaattcctggatatctgcgagaacgcagagggtgccatcgctgtccactgcaaagccggtctgggacggaccggtactctaattgcatgttacattatgaaacactacaggatgacagccgctgaaacaatcgcctgggtccgaatttgccgcccagggtccgtcattggcccacaacagcaatttctggtgatgaaacagaccaacttatggcttgagggtgattacttccgccagaagctcaagggccaagaaaacggacagcacagggccgcttttagcaaactgctgtccggcgtagacgacatcagtattaacggcgtcgaaaaccaggaccagcaggagcctgaaccgtactctgatgatgacgagatcaatggtgtgacccagggagaccgattgagggctctgaagagtcgccgtcagtcaaaaacaaacgctattccactcaccgtcatcttgcagagttctgttcaaagctgcaaaaccagcgaaccaaatatttctggcagtgccggtatcactaagagaacaacccgctcagcctctcgcaagtcttctgtcaaatccctttccattagtagaacgaaaacagtcctgcgatag

SEQ ID NO: 217677 - DNA, 1386 bp, Artificial Sequence
  Description of Artificial Sequence: Synthetic coding sequence
atgtcaagggaaggtgccggtgcagcactagtagctgaagttattaaagacaggctgtgctttgctattctgtattcccgtcccaaatctgcttctaatgtacattatttttcgattgacaatgagctcgaatacgagaatttttacgctgacttcgggccactgaacctggctatggtatatcgatactgctgcaaaataaataaaaagctgaaatcaattactatgctgaggaagaaaattgtgcactttaccggaagtgatcagagaaaacaggcaaacgccgcattcctcgttggctgctatatggtcatctacctcggcagaactcccgaggaagcctatagaatcctcatattcggggagacaagttacatcccttttagagacgccgcttacggaagctgcaatttttatatcacgctgctggattgcttccatgcggtgaaaaaagccatgcagtatgggtttctcaacttcaactcttttaacctcgatgagtatgaacactacgagaaagctgaaaacggggaccttaattggatcatccccgaccggttcatcgcattctgcggccctcattccagggcaaggctcgaatctggctaccaccagcacagcccggaaacttatatacagtacttcaaaaatcacaatgtgaccacaataattcgcctgaataagagaatgtatgacgcaaaacggttcactgatgcgggattcgaccatcatgacctcttcttcgcagatggatccacccctacggacgcaatagtcaaagaattcctcgatatttgcgagaacgccgagggggctatcgccgtccattgtaaggccggattgggacggaccggaactttaattgcctgctatatcatgaagcactataggatgaccgctgccgagacaatagcctgggtccgaatctgcagacccggtagcgtgattggacctcagcagcaattcctggtgatgaaacaaaccaacctgtggctggaaggcgattacttccgccagaaactgaaaggtcaggagaatggccagcatagggccgctttcagtaaactcctgtcaggagttgatgatatcagcataaatggtgtcgaaaaccaggatcaacaagaacccgaaccatattccgacgatgatgaaattaacggggttacccagggagaccgccttcgggcactgaagtcaaggagacaatccaagaccaacgccattccactcaccgtgatactgcaaagcagtgttcagtcatgcaagactagcgaacccaatatttctggatcagctggaataactaagcgaactactcggtccgcaagccgcaagtcgtcagtcaagagtttgtccatatcccggaccaagaccgttttgaggtag

SEQ ID NO: 217678 - DNA, 1458 bp, Artificial Sequence
  Description of Artificial Sequence: Synthetic coding sequence
atgaagcggaagtcagaacgacggagtagctgggctgccgcaccaccatgttcacgccgttgtagcagcacttcccccggagtgaagaagattcggtcgtcaacacagcaagatccacgcaggcgggaccctcaagatgacgtctacctggacattaccgatagattatgctttgcaattctttacagcagacccaaatccgcttcaaatgtgcactatttctctattgacaacgagcttgagtacgagaatttctatgctgactttggccctcttaaccttgccatggtgtacaggtattgctgtaaaattaacaaaaaactgaagagcattactatgcttagaaaaaagattgtgcacttcaccggatccgatcagcgtaaacaggctaacgccgcatttctggtgggctgctacatggtgatttacctcggcaggactccggaggaggcataccgtattctgatctttggcgagacatcatacattcctttccgggacgccgcatatggatcttgcaatttctatatcacccttctggactgctttcacgcagtgaaaaaggccatgcagtatgggtttctgaatttcaatagcttcaacctcgacgaatacgagcattacgagaaggcagagaacggcgatctcaactggatcatccccgataggttcatagcgttttgcggacctcatagccgagcaaggttagagagtggatatcaccagcacagccccgaaacgtatattcagtacttcaagaatcacaacgtgaccactataataagactgaacaagcgtatgtatgatgctaaaagatttacagatgcaggctttgatcatcacgatctgttcttcgccgacggatcaacgcctacagacgccatagtgaaagagtttctcgacatctgtgaaaacgcagaaggcgcaattgccgtccattgtaaggccggtctcggccgtacaggtaccctaatcgcatgttatatcatgaaacattacagaatgaccgcagcagaaactatcgcctgggtgaggatctgtcggcctgggtccgttatagggcctcagcagcagtttctggtcatgaagcaaaccaacctgtggttagaaggtgattacttccgacaaaagctaaagggccaggagaacgggcagcacagggctgccttctctaagctattatccggggtggatgacatctcgataaatggggtggagaaccaggaccagcaagagcctgagccttattctgacgacgatgaaatcaatggggttacccagggcgatcgcctgcgagcgctgaagagtaggcggcaatccaaaaccaatgccatccctctgacgtgccctctggccgtcctgacttctgcactctgctcggtggtgatttggtggattgtttgcgattatatactgccaatcttgctgttctgcctggatggatttcgcacgcagtag

SEQ ID NO: 217679 - DNA, 5345 bp, Artificial Sequence
  Description of Artificial Sequence: Synthetic coding sequence
atgtcaggagaggtgaggttgagacagctagagcagtttatcctcgatggacccgcacaaaccaacggacagtgtttcagcgttgagacattgttggacattctgatatgtctgtatgacgagtgcaacaactcaccactgagacgcgagaaaaatatcctcgaatacctggaatgggcgaaaccctttacatcaaaagtgaaacagatgcgactgcaccgggaggattttgagatcctgaaagtgattggacgcggagcttttggagaagttgcggttgtgaagttgaaaaacgctgacaaagtattcgccatgaagatacttaataaatgggagatgctgaaaagggctgaaaccgcctgttttcgagaggagcgagacgtgctcgtaaatggtgacaacaaatggattactaccctgcactacgcatttcaggacgataacaatctgtacctggtgatggactattatgtcgggggagaccttctgactttgctgagtaaattcgaggacagactacccgaagacatggcgaggttctacttagccgagatggtaattgccatcgacagtgtccaccagttgcattatgtgcacagagacattaagcctgataacatcttgatggatatgaatggtcacatccgcctcgccgacttcggctcttgcctgaaattgatggaggatggcacagtgcagtccagtgtcgccgtggggaccccggactacatctcgcctgagattctccaggccatggaggacggaaaaggacgatatggtcccgagtgtgactggtggtctctgggggtttgcatgtatgagatgctctatggtgagacccccttttatgccgaaagcctcgtggagacatatggaaagattatgaaccataaagagcggtttcaatttcctgcgcaggtcaccgacgttagtgaaaacgcaaaggacctcattcgacgcctgatctgtagcagggaacatcggctcggacaaaacgggatcgaggattttaagaaacacccctttttctctggtatagattgggacaacatcaggaactgcgaggccccatatatacccgaggtaagcagtccgactgatacgagtaactttgacgtcgacgatgattgtctgaaaaatagcgagacaatgcccccacctacacacacggccttctccgggcatcacttaccatttgtcggcttcacttacacatcttcctgcgtcctctccgatagatcatgcctgcgcgtcactgcagggccaaccagcctggacttggacgtaaatgtgcagcgaaccctcgacaacaatctggctaccgaagcgtatgagaggaggataaagcggttggaacaggagaagctggaactgagcagaaaactgcaggaaagtacccaaaccgtccaggctttacagtactctacagtggacgggcctttgaccgcttccaaggacctggagattaaaaacctgaaggaggagattgaaaaactgcggaagcaagtgaccgagtcatcccacctggagcaacaactggaggaagccaacgcagttcgccaggaactggatgatgccttccgccagataaaagcatacgagaagcaaattaaaacgctgcagcaggaaagagaagatttaaataaggaactggtacaggcttctgaacgcctgaaaaaccagtcgaaggagttgaaagacgcccattgccagcggaaactggcaatgcaggaatttatggaaattaacgaacgtctgacggagcttcatacccagaagcaaaagttagccagacatgtgagagataaagaggaggaggtggatttggttatgcagaaggtggagtcactccgccaggaactccgaaggaccgaacgtgctaagaaagaactggaagtccatacagaagcattagcggcagaagcctcgaaggacaggaagttgcgggaacagtcagaacactactccaaacagctcgaaaacgaactcgaaggcttaaagcagaagcagatttcatactcccccggagtgtgctcaatcgaacaccagcaggagatcaccaagctgaaaaccgaccttgaaaagaaatctatcttttacgaggaggaattatcaaaacgggaggggattcacgctaacgagattaaaaatctgaaaaaagaactccacgatagtgagggccagcagctcgccttaaacaaagagataatgattctcaaagacaagctggagaagacgcggagagagtcccagagcgaacgcgaagagtttgaatcagagttcaagcagcaatacgagcgggagaaagtgcttctcacggaggaaaacaaaaagttaacatctgaattggataagctcacaacactttacgaaaacctgtctatccataaccagcaactcgaggaggaggtaaaggacctggccgataagaaagagagcgtggcccactgggaggcacagataaccgagattattcagtgggtcagcgacgagaaagatgcccgaggctatctgcaggcacttgcatctaaaatgacggaggaactggaggccttaaggaacagctcgctgggaactagagcaacggatatgccatggaaaatgagaaggtttgcgaaacttgacatgagtgccaggctggagttacagagtgcccttgacgccgagatcagggccaaacaggcaatccaggaagagttgaacaaagtcaaagctagtaatatcatcacagagtgcaagctgaaggacagtgaaaagaaaaacctcgagctgctatctgagatcgagcagctgatcaaagacacagaagagctgaggtctgaaaaaggaatcgaacatcaggactcgcagcactcttttttggccttcttgaacacaccaacagatgcacttgatcagtttgagactgtcgattctacgcccctatcggttcacactcctacactccggaagaaggggtgtcccggtagcacaggattcccacctaagcgcaagacccatcagttcttcgtaaagtcctttacgaccccaacaaaatgccaccagtgcaccagcctgatggttggcttaatcagacagggatgcagctgtgaagtgtgcgggttcagctgccatatcacatgtgtgaacaaggccccaacgacgtgccctgtcccacctgagcagactaagggccctctaggcattgatccccagaagggaattgggaccgcatatgaaggacatgtgcggattccaaagccagcaggggtgaaaaaggggtggcagcgggcattggccatcgtgtgcgactttaagctgtttctctacgacatcgctgagggcaaggcatcacagccatcagtcgtgatcagccaggtgattgatatgcgtgatgaagaattttctgtcagctcggtgctagcgtcggatgttatccacgctagtcgcaaagatatcccatgtatcttcagagtcaccgcatcccaactgtccgcctctaataataagtgcagtatacttatgcttgccgataccgagaacgaaaagaacaaatgggtcggagttttgtccgaactgcacaaaatcctaaagaaaaataaattccgagatcgctccgtctatgtgcccaaggaagcatacgacagtactctccccctaattaaaactacccaggccgctgctattattgatcacgaacgcatcgccctgggaaacgaagagggccttttcgtggtccacgtcacgaaggatgagatcatcagggtgggcgataacaaaaagattcaccagattgagctcattccaaatgaccagctggtggctgtcatctcaggtagaaatcggcacgtccggctattccccatgtccgctcttgacggcagggaaacggatttctataaactgtccgagaccaaagggtgtcagacagtcacctccgggaaggtaaggcacggcgcactgacgtgcctctgtgtggcaatgaaacgccaagtactgtgctacgaattgtttcagagtaaaacaagacaccgtaaattcaaggagatacaagtgccttacaatgtccagtggatggcgatcttcagcgaacagttgtgcgtggggttccaatccggatttctgcggtaccctctgaacggcgagggtaacccgtatagtatgctgcactccaatgatcacactctttctttcatcgcccaccagccaatggatgccatctgcgccgtagaaatctctagcaaggaatacctcctgtgttttaatagcatcggaatttacacggactgtcagggcagacgctcccggcagcaggaactgatgtggccagctaatccctcaagctgttgttataacgccccttatttgagcgtatactctgagaatgcggtcgatatatttgatgtcaatagtatggaatggatacaaacgctgcccttgaagaaggtcagaccccttaacaacgaggggtcattaaacctgctgggactcgaaactatacggctgatttattttaagaacaaaatggccgagggggacgagcttgtggttcccgagacatcagataattcccggaagcaaatggtgcgaaacataaataataaaaggcggtacagtttccgtgtccccgaagaggagagaatgcagcagagacgggagatgttgagggacccagaaatgcgcaacaagttgatttcaaacccaaccaattttaatcatatagcgcacatgggaccaggagatggaattcagatattgaaggatctgccgatgccagggttcccctatccttctcctcaccatcactcaggactaatcagcagccccatcaacttcgaacacatttaccacatgaccgtgaactccgccgagaagtttctcagcccagattccattaacccagagtactcaccctccttaaggagcgttcccggtaccccatcattcatgacacttagaaaccccagaccccaagagtccagaaccgtgttcagtggctccgtctctattccgagcattacaaaatccaggcccgaacccggtcgctcgatgagcgcctctagcggactatctgcgagaagctctgctcagaatggatccgctctcaagcgggagttttctggcggaagttacagcgccaaaagacaaccgatgccttcaccctctgagggcagcctgtccagcggaggaatggatcagggttctgacgcacccgctcgcgacttcgacggggaagactctgactcacccagacactcaacagcttcgaattcgtctaacctgagttcgcctccctcccccgcaagccccagaaagaccaagtctctttctctggagtccaccgacagggggagctgggatcctta

SEQ ID NO: 217680 - DNA, 2457 bp, Artificial Sequence
  Description of Artificial Sequence: Synthetic coding sequence
atgattttgaaggataagctggagaaaacccgtagagaaagccagtccgagagagaggaatttgagtctgaatttaagcaacagtacgaaagagagaaagtcttgctgaccgaagagaataaaaagctgacttcagagcttgacaaattaaccacattgtatgaaaatctgtctatacacaatcaacagctggaagaagaagtcaaagacttggctgacaaaaaagaatctgttgcccactgggaggcacaaattacggaaatcatccagtgggtgtctgatgagaaagatgcgagaggctatctgcaggccctcgcctctaagatgaccgaagagttggaagcgctccgaaactcgagcctggggactcgagcaactgacatgccctggaaaatgcgcaggtttgctaagcttgatatgagtgctcggcttgagctccagtcagctctggacgccgagatcagagccaagcaggcgattcaagaggagctgaacaaagtaaaggcctccaatattataaccgaatgtaaactcaaagattcggagaaaaagaacttagaactactcagtgagattgagcagctaatcaaagatactgaggagctccgttccgagaaagggatcgagcatcaggactcccaacactcttttctcgccttcttaaacacacctaccgatgctttggatcagttcgaggattcattttcctcttcaagtagttctctgatagatttccttgacgacaccgatcccgtggagaatacctatgtgtggaatccaagcgtgaaattccatatccagagcaggagcacctccccaagtacatctagtgaagctgaaccagttaaaaccgtggattccaccccactgagcgtgcacacgccgactctgcgtaagaaggggtgcccagggagcaccggcttccccccaaagagaaagacacaccagttcttcgtcaaaagttttaccacacccaccaagtgtcatcaatgtacctccctgatggtgggactgatcaggcagggctgcagctgtgaagtctgcggcttttcttgccacatcacttgcgtgaataaagcgccaaccacttgtcctgtccctcctgaacagaccaagggtccgctgggaatcgaccctcaaaaaggcatcggaacagcctatgagggccacgtgcggatccctaaaccagctggggtaaaaaaaggctggcaaagagcgttggccattgtctgcgatttcaagctgttcttatacgacatcgccgagggtaaagcttcccaaccttctgtggttatttcacaggtcatcgatatgcgtgacgaggagttctcagtgtcatccgtgctggctagtgacgtgatccacgcgtcgcgaaaagacatcccctgcattttcagggtgaccgcctcacagctgagcgcttcaaataacaagtgctccattctgatgttagccgacacggaaaatgaaaagaataaatgggtgggagtgctctcagaactgcataagatcctgaagaagaataaattcagggatcggtcagtctatgtgccgaaggaagcatacgacagcacactccccctcattaagacaacccaggccgctgctatcattgatcatgagagaattgccctgggaaatgaggagggtctgtttgtcgtccacgtcaccaaggatgaaattatccgggtgggcgataataaaaaaattcaccaaatcgagctgattccaaatgatcagcttgtggccgtgataagcggaagaaatcgccatgtgcgtctcttcccgatgtcagccttggacggcagagaaaccgatttttacaagcttagcgaaacaaaaggatgtcagactgtaaccagcggtaaggttcggcacggtgccctcacctgcctttgtgttgccatgaagcggcaggtactgtgttatgagctattccaatcaaaaacccggcatcgcaaattcaaggagattcaggtgccctacaatgtgcagtggatggctattttctccgagcaactatgtgttggatttcagtcaggcttcctgcgttaccctctaaatggagagggaaatccttactccatgcttcatagcaacgaccacactttgtcttttatagcgcatcagcctatggacgccatttgcgccgtggagatatcgagcaaagaatacctgctttgctttaatagcatcggtatctacaccgactgccagggacggagaagtaggcagcaggaactcatgtggccagctaaccctagcagctgctgttacaatgccccttatctctcagtctactctgagaacgccgtagatattttcgatgtgaacagtatggagtggatacagaccctacctctgaagaaggttcgaccccttaataatgaaggaagcctgaatcttctcggattggagaccattcgcctgatctactttaagaataagatggcttag

SEQ ID NO: 217681 - DNA, 5075 bp, Artificial Sequence
  Description of Artificial Sequence: Synthetic coding sequence
atgagcggtgaggtgagactgaggcagctggagcagttcatcctggatggccctgctcagactaatggccagtgcttttctgtcgagaccctgctcgacattctgatttgtctttatgacgagtgcaataactcgcctcttcggagagagaaaaacatccttgagtatctggagtgggcaaagcccttcacgtctaaggtcaagcagatgagattacatcgggaggacttcgagatcttgaaggtgattggaagaggtgctttcggagaagtcgcggtggtgaaactgaaaaatgctgacaaggtgttcgcgatgaagatactcaataagtgggagatgctgaaacgagcggaaacagcttgcttcagggaggagcgagacgtgctcgtcaatggggataataaatggatcactaccctgcactacgcctttcaagatgacaacaacctttatttggttatggattattatgtgggcggagatctattaacactgctcagtaaatttgaggaccgcttgcctgaagacatggcccgattctacctggccgaaatggtcatcgccattgatagcgtgcaccagctgcattatgtccacagagacatcaagccagataatatccttatggatatgaatggacatattcgcctggcagacttcggctcctgtctgaagctgatggaggatggaacagtgcaatcctcggtggccgtgggaacccccgattatatttctcctgagatcctccaggcaatggaggatggtaagggacggtacggaccagaatgcgattggtggtcacttggggtttgcatgtacgaaatgttgtacggagagaccccattttacgctgagagcctggtggaaacatacggtaaaattatgaaccataaggagcgcttccagtttcctgcccaagtaacagacgtgtccgagaatgctaaggaccttatccgccgattaatttgctctagggaacaccgactgggacagaacggcatcgaggatttcaagaagcatccattctttagtgggatcgactgggacaatatcaggaactgtgaggctccatacatccctgaggtgtcatcacccaccgatacatctaatttcgacgtggacgacgactgtctgaagaacagcgagacaatgcctccacccacccataccgccttctcgggtcatcacctgccattcgtgggctttacatacacgagttcctgtgtcctgagtgataggagctgtttgagggtcaccgctggtcctacaagtttggatctggatgtcaatgttcagcgaaccctcgataacaaccttgccacagaggcatacgagcgacgtatcaaaaggcttgagcaggaaaaattggaattgagtaggaaactgcaggaatctactcagaccgtgcaggccttgcagtattctacagtagacggcccactgacagcctctaaggatctggagataaaaaacctgaaggaggaaatagagaaactcaggaagcaggtgacagagtcaagccacttggagcagcagttggaggaagctaacgctgtgcgccaagaactagacgatgcctttcgtcaaataaaagcatatgaaaaacagatcaagactctgcagcaggagcgggaagatctaaacaaggagctggttcaggctagcgaaagactcaagaatcagtctaaagagttaaaggacgcccactgccaaaggaagttggcgatgcaggaattcatggaaatcaacgagcgtctcacggaactgcacactcagaagcagaagctggcaagacatgtccgagataaggaggaggaggtggaccttgtgatgcagaaggtggagtctttgcgccaggagctccgtagaacagagcgcgcaaaaaaggaactggaagtgcacactgaagctctggccgcagaagcctcgaaggaccgaaagttgcgggaacagtccgagcactactccaagcaattggagaatgagctggagggccttaagcaaaaacagatctcttattcacccggagtttgttcaattgagcatcagcaggaaattacaaagctgaagaccgatctcgagaaaaagtccatcttctatgaggaagagctctctaaaagagaaggaatacacgctaatgagatcaagaacctgaagaaggagctccacgacagcgagggccaacagctggctctgaacaaggaaataatgatcctgaaggataagctggagaagacacgtagagaaagtcagtcagagagggaggagttcgagagcgaatttaagcagcaatacgagagagaaaaagtcctcctgaccgaggagaacaaaaaacttacatccgagttggacaagcttactaccctgtacgagaatctcagcattcataaccagcaacttgaagaggaggtcaaggatctggccgacaaaaaggagtccgtcgcccactgggaagcccagatcaccgaaatcatccagtgggtctctgacgaaaaagacgcaagaggctaccttcaagcactggcttctaagatgacagaggaactggaagccctgcgcaattcatcattagggacgcgagccaccgatatgccgtggaagatgcgaaggttcgctaaacttgacatgtctgccagactcgagcttcagagcgccctggatgccgagattcgggctaaacaggcaatccaagaggagctcaataaggtaaaggctagcaatatcatcacagagtgtaagctcaaagacagcgagaaaaagaacctggagttgttgtctgagatcgaacaacttatcaaggacactgaggagttacgtagtgaaaaaggtattgagcatcaggattctcagcattcatttttagcgttccttaacacccccacagacgccctggatcagttcgaacgaaaaacccaccagttctttgtcaagagtttcaccacacctacaaaatgtcaccagtgcaccagcctgatggtagggctcatcaggcaggggtgcagctgcgaggtgtgtggattttcctgtcacataacctgtgttaacaaggcaccaacgacttgtcccgtcccccctgaacagaccaaggggcctcttgggatcgacccgcagaaaggaatcggcacagcatatgagggccacgtgcggatccctaaacctgccggtgttaaaaaggggtggcagagagccttagctatcgtgtgcgactttaaattgttcctgtatgatatcgcggaagggaaagccagccaacctagcgtggtgatttcgcaggtgattgatatgagggacgaggaattttcagtgtcaagtgtgctggcttctgatgttatccacgccagccgcaaggatattccatgtatctttcgcgtcaccgcaagccagctgtcagcaagcaataacaaatgttctatcctgatgctggctgacacagagaacgagaaaaacaaatgggtgggcgtcttatccgagctgcataaaatactgaaaaaaaataaattccgggaccggagcgtgtatgtgcccaaggaggcctacgatagtactctgccactgatcaaaacgacacaggcggctgcaatcattgaccacgagcggatagcactggggaatgaagaagggctctttgtggtgcacgttactaaggacgagatcatccgagtgggtgataataagaagattcaccagatcgagttgattcccaacgatcagttagtggcagtaatttctgggcgtaacaggcatgtgcggttgttcccaatgtcagcgcttgatgggagagagaccgacttctataagttaagtgaaactaagggctgccagaccgtgacctccggtaaggtgcgccacggcgctctcacatgtctgtgtgttgccatgaagaggcaggtgctttgctacgaactgtttcagagtaaaactcgccataggaagttcaaggaaatccaggtgccatacaatgtgcagtggatggccatcttttccgagcaactctgcgtagggttccagtcaggcttcctccgctatccactgaacggagagggaaatccatactctatgttgcatagcaatgaccacacactaagctttattgctcaccagcctatggacgccatctgcgctgtcgagatctcttccaaagaatacttattgtgtttcaactccattggcatttataccgattgtcaaggtcggcgttcccggcagcaagaattgatgtggccggcaaatcctagtagttgctgctacaacgctccctatttatccgtgtacagtgaaaacgccgtagacatctttgatgtgaactccatggagtggatacagaccctgccactgaagaaagtgaggccactgaataatgaaggaagtctgaatctgctgggcctggagacaataaggctgatttacttcaagaataagatggccgaaggagatgagcttgtggtgcctgagacaagcgacaatagccggaaacagatggtgcggaacatcaataataagcgacggtatagtttcagggtcccggaagaggagagaatgcagcagaggcgcgaaatgctgagggaccccgagatgagaaataagctgatctcaaatccaaccaactttaatcacatcgcccatatgggccctggggacgggatccaaatactgaaggatcttcctatgaatcctcggccacaggagagccggacagtcttctcaggatcggtaagcatacctagcataacaaagagccgtcccgagccgggacggtcaatgtcggctagtagtggcttaagtgccaggtctagcgcgcagaatggcagcgcgctcaaaagggaattctcgggaggcagctactccgctaaacgccagccaatgccctccccatcggagggctcgcttagcagcggcggaatggaccaaggaagcgacgctccagcgagggacttcgatggagaagacagtgattctccccgacattcgacagctagcaatagctctaatctgtcttcacctccttctcccgcttcaccccgaaagaccaagtctttatccttagagtctaccgacagggggtcctgggatccata

SEQ ID NO: 217682 - DNA, 5198 bp, Artificial Sequence
  Description of Artificial Sequence: Synthetic coding sequence
atgtcgggggaagttcggctacggcaattagagcagtttattctggacgggcctgcacaaaccaatgggcagtgcttctcagttgaaacactgcttgatattcttatctgtctgtacgacgaatgcaacaactctcccctccgccgagagaagaatatattggagtatctggagtgggctaagccattcacttccaaagtgaaacagatgcggctccacagggaagacttcgagatattaaaggttatcggccgtggggcttttggtgaagtggctgtggtcaagctgaagaacgccgataaggtgtttgcaatgaaaatcctcaacaagtgggagatgctaaagagagctgagacagcttgttttcgagaagaacgggacgtgctggtcaacggcgataataagtggatcacaacactccattacgcctttcaagatgacaacaacctgtatctggttatggattattatgtgggaggcgacctcctcacacttctcagcaaattcgaagatagactacctgaagacatggccagattttacttagctgagatggtgatcgctatcgactccgtgcaccagctacattatgtccatcgggatatcaagcctgacaacatacttatggacatgaacggacatatcaggctcgcggacttcggcagctgtttgaagctcatggaggatgggaccgtgcagtcatcagttgccgtgggtacgcctgactacatatccccagaaatcctgcaggccatggaagacggcaagggtcggtatggcccagagtgcgactggtggagtctgggggtatgcatgtatgagatgctttacggcgagacacccttttatgcggagagccttgtggagacctacggaaagattatgaaccacaaagagaggttccagtttccggcacaagtgactgatgtctcagagaacgccaaagatctgatacgcaggttgatttgctcacgagaacacagactcggacaaaatggcattgaggactttaaaaaacatcctttcttctcaggaattgactgggataacatcagaaattgtgaggccccttacattcctgaagtgagtagccctacagacacaagcaattttgacgtggacgacgactgcctcaaaaactccgagacaatgccccctccgacccatactgcgttctcaggtcatcatttaccgttcgttggattcacgtacaccagcagttgtgtactctctgaccgaagctgcttgagggtcactgctggacccacctcactggatctcgacgtgaatgtccagcgaaccctcgacaacaatctggccaccgaagcatacgagcgcaggatcaagcggcttgagcaggagaagcttgaactatctcggaagctgcaggagtccactcaaacagtccaggcccttcagtactcgacagtagacgggcctttaacagcttccaaggatctggagattaaaaatctgaaggaggagatcgagaaactgcgaaagcaggtcacagagtcctctcacttggaacagcaacttgaggaggctaacgccgtgcgccaggagcttgacgatgcattccggcagataaaggcgtatgagaaacagataaagacccttcaacaagaaagggaggatctgaataaggagctggtacaggcctccgagaggctgaagaaccagtcaaaagagctcaaggacgcacattgtcagaggaaactcgctatgcaggaatttatggagatcaatgaaagactgaccgagcttcacactcaaaagcagaagctggcacggcacgtgcgtgataaagaggaggaagttgacttggttatgcagaaagtggaatctctgagacaagagcttcgtagaactgaacgcgctaagaaggagctcgaagtgcataccgaagccctggctgctgaggcatccaaggaccggaaactccgggaacaaagtgagcattacagcaagcagctggaaaacgaattagagggcttgaagcagaagcagatcagttacagtcctggcgtgtgttcaatcgagcaccagcaggagatcactaagctgaagactgatctcgaaaaaaaatcaatcttctacgaggaagagttgtctaagagagagggcatccacgccaacgagataaaaaacttaaagaaggaattacacgactccgagggtcagcagcttgcgctgaacaaagaaattatgattctcaaggacaagttggagaagacaaggagggagtctcagtccgaaagagaagaattcgaatccgagtttaaacagcagtacgaacgcgagaaggtgttgctgaccgaagaaaataaaaagctaactagcgagctggacaaactcaccaccctttacgagaacctttctatacataatcagcagctggaggaagaagtgaaagacctggccgacaaaaaggagagcgtggctcattgggaggcacagattacagaaattatacagtgggtctcagacgaaaaggacgccaggggctatttgcaggcactcgcgagtaagatgaccgaggaattggaggcattacggaacagtagtcttggaacacgtgctacggacatgccatggaaaatgcgcagattcgccaaactcgatatgtccgccaggctggagctccagagcgccctcgacgctgaaattagagctaagcaggccattcaggaagagctgaacaaagtcaaagcgagtaatatcattaccgagtgtaagctgaaggactccgaaaaaaagaaccttgaactgttgtccgagatcgagcagctgattaaggacaccgaagagttacgctccgaaaaggggatagaacaccaggactcccagcattctttcctggccttccttaataccccgaccgatgcgctggaccagttcgagcgctctcctagttgcaccccggcaagtaaagggcgacggaccgtggatagcactccattatcagttcacacccctaccctccggaaaaagggttgccccggttctaccggattccccccaaagcgcaaaactcaccagttttttgtgaaatccttcaccactcctaccaagtgccaccagtgcactagcctgatggtgggactgatccgtcagggttgttcttgtgaggtttgtggcttctcctgtcacattacctgtgtcaacaaagcaccaaccacttgtccggttcctccagagcagacaaaagggccactcggcattgacccccagaagggcataggaaccgcctatgaaggccatgtccggatcccaaagccggctggagtcaagaagggatggcagcgcgctctggcgattgtctgcgactttaaactcttcctgtacgacatcgctgaagggaaggccagccagccatccgttgtcatttcccaggtgattgacatgcgcgatgaagaatttagcgtgtcttccgtcctcgccagcgacgtgatccacgcttcaaggaaggacatcccgtgcatcttcagggtgactgccagccaactttctgctagcaataacaaatgttccatcctgatgctcgcggacaccgaaaatgagaagaataagtgggtgggcgtcctgtcagaactccataaaatactcaaaaagaacaagttccgggaccgcagcgtgtacgtgcctaaagaggcctatgattctacactacctctcataaagacaactcaggccgcagcaatcatcgatcatgaacggatcgccctcggtaatgaagaaggtctcttcgtggtacatgtcaccaaggacgaaattattcgcgtaggggacaataagaagatccaccagatagagctgatccctaatgaccagttagtggcagtcatatcaggcagaaaccgtcatgtcaggctgttcccaatgagtgccctggatggccgagagactgacttttacaagctgagcgagactaagggctgtcagaccgtcacctccggcaaagtgaggcacggcgctttaacctgtctgtgcgtggccatgaaacgccaggtcctctgttacgaactatttcaaagtaagacccggcacaggaaatttaaggaaatccaggtcccctacaacgttcagtggatggccattttctccgagcaactttgtgtgggttttcagtctggatttttacgctatcctttaaacggtgagggaaacccttattctatgctgcactctaatgaccacacgctatcattcatcgcacatcaaccaatggatgcaatttgtgcagtggagattagttctaaggagtacctactgtgtttcaattctattgggatctatactgactgtcaggggcgaagatcccgccagcaggagctcatgtggcccgcaaatccgagctcatgctgttataacgctccttaccttagcgtttattccgaaaatgccgttgacatcttcgacgtcaactctatggagtggatccagaccttgcccctgaagaaggtgcgcccactcaacaatgagggctcccttaatctcttgggactggagactattcgcctcatttattttaaaaataaaatggctgagggcgatgagttggtcgtcccggaaacaagtgataattcccggaaacaaatggtcaggaacattaataataaacgacgttactcatttcgggttcctgaggaagagcggatgcagcagcgaagagagatgctgcgtgacccagagatgcgtaacaaactgatcagtaaccccaccaatttcaaccatatcgcccatatggggccaggtgatggtattcaaattctcaaggacctccctatgaatcccaggccccaggaaagccgcacagtattttccggaagcgtgtccattccatctatcacaaaatcaagacctgagccaggcagatcaatgtctgcttctagtgggctctctgctcgctcctctgcccagaacggcagcgccctcaagagagagttctctggaggaagctacagtgcaaaacgccagcctatgcctagcccaagtgagggatcactttcaagcggtggcatggatcagggttctgacgcacccgcaagggacttcgacggagaggacagcgatagccctcggcactccacagcttccaacagctcaaatttgagctcacccccttcgccagctagccctcggaaaactaaatcactgtcactggaaagcactgaccgtggctcttgggatcctta

SEQ ID NO: 217683 - DNA, 5264 bp, Artificial Sequence
  Description of Artificial Sequence: Synthetic coding sequence
atgagtggcgaagtgaggctgcgccaattggagcagttcatcctggacggtccagcacagaccaatggtcagtgtttttccgtggagacactgttggacatcctcatttgtctctacgatgagtgtaacaacagtcccttgagaagggaaaaaaacattctggaataccttgagtgggcaaaaccctttacctcaaaagtgaagcaaatgagactacatcgggaggattttgagattctgaaggttataggtagaggcgcattcggcgaggtggccgtggtaaaactgaagaacgccgataaagttttcgctatgaaaatactgaacaagtgggagatgcttaaaagagccgaaaccgcatgctttcgggaagagagggacgtgctcgtgaacggtgacaataaatggataacgaccttgcattacgcctttcaggatgacaataacctgtatctggtgatggattattacgtaggcggtgacctgctgaccctgttgtctaagttcgaagacagattgccagaggatatggctaggttctacttggccgagatggtcatcgccatagactcagtccaccagctgcattatgttcacagggacattaagcctgataacattctgatggacatgaacggacatatccggctcgccgatttcgggagttgcctgaagctgatggaagatggcactgtgcagtcctccgtagccgtcggcaccccagactatatcagtccagagattcttcaagccatggaggatggcaaggggagatacggtcctgaatgtgattggtggagcctcggggtgtgtatgtacgagatgctgtacggcgagactcctttctatgcggaatctctggtcgaaacttacggtaaaatcatgaaccataaagaacggtttcagtttcctgcacaggtcaccgacgtgagtgagaatgcgaaggacctgattcgtcgtctcatctgctcgcgggagcatcggctgggtcaaaatggaatcgaagattttaagaaacatccgttcttttccgggatagactgggacaacatccggaactgcgaggctccatacattcctgaggtgtcttctcccactgatacaagtaatttcgatgtagatgacgattgccttaagaattctgagaccatgcctccacctactcacactgcctttagcggccaccatctcccatttgtaggcttcacttataccagctcctgcgtcttaagcgacagatcctgcctgcgagtgactgctggccctacctcactggaccttgacgtgaatgtgcaacggaccctagataacaacttagccaccgaggcctatgagaggcgcattaagcgactcgaacaagaaaaattggaactgtcaaggaagctgcaggagtctacccagaccgtgcaggctctccagtattccaccgttgatggcccattgactgcctccaaagatctggaaatcaagaaccttaaagaggagatcgagaagttgcggaaacaggtgaccgagtcgagccatctagagcagcagctggaagaagcgaacgcggtccgtcaagaactcgacgacgcgtttcgacagattaaagcatacgaaaagcagatcaaaacgctgcagcaggagagagaggacctgaataaagagctggtgcaggcctccgagagactgaaaaaccagagtaaagagctgaaggacgctcattgccagcgtaagctggctatgcaggaattcatggaaatcaacgagcgtctgacggagctccacacacagaaacagaaacttgcaagacacgtacgcgacaaagaagaagaggtagacctcgtcatgcagaaagttgaatccctccgacaggaactgaggagaaccgagagggccaaaaaggaactggaggtgcataccgaagccctggcggcagaggcatctaaggacagaaagctgagagagcagtccgaacactatagcaagcagctggaaaacgaactggagggtttgaagcaaaagcagatttcatatagtcctggtgtgtgcagtattgaacatcagcaggagatcaccaagctgaagacagatcttgaaaagaagagcatcttttatgaagaagagctctcaaagagagagggcatccacgccaatgaaatcaaaaacctcaagaaagagctgcacgactccgaggggcagcaattggcgctgaataaggaaattatgatcctgaaggacaagctagagaaaaccagacgcgaaagccagagcgaacgcgaagagttcgagagcgaattcaagcagcagtatgagcgcgagaaggttctcctaactgaggagaacaagaagcttacctcagaattggacaaactgacaactctctatgaaaacttatcaattcataatcaacaacttgaggaggaagtgaaggacctcgcagataaaaaagagtcagtcgcgcattgggaggcccagatcacagaaattatccagtgggtgagcgatgagaaagatgctagagggtatctgcaagccctggcgagcaagatgacagaggaactcgaggccctgcgtaattctagtttgggaacaagagccaccgacatgccttggaagatgcggagattcgctaagctcgacatgtccgcaagactggaactgcaaagcgccctggatgccgaaatacgggcaaaacaggcaatccaagaggaactgaacaaggttaaagcatcaaacataataactgagtgtaaactgaaagattctgaaaaaaagaacttggagctcctgtcagagattgagcagctgataaaggacactgaagaactccgcagcgaaaaagggatagagcaccaagactcccagcatagcttcctggcctttctcaacactccaacggacgcactagaccagttcgagaccgatccagtggaaaacacttacgtgtggaatccaagtgtcaaatttcatattcagagcaggtccacatccccctctacctcgagtgaagccgagcctgtcaagacggtggactccacccccctcagtgtgcatacacccaccctgaggaaaaaaggatgccccggatctacaggtttccctcccaaaaggaagacccatcaattttttgtaaaaagtttcacaacaccaaccaaatgccaccagtgcactagcctaatggtgggactgattcgtcagggttgtagttgcgaagtgtgcggcttttcctgtcacatcacgtgtgtaaacaaggcacctaccacatgcccagtccctccagaacaaaccaagggacccctgggaatcgatcctcagaaaggtatcggcaccgcctatgaaggacacgtgcgtattccaaagcccgcaggagtgaagaaaggctggcagagagcactggccatagtgtgcgattttaagttatttttatacgatattgcagagggtaaagccagccagccttccgtggtcataagccaggtgattgacatgcgagacgaagagttctcagtatcctcggtgttggcatccgacgtgatccatgcctcccggaaggatattccgtgtattttccgcgtcaccgcctcccagcttagcgcctcaaacaataagtgctctattctaatgcttgccgacactgaaaacgagaagaataagtgggtgggcgtactttccgaactgcacaagatcctcaaaaagaacaaatttcgcgatagatcagtctacgtccctaaagaggcctacgacagtactttgcccctcatcaagaccacacaagccgcagcaatcatcgatcatgagaggattgccctggggaatgaggaaggtctgtttgttgtacacgtcacaaaagatgagatcataagggtgggggataataaaaagatacatcaaatcgagctgatcccaaacgatcagctggtggcagtcatcagcggcagaaaccggcacgtgcggctgttccctatgtccgctttagacgggagggaaacagacttctataagctgtctgagactaaggggtgccaaaccgtgacaagtggcaaggttcgtcacggggctctcacatgcttatgtgtcgccatgaagaggcaggttctctgttacgagctgtttcaatctaagacgcgacaccgtaaatttaaagaaatccaggtgccatataacgttcagtggatggccattttttctgaacagctatgcgtaggattccaatctgggtttcttcggtaccctcttaatggagaaggtaatccttattctatgcttcatagtaacgaccacactctgtctttcatcgctcaccagcccatggacgcgatttgcgcagtggagatctcaagtaaagagtacctcctgtgcttcaactccatcggtatctacaccgactgtcagggccgtaggagccgtcaacaggagctgatgtggccagccaatcccagcagttgttgctacaacgccccatatttaagtgtttactctgaaaacgctgtcgacatatttgacgtcaactcaatggagtggattcagactctccccttgaaaaaagtcagacctctgaataatgaaggatctcttaatctgctggggctcgagacaatacgactgatttactttaagaacaagatggctgaaggagacgaattggtggtgccagagacatcagataactccagaaagcagatggtccggaatataaataacaaacgcagatatagttttagagtgcctgaagaagagcgcatgcagcagaggcgagaaatgctcagggacccagaaatgcgaaataagttgatatccaatccaactaattttaaccacattgcccatatgggccctggcgacgggatccagattttgaaggacctgcctatgaatcctagaccacaagagtcccgcacagtcttttcgggatctgtcagcatccctagcatcactaaaagtcgacctgagccaggcagatccatgagtgctagcagcgggctttccgctcggtctagcgctcagaacggcagcgctctgaagagggagttctctggcggttcgtactctgccaaacgtcagcccatgccctcaccttccgaggggtctctgagtagcggcggaatggaccaaggttccgacgcccctgccagagacttcgatggcgaggatagcgattccccgcgacactccaccgcctctaattcatctaatctgagctctcccccaagtcccgctagtccacgcaagacgaagagtctaagcctggaatccaccgatcggggatcatgggaccctta

SEQ ID NO: 217684 - DNA, 4916 bp, Artificial Sequence
  Description of Artificial Sequence: Synthetic coding sequence
atgtcaggtgaggtccgactccgacagttagagcagttcattctggacggaccggctcagacgaacggccagtgttttagtgtagagaccctgttagacattctaatttgtctctatgacgaatgcaataatagtcctctgcgtcgtgaaaagaacatcctggagtatctggaatgggctaagccatttacaagcaaggtcaagcagatgagattacatcgcgaggacttcgaaatccttaaggtcattggcaggggtgcctttggggaggtggccgtagtgaaactgaagaacgccgataaggtattcgctatgaagattttgaacaaatgggaaatgctaaagagagccgagacagcctgtttccgagaggagagagacgtacttgtcaacggggacaacaagtggatcacaaccttgcattacgcctttcaggatgacaataatctgtacctggtgatggattactatgtggggggtgacctgctaactctgctgagtaagtttgaggatcgtctgccggaggatatggcccgattctatcttgccgaaatggttattgctatcgactctgtgcaccagctgcactatgtacatcgcgacattaagcccgataatatccttatggatatgaacggtcacatcagacttgccgacttcggctcctgtctgaagctaatggaggacggcaccgtgcagtccagtgtggcagtcggaacaccggactacatttcccctgagatactccaagccatggaagatggaaagggcagatacggacccgagtgcgactggtggtcactgggggtatgtatgtacgagatgttatatggcgaaacccccttctacgcagagtcccttgtagaaacatatggcaagatcatgaaccataaggagcggtttcagttccccgctcaggtaacggacgtctccgagaatgccaaagacctcattcggagactgatttgctcacgtgagcatcgcctgggacagaacggaatcgaagattttaagaagcacccttttttctccggaatcgattgggataatattcgcaactgcgaagccccttacataccagaagtttcctccccaactgatacctcaaactttgacgtggatgatgactgcctgaagaactcagagacaatgcccccaccaactcatactgcttttagcggtcatcatctcccattcgtcggctttacatacacctcatcctgcgtactcagtgatagatcctgcttaagagtaaccgcaggcccaaccagtctagacctggatgtcaacgtgcaaagaactctcgacaacaaccttgccaccgaggcctacgagcgcaggatcaaaaggctggaacaggagaagctggagctttctcggaaacttcaagaatctacacagaccgtgcaggcgttacagtacagtaccgtggacggccctttgaccgcgtccaaagacttggagatcaaaaacttgaaggaggaaatcgaaaaactgcggaaacaggtgacagagtcctcccacctggaacagcagctcgaggaggcaaatgcggtgcggcaggagctggatgatgcatttcgccagattaaagcttatgaaaaacagatcaagactctccagcaggaaagggaagacctgaacaaactggaggtgcacacagaagctctggctgcagaagcgagcaaggatagaaagttgcgggaacaaagtgaacactatagcaaacagctggaaaatgaattggagggtctgaagcagaaacaaatcagctacagcccaggcgtgtgctctatcgagcaccagcaggaaattacaaaactcaagaccgacctggagaaaaaatccatcttctatgaagaagagttgtcgaaaagggagggaatccatgctaatgagattaaaaatctgaagaaggaactgcacgattctgaaggccagcagctagccctcaataaggagattatgatcttgaaagacaagcttgagaaaacacgcagagaatctcagagtgaaagggaagaattcgaatcggagtttaagcaacagtatgaacgcgagaaggtactgctgactgaagagaacaaaaaactgacatccgagctggacaagctgaccaccctctacgagaatctcagtatacataatcagcaactcgaggaggaggtaaaagacttggctgacaaaaaagagtcagttgcccattgggaagctcaaatcacagagatcatccagtgggtttccgatgagaaagatgctagaggctatctccaggcgttggcctctaaaatgaccgaagaactggaagccctgaggaattcatcccttgggaccagagccactgatatgccttggaaaatgcgaagattcgccaagttggatatgtcagctcggctggagctgcagtccgctttagatgcagaaattcgcgcaaagcaagctatccaggaggagctcaacaaggtgaaggccagcaacatcattacagagtgcaagctcaaagactcagagaagaaaaaccttgaactactctctgaaattgagcagttgatcaaagatacagaggaactccggagcgaaaagggaatcgagcaccaggacagccagcattcttttttggcattcctgaatacaccaactgatgccctcgatcagtttgaaacagtggattcaacccctctgagtgtgcatacaccaacgctgagaaagaagggatgtcccggtagtaccggatttccccctaaacggaaaacgcaccagttcttcgtcaagtcctttaccacacccactaagtgccaccagtgcaccagcttaatggtcggactaattcgtcagggctgttcctgcgaggtgtgtggttttagctgtcacatcacatgtgtgaacaaagcaccaacaacatgtcccgtccccccagagcaaaccaagggccctctgggtattgatccccagaagggcataggaactgcatacgagggtcacgtcagaataccgaaacccgctggagtgaagaagggctggcaaagagccctggccatagtgtgtgattttaagttgttcttgtacgatatcgctgagggaaaggcttcacagccatccgtggtcatttcccaagtgattgacatgcgtgatgaagaattcagcgtgagttctgttctggcttcagacgtgatacacgcatcccgaaaggacatcccgtgtatcttcagagtgacagcttcccaactgagcgcgagcaacaacaaatgcagtatccttatgcttgctgataccgaaaatgaaaagaacaaatgggtgggggtactctcagaacttcacaagattttgaagaagaataagtttagggacagaagcgtttatgtgccaaaggaggcgtatgactccactctgcctctgatcaagaccacacaagcagccgcaattattgatcacgagcggattgccctgggtaacgaagagggcctctttgttgtgcacgtgaccaaagatgagatcatcagggtgggggataacaagaaaattcaccagatcgagctgatacccaacgatcagctcgtggccgtgattagcggaagaaatcgtcacgtgaggttgtttcccatgtctgccctggacggtcgggagacggacttctacaagctgagcgagacgaagggctgccagacggtgaccagtgggaaggttcgccacggtgccctgacttgcctgtgcgtagcaatgaaacggcaggtcctgtgctatgaactgtttcagtcaaaaacacgacacaggaaatttaaggagatccaggtaccgtacaatgttcagtggatggcaatttttagcgaacaactttgtgtaggttttcagagcggcttcctgagatatccattgaacggagagggtaatccatacagcatgctgcacagcaacgaccataccctctctttcattgcccaccaacccatggacgccatttgcgccgtggagataagcagcaaggagtatctgctgtgttttaattccattgggatttatactgactgccagggtcggcgatctaggcagcaggaactaatgtggcccgcaaaccctagctcatgctgctacaacgccccttacctgtcagtgtactcggagaacgccgtggacatttttgacgtaaattctatggaatggatccagacactccccctcaagaaagtcagaccactcaataacgaaggcagccttaatctcttgggcttagagacaatcaggcttatctacttcaaaaacaaaatggctgagggggatgagctggttgtaccagagacatccgataacagtcgtaagcaaatggtccgcaatattaataacaaaagacgctactcctttcgggttccagaagaagagaggatgcagcagagacgagaaatgctgagggaccccgagatgagaaataaactgatcagcaaccctaccaattttaaccatatcgcccacatgggtccaggcgacggcattcaaatccttaaagatctacccatgaaccctcgcccacaggagtcccgcacggtgttctcaggctctgtgagcatcccttccataaccaaatcacgaccggagccaggtagatctatgtcggcatcatctggcttatccgcgcgaagtagcgcccaaaatggatccgcacttaagcgagaattctccgggggaagttactctgcaaaaagacagccaatgcccagcccctcggaaggaagtctgagctcgggtgggatggaccaggggtctgatgctccagccagagactttgatggagaggacagtgatagtcccaggcactcaacagcctctaattcttccaatttgtcaagtccacccagtccggcttctcctcgtaaaaccaaatccctaagtttagagtcaactgatcgagggtcttgggatccata

SEQ ID NO: 217685 - DNA, 5160 bp, Artificial Sequence
  Description of Artificial Sequence: Synthetic coding sequence
atgtcaggtgaagtgcggttacggcaattggaacagtttattctggacgggcctgcccaaactaatggacagtgcttttcggtggagaccctccttgatattcttatttgcctttacgatgagtgtaataattccccactgcgcagagaaaaaaacatcctggagtatctcgaatgggctaagccattcacgtccaaagtcaaacaaatgcggttgcatagagaagattttgagattttgaaggttattggcaggggggcttttggagaggtcgcagtggttaagcttaagaatgccgataaggtgttcgcgatgaaaattttaaacaagtgggagatgctcaagcgggcagaaacagcttgtttccgcgaggaaagggacgtcctcgtcaacggtgacaacaagtggattactacattacactatgctttccaagacgacaataacttgtacctggtcatggattactatgtcggcggtgatttactgacacttctcagtaagtttgaagataggcttcccgaagatatggccagattttaccttgctgagatggttattgccatcgacagcgtgcatcaactgcactacgtccatagggatatcaagccagacaatatcctaatggatatgaatgggcatatccgactagctgatttcggctcttgtttaaagttgatggaggacggaaccgtgcaaagtagtgtggccgtgggaaccccagactacatctctcctgagattctccaggccatggaggatggcaaaggccgttatggtcctgagtgcgactggtggtccctgggcgtgtgcatgtacgagatgctgtatggggaaaccccgttttacgctgagtcgctggttgagacttacggcaagatcatgaaccataaagagaggttccaatttccagcacaagtgactgacgtgagcgagaatgccaaggatctgattagacgactaatttgctcccgggagcacaggctcggccaaaacggcattgaggactttaagaagcacccattttttagcggcatcgactgggataatatccgcaattgcgaagctccgtatattccagaggtaagcagtcccactgatacaagtaacttcgatgttgatgacgactgtctgaagaacagcgaaaccatgccccctcctacacatactgccttctccggacatcacctcccattcgttggattcacatataccagttcatgcgtgctgtccgaccgttcatgcctgagagtcaccgccggacccacctctttggacttggatgtgaatgttcagcggacgctggacaataatctggccaccgaagcctacgagcggaggatcaaacggctggaacaggaaaagttggagttgagtcgtaaacttcaggaatctacacaaacagtgcaggccctgcagtacagcaccgtcgacggcccactcaccgcctcaaaggatctggagattaagaacctgaaggaagagattgagaagcttaggaaacaggtgactgagtccagccaccttgaacaacaactcgaagaggcaaacgctgtgcgacaagaattggacgatgcttttcgacagataaaggcgtatgagaagcagattaagacgctccagcaagaaagggaggatctcaacaaagagctggttcaagcaagcgagaggctcaagaatcagtccaaagagcttaaggacgctcactgccagcgaaagctggccatgcaagaattcatggagataaatgagcggttaacagagttgcacacacagaagcagaaactggccaggcatgtccgagataaagaggaggaagtggaccttgtgatgcagaaggtggagagtctccggcaggaacttcgacgcaccgagagagccaagaaagaacttgaagtccatacagaagccttggccgctgaggcaagcaaggatagaaagctccgtgagcagtccgaacactatagcaagcaactcgagaatgagctcgagggactaaagcaaaaacagatcagctactcccccggtgtctgcagtatcgagcatcagcaggagattaccaagctgaaaacagacttggaaaagaagtcaattttttacgaagaagagctttcaaaaagagaggggatccacgccaatgaaataaagaacctgaagaaagaactgcacgacagtgagggacagcagctggcattaaataaagagattatgattctgaaagacaaactggaaaagacgcgtcgagaatctcaatcagaaagagaagaattcgaatccgaattcaagcaacaatacgagcgggagaaagtcttgctgacagaggagaataaaaagctcacaagtgaactagacaagcttactactctctatgagaatctgtctatccacaatcagcagttagaggaagaggtgaaggacctggccgacaaaaaagagtcggttgcacactgggaggcacagattacagaaataattcaatgggtaagtgatgaaaaggacgcacgtggctacttgcaggctctcgcttccaagatgacggaggagctggaagccttgcgcaattctagcttaggaacccgcgctacagatatgccatggaagatgcggagattcgcgaagttggatatgagtgccagattagagttacaaagcgctctggatgcagaaatccgcgcaaaacaagctattcaagaggagctcaataaggtcaaggcatctaatatcatcacggagtgcaagctaaaagattcagagaaaaagaatctagaattgcttagcgagatcgaacagttgataaaggacactgaggagctgaggtctgaaaaaggaattgagcaccaggatagtcaacattcttttttggcttttctcaatactcctactgacgctcttgaccagtttgagaccgttgactctacgcctctgagcgttcatacgccaaccttgcggaagaaggggtgccctggctccaccgggtttccaccaaaaaggaagacccaccagttcttcgttaagtcatttaccactcccactaagtgccatcagtgcacatctctgatggttgggctgattagacagggttgctcttgcgaagtctgtggtttctcatgtcatatcacatgtgtgaacaaagcacctaccacttgtcccgtgccccctgaacagaccaagggcccactggggatcgaccctcagaaggggatcggaacagcttatgagggccatgtcagaatacccaagccagcaggtgttaaaaagggctggcaaagagcacttgcaatcgtttgtgatttcaagctattcctgtatgatatcgccgagggcaaagcaagccaaccgtcagtagtcatctctcaagtaatcgatatgcgtgacgaagaattttccgtttcttcagtcctggctagcgacgtaatccatgctagtagaaaggacattccctgcatttttcgcgtgacagctagtcaactatctgcaagcaacaacaagtgctcgattcttatgctcgccgacactgaaaatgagaaaaacaaatgggttggcgtcctgtctgaattacataagattctgaaaaaaaataaattccgggatcgctctgtttacgtacctaaggaagcatacgacagtactctgcccttgatcaagacaactcaagctgccgcaataatagaccatgagcgtattgccctgggaaacgaagaaggcctgttcgtcgtccatgtgaccaaagacgaaataattcgcgtgggggacaacaagaaaatacatcaaatcgaactcattcccaacgatcagctcgtggcagtgataagcggcagaaacagacatgtccggttattcccgatgagcgccctggacggtcgtgagacagatttctataagttgtccgaaacaaaaggatgccagactgtgacaagtggcaaagtgagacacggggctctgacttgcctctgcgtagccatgaaacggcaggtgctctgttacgaactgttccagtccaagacccgacaccgaaaatttaaagaaattcaggtcccctacaatgtccaatggatggccatctttagcgaacaactgtgcgtgggcttccagagcgggttcttgagatacccactgaatggtgaaggcaatccttactcgatgcttcactctaacgatcacacactgtcgttcatcgcccatcaacccatggatgctatctgcgctgtcgaaattagctctaaggagtaccttctgtgcttcaatagtatcggcatctacacagattgtcagggaagacggtctaggcaacaggaactcatgtggccagcaaatccatccagctgctgttataacgccccatacctcagcgtgtattccgagaacgcggttgacatctttgatgtgaattcaatggagtggattcaaactttgcccttaaaaaaggtgcggccattgaataatgagggttcgctgaacttgctggggttggaaactattcggctcatttatttcaagaataagatggccgagggcgacgagctggtagtgcctgaaacttccgacaactctcgcaagcagatggtgagaaacatcaacaacaagagacgctattcatttcgggtgccagaagaagaaagaatgcagcagaggagggaaatgttacgagaccccgagatgagaaacaaattaatttctaatcccacaaacttcaaccacattgcgcacatgggacccggtgacggcatccagatcctgaaggacctgccgatgaaccccagaccacaagagtcccggacggtgttcagcggctcagtctcaattcccagcatcacaaagagtaggccggagcctggcagaagcatgagtgcctcatcagggctgagcgccaggagtagtgcccaaaatggatctgcactgaagcgggaattctcagggggatcatacagtgccaaacgccagcccatgccctctccatctgaaggatcactctcctcgggcggaatggatcaggggtccgacgctcctgccagagacttcgatggagaagactcagattcacccagacatagtactgcttcaaatagttccaatctgtcatctccacctagccccgcaagtccacgaaagactaaatccttgagcctggagagtactgatcgagggagctgggacccgtac

SEQ ID NO: 217686 - DNA, 1641 bp, Artificial Sequence
  Description of Artificial Sequence: Synthetic coding sequence
tgagacattgcagaaggaaaagcctcacagccttcagtcgtgatcagccaggtgattgatatgcgtgacgaggaatttagtgtgtcctctgtcttggcttcagacgtgatccacgctagcagaaaagacattccgtgtatattcagggttacagcctcacaattatcagcatccaataacaaatgctcaattctgatgctggctgacacggagaatgaaaaaaacaaatgggtgggggtcctttctgaacttcataagattctaaaaaagaacaaatttagggacaggtctgtgtacgtgccgaaggaggcttatgactccacactgccactgattaaaactacacaagcagctgccataattgatcacgaaaggatcgccctcggtaatgaggaaggcctgtttgtcgtacacgttaccaaggacgaaattatccgcgttggcgataataaaaaaattcaccagattgagctcattccaaacgaccagcttgtggccgtgatctctggaaggaacagacatgtaagactgttccctatgtctgcccttgatggacgcgaaacggacttctacaagctttcagagaccaaaggatgccagacagttacttcaggtaaggttcggcatggggcattgacatgtctatgcgtcgctatgaaaagacaagtgctgtgctatgaactgtttcagtccaaaacgcgacacaggaagttcaaggagatccaggtgccatacaacgtgcagtggatggcgatattcagtgagcaattgtgcgtcggatttcaatcaggatttctgcgttatcccctcaacggcgaaggcaatccgtattcaatgcttcactcaaatgaccacactttgtcatttattgctcaccagcccatggatgccatttgtgccgtggaaatctcttctaaagaatacctgttatgcttcaatagtatcggcatctatacagactgtcaaggcaggcgaagccgccagcaggagctgatgtggccggctaaccccagctcgtgctgctacaatgccccatacttgagcgtgtactcggagaacgccgttgacatcttcgatgttaattccatggagtggatccagacccttcctctgaagaaggtccggcctcttaataatgaggggtccctgaatctgctgggcctcgaaacgatacgcctgatctatttcaagaacaaaatggccgagggcgacgaactggtcgtaccagagacctctgacaattccagaaaacagatggtgcggaacataaataacaaacggaggtatagcttccgtgtgcccgaagaggaacgcatgcaacagcggagggagatgctgagagacccagaaatgaggaacaagctcatcagtaacccaacaaactttaatcacatcgcacacatgggccctggagacggcattcagatactgaaggatttgcccatgaatcctagaccccaggaatcgcggacagtgttctcaggaagcgtgtccatcccaagtatcaccaaatctagacccgaacccggaagatctatgtccgcttcttctggtctctccgccagcaagtgtagaggctaccgcaaagtccccctaaggcaaggggatcctcagctcccccctcttctgagtagaggctag

SEQ ID NO: 217687 - DNA, 2187 bp, Artificial Sequence
  Description of Artificial Sequence: Synthetic coding sequence
taagttagcgatgaaaaagatgcaaggggttatttacaagcattagcctctaagatgacagaggaacttgaagccctccggaatagcagcctgggaacccgggctacagacatgccatggaagatgaggcggtttgcgaagctggacatgtcagcaaggctggagctccagtcagcgctggatgccgaaatccgagccaaacaggcaatccaggaagaactgaataaggtgaaagccagcaacatcatcacagaatgcaaactgaaagacagcgagaaaaagaacctcgagctgctgagtgagatagagcaactgatcaaagacactgaagagcttcgttcggagaaaggcatagagcatcaggacagccagcattcatttcttgcatttctaaacacaccaactgacgccctagatcaatttgaagatagtttttcgagcagcagttcgtccctgatagattttctggacgataccgacccggtggagaacacctatgtgtggaaccccagcgtcaagtttcacattcagtcccgatccacatctccatcaacatcgagcgaggccgagcccgttaaaacagtagactctacccctctcagcgttcatacccctacgctccggaagaaggggtgccccggtagcactgggttcccacctaaacgcaagacgcaccaattcttcgtgaaaagttttacaacacccacaaagtgccatcagtgtactagtctgatggtgggtcttatccggcagggctgttcttgcgaagtttgtggattcagctgtcatatcacctgcgtcaacaaagcccctacgacatgccctgtgccgcctgagcagactaaaggcccactaggtatagatcctcagaaggggattggtactgcgtacgaaggacatgtacgcatcccaaagcccgcaggagtgaagaaggggtggcaacgcgctcttgccatcgtgtgcgactttaagcttttcctctacgatattgctgagggcaaggcttcacagccgtcggttgtcatatctcaagtcatcgatatgagagacgaggagttctcggtatcatctgtgctcgcttccgatgtaatacacgcctctcggaaagacatcccatgtatattccgggtcactgctagtcagctgagcgccagcaataacaagtgctccatcctcatgctggcagacacagagaacgagaaaaataagtgggtgggagtgctctcagagttgcacaaaatcttgaagaagaacaaattccgcgaccggtccgtgtacgtgccaaaggaggcctacgacagcacgttgcctctgataaagaccacgcaagcagccgcaattatcgatcatgagcgcattgccctgggaaatgaagaaggcctgttcgtggttcatgtgaccaaagatgagattattagggtcggtgataacaaaaaaattcaccagatagaacttattccaaatgatcaactcgttgcagttatctctggtaggaatcgtcatgtgagattgttccctatgtccgcattagacgggcgagagacagatttttataagctcagtgaaaccaagggctgtcagaccgtcacttccggtaaggtgaggcacggcgcactgacctgcctgtgcgtggctatgaaacgccaggtgctttgttacgagctttttcagagtaagactcgtcaccgaaagtttaaggagatccaagtaccttacaacgtccagtggatggctatattcagcgaacagttgtgcgtcggttttcagagcgggttcctgagataccctttaaacggagaaggcaacccatactctatgctgcacagcaacgaccacactctgtcttttatcgcacaccagcccatggacgctatctgtgcagtcgagatatctagcaaagaatatctcctgtgctttaattccattggaatttacactgactgtcaagggaggaggtctcgccaacaggagctcatgtggccagcgaatccatcctcctgctgttataatgcgccttatctctcagtgtattccgagaacgctgtcgatattttcgacgttaactctatggagtggatccaaacactgcctttgaaaaaagtgcgacctctgaacaatgaggggtccctgaacctgttgggcctggaaaccatccggctaatttatttcaagaataagatggcatag

SEQ ID NO: 217688 - DNA, 3147 bp, Artificial Sequence
  Description of Artificial Sequence: Synthetic coding sequence
taagaaggaattcacgcgaacgagattaagaatctgaagaaggagctgcacgactccgaggggcagcagctcgctcttaataaagagatcatgatattgaaagacaaactggaaaaaacacggcgagagtcccagtctgaacgcgaagagttcgaatccgagttcaaacaacagtatgagcgggagaaggtgctgctgactgaagagaacaagaaactcaccagtgagctggacaagctgaccaccttgtacgaaaacctttcgattcataaccagcagcttgaggaagaggtgaaagatcttgcagacaaaaaggagtctgttgctcactgggaggcccagatcaccgagattattcaatgggtgagcgacgagaaggacgctcgcggatatctgcaggctctcgccagcaagatgaccgaagagctggaagcactacgaaattcaagtctcgggacccgagcaactgacatgccatggaagatgcgacgctttgcaaaacttgacatgagcgcccgtctggagcttcagtctgccctagacgccgagatccgggcaaaacaggcgattcaggaggagctaaacaaagtgaaagcaagcaatattattacagagtgtaaactcaaggattctgaaaaaaagaacctcgagctgctttccgaaatagagcagttgatcaaagacacagaagaacttaggtcagaaaagggtatcgaacaccaggatagtcaacactctttcctcgccttcctgaatacgccaacagatgcgctggaccaatttgaaacggacccagttgagaacacttacgtgtggaatccctctgtgaagtttcacattcagtcccggagcacaagccccagcactagcagtgaagcagagccagttaaaaccgttgacagcacaccgctatccgtccacaccccaaccctcagaaagaagggatgccctggcagcaccggctttccccctaaaaggaaaactcaccaattctttgtcaagtcatttaccactccgacaaaatgccaccaatgtacttccctgatggttggacttattagacaggggtgtagttgcgaggtttgtggcttcagttgccatatcacctgcgtcaacaaggccccaacaacctgtccagtgcctccggaacaaacgaagggccctctcgggatcgatcctcagaaagggatagggacggcctatgagggacacgttagaatacccaaacccgctggtgtcaagaagggttggcaacgcgctctggcaatcgtttgcgactttaagctgtttctctacgatatcgcagagggaaaggcttcacaaccctccgtggtcatctctcaggtgatcgatatgagagacgaagaattctcggtctcttctgtgcttgcgtccgacgtgatccatgccagcaggaaggatatcccttgtatcttcagggtgacggcctcccagttatccgcctctaacaataaatgctcaatcctgatgttggccgataccgaaaacgagaaaaataagtgggtaggcgtgctgtcagagcttcacaaaatccttaaaaaaaacaagtttagagatagatcagtgtacgtaccaaaggaagcatatgactccactcttcccctcatcaaaaccacccaggcggctgcgattatcgatcacgaacgaatagccctgggtaacgaagaagggctcttcgtcgttcatgttacgaaggatgagatcattcgcgtgggcgacaacaaaaagattcaccagatagagctgattccaaatgaccagctggtcgctgtgattagtggcaggaataggcacgtgcgcctattccctatgtcagctcttgacggacgtgagacagatttctacaaactttcagaaactaagggatgtcagacggttacttccggcaaggtgaggcacggagcactcacatgcctgtgcgtcgccatgaagaggcaggttctgtgctacgaactgttccaatctaagactagacatcgcaaattcaaggagattcaagtgccttacaacgtgcaatggatggccatattcagtgagcaattgtgtgtgggcttccagtccggatttctgagataccccctgaatggtgaaggtaatccatacagtatgttgcacagtaatgaccacaccctttcctttattgctcatcagcctatggacgccatctgcgcagtggaaataagcagcaaggagtatctgttgtgctttaactcaataggcatttataccgactgccagggacgtagatcgaggcaacaggaactcatgtggcccgcaaatccgtctagttgctgttacaatgccccatacctctctgtgtactctgagaacgctgtggacatctttgatgttaactccatggagtggatccagacactgccattgaaaaaagtgagacctcttaataatgagggcagcttgaacctgttaggtcttgagacgatcagactgatttatttcaagaacaaaatggcagagggggatgagctggttgtacctgaaacgtccgataattcccggaagcaaatggtgcggaacataaacaacaagcgtcggtacagcttccgcgttccagaggaagagcgaatgcagcaacgaagagagatgcttcgcgaccctgagatgaggaataagcttatatctaatcccacaaacttcaatcacattgcccacatggggccaggtgacggcatccaaatcctgaaggacctccccatgaacccacggccacaggaatcacgcaccgttttctcgggatccgtcagtattcccagcataaccaagtcccggccagagccaggcaggagtatgagcgcttcttccgggttgagcgcgaggtcgtcagctcaaaatggatccgctctcaagcgcgagttttcgggtgggtcctattccgccaaacgccaacccatgcctagccccagcgagggtagtctgagtagtggcggaatggaccagggtagcgacgcacccgctagggatttcgacggcgaggacagcgactccccgaggcattctaccgccagcaattccagcaacttgtcatctccaccatcacccgcttcccccagaaagacaaagtctttgagtctggaatccacagatcggggaagttgggacccatag

SEQ ID NO: 217689 - DNA, 2955 bp, Artificial Sequence
  Description of Artificial Sequence: Synthetic coding sequence
tgacagctcgaggaggaagtgaaggatctcgccgacaaaaaggaatctgttgcccactgggaagcccagattaccgagattattcagtgggttagcgacgagaaagacgcccgtggatatctgcaggccctggcctctaaaatgactgaggagctcgaggccctgcgaaactcgtccctggggacgagggctacagatatgccgtggaagatgagaaggtttgccaaactggatatgtcagctcgtctggaactgcagagtgcgctggacgccgagatacgtgctaagcaagccatccaggaggagttgaacaaagtgaaggcatcaaacataataacagaatgtaagctgaaagactcagaaaagaagaatctggaactcctgagcgagatcgagcagctaataaaggatacagaagaacttcggtccgagaaaggaattgaacatcaggacagtcaacattccttcctggcctttttgaatacaccaacagatgccttagatcagtttgagactgtcgactcaacccctctgagcgtccacacaccaacattgcgaaagaagggatgccctggatctaccggcttccctccaaagagaaagacccatcagtttttcgttaaatcctttactactccaacaaagtgccaccagtgcaccagtcttatggtgggactgattagacaaggctgtagttgtgaggtctgcggcttctcttgtcacattacttgcgtgaacaaggccccaactacttgtccggtgcctcctgagcagaccaaaggaccgctgggtattgacccacagaagggtattgggaccgcatacgagggacatgtgagaatacctaaacccgctggagttaagaaggggtggcagcgtgccctcgctattgtttgtgattttaagctgtttctatacgacatcgccgaaggaaaagcgtctcagcctagcgtggtcatcagccaggtcattgacatgagggacgaggagttttccgtaagcagcgttttagcatcagacgtgatccacgcctcacggaaggatattccatgtatatttcgagtcacagcatcccaactgtcagcttctaacaacaagtgcagcatcctgatgctggccgacacagagaacgagaagaataagtgggtcggggtgttaagtgagctgcataaaattctgaagaagaataagttcagggacaggtcagtgtacgtgcccaaagaggcttacgattccacgctgcctctgataaagacgacgcaggctgcagccataatcgaccacgagagaattgctctggggaatgaagaaggtctgttcgtggttcacgtgaccaaagacgagatcatccgagtgggagacaacaaaaagattcaccagattgagttaatcccaaatgaccagttagtggcggttattagcggacggaaccgccatgtccggctctttccaatgagtgcattggacggacgggaaacagatttttacaaactgtctgagaccaagggatgccagaccgtgacgtccggtaaggttagacatggggctctcacctgcctctgcgttgccatgaagaggcaggtcttgtgttatgaattattccagagtaagaccaggcaccgtaaattcaaggaaatccaggttccttataatgtacaatggatggccatcttttccgagcagctgtgcgtggggttccaatcaggattcctgagatatccccttaatggtgaagggaatccttactccatgctgcacagcaacgaccacacactctcatttatagcccatcagcctatggacgcaatctgcgcagttgaaatcagtagcaaggagtaccttctgtgtttcaattcaatcgggatttataccgattgccagggcaggagaagtagacagcaggagctgatgtggcctgcaaacccgtcatcttgttgctataatgcaccatacctttcagtgtacagcgaaaacgcagtggacatttttgacgtaaattctatggagtggatacagacactaccgctgaagaaggtccgtcccctgaacaatgaagggtccttgaacctcctgggactggaaacaattcgtcttatatatttcaagaataaaatggcagagggggatgaacttgtcgtaccagaaacctctgacaatagcaggaaacagatggtgcgcaatattaacaataaacgaagatactcatttcgggtgcccgaagaggaaagaatgcaacaacgtcgagagatgcttagagaccccgagatgcgcaacaagctcatcagtaaccccaccaactttaatcacattgcacatatgggtcccggagacggtatccagatcctgaaggaccttccaatgccaggtttcccatacccttcaccccaccaccacagtggtctcatctcaagccctattaactttgaacatatttatcatatgactgttaactctgcagagaagtttctgtcgcctgattccattaatccagagtactcccccagtttgcggtccgtaccgggaacaccttctttcatgaccctgagaaatcctcggcctcaggagagccgcaccgttttctccgggtctgtgtccatcccaagtatcacaaagtcaagacccgaaccagggcgaagcatgtcggctagcagtggccttagtgcaaggtcttcagctcagaatggtagcgcccttaagagggaatttagcgggggatcttattctgcaaagcgacagcccatgcctagcccatccgagggctctctttccagtggaggtatggaccagggttcagacgcccctgctagggactttgatggcgaggactcagatagtcctcggcattcaaccgcatccaattcgtccaacctgtcttcgcctccctcgccagccagtcccaggaagacaaaatcactgtcactggagagtactgaccgtggttcgtgggatccatag

SEQ ID NO: 217690 - DNA, 5100 bp, Artificial Sequence
  Description of Artificial Sequence: Synthetic coding sequence
atgtcgggtgaggtaaggctgcggcaactggagcagtttatcttagacggcccagcacagaccaatgggcaatgttttagcgtagagacattattggacatcctgatatgtctgtatgatgagtgtaataactcacctttacgccgagagaaaaacatcctcgaataccttgagtgggcgaaacctttcaccagcaaagtgaaacagatgcgcctccatcgtgaggactttgagatcctaaaggtgattgggagaggtgccttcggcgaggtcgccgttgtaaagctgaagaatgccgataaggtctttgccatgaagattttgaataagtgggaaatgctcaagcgagccgaaaccgcttgcttcagagaagaacgagacgtgttggtgaacggtgacaataagtggattacaacacttcactacgcatttcaggacgacaataatctctacctagtaatggattattatgttggaggggaccttctcacactcttaagcaagttcgaagacagattgccggaggacatggcaagattctacctggccgagatggtcatagccattgactctgtgcaccagctgcactatgtccacagagacatcaaacctgataacattctgatggacatgaatggccatattcgcctggccgacttcgggagctgtttaaagctgatggaggacgggactgtgcagtcgtctgtggctgtggggacacctgactacatttccccagagatcctgcaggcaatggaggacggaaaagggcgatacgggcctgaatgtgactggtggtctctaggtgtgtgtatgtatgagatgctttacggggaaacccccttttatgctgagtccctggtcgagacttatggaaagattatgaaccacaaagagcggttccagtttcccgcacaggtgaccgacgtgagcgaaaacgcaaaagatctgatccgtcgtctgatatgttcccgggaacatcgattgggacaaaatggcatagaagactttaaaaaacatccctttttctcaggcattgactgggataacataaggaattgcgaggccccttatatccccgaggtttcctccccaaccgacacatcaaactttgacgtggacgacgattgcctgaagaattccgaaacgatgcccccaccaacccacacggcgttttctggtcatcatcttcccttcgtcggcttcacatacactagctcctgtgtcctatctgaccgaagttgcctgcgggtgacagccggacccacgagcctggacttggacgtcaacgtgcagcgaacactcgataacaaccttgccactgaagcgtatgagcgaagaattaagcgcctggaacaggagaaactagagttgagcagaaagttgcaggagtctacacaaacagttcaggctctgcaatactccactgtcgacggacccctcacagctagtaaagacctggagattaagaatttgaaggaggagattgagaagctccggaagcaggtgaccgagtcttctcaccttgagcagcagctggaggaggccaacgctgtccgccaggagctggacgacgcctttcggcagatcaaggcttacgagaagcagatcaaaaccctgcaacaggaaagggaagatttaaataaagaactggtgcaagccagtgagagacttaagaatcagtcaaaggagttgaaagacgcacactgccaaaggaaattggctatgcaagagtttatggagatcaacgaaaggctgactgagctgcatacccagaagcagaagcttgcccgtcacgttcgcgataaagaggaggaggtagaccttgtgatgcaaaaggtggagtctcttcgacaagagctgcgacgcacagagagagccaaaaaggagctggaggtgcataccgaggccttggcagcagaggcttcgaaggatcgcaagctgcgtgaacaaagcgaacattatagtaaacagctggaaaacgaactggaaggtctcaaacaaaagcagatctcttattccccaggagtgtgtagcatagagcatcagcaggagattacaaagctgaagacggacctggaaaaaaagagcattttctacgaggaggaattgagcaagagagagggtattcacgctaacgagattaagaacttgaagaaagaactccacgatagcgagggtcaacagctggctctcaataaagagattatgatcctgaaggataagctcgagaaaactagacgtgaaagccagtcagagagagaggagttcgagagcgagtttaaacagcagtatgagcgtgaaaaggtgcttctgacggaggagaataaaaagctgaccagcgaattagataaactgacaacactgtatgagaatctcagcattcataaccagcagctcgaagaggaagtgaaagatcttgcagataagaaggaatcagtggctcattgggaagctcagataactgaaataatccagtgggtttctgatgaaaaggatgcacgaggatacctgcaggcactggcatccaaaatgaccgaggagctcgaggccttacgcaactcaagtctgggcacgcgcgcaactgacatgccatggaagatgagaaggttcgcaaagctcgatatgagtgctcggctagagttacaaagtgccctcgatgcagaaattcgggcaaaacaggcaatccaggaggaactgaacaaggttaaggcaagcaacatcattactgaatgtaagcttaaggatagtgagaaaaaaaaccttgagctcttaagcgagatagaacaattgatcaaggatacagaagagttgcggagcgagaaggcaagcaaaggacggagaacagtggattcaacgcctttgtctgtgcatacgcctaccttgaggaaaaagggttgtccgggtagtaccggctttccgccaaagcgcaagacacaccagttctttgtgaaaagttttaccacgcccaccaaatgccatcagtgtaccagtttgatggttgggctgatcaggcagggctgtagctgcgaagtctgcggcttttcctgtcacattacttgcgtgaacaaggcccctaccacatgtccggtgccgcctgagcagacaaagggccctctgggcatcgacccgcaaaaggggataggcaccgcgtacgaggggcatgtgcggatccccaaacctgctggcgtcaagaagggttggcagcgtgccttagccatagtgtgcgacttcaaattgtttctgtacgacatagctgagggcaaggccagccagcctagcgtggtcatctcccaggtgatcgatatgcgtgatgaggaattctcggtgtccagtgtgttggcttctgatgttatccacgcctccaggaaagacataccatgcatttttcgagtgacagcaagccagctaagtgccagcaacaacaagtgcagcattttgatgttggccgacactgagaatgagaagaacaaatgggtgggggtactctcagaactccacaagattctcaagaaaaataaattccgggaccgttccgtctacgtgcctaaggaggcatacgacagcacgcttccgttgataaaaacgacccaagctgcggctataattgaccacgaaagaattgccctgggaaatgaagaaggattatttgtcgtgcatgtaacgaaggacgaaattatccgggtcggagacaataaaaaaattcatcagatagaattgatacctaatgaccagctggtggccgtgatctccgggagaaatcggcatgtacgtctgtttcctatgtcggcactagacggaagggagaccgatttctataagttgtcggagacaaaggggtgccagaccgtgacatccgggaaggttagacacggcgcactgacttgtctctgcgtcgctatgaagcgtcaggtgctgtgctatgagctgtttcagagtaagactcggcataggaagtttaaagagatccaggttccatacaacgtgcagtggatggctatttttagcgagcaactgtgtgtaggcttccagagcggcttcctgcgttaccctttgaacggcgaagggaacccgtactcaatgctccattctaacgaccatactctgagcttcatcgcccatcagccaatggacgctatctgtgccgtggagatttcttccaaagaataccttctttgttttaattctattggcatctatacagactgccaggggagaaggagtcggcagcaggagcttatgtggcccgctaatccttcctcctgctgttacaatgctccctacctgagcgtgtactcagagaatgcggtggatatttttgacgtgaatagcatggagtggatccagacactgccgctcaaaaaggtgcgacccctaaataatgaagggagcctgaatctgctgggtctggaaacaatccgtcttatttactttaaaaacaagatggccgagggggatgagctcgtcgttcctgagaccagcgacaactcgcgaaagcaaatggtacgcaacatcaataataaaagaagatattcatttcgagttcctgaggaggagaggatgcagcagagacgggagatgctgagagaccccgaaatgagaaacaagctgatcagcaatcctaccaatttcaaccatatcgcccacatgggtcctggggacgggattcaaatcctgaaggacttgcctatgaaccccaggccccaggaatcccgaaccgtgttctccggcagcgtaagtatcccctctatcactaagtccagaccagagccaggtcggtccatgagtgcttcctctggtctttctgcgaggtcgtctgctcagaacggttcagccttaaagagagaattctcaggcggatcatactctgccaaacggcagccaatgccgagccccagcgagggcagtttgtccagtgggggaatggatcagggctctgatgccccagcccgtgacttcgacggggaggacagcgactcccctaggcacagcacagcttcaaactcatctaacctgtcatctccgccatctccagcctcaccaagaaaaacaaaaagtctatcgttggagagcaccgacagaggtagttgggatccttag

SEQ ID NO: 217691 - DNA, 5135 bp, Artificial Sequence
  Description of Artificial Sequence: Synthetic coding sequence
atgagtgctaaggttaggttgaagaagctagagcagctcctgttagacggtccatggagaaacgagtctgctctgagcgttgagaccctactagatgtgttagtgtgcctttacaccgagtgcagccattctgcgctgcggagagataagtatgtcgccgagtttttggagtgggcaaagccatttacacagctcgtcaaggaaatgcagctccatagagaggactttgagataattaaggtgatcggacgaggtgccttcggggaagttgccgtggtaaagatgaaaaacactgagagaatttacgctatgaaaatactcaacaagtgggaaatgctgaagagggcagagactgcctgcttcagagaagagcgagatgtgctggtgaacggagactgtcagtggataaccgcactccattacgcctttcaggatgaaaaccatctgtatctagtcatggactactatgtgggcggagacttgctgacattgctcagcaagttcgaagataagttgcctgaagatatggctcgcttttatattggtgagatggtcctcgccattgattccattcaccagctgcattatgtccacagggacataaagccagataatgtgttgctcgacgtgaacggacacattagacttgccgactttggctcctgcttaaagatgaacgatgatggaaccgtccagtctagcgttgccgtgggaacgcccgactacatatcacccgagatactgcaggccatggaggatgggatgggtaagtatggcccagaatgcgactggtggagtttgggcgtctgcatgtatgagatgctctacggtgagacacctttctacgcagagagcttggtcgagacatacggcaagatcatgaaccacgaggagaggtttcagttccctagtcacgtgactgacgtgtcggaagaggccaaagacttgattcagcgattgatttgttcccgcgaacgtagactcggccaaaatggaatcgaggatttcaaaaagcatgcctttttcgaaggtctgaactgggagaacattcgcaacctcgaggccccttatatccccgacgttagcagtcctagcgatacctcaaattttgatgtggatgatgatgtactacgtaataccgagattcttccccctggaagccacacagggttctcaggcctgcacctccctttcattggttttacattcacaaccgagtcctgcttctctgaccggggatctctgaaatccattatgcagagtaatactctaacaaaggatgaagatgttcaacgcgacctggagcactcgctgcagatggaagcttacgaaaggcgcattagaaggctcgaacaggaaaaactagagctgtccagaaagctccaagaatccacccaaactgtgcagtcattacatgggagtagcagagcgctttcgaactccaaccgggacaaggaaattaagaaactaaatgaggaaattgagcggctcaaaaataagatagctgacagcaacaggctggagcgtcaactggaggatacagtggctctgcgccaggaaagagaggactcaacacagcggctgaggggtttagagaagcagcatagagttgtgcggcaggaaaaggaggagctgcacaaacaacttgtggaggctagtgaaagactgaagtctcaggccaaagaacttaaagatgcacaccaacaacgtaagctggccctgcaggaattctccgagttaaacgagcggatggctgagctgagagcacagaagcagaaagtctctaggcaactgagggataaggaagaggagatggaggtcgctacgcaaaaggtggacgccatgcgccaggagatgagaagagctgaaaagctcagaaaagagcttgaggcgcaactcgacgacgctgtggccgaggcaagtaaagagcgcaagttgcgcgagcatagtgagaatttctgtaagcaaatggagtcagagctggaagccttgaaggtaaagcaagggggacgaggagctggcgctaccttggaacatcagcaggaaatttccaagatcaaatccgaactggagaagaaggtcttgttctacgaggaagagttagtgagacgcgaggcctcacatgtgttggaggttaagaatgtgaagaaagaagtccacgacagcgagagccatcagctcgctttgcaaaaagagattctgatgctgaaagataaactggagaagtctaagcgcgagagacacaacgaaatggaggaggcggtaggaacaataaaggataagtatgagcgcgagagagctatgctttttgatgagaacaagaagctgaccgcagagaatgaaaagttatgttccttcgtggataagctgactgcacagaatagacagctcgaagacgagctccaggacctggcagctaaaaaagaatcagtggcacactgggaagcacaaatcgcagagatcatccaatgggtgtctgatgagaaggacgctcggggttatctgcaggcactggcttccaagatgactgaggagctggaagcattgagatcgtcctctcttggctcgaggacacttgatcctctctggaaagtgaggagatctcagaagctggatatgtccgccagactggaactgcagagtgctttggaagccgaaattcgcgctaagcagctggtccaggaagagttgagaaaagtgaaggacgccaacttaacactggagagcaaactgaaagactctgaggccaagaacagagagctgcttgaggaaatggaaatcctcaagaagaaaatggaggaaaaattccgggctgacacgggcctaaagttacccgacttccaggactctattttcgaatactttaacaccgcgccattagctcacgacctgacgttcaggaccagcagcgcttctgagcaggagacccaagcccctaaacctgaggctagcccgagcatgtccgtcgcagcatctgagcagcaagaggacatggcacgacccccacagaggccctctgcagtccccctgcccaccactcaagccctggctctggccggacccaaaccaaaggcccaccagtttagcatcaaatcattttcctcaccaacacaatgcagccattgcacatctctgatggttggtttgatccgacagggatatgcgtgtgaggtttgctcctttgcctgccacgttagctgtaaagatggcgcaccgcaagtgtgtcctattccgcctgaacagtcaaaaagacctctaggggtcgacgtgcagcgcggaatcggcacagcttataagggacacgtgaaagtccctaaacccacaggtgttaagaaaggctggcagagagcctacgccgtcgtctgtgactgcaagttgtttctgtacgatttgcctgaggggaagagcacgcagccgggtgtcatcgcttcccaagttcttgacctccgagacgacgaatttagcgtgagtagcgtgctggctagcgacgttattcacgccacccggcgagatatcccctgcatctttagagtgacggcctcactgttaggcgcaccatcaaagacttccagtttgttgattctgacagaaaacgagaatgaaaaaagaaaatgggtggggatcctcgagggcctccagtccatcctgcacaaaaaccggcttagaaaccaggtagtgcatgttccactggaagcttatgatagctcactgccacttataaaggcaattctaacagcggctatcgttgatgcagatcgcatcgccgttgggctggaagagggtctctatgtgattgaagtgaccagagacgttatagtccgcgcagccgattgcaaaaaagtccatcagatcgaactggccccaagagaaaaaatcgtcattctgctctgcgggaggaaccatcacgtgcacctttatccctggtcgtcactggatggcgctgaggggagtttcgatattaaactgccagaaaccaagggctgtcagctaatggctacagcaactctgaagcggaattctggcacatgtctgtttgtggcagtcaaaaggctaatattgtgttacgaaattcagcgcactaaaccgtttcatcgaaagttcaatgaaatcgttgcacctggctccgtgcaatgcctggctgtgctgcgcgacaggctgtgtgtgggctaccccagcgggttttgtttgctctcaatccagggagatggacaacccctgaacttagttaacccaaacgatccgtccctagcttttttgagccaacagagttttgacgcactgtgcgcggtagagcttgagtccgaggaatacctcctgtgcttcagccatatggggttgtatgttgaccctcagggcagaagggcgagggctcaggagttgatgtggcccgctgctccggtggcttgttcatgtagcccaacacacgtgaccgtgtattctgaatatggagtggatgtgtttgatgttaggaccatggagtgggtccagacgattggcctccgcaggatccggcctctcaacagtgagggcaccctcaatctcctcaattgtgaaccacctcgactcatctactttaagtctaagtttagcggagcggtcctcaatgtgcccgatacctcggataacagcaagaagcagatgctgcggacaagaagtaagagaaggtttgtgtttaaagtgcccgaagaagaacgcctgcagcagagacgggaaatgcttcgcgaccctgagcttagaagtaaaatgatctctaatcctaccaattttaaccacgtggctcatatgggccctggtgatggcatgcaagtgttgatggatctgcccttatcggcagttcctccaagccaggaggaaaggccgggacccgcacccacaaacctggcccgtcagccaccttctcgcaataaaccttatattagttggccatctagcggaggctccgaaccatccgtcactgtgcccttgcggagcatgagcgaccctgaccaagacttcgacaaagaaccggactccgattctacgaaacactctaccccttctaactcttcaaaccccagcgggccaccaagtcccaattccccccatagaagtcaactcccccttgagggcctggagcaacctgcctgtgatactta
